United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 120

SEQ ID NO: 5085723 - DNA, 20 bp, Homo sapiens
aaatgcatatcctgagccat

SEQ ID NO: 5085724 - DNA, 16 bp, Homo sapiens
aaatgcatattaaata

SEQ ID NO: 5085725 - DNA, 12 bp, Homo sapiens
aaatgcatattt

SEQ ID NO: 5085726 - DNA, 17 bp, Homo sapiens
aaatgcatcaatcctgt

SEQ ID NO: 5085727 - DNA, 18 bp, Homo sapiens
aaatgcatcaatcctgtg

SEQ ID NO: 5085728 - DNA, 19 bp, Homo sapiens
aaatgcatctttgatgtgt

SEQ ID NO: 5085729 - DNA, 14 bp, Homo sapiens
aaatgcatgaacaa

SEQ ID NO: 5085730 - DNA, 21 bp, Homo sapiens
aaatgcatgatattgtatgta

SEQ ID NO: 5085731 - DNA, 21 bp, Homo sapiens
aaatgcatgattgcagaattg

SEQ ID NO: 5085732 - DNA, 13 bp, Homo sapiens
aaatgcatgattt

SEQ ID NO: 5085733 - DNA, 14 bp, Homo sapiens
aaatgcatgatttt

SEQ ID NO: 5085734 - DNA, 15 bp, Homo sapiens
aaatgcatgatttta

SEQ ID NO: 5085735 - DNA, 16 bp, Homo sapiens
aaatgcatgattttat

SEQ ID NO: 5085736 - DNA, 19 bp, Homo sapiens
aaatgcatgattttataca

SEQ ID NO: 5085737 - DNA, 22 bp, Homo sapiens
aaatgcatgattttatacatag

SEQ ID NO: 5085738 - DNA, 13 bp, Homo sapiens
aaatgcatggagg

SEQ ID NO: 5085739 - DNA, 13 bp, Homo sapiens
aaatgcatgtctt

SEQ ID NO: 5085740 - DNA, 15 bp, Homo sapiens
aaatgcattattgac

SEQ ID NO: 5085741 - DNA, 14 bp, Homo sapiens
aaatgcattcatgt

SEQ ID NO: 5085742 - DNA, 17 bp, Homo sapiens
aaatgcattctatcgtt

SEQ ID NO: 5085743 - DNA, 20 bp, Homo sapiens
aaatgcatttatagatcatt

SEQ ID NO: 5085744 - DNA, 14 bp, Homo sapiens
aaatgcatttctaa

SEQ ID NO: 5085745 - DNA, 17 bp, Homo sapiens
aaatgcattttgctaga

SEQ ID NO: 5085746 - DNA, 16 bp, Homo sapiens
aaatgcatttttatca

SEQ ID NO: 5085747 - DNA, 21 bp, Homo sapiens
aaatgccaaaggaagttttaa

SEQ ID NO: 5085748 - DNA, 18 bp, Homo sapiens
aaatgccaaattaaaaaa

SEQ ID NO: 5085749 - DNA, 20 bp, Homo sapiens
aaatgccaactgttggaatt

SEQ ID NO: 5085750 - DNA, 18 bp, Homo sapiens
aaatgccaagtgcctgct

SEQ ID NO: 5085751 - DNA, 18 bp, Homo sapiens
aaatgccacaagacataa

SEQ ID NO: 5085752 - DNA, 23 bp, Homo sapiens
aaatgccacacttgtgtgccaca

SEQ ID NO: 5085753 - DNA, 14 bp, Homo sapiens
aaatgccactctgg

SEQ ID NO: 5085754 - DNA, 16 bp, Homo sapiens
aaatgccacttaacag

SEQ ID NO: 5085755 - DNA, 14 bp, Homo sapiens
aaatgccagagcca

SEQ ID NO: 5085756 - DNA, 15 bp, Homo sapiens
aaatgccagagccaa

SEQ ID NO: 5085757 - DNA, 17 bp, Homo sapiens
aaatgccagagccaacc

SEQ ID NO: 5085758 - DNA, 23 bp, Homo sapiens
aaatgccagagccaacctggact

SEQ ID NO: 5085759 - DNA, 18 bp, Homo sapiens
aaatgccagtctcattgt

SEQ ID NO: 5085760 - DNA, 19 bp, Homo sapiens
aaatgccataatacaaaag

SEQ ID NO: 5085761 - DNA, 20 bp, Homo sapiens
aaatgccataatacaaaagg

SEQ ID NO: 5085762 - DNA, 19 bp, Homo sapiens
aaatgccatagtttgtgaa

SEQ ID NO: 5085763 - DNA, 17 bp, Homo sapiens
aaatgccatgtttatca

SEQ ID NO: 5085764 - DNA, 20 bp, Homo sapiens
aaatgccatttagcaataaa

SEQ ID NO: 5085765 - DNA, 19 bp, Homo sapiens
aaatgccatttatttattg

SEQ ID NO: 5085766 - DNA, 20 bp, Homo sapiens
aaatgccatttatttattga

SEQ ID NO: 5085767 - DNA, 13 bp, Homo sapiens
aaatgcccaagga

SEQ ID NO: 5085768 - DNA, 18 bp, Homo sapiens
aaatgcccaaggatgcct

SEQ ID NO: 5085769 - DNA, 12 bp, Homo sapiens
aaatgcccagtt

SEQ ID NO: 5085770 - DNA, 18 bp, Homo sapiens
aaatgcccccattctccc

SEQ ID NO: 5085771 - DNA, 22 bp, Homo sapiens
aaatgccctcttctcgtgcctc

SEQ ID NO: 5085772 - DNA, 13 bp, Homo sapiens
aaatgccctgtcc

SEQ ID NO: 5085773 - DNA, 15 bp, Homo sapiens
aaatgcctaataaac

SEQ ID NO: 5085774 - DNA, 17 bp, Homo sapiens
aaatgcctagagatatt

SEQ ID NO: 5085775 - DNA, 19 bp, Homo sapiens
aaatgcctagtttttagta

SEQ ID NO: 5085776 - DNA, 17 bp, Homo sapiens
aaatgcctcagtgtatt

SEQ ID NO: 5085777 - DNA, 18 bp, Homo sapiens
aaatgcctcagtgtattt

SEQ ID NO: 5085778 - DNA, 21 bp, Homo sapiens
aaatgcctccaaagtattgta

SEQ ID NO: 5085779 - DNA, 16 bp, Homo sapiens
aaatgcctctgccttg

SEQ ID NO: 5085780 - DNA, 14 bp, Homo sapiens
aaatgcctgctgct

SEQ ID NO: 5085781 - DNA, 17 bp, Homo sapiens
aaatgccttaaaatgga

SEQ ID NO: 5085782 - DNA, 23 bp, Homo sapiens
aaatgccttaccctcatgttctt

SEQ ID NO: 5085783 - DNA, 22 bp, Homo sapiens
aaatgccttactttgtatgata

SEQ ID NO: 5085784 - DNA, 22 bp, Homo sapiens
aaatgccttagaaatgtaaact

SEQ ID NO: 5085785 - DNA, 23 bp, Homo sapiens
aaatgccttagaaatgtaaactg

SEQ ID NO: 5085786 - DNA, 19 bp, Homo sapiens
aaatgccttcatgaatctt

SEQ ID NO: 5085787 - DNA, 14 bp, Homo sapiens
aaatgccttgaact

SEQ ID NO: 5085788 - DNA, 15 bp, Homo sapiens
aaatgccttggtttg

SEQ ID NO: 5085789 - DNA, 15 bp, Homo sapiens
aaatgcctttatatt

SEQ ID NO: 5085790 - DNA, 14 bp, Homo sapiens
aaatgcctttgaga

SEQ ID NO: 5085791 - DNA, 15 bp, Homo sapiens
aaatgcctttgtact

SEQ ID NO: 5085792 - DNA, 18 bp, Homo sapiens
aaatgcctttttgtttac

SEQ ID NO: 5085793 - DNA, 16 bp, Homo sapiens
aaatgcgaaattattg

SEQ ID NO: 5085794 - DNA, 15 bp, Homo sapiens
aaatgcggttataaa

SEQ ID NO: 5085795 - DNA, 15 bp, Homo sapiens
aaatgcgtccctgta

SEQ ID NO: 5085796 - DNA, 13 bp, Homo sapiens
aaatgctaaactt

SEQ ID NO: 5085797 - DNA, 15 bp, Homo sapiens
aaatgctaaatgcaa

SEQ ID NO: 5085798 - DNA, 18 bp, Homo sapiens
aaatgctaaatgcaaaca

SEQ ID NO: 5085799 - DNA, 21 bp, Homo sapiens
aaatgctaatattaaaagtca

SEQ ID NO: 5085800 - DNA, 23 bp, Homo sapiens
aaatgctaatattaaaagtcaca

SEQ ID NO: 5085801 - DNA, 14 bp, Homo sapiens
aaatgctaatgtaa

SEQ ID NO: 5085802 - DNA, 19 bp, Homo sapiens
aaatgctaatgtcaaactt

SEQ ID NO: 5085803 - DNA, 23 bp, Homo sapiens
aaatgctagaagctgtctaggtc

SEQ ID NO: 5085804 - DNA, 15 bp, Homo sapiens
aaatgctataatttg

SEQ ID NO: 5085805 - DNA, 18 bp, Homo sapiens
aaatgctatcaaataact

SEQ ID NO: 5085806 - DNA, 13 bp, Homo sapiens
aaatgctatggaa

SEQ ID NO: 5085807 - DNA, 14 bp, Homo sapiens
aaatgctatggaaa

SEQ ID NO: 5085808 - DNA, 23 bp, Homo sapiens
aaatgctatggaaatacatttag

SEQ ID NO: 5085809 - DNA, 17 bp, Homo sapiens
aaatgctatgtcatttc

SEQ ID NO: 5085810 - DNA, 21 bp, Homo sapiens
aaatgctattgttgtgggctt

SEQ ID NO: 5085811 - DNA, 18 bp, Homo sapiens
aaatgctcaaagaaatct

SEQ ID NO: 5085812 - DNA, 17 bp, Homo sapiens
aaatgctcaatttcagc

SEQ ID NO: 5085813 - DNA, 17 bp, Homo sapiens
aaatgctcataaagatg

SEQ ID NO: 5085814 - DNA, 21 bp, Homo sapiens
aaatgctcataaagatgttaa

SEQ ID NO: 5085815 - DNA, 23 bp, Homo sapiens
aaatgctcataaagatgttaaat

SEQ ID NO: 5085816 - DNA, 18 bp, Homo sapiens
aaatgctcattttctggt

SEQ ID NO: 5085817 - DNA, 21 bp, Homo sapiens
aaatgctcattttctggtttg

SEQ ID NO: 5085818 - DNA, 17 bp, Homo sapiens
aaatgctcattttcttt

SEQ ID NO: 5085819 - DNA, 20 bp, Homo sapiens
aaatgctcctagaagtctta

SEQ ID NO: 5085820 - DNA, 21 bp, Homo sapiens
aaatgctccttgtggcctttt

SEQ ID NO: 5085821 - DNA, 13 bp, Homo sapiens
aaatgctctaatg

SEQ ID NO: 5085822 - DNA, 16 bp, Homo sapiens
aaatgctctctcaaat

SEQ ID NO: 5085823 - DNA, 14 bp, Homo sapiens
aaatgctctgatta

SEQ ID NO: 5085824 - DNA, 21 bp, Homo sapiens
aaatgctcttaaaatatcttc

SEQ ID NO: 5085825 - DNA, 13 bp, Homo sapiens
aaatgctcttgtc

SEQ ID NO: 5085826 - DNA, 18 bp, Homo sapiens
aaatgctcttttgcacaa

SEQ ID NO: 5085827 - DNA, 17 bp, Homo sapiens
aaatgctgaaaattgcc

SEQ ID NO: 5085828 - DNA, 13 bp, Homo sapiens
aaatgctgaatga

SEQ ID NO: 5085829 - DNA, 12 bp, Homo sapiens
aaatgctgaccc

SEQ ID NO: 5085830 - DNA, 14 bp, Homo sapiens
aaatgctgatattt

SEQ ID NO: 5085831 - DNA, 18 bp, Homo sapiens
aaatgctgatatttactg

SEQ ID NO: 5085832 - DNA, 17 bp, Homo sapiens
aaatgctgcgcccttcc

SEQ ID NO: 5085833 - DNA, 12 bp, Homo sapiens
aaatgctgctct

SEQ ID NO: 5085834 - DNA, 18 bp, Homo sapiens
aaatgctgctctcagcct

SEQ ID NO: 5085835 - DNA, 19 bp, Homo sapiens
aaatgctgctgtcagacga

SEQ ID NO: 5085836 - DNA, 16 bp, Homo sapiens
aaatgctgcttttaaa

SEQ ID NO: 5085837 - DNA, 14 bp, Homo sapiens
aaatgctggctgag

SEQ ID NO: 5085838 - DNA, 22 bp, Homo sapiens
aaatgctgggggtaggtggcta

SEQ ID NO: 5085839 - DNA, 22 bp, Homo sapiens
aaatgctggtatttgatttcct

SEQ ID NO: 5085840 - DNA, 13 bp, Homo sapiens
aaatgctgtaaat

SEQ ID NO: 5085841 - DNA, 16 bp, Homo sapiens
aaatgctgtaaatatt

SEQ ID NO: 5085842 - DNA, 21 bp, Homo sapiens
aaatgctgtatgtcattaaag

SEQ ID NO: 5085843 - DNA, 22 bp, Homo sapiens
aaatgctgtatgtcattaaagt

SEQ ID NO: 5085844 - DNA, 14 bp, Homo sapiens
aaatgctgtatttt

SEQ ID NO: 5085845 - DNA, 18 bp, Homo sapiens
aaatgctgtatttttaca

SEQ ID NO: 5085846 - DNA, 20 bp, Homo sapiens
aaatgctgtatttttacagc

SEQ ID NO: 5085847 - DNA, 23 bp, Homo sapiens
aaatgctgtctttcttgctccct

SEQ ID NO: 5085848 - DNA, 19 bp, Homo sapiens
aaatgctgtgcaaacagtg

SEQ ID NO: 5085849 - DNA, 18 bp, Homo sapiens
aaatgctgttagtaaatt

SEQ ID NO: 5085850 - DNA, 19 bp, Homo sapiens
aaatgcttcatttgtatgt

SEQ ID NO: 5085851 - DNA, 23 bp, Homo sapiens
aaatgcttcatttgtatgtcaaa

SEQ ID NO: 5085852 - DNA, 22 bp, Homo sapiens
aaatgcttctaaatatgaagga

SEQ ID NO: 5085853 - DNA, 18 bp, Homo sapiens
aaatgcttctgttgtaat

SEQ ID NO: 5085854 - DNA, 17 bp, Homo sapiens
aaatgcttctttctact

SEQ ID NO: 5085855 - DNA, 17 bp, Homo sapiens
aaatgcttgacaaatat

SEQ ID NO: 5085856 - DNA, 19 bp, Homo sapiens
aaatgctttaaaaactatt

SEQ ID NO: 5085857 - DNA, 14 bp, Homo sapiens
aaatgctttaaata

SEQ ID NO: 5085858 - DNA, 19 bp, Homo sapiens
aaatgctttaaatagttta

SEQ ID NO: 5085859 - DNA, 18 bp, Homo sapiens
aaatgctttctcatgcat

SEQ ID NO: 5085860 - DNA, 14 bp, Homo sapiens
aaatgctttgaaaa

SEQ ID NO: 5085861 - DNA, 18 bp, Homo sapiens
aaatgctttgttttccca

SEQ ID NO: 5085862 - DNA, 19 bp, Homo sapiens
aaatgcttttaaatgctct

SEQ ID NO: 5085863 - DNA, 15 bp, Homo sapiens
aaatgcttttatatt

SEQ ID NO: 5085864 - DNA, 17 bp, Homo sapiens
aaatgcttttatattct

SEQ ID NO: 5085865 - DNA, 18 bp, Homo sapiens
aaatgcttttatattcta

SEQ ID NO: 5085866 - DNA, 14 bp, Homo sapiens
aaatgttacctctg

SEQ ID NO: 5085867 - DNA, 20 bp, Homo sapiens
aaatgttacgtgaagaaata

SEQ ID NO: 5085868 - DNA, 22 bp, Homo sapiens
aaatgttacgtgaagaaataaa

SEQ ID NO: 5085869 - DNA, 17 bp, Homo sapiens
aaatgttacttctgata

SEQ ID NO: 5085870 - DNA, 16 bp, Homo sapiens
aaatgttagcaagatg

SEQ ID NO: 5085871 - DNA, 21 bp, Homo sapiens
aaatgttagcaagatgatttt

SEQ ID NO: 5085872 - DNA, 16 bp, Homo sapiens
aaatgttagtatttta

SEQ ID NO: 5085873 - DNA, 23 bp, Homo sapiens
aaatgttagtattttaatcctgt

SEQ ID NO: 5085874 - DNA, 19 bp, Homo sapiens
aaatgttagtttcttggta

SEQ ID NO: 5085875 - DNA, 20 bp, Homo sapiens
aaatgttatcttatactgta

SEQ ID NO: 5085876 - DNA, 23 bp, Homo sapiens
aaatgttatcttatactgtacaa

SEQ ID NO: 5085877 - DNA, 18 bp, Homo sapiens
aaatgttatcttctcaag

SEQ ID NO: 5085878 - DNA, 19 bp, Homo sapiens
aaatgttatcttttaaatc

SEQ ID NO: 5085879 - DNA, 18 bp, Homo sapiens
aaatgttattattcttga

SEQ ID NO: 5085880 - DNA, 15 bp, Homo sapiens
aaatgttatttaaca

SEQ ID NO: 5085881 - DNA, 15 bp, Homo sapiens
aaatgttcaaactgt

SEQ ID NO: 5085882 - DNA, 15 bp, Homo sapiens
aaatgttcacaaggt

SEQ ID NO: 5085883 - DNA, 22 bp, Homo sapiens
aaatgttcacttcgaaattctg

SEQ ID NO: 5085884 - DNA, 20 bp, Homo sapiens
aaatgttcatcaatgaatga

SEQ ID NO: 5085885 - DNA, 11 bp, Homo sapiens
aaatgttcatt

SEQ ID NO: 5085886 - DNA, 14 bp, Homo sapiens
aaatgttcattgta

SEQ ID NO: 5085887 - DNA, 17 bp, Homo sapiens
aaatgttctaagtttct

SEQ ID NO: 5085888 - DNA, 20 bp, Homo sapiens
aaatgttctatatgcattta

SEQ ID NO: 5085889 - DNA, 22 bp, Homo sapiens
aaatgttctatatgcatttaat

SEQ ID NO: 5085890 - DNA, 18 bp, Homo sapiens
aaatgttctatggttatg

SEQ ID NO: 5085891 - DNA, 17 bp, Homo sapiens
aaatgttctatttaaca

SEQ ID NO: 5085892 - DNA, 19 bp, Homo sapiens
aaatgttctatttaacaac

SEQ ID NO: 5085893 - DNA, 13 bp, Homo sapiens
aaatgttctcaaa

SEQ ID NO: 5085894 - DNA, 14 bp, Homo sapiens
aaatgttctcaaat

SEQ ID NO: 5085895 - DNA, 15 bp, Homo sapiens
aaatgttctcaaata

SEQ ID NO: 5085896 - DNA, 22 bp, Homo sapiens
aaatgttctggtatgcattctt

SEQ ID NO: 5085897 - DNA, 15 bp, Homo sapiens
aaatgttctgtttgc

SEQ ID NO: 5085898 - DNA, 15 bp, Homo sapiens
aaatgttcttccagt

SEQ ID NO: 5085899 - DNA, 14 bp, Homo sapiens
aaatgttcttggtg

SEQ ID NO: 5085900 - DNA, 16 bp, Homo sapiens
aaatgttctttagatg

SEQ ID NO: 5085901 - DNA, 11 bp, Homo sapiens
aaatgttgaaa

SEQ ID NO: 5085902 - DNA, 21 bp, Homo sapiens
aaatgttgaaaagtcaaactg

SEQ ID NO: 5085903 - DNA, 14 bp, Homo sapiens
aaatgttgaaatct

SEQ ID NO: 5085904 - DNA, 19 bp, Homo sapiens
aaatgttgaaatcttaaaa

SEQ ID NO: 5085905 - DNA, 15 bp, Homo sapiens
aaatgttgaataaaa

SEQ ID NO: 5085906 - DNA, 23 bp, Homo sapiens
aaatgttgaataaaaatatgtac

SEQ ID NO: 5085907 - DNA, 20 bp, Homo sapiens
aaatgttgcacatcattcat

SEQ ID NO: 5085908 - DNA, 21 bp, Homo sapiens
aaatgttgcacatcattcatt

SEQ ID NO: 5085909 - DNA, 17 bp, Homo sapiens
aaatgttggaattttca

SEQ ID NO: 5085910 - DNA, 18 bp, Homo sapiens
aaatgttggaattttcaa

SEQ ID NO: 5085911 - DNA, 22 bp, Homo sapiens
aaatgttggatttataaatgct

SEQ ID NO: 5085912 - DNA, 23 bp, Homo sapiens
aaatgttggatttataaatgcta

SEQ ID NO: 5085913 - DNA, 17 bp, Homo sapiens
aaatgttggtcatttta

SEQ ID NO: 5085914 - DNA, 13 bp, Homo sapiens
aaatgttggtgca

SEQ ID NO: 5085915 - DNA, 16 bp, Homo sapiens
aaatgttgtatttcaa

SEQ ID NO: 5085916 - DNA, 17 bp, Homo sapiens
aaatgttgtatttcaaa

SEQ ID NO: 5085917 - DNA, 16 bp, Homo sapiens
aaatgttgtcctgtta

SEQ ID NO: 5085918 - DNA, 12 bp, Homo sapiens
aaatgtttaaag

SEQ ID NO: 5085919 - DNA, 14 bp, Homo sapiens
aaatgtttaaagaa

SEQ ID NO: 5085920 - DNA, 11 bp, Homo sapiens
aaatgtttaat

SEQ ID NO: 5085921 - DNA, 22 bp, Homo sapiens
aaatgtttaatatctgactgaa

SEQ ID NO: 5085922 - DNA, 13 bp, Homo sapiens
aaatgtttaatca

SEQ ID NO: 5085923 - DNA, 14 bp, Homo sapiens
aaatgtttaatcat

SEQ ID NO: 5085924 - DNA, 18 bp, Homo sapiens
aaatgtttaatcatataa

SEQ ID NO: 5085925 - DNA, 16 bp, Homo sapiens
aaatgtttaattcatt

SEQ ID NO: 5085926 - DNA, 19 bp, Homo sapiens
aaatgtttaattcattaat

SEQ ID NO: 5085927 - DNA, 20 bp, Homo sapiens
aaatgtttacagggagcctc

SEQ ID NO: 5085928 - DNA, 13 bp, Homo sapiens
aaatgtttacatt

SEQ ID NO: 5085929 - DNA, 16 bp, Homo sapiens
aaatgtttacattttc

SEQ ID NO: 5085930 - DNA, 16 bp, Homo sapiens
aaatgtttacattttg

SEQ ID NO: 5085931 - DNA, 16 bp, Homo sapiens
aaatgtttactgtaaa

SEQ ID NO: 5085932 - DNA, 15 bp, Homo sapiens
aaatgtttactgtat

SEQ ID NO: 5085933 - DNA, 18 bp, Homo sapiens
aaatgtttaggaaattta

SEQ ID NO: 5085934 - DNA, 11 bp, Homo sapiens
aaatgtttata

SEQ ID NO: 5085935 - DNA, 15 bp, Homo sapiens
aaatgtttatactgt

SEQ ID NO: 5085936 - DNA, 20 bp, Homo sapiens
aaatgtttatattgttttta

SEQ ID NO: 5085937 - DNA, 20 bp, Homo sapiens
aaatgtttatgttttcaact

SEQ ID NO: 5085938 - DNA, 13 bp, Homo sapiens
aaatgtttatttt

SEQ ID NO: 5085939 - DNA, 15 bp, Homo sapiens
aaatgtttatttttg

SEQ ID NO: 5085940 - DNA, 16 bp, Homo sapiens
aaatgtttcaaatgca

SEQ ID NO: 5085941 - DNA, 22 bp, Homo sapiens
aaatgtttcaagcgcttaactc

SEQ ID NO: 5085942 - DNA, 16 bp, Homo sapiens
aaatgtttcattttca

SEQ ID NO: 5085943 - DNA, 12 bp, Homo sapiens
aaatgtttcccc

SEQ ID NO: 5085944 - DNA, 13 bp, Homo sapiens
aaatgtttccccc

SEQ ID NO: 5085945 - DNA, 21 bp, Homo sapiens
aaatgtttcctccaaatctga

SEQ ID NO: 5085946 - DNA, 19 bp, Homo sapiens
aaatgtttccttgtgcctg

SEQ ID NO: 5085947 - DNA, 10 bp, Homo sapiens
aaatgtttct

SEQ ID NO: 5085948 - DNA, 12 bp, Homo sapiens
aaatgtttctaa

SEQ ID NO: 5085949 - DNA, 19 bp, Homo sapiens
aaatgtttgaaaacaaaaa

SEQ ID NO: 5085950 - DNA, 23 bp, Homo sapiens
aaatgtttgccctgttcaaagta

SEQ ID NO: 5085951 - DNA, 13 bp, Homo sapiens
aaatgtttggaaa

SEQ ID NO: 5085952 - DNA, 12 bp, Homo sapiens
aaatgtttggat

SEQ ID NO: 5085953 - DNA, 19 bp, Homo sapiens
aaatgtttggcatgtaaat

SEQ ID NO: 5085954 - DNA, 20 bp, Homo sapiens
aaatgtttggcatgtaaatg

SEQ ID NO: 5085955 - DNA, 21 bp, Homo sapiens
aaatgtttgtactttttaatg

SEQ ID NO: 5085956 - DNA, 11 bp, Homo sapiens
aaatgtttgtt

SEQ ID NO: 5085957 - DNA, 16 bp, Homo sapiens
aaatgtttgtttatat

SEQ ID NO: 5085958 - DNA, 23 bp, Homo sapiens
aaatgttttaaagtttaatgcct

SEQ ID NO: 5085959 - DNA, 16 bp, Homo sapiens
aaatgttttaaggctt

SEQ ID NO: 5085960 - DNA, 14 bp, Homo sapiens
aaatgttttataag

SEQ ID NO: 5085961 - DNA, 13 bp, Homo sapiens
aaatgttttatga

SEQ ID NO: 5085962 - DNA, 11 bp, Homo sapiens
aaatgttttca

SEQ ID NO: 5085963 - DNA, 15 bp, Homo sapiens
aaatgttttcagcta

SEQ ID NO: 5085964 - DNA, 18 bp, Homo sapiens
aaatgttttcatttacag

SEQ ID NO: 5085965 - DNA, 16 bp, Homo sapiens
aaatgttttcatttta

SEQ ID NO: 5085966 - DNA, 23 bp, Homo sapiens
aaatgttttcccctaattttcca

SEQ ID NO: 5085967 - DNA, 22 bp, Homo sapiens
aaatgttttctgcagaaaaaaa

SEQ ID NO: 5085968 - DNA, 13 bp, Homo sapiens
aaatgttttctgg

SEQ ID NO: 5085969 - DNA, 13 bp, Homo sapiens
aaatgttttgtaa

SEQ ID NO: 5085970 - DNA, 22 bp, Homo sapiens
aaatgttttgtaaactttgaaa

SEQ ID NO: 5085971 - DNA, 23 bp, Homo sapiens
aaatgttttgtaaactttgaaat

SEQ ID NO: 5085972 - DNA, 15 bp, Homo sapiens
aaatgtttttaaaaa

SEQ ID NO: 5085973 - DNA, 20 bp, Homo sapiens
aaatgtttttaataaaagaa

SEQ ID NO: 5085974 - DNA, 23 bp, Homo sapiens
aaatgtttttctgccagggagct

SEQ ID NO: 5085975 - DNA, 12 bp, Homo sapiens
aaatgtttttgg

SEQ ID NO: 5085976 - DNA, 17 bp, Homo sapiens
aaatgtttttggcaaca

SEQ ID NO: 5085977 - DNA, 14 bp, Homo sapiens
aaatgttttttgat

SEQ ID NO: 5085978 - DNA, 19 bp, Homo sapiens
aaattaaaaaaaaaaaact

SEQ ID NO: 5085979 - DNA, 21 bp, Homo sapiens
aaattaaaaaaaaaaaacttt

SEQ ID NO: 5085980 - DNA, 22 bp, Homo sapiens
aaattaaaaaaaaattgtatct

SEQ ID NO: 5085981 - DNA, 16 bp, Homo sapiens
aaattaaaaaagataa

SEQ ID NO: 5085982 - DNA, 17 bp, Homo sapiens
aaattaaaaaagctgct

SEQ ID NO: 5085983 - DNA, 14 bp, Homo sapiens
aaattaaaaaatga

SEQ ID NO: 5085984 - DNA, 13 bp, Homo sapiens
aaattaaaaagat

SEQ ID NO: 5085985 - DNA, 23 bp, Homo sapiens
aaattaaaaagattctttttctg

SEQ ID NO: 5085986 - DNA, 14 bp, Homo sapiens
aaattaaaacaaat

SEQ ID NO: 5085987 - DNA, 19 bp, Homo sapiens
aaattaaaacaaatataca

SEQ ID NO: 5085988 - DNA, 18 bp, Homo sapiens
aaattaaaacatatttca

SEQ ID NO: 5085989 - DNA, 13 bp, Homo sapiens
aaattaaaacgaa

SEQ ID NO: 5085990 - DNA, 13 bp, Homo sapiens
aaattaaaagaag

SEQ ID NO: 5085991 - DNA, 13 bp, Homo sapiens
aaattaaaatatt

SEQ ID NO: 5085992 - DNA, 14 bp, Homo sapiens
aaattaaaatggat

SEQ ID NO: 5085993 - DNA, 13 bp, Homo sapiens
aaattaaaattta

SEQ ID NO: 5085994 - DNA, 14 bp, Homo sapiens
aaattaaaatttaa

SEQ ID NO: 5085995 - DNA, 18 bp, Homo sapiens
aaattaaacataaaacaa

SEQ ID NO: 5085996 - DNA, 14 bp, Homo sapiens
aaattaaacatttt

SEQ ID NO: 5085997 - DNA, 15 bp, Homo sapiens
aaattaaacattttt

SEQ ID NO: 5085998 - DNA, 16 bp, Homo sapiens
aaattaaacatttttc

SEQ ID NO: 5085999 - DNA, 13 bp, Homo sapiens
aaattaaacttta

SEQ ID NO: 5086000 - DNA, 12 bp, Homo sapiens
aaattaaagaaa

SEQ ID NO: 5086001 - DNA, 17 bp, Homo sapiens
aaattaaagtatgcaaa

SEQ ID NO: 5086002 - DNA, 21 bp, Homo sapiens
aaattaaagtatgcaaaataa

SEQ ID NO: 5086003 - DNA, 16 bp, Homo sapiens
aaattaaagtgctgtt

SEQ ID NO: 5086004 - DNA, 17 bp, Homo sapiens
aaattaaagtgctgttt

SEQ ID NO: 5086005 - DNA, 16 bp, Homo sapiens
aaattaaagtttgctt

SEQ ID NO: 5086006 - DNA, 18 bp, Homo sapiens
aaattaaataaaattttt

SEQ ID NO: 5086007 - DNA, 12 bp, Homo sapiens
aaattaaatact

SEQ ID NO: 5086008 - DNA, 13 bp, Homo sapiens
aaattaaatactt

SEQ ID NO: 5086009 - DNA, 20 bp, Homo sapiens
aaattaaatatatgtatgta

SEQ ID NO: 5086010 - DNA, 20 bp, Homo sapiens
aaattaaatctagacattct

SEQ ID NO: 5086011 - DNA, 22 bp, Homo sapiens
aaattaaatctagacattcttt

SEQ ID NO: 5086012 - DNA, 14 bp, Homo sapiens
aaattaaatgaatt

SEQ ID NO: 5086013 - DNA, 21 bp, Homo sapiens
aaattaaattctctctaacat

SEQ ID NO: 5086014 - DNA, 21 bp, Homo sapiens
aaattaacagtattaaatgac

SEQ ID NO: 5086015 - DNA, 18 bp, Homo sapiens
aaattaacagtcctaact

SEQ ID NO: 5086016 - DNA, 19 bp, Homo sapiens
aaattaactaaggaaatat

SEQ ID NO: 5086017 - DNA, 22 bp, Homo sapiens
aaattaactcaccagatttact

SEQ ID NO: 5086018 - DNA, 20 bp, Homo sapiens
aaattaactgggtaatgaaa

SEQ ID NO: 5086019 - DNA, 13 bp, Homo sapiens
aaattaactgtat

SEQ ID NO: 5086020 - DNA, 14 bp, Homo sapiens
aaattaactgtatg

SEQ ID NO: 5086021 - DNA, 20 bp, Homo sapiens
aaattaacttctattttcaa

SEQ ID NO: 5086022 - DNA, 17 bp, Homo sapiens
aaattaacttgagtttt

SEQ ID NO: 5086023 - DNA, 19 bp, Homo sapiens
aaattaacttttataaact

SEQ ID NO: 5086024 - DNA, 14 bp, Homo sapiens
aaattaagaaagga

SEQ ID NO: 5086025 - DNA, 15 bp, Homo sapiens
aaattaagaagaaac

SEQ ID NO: 5086026 - DNA, 14 bp, Homo sapiens
aaattaagaatgtt

SEQ ID NO: 5086027 - DNA, 16 bp, Homo sapiens
aaattaagaatgttct

SEQ ID NO: 5086028 - DNA, 13 bp, Homo sapiens
aaattaagacaaa

SEQ ID NO: 5086029 - DNA, 13 bp, Homo sapiens
aaattaagacttt

SEQ ID NO: 5086030 - DNA, 15 bp, Homo sapiens
aaattaagactttaa

SEQ ID NO: 5086031 - DNA, 22 bp, Homo sapiens
aaattaagactttaaaagatga

SEQ ID NO: 5086032 - DNA, 17 bp, Homo sapiens
aaattaagagatacatt

SEQ ID NO: 5086033 - DNA, 20 bp, Homo sapiens
aaattaagagatacattccc

SEQ ID NO: 5086034 - DNA, 13 bp, Homo sapiens
aaattaagatcct

SEQ ID NO: 5086035 - DNA, 19 bp, Homo sapiens
aaattaagatcctaaactc

SEQ ID NO: 5086036 - DNA, 21 bp, Homo sapiens
aaattaagatcctaaactctc

SEQ ID NO: 5086037 - DNA, 17 bp, Homo sapiens
aaattaagatgttcaga

SEQ ID NO: 5086038 - DNA, 17 bp, Homo sapiens
aaattaagcaaatgtta

SEQ ID NO: 5086039 - DNA, 22 bp, Homo sapiens
aaattaaggcaactgaacaaaa

SEQ ID NO: 5086040 - DNA, 17 bp, Homo sapiens
aaattaagggttaagaa

SEQ ID NO: 5086041 - DNA, 12 bp, Homo sapiens
aaattaaggtgt

SEQ ID NO: 5086042 - DNA, 23 bp, Homo sapiens
aaattaaggtgtttgaaaatagt

SEQ ID NO: 5086043 - DNA, 16 bp, Homo sapiens
aaattaagtcattttg

SEQ ID NO: 5086044 - DNA, 18 bp, Homo sapiens
aaattaagtgtgtataaa

SEQ ID NO: 5086045 - DNA, 21 bp, Homo sapiens
aaattaatacattctatgaca

SEQ ID NO: 5086046 - DNA, 20 bp, Homo sapiens
aaattaatagcttttgatta

SEQ ID NO: 5086047 - DNA, 13 bp, Homo sapiens
aaatgcttttcac

SEQ ID NO: 5086048 - DNA, 15 bp, Homo sapiens
aaatgcttttctgaa

SEQ ID NO: 5086049 - DNA, 14 bp, Homo sapiens
aaatgctttttgtt

SEQ ID NO: 5086050 - DNA, 20 bp, Homo sapiens
aaatggaaaaaaattacaag

SEQ ID NO: 5086051 - DNA, 13 bp, Homo sapiens
aaatggaaaatat

SEQ ID NO: 5086052 - DNA, 20 bp, Homo sapiens
aaatggaaaatatacaagta

SEQ ID NO: 5086053 - DNA, 21 bp, Homo sapiens
aaatggaaaattaattctaaa

SEQ ID NO: 5086054 - DNA, 18 bp, Homo sapiens
aaatggaaacaccactgc

SEQ ID NO: 5086055 - DNA, 16 bp, Homo sapiens
aaatggaaagaaggaa

SEQ ID NO: 5086056 - DNA, 20 bp, Homo sapiens
aaatggaaaggtcctgctgt

SEQ ID NO: 5086057 - DNA, 16 bp, Homo sapiens
aaatggaaatgggcag

SEQ ID NO: 5086058 - DNA, 14 bp, Homo sapiens
aaatggaaattttg

SEQ ID NO: 5086059 - DNA, 20 bp, Homo sapiens
aaatggaacgctaatgaaac

SEQ ID NO: 5086060 - DNA, 18 bp, Homo sapiens
aaatggaagacacattga

SEQ ID NO: 5086061 - DNA, 15 bp, Homo sapiens
aaatggaagcaaaga

SEQ ID NO: 5086062 - DNA, 17 bp, Homo sapiens
aaatggaagcaaagaca

SEQ ID NO: 5086063 - DNA, 18 bp, Homo sapiens
aaatggaagcaaagacaa

SEQ ID NO: 5086064 - DNA, 13 bp, Homo sapiens
aaatggaattact

SEQ ID NO: 5086065 - DNA, 19 bp, Homo sapiens
aaatggaattactccaaaa

SEQ ID NO: 5086066 - DNA, 14 bp, Homo sapiens
aaatggacaaagaa

SEQ ID NO: 5086067 - DNA, 22 bp, Homo sapiens
aaatggacaaggcctaattttt

SEQ ID NO: 5086068 - DNA, 14 bp, Homo sapiens
aaatggacaatacc

SEQ ID NO: 5086069 - DNA, 17 bp, Homo sapiens
aaatggacaataccaga

SEQ ID NO: 5086070 - DNA, 13 bp, Homo sapiens
aaatggacatttt

SEQ ID NO: 5086071 - DNA, 19 bp, Homo sapiens
aaatggacctatctgtaag

SEQ ID NO: 5086072 - DNA, 19 bp, Homo sapiens
aaatggactacagtagctc

SEQ ID NO: 5086073 - DNA, 23 bp, Homo sapiens
aaatggactgtggtgactttgga

SEQ ID NO: 5086074 - DNA, 19 bp, Homo sapiens
aaatggacttgcttcttgt

SEQ ID NO: 5086075 - DNA, 14 bp, Homo sapiens
aaatggacttttgt

SEQ ID NO: 5086076 - DNA, 19 bp, Homo sapiens
aaatggacttttgttcatg

SEQ ID NO: 5086077 - DNA, 18 bp, Homo sapiens
aaatggagaagctgcagg

SEQ ID NO: 5086078 - DNA, 18 bp, Homo sapiens
aaatggagctcagtaaca

SEQ ID NO: 5086079 - DNA, 18 bp, Homo sapiens
aaatggaggcttttcact

SEQ ID NO: 5086080 - DNA, 14 bp, Homo sapiens
aaatggagggtggg

SEQ ID NO: 5086081 - DNA, 22 bp, Homo sapiens
aaatggaggtccttctgctgga

SEQ ID NO: 5086082 - DNA, 22 bp, Homo sapiens
aaatggagttggagttcattca

SEQ ID NO: 5086083 - DNA, 17 bp, Homo sapiens
aaatggatagattgttt

SEQ ID NO: 5086084 - DNA, 23 bp, Homo sapiens
aaatggatgccttgaataataag

SEQ ID NO: 5086085 - DNA, 13 bp, Homo sapiens
aaatggatgtaat

SEQ ID NO: 5086086 - DNA, 20 bp, Homo sapiens
aaatggcaaaaccagtagct

SEQ ID NO: 5086087 - DNA, 14 bp, Homo sapiens
aaatggcaaatgca

SEQ ID NO: 5086088 - DNA, 15 bp, Homo sapiens
aaatggcaacaaact

SEQ ID NO: 5086089 - DNA, 13 bp, Homo sapiens
aaatggcaagaga

SEQ ID NO: 5086090 - DNA, 17 bp, Homo sapiens
aaatggcaagttttcca

SEQ ID NO: 5086091 - DNA, 17 bp, Homo sapiens
aaatggcaagttttgat

SEQ ID NO: 5086092 - DNA, 15 bp, Homo sapiens
aaatggcaatttttt

SEQ ID NO: 5086093 - DNA, 13 bp, Homo sapiens
aaatggcacctgt

SEQ ID NO: 5086094 - DNA, 16 bp, Homo sapiens
aaatggcacctgtata

SEQ ID NO: 5086095 - DNA, 15 bp, Homo sapiens
aaatggcatttagca

SEQ ID NO: 5086096 - DNA, 23 bp, Homo sapiens
aaatggcatttagcacagtattt

SEQ ID NO: 5086097 - DNA, 16 bp, Homo sapiens
aaatggccagtgctgc

SEQ ID NO: 5086098 - DNA, 11 bp, Homo sapiens
aaatggccatt

SEQ ID NO: 5086099 - DNA, 16 bp, Homo sapiens
aaatggccatttgctt

SEQ ID NO: 5086100 - DNA, 22 bp, Homo sapiens
aaatggccatttgctttttcac

SEQ ID NO: 5086101 - DNA, 19 bp, Homo sapiens
aaatggccattttaaaatg

SEQ ID NO: 5086102 - DNA, 13 bp, Homo sapiens
aaatggccctgtt

SEQ ID NO: 5086103 - DNA, 21 bp, Homo sapiens
aaatggcctcatgtggctgga

SEQ ID NO: 5086104 - DNA, 22 bp, Homo sapiens
aaatggcctcatgtggctggaa

SEQ ID NO: 5086105 - DNA, 14 bp, Homo sapiens
aaatggccttcccg

SEQ ID NO: 5086106 - DNA, 14 bp, Homo sapiens
aaatggcgaacatg

SEQ ID NO: 5086107 - DNA, 16 bp, Homo sapiens
aaatggcgaacatgtg

SEQ ID NO: 5086108 - DNA, 16 bp, Homo sapiens
aaatggcgtctgctct

SEQ ID NO: 5086109 - DNA, 17 bp, Homo sapiens
aaatggcgtctgctctg

SEQ ID NO: 5086110 - DNA, 21 bp, Homo sapiens
aaatggcgtctggaagtccaa

SEQ ID NO: 5086111 - DNA, 21 bp, Homo sapiens
aaatggctaataaactgtatt

SEQ ID NO: 5086112 - DNA, 23 bp, Homo sapiens
aaatggctaataaactgtattaa

SEQ ID NO: 5086113 - DNA, 21 bp, Homo sapiens
aaatggctacatctccaaata

SEQ ID NO: 5086114 - DNA, 15 bp, Homo sapiens
aaatggctatgaaca

SEQ ID NO: 5086115 - DNA, 17 bp, Homo sapiens
aaatggctctgtgaaat

SEQ ID NO: 5086116 - DNA, 15 bp, Homo sapiens
aaatggctgaagaaa

SEQ ID NO: 5086117 - DNA, 16 bp, Homo sapiens
aaatggctgaagaaac

SEQ ID NO: 5086118 - DNA, 23 bp, Homo sapiens
aaatggctgaagaaacacagcat

SEQ ID NO: 5086119 - DNA, 23 bp, Homo sapiens
aaatggctgcttttgtctccctt

SEQ ID NO: 5086120 - DNA, 13 bp, Homo sapiens
aaatggctggggc

SEQ ID NO: 5086121 - DNA, 19 bp, Homo sapiens
aaatggctggggccgctgg

SEQ ID NO: 5086122 - DNA, 22 bp, Homo sapiens
aaatggcttcagaattaaaact

SEQ ID NO: 5086123 - DNA, 21 bp, Homo sapiens
aaatggcttcggacaaaatat

SEQ ID NO: 5086124 - DNA, 20 bp, Homo sapiens
aaatggcttgttcagtcact

SEQ ID NO: 5086125 - DNA, 15 bp, Homo sapiens
aaatgggaaaaaact

SEQ ID NO: 5086126 - DNA, 15 bp, Homo sapiens
aaatgggaattctca

SEQ ID NO: 5086127 - DNA, 18 bp, Homo sapiens
aaatgggaattctcaggt

SEQ ID NO: 5086128 - DNA, 23 bp, Homo sapiens
aaatgggaattctgacttactta

SEQ ID NO: 5086129 - DNA, 15 bp, Homo sapiens
aaatgggactctgaa

SEQ ID NO: 5086130 - DNA, 18 bp, Homo sapiens
aaatgggactgatgtcat

SEQ ID NO: 5086131 - DNA, 21 bp, Homo sapiens
aaatgggactgatgtcatctt

SEQ ID NO: 5086132 - DNA, 16 bp, Homo sapiens
aaatgggacttctttt

SEQ ID NO: 5086133 - DNA, 20 bp, Homo sapiens
aaatgggagctgagcagcct

SEQ ID NO: 5086134 - DNA, 20 bp, Homo sapiens
aaatgggcagagcagagacc

SEQ ID NO: 5086135 - DNA, 23 bp, Homo sapiens
aaatgggcattttacaagaagta

SEQ ID NO: 5086136 - DNA, 18 bp, Homo sapiens
aaatggggagctggccta

SEQ ID NO: 5086137 - DNA, 13 bp, Homo sapiens
aaatggggccaga

SEQ ID NO: 5086138 - DNA, 20 bp, Homo sapiens
aaatgggggcggctggaaag

SEQ ID NO: 5086139 - DNA, 17 bp, Homo sapiens
aaatgggggtgcatttg

SEQ ID NO: 5086140 - DNA, 22 bp, Homo sapiens
aaatgggtgtatataattttat

SEQ ID NO: 5086141 - DNA, 15 bp, Homo sapiens
aaatgggtgttattt

SEQ ID NO: 5086142 - DNA, 22 bp, Homo sapiens
aaatgggttggtgcttctaacc

SEQ ID NO: 5086143 - DNA, 18 bp, Homo sapiens
aaatggtaaaattgcatg

SEQ ID NO: 5086144 - DNA, 19 bp, Homo sapiens
aaatggtaaaattgcatgg

SEQ ID NO: 5086145 - DNA, 20 bp, Homo sapiens
aaatggtaatttctactttg

SEQ ID NO: 5086146 - DNA, 20 bp, Homo sapiens
aaatggtacagcttctggag

SEQ ID NO: 5086147 - DNA, 18 bp, Homo sapiens
aaatggtagcattttaaa

SEQ ID NO: 5086148 - DNA, 22 bp, Homo sapiens
aaatggtagcattttaaacaaa

SEQ ID NO: 5086149 - DNA, 19 bp, Homo sapiens
aaatggtagttagcaacta

SEQ ID NO: 5086150 - DNA, 15 bp, Homo sapiens
aaatggtataaaagg

SEQ ID NO: 5086151 - DNA, 16 bp, Homo sapiens
aaatggtatcttttgg

SEQ ID NO: 5086152 - DNA, 18 bp, Homo sapiens
aaatggtatgccaactta

SEQ ID NO: 5086153 - DNA, 21 bp, Homo sapiens
aaatggtatggccaaaagtca

SEQ ID NO: 5086154 - DNA, 15 bp, Homo sapiens
aaatggtattttttg

SEQ ID NO: 5086155 - DNA, 19 bp, Homo sapiens
aaatggtattttttgtgaa

SEQ ID NO: 5086156 - DNA, 21 bp, Homo sapiens
aaatggtattttttgtgaatg

SEQ ID NO: 5086157 - DNA, 21 bp, Homo sapiens
aaatggtccaattagtttcct

SEQ ID NO: 5086158 - DNA, 20 bp, Homo sapiens
aaatggtcctatttttgtga

SEQ ID NO: 5086159 - DNA, 17 bp, Homo sapiens
aaatggtcgcccaggag

SEQ ID NO: 5086160 - DNA, 18 bp, Homo sapiens
aaatggtcgcccaggaga

SEQ ID NO: 5086161 - DNA, 14 bp, Homo sapiens
aaatggtgatttaa

SEQ ID NO: 5086162 - DNA, 19 bp, Homo sapiens
aaatggtgctgcagatttg

SEQ ID NO: 5086163 - DNA, 22 bp, Homo sapiens
aaatggtggaggattgctgcca

SEQ ID NO: 5086164 - DNA, 18 bp, Homo sapiens
aaatggtggcttcagctc

SEQ ID NO: 5086165 - DNA, 22 bp, Homo sapiens
aaatggtggcttcagctccagc

SEQ ID NO: 5086166 - DNA, 21 bp, Homo sapiens
aaatggtggtttgtcatatat

SEQ ID NO: 5086167 - DNA, 23 bp, Homo sapiens
aaatggtggtttgtcatatattc

SEQ ID NO: 5086168 - DNA, 20 bp, Homo sapiens
aaatggtgtacataatgtat

SEQ ID NO: 5086169 - DNA, 17 bp, Homo sapiens
aaatggtgttttatctt

SEQ ID NO: 5086170 - DNA, 22 bp, Homo sapiens
aaatggtgttttcatgtaaata

SEQ ID NO: 5086171 - DNA, 14 bp, Homo sapiens
aaatggtgtttttt

SEQ ID NO: 5086172 - DNA, 20 bp, Homo sapiens
aaatggttaaattttacatg

SEQ ID NO: 5086173 - DNA, 14 bp, Homo sapiens
aaatggttcagaat

SEQ ID NO: 5086174 - DNA, 15 bp, Homo sapiens
aaatggttcagaatt

SEQ ID NO: 5086175 - DNA, 18 bp, Homo sapiens
aaatggttcttacttttc

SEQ ID NO: 5086176 - DNA, 16 bp, Homo sapiens
aaatggttgtattaga

SEQ ID NO: 5086177 - DNA, 19 bp, Homo sapiens
aaatggttgtattagatgt

SEQ ID NO: 5086178 - DNA, 23 bp, Homo sapiens
aaatggttgtcacctctctctga

SEQ ID NO: 5086179 - DNA, 14 bp, Homo sapiens
aaatggttttcaac

SEQ ID NO: 5086180 - DNA, 24 bp, Homo sapiens
aaatggttttgttttgcacgtttg

SEQ ID NO: 5086181 - DNA, 19 bp, Homo sapiens
aaatggtttttgcaagatt

SEQ ID NO: 5086182 - DNA, 15 bp, Homo sapiens
aaatggtttttgcct

SEQ ID NO: 5086183 - DNA, 13 bp, Homo sapiens
aaatgtaaaaaac

SEQ ID NO: 5086184 - DNA, 15 bp, Homo sapiens
aaatgtaaaaaacaa

SEQ ID NO: 5086185 - DNA, 17 bp, Homo sapiens
aaatgtaaaaaacaaaa

SEQ ID NO: 5086186 - DNA, 18 bp, Homo sapiens
aaatgtaaaaaacaaaaa

SEQ ID NO: 5086187 - DNA, 19 bp, Homo sapiens
aaatgtaaaaaacaaaaaa

SEQ ID NO: 5086188 - DNA, 19 bp, Homo sapiens
aaatgtaaaaatgaaggaa

SEQ ID NO: 5086189 - DNA, 21 bp, Homo sapiens
aaatgtaaaaatgaaggaatt

SEQ ID NO: 5086190 - DNA, 17 bp, Homo sapiens
aaatgtaaaagtactct

SEQ ID NO: 5086191 - DNA, 14 bp, Homo sapiens
aaatgtaaaatatt

SEQ ID NO: 5086192 - DNA, 23 bp, Homo sapiens
aaatgtaaaatatttataaatga

SEQ ID NO: 5086193 - DNA, 13 bp, Homo sapiens
aaatgtaaactgc

SEQ ID NO: 5086194 - DNA, 15 bp, Homo sapiens
aaatgtaaactgcca

SEQ ID NO: 5086195 - DNA, 16 bp, Homo sapiens
aaatgtaaactgccat

SEQ ID NO: 5086196 - DNA, 19 bp, Homo sapiens
aaatgtaaactgtttcttt

SEQ ID NO: 5086197 - DNA, 22 bp, Homo sapiens
aaatgtaaagatatttttatct

SEQ ID NO: 5086198 - DNA, 14 bp, Homo sapiens
aaatgtaaagtcta

SEQ ID NO: 5086199 - DNA, 13 bp, Homo sapiens
aaatgtaaatact

SEQ ID NO: 5086200 - DNA, 13 bp, Homo sapiens
aaatgtaaatgtt

SEQ ID NO: 5086201 - DNA, 18 bp, Homo sapiens
aaatgtaacatgaagcaa

SEQ ID NO: 5086202 - DNA, 13 bp, Homo sapiens
aaatgtaactgtc

SEQ ID NO: 5086203 - DNA, 18 bp, Homo sapiens
aaatgtaactgtgccagt

SEQ ID NO: 5086204 - DNA, 20 bp, Homo sapiens
aaatgtaacttattccaagt

SEQ ID NO: 5086205 - DNA, 22 bp, Homo sapiens
aaatgtaagatcgttctctgcc

SEQ ID NO: 5086206 - DNA, 22 bp, Homo sapiens
aaatgtaagattatagattcta

SEQ ID NO: 5086207 - DNA, 18 bp, Homo sapiens
aaatgtaaggctgtgtaa

SEQ ID NO: 5086208 - DNA, 22 bp, Homo sapiens
aaatgtaagggaaactgccagc

SEQ ID NO: 5086209 - DNA, 22 bp, Homo sapiens
aaatgtaagttatgtgttaaat

SEQ ID NO: 5086210 - DNA, 21 bp, Homo sapiens
aaatgtaagttgagaaaaatt

SEQ ID NO: 5086211 - DNA, 14 bp, Homo sapiens
aaatgtaatactgg

SEQ ID NO: 5086212 - DNA, 15 bp, Homo sapiens
aaatgtaatactgga

SEQ ID NO: 5086213 - DNA, 16 bp, Homo sapiens
aaatgtaatagtttat

SEQ ID NO: 5086214 - DNA, 20 bp, Homo sapiens
aaatgtaattataagctgag

SEQ ID NO: 5086215 - DNA, 19 bp, Homo sapiens
aaatgtaattatgttctaa

SEQ ID NO: 5086216 - DNA, 12 bp, Homo sapiens
aaatgtaattga

SEQ ID NO: 5086217 - DNA, 14 bp, Homo sapiens
aaatgtaatttaaa

SEQ ID NO: 5086218 - DNA, 18 bp, Homo sapiens
aaatgtaatttagaaact

SEQ ID NO: 5086219 - DNA, 19 bp, Homo sapiens
aaatgtacaaaataaagtt

SEQ ID NO: 5086220 - DNA, 22 bp, Homo sapiens
aaatgtacactaccaaacactc

SEQ ID NO: 5086221 - DNA, 14 bp, Homo sapiens
aaatgtacactttt

SEQ ID NO: 5086222 - DNA, 15 bp, Homo sapiens
aaatgtacacttttt

SEQ ID NO: 5086223 - DNA, 19 bp, Homo sapiens
aaatgtacagacatattta

SEQ ID NO: 5086224 - DNA, 18 bp, Homo sapiens
aaattaatatatcattat

SEQ ID NO: 5086225 - DNA, 14 bp, Homo sapiens
aaattaatatatta

SEQ ID NO: 5086226 - DNA, 11 bp, Homo sapiens
aaattaatatc

SEQ ID NO: 5086227 - DNA, 14 bp, Homo sapiens
aaattaatatcttt

SEQ ID NO: 5086228 - DNA, 17 bp, Homo sapiens
aaattaatatggcttca

SEQ ID NO: 5086229 - DNA, 15 bp, Homo sapiens
aaattaatattgtat

SEQ ID NO: 5086230 - DNA, 23 bp, Homo sapiens
aaattaatatttgtgctttgaaa

SEQ ID NO: 5086231 - DNA, 16 bp, Homo sapiens
aaattaatcctcacag

SEQ ID NO: 5086232 - DNA, 14 bp, Homo sapiens
aaattaatctgggc

SEQ ID NO: 5086233 - DNA, 22 bp, Homo sapiens
aaattaatcttttaaaaatgat

SEQ ID NO: 5086234 - DNA, 23 bp, Homo sapiens
aaattaatcttttaaaaatgatg

SEQ ID NO: 5086235 - DNA, 16 bp, Homo sapiens
aaattaatgaagcttt

SEQ ID NO: 5086236 - DNA, 15 bp, Homo sapiens
aaattaatgtaataa

SEQ ID NO: 5086237 - DNA, 18 bp, Homo sapiens
aaattaatgtaataaagt

SEQ ID NO: 5086238 - DNA, 14 bp, Homo sapiens
aaattaatgtgtaa

SEQ ID NO: 5086239 - DNA, 20 bp, Homo sapiens
aaattaatgtgtaaaattgg

SEQ ID NO: 5086240 - DNA, 19 bp, Homo sapiens
aaattaatgttccagtttg

SEQ ID NO: 5086241 - DNA, 20 bp, Homo sapiens
aaattaattaggaattactt

SEQ ID NO: 5086242 - DNA, 15 bp, Homo sapiens
aaattaattcctatc

SEQ ID NO: 5086243 - DNA, 13 bp, Homo sapiens
aaattaattcttt

SEQ ID NO: 5086244 - DNA, 13 bp, Homo sapiens
aaattaatttttc

SEQ ID NO: 5086245 - DNA, 19 bp, Homo sapiens
aaattacaaaagagcagca

SEQ ID NO: 5086246 - DNA, 21 bp, Homo sapiens
aaattacaaaagagcagcatt

SEQ ID NO: 5086247 - DNA, 18 bp, Homo sapiens
aaattacaaagaaaataa

SEQ ID NO: 5086248 - DNA, 18 bp, Homo sapiens
aaattacaagtttcagta

SEQ ID NO: 5086249 - DNA, 13 bp, Homo sapiens
aaattacaatttt

SEQ ID NO: 5086250 - DNA, 14 bp, Homo sapiens
aaattacaatttta

SEQ ID NO: 5086251 - DNA, 19 bp, Homo sapiens
aaattacacaataaagcag

SEQ ID NO: 5086252 - DNA, 23 bp, Homo sapiens
aaattacacccatgcacagaaca

SEQ ID NO: 5086253 - DNA, 15 bp, Homo sapiens
aaattacactttatt

SEQ ID NO: 5086254 - DNA, 18 bp, Homo sapiens
aaattacactttattctt

SEQ ID NO: 5086255 - DNA, 21 bp, Homo sapiens
aaattacagaagaagctcctg

SEQ ID NO: 5086256 - DNA, 15 bp, Homo sapiens
aaattacagctttta

SEQ ID NO: 5086257 - DNA, 13 bp, Homo sapiens
aaattacagtcat

SEQ ID NO: 5086258 - DNA, 22 bp, Homo sapiens
aaattacataagttagaacaag

SEQ ID NO: 5086259 - DNA, 21 bp, Homo sapiens
aaattacatagacttaggcat

SEQ ID NO: 5086260 - DNA, 14 bp, Homo sapiens
aaattacatatact

SEQ ID NO: 5086261 - DNA, 18 bp, Homo sapiens
aaattacatgaagatttg

SEQ ID NO: 5086262 - DNA, 13 bp, Homo sapiens
aaattacatgttt

SEQ ID NO: 5086263 - DNA, 12 bp, Homo sapiens
aaattacatttg

SEQ ID NO: 5086264 - DNA, 18 bp, Homo sapiens
aaattacatttgtaattt

SEQ ID NO: 5086265 - DNA, 20 bp, Homo sapiens
aaattacatttgtaatttaa

SEQ ID NO: 5086266 - DNA, 12 bp, Homo sapiens
aaattacatttt

SEQ ID NO: 5086267 - DNA, 13 bp, Homo sapiens
aaattacattttt

SEQ ID NO: 5086268 - DNA, 14 bp, Homo sapiens
aaattacattttta

SEQ ID NO: 5086269 - DNA, 15 bp, Homo sapiens
aaattacctgtggat

SEQ ID NO: 5086270 - DNA, 13 bp, Homo sapiens
aaattacctttaa

SEQ ID NO: 5086271 - DNA, 20 bp, Homo sapiens
aaattacctttacatatata

SEQ ID NO: 5086272 - DNA, 21 bp, Homo sapiens
aaattacctttacatatatag

SEQ ID NO: 5086273 - DNA, 23 bp, Homo sapiens
aaattacgtatgcaagtctgtga

SEQ ID NO: 5086274 - DNA, 23 bp, Homo sapiens
aaattacgtttgttattcctagt

SEQ ID NO: 5086275 - DNA, 17 bp, Homo sapiens
aaattactaatgattta

SEQ ID NO: 5086276 - DNA, 15 bp, Homo sapiens
aaattactaattatc

SEQ ID NO: 5086277 - DNA, 19 bp, Homo sapiens
aaattactatagcaaagta

SEQ ID NO: 5086278 - DNA, 19 bp, Homo sapiens
aaattactatctgttgaaa

SEQ ID NO: 5086279 - DNA, 14 bp, Homo sapiens
aaattactattctt

SEQ ID NO: 5086280 - DNA, 20 bp, Homo sapiens
aaattactcaggaagaacac

SEQ ID NO: 5086281 - DNA, 14 bp, Homo sapiens
aaattactctttct

SEQ ID NO: 5086282 - DNA, 23 bp, Homo sapiens
aaattactgtttattaaagtaca

SEQ ID NO: 5086283 - DNA, 13 bp, Homo sapiens
aaattactgtttt

SEQ ID NO: 5086284 - DNA, 15 bp, Homo sapiens
aaattactgttttat

SEQ ID NO: 5086285 - DNA, 20 bp, Homo sapiens
aaattactgttttatgttga

SEQ ID NO: 5086286 - DNA, 16 bp, Homo sapiens
aaattacttggctttt

SEQ ID NO: 5086287 - DNA, 22 bp, Homo sapiens
aaattactttaacattttggaa

SEQ ID NO: 5086288 - DNA, 12 bp, Homo sapiens
aaattagaaaaa

SEQ ID NO: 5086289 - DNA, 13 bp, Homo sapiens
aaattagaaaaaa

SEQ ID NO: 5086290 - DNA, 19 bp, Homo sapiens
aaattagaaaaaaattact

SEQ ID NO: 5086291 - DNA, 13 bp, Homo sapiens
aaattagaaaata

SEQ ID NO: 5086292 - DNA, 15 bp, Homo sapiens
aaattagaaaatatt

SEQ ID NO: 5086293 - DNA, 20 bp, Homo sapiens
aaattagaaaatgttattta

SEQ ID NO: 5086294 - DNA, 20 bp, Homo sapiens
aaattagaaacaccattcat

SEQ ID NO: 5086295 - DNA, 19 bp, Homo sapiens
aaattagaaaggacaacag

SEQ ID NO: 5086296 - DNA, 23 bp, Homo sapiens
aaattagaaaggacaacagttct

SEQ ID NO: 5086297 - DNA, 21 bp, Homo sapiens
aaattagatattgttttgtga

SEQ ID NO: 5086298 - DNA, 19 bp, Homo sapiens
aaattagatcctaagatgt

SEQ ID NO: 5086299 - DNA, 14 bp, Homo sapiens
aaattagatgaact

SEQ ID NO: 5086300 - DNA, 16 bp, Homo sapiens
aaattagatgactgaa

SEQ ID NO: 5086301 - DNA, 13 bp, Homo sapiens
aaattagatttgt

SEQ ID NO: 5086302 - DNA, 16 bp, Homo sapiens
aaattagatttgtgca

SEQ ID NO: 5086303 - DNA, 14 bp, Homo sapiens
aaattagcatgcaa

SEQ ID NO: 5086304 - DNA, 16 bp, Homo sapiens
aaattagccacatgta

SEQ ID NO: 5086305 - DNA, 15 bp, Homo sapiens
aaattagccgggcgt

SEQ ID NO: 5086306 - DNA, 22 bp, Homo sapiens
aaattagctgggcatggtggtg

SEQ ID NO: 5086307 - DNA, 15 bp, Homo sapiens
aaattagcttttagt

SEQ ID NO: 5086308 - DNA, 20 bp, Homo sapiens
aaattaggaaagtactgcat

SEQ ID NO: 5086309 - DNA, 16 bp, Homo sapiens
aaattaggaataaata

SEQ ID NO: 5086310 - DNA, 18 bp, Homo sapiens
aaattaggaataaataaa

SEQ ID NO: 5086311 - DNA, 19 bp, Homo sapiens
aaattaggatttcatgatt

SEQ ID NO: 5086312 - DNA, 16 bp, Homo sapiens
aaattagggagctctt

SEQ ID NO: 5086313 - DNA, 14 bp, Homo sapiens
aaattagggcaatt

SEQ ID NO: 5086314 - DNA, 20 bp, Homo sapiens
aaattagggctacattgtaa

SEQ ID NO: 5086315 - DNA, 19 bp, Homo sapiens
aaattagggctctaatttc

SEQ ID NO: 5086316 - DNA, 16 bp, Homo sapiens
aaattagtaatgtact

SEQ ID NO: 5086317 - DNA, 13 bp, Homo sapiens
aaattagtaattg

SEQ ID NO: 5086318 - DNA, 13 bp, Homo sapiens
aaattagtatttt

SEQ ID NO: 5086319 - DNA, 22 bp, Homo sapiens
aaattagtcttttgtaatatca

SEQ ID NO: 5086320 - DNA, 17 bp, Homo sapiens
aaattagtctttttctt

SEQ ID NO: 5086321 - DNA, 20 bp, Homo sapiens
aaattagtgaagttctttta

SEQ ID NO: 5086322 - DNA, 21 bp, Homo sapiens
aaattagtgaccattattcac

SEQ ID NO: 5086323 - DNA, 13 bp, Homo sapiens
aaattagtgagat

SEQ ID NO: 5086324 - DNA, 15 bp, Homo sapiens
aaattagtgagattt

SEQ ID NO: 5086325 - DNA, 18 bp, Homo sapiens
aaattagtgagatttgta

SEQ ID NO: 5086326 - DNA, 23 bp, Homo sapiens
aaattagtgtacctattaaaagt

SEQ ID NO: 5086327 - DNA, 12 bp, Homo sapiens
aaattagtgttt

SEQ ID NO: 5086328 - DNA, 13 bp, Homo sapiens
aaattagtgtttt

SEQ ID NO: 5086329 - DNA, 13 bp, Homo sapiens
aaattagttatat

SEQ ID NO: 5086330 - DNA, 15 bp, Homo sapiens
aaattagttcccatt

SEQ ID NO: 5086331 - DNA, 16 bp, Homo sapiens
aaattagtttaaaatg

SEQ ID NO: 5086332 - DNA, 19 bp, Homo sapiens
aaattagtttgacactgct

SEQ ID NO: 5086333 - DNA, 23 bp, Homo sapiens
aaattagtttgttatagttgaag

SEQ ID NO: 5086334 - DNA, 20 bp, Homo sapiens
aaattagttttaaaatacta

SEQ ID NO: 5086335 - DNA, 23 bp, Homo sapiens
aaattagttttaaaatactatat

SEQ ID NO: 5086336 - DNA, 15 bp, Homo sapiens
aaattataaactttt

SEQ ID NO: 5086337 - DNA, 19 bp, Homo sapiens
aaattataaagccttcaga

SEQ ID NO: 5086338 - DNA, 17 bp, Homo sapiens
aaattataactattaca

SEQ ID NO: 5086339 - DNA, 21 bp, Homo sapiens
aaattataactattacagtgt

SEQ ID NO: 5086340 - DNA, 19 bp, Homo sapiens
aaattataacttaaaatat

SEQ ID NO: 5086341 - DNA, 12 bp, Homo sapiens
aaattataagaa

SEQ ID NO: 5086342 - DNA, 12 bp, Homo sapiens
aaattataagga

SEQ ID NO: 5086343 - DNA, 23 bp, Homo sapiens
aaattataaggactgcatggtaa

SEQ ID NO: 5086344 - DNA, 15 bp, Homo sapiens
aaattataatgcatc

SEQ ID NO: 5086345 - DNA, 23 bp, Homo sapiens
aaattataatgtattcatatttg

SEQ ID NO: 5086346 - DNA, 23 bp, Homo sapiens
aaattatagaaacaatactgttc

SEQ ID NO: 5086347 - DNA, 13 bp, Homo sapiens
aaattatagaagt

SEQ ID NO: 5086348 - DNA, 18 bp, Homo sapiens
aaattatagctctaatgt

SEQ ID NO: 5086349 - DNA, 21 bp, Homo sapiens
aaattatagctctaatgtttg

SEQ ID NO: 5086350 - DNA, 18 bp, Homo sapiens
aaattataggagacttgt

SEQ ID NO: 5086351 - DNA, 13 bp, Homo sapiens
aaattatatagca

SEQ ID NO: 5086352 - DNA, 14 bp, Homo sapiens
aaattatatagcaa

SEQ ID NO: 5086353 - DNA, 21 bp, Homo sapiens
aaattatatgatatgcatgta

SEQ ID NO: 5086354 - DNA, 23 bp, Homo sapiens
aaattatattctgtttattatga

SEQ ID NO: 5086355 - DNA, 15 bp, Homo sapiens
aaattatatttacct

SEQ ID NO: 5086356 - DNA, 17 bp, Homo sapiens
aaattatcaagctaata

SEQ ID NO: 5086357 - DNA, 23 bp, Homo sapiens
aaattatcaggcaaatttgcatt

SEQ ID NO: 5086358 - DNA, 22 bp, Homo sapiens
aaattatcagttatattttgct

SEQ ID NO: 5086359 - DNA, 21 bp, Homo sapiens
aaattatcctctttgtaattt

SEQ ID NO: 5086360 - DNA, 13 bp, Homo sapiens
aaattatctattt

SEQ ID NO: 5086361 - DNA, 14 bp, Homo sapiens
aaattatctatttg

SEQ ID NO: 5086362 - DNA, 17 bp, Homo sapiens
aaattatctgaatatta

SEQ ID NO: 5086363 - DNA, 12 bp, Homo sapiens
aaattatctgtt

SEQ ID NO: 5086364 - DNA, 18 bp, Homo sapiens
aaattatctgttctatgg

SEQ ID NO: 5086365 - DNA, 20 bp, Homo sapiens
aaattatcttgatacattca

SEQ ID NO: 5086366 - DNA, 14 bp, Homo sapiens
aaattatctttaaa

SEQ ID NO: 5086367 - DNA, 17 bp, Homo sapiens
aaattatctttaaaact

SEQ ID NO: 5086368 - DNA, 17 bp, Homo sapiens
aaattatgaagctcata

SEQ ID NO: 5086369 - DNA, 18 bp, Homo sapiens
aaattatgaatattaaag

SEQ ID NO: 5086370 - DNA, 14 bp, Homo sapiens
aaattatgaatgag

SEQ ID NO: 5086371 - DNA, 20 bp, Homo sapiens
aaattatgaatgagttttac

SEQ ID NO: 5086372 - DNA, 13 bp, Homo sapiens
aaattatgacaat

SEQ ID NO: 5086373 - DNA, 19 bp, Homo sapiens
aaattatgacgtgcacaaa

SEQ ID NO: 5086374 - DNA, 20 bp, Homo sapiens
aaattatgagtgattaagaa

SEQ ID NO: 5086375 - DNA, 19 bp, Homo sapiens
aaattatgcaaaagcagct

SEQ ID NO: 5086376 - DNA, 21 bp, Homo sapiens
aaattatgctaagaatttttt

SEQ ID NO: 5086377 - DNA, 21 bp, Homo sapiens
aaattatggaatatcatctgt

SEQ ID NO: 5086378 - DNA, 23 bp, Homo sapiens
aaattatggaatatcatctgtca

SEQ ID NO: 5086379 - DNA, 16 bp, Homo sapiens
aaattatggcatttct

SEQ ID NO: 5086380 - DNA, 14 bp, Homo sapiens
aaattatggtaaaa

SEQ ID NO: 5086381 - DNA, 14 bp, Homo sapiens
aaattatggtgaaa

SEQ ID NO: 5086382 - DNA, 16 bp, Homo sapiens
aaattatggtgaaatt

SEQ ID NO: 5086383 - DNA, 16 bp, Homo sapiens
aaattatgtataaaca

SEQ ID NO: 5086384 - DNA, 23 bp, Homo sapiens
aaattatgtataaacataagttg

SEQ ID NO: 5086385 - DNA, 19 bp, Homo sapiens
aaattatgtcaaatggatg

SEQ ID NO: 5086386 - DNA, 18 bp, Homo sapiens
aaattatgtgaaatgctt

SEQ ID NO: 5086387 - DNA, 22 bp, Homo sapiens
aaattatgtgacattttacatt

SEQ ID NO: 5086388 - DNA, 23 bp, Homo sapiens
aaattatgttactgtatttttca

SEQ ID NO: 5086389 - DNA, 12 bp, Homo sapiens
aaattatgtttt

SEQ ID NO: 5086390 - DNA, 16 bp, Homo sapiens
aaattatgtttttatt

SEQ ID NO: 5086391 - DNA, 14 bp, Homo sapiens
aaattattaatgaa

SEQ ID NO: 5086392 - DNA, 13 bp, Homo sapiens
aaattattacata

SEQ ID NO: 5086393 - DNA, 12 bp, Homo sapiens
aaattattactt

SEQ ID NO: 5086394 - DNA, 17 bp, Homo sapiens
aaattattactttaaat

SEQ ID NO: 5086395 - DNA, 24 bp, Homo sapiens
aaattattactttaaattatatga

SEQ ID NO: 5086396 - DNA, 13 bp, Homo sapiens
aaattattagaac

SEQ ID NO: 5086397 - DNA, 15 bp, Homo sapiens
aaattattagcattt

SEQ ID NO: 5086398 - DNA, 23 bp, Homo sapiens
aaattattagtttacatcatttt

SEQ ID NO: 5086399 - DNA, 15 bp, Homo sapiens
aaattattatatata

SEQ ID NO: 5086400 - DNA, 21 bp, Homo sapiens
aaattattatcttcttaacag

SEQ ID NO: 5086401 - DNA, 16 bp, Homo sapiens
aaattattatgacacc

SEQ ID NO: 5086402 - DNA, 20 bp, Homo sapiens
aaattattcagttaagaaaa

SEQ ID NO: 5086403 - DNA, 11 bp, Homo sapiens
aaatgtacatc

SEQ ID NO: 5086404 - DNA, 18 bp, Homo sapiens
aaatgtacatcagtttgt

SEQ ID NO: 5086405 - DNA, 16 bp, Homo sapiens
aaatgtacatttattc

SEQ ID NO: 5086406 - DNA, 18 bp, Homo sapiens
aaatgtacatttattcat

SEQ ID NO: 5086407 - DNA, 21 bp, Homo sapiens
aaatgtacatttccaaatgaa

SEQ ID NO: 5086408 - DNA, 17 bp, Homo sapiens
aaatgtaccttctttca

SEQ ID NO: 5086409 - DNA, 21 bp, Homo sapiens
aaatgtactacatttgcatgc

SEQ ID NO: 5086410 - DNA, 22 bp, Homo sapiens
aaatgtactggtaattgtacaa

SEQ ID NO: 5086411 - DNA, 23 bp, Homo sapiens
aaatgtactggtaattgtacaat

SEQ ID NO: 5086412 - DNA, 15 bp, Homo sapiens
aaatgtacttaaatg

SEQ ID NO: 5086413 - DNA, 16 bp, Homo sapiens
aaatgtacttaaatga

SEQ ID NO: 5086414 - DNA, 16 bp, Homo sapiens
aaatgtacttatatta

SEQ ID NO: 5086415 - DNA, 22 bp, Homo sapiens
aaatgtacttatattaagaaaa

SEQ ID NO: 5086416 - DNA, 17 bp, Homo sapiens
aaatgtagaagaaagca

SEQ ID NO: 5086417 - DNA, 20 bp, Homo sapiens
aaatgtagaagaaagcaaaa

SEQ ID NO: 5086418 - DNA, 16 bp, Homo sapiens
aaatgtagaatattca

SEQ ID NO: 5086419 - DNA, 21 bp, Homo sapiens
aaatgtagaattgaaaatgca

SEQ ID NO: 5086420 - DNA, 17 bp, Homo sapiens
aaatgtagacagatatt

SEQ ID NO: 5086421 - DNA, 16 bp, Homo sapiens
aaatgtagcttttatg

SEQ ID NO: 5086422 - DNA, 16 bp, Homo sapiens
aaatgtaggtatgaat

SEQ ID NO: 5086423 - DNA, 16 bp, Homo sapiens
aaatgtagttgatgta

SEQ ID NO: 5086424 - DNA, 14 bp, Homo sapiens
aaatgtagttttaa

SEQ ID NO: 5086425 - DNA, 15 bp, Homo sapiens
aaatgtagttttaaa

SEQ ID NO: 5086426 - DNA, 15 bp, Homo sapiens
aaatgtagttttgta

SEQ ID NO: 5086427 - DNA, 19 bp, Homo sapiens
aaatgtataaaaattatca

SEQ ID NO: 5086428 - DNA, 22 bp, Homo sapiens
aaatgtataattaacttaactg

SEQ ID NO: 5086429 - DNA, 14 bp, Homo sapiens
aaatgtatatacac

SEQ ID NO: 5086430 - DNA, 17 bp, Homo sapiens
aaatgtatatacacata

SEQ ID NO: 5086431 - DNA, 19 bp, Homo sapiens
aaatgtatatacacatata

SEQ ID NO: 5086432 - DNA, 23 bp, Homo sapiens
aaatgtatatacacatataccta

SEQ ID NO: 5086433 - DNA, 14 bp, Homo sapiens
aaatgtatatattt

SEQ ID NO: 5086434 - DNA, 16 bp, Homo sapiens
aaatgtatatatttag

SEQ ID NO: 5086435 - DNA, 17 bp, Homo sapiens
aaatgtatatatttagt

SEQ ID NO: 5086436 - DNA, 18 bp, Homo sapiens
aaatgtatatatttagtg

SEQ ID NO: 5086437 - DNA, 21 bp, Homo sapiens
aaatgtatatatttagtgctg

SEQ ID NO: 5086438 - DNA, 15 bp, Homo sapiens
aaatgtatatgcact

SEQ ID NO: 5086439 - DNA, 21 bp, Homo sapiens
aaatgtatccaaggaaacatt

SEQ ID NO: 5086440 - DNA, 16 bp, Homo sapiens
aaatgtatctgcatat

SEQ ID NO: 5086441 - DNA, 19 bp, Homo sapiens
aaatgtatgcatgttgtct

SEQ ID NO: 5086442 - DNA, 18 bp, Homo sapiens
aaatgtatgtgtgtctat

SEQ ID NO: 5086443 - DNA, 16 bp, Homo sapiens
aaatgtattaactgaa

SEQ ID NO: 5086444 - DNA, 15 bp, Homo sapiens
aaatgtattacagtg

SEQ ID NO: 5086445 - DNA, 13 bp, Homo sapiens
aaatgtattcaag

SEQ ID NO: 5086446 - DNA, 15 bp, Homo sapiens
aaatgtattcattct

SEQ ID NO: 5086447 - DNA, 16 bp, Homo sapiens
aaatgtattgattcaa

SEQ ID NO: 5086448 - DNA, 13 bp, Homo sapiens
aaatgtattggca

SEQ ID NO: 5086449 - DNA, 15 bp, Homo sapiens
aaatgtatttcctga

SEQ ID NO: 5086450 - DNA, 16 bp, Homo sapiens
aaatgtattttacata

SEQ ID NO: 5086451 - DNA, 16 bp, Homo sapiens
aaatgtattttatgtt

SEQ ID NO: 5086452 - DNA, 19 bp, Homo sapiens
aaatgtattttatgttata

SEQ ID NO: 5086453 - DNA, 22 bp, Homo sapiens
aaatgtattttgaagaatattt

SEQ ID NO: 5086454 - DNA, 15 bp, Homo sapiens
aaatgtatttttcta

SEQ ID NO: 5086455 - DNA, 15 bp, Homo sapiens
aaatgtcaaattgat

SEQ ID NO: 5086456 - DNA, 13 bp, Homo sapiens
aaatgtcaagaca

SEQ ID NO: 5086457 - DNA, 16 bp, Homo sapiens
aaatgtcaatagcaaa

SEQ ID NO: 5086458 - DNA, 17 bp, Homo sapiens
aaatgtcacacttgttt

SEQ ID NO: 5086459 - DNA, 19 bp, Homo sapiens
aaatgtcactgttataaat

SEQ ID NO: 5086460 - DNA, 20 bp, Homo sapiens
aaatgtcactgttataaatt

SEQ ID NO: 5086461 - DNA, 19 bp, Homo sapiens
aaatgtcacttcatatttt

SEQ ID NO: 5086462 - DNA, 22 bp, Homo sapiens
aaatgtcagatacaatgtattt

SEQ ID NO: 5086463 - DNA, 21 bp, Homo sapiens
aaatgtcagtgtttgggaaat

SEQ ID NO: 5086464 - DNA, 16 bp, Homo sapiens
aaatgtcagttctgat

SEQ ID NO: 5086465 - DNA, 12 bp, Homo sapiens
aaatgtcataaa

SEQ ID NO: 5086466 - DNA, 20 bp, Homo sapiens
aaatgtcatgagattgctgt

SEQ ID NO: 5086467 - DNA, 18 bp, Homo sapiens
aaatgtcattgtctactc

SEQ ID NO: 5086468 - DNA, 14 bp, Homo sapiens
aaatgtcatttcat

SEQ ID NO: 5086469 - DNA, 15 bp, Homo sapiens
aaatgtccaaaatgt

SEQ ID NO: 5086470 - DNA, 22 bp, Homo sapiens
aaatgtccagccacccccaggc

SEQ ID NO: 5086471 - DNA, 13 bp, Homo sapiens
aaatgtccctgca

SEQ ID NO: 5086472 - DNA, 21 bp, Homo sapiens
aaatgtcctgcaatttaggat

SEQ ID NO: 5086473 - DNA, 13 bp, Homo sapiens
aaatgtcctgcat

SEQ ID NO: 5086474 - DNA, 15 bp, Homo sapiens
aaatgtccttgtgat

SEQ ID NO: 5086475 - DNA, 18 bp, Homo sapiens
aaatgtcctttctcagag

SEQ ID NO: 5086476 - DNA, 11 bp, Homo sapiens
aaatgtctaat

SEQ ID NO: 5086477 - DNA, 18 bp, Homo sapiens
aaatgtctaatagcccat

SEQ ID NO: 5086478 - DNA, 18 bp, Homo sapiens
aaatgtctaatgtatttt

SEQ ID NO: 5086479 - DNA, 16 bp, Homo sapiens
aaatgtctattaaggt

SEQ ID NO: 5086480 - DNA, 14 bp, Homo sapiens
aaatgtctattatt

SEQ ID NO: 5086481 - DNA, 17 bp, Homo sapiens
aaatgtctcactgagca

SEQ ID NO: 5086482 - DNA, 18 bp, Homo sapiens
aaatgtctgacacattaa

SEQ ID NO: 5086483 - DNA, 12 bp, Homo sapiens
aaatgtctgctg

SEQ ID NO: 5086484 - DNA, 13 bp, Homo sapiens
aaatgtctgctgg

SEQ ID NO: 5086485 - DNA, 19 bp, Homo sapiens
aaatgtctggagaataatt

SEQ ID NO: 5086486 - DNA, 18 bp, Homo sapiens
aaatgtcttatatagcag

SEQ ID NO: 5086487 - DNA, 12 bp, Homo sapiens
aaatgtcttgct

SEQ ID NO: 5086488 - DNA, 23 bp, Homo sapiens
aaatgtcttgctgttgacatatt

SEQ ID NO: 5086489 - DNA, 12 bp, Homo sapiens
aaatgtcttggt

SEQ ID NO: 5086490 - DNA, 14 bp, Homo sapiens
aaatgtctttaatg

SEQ ID NO: 5086491 - DNA, 21 bp, Homo sapiens
aaatgtctttccaaattattt

SEQ ID NO: 5086492 - DNA, 14 bp, Homo sapiens
aaatgtctttctat

SEQ ID NO: 5086493 - DNA, 22 bp, Homo sapiens
aaatgtctttctattcataata

SEQ ID NO: 5086494 - DNA, 15 bp, Homo sapiens
aaatgtctttgtaag

SEQ ID NO: 5086495 - DNA, 16 bp, Homo sapiens
aaatgtctttgtaagt

SEQ ID NO: 5086496 - DNA, 19 bp, Homo sapiens
aaatgtgaaagatgcatgt

SEQ ID NO: 5086497 - DNA, 11 bp, Homo sapiens
aaatgtgaaat

SEQ ID NO: 5086498 - DNA, 20 bp, Homo sapiens
aaatgtgaaatccctaccat

SEQ ID NO: 5086499 - DNA, 15 bp, Homo sapiens
aaatgtgaagatgca

SEQ ID NO: 5086500 - DNA, 22 bp, Homo sapiens
aaatgtgaatggaaacttggaa

SEQ ID NO: 5086501 - DNA, 11 bp, Homo sapiens
aaatgtgaatt

SEQ ID NO: 5086502 - DNA, 23 bp, Homo sapiens
aaatgtgaattactaacttctaa

SEQ ID NO: 5086503 - DNA, 12 bp, Homo sapiens
aaatgtgaattt

SEQ ID NO: 5086504 - DNA, 19 bp, Homo sapiens
aaatgtgaatttcaacttt

SEQ ID NO: 5086505 - DNA, 17 bp, Homo sapiens
aaatgtgaatttttatt

SEQ ID NO: 5086506 - DNA, 21 bp, Homo sapiens
aaatgtgaatttttattgttg

SEQ ID NO: 5086507 - DNA, 21 bp, Homo sapiens
aaatgtgactggttcagaaat

SEQ ID NO: 5086508 - DNA, 14 bp, Homo sapiens
aaatgtgacttggc

SEQ ID NO: 5086509 - DNA, 13 bp, Homo sapiens
aaatgtgagaaat

SEQ ID NO: 5086510 - DNA, 14 bp, Homo sapiens
aaatgtgagaaatg

SEQ ID NO: 5086511 - DNA, 17 bp, Homo sapiens
aaatgtgagaaatgtct

SEQ ID NO: 5086512 - DNA, 15 bp, Homo sapiens
aaatgtgaggcaata

SEQ ID NO: 5086513 - DNA, 13 bp, Homo sapiens
aaatgtgatgaat

SEQ ID NO: 5086514 - DNA, 22 bp, Homo sapiens
aaatgtgatgcttataataaag

SEQ ID NO: 5086515 - DNA, 18 bp, Homo sapiens
aaatgtgatgttctaagg

SEQ ID NO: 5086516 - DNA, 19 bp, Homo sapiens
aaatgtgatgttctaaggc

SEQ ID NO: 5086517 - DNA, 20 bp, Homo sapiens
aaatgtgatgttctaaggct

SEQ ID NO: 5086518 - DNA, 22 bp, Homo sapiens
aaatgtgatgttctaaggctct

SEQ ID NO: 5086519 - DNA, 23 bp, Homo sapiens
aaatgtgatttgtcttcccttct

SEQ ID NO: 5086520 - DNA, 15 bp, Homo sapiens
aaatgtgatttttct

SEQ ID NO: 5086521 - DNA, 13 bp, Homo sapiens
aaatgtgcaagag

SEQ ID NO: 5086522 - DNA, 22 bp, Homo sapiens
aaatgtgcaatttgtaaatatt

SEQ ID NO: 5086523 - DNA, 11 bp, Homo sapiens
aaatgtgcagt

SEQ ID NO: 5086524 - DNA, 12 bp, Homo sapiens
aaatgtgcagta

SEQ ID NO: 5086525 - DNA, 15 bp, Homo sapiens
aaatgtgcattttgt

SEQ ID NO: 5086526 - DNA, 21 bp, Homo sapiens
aaatgtgctaaagttggaaag

SEQ ID NO: 5086527 - DNA, 22 bp, Homo sapiens
aaatgtgctcaaattactaatg

SEQ ID NO: 5086528 - DNA, 16 bp, Homo sapiens
aaatgtgctttgagaa

SEQ ID NO: 5086529 - DNA, 21 bp, Homo sapiens
aaatgtggagaagagtgccct

SEQ ID NO: 5086530 - DNA, 19 bp, Homo sapiens
aaatgtggattttgtagat

SEQ ID NO: 5086531 - DNA, 18 bp, Homo sapiens
aaatgtggccaagcctat

SEQ ID NO: 5086532 - DNA, 15 bp, Homo sapiens
aaatgtggctcctgg

SEQ ID NO: 5086533 - DNA, 16 bp, Homo sapiens
aaatgtggctgtaaaa

SEQ ID NO: 5086534 - DNA, 19 bp, Homo sapiens
aaatgtggttgcttaattc

SEQ ID NO: 5086535 - DNA, 19 bp, Homo sapiens
aaatgtgtaaatgtggaca

SEQ ID NO: 5086536 - DNA, 23 bp, Homo sapiens
aaatgtgtacaatgtacacactg

SEQ ID NO: 5086537 - DNA, 13 bp, Homo sapiens
aaatgtgtacagt

SEQ ID NO: 5086538 - DNA, 17 bp, Homo sapiens
aaatgtgtacagtgaat

SEQ ID NO: 5086539 - DNA, 22 bp, Homo sapiens
aaatgtgtacagtgaattgtct

SEQ ID NO: 5086540 - DNA, 24 bp, Homo sapiens
aaatgtgtacagtgaattgtcttt

SEQ ID NO: 5086541 - DNA, 20 bp, Homo sapiens
aaatgtgtatcggatgcttt

SEQ ID NO: 5086542 - DNA, 20 bp, Homo sapiens
aaatgtgtatttcttaagaa

SEQ ID NO: 5086543 - DNA, 15 bp, Homo sapiens
aaatgtgtattttaa

SEQ ID NO: 5086544 - DNA, 22 bp, Homo sapiens
aaatgtgtatttttgttgcagt

SEQ ID NO: 5086545 - DNA, 14 bp, Homo sapiens
aaatgtgtcagaat

SEQ ID NO: 5086546 - DNA, 20 bp, Homo sapiens
aaatgtgtcctatctatctt

SEQ ID NO: 5086547 - DNA, 15 bp, Homo sapiens
aaatgtgtctctgct

SEQ ID NO: 5086548 - DNA, 17 bp, Homo sapiens
aaatgtgtcttgtatta

SEQ ID NO: 5086549 - DNA, 20 bp, Homo sapiens
aaatgtgtcttgtattatca

SEQ ID NO: 5086550 - DNA, 21 bp, Homo sapiens
aaatgtgtgccatattctggt

SEQ ID NO: 5086551 - DNA, 16 bp, Homo sapiens
aaatgtgtggtgctaa

SEQ ID NO: 5086552 - DNA, 18 bp, Homo sapiens
aaatgtgtgtaaaaaagt

SEQ ID NO: 5086553 - DNA, 22 bp, Homo sapiens
aaatgtgtgtgatgtgacattt

SEQ ID NO: 5086554 - DNA, 23 bp, Homo sapiens
aaatgtgtgtgatgtgacatttg

SEQ ID NO: 5086555 - DNA, 12 bp, Homo sapiens
aaatgtgtgtgt

SEQ ID NO: 5086556 - DNA, 15 bp, Homo sapiens
aaatgtgtgttgact

SEQ ID NO: 5086557 - DNA, 21 bp, Homo sapiens
aaatgtgtgttgtaacaaata

SEQ ID NO: 5086558 - DNA, 23 bp, Homo sapiens
aaatgtgtgtttttttagggttt

SEQ ID NO: 5086559 - DNA, 21 bp, Homo sapiens
aaatgtgttagcactgatagt

SEQ ID NO: 5086560 - DNA, 15 bp, Homo sapiens
aaatgtgtttccttt

SEQ ID NO: 5086561 - DNA, 13 bp, Homo sapiens
aaatgtgtttgct

SEQ ID NO: 5086562 - DNA, 16 bp, Homo sapiens
aaatgtgttttggtcc

SEQ ID NO: 5086563 - DNA, 16 bp, Homo sapiens
aaatgtgtttttctat

SEQ ID NO: 5086564 - DNA, 19 bp, Homo sapiens
aaatgtgtttttctatata

SEQ ID NO: 5086565 - DNA, 14 bp, Homo sapiens
aaatgttaaaagtt

SEQ ID NO: 5086566 - DNA, 16 bp, Homo sapiens
aaatgttaaaagtttt

SEQ ID NO: 5086567 - DNA, 14 bp, Homo sapiens
aaatgttaaaatgt

SEQ ID NO: 5086568 - DNA, 16 bp, Homo sapiens
aaatgttaaaatgtat

SEQ ID NO: 5086569 - DNA, 16 bp, Homo sapiens
aaatgttaaaccctta

SEQ ID NO: 5086570 - DNA, 11 bp, Homo sapiens
aaatgttaact

SEQ ID NO: 5086571 - DNA, 13 bp, Homo sapiens
aaatgttaagaaa

SEQ ID NO: 5086572 - DNA, 15 bp, Homo sapiens
aaatgttaagaaaga

SEQ ID NO: 5086573 - DNA, 22 bp, Homo sapiens
aaatgttaatgagaaaatggct

SEQ ID NO: 5086574 - DNA, 23 bp, Homo sapiens
aaatgttacacattaaacaggat

SEQ ID NO: 5086575 - DNA, 17 bp, Homo sapiens
aaatgttacatagtgta

SEQ ID NO: 5086576 - DNA, 21 bp, Homo sapiens
aaatgttacatagtgtaggct

SEQ ID NO: 5086577 - DNA, 23 bp, Homo sapiens
aaatgttaccagtgttaataaat

SEQ ID NO: 5086578 - DNA, 15 bp, Homo sapiens
aaatgttacctctga

SEQ ID NO: 5086579 - DNA, 19 bp, Homo sapiens
aaatgttacctctgaattt

SEQ ID NO: 5086580 - DNA, 16 bp, Homo sapiens
aaatgttacttctgat

SEQ ID NO: 5086581 - DNA, 13 bp, Homo sapiens
aaatgttagactt

SEQ ID NO: 5086582 - DNA, 12 bp, Homo sapiens
aaattattctag

SEQ ID NO: 5086583 - DNA, 21 bp, Homo sapiens
aaattattgtaaactttttca

SEQ ID NO: 5086584 - DNA, 23 bp, Homo sapiens
aaattattgtaaactttttcaat

SEQ ID NO: 5086585 - DNA, 20 bp, Homo sapiens
aaattattgtttttcttttt

SEQ ID NO: 5086586 - DNA, 12 bp, Homo sapiens
aaattatttaaa

SEQ ID NO: 5086587 - DNA, 15 bp, Homo sapiens
aaattatttaatatg

SEQ ID NO: 5086588 - DNA, 18 bp, Homo sapiens
aaattatttaatatgcat

SEQ ID NO: 5086589 - DNA, 15 bp, Homo sapiens
aaattatttattatt

SEQ ID NO: 5086590 - DNA, 13 bp, Homo sapiens
aaattatttcaga

SEQ ID NO: 5086591 - DNA, 12 bp, Homo sapiens
aaattatttctt

SEQ ID NO: 5086592 - DNA, 14 bp, Homo sapiens
aaattatttcttaa

SEQ ID NO: 5086593 - DNA, 22 bp, Homo sapiens
aaattatttcttaattattata

SEQ ID NO: 5086594 - DNA, 13 bp, Homo sapiens
aaattatttgaaa

SEQ ID NO: 5086595 - DNA, 17 bp, Homo sapiens
aaattatttgattattt

SEQ ID NO: 5086596 - DNA, 19 bp, Homo sapiens
aaattatttgccttttaaa

SEQ ID NO: 5086597 - DNA, 13 bp, Homo sapiens
aaattatttgtgt

SEQ ID NO: 5086598 - DNA, 21 bp, Homo sapiens
aaattatttgtgtaatagaaa

SEQ ID NO: 5086599 - DNA, 22 bp, Homo sapiens
aaattatttgtgtaatagaaaa

SEQ ID NO: 5086600 - DNA, 22 bp, Homo sapiens
aaattatttgtgttgggggaaa

SEQ ID NO: 5086601 - DNA, 15 bp, Homo sapiens
aaattattttaaaca

SEQ ID NO: 5086602 - DNA, 16 bp, Homo sapiens
aaattattttaaatta

SEQ ID NO: 5086603 - DNA, 17 bp, Homo sapiens
aaattattttaatattt

SEQ ID NO: 5086604 - DNA, 20 bp, Homo sapiens
aaattattttaatattttgt

SEQ ID NO: 5086605 - DNA, 14 bp, Homo sapiens
aaattattttatat

SEQ ID NO: 5086606 - DNA, 13 bp, Homo sapiens
aaattattttatc

SEQ ID NO: 5086607 - DNA, 19 bp, Homo sapiens
aaattattttatgtcatag

SEQ ID NO: 5086608 - DNA, 13 bp, Homo sapiens
aaattattttgac

SEQ ID NO: 5086609 - DNA, 21 bp, Homo sapiens
aaattattttgttagtggaaa

SEQ ID NO: 5086610 - DNA, 20 bp, Homo sapiens
aaattattttgttcatacat

SEQ ID NO: 5086611 - DNA, 21 bp, Homo sapiens
aaattatttttaaaagaaaaa

SEQ ID NO: 5086612 - DNA, 19 bp, Homo sapiens
aaattatttttaagaaatc

SEQ ID NO: 5086613 - DNA, 23 bp, Homo sapiens
aaattatttttatacaccattgt

SEQ ID NO: 5086614 - DNA, 14 bp, Homo sapiens
aaattatttttatt

SEQ ID NO: 5086615 - DNA, 23 bp, Homo sapiens
aaattattttttgcatcatttaa

SEQ ID NO: 5086616 - DNA, 15 bp, Homo sapiens
aaattcaaaaagaac

SEQ ID NO: 5086617 - DNA, 17 bp, Homo sapiens
aaattcaaaatgctcta

SEQ ID NO: 5086618 - DNA, 13 bp, Homo sapiens
aaattcaaaccat

SEQ ID NO: 5086619 - DNA, 16 bp, Homo sapiens
aaattcaacaaacatt

SEQ ID NO: 5086620 - DNA, 16 bp, Homo sapiens
aaattcaacaaatgat

SEQ ID NO: 5086621 - DNA, 16 bp, Homo sapiens
aaattcaaccacagat

SEQ ID NO: 5086622 - DNA, 21 bp, Homo sapiens
aaattcaacgttaataattct

SEQ ID NO: 5086623 - DNA, 16 bp, Homo sapiens
aaattcaactttgtaa

SEQ ID NO: 5086624 - DNA, 16 bp, Homo sapiens
aaattcaagaaaataa

SEQ ID NO: 5086625 - DNA, 17 bp, Homo sapiens
aaattcaagaaaataaa

SEQ ID NO: 5086626 - DNA, 21 bp, Homo sapiens
aaattcaagagctagaaaaat

SEQ ID NO: 5086627 - DNA, 22 bp, Homo sapiens
aaattcaagagctagaaaaata

SEQ ID NO: 5086628 - DNA, 20 bp, Homo sapiens
aaattcaaggagatataaaa

SEQ ID NO: 5086629 - DNA, 14 bp, Homo sapiens
aaattcaatagtaa

SEQ ID NO: 5086630 - DNA, 13 bp, Homo sapiens
aaattcaatgatt

SEQ ID NO: 5086631 - DNA, 15 bp, Homo sapiens
aaattcaatgattct

SEQ ID NO: 5086632 - DNA, 17 bp, Homo sapiens
aaattcaattgtaaatt

SEQ ID NO: 5086633 - DNA, 14 bp, Homo sapiens
aaattcacaaactt

SEQ ID NO: 5086634 - DNA, 19 bp, Homo sapiens
aaattcacaagttgtgttt

SEQ ID NO: 5086635 - DNA, 21 bp, Homo sapiens
aaattcacatcctcagaaagt

SEQ ID NO: 5086636 - DNA, 21 bp, Homo sapiens
aaattcacccccatccacagt

SEQ ID NO: 5086637 - DNA, 17 bp, Homo sapiens
aaattcactaatcttga

SEQ ID NO: 5086638 - DNA, 16 bp, Homo sapiens
aaattcactattggct

SEQ ID NO: 5086639 - DNA, 18 bp, Homo sapiens
aaattcactattggctgg

SEQ ID NO: 5086640 - DNA, 16 bp, Homo sapiens
aaattcactgttgaat

SEQ ID NO: 5086641 - DNA, 17 bp, Homo sapiens
aaattcactgttgaatg

SEQ ID NO: 5086642 - DNA, 21 bp, Homo sapiens
aaattcactgtttcactgaaa

SEQ ID NO: 5086643 - DNA, 13 bp, Homo sapiens
aaattcagacaac

SEQ ID NO: 5086644 - DNA, 17 bp, Homo sapiens
aaattcagacaacatta

SEQ ID NO: 5086645 - DNA, 18 bp, Homo sapiens
aaattcagacaacattat

SEQ ID NO: 5086646 - DNA, 21 bp, Homo sapiens
aaattcagacaacattatgat

SEQ ID NO: 5086647 - DNA, 19 bp, Homo sapiens
aaattcagagcaagttcct

SEQ ID NO: 5086648 - DNA, 16 bp, Homo sapiens
aaattcagataatggt

SEQ ID NO: 5086649 - DNA, 24 bp, Homo sapiens
aaattcagataatggtaatttagt

SEQ ID NO: 5086650 - DNA, 21 bp, Homo sapiens
aaattcagatcaaaatgcctt

SEQ ID NO: 5086651 - DNA, 15 bp, Homo sapiens
aaattcagcatttga

SEQ ID NO: 5086652 - DNA, 13 bp, Homo sapiens
aaattcagctcct

SEQ ID NO: 5086653 - DNA, 13 bp, Homo sapiens
aaattcagctctg

SEQ ID NO: 5086654 - DNA, 14 bp, Homo sapiens
aaattcagggcttt

SEQ ID NO: 5086655 - DNA, 16 bp, Homo sapiens
aaattcaggtacagaa

SEQ ID NO: 5086656 - DNA, 13 bp, Homo sapiens
aaattcagtattt

SEQ ID NO: 5086657 - DNA, 17 bp, Homo sapiens
aaattcagtattttgcc

SEQ ID NO: 5086658 - DNA, 12 bp, Homo sapiens
aaattcagtctt

SEQ ID NO: 5086659 - DNA, 16 bp, Homo sapiens
aaattcagtttttgta

SEQ ID NO: 5086660 - DNA, 18 bp, Homo sapiens
aaattcagtttttgtatc

SEQ ID NO: 5086661 - DNA, 19 bp, Homo sapiens
aaattcataaccaaagaga

SEQ ID NO: 5086662 - DNA, 13 bp, Homo sapiens
aaattcatattat

SEQ ID NO: 5086663 - DNA, 19 bp, Homo sapiens
aaattcatggaactttcat

SEQ ID NO: 5086664 - DNA, 17 bp, Homo sapiens
aaattcattaaagaaaa

SEQ ID NO: 5086665 - DNA, 16 bp, Homo sapiens
aaattcatttcacatt

SEQ ID NO: 5086666 - DNA, 12 bp, Homo sapiens
aaattcatttct

SEQ ID NO: 5086667 - DNA, 12 bp, Homo sapiens
aaattcatttgt

SEQ ID NO: 5086668 - DNA, 12 bp, Homo sapiens
aaattcatttta

SEQ ID NO: 5086669 - DNA, 13 bp, Homo sapiens
aaattcattttta

SEQ ID NO: 5086670 - DNA, 13 bp, Homo sapiens
aaattccaaactt

SEQ ID NO: 5086671 - DNA, 12 bp, Homo sapiens
aaattccaaagt

SEQ ID NO: 5086672 - DNA, 14 bp, Homo sapiens
aaattccaaagtct

SEQ ID NO: 5086673 - DNA, 18 bp, Homo sapiens
aaattccaaagtctctaa

SEQ ID NO: 5086674 - DNA, 21 bp, Homo sapiens
aaattccaaagtctctaattc

SEQ ID NO: 5086675 - DNA, 15 bp, Homo sapiens
aaattccaaattttt

SEQ ID NO: 5086676 - DNA, 17 bp, Homo sapiens
aaattccaagtgattga

SEQ ID NO: 5086677 - DNA, 14 bp, Homo sapiens
aaattccactgaaa

SEQ ID NO: 5086678 - DNA, 17 bp, Homo sapiens
aaattccactgaaaatt

SEQ ID NO: 5086679 - DNA, 22 bp, Homo sapiens
aaattccactgaaaatttaaca

SEQ ID NO: 5086680 - DNA, 13 bp, Homo sapiens
aaattccagaatg

SEQ ID NO: 5086681 - DNA, 19 bp, Homo sapiens
aaattccagaggactctgc

SEQ ID NO: 5086682 - DNA, 24 bp, Homo sapiens
aaattccagaggactctgcttaaa

SEQ ID NO: 5086683 - DNA, 13 bp, Homo sapiens
aaattccatgttt

SEQ ID NO: 5086684 - DNA, 17 bp, Homo sapiens
aaattcccgtgttgctt

SEQ ID NO: 5086685 - DNA, 14 bp, Homo sapiens
aaattccctctgga

SEQ ID NO: 5086686 - DNA, 17 bp, Homo sapiens
aaattccctctggagtt

SEQ ID NO: 5086687 - DNA, 23 bp, Homo sapiens
aaattccctctggagtttcatgt

SEQ ID NO: 5086688 - DNA, 15 bp, Homo sapiens
aaattccctggcctt

SEQ ID NO: 5086689 - DNA, 18 bp, Homo sapiens
aaattcccttcatctgga

SEQ ID NO: 5086690 - DNA, 24 bp, Homo sapiens
aaattcctaagaatcagagtagaa

SEQ ID NO: 5086691 - DNA, 11 bp, Homo sapiens
aaattcctaat

SEQ ID NO: 5086692 - DNA, 16 bp, Homo sapiens
aaattcctattgtgat

SEQ ID NO: 5086693 - DNA, 19 bp, Homo sapiens
aaattcctcaacagtgttt

SEQ ID NO: 5086694 - DNA, 14 bp, Homo sapiens
aaattcctctgtag

SEQ ID NO: 5086695 - DNA, 18 bp, Homo sapiens
aaattcctctttgctttg

SEQ ID NO: 5086696 - DNA, 15 bp, Homo sapiens
aaattcctgcttaat

SEQ ID NO: 5086697 - DNA, 12 bp, Homo sapiens
aaattcctgttg

SEQ ID NO: 5086698 - DNA, 13 bp, Homo sapiens
aaattcctgttgt

SEQ ID NO: 5086699 - DNA, 18 bp, Homo sapiens
aaattcctttcagagttt

SEQ ID NO: 5086700 - DNA, 18 bp, Homo sapiens
aaattcgacctgatttac

SEQ ID NO: 5086701 - DNA, 14 bp, Homo sapiens
aaattcgcatgttt

SEQ ID NO: 5086702 - DNA, 15 bp, Homo sapiens
aaattcgcatgttta

SEQ ID NO: 5086703 - DNA, 14 bp, Homo sapiens
aaattcgctttcta

SEQ ID NO: 5086704 - DNA, 22 bp, Homo sapiens
aaattctaaataaaatataatt

SEQ ID NO: 5086705 - DNA, 14 bp, Homo sapiens
aaattctaaattac

SEQ ID NO: 5086706 - DNA, 15 bp, Homo sapiens
aaattctacaacaca

SEQ ID NO: 5086707 - DNA, 19 bp, Homo sapiens
aaattctactaagttattt

SEQ ID NO: 5086708 - DNA, 22 bp, Homo sapiens
aaattctactaagttattttat

SEQ ID NO: 5086709 - DNA, 20 bp, Homo sapiens
aaattctagtctgtttcatt

SEQ ID NO: 5086710 - DNA, 15 bp, Homo sapiens
aaattctataagaga

SEQ ID NO: 5086711 - DNA, 17 bp, Homo sapiens
aaattctataagagaca

SEQ ID NO: 5086712 - DNA, 20 bp, Homo sapiens
aaattctatatgatcctgaa

SEQ ID NO: 5086713 - DNA, 13 bp, Homo sapiens
aaattctatggaa

SEQ ID NO: 5086714 - DNA, 16 bp, Homo sapiens
aaattctatgttaaat

SEQ ID NO: 5086715 - DNA, 20 bp, Homo sapiens
aaattctatgttaaatactg

SEQ ID NO: 5086716 - DNA, 22 bp, Homo sapiens
aaattctattgaaaacagtgtc

SEQ ID NO: 5086717 - DNA, 18 bp, Homo sapiens
aaattctcaaagttttat

SEQ ID NO: 5086718 - DNA, 17 bp, Homo sapiens
aaattctcaagtgatag

SEQ ID NO: 5086719 - DNA, 11 bp, Homo sapiens
aaattctcaga

SEQ ID NO: 5086720 - DNA, 12 bp, Homo sapiens
aaattctcagag

SEQ ID NO: 5086721 - DNA, 12 bp, Homo sapiens
aaattctccaac

SEQ ID NO: 5086722 - DNA, 16 bp, Homo sapiens
aaattctcctggaggt

SEQ ID NO: 5086723 - DNA, 13 bp, Homo sapiens
aaattctctccta

SEQ ID NO: 5086724 - DNA, 16 bp, Homo sapiens
aaattctcttaaataa

SEQ ID NO: 5086725 - DNA, 17 bp, Homo sapiens
aaattctcttaaataaa

SEQ ID NO: 5086726 - DNA, 21 bp, Homo sapiens
aaattctgaaaactgaatgtc

SEQ ID NO: 5086727 - DNA, 19 bp, Homo sapiens
aaattctgaatttgcaaag

SEQ ID NO: 5086728 - DNA, 17 bp, Homo sapiens
aaattctgaattttggt

SEQ ID NO: 5086729 - DNA, 15 bp, Homo sapiens
aaattctgatacatt

SEQ ID NO: 5086730 - DNA, 18 bp, Homo sapiens
aaattctgatgtttctgt

SEQ ID NO: 5086731 - DNA, 18 bp, Homo sapiens
aaattctgattattacaa

SEQ ID NO: 5086732 - DNA, 12 bp, Homo sapiens
aaattctgattc

SEQ ID NO: 5086733 - DNA, 14 bp, Homo sapiens
aaattctgattctt

SEQ ID NO: 5086734 - DNA, 17 bp, Homo sapiens
aaattctgattcttcta

SEQ ID NO: 5086735 - DNA, 14 bp, Homo sapiens
aaattctgatttct

SEQ ID NO: 5086736 - DNA, 17 bp, Homo sapiens
aaattctgatttctttt

SEQ ID NO: 5086737 - DNA, 22 bp, Homo sapiens
aaattctgatttcttttcacca

SEQ ID NO: 5086738 - DNA, 22 bp, Homo sapiens
aaattctgccttattatttctt

SEQ ID NO: 5086739 - DNA, 14 bp, Homo sapiens
aaattctgctgctt

SEQ ID NO: 5086740 - DNA, 13 bp, Homo sapiens
aaattctgctgtt

SEQ ID NO: 5086741 - DNA, 14 bp, Homo sapiens
aaattctgctgtta

SEQ ID NO: 5086742 - DNA, 20 bp, Homo sapiens
aaattctgggcctaattttt

SEQ ID NO: 5086743 - DNA, 18 bp, Homo sapiens
aaattctggtatacattg

SEQ ID NO: 5086744 - DNA, 13 bp, Homo sapiens
aaattctgtaatt

SEQ ID NO: 5086745 - DNA, 11 bp, Homo sapiens
aaattctgtgg

SEQ ID NO: 5086746 - DNA, 17 bp, Homo sapiens
aaattctgttaaaatct

SEQ ID NO: 5086747 - DNA, 19 bp, Homo sapiens
aaattctgttaaaatctat

SEQ ID NO: 5086748 - DNA, 20 bp, Homo sapiens
aaattctgttaaaatctatt

SEQ ID NO: 5086749 - DNA, 19 bp, Homo sapiens
aaattctgttagctgctca

SEQ ID NO: 5086750 - DNA, 13 bp, Homo sapiens
aaattctgtttct

SEQ ID NO: 5086751 - DNA, 12 bp, Homo sapiens
aaattctgtttt

SEQ ID NO: 5086752 - DNA, 21 bp, Homo sapiens
aaattcttattggccaaatgc

SEQ ID NO: 5086753 - DNA, 23 bp, Homo sapiens
aaattcttattggccaaatgcct

SEQ ID NO: 5086754 - DNA, 21 bp, Homo sapiens
aaattcttcaagaaagaattc

SEQ ID NO: 5086755 - DNA, 18 bp, Homo sapiens
aaattcttcaatttgaaa

SEQ ID NO: 5086756 - DNA, 21 bp, Homo sapiens
aaattcttgcaaagtatccct

SEQ ID NO: 5086757 - DNA, 14 bp, Homo sapiens
aaattcttgcactg

SEQ ID NO: 5086758 - DNA, 21 bp, Homo sapiens
aaattcttgcactgtatccaa

SEQ ID NO: 5086759 - DNA, 19 bp, Homo sapiens
aaattctttcctaccttgg

SEQ ID NO: 5086760 - DNA, 23 bp, Homo sapiens
aaattcttttttaaattttcttc

SEQ ID NO: 5086761 - DNA, 13 bp, Homo sapiens
aaattgaaaaaag

SEQ ID NO: 5086762 - DNA, 20 bp, Homo sapiens
aaattgaaaaataaaaacca

SEQ ID NO: 5086763 - DNA, 15 bp, Homo sapiens
aaatgttagacttgt

SEQ ID NO: 5086764 - DNA, 15 bp, Homo sapiens
aaatgttagcaagat

SEQ ID NO: 5086765 - DNA, 18 bp, Homo sapiens
aaatgttagtcattgtta

SEQ ID NO: 5086766 - DNA, 14 bp, Homo sapiens
aaatgttatgactc

SEQ ID NO: 5086767 - DNA, 15 bp, Homo sapiens
aaatgttatgactcc

SEQ ID NO: 5086768 - DNA, 12 bp, Homo sapiens
aaatgttatgta

SEQ ID NO: 5086769 - DNA, 13 bp, Homo sapiens
aaatgttatgtat

SEQ ID NO: 5086770 - DNA, 14 bp, Homo sapiens
aaatgttatgtata

SEQ ID NO: 5086771 - DNA, 23 bp, Homo sapiens
aaatgttatgtatatggtggtaa

SEQ ID NO: 5086772 - DNA, 16 bp, Homo sapiens
aaatgttcacttttga

SEQ ID NO: 5086773 - DNA, 14 bp, Homo sapiens
aaatgttcatgatt

SEQ ID NO: 5086774 - DNA, 12 bp, Homo sapiens
aaatgttcattc

SEQ ID NO: 5086775 - DNA, 17 bp, Homo sapiens
aaatgttcccttgacca

SEQ ID NO: 5086776 - DNA, 20 bp, Homo sapiens
aaatgttcccttgaccattg

SEQ ID NO: 5086777 - DNA, 13 bp, Homo sapiens
aaatgttctaagt

SEQ ID NO: 5086778 - DNA, 13 bp, Homo sapiens
aaatgttctatat

SEQ ID NO: 5086779 - DNA, 18 bp, Homo sapiens
aaatgttctcgttttgaa

SEQ ID NO: 5086780 - DNA, 13 bp, Homo sapiens
aaatgttcttcca

SEQ ID NO: 5086781 - DNA, 15 bp, Homo sapiens
aaatgttctttgggg

SEQ ID NO: 5086782 - DNA, 15 bp, Homo sapiens
aaatgttgaaatctt

SEQ ID NO: 5086783 - DNA, 18 bp, Homo sapiens
aaatgttgaaatcttaaa

SEQ ID NO: 5086784 - DNA, 20 bp, Homo sapiens
aaatgttgacatacctttta

SEQ ID NO: 5086785 - DNA, 22 bp, Homo sapiens
aaatgttgacataccttttatt

SEQ ID NO: 5086786 - DNA, 23 bp, Homo sapiens
aaatgttgacatgggacatttgc

SEQ ID NO: 5086787 - DNA, 16 bp, Homo sapiens
aaatgttgagaagcgt

SEQ ID NO: 5086788 - DNA, 22 bp, Homo sapiens
aaatgttgctctaatcagattg

SEQ ID NO: 5086789 - DNA, 23 bp, Homo sapiens
aaatgttgctctgggagacttac

SEQ ID NO: 5086790 - DNA, 11 bp, Homo sapiens
aaatgttgctg

SEQ ID NO: 5086791 - DNA, 17 bp, Homo sapiens
aaatgttggaatgttat

SEQ ID NO: 5086792 - DNA, 18 bp, Homo sapiens
aaatgttggatttataaa

SEQ ID NO: 5086793 - DNA, 21 bp, Homo sapiens
aaatgttggatttataaatgc

SEQ ID NO: 5086794 - DNA, 11 bp, Homo sapiens
aaatgttggct

SEQ ID NO: 5086795 - DNA, 13 bp, Homo sapiens
aaatgtttaaaga

SEQ ID NO: 5086796 - DNA, 23 bp, Homo sapiens
aaatgtttaagtattaacttaca

SEQ ID NO: 5086797 - DNA, 13 bp, Homo sapiens
aaatgtttaatat

SEQ ID NO: 5086798 - DNA, 17 bp, Homo sapiens
aaatgtttaatatctga

SEQ ID NO: 5086799 - DNA, 17 bp, Homo sapiens
aaatgtttaatggtgaa

SEQ ID NO: 5086800 - DNA, 14 bp, Homo sapiens
aaatgtttacattt

SEQ ID NO: 5086801 - DNA, 18 bp, Homo sapiens
aaatgtttacattttctt

SEQ ID NO: 5086802 - DNA, 20 bp, Homo sapiens
aaatgtttacattttctttc

SEQ ID NO: 5086803 - DNA, 16 bp, Homo sapiens
aaatgtttactataga

SEQ ID NO: 5086804 - DNA, 14 bp, Homo sapiens
aaatgtttactgta

SEQ ID NO: 5086805 - DNA, 15 bp, Homo sapiens
aaatgtttactgtaa

SEQ ID NO: 5086806 - DNA, 17 bp, Homo sapiens
aaatgtttactgtaaat

SEQ ID NO: 5086807 - DNA, 19 bp, Homo sapiens
aaatgtttactgtaaattt

SEQ ID NO: 5086808 - DNA, 18 bp, Homo sapiens
aaatgtttatactgtatt

SEQ ID NO: 5086809 - DNA, 13 bp, Homo sapiens
aaatgtttatgga

SEQ ID NO: 5086810 - DNA, 16 bp, Homo sapiens
aaatgtttatggaaat

SEQ ID NO: 5086811 - DNA, 14 bp, Homo sapiens
aaatgtttatttaa

SEQ ID NO: 5086812 - DNA, 22 bp, Homo sapiens
aaatgtttatttaaaagagcag

SEQ ID NO: 5086813 - DNA, 17 bp, Homo sapiens
aaatgtttcaaaataga

SEQ ID NO: 5086814 - DNA, 22 bp, Homo sapiens
aaatgtttcatgaagaaaaaat

SEQ ID NO: 5086815 - DNA, 12 bp, Homo sapiens
aaatgtttcatt

SEQ ID NO: 5086816 - DNA, 23 bp, Homo sapiens
aaatgtttcattatgcactttta

SEQ ID NO: 5086817 - DNA, 15 bp, Homo sapiens
aaatgtttcccccac

SEQ ID NO: 5086818 - DNA, 11 bp, Homo sapiens
aaatgtttcct

SEQ ID NO: 5086819 - DNA, 17 bp, Homo sapiens
aaatgtttccttaaaca

SEQ ID NO: 5086820 - DNA, 22 bp, Homo sapiens
aaatgtttctctctctctacct

SEQ ID NO: 5086821 - DNA, 15 bp, Homo sapiens
aaatgtttctgtgtc

SEQ ID NO: 5086822 - DNA, 16 bp, Homo sapiens
aaatgtttctgtgtca

SEQ ID NO: 5086823 - DNA, 11 bp, Homo sapiens
aaatgtttctt

SEQ ID NO: 5086824 - DNA, 19 bp, Homo sapiens
aaatgtttcttttgtttgg

SEQ ID NO: 5086825 - DNA, 17 bp, Homo sapiens
aaatgtttggaatttaa

SEQ ID NO: 5086826 - DNA, 14 bp, Homo sapiens
aaatgtttgtactt

SEQ ID NO: 5086827 - DNA, 21 bp, Homo sapiens
aaatgtttgtctcagttggaa

SEQ ID NO: 5086828 - DNA, 20 bp, Homo sapiens
aaatgtttgttaaaaataaa

SEQ ID NO: 5086829 - DNA, 19 bp, Homo sapiens
aaatgtttgttatttacac

SEQ ID NO: 5086830 - DNA, 15 bp, Homo sapiens
aaatgttttaaactc

SEQ ID NO: 5086831 - DNA, 13 bp, Homo sapiens
aaatgttttaatg

SEQ ID NO: 5086832 - DNA, 14 bp, Homo sapiens
aaatgttttacaac

SEQ ID NO: 5086833 - DNA, 20 bp, Homo sapiens
aaatgttttacaatggctgg

SEQ ID NO: 5086834 - DNA, 21 bp, Homo sapiens
aaatgttttacaatggctggg

SEQ ID NO: 5086835 - DNA, 22 bp, Homo sapiens
aaatgttttattcggcatttaa

SEQ ID NO: 5086836 - DNA, 13 bp, Homo sapiens
aaatgttttcatt

SEQ ID NO: 5086837 - DNA, 21 bp, Homo sapiens
aaatgttttctgcagaaaaaa

SEQ ID NO: 5086838 - DNA, 11 bp, Homo sapiens
aaatgttttgc

SEQ ID NO: 5086839 - DNA, 12 bp, Homo sapiens
aaatgttttgga

SEQ ID NO: 5086840 - DNA, 13 bp, Homo sapiens
aaatgttttggaa

SEQ ID NO: 5086841 - DNA, 17 bp, Homo sapiens
aaatgttttgtaaacat

SEQ ID NO: 5086842 - DNA, 19 bp, Homo sapiens
aaatgttttgtaagaaacc

SEQ ID NO: 5086843 - DNA, 15 bp, Homo sapiens
aaatgtttttatttt

SEQ ID NO: 5086844 - DNA, 18 bp, Homo sapiens
aaatgtttttatttttgt

SEQ ID NO: 5086845 - DNA, 17 bp, Homo sapiens
aaatgtttttctatgta

SEQ ID NO: 5086846 - DNA, 12 bp, Homo sapiens
aaatgtttttga

SEQ ID NO: 5086847 - DNA, 14 bp, Homo sapiens
aaatgtttttggtc

SEQ ID NO: 5086848 - DNA, 21 bp, Homo sapiens
aaatgtttttggtcttttata

SEQ ID NO: 5086849 - DNA, 22 bp, Homo sapiens
aaatgtttttttttaaagactt

SEQ ID NO: 5086850 - DNA, 12 bp, Homo sapiens
aaattaaaaaag

SEQ ID NO: 5086851 - DNA, 15 bp, Homo sapiens
aaattaaaaaagata

SEQ ID NO: 5086852 - DNA, 17 bp, Homo sapiens
aaattaaaaagattctt

SEQ ID NO: 5086853 - DNA, 14 bp, Homo sapiens
aaattaaaaataaa

SEQ ID NO: 5086854 - DNA, 12 bp, Homo sapiens
aaattaaaacaa

SEQ ID NO: 5086855 - DNA, 22 bp, Homo sapiens
aaattaaaacaaatatacattt

SEQ ID NO: 5086856 - DNA, 23 bp, Homo sapiens
aaattaaaagaaatatacagttt

SEQ ID NO: 5086857 - DNA, 14 bp, Homo sapiens
aaattaaaatgtaa

SEQ ID NO: 5086858 - DNA, 12 bp, Homo sapiens
aaattaaaattg

SEQ ID NO: 5086859 - DNA, 22 bp, Homo sapiens
aaattaaaattttatgacagta

SEQ ID NO: 5086860 - DNA, 14 bp, Homo sapiens
aaattaaacaatat

SEQ ID NO: 5086861 - DNA, 15 bp, Homo sapiens
aaattaaaccaatga

SEQ ID NO: 5086862 - DNA, 17 bp, Homo sapiens
aaattaaacgagcgaag

SEQ ID NO: 5086863 - DNA, 19 bp, Homo sapiens
aaattaaacttatttacaa

SEQ ID NO: 5086864 - DNA, 14 bp, Homo sapiens
aaattaaacttcaa

SEQ ID NO: 5086865 - DNA, 14 bp, Homo sapiens
aaattaaagaaaat

SEQ ID NO: 5086866 - DNA, 14 bp, Homo sapiens
aaattaaagcagca

SEQ ID NO: 5086867 - DNA, 13 bp, Homo sapiens
aaattaaagctga

SEQ ID NO: 5086868 - DNA, 22 bp, Homo sapiens
aaattaaagggcagatattctc

SEQ ID NO: 5086869 - DNA, 13 bp, Homo sapiens
aaattaaagtatg

SEQ ID NO: 5086870 - DNA, 15 bp, Homo sapiens
aaattaaagtatgca

SEQ ID NO: 5086871 - DNA, 14 bp, Homo sapiens
aaattaaagtgctg

SEQ ID NO: 5086872 - DNA, 12 bp, Homo sapiens
aaattaaataaa

SEQ ID NO: 5086873 - DNA, 15 bp, Homo sapiens
aaattaaataaaata

SEQ ID NO: 5086874 - DNA, 14 bp, Homo sapiens
aaattaaataaact

SEQ ID NO: 5086875 - DNA, 16 bp, Homo sapiens
aaattaaataaactgt

SEQ ID NO: 5086876 - DNA, 17 bp, Homo sapiens
aaattaaataaactgtt

SEQ ID NO: 5086877 - DNA, 21 bp, Homo sapiens
aaattaaataaactgttttca

SEQ ID NO: 5086878 - DNA, 17 bp, Homo sapiens
aaattaaataaatcttt

SEQ ID NO: 5086879 - DNA, 14 bp, Homo sapiens
aaattaaataaatt

SEQ ID NO: 5086880 - DNA, 13 bp, Homo sapiens
aaattaaatctgt

SEQ ID NO: 5086881 - DNA, 18 bp, Homo sapiens
aaattaaatgccttgtat

SEQ ID NO: 5086882 - DNA, 20 bp, Homo sapiens
aaattaaatgccttgtataa

SEQ ID NO: 5086883 - DNA, 17 bp, Homo sapiens
aaattaaattctctcta

SEQ ID NO: 5086884 - DNA, 13 bp, Homo sapiens
aaattaaattggg

SEQ ID NO: 5086885 - DNA, 17 bp, Homo sapiens
aaattaacaaagtgtca

SEQ ID NO: 5086886 - DNA, 16 bp, Homo sapiens
aaattaacaaattcag

SEQ ID NO: 5086887 - DNA, 19 bp, Homo sapiens
aaattaacacaaaggaagt

SEQ ID NO: 5086888 - DNA, 18 bp, Homo sapiens
aaattaacagaaaaacag

SEQ ID NO: 5086889 - DNA, 17 bp, Homo sapiens
aaattaacagtcctaac

SEQ ID NO: 5086890 - DNA, 16 bp, Homo sapiens
aaattaacatcagtgt

SEQ ID NO: 5086891 - DNA, 20 bp, Homo sapiens
aaattaaccatagatgtaga

SEQ ID NO: 5086892 - DNA, 22 bp, Homo sapiens
aaattaactaggttgctacttt

SEQ ID NO: 5086893 - DNA, 20 bp, Homo sapiens
aaattaactcactatggttt

SEQ ID NO: 5086894 - DNA, 18 bp, Homo sapiens
aaattaactgctccaaat

SEQ ID NO: 5086895 - DNA, 21 bp, Homo sapiens
aaattaactgctccaaattta

SEQ ID NO: 5086896 - DNA, 22 bp, Homo sapiens
aaattaactgctccaaatttaa

SEQ ID NO: 5086897 - DNA, 21 bp, Homo sapiens
aaattaactgggtaatgaaac

SEQ ID NO: 5086898 - DNA, 17 bp, Homo sapiens
aaattaacttctatttt

SEQ ID NO: 5086899 - DNA, 12 bp, Homo sapiens
aaattaactttt

SEQ ID NO: 5086900 - DNA, 14 bp, Homo sapiens
aaattaacttttat

SEQ ID NO: 5086901 - DNA, 21 bp, Homo sapiens
aaattaacttttataaacttt

SEQ ID NO: 5086902 - DNA, 13 bp, Homo sapiens
aaattaagaagaa

SEQ ID NO: 5086903 - DNA, 14 bp, Homo sapiens
aaattaagaagaaa

SEQ ID NO: 5086904 - DNA, 16 bp, Homo sapiens
aaattaagaagaaact

SEQ ID NO: 5086905 - DNA, 12 bp, Homo sapiens
aaattaagattt

SEQ ID NO: 5086906 - DNA, 23 bp, Homo sapiens
aaattaaggcaactgaacaaaaa

SEQ ID NO: 5086907 - DNA, 17 bp, Homo sapiens
aaattaaggtgtttgaa

SEQ ID NO: 5086908 - DNA, 13 bp, Homo sapiens
aaattaagtgtgt

SEQ ID NO: 5086909 - DNA, 14 bp, Homo sapiens
aaattaagtgttgt

SEQ ID NO: 5086910 - DNA, 15 bp, Homo sapiens
aaattaataccacta

SEQ ID NO: 5086911 - DNA, 16 bp, Homo sapiens
aaattaatacttcatt

SEQ ID NO: 5086912 - DNA, 17 bp, Homo sapiens
aaattaatatctttctg

SEQ ID NO: 5086913 - DNA, 21 bp, Homo sapiens
aaattaatatggtgtattttt

SEQ ID NO: 5086914 - DNA, 14 bp, Homo sapiens
aaattaatattgta

SEQ ID NO: 5086915 - DNA, 15 bp, Homo sapiens
aaattaatatttgtg

SEQ ID NO: 5086916 - DNA, 20 bp, Homo sapiens
aaattaatcagccccagagt

SEQ ID NO: 5086917 - DNA, 13 bp, Homo sapiens
aaattaatctttc

SEQ ID NO: 5086918 - DNA, 19 bp, Homo sapiens
aaattaatcttttaaaaat

SEQ ID NO: 5086919 - DNA, 14 bp, Homo sapiens
aaattaatgattct

SEQ ID NO: 5086920 - DNA, 22 bp, Homo sapiens
aaattaatgcagatttctcttt

SEQ ID NO: 5086921 - DNA, 13 bp, Homo sapiens
aaattaatgtaat

SEQ ID NO: 5086922 - DNA, 17 bp, Homo sapiens
aaattaatgtaataaag

SEQ ID NO: 5086923 - DNA, 15 bp, Homo sapiens
aaattaatgtgtaaa

SEQ ID NO: 5086924 - DNA, 18 bp, Homo sapiens
aaattaatgtgtaaaatt

SEQ ID NO: 5086925 - DNA, 14 bp, Homo sapiens
aaattaattctaaa

SEQ ID NO: 5086926 - DNA, 16 bp, Homo sapiens
aaattaattctaaact

SEQ ID NO: 5086927 - DNA, 21 bp, Homo sapiens
aaattaattctttatcacatg

SEQ ID NO: 5086928 - DNA, 22 bp, Homo sapiens
aaattaattctttatcacatgt

SEQ ID NO: 5086929 - DNA, 16 bp, Homo sapiens
aaattaattggcagca

SEQ ID NO: 5086930 - DNA, 18 bp, Homo sapiens
aaattaattggcagcaga

SEQ ID NO: 5086931 - DNA, 18 bp, Homo sapiens
aaattaattgtgtgaact

SEQ ID NO: 5086932 - DNA, 15 bp, Homo sapiens
aaattacaattttat

SEQ ID NO: 5086933 - DNA, 23 bp, Homo sapiens
aaattacacaataaagcagtcct

SEQ ID NO: 5086934 - DNA, 17 bp, Homo sapiens
aaattacactataatat

SEQ ID NO: 5086935 - DNA, 20 bp, Homo sapiens
aaattacactataatataaa

SEQ ID NO: 5086936 - DNA, 14 bp, Homo sapiens
aaattacagcttca

SEQ ID NO: 5086937 - DNA, 16 bp, Homo sapiens
aaattacagtgcagtt

SEQ ID NO: 5086938 - DNA, 22 bp, Homo sapiens
aaattacatagacttaggcatt

SEQ ID NO: 5086939 - DNA, 22 bp, Homo sapiens
aaattacatgttttttcatttg

SEQ ID NO: 5086940 - DNA, 13 bp, Homo sapiens
aaattacatttgt

SEQ ID NO: 5086941 - DNA, 16 bp, Homo sapiens
aaattacctttaatgc

SEQ ID NO: 5086942 - DNA, 20 bp, Homo sapiens
aaattacctttaattttaat

SEQ ID NO: 5086943 - DNA, 22 bp, Homo sapiens
aaattactaataaattgacata

SEQ ID NO: 5086944 - DNA, 13 bp, Homo sapiens
aaattactaatga

SEQ ID NO: 5086945 - DNA, 20 bp, Homo sapiens
aaattgaaaacactaacaaa

SEQ ID NO: 5086946 - DNA, 14 bp, Homo sapiens
aaattgaaagaact

SEQ ID NO: 5086947 - DNA, 22 bp, Homo sapiens
aaattgaaagcactatgaattt

SEQ ID NO: 5086948 - DNA, 20 bp, Homo sapiens
aaattgaaaggcattctctg

SEQ ID NO: 5086949 - DNA, 14 bp, Homo sapiens
aaattgaaagtatt

SEQ ID NO: 5086950 - DNA, 15 bp, Homo sapiens
aaattgaaagtattc

SEQ ID NO: 5086951 - DNA, 21 bp, Homo sapiens
aaattgaaatgggaacaatat

SEQ ID NO: 5086952 - DNA, 17 bp, Homo sapiens
aaattgaacttcccaca

SEQ ID NO: 5086953 - DNA, 12 bp, Homo sapiens
aaattgaagaga

SEQ ID NO: 5086954 - DNA, 18 bp, Homo sapiens
aaattgaagcaactacaa

SEQ ID NO: 5086955 - DNA, 17 bp, Homo sapiens
aaattgaagtgtcttct

SEQ ID NO: 5086956 - DNA, 23 bp, Homo sapiens
aaattgaataatggtaccagata

SEQ ID NO: 5086957 - DNA, 20 bp, Homo sapiens
aaattgaatactttgaatgt

SEQ ID NO: 5086958 - DNA, 21 bp, Homo sapiens
aaattgaatactttgaatgtg

SEQ ID NO: 5086959 - DNA, 21 bp, Homo sapiens
aaattgaataggtagtatcat

SEQ ID NO: 5086960 - DNA, 13 bp, Homo sapiens
aaattgaatgcaa

SEQ ID NO: 5086961 - DNA, 20 bp, Homo sapiens
aaattgaatgtggctgaagt

SEQ ID NO: 5086962 - DNA, 13 bp, Homo sapiens
aaattgaatttaa

SEQ ID NO: 5086963 - DNA, 19 bp, Homo sapiens
aaattgacctcaaaagaaa

SEQ ID NO: 5086964 - DNA, 23 bp, Homo sapiens
aaattgactgatgattttccttt

SEQ ID NO: 5086965 - DNA, 13 bp, Homo sapiens
aaattgactgtac

SEQ ID NO: 5086966 - DNA, 15 bp, Homo sapiens
aaattgactgtcacg

SEQ ID NO: 5086967 - DNA, 15 bp, Homo sapiens
aaattgacttagata

SEQ ID NO: 5086968 - DNA, 16 bp, Homo sapiens
aaattgacttagatat

SEQ ID NO: 5086969 - DNA, 21 bp, Homo sapiens
aaattgacttagatattaaaa

SEQ ID NO: 5086970 - DNA, 18 bp, Homo sapiens
aaattgagacagtgcaca

SEQ ID NO: 5086971 - DNA, 18 bp, Homo sapiens
aaattgagcagttcatga

SEQ ID NO: 5086972 - DNA, 22 bp, Homo sapiens
aaattgagctagttaaggcaaa

SEQ ID NO: 5086973 - DNA, 23 bp, Homo sapiens
aaattgagctgctttttttgaaa

SEQ ID NO: 5086974 - DNA, 15 bp, Homo sapiens
aaattgagtttcaga

SEQ ID NO: 5086975 - DNA, 14 bp, Homo sapiens
aaattgatgggtgg

SEQ ID NO: 5086976 - DNA, 16 bp, Homo sapiens
aaattgatgggtgggc

SEQ ID NO: 5086977 - DNA, 15 bp, Homo sapiens
aaattgatgttgatg

SEQ ID NO: 5086978 - DNA, 20 bp, Homo sapiens
aaattgatttgtcaagagga

SEQ ID NO: 5086979 - DNA, 22 bp, Homo sapiens
aaattgatttgtcaagaggata

SEQ ID NO: 5086980 - DNA, 23 bp, Homo sapiens
aaattgatttgttatggttacat

SEQ ID NO: 5086981 - DNA, 11 bp, Homo sapiens
aaattgatttt

SEQ ID NO: 5086982 - DNA, 13 bp, Homo sapiens
aaattgcaaagaa

SEQ ID NO: 5086983 - DNA, 15 bp, Homo sapiens
aaattgcaacatatt

SEQ ID NO: 5086984 - DNA, 9 bp, Homo sapiens
aaattgcac

SEQ ID NO: 5086985 - DNA, 13 bp, Homo sapiens
aaattgcacagag

SEQ ID NO: 5086986 - DNA, 12 bp, Homo sapiens
aaattgcactga

SEQ ID NO: 5086987 - DNA, 14 bp, Homo sapiens
aaattgcactgaag

SEQ ID NO: 5086988 - DNA, 18 bp, Homo sapiens
aaattgcactgaagtttt

SEQ ID NO: 5086989 - DNA, 15 bp, Homo sapiens
aaattgcagaattca

SEQ ID NO: 5086990 - DNA, 18 bp, Homo sapiens
aaattgcagcagttgcta

SEQ ID NO: 5086991 - DNA, 16 bp, Homo sapiens
aaattgcagtaacaaa

SEQ ID NO: 5086992 - DNA, 17 bp, Homo sapiens
aaattgcagtttacagt

SEQ ID NO: 5086993 - DNA, 22 bp, Homo sapiens
aaattgcagtttcatgtatgta

SEQ ID NO: 5086994 - DNA, 15 bp, Homo sapiens
aaattgcatactttg

SEQ ID NO: 5086995 - DNA, 23 bp, Homo sapiens
aaattgcatactttgtattttga

SEQ ID NO: 5086996 - DNA, 16 bp, Homo sapiens
aaattgcatgaaacta

SEQ ID NO: 5086997 - DNA, 17 bp, Homo sapiens
aaattgcatgaaactag

SEQ ID NO: 5086998 - DNA, 21 bp, Homo sapiens
aaattgcattcattgacttca

SEQ ID NO: 5086999 - DNA, 12 bp, Homo sapiens
aaattgcatttg

SEQ ID NO: 5087000 - DNA, 13 bp, Homo sapiens
aaattgcatttgt

SEQ ID NO: 5087001 - DNA, 18 bp, Homo sapiens
aaattgccaaaatatatt

SEQ ID NO: 5087002 - DNA, 21 bp, Homo sapiens
aaattgccattggacagttgt

SEQ ID NO: 5087003 - DNA, 18 bp, Homo sapiens
aaattgccctatgctgtg

SEQ ID NO: 5087004 - DNA, 13 bp, Homo sapiens
aaattgcctccct

SEQ ID NO: 5087005 - DNA, 22 bp, Homo sapiens
aaattgcctccttatttatcaa

SEQ ID NO: 5087006 - DNA, 17 bp, Homo sapiens
aaattgcctgaaaccca

SEQ ID NO: 5087007 - DNA, 15 bp, Homo sapiens
aaattgcctgatttg

SEQ ID NO: 5087008 - DNA, 12 bp, Homo sapiens
aaattgccttca

SEQ ID NO: 5087009 - DNA, 14 bp, Homo sapiens
aaattgcctttctg

SEQ ID NO: 5087010 - DNA, 21 bp, Homo sapiens
aaattgcctttctgtgtttat

SEQ ID NO: 5087011 - DNA, 15 bp, Homo sapiens
aaattgctattttat

SEQ ID NO: 5087012 - DNA, 16 bp, Homo sapiens
aaattgctctgtgtat

SEQ ID NO: 5087013 - DNA, 21 bp, Homo sapiens
aaattgctctgtgtatatctc

SEQ ID NO: 5087014 - DNA, 22 bp, Homo sapiens
aaattgctctgtgtatatctct

SEQ ID NO: 5087015 - DNA, 11 bp, Homo sapiens
aaattgctgag

SEQ ID NO: 5087016 - DNA, 13 bp, Homo sapiens
aaattgctgagat

SEQ ID NO: 5087017 - DNA, 20 bp, Homo sapiens
aaattgctgagatgtttagt

SEQ ID NO: 5087018 - DNA, 16 bp, Homo sapiens
aaattgctgcatattt

SEQ ID NO: 5087019 - DNA, 14 bp, Homo sapiens
aaattgctgtgctt

SEQ ID NO: 5087020 - DNA, 23 bp, Homo sapiens
aaattgctgtgctttatggatag

SEQ ID NO: 5087021 - DNA, 14 bp, Homo sapiens
aaattgctgtgtat

SEQ ID NO: 5087022 - DNA, 19 bp, Homo sapiens
aaattgcttctaaaacaat

SEQ ID NO: 5087023 - DNA, 12 bp, Homo sapiens
aaattgcttttt

SEQ ID NO: 5087024 - DNA, 16 bp, Homo sapiens
aaattggaaacatttt

SEQ ID NO: 5087025 - DNA, 13 bp, Homo sapiens
aaattggaactct

SEQ ID NO: 5087026 - DNA, 22 bp, Homo sapiens
aaattggaatggaactactgta

SEQ ID NO: 5087027 - DNA, 18 bp, Homo sapiens
aaattggagaaaagcact

SEQ ID NO: 5087028 - DNA, 22 bp, Homo sapiens
aaattggagctcattttccaca

SEQ ID NO: 5087029 - DNA, 18 bp, Homo sapiens
aaattggagttttaaaaa

SEQ ID NO: 5087030 - DNA, 18 bp, Homo sapiens
aaattggattagcctgga

SEQ ID NO: 5087031 - DNA, 19 bp, Homo sapiens
aaattgggctggattgtgc

SEQ ID NO: 5087032 - DNA, 17 bp, Homo sapiens
aaattggggattcttaa

SEQ ID NO: 5087033 - DNA, 22 bp, Homo sapiens
aaattggggattcttaaagttg

SEQ ID NO: 5087034 - DNA, 23 bp, Homo sapiens
aaattggggattcttaaagttga

SEQ ID NO: 5087035 - DNA, 19 bp, Homo sapiens
aaattgggtgtgccctggc

SEQ ID NO: 5087036 - DNA, 15 bp, Homo sapiens
aaattgggttcatga

SEQ ID NO: 5087037 - DNA, 20 bp, Homo sapiens
aaattggtaccttgcacaca

SEQ ID NO: 5087038 - DNA, 18 bp, Homo sapiens
aaattggtacttgtttca

SEQ ID NO: 5087039 - DNA, 19 bp, Homo sapiens
aaattggtgataagtggaa

SEQ ID NO: 5087040 - DNA, 16 bp, Homo sapiens
aaattggtgggaagca

SEQ ID NO: 5087041 - DNA, 17 bp, Homo sapiens
aaattggtgggaagcaa

SEQ ID NO: 5087042 - DNA, 14 bp, Homo sapiens
aaattggtgtttct

SEQ ID NO: 5087043 - DNA, 22 bp, Homo sapiens
aaattggttaatgaaaaatctg

SEQ ID NO: 5087044 - DNA, 16 bp, Homo sapiens
aaattggttcagggtg

SEQ ID NO: 5087045 - DNA, 14 bp, Homo sapiens
aaattgtaaatgtt

SEQ ID NO: 5087046 - DNA, 17 bp, Homo sapiens
aaattgtaaattttaga

SEQ ID NO: 5087047 - DNA, 16 bp, Homo sapiens
aaattgtaagccagag

SEQ ID NO: 5087048 - DNA, 18 bp, Homo sapiens
aaattgtaagccagagtc

SEQ ID NO: 5087049 - DNA, 20 bp, Homo sapiens
aaattgtaagccagagtcaa

SEQ ID NO: 5087050 - DNA, 21 bp, Homo sapiens
aaattgtaagccagagtcaac

SEQ ID NO: 5087051 - DNA, 14 bp, Homo sapiens
aaattgtacagccg

SEQ ID NO: 5087052 - DNA, 15 bp, Homo sapiens
aaattgtacattttg

SEQ ID NO: 5087053 - DNA, 15 bp, Homo sapiens
aaattgtaccttttt

SEQ ID NO: 5087054 - DNA, 20 bp, Homo sapiens
aaattgtagctttttattaa

SEQ ID NO: 5087055 - DNA, 22 bp, Homo sapiens
aaattgtataccaatgtgtttt

SEQ ID NO: 5087056 - DNA, 15 bp, Homo sapiens
aaattgtatattcac

SEQ ID NO: 5087057 - DNA, 22 bp, Homo sapiens
aaattgtatcttattataaaat

SEQ ID NO: 5087058 - DNA, 21 bp, Homo sapiens
aaattgtattgaaaacactta

SEQ ID NO: 5087059 - DNA, 18 bp, Homo sapiens
aaattgtcagatgctgtg

SEQ ID NO: 5087060 - DNA, 21 bp, Homo sapiens
aaattgtcccttaaacaaaaa

SEQ ID NO: 5087061 - DNA, 23 bp, Homo sapiens
aaattgtccgtgttcatacattt

SEQ ID NO: 5087062 - DNA, 14 bp, Homo sapiens
aaattgtctgccat

SEQ ID NO: 5087063 - DNA, 23 bp, Homo sapiens
aaattgtctgggttccaaaatat

SEQ ID NO: 5087064 - DNA, 14 bp, Homo sapiens
aaattgtctgtctg

SEQ ID NO: 5087065 - DNA, 18 bp, Homo sapiens
aaattgtctgtctgctct

SEQ ID NO: 5087066 - DNA, 21 bp, Homo sapiens
aaattgtctgtctgctcttat

SEQ ID NO: 5087067 - DNA, 19 bp, Homo sapiens
aaattgtgaactcattgct

SEQ ID NO: 5087068 - DNA, 22 bp, Homo sapiens
aaattgtgaagctaatgaccaa

SEQ ID NO: 5087069 - DNA, 23 bp, Homo sapiens
aaattgtgaagctaatgaccaac

SEQ ID NO: 5087070 - DNA, 12 bp, Homo sapiens
aaattgtgatgt

SEQ ID NO: 5087071 - DNA, 15 bp, Homo sapiens
aaattgtgatgtgtc

SEQ ID NO: 5087072 - DNA, 17 bp, Homo sapiens
aaattgtgcttctcccc

SEQ ID NO: 5087073 - DNA, 22 bp, Homo sapiens
aaattgtgcttctccccagaat

SEQ ID NO: 5087074 - DNA, 12 bp, Homo sapiens
aaattgtggatg

SEQ ID NO: 5087075 - DNA, 13 bp, Homo sapiens
aaattgtggatga

SEQ ID NO: 5087076 - DNA, 21 bp, Homo sapiens
aaattgtggatgaagacccta

SEQ ID NO: 5087077 - DNA, 19 bp, Homo sapiens
aaattgtgggtctatttct

SEQ ID NO: 5087078 - DNA, 16 bp, Homo sapiens
aaattgtgtacacttt

SEQ ID NO: 5087079 - DNA, 23 bp, Homo sapiens
aaattgtgtacactttcattact

SEQ ID NO: 5087080 - DNA, 22 bp, Homo sapiens
aaattgtgtgtgctctgcttca

SEQ ID NO: 5087081 - DNA, 12 bp, Homo sapiens
aaattgtgtttg

SEQ ID NO: 5087082 - DNA, 19 bp, Homo sapiens
aaattgttatcaaaatagt

SEQ ID NO: 5087083 - DNA, 17 bp, Homo sapiens
aaattgttcaaaaataa

SEQ ID NO: 5087084 - DNA, 18 bp, Homo sapiens
aaattgttcaaaaataac

SEQ ID NO: 5087085 - DNA, 20 bp, Homo sapiens
aaattgttcatgttaccaaa

SEQ ID NO: 5087086 - DNA, 13 bp, Homo sapiens
aaattgttcctga

SEQ ID NO: 5087087 - DNA, 14 bp, Homo sapiens
aaattgttctctta

SEQ ID NO: 5087088 - DNA, 12 bp, Homo sapiens
aaattgttcttg

SEQ ID NO: 5087089 - DNA, 21 bp, Homo sapiens
aaattgttcttgggagaaaat

SEQ ID NO: 5087090 - DNA, 20 bp, Homo sapiens
aaattgttgtatatcactaa

SEQ ID NO: 5087091 - DNA, 21 bp, Homo sapiens
aaattgtttatgtgttatgaa

SEQ ID NO: 5087092 - DNA, 11 bp, Homo sapiens
aaattgtttca

SEQ ID NO: 5087093 - DNA, 17 bp, Homo sapiens
aaattgtttcatatctg

SEQ ID NO: 5087094 - DNA, 14 bp, Homo sapiens
aaattgtttccaaa

SEQ ID NO: 5087095 - DNA, 18 bp, Homo sapiens
aaattgtttccaaagtgc

SEQ ID NO: 5087096 - DNA, 22 bp, Homo sapiens
aaattgtttccaaagtgcatgt

SEQ ID NO: 5087097 - DNA, 20 bp, Homo sapiens
aaattgtttcttgacaagct

SEQ ID NO: 5087098 - DNA, 18 bp, Homo sapiens
aaattgttttaccagctc

SEQ ID NO: 5087099 - DNA, 12 bp, Homo sapiens
aaattgttttca

SEQ ID NO: 5087100 - DNA, 14 bp, Homo sapiens
aaattgttttcact

SEQ ID NO: 5087101 - DNA, 20 bp, Homo sapiens
aaattgttttcacttgtatt

SEQ ID NO: 5087102 - DNA, 22 bp, Homo sapiens
aaattgttttcacttgtattga

SEQ ID NO: 5087103 - DNA, 20 bp, Homo sapiens
aaattgttttgagctttcca

SEQ ID NO: 5087104 - DNA, 22 bp, Homo sapiens
aaattgtttttaatttgaatca

SEQ ID NO: 5087105 - DNA, 13 bp, Homo sapiens
aaattgtttttac

SEQ ID NO: 5087106 - DNA, 17 bp, Homo sapiens
aaatttaaaaagatgga

SEQ ID NO: 5087107 - DNA, 16 bp, Homo sapiens
aaatttaaaaataaag

SEQ ID NO: 5087108 - DNA, 13 bp, Homo sapiens
aaatttaaaaatc

SEQ ID NO: 5087109 - DNA, 19 bp, Homo sapiens
aaatttaaaaattaaagca

SEQ ID NO: 5087110 - DNA, 13 bp, Homo sapiens
aaatttaaaacaa

SEQ ID NO: 5087111 - DNA, 14 bp, Homo sapiens
aaatttaaaacaca

SEQ ID NO: 5087112 - DNA, 23 bp, Homo sapiens
aaatttaaaagacactgtttaca

SEQ ID NO: 5087113 - DNA, 22 bp, Homo sapiens
aaatttaaaagtaaaatgtctt

SEQ ID NO: 5087114 - DNA, 15 bp, Homo sapiens
aaatttaaaatgtgt

SEQ ID NO: 5087115 - DNA, 13 bp, Homo sapiens
aaatttaaacatt

SEQ ID NO: 5087116 - DNA, 13 bp, Homo sapiens
aaatttaaagcag

SEQ ID NO: 5087117 - DNA, 12 bp, Homo sapiens
aaatttaacata

SEQ ID NO: 5087118 - DNA, 13 bp, Homo sapiens
aaatttaacatct

SEQ ID NO: 5087119 - DNA, 19 bp, Homo sapiens
aaatttaactctggtttct

SEQ ID NO: 5087120 - DNA, 22 bp, Homo sapiens
aaatttaactgcctaaaatgtt

SEQ ID NO: 5087121 - DNA, 14 bp, Homo sapiens
aaatttaactttta

SEQ ID NO: 5087122 - DNA, 16 bp, Homo sapiens
aaatttaacttttaaa

SEQ ID NO: 5087123 - DNA, 15 bp, Homo sapiens
aaatttaagaaaaca

SEQ ID NO: 5087124 - DNA, 16 bp, Homo sapiens
aaatttaagaaaacaa

SEQ ID NO: 5087125 - DNA, 21 bp, Homo sapiens
aaatttaagaaaacaagtata

SEQ ID NO: 5087126 - DNA, 11 bp, Homo sapiens
aaatttaagag

SEQ ID NO: 5087127 - DNA, 14 bp, Homo sapiens
aaatttaagcaaac

SEQ ID NO: 5087128 - DNA, 13 bp, Homo sapiens
aaatttaagcaca

SEQ ID NO: 5087129 - DNA, 12 bp, Homo sapiens
aaatttaagcat

SEQ ID NO: 5087130 - DNA, 13 bp, Homo sapiens
aaatttaagcatt

SEQ ID NO: 5087131 - DNA, 21 bp, Homo sapiens
aaatttaagtgcgtgtgtaga

SEQ ID NO: 5087132 - DNA, 14 bp, Homo sapiens
aaatttaataaaaa

SEQ ID NO: 5087133 - DNA, 21 bp, Homo sapiens
aaatttaataccagatacctt

SEQ ID NO: 5087134 - DNA, 20 bp, Homo sapiens
aaatttaatatagctatttt

SEQ ID NO: 5087135 - DNA, 19 bp, Homo sapiens
aaatttaatccttctttgt

SEQ ID NO: 5087136 - DNA, 15 bp, Homo sapiens
aaatttaatgctgcc

SEQ ID NO: 5087137 - DNA, 16 bp, Homo sapiens
aaatttaattacaaac

SEQ ID NO: 5087138 - DNA, 17 bp, Homo sapiens
aaatttaattcatgttt

SEQ ID NO: 5087139 - DNA, 18 bp, Homo sapiens
aaatttaattcatgtttc

SEQ ID NO: 5087140 - DNA, 18 bp, Homo sapiens
aaatttaattgtgtaact

SEQ ID NO: 5087141 - DNA, 13 bp, Homo sapiens
aaatttacacagt

SEQ ID NO: 5087142 - DNA, 22 bp, Homo sapiens
aaatttacacagtgagactgta

SEQ ID NO: 5087143 - DNA, 23 bp, Homo sapiens
aaatttacacagtgagactgtac

SEQ ID NO: 5087144 - DNA, 13 bp, Homo sapiens
aaatttacagaat

SEQ ID NO: 5087145 - DNA, 21 bp, Homo sapiens
aaatttacatcagaagtttgc

SEQ ID NO: 5087146 - DNA, 17 bp, Homo sapiens
aaatttacatcatttct

SEQ ID NO: 5087147 - DNA, 15 bp, Homo sapiens
aaatttacatttatc

SEQ ID NO: 5087148 - DNA, 16 bp, Homo sapiens
aaatttacatttatct

SEQ ID NO: 5087149 - DNA, 16 bp, Homo sapiens
aaatttacgtatattt

SEQ ID NO: 5087150 - DNA, 15 bp, Homo sapiens
aaatttactatatat

SEQ ID NO: 5087151 - DNA, 21 bp, Homo sapiens
aaatttactgtctaagattaa

SEQ ID NO: 5087152 - DNA, 17 bp, Homo sapiens
aaatttactgtgagact

SEQ ID NO: 5087153 - DNA, 22 bp, Homo sapiens
aaatttactttaaaaagaaatt

SEQ ID NO: 5087154 - DNA, 16 bp, Homo sapiens
aaatttagatcaaatt

SEQ ID NO: 5087155 - DNA, 16 bp, Homo sapiens
aaatttagcattgtag

SEQ ID NO: 5087156 - DNA, 19 bp, Homo sapiens
aaatttagccctttaaaac

SEQ ID NO: 5087157 - DNA, 21 bp, Homo sapiens
aaatttataaactaattttgt

SEQ ID NO: 5087158 - DNA, 11 bp, Homo sapiens
aaatttataac

SEQ ID NO: 5087159 - DNA, 14 bp, Homo sapiens
aaatttataatttt

SEQ ID NO: 5087160 - DNA, 20 bp, Homo sapiens
aaatttatacaaagaaactt

SEQ ID NO: 5087161 - DNA, 14 bp, Homo sapiens
aaatttatataaaa

SEQ ID NO: 5087162 - DNA, 13 bp, Homo sapiens
aaatttatatact

SEQ ID NO: 5087163 - DNA, 17 bp, Homo sapiens
aaatttatatacttttt

SEQ ID NO: 5087164 - DNA, 19 bp, Homo sapiens
aaatttatatactttttga

SEQ ID NO: 5087165 - DNA, 18 bp, Homo sapiens
aaatttatgcatttcatt

SEQ ID NO: 5087166 - DNA, 15 bp, Homo sapiens
aaatttatgtcattt

SEQ ID NO: 5087167 - DNA, 22 bp, Homo sapiens
aaatttatgtcattttcagatc

SEQ ID NO: 5087168 - DNA, 12 bp, Homo sapiens
aaatttattaaa

SEQ ID NO: 5087169 - DNA, 14 bp, Homo sapiens
aaatttattaaata

SEQ ID NO: 5087170 - DNA, 21 bp, Homo sapiens
aaatttattagccctgcattt

SEQ ID NO: 5087171 - DNA, 20 bp, Homo sapiens
aaatttattatatatttaca

SEQ ID NO: 5087172 - DNA, 20 bp, Homo sapiens
aaatttattctacttttaaa

SEQ ID NO: 5087173 - DNA, 10 bp, Homo sapiens
aaatttattt

SEQ ID NO: 5087174 - DNA, 14 bp, Homo sapiens
aaatttattttaat

SEQ ID NO: 5087175 - DNA, 18 bp, Homo sapiens
aaatttattttataagaa

SEQ ID NO: 5087176 - DNA, 13 bp, Homo sapiens
aaatttcaaaaga

SEQ ID NO: 5087177 - DNA, 16 bp, Homo sapiens
aaatttcaaaagacat

SEQ ID NO: 5087178 - DNA, 21 bp, Homo sapiens
aaatttcaaaagacatgttgt

SEQ ID NO: 5087179 - DNA, 14 bp, Homo sapiens
aaatttcaaatgtt

SEQ ID NO: 5087180 - DNA, 20 bp, Homo sapiens
aaatttcacaagctaggcca

SEQ ID NO: 5087181 - DNA, 18 bp, Homo sapiens
aaatttcactactagatt

SEQ ID NO: 5087182 - DNA, 18 bp, Homo sapiens
aaatttcagcagctgcag

SEQ ID NO: 5087183 - DNA, 18 bp, Homo sapiens
aaatttcaggttgttggt

SEQ ID NO: 5087184 - DNA, 12 bp, Homo sapiens
aaatttcatgaa

SEQ ID NO: 5087185 - DNA, 13 bp, Homo sapiens
aaatttcattgca

SEQ ID NO: 5087186 - DNA, 14 bp, Homo sapiens
aaatttccactcag

SEQ ID NO: 5087187 - DNA, 22 bp, Homo sapiens
aaatttccagtacctttgtcac

SEQ ID NO: 5087188 - DNA, 18 bp, Homo sapiens
aaatttccccaacagtgt

SEQ ID NO: 5087189 - DNA, 22 bp, Homo sapiens
aaatttccccaacagtgtgaag

SEQ ID NO: 5087190 - DNA, 23 bp, Homo sapiens
aaatttccccaacagtgtgaagt

SEQ ID NO: 5087191 - DNA, 13 bp, Homo sapiens
aaatttccctggg

SEQ ID NO: 5087192 - DNA, 21 bp, Homo sapiens
aaatttcctccacattcatgt

SEQ ID NO: 5087193 - DNA, 20 bp, Homo sapiens
aaatttcgcttcttagaaca

SEQ ID NO: 5087194 - DNA, 16 bp, Homo sapiens
aaatttcgttgtccaa

SEQ ID NO: 5087195 - DNA, 18 bp, Homo sapiens
aaatttcgttgtccaatt

SEQ ID NO: 5087196 - DNA, 19 bp, Homo sapiens
aaatttctaaatctccaaa

SEQ ID NO: 5087197 - DNA, 15 bp, Homo sapiens
aaatttctcattagt

SEQ ID NO: 5087198 - DNA, 17 bp, Homo sapiens
aaatttctctactgtct

SEQ ID NO: 5087199 - DNA, 19 bp, Homo sapiens
aaatttctgccctgagccc

SEQ ID NO: 5087200 - DNA, 20 bp, Homo sapiens
aaatttctgccctgagccct

SEQ ID NO: 5087201 - DNA, 23 bp, Homo sapiens
aaatttctgcttttgcatctttg

SEQ ID NO: 5087202 - DNA, 21 bp, Homo sapiens
aaatttctggcaaatattttg

SEQ ID NO: 5087203 - DNA, 19 bp, Homo sapiens
aaatttctgggatatttaa

SEQ ID NO: 5087204 - DNA, 14 bp, Homo sapiens
aaatttcttatgtg

SEQ ID NO: 5087205 - DNA, 15 bp, Homo sapiens
aaatttcttatgtga

SEQ ID NO: 5087206 - DNA, 14 bp, Homo sapiens
aaatttgaaaaaac

SEQ ID NO: 5087207 - DNA, 16 bp, Homo sapiens
aaatttgaaaatgtcc

SEQ ID NO: 5087208 - DNA, 23 bp, Homo sapiens
aaatttgaaacattgcttttaaa

SEQ ID NO: 5087209 - DNA, 18 bp, Homo sapiens
aaatttgaaccaaaacat

SEQ ID NO: 5087210 - DNA, 14 bp, Homo sapiens
aaatttgaagtaaa

SEQ ID NO: 5087211 - DNA, 15 bp, Homo sapiens
aaatttgaataataa

SEQ ID NO: 5087212 - DNA, 21 bp, Homo sapiens
aaatttgacattgtcagaatg

SEQ ID NO: 5087213 - DNA, 17 bp, Homo sapiens
aaatttgactaatttta

SEQ ID NO: 5087214 - DNA, 14 bp, Homo sapiens
aaatttgagactat

SEQ ID NO: 5087215 - DNA, 16 bp, Homo sapiens
aaatttgatacttata

SEQ ID NO: 5087216 - DNA, 15 bp, Homo sapiens
aaatttgatgatgtt

SEQ ID NO: 5087217 - DNA, 22 bp, Homo sapiens
aaatttgatggtgaatattaca

SEQ ID NO: 5087218 - DNA, 16 bp, Homo sapiens
aaatttgatggttgaa

SEQ ID NO: 5087219 - DNA, 13 bp, Homo sapiens
aaatttgatttga

SEQ ID NO: 5087220 - DNA, 17 bp, Homo sapiens
aaatttgcaaaatcact

SEQ ID NO: 5087221 - DNA, 20 bp, Homo sapiens
aaatttgccatgacatttca

SEQ ID NO: 5087222 - DNA, 24 bp, Homo sapiens
aaatttgccatgacatttcatctg

SEQ ID NO: 5087223 - DNA, 13 bp, Homo sapiens
aaatttgcccctg

SEQ ID NO: 5087224 - DNA, 17 bp, Homo sapiens
aaatttgcccctggcaa

SEQ ID NO: 5087225 - DNA, 19 bp, Homo sapiens
aaatttggaacttacaaag

SEQ ID NO: 5087226 - DNA, 12 bp, Homo sapiens
aaatttggaatt

SEQ ID NO: 5087227 - DNA, 20 bp, Homo sapiens
aaatttggatttacgactga

SEQ ID NO: 5087228 - DNA, 18 bp, Homo sapiens
aaatttggccaaacaagt

SEQ ID NO: 5087229 - DNA, 20 bp, Homo sapiens
aaatttggctcacttgcctt

SEQ ID NO: 5087230 - DNA, 20 bp, Homo sapiens
aaatttggggacagattcag

SEQ ID NO: 5087231 - DNA, 21 bp, Homo sapiens
aaatttggggacagattcagt

SEQ ID NO: 5087232 - DNA, 13 bp, Homo sapiens
aaatttgtaaact

SEQ ID NO: 5087233 - DNA, 12 bp, Homo sapiens
aaatttgtaagt

SEQ ID NO: 5087234 - DNA, 20 bp, Homo sapiens
aaatttgtaagtttcaggtg

SEQ ID NO: 5087235 - DNA, 19 bp, Homo sapiens
aaatttgtaatatatcctg

SEQ ID NO: 5087236 - DNA, 24 bp, Homo sapiens
aaatttgtacaggactgtaaagat

SEQ ID NO: 5087237 - DNA, 13 bp, Homo sapiens
aaatttgtactat

SEQ ID NO: 5087238 - DNA, 17 bp, Homo sapiens
aaatttgtactatttaa

SEQ ID NO: 5087239 - DNA, 19 bp, Homo sapiens
aaatttgtactatttaact

SEQ ID NO: 5087240 - DNA, 11 bp, Homo sapiens
aaatttgtaga

SEQ ID NO: 5087241 - DNA, 16 bp, Homo sapiens
aaatttgtataaataa

SEQ ID NO: 5087242 - DNA, 22 bp, Homo sapiens
aaatttgtccaatggctgtaaa

SEQ ID NO: 5087243 - DNA, 19 bp, Homo sapiens
aaatttgtctgaaacattt

SEQ ID NO: 5087244 - DNA, 15 bp, Homo sapiens
aaatttgtcttaaaa

SEQ ID NO: 5087245 - DNA, 16 bp, Homo sapiens
aaatttgtgctgggtt

SEQ ID NO: 5087246 - DNA, 17 bp, Homo sapiens
aaatttgtgctttttaa

SEQ ID NO: 5087247 - DNA, 12 bp, Homo sapiens
aaatttgtggaa

SEQ ID NO: 5087248 - DNA, 15 bp, Homo sapiens
aaatttgtgtaatat

SEQ ID NO: 5087249 - DNA, 12 bp, Homo sapiens
aaatttgtgtgc

SEQ ID NO: 5087250 - DNA, 19 bp, Homo sapiens
aaatttgttattttgcaac

SEQ ID NO: 5087251 - DNA, 22 bp, Homo sapiens
aaatttgttctttgtttagcct

SEQ ID NO: 5087252 - DNA, 18 bp, Homo sapiens
aaatttgttgaaattatg

SEQ ID NO: 5087253 - DNA, 13 bp, Homo sapiens
aaatttgttgcat

SEQ ID NO: 5087254 - DNA, 19 bp, Homo sapiens
aaatttgtttaaagtatac

SEQ ID NO: 5087255 - DNA, 13 bp, Homo sapiens
aaatttgtttgta

SEQ ID NO: 5087256 - DNA, 14 bp, Homo sapiens
aaatttgtttgtat

SEQ ID NO: 5087257 - DNA, 16 bp, Homo sapiens
aaatttgttttcaaca

SEQ ID NO: 5087258 - DNA, 19 bp, Homo sapiens
aaatttgttttcaacaatt

SEQ ID NO: 5087259 - DNA, 13 bp, Homo sapiens
aaattttaaaaat

SEQ ID NO: 5087260 - DNA, 13 bp, Homo sapiens
aaattttaaaaca

SEQ ID NO: 5087261 - DNA, 13 bp, Homo sapiens
aaattttaaaatt

SEQ ID NO: 5087262 - DNA, 22 bp, Homo sapiens
aaattttaaagccattctgatt

SEQ ID NO: 5087263 - DNA, 22 bp, Homo sapiens
aaattttaaagcctgaaaattc

SEQ ID NO: 5087264 - DNA, 14 bp, Homo sapiens
aaattttaaaggaa

SEQ ID NO: 5087265 - DNA, 23 bp, Homo sapiens
aaattttaaggccacggccttgt

SEQ ID NO: 5087266 - DNA, 21 bp, Homo sapiens
aaattttaatgttaactttca

SEQ ID NO: 5087267 - DNA, 12 bp, Homo sapiens
aaattttagagc

SEQ ID NO: 5087268 - DNA, 15 bp, Homo sapiens
aaattttagtacatt

SEQ ID NO: 5087269 - DNA, 15 bp, Homo sapiens
aaattttagtccaaa

SEQ ID NO: 5087270 - DNA, 22 bp, Homo sapiens
aaattttagttatagtgtttaa

SEQ ID NO: 5087271 - DNA, 22 bp, Homo sapiens
aaattttataagcaaatttcaa

SEQ ID NO: 5087272 - DNA, 22 bp, Homo sapiens
aaattttataggactgttcttt

SEQ ID NO: 5087273 - DNA, 18 bp, Homo sapiens
aaattttatatgtaaatg

SEQ ID NO: 5087274 - DNA, 22 bp, Homo sapiens
aaattttatatgtaaatgtgtt

SEQ ID NO: 5087275 - DNA, 23 bp, Homo sapiens
aaattttatctgcctctcttgta

SEQ ID NO: 5087276 - DNA, 11 bp, Homo sapiens
aaattttatgt

SEQ ID NO: 5087277 - DNA, 22 bp, Homo sapiens
aaattttattaaacaattttgt

SEQ ID NO: 5087278 - DNA, 14 bp, Homo sapiens
aaattttattatta

SEQ ID NO: 5087279 - DNA, 12 bp, Homo sapiens
aaattttattcc

SEQ ID NO: 5087280 - DNA, 13 bp, Homo sapiens
aaattttattcct

SEQ ID NO: 5087281 - DNA, 14 bp, Homo sapiens
aaattttcaagttt

SEQ ID NO: 5087282 - DNA, 15 bp, Homo sapiens
aaattttcattctga

SEQ ID NO: 5087283 - DNA, 21 bp, Homo sapiens
aaattttcccagtgaataaat

SEQ ID NO: 5087284 - DNA, 20 bp, Homo sapiens
aaattttcctttatgattct

SEQ ID NO: 5087285 - DNA, 18 bp, Homo sapiens
aaattttctatgcttatt

SEQ ID NO: 5087286 - DNA, 13 bp, Homo sapiens
aaattttctcctt

SEQ ID NO: 5087287 - DNA, 16 bp, Homo sapiens
aaattttctctaaact

SEQ ID NO: 5087288 - DNA, 17 bp, Homo sapiens
aaattttctctaaactg

SEQ ID NO: 5087289 - DNA, 19 bp, Homo sapiens
aaattttctctaaactgtt

SEQ ID NO: 5087290 - DNA, 21 bp, Homo sapiens
aaattttctctaaactgtttc

SEQ ID NO: 5087291 - DNA, 22 bp, Homo sapiens
aaattttctgtacagtttgtga

SEQ ID NO: 5087292 - DNA, 21 bp, Homo sapiens
aaattttcttcctttgaagct

SEQ ID NO: 5087293 - DNA, 12 bp, Homo sapiens
aaattttctttt

SEQ ID NO: 5087294 - DNA, 14 bp, Homo sapiens
aaattttcttttaa

SEQ ID NO: 5087295 - DNA, 17 bp, Homo sapiens
aaattttcttttaagca

SEQ ID NO: 5087296 - DNA, 15 bp, Homo sapiens
aaattttgaatgtac

SEQ ID NO: 5087297 - DNA, 18 bp, Homo sapiens
aaattttgatgttttaag

SEQ ID NO: 5087298 - DNA, 12 bp, Homo sapiens
aaattttgcaaa

SEQ ID NO: 5087299 - DNA, 17 bp, Homo sapiens
aaattttgcctaataca

SEQ ID NO: 5087300 - DNA, 16 bp, Homo sapiens
aaattttgctaccaaa

SEQ ID NO: 5087301 - DNA, 21 bp, Homo sapiens
aaattttggaaagattatcct

SEQ ID NO: 5087302 - DNA, 17 bp, Homo sapiens
aaattttggaagaattc

SEQ ID NO: 5087303 - DNA, 22 bp, Homo sapiens
aaattttggaagaattcatgat

SEQ ID NO: 5087304 - DNA, 22 bp, Homo sapiens
aaattactaattttacacatta

SEQ ID NO: 5087305 - DNA, 20 bp, Homo sapiens
aaattactatctgttgaaaa

SEQ ID NO: 5087306 - DNA, 21 bp, Homo sapiens
aaattactccaaggtttataa

SEQ ID NO: 5087307 - DNA, 14 bp, Homo sapiens
aaattactgtgtaa

SEQ ID NO: 5087308 - DNA, 14 bp, Homo sapiens
aaattactgtgtta

SEQ ID NO: 5087309 - DNA, 13 bp, Homo sapiens
aaattactgttta

SEQ ID NO: 5087310 - DNA, 14 bp, Homo sapiens
aaattactgtttta

SEQ ID NO: 5087311 - DNA, 12 bp, Homo sapiens
aaattactttaa

SEQ ID NO: 5087312 - DNA, 14 bp, Homo sapiens
aaattactttaaca

SEQ ID NO: 5087313 - DNA, 16 bp, Homo sapiens
aaattactttaacatt

SEQ ID NO: 5087314 - DNA, 20 bp, Homo sapiens
aaattactttgattccattt

SEQ ID NO: 5087315 - DNA, 17 bp, Homo sapiens
aaattactttgtgaata

SEQ ID NO: 5087316 - DNA, 11 bp, Homo sapiens
aaattagaaaa

SEQ ID NO: 5087317 - DNA, 17 bp, Homo sapiens
aaattagaaaaaaacaa

SEQ ID NO: 5087318 - DNA, 20 bp, Homo sapiens
aaattagaaaaatatatgct

SEQ ID NO: 5087319 - DNA, 12 bp, Homo sapiens
aaattagaaaat

SEQ ID NO: 5087320 - DNA, 17 bp, Homo sapiens
aaattagaaaatcctat

SEQ ID NO: 5087321 - DNA, 14 bp, Homo sapiens
aaattagaaaggac

SEQ ID NO: 5087322 - DNA, 16 bp, Homo sapiens
aaattagaaaggacaa

SEQ ID NO: 5087323 - DNA, 20 bp, Homo sapiens
aaattagacaaatgctacat

SEQ ID NO: 5087324 - DNA, 16 bp, Homo sapiens
aaattagacttatagt

SEQ ID NO: 5087325 - DNA, 18 bp, Homo sapiens
aaattagataaattgtag

SEQ ID NO: 5087326 - DNA, 20 bp, Homo sapiens
aaattagatcctaagatgtg

SEQ ID NO: 5087327 - DNA, 22 bp, Homo sapiens
aaattagatttggcatctcctg

SEQ ID NO: 5087328 - DNA, 14 bp, Homo sapiens
aaattagatttgtg

SEQ ID NO: 5087329 - DNA, 21 bp, Homo sapiens
aaattagatttgtgcaaacat

SEQ ID NO: 5087330 - DNA, 21 bp, Homo sapiens
aaattagcaatcattttatat

SEQ ID NO: 5087331 - DNA, 17 bp, Homo sapiens
aaattagcatgcaagct

SEQ ID NO: 5087332 - DNA, 18 bp, Homo sapiens
aaattagcatgcaagctt

SEQ ID NO: 5087333 - DNA, 20 bp, Homo sapiens
aaattagccagtaatcctgt

SEQ ID NO: 5087334 - DNA, 19 bp, Homo sapiens
aaattagcctaagatatac

SEQ ID NO: 5087335 - DNA, 20 bp, Homo sapiens
aaattagcctaagatatact

SEQ ID NO: 5087336 - DNA, 21 bp, Homo sapiens
aaattagccttgatattctcc

SEQ ID NO: 5087337 - DNA, 13 bp, Homo sapiens
aaattagctattt

SEQ ID NO: 5087338 - DNA, 18 bp, Homo sapiens
aaattagctgtgtgaaat

SEQ ID NO: 5087339 - DNA, 20 bp, Homo sapiens
aaattaggaacagtaaaatc

SEQ ID NO: 5087340 - DNA, 21 bp, Homo sapiens
aaattaggaacagtaaaatcc

SEQ ID NO: 5087341 - DNA, 15 bp, Homo sapiens
aaattaggaataaat

SEQ ID NO: 5087342 - DNA, 23 bp, Homo sapiens
aaattaggaggctcaacaataaa

SEQ ID NO: 5087343 - DNA, 12 bp, Homo sapiens
aaattaggcagt

SEQ ID NO: 5087344 - DNA, 19 bp, Homo sapiens
aaattaggccttatgtaag

SEQ ID NO: 5087345 - DNA, 23 bp, Homo sapiens
aaattagggttggttcctttcca

SEQ ID NO: 5087346 - DNA, 17 bp, Homo sapiens
aaattaggttttgtaca

SEQ ID NO: 5087347 - DNA, 12 bp, Homo sapiens
aaattagtattt

SEQ ID NO: 5087348 - DNA, 20 bp, Homo sapiens
aaattagtgagattaaaaat

SEQ ID NO: 5087349 - DNA, 22 bp, Homo sapiens
aaattagtgtacctattaaaag

SEQ ID NO: 5087350 - DNA, 16 bp, Homo sapiens
aaattagtgttttcat

SEQ ID NO: 5087351 - DNA, 17 bp, Homo sapiens
aaattagtgttttcatt

SEQ ID NO: 5087352 - DNA, 19 bp, Homo sapiens
aaattagtgttttcattct

SEQ ID NO: 5087353 - DNA, 22 bp, Homo sapiens
aaattagtgttttcattctggt

SEQ ID NO: 5087354 - DNA, 13 bp, Homo sapiens
aaattagtttaaa

SEQ ID NO: 5087355 - DNA, 17 bp, Homo sapiens
aaattagtttaaaatga

SEQ ID NO: 5087356 - DNA, 14 bp, Homo sapiens
aaattagtttacct

SEQ ID NO: 5087357 - DNA, 12 bp, Homo sapiens
aaattagtttga

SEQ ID NO: 5087358 - DNA, 13 bp, Homo sapiens
aaattagtttgac

SEQ ID NO: 5087359 - DNA, 16 bp, Homo sapiens
aaattataaaattgaa

SEQ ID NO: 5087360 - DNA, 15 bp, Homo sapiens
aaattataaactcta

SEQ ID NO: 5087361 - DNA, 13 bp, Homo sapiens
aaattataaactt

SEQ ID NO: 5087362 - DNA, 14 bp, Homo sapiens
aaattataaatgtt

SEQ ID NO: 5087363 - DNA, 15 bp, Homo sapiens
aaattataaatgttt

SEQ ID NO: 5087364 - DNA, 16 bp, Homo sapiens
aaattataaatgtttc

SEQ ID NO: 5087365 - DNA, 17 bp, Homo sapiens
aaattataaatgtttca

SEQ ID NO: 5087366 - DNA, 19 bp, Homo sapiens
aaattataaatgtttcatg

SEQ ID NO: 5087367 - DNA, 15 bp, Homo sapiens
aaattataactatta

SEQ ID NO: 5087368 - DNA, 19 bp, Homo sapiens
aaattataactattacagt

SEQ ID NO: 5087369 - DNA, 18 bp, Homo sapiens
aaattataagaagaggaa

SEQ ID NO: 5087370 - DNA, 17 bp, Homo sapiens
aaattataaggactgca

SEQ ID NO: 5087371 - DNA, 20 bp, Homo sapiens
aaattataagtagatttgta

SEQ ID NO: 5087372 - DNA, 18 bp, Homo sapiens
aaattataatgcatctaa

SEQ ID NO: 5087373 - DNA, 12 bp, Homo sapiens
aaattataatgt

SEQ ID NO: 5087374 - DNA, 15 bp, Homo sapiens
aaattataatgtatt

SEQ ID NO: 5087375 - DNA, 20 bp, Homo sapiens
aaattatacataataaagtg

SEQ ID NO: 5087376 - DNA, 15 bp, Homo sapiens
aaattatataaggca

SEQ ID NO: 5087377 - DNA, 16 bp, Homo sapiens
aaattatataagtatt

SEQ ID NO: 5087378 - DNA, 22 bp, Homo sapiens
aaattatatagcaaagatatat

SEQ ID NO: 5087379 - DNA, 23 bp, Homo sapiens
aaattatatattgcaaggtgtga

SEQ ID NO: 5087380 - DNA, 13 bp, Homo sapiens
aaattatatattt

SEQ ID NO: 5087381 - DNA, 19 bp, Homo sapiens
aaattatatccgtgagttg

SEQ ID NO: 5087382 - DNA, 18 bp, Homo sapiens
aaattatatgatatgcat

SEQ ID NO: 5087383 - DNA, 12 bp, Homo sapiens
aaattatattcc

SEQ ID NO: 5087384 - DNA, 13 bp, Homo sapiens
aaattatattctg

SEQ ID NO: 5087385 - DNA, 16 bp, Homo sapiens
aaattatattctgttt

SEQ ID NO: 5087386 - DNA, 18 bp, Homo sapiens
aaattatatttgtgctat

SEQ ID NO: 5087387 - DNA, 15 bp, Homo sapiens
aaattatcaagctaa

SEQ ID NO: 5087388 - DNA, 18 bp, Homo sapiens
aaattatcaagctaataa

SEQ ID NO: 5087389 - DNA, 20 bp, Homo sapiens
aaattatcaagctaataaaa

SEQ ID NO: 5087390 - DNA, 16 bp, Homo sapiens
aaattatcagttatat

SEQ ID NO: 5087391 - DNA, 17 bp, Homo sapiens
aaattatcctctttgta

SEQ ID NO: 5087392 - DNA, 20 bp, Homo sapiens
aaattatctgaatattagat

SEQ ID NO: 5087393 - DNA, 16 bp, Homo sapiens
aaattatctgttctat

SEQ ID NO: 5087394 - DNA, 13 bp, Homo sapiens
aaattatctttaa

SEQ ID NO: 5087395 - DNA, 19 bp, Homo sapiens
aaattatctttagttgaat

SEQ ID NO: 5087396 - DNA, 20 bp, Homo sapiens
aaattatctttagttgaatt

SEQ ID NO: 5087397 - DNA, 17 bp, Homo sapiens
aaattatgaatgagttt

SEQ ID NO: 5087398 - DNA, 20 bp, Homo sapiens
aaattatgagatgatgaaaa

SEQ ID NO: 5087399 - DNA, 14 bp, Homo sapiens
aaattatgagattt

SEQ ID NO: 5087400 - DNA, 22 bp, Homo sapiens
aaattatgagctatcctttcaa

SEQ ID NO: 5087401 - DNA, 12 bp, Homo sapiens
aaattatgcaaa

SEQ ID NO: 5087402 - DNA, 14 bp, Homo sapiens
aaattatggaaaca

SEQ ID NO: 5087403 - DNA, 17 bp, Homo sapiens
aaattatggaatatcat

SEQ ID NO: 5087404 - DNA, 15 bp, Homo sapiens
aaattatgtaaatta

SEQ ID NO: 5087405 - DNA, 13 bp, Homo sapiens
aaattatgtaatg

SEQ ID NO: 5087406 - DNA, 19 bp, Homo sapiens
aaattatgtatgtttacat

SEQ ID NO: 5087407 - DNA, 17 bp, Homo sapiens
aaattatgtgacatttt

SEQ ID NO: 5087408 - DNA, 21 bp, Homo sapiens
aaattatgtgaccataatgta

SEQ ID NO: 5087409 - DNA, 20 bp, Homo sapiens
aaattatgttacatctgttt

SEQ ID NO: 5087410 - DNA, 22 bp, Homo sapiens
aaattatgttactgtatttttc

SEQ ID NO: 5087411 - DNA, 17 bp, Homo sapiens
aaattatgtttatataa

SEQ ID NO: 5087412 - DNA, 24 bp, Homo sapiens
aaattatgtttatataaatgcttt

SEQ ID NO: 5087413 - DNA, 14 bp, Homo sapiens
aaattatgttttaa

SEQ ID NO: 5087414 - DNA, 14 bp, Homo sapiens
aaattatgttttta

SEQ ID NO: 5087415 - DNA, 21 bp, Homo sapiens
aaattattaattgtcctgtgt

SEQ ID NO: 5087416 - DNA, 18 bp, Homo sapiens
aaattattactttaaatt

SEQ ID NO: 5087417 - DNA, 19 bp, Homo sapiens
aaattattagtttacatca

SEQ ID NO: 5087418 - DNA, 19 bp, Homo sapiens
aaattattataagcattga

SEQ ID NO: 5087419 - DNA, 22 bp, Homo sapiens
aaattattataagcattgaaat

SEQ ID NO: 5087420 - DNA, 16 bp, Homo sapiens
aaattattatatattt

SEQ ID NO: 5087421 - DNA, 17 bp, Homo sapiens
aaattattatatattta

SEQ ID NO: 5087422 - DNA, 17 bp, Homo sapiens
aaattattatgactcaa

SEQ ID NO: 5087423 - DNA, 21 bp, Homo sapiens
aaattattcagaactatttaa

SEQ ID NO: 5087424 - DNA, 21 bp, Homo sapiens
aaattattcagttaagaaaaa

SEQ ID NO: 5087425 - DNA, 23 bp, Homo sapiens
aaattattcagttaagaaaaaaa

SEQ ID NO: 5087426 - DNA, 20 bp, Homo sapiens
aaattattctataatttcca

SEQ ID NO: 5087427 - DNA, 14 bp, Homo sapiens
aaattattggtata

SEQ ID NO: 5087428 - DNA, 18 bp, Homo sapiens
aaattattggtatatttg

SEQ ID NO: 5087429 - DNA, 16 bp, Homo sapiens
aaattattgtaaactt

SEQ ID NO: 5087430 - DNA, 23 bp, Homo sapiens
aaattatttattacttgtgcact

SEQ ID NO: 5087431 - DNA, 13 bp, Homo sapiens
aaattatttcata

SEQ ID NO: 5087432 - DNA, 20 bp, Homo sapiens
aaattatttcatacaaaact

SEQ ID NO: 5087433 - DNA, 13 bp, Homo sapiens
aaattatttgcat

SEQ ID NO: 5087434 - DNA, 15 bp, Homo sapiens
aaattatttgccttt

SEQ ID NO: 5087435 - DNA, 18 bp, Homo sapiens
aaattatttgccttttaa

SEQ ID NO: 5087436 - DNA, 23 bp, Homo sapiens
aaattatttgtgtaatagaaaac

SEQ ID NO: 5087437 - DNA, 17 bp, Homo sapiens
aaattattttaaacaaa

SEQ ID NO: 5087438 - DNA, 22 bp, Homo sapiens
aaattattttaatattttgtat

SEQ ID NO: 5087439 - DNA, 13 bp, Homo sapiens
aaattattttatg

SEQ ID NO: 5087440 - DNA, 18 bp, Homo sapiens
aaattattttatgtcata

SEQ ID NO: 5087441 - DNA, 13 bp, Homo sapiens
aaattattttcaa

SEQ ID NO: 5087442 - DNA, 23 bp, Homo sapiens
aaattattttctccaaataaaaa

SEQ ID NO: 5087443 - DNA, 19 bp, Homo sapiens
aaattattttgttcataca

SEQ ID NO: 5087444 - DNA, 21 bp, Homo sapiens
aaattattttgttcatacata

SEQ ID NO: 5087445 - DNA, 23 bp, Homo sapiens
aaattatttttaaaagaaaaaaa

SEQ ID NO: 5087446 - DNA, 16 bp, Homo sapiens
aaattcaaacatattc

SEQ ID NO: 5087447 - DNA, 19 bp, Homo sapiens
aaattcaaaccatttaatt

SEQ ID NO: 5087448 - DNA, 22 bp, Homo sapiens
aaattcaaaccatttaattcat

SEQ ID NO: 5087449 - DNA, 21 bp, Homo sapiens
aaattcaaagcataaaacttt

SEQ ID NO: 5087450 - DNA, 14 bp, Homo sapiens
aaattcaaagcatg

SEQ ID NO: 5087451 - DNA, 14 bp, Homo sapiens
aaattcaacaaatg

SEQ ID NO: 5087452 - DNA, 20 bp, Homo sapiens
aaattcaacacttattttct

SEQ ID NO: 5087453 - DNA, 22 bp, Homo sapiens
aaattcaaccccagaaattgac

SEQ ID NO: 5087454 - DNA, 19 bp, Homo sapiens
aaattcaacctgtgtctta

SEQ ID NO: 5087455 - DNA, 15 bp, Homo sapiens
aaattcaactttgta

SEQ ID NO: 5087456 - DNA, 20 bp, Homo sapiens
aaattcaagaaaataaaact

SEQ ID NO: 5087457 - DNA, 17 bp, Homo sapiens
aaattcaatagtaatat

SEQ ID NO: 5087458 - DNA, 15 bp, Homo sapiens
aaattcaattgtaaa

SEQ ID NO: 5087459 - DNA, 19 bp, Homo sapiens
aaattcaattgtaaattga

SEQ ID NO: 5087460 - DNA, 23 bp, Homo sapiens
aaattcaattgtaaattgaatca

SEQ ID NO: 5087461 - DNA, 16 bp, Homo sapiens
aaattcacaagctgcc

SEQ ID NO: 5087462 - DNA, 17 bp, Homo sapiens
aaattcacagaagccta

SEQ ID NO: 5087463 - DNA, 19 bp, Homo sapiens
aaattcacatgatgcactt

SEQ ID NO: 5087464 - DNA, 22 bp, Homo sapiens
aaattcaccccctttcctggac

SEQ ID NO: 5087465 - DNA, 16 bp, Homo sapiens
aaattcaccttcccct

SEQ ID NO: 5087466 - DNA, 21 bp, Homo sapiens
aaattcactgttgaatgcctg

SEQ ID NO: 5087467 - DNA, 15 bp, Homo sapiens
aaattcactgtttgt

SEQ ID NO: 5087468 - DNA, 17 bp, Homo sapiens
aaattcacttctatata

SEQ ID NO: 5087469 - DNA, 23 bp, Homo sapiens
aaattcagacaacattatgatct

SEQ ID NO: 5087470 - DNA, 18 bp, Homo sapiens
aaattcagataatggtaa

SEQ ID NO: 5087471 - DNA, 22 bp, Homo sapiens
aaattcagatcaaaatgccttt

SEQ ID NO: 5087472 - DNA, 20 bp, Homo sapiens
aaattcaggctactgcttca

SEQ ID NO: 5087473 - DNA, 10 bp, Homo sapiens
aaattcaggt

SEQ ID NO: 5087474 - DNA, 18 bp, Homo sapiens
aaattcagtattttgcct

SEQ ID NO: 5087475 - DNA, 15 bp, Homo sapiens
aaattcagtctctga

SEQ ID NO: 5087476 - DNA, 13 bp, Homo sapiens
aaattcagttttt

SEQ ID NO: 5087477 - DNA, 21 bp, Homo sapiens
aaattcagtttttgtatcttg

SEQ ID NO: 5087478 - DNA, 20 bp, Homo sapiens
aaattcagtttttttccagt

SEQ ID NO: 5087479 - DNA, 14 bp, Homo sapiens
aaattcatataaag

SEQ ID NO: 5087480 - DNA, 21 bp, Homo sapiens
aaattcatcaaatggaagaca

SEQ ID NO: 5087481 - DNA, 14 bp, Homo sapiens
aaattcatgctgct

SEQ ID NO: 5087482 - DNA, 12 bp, Homo sapiens
aaattttggcca

SEQ ID NO: 5087483 - DNA, 18 bp, Homo sapiens
aaattttggccaaagtgt

SEQ ID NO: 5087484 - DNA, 18 bp, Homo sapiens
aaattttggttttctact

SEQ ID NO: 5087485 - DNA, 19 bp, Homo sapiens
aaattttggttttctactg

SEQ ID NO: 5087486 - DNA, 16 bp, Homo sapiens
aaattttgtaaaacaa

SEQ ID NO: 5087487 - DNA, 12 bp, Homo sapiens
aaattttgtaag

SEQ ID NO: 5087488 - DNA, 14 bp, Homo sapiens
aaattttgtaagaa

SEQ ID NO: 5087489 - DNA, 18 bp, Homo sapiens
aaattttgtaagggagca

SEQ ID NO: 5087490 - DNA, 18 bp, Homo sapiens
aaattttgtaattttctt

SEQ ID NO: 5087491 - DNA, 19 bp, Homo sapiens
aaattttgtaattttcttg

SEQ ID NO: 5087492 - DNA, 21 bp, Homo sapiens
aaattttgtaattttcttgat

SEQ ID NO: 5087493 - DNA, 11 bp, Homo sapiens
aaattttgtac

SEQ ID NO: 5087494 - DNA, 14 bp, Homo sapiens
aaattttgtacatt

SEQ ID NO: 5087495 - DNA, 21 bp, Homo sapiens
aaattttgtgatatggagccc

SEQ ID NO: 5087496 - DNA, 21 bp, Homo sapiens
aaattttgtgatgaataaaat

SEQ ID NO: 5087497 - DNA, 23 bp, Homo sapiens
aaattttgtgatgaataaaataa

SEQ ID NO: 5087498 - DNA, 19 bp, Homo sapiens
aaattttgttttctttttc

SEQ ID NO: 5087499 - DNA, 20 bp, Homo sapiens
aaattttgttttctttttct

SEQ ID NO: 5087500 - DNA, 13 bp, Homo sapiens
aaatttttactca

SEQ ID NO: 5087501 - DNA, 18 bp, Homo sapiens
aaatttttaggaaactca

SEQ ID NO: 5087502 - DNA, 13 bp, Homo sapiens
aaatttttataaa

SEQ ID NO: 5087503 - DNA, 13 bp, Homo sapiens
aaatttttatgta

SEQ ID NO: 5087504 - DNA, 16 bp, Homo sapiens
aaatttttatgtaaaa

SEQ ID NO: 5087505 - DNA, 17 bp, Homo sapiens
aaatttttatgtaatta

SEQ ID NO: 5087506 - DNA, 15 bp, Homo sapiens
aaatttttatttttc

SEQ ID NO: 5087507 - DNA, 14 bp, Homo sapiens
aaatttttcatatt

SEQ ID NO: 5087508 - DNA, 20 bp, Homo sapiens
aaatttttcatctcttcaat

SEQ ID NO: 5087509 - DNA, 14 bp, Homo sapiens
aaatttttcctgca

SEQ ID NO: 5087510 - DNA, 17 bp, Homo sapiens
aaatttttccttagcat

SEQ ID NO: 5087511 - DNA, 21 bp, Homo sapiens
aaatttttctcagtttgtata

SEQ ID NO: 5087512 - DNA, 16 bp, Homo sapiens
aaatttttctgcttta

SEQ ID NO: 5087513 - DNA, 20 bp, Homo sapiens
aaatttttctgggaagaaaa

SEQ ID NO: 5087514 - DNA, 23 bp, Homo sapiens
aaatttttcttccttaaactcct

SEQ ID NO: 5087515 - DNA, 19 bp, Homo sapiens
aaatttttcttttcttgat

SEQ ID NO: 5087516 - DNA, 18 bp, Homo sapiens
aaatttttgaaaaatatt

SEQ ID NO: 5087517 - DNA, 16 bp, Homo sapiens
aaatttttgacacttt

SEQ ID NO: 5087518 - DNA, 17 bp, Homo sapiens
aaatttttgacactttt

SEQ ID NO: 5087519 - DNA, 20 bp, Homo sapiens
aaatttttgacactttttgt

SEQ ID NO: 5087520 - DNA, 14 bp, Homo sapiens
aaatttttgcatgt

SEQ ID NO: 5087521 - DNA, 16 bp, Homo sapiens
aaatttttgcatgttt

SEQ ID NO: 5087522 - DNA, 15 bp, Homo sapiens
aaatttttggattga

SEQ ID NO: 5087523 - DNA, 21 bp, Homo sapiens
aaatttttggattgacagtaa

SEQ ID NO: 5087524 - DNA, 12 bp, Homo sapiens
aaatttttggtt

SEQ ID NO: 5087525 - DNA, 20 bp, Homo sapiens
aaatttttgtagtagcgttt

SEQ ID NO: 5087526 - DNA, 12 bp, Homo sapiens
aaatttttgtca

SEQ ID NO: 5087527 - DNA, 21 bp, Homo sapiens
aaatttttgttggcttgcttg

SEQ ID NO: 5087528 - DNA, 15 bp, Homo sapiens
aaattttttaaaaaa

SEQ ID NO: 5087529 - DNA, 17 bp, Homo sapiens
aaattttttaaaagttt

SEQ ID NO: 5087530 - DNA, 16 bp, Homo sapiens
aaattttttaaaggtt

SEQ ID NO: 5087531 - DNA, 22 bp, Homo sapiens
aaattttttacgtagctatttt

SEQ ID NO: 5087532 - DNA, 14 bp, Homo sapiens
aaattttttacttt

SEQ ID NO: 5087533 - DNA, 12 bp, Homo sapiens
aaattttttgac

SEQ ID NO: 5087534 - DNA, 13 bp, Homo sapiens
aaattttttgact

SEQ ID NO: 5087535 - DNA, 11 bp, Homo sapiens
aaattttttgt

SEQ ID NO: 5087536 - DNA, 13 bp, Homo sapiens
aaatttttttaga

SEQ ID NO: 5087537 - DNA, 14 bp, Homo sapiens
aaatttttttccta

SEQ ID NO: 5087538 - DNA, 15 bp, Homo sapiens
aaatttttttcttag

SEQ ID NO: 5087539 - DNA, 16 bp, Homo sapiens
aaatttttttcttagg

SEQ ID NO: 5087540 - DNA, 18 bp, Homo sapiens
aaatttttttgatgtgct

SEQ ID NO: 5087541 - DNA, 17 bp, Homo sapiens
aaatttttttgtatgaa

SEQ ID NO: 5087542 - DNA, 19 bp, Homo sapiens
aaatttttttgtatgaaaa

SEQ ID NO: 5087543 - DNA, 15 bp, Homo sapiens
aaattttttttacat

SEQ ID NO: 5087544 - DNA, 18 bp, Homo sapiens
aaattttttttacatttt

SEQ ID NO: 5087545 - DNA, 15 bp, Homo sapiens
aaattttttttcatg

SEQ ID NO: 5087546 - DNA, 18 bp, Homo sapiens
aaattttttttgtttcat

SEQ ID NO: 5087547 - DNA, 17 bp, Homo sapiens
aaatttttttttaacca

SEQ ID NO: 5087548 - DNA, 23 bp, Homo sapiens
aaatttttttttttaacaatgac

SEQ ID NO: 5087549 - DNA, 22 bp, Homo sapiens
aacaaaaaaaagaaagaaaaaa

SEQ ID NO: 5087550 - DNA, 13 bp, Homo sapiens
aacaaaaaaacta

SEQ ID NO: 5087551 - DNA, 15 bp, Homo sapiens
aacaaaaaaagtttg

SEQ ID NO: 5087552 - DNA, 13 bp, Homo sapiens
aacaaaaaacaga

SEQ ID NO: 5087553 - DNA, 15 bp, Homo sapiens
aacaaaaaacagatt

SEQ ID NO: 5087554 - DNA, 17 bp, Homo sapiens
aacaaaaaacagattct

SEQ ID NO: 5087555 - DNA, 15 bp, Homo sapiens
aacaaaaaagagaaa

SEQ ID NO: 5087556 - DNA, 13 bp, Homo sapiens
aacaaaaaaggtt

SEQ ID NO: 5087557 - DNA, 13 bp, Homo sapiens
aacaaaaaataca

SEQ ID NO: 5087558 - DNA, 14 bp, Homo sapiens
aacaaaaaatacat

SEQ ID NO: 5087559 - DNA, 19 bp, Homo sapiens
aacaaaaacactaaaaata

SEQ ID NO: 5087560 - DNA, 12 bp, Homo sapiens
aacaaaaaccaa

SEQ ID NO: 5087561 - DNA, 16 bp, Homo sapiens
aacaaaaaccagcagg

SEQ ID NO: 5087562 - DNA, 12 bp, Homo sapiens
aacaaaaactat

SEQ ID NO: 5087563 - DNA, 12 bp, Homo sapiens
aacaaaaagaac

SEQ ID NO: 5087564 - DNA, 13 bp, Homo sapiens
aacaaaaagcccc

SEQ ID NO: 5087565 - DNA, 16 bp, Homo sapiens
aacaaaaagctaacat

SEQ ID NO: 5087566 - DNA, 23 bp, Homo sapiens
aacaaaaaggtaaatcccacatc

SEQ ID NO: 5087567 - DNA, 15 bp, Homo sapiens
aacaaaaatagaata

SEQ ID NO: 5087568 - DNA, 18 bp, Homo sapiens
aacaaaaatgactctaaa

SEQ ID NO: 5087569 - DNA, 15 bp, Homo sapiens
aacaaaacaaaacaa

SEQ ID NO: 5087570 - DNA, 17 bp, Homo sapiens
aacaaaacaaacttcca

SEQ ID NO: 5087571 - DNA, 20 bp, Homo sapiens
aacaaaacaacaacaataca

SEQ ID NO: 5087572 - DNA, 14 bp, Homo sapiens
aacaaaacagaagg

SEQ ID NO: 5087573 - DNA, 21 bp, Homo sapiens
aacaaaaccaaaagttattaa

SEQ ID NO: 5087574 - DNA, 17 bp, Homo sapiens
aacaaaacctcttctgt

SEQ ID NO: 5087575 - DNA, 19 bp, Homo sapiens
aacaaaactgaccttgact

SEQ ID NO: 5087576 - DNA, 12 bp, Homo sapiens
aacaaaactgtt

SEQ ID NO: 5087577 - DNA, 18 bp, Homo sapiens
aacaaaactgttcttttg

SEQ ID NO: 5087578 - DNA, 21 bp, Homo sapiens
aacaaaactgttcttttgcat

SEQ ID NO: 5087579 - DNA, 12 bp, Homo sapiens
aacaaaacttct

SEQ ID NO: 5087580 - DNA, 15 bp, Homo sapiens
aacaaaagatttgtt

SEQ ID NO: 5087581 - DNA, 15 bp, Homo sapiens
aacaaaagcaagact

SEQ ID NO: 5087582 - DNA, 20 bp, Homo sapiens
aacaaaaggaagactggaga

SEQ ID NO: 5087583 - DNA, 17 bp, Homo sapiens
aacaaaagggtgtatag

SEQ ID NO: 5087584 - DNA, 16 bp, Homo sapiens
aacaaaagtacattgc

SEQ ID NO: 5087585 - DNA, 19 bp, Homo sapiens
aacaaaagtacattgctta

SEQ ID NO: 5087586 - DNA, 13 bp, Homo sapiens
aacaaaagttccc

SEQ ID NO: 5087587 - DNA, 17 bp, Homo sapiens
aacaaaatacattcttt

SEQ ID NO: 5087588 - DNA, 12 bp, Homo sapiens
aacaaaatagaa

SEQ ID NO: 5087589 - DNA, 23 bp, Homo sapiens
aacaaaatataaatcacagattt

SEQ ID NO: 5087590 - DNA, 21 bp, Homo sapiens
aacaaaatcaagcctgattca

SEQ ID NO: 5087591 - DNA, 22 bp, Homo sapiens
aacaaaatcacaagcaataatt

SEQ ID NO: 5087592 - DNA, 22 bp, Homo sapiens
aacaaaatccaaccctgtcaga

SEQ ID NO: 5087593 - DNA, 17 bp, Homo sapiens
aacaaaatctaaaacaa

SEQ ID NO: 5087594 - DNA, 13 bp, Homo sapiens
aacaaaatctgtt

SEQ ID NO: 5087595 - DNA, 15 bp, Homo sapiens
aacaaaatgaaaaaa

SEQ ID NO: 5087596 - DNA, 15 bp, Homo sapiens
aacaaaatgaaaata

SEQ ID NO: 5087597 - DNA, 13 bp, Homo sapiens
aacaaaatgaaat

SEQ ID NO: 5087598 - DNA, 14 bp, Homo sapiens
aacaaaatgaagct

SEQ ID NO: 5087599 - DNA, 20 bp, Homo sapiens
aacaaaatgaagttaactta

SEQ ID NO: 5087600 - DNA, 20 bp, Homo sapiens
aacaaaatgtaatgtcagac

SEQ ID NO: 5087601 - DNA, 12 bp, Homo sapiens
aacaaaatgtta

SEQ ID NO: 5087602 - DNA, 17 bp, Homo sapiens
aacaaaattccattaca

SEQ ID NO: 5087603 - DNA, 12 bp, Homo sapiens
aacaaaattgca

SEQ ID NO: 5087604 - DNA, 13 bp, Homo sapiens
aacaaaatttcac

SEQ ID NO: 5087605 - DNA, 13 bp, Homo sapiens
aacaaaatttcta

SEQ ID NO: 5087606 - DNA, 20 bp, Homo sapiens
aacaaaatttgactaatttt

SEQ ID NO: 5087607 - DNA, 21 bp, Homo sapiens
aacaaaattttattttgtgct

SEQ ID NO: 5087608 - DNA, 12 bp, Homo sapiens
aacaaaattttt

SEQ ID NO: 5087609 - DNA, 15 bp, Homo sapiens
aacaaacaaaactct

SEQ ID NO: 5087610 - DNA, 16 bp, Homo sapiens
aacaaacaacctgcca

SEQ ID NO: 5087611 - DNA, 16 bp, Homo sapiens
aacaaacaccttctta

SEQ ID NO: 5087612 - DNA, 19 bp, Homo sapiens
aacaaacaccttcttatta

SEQ ID NO: 5087613 - DNA, 17 bp, Homo sapiens
aacaaacagatgctctg

SEQ ID NO: 5087614 - DNA, 15 bp, Homo sapiens
aacaaacattgtgtt

SEQ ID NO: 5087615 - DNA, 18 bp, Homo sapiens
aacaaacatttgctgaat

SEQ ID NO: 5087616 - DNA, 14 bp, Homo sapiens
aacaaaccatctgg

SEQ ID NO: 5087617 - DNA, 20 bp, Homo sapiens
aacaaaccatctggtgcctt

SEQ ID NO: 5087618 - DNA, 22 bp, Homo sapiens
aacaaaccccgaaacagtaaga

SEQ ID NO: 5087619 - DNA, 21 bp, Homo sapiens
aacaaaccgaaaatggacatt

SEQ ID NO: 5087620 - DNA, 21 bp, Homo sapiens
aacaaacctctatatgttgct

SEQ ID NO: 5087621 - DNA, 22 bp, Homo sapiens
aacaaaccttaaacacccagaa

SEQ ID NO: 5087622 - DNA, 19 bp, Homo sapiens
aacaaaccttgccttgaaa

SEQ ID NO: 5087623 - DNA, 19 bp, Homo sapiens
aacaaacgtaatttgttat

SEQ ID NO: 5087624 - DNA, 16 bp, Homo sapiens
aacaaacgtgtttttt

SEQ ID NO: 5087625 - DNA, 20 bp, Homo sapiens
aacaaactcgttttttacaa

SEQ ID NO: 5087626 - DNA, 16 bp, Homo sapiens
aacaaactgaaaaatc

SEQ ID NO: 5087627 - DNA, 22 bp, Homo sapiens
aacaaactgcacatgatttcac

SEQ ID NO: 5087628 - DNA, 20 bp, Homo sapiens
aacaaactgtgtaactgccc

SEQ ID NO: 5087629 - DNA, 11 bp, Homo sapiens
aacaaacttcc

SEQ ID NO: 5087630 - DNA, 19 bp, Homo sapiens
aacaaacttccaaacagtg

SEQ ID NO: 5087631 - DNA, 13 bp, Homo sapiens
aacaaagaaaaga

SEQ ID NO: 5087632 - DNA, 15 bp, Homo sapiens
aacaaagaaagagat

SEQ ID NO: 5087633 - DNA, 20 bp, Homo sapiens
aacaaagaaataaaatcctg

SEQ ID NO: 5087634 - DNA, 17 bp, Homo sapiens
aacaaagaaattatgtg

SEQ ID NO: 5087635 - DNA, 17 bp, Homo sapiens
aacaaagaagacaacat

SEQ ID NO: 5087636 - DNA, 19 bp, Homo sapiens
aacaaagacattgacagca

SEQ ID NO: 5087637 - DNA, 20 bp, Homo sapiens
aacaaagacattgacagcaa

SEQ ID NO: 5087638 - DNA, 18 bp, Homo sapiens
aacaaagacatttatatg

SEQ ID NO: 5087639 - DNA, 19 bp, Homo sapiens
aacaaagacgggtattgtt

SEQ ID NO: 5087640 - DNA, 12 bp, Homo sapiens
aacaaagagtga

SEQ ID NO: 5087641 - DNA, 15 bp, Homo sapiens
aacaaagagtgaaat

SEQ ID NO: 5087642 - DNA, 19 bp, Homo sapiens
aacaaagatatcttttctt

SEQ ID NO: 5087643 - DNA, 22 bp, Homo sapiens
aacaaagatatcttttctttag

SEQ ID NO: 5087644 - DNA, 21 bp, Homo sapiens
aacaaagatgccacattcaaa

SEQ ID NO: 5087645 - DNA, 14 bp, Homo sapiens
aacaaagattgaga

SEQ ID NO: 5087646 - DNA, 19 bp, Homo sapiens
aacaaagcaattctttcaa

SEQ ID NO: 5087647 - DNA, 15 bp, Homo sapiens
aacaaagcagccacg

SEQ ID NO: 5087648 - DNA, 18 bp, Homo sapiens
aacaaagcagtatataat

SEQ ID NO: 5087649 - DNA, 15 bp, Homo sapiens
aacaaagcatgctca

SEQ ID NO: 5087650 - DNA, 16 bp, Homo sapiens
aacaaagcatgctcag

SEQ ID NO: 5087651 - DNA, 21 bp, Homo sapiens
aacaaagcatgctcagtattg

SEQ ID NO: 5087652 - DNA, 15 bp, Homo sapiens
aacaaagctgttaaa

SEQ ID NO: 5087653 - DNA, 22 bp, Homo sapiens
aacaaagctgttaaactgttag

SEQ ID NO: 5087654 - DNA, 15 bp, Homo sapiens
aacaaagctgttgat

SEQ ID NO: 5087655 - DNA, 21 bp, Homo sapiens
aacaaaggatttgaaaacacc

SEQ ID NO: 5087656 - DNA, 19 bp, Homo sapiens
aacaaaggcaagttaagag

SEQ ID NO: 5087657 - DNA, 20 bp, Homo sapiens
aacaaaggcaagttaagaga

SEQ ID NO: 5087658 - DNA, 21 bp, Homo sapiens
aacaaaggcaagttaagagaa

SEQ ID NO: 5087659 - DNA, 12 bp, Homo sapiens
aacaaaggcagc

SEQ ID NO: 5087660 - DNA, 17 bp, Homo sapiens
aacaaagggaaaaaaga

SEQ ID NO: 5087661 - DNA, 17 bp, Homo sapiens
aacaaagggttttcttt

SEQ ID NO: 5087662 - DNA, 15 bp, Homo sapiens
aacaaagtactcttt

SEQ ID NO: 5087663 - DNA, 18 bp, Homo sapiens
aaattcatggcatgctta

SEQ ID NO: 5087664 - DNA, 15 bp, Homo sapiens
aaattcattaaagaa

SEQ ID NO: 5087665 - DNA, 15 bp, Homo sapiens
aaattcattccattt

SEQ ID NO: 5087666 - DNA, 19 bp, Homo sapiens
aaattcatttcacattaat

SEQ ID NO: 5087667 - DNA, 16 bp, Homo sapiens
aaattcatttctaatt

SEQ ID NO: 5087668 - DNA, 24 bp, Homo sapiens
aaattcatttttaagatagaacac

SEQ ID NO: 5087669 - DNA, 14 bp, Homo sapiens
aaattccaaagatc

SEQ ID NO: 5087670 - DNA, 16 bp, Homo sapiens
aaattccaaagatctg

SEQ ID NO: 5087671 - DNA, 13 bp, Homo sapiens
aaattccaataca

SEQ ID NO: 5087672 - DNA, 15 bp, Homo sapiens
aaattccactgaaaa

SEQ ID NO: 5087673 - DNA, 17 bp, Homo sapiens
aaattccagaggactct

SEQ ID NO: 5087674 - DNA, 19 bp, Homo sapiens
aaattccagcaataagaaa

SEQ ID NO: 5087675 - DNA, 20 bp, Homo sapiens
aaattccagcaataagaaat

SEQ ID NO: 5087676 - DNA, 19 bp, Homo sapiens
aaattccagttatttattt

SEQ ID NO: 5087677 - DNA, 19 bp, Homo sapiens
aaattccatacttctctca

SEQ ID NO: 5087678 - DNA, 19 bp, Homo sapiens
aaattccatgtccctgtat

SEQ ID NO: 5087679 - DNA, 14 bp, Homo sapiens
aaattccattatct

SEQ ID NO: 5087680 - DNA, 15 bp, Homo sapiens
aaattccattatctt

SEQ ID NO: 5087681 - DNA, 18 bp, Homo sapiens
aaattcccaaatattaca

SEQ ID NO: 5087682 - DNA, 20 bp, Homo sapiens
aaattcccagatttgaagac

SEQ ID NO: 5087683 - DNA, 12 bp, Homo sapiens
aaattcccatga

SEQ ID NO: 5087684 - DNA, 19 bp, Homo sapiens
aaattccccatatttgtgt

SEQ ID NO: 5087685 - DNA, 22 bp, Homo sapiens
aaattccccatatttgtgttca

SEQ ID NO: 5087686 - DNA, 13 bp, Homo sapiens
aaattccccttcc

SEQ ID NO: 5087687 - DNA, 17 bp, Homo sapiens
aaattcccgttttgtca

SEQ ID NO: 5087688 - DNA, 13 bp, Homo sapiens
aaattccctctgg

SEQ ID NO: 5087689 - DNA, 12 bp, Homo sapiens
aaattccctgga

SEQ ID NO: 5087690 - DNA, 20 bp, Homo sapiens
aaattccctggaccagatgc

SEQ ID NO: 5087691 - DNA, 13 bp, Homo sapiens
aaattcccttcct

SEQ ID NO: 5087692 - DNA, 15 bp, Homo sapiens
aaattcccttcctgt

SEQ ID NO: 5087693 - DNA, 21 bp, Homo sapiens
aaattcccttttcaccttttc

SEQ ID NO: 5087694 - DNA, 15 bp, Homo sapiens
aaattcctaattcta

SEQ ID NO: 5087695 - DNA, 22 bp, Homo sapiens
aaattcctactccctcttccaa

SEQ ID NO: 5087696 - DNA, 17 bp, Homo sapiens
aaattcctagtgtcttt

SEQ ID NO: 5087697 - DNA, 22 bp, Homo sapiens
aaattcctattgtgatttgact

SEQ ID NO: 5087698 - DNA, 23 bp, Homo sapiens
aaattcctattgtgatttgactg

SEQ ID NO: 5087699 - DNA, 11 bp, Homo sapiens
aaattcctcct

SEQ ID NO: 5087700 - DNA, 19 bp, Homo sapiens
aaattcctctttgctttgc

SEQ ID NO: 5087701 - DNA, 11 bp, Homo sapiens
aaattcctgta

SEQ ID NO: 5087702 - DNA, 22 bp, Homo sapiens
aaattcctgtgttcaatattta

SEQ ID NO: 5087703 - DNA, 22 bp, Homo sapiens
aaattccttgccccacagttgt

SEQ ID NO: 5087704 - DNA, 17 bp, Homo sapiens
aaattcctttcagagtt

SEQ ID NO: 5087705 - DNA, 17 bp, Homo sapiens
aaattcgacctgattta

SEQ ID NO: 5087706 - DNA, 23 bp, Homo sapiens
aaattcgacctgatttacagttt

SEQ ID NO: 5087707 - DNA, 21 bp, Homo sapiens
aaattcgctgcaacctgttga

SEQ ID NO: 5087708 - DNA, 17 bp, Homo sapiens
aaattcggaatggtttt

SEQ ID NO: 5087709 - DNA, 14 bp, Homo sapiens
aaattctaaatgta

SEQ ID NO: 5087710 - DNA, 15 bp, Homo sapiens
aaattctactaagtt

SEQ ID NO: 5087711 - DNA, 17 bp, Homo sapiens
aaattctactaagttat

SEQ ID NO: 5087712 - DNA, 23 bp, Homo sapiens
aaattctactaagttattttatg

SEQ ID NO: 5087713 - DNA, 22 bp, Homo sapiens
aaattctagaaagtactttggc

SEQ ID NO: 5087714 - DNA, 14 bp, Homo sapiens
aaattctagattac

SEQ ID NO: 5087715 - DNA, 19 bp, Homo sapiens
aaattctagtctctgattt

SEQ ID NO: 5087716 - DNA, 21 bp, Homo sapiens
aaattctagtctgtttcatta

SEQ ID NO: 5087717 - DNA, 19 bp, Homo sapiens
aaattctataggaacatat

SEQ ID NO: 5087718 - DNA, 12 bp, Homo sapiens
aaattctatgtt

SEQ ID NO: 5087719 - DNA, 18 bp, Homo sapiens
aaattctatgttaaatac

SEQ ID NO: 5087720 - DNA, 19 bp, Homo sapiens
aaattctattacagtatgt

SEQ ID NO: 5087721 - DNA, 13 bp, Homo sapiens
aaattctcaaaat

SEQ ID NO: 5087722 - DNA, 16 bp, Homo sapiens
aaattctcaaagtttt

SEQ ID NO: 5087723 - DNA, 14 bp, Homo sapiens
aaattctcctggag

SEQ ID NO: 5087724 - DNA, 16 bp, Homo sapiens
aaattctctcaagact

SEQ ID NO: 5087725 - DNA, 20 bp, Homo sapiens
aaattctctcaagacttctc

SEQ ID NO: 5087726 - DNA, 12 bp, Homo sapiens
aaattctcttct

SEQ ID NO: 5087727 - DNA, 14 bp, Homo sapiens
aaattctcttcttt

SEQ ID NO: 5087728 - DNA, 16 bp, Homo sapiens
aaattctgaatatttt

SEQ ID NO: 5087729 - DNA, 20 bp, Homo sapiens
aaattctgaatttgcaaagt

SEQ ID NO: 5087730 - DNA, 15 bp, Homo sapiens
aaattctgaattttg

SEQ ID NO: 5087731 - DNA, 20 bp, Homo sapiens
aaattctgagacatgtgtca

SEQ ID NO: 5087732 - DNA, 13 bp, Homo sapiens
aaattctgagtga

SEQ ID NO: 5087733 - DNA, 14 bp, Homo sapiens
aaattctgatacat

SEQ ID NO: 5087734 - DNA, 15 bp, Homo sapiens
aaattctgatgtttc

SEQ ID NO: 5087735 - DNA, 17 bp, Homo sapiens
aaattctgatgtttctg

SEQ ID NO: 5087736 - DNA, 13 bp, Homo sapiens
aaattctgattat

SEQ ID NO: 5087737 - DNA, 14 bp, Homo sapiens
aaattctgccccca

SEQ ID NO: 5087738 - DNA, 16 bp, Homo sapiens
aaattctgctgcttga

SEQ ID NO: 5087739 - DNA, 18 bp, Homo sapiens
aaattctggcccagccaa

SEQ ID NO: 5087740 - DNA, 16 bp, Homo sapiens
aaattctgtgccttgt

SEQ ID NO: 5087741 - DNA, 22 bp, Homo sapiens
aaattctgtgccttgttttttg

SEQ ID NO: 5087742 - DNA, 18 bp, Homo sapiens
aaattctgtggctgccat

SEQ ID NO: 5087743 - DNA, 10 bp, Homo sapiens
aaattctgtt

SEQ ID NO: 5087744 - DNA, 14 bp, Homo sapiens
aaattctgtttctt

SEQ ID NO: 5087745 - DNA, 15 bp, Homo sapiens
aaattctgtttcttg

SEQ ID NO: 5087746 - DNA, 17 bp, Homo sapiens
aaattctgtttttaaaa

SEQ ID NO: 5087747 - DNA, 14 bp, Homo sapiens
aaattcttcacatg

SEQ ID NO: 5087748 - DNA, 18 bp, Homo sapiens
aaattcttgaagttcatg

SEQ ID NO: 5087749 - DNA, 15 bp, Homo sapiens
aaattcttgcactgt

SEQ ID NO: 5087750 - DNA, 23 bp, Homo sapiens
aaattcttgcactgtatccaagt

SEQ ID NO: 5087751 - DNA, 11 bp, Homo sapiens
aaattctttag

SEQ ID NO: 5087752 - DNA, 16 bp, Homo sapiens
aaattctttagtactc

SEQ ID NO: 5087753 - DNA, 18 bp, Homo sapiens
aaattctttagtactcaa

SEQ ID NO: 5087754 - DNA, 22 bp, Homo sapiens
aaattctttagtactcaatgtt

SEQ ID NO: 5087755 - DNA, 23 bp, Homo sapiens
aaattctttagtactcaatgttt

SEQ ID NO: 5087756 - DNA, 13 bp, Homo sapiens
aaattctttcatg

SEQ ID NO: 5087757 - DNA, 13 bp, Homo sapiens
aaattctttcatt

SEQ ID NO: 5087758 - DNA, 20 bp, Homo sapiens
aaattctttcccagtctgtc

SEQ ID NO: 5087759 - DNA, 15 bp, Homo sapiens
aaattcttttataaa

SEQ ID NO: 5087760 - DNA, 11 bp, Homo sapiens
aaattcttttc

SEQ ID NO: 5087761 - DNA, 11 bp, Homo sapiens
aaattcttttt

SEQ ID NO: 5087762 - DNA, 21 bp, Homo sapiens
aaattcttttttaaattttct

SEQ ID NO: 5087763 - DNA, 18 bp, Homo sapiens
aaattctttttttattat

SEQ ID NO: 5087764 - DNA, 23 bp, Homo sapiens
aaattgaaaaaagtggaaaacat

SEQ ID NO: 5087765 - DNA, 15 bp, Homo sapiens
aaattgaaaaataaa

SEQ ID NO: 5087766 - DNA, 21 bp, Homo sapiens
aaattgaaaaataaaaaccat

SEQ ID NO: 5087767 - DNA, 23 bp, Homo sapiens
aaattgaaaacacactcaaaaga

SEQ ID NO: 5087768 - DNA, 17 bp, Homo sapiens
aaattgaaaacactaac

SEQ ID NO: 5087769 - DNA, 19 bp, Homo sapiens
aaattgaaagcactatgaa

SEQ ID NO: 5087770 - DNA, 23 bp, Homo sapiens
aaattgaaagcttccatgtttaa

SEQ ID NO: 5087771 - DNA, 19 bp, Homo sapiens
aaattgaaataaagataaa

SEQ ID NO: 5087772 - DNA, 15 bp, Homo sapiens
aaattgaaataaata

SEQ ID NO: 5087773 - DNA, 13 bp, Homo sapiens
aaattgaaatgta

SEQ ID NO: 5087774 - DNA, 20 bp, Homo sapiens
aaattgaaatgtaaggctgt

SEQ ID NO: 5087775 - DNA, 12 bp, Homo sapiens
aaattgaaattg

SEQ ID NO: 5087776 - DNA, 22 bp, Homo sapiens
aaattgaacctttgtgccctat

SEQ ID NO: 5087777 - DNA, 12 bp, Homo sapiens
aaattgaacttc

SEQ ID NO: 5087778 - DNA, 15 bp, Homo sapiens
aaattgaacttccca

SEQ ID NO: 5087779 - DNA, 23 bp, Homo sapiens
aaattgaagagatttcaacatat

SEQ ID NO: 5087780 - DNA, 23 bp, Homo sapiens
aaattgaagcaactacaacttct

SEQ ID NO: 5087781 - DNA, 14 bp, Homo sapiens
aaattgaatacttt

SEQ ID NO: 5087782 - DNA, 19 bp, Homo sapiens
aaattgaatactttgaatg

SEQ ID NO: 5087783 - DNA, 22 bp, Homo sapiens
aaattgaatagtttatttctgt

SEQ ID NO: 5087784 - DNA, 12 bp, Homo sapiens
aaattgaatgta

SEQ ID NO: 5087785 - DNA, 19 bp, Homo sapiens
aaattgaatgtaccttatt

SEQ ID NO: 5087786 - DNA, 16 bp, Homo sapiens
aaattgaatttaacaa

SEQ ID NO: 5087787 - DNA, 18 bp, Homo sapiens
aaattgaatttaacaatg

SEQ ID NO: 5087788 - DNA, 18 bp, Homo sapiens
aaattgacaacattttat

SEQ ID NO: 5087789 - DNA, 19 bp, Homo sapiens
aaattgacagctttctaac

SEQ ID NO: 5087790 - DNA, 18 bp, Homo sapiens
aaattgaccctagccaga

SEQ ID NO: 5087791 - DNA, 14 bp, Homo sapiens
aaattgactgtact

SEQ ID NO: 5087792 - DNA, 22 bp, Homo sapiens
aaattgacttagatattaaaat

SEQ ID NO: 5087793 - DNA, 21 bp, Homo sapiens
aaattgagaagggaaatctta

SEQ ID NO: 5087794 - DNA, 21 bp, Homo sapiens
aaattgagacagtgcacatga

SEQ ID NO: 5087795 - DNA, 20 bp, Homo sapiens
aaattgagataatgatactt

SEQ ID NO: 5087796 - DNA, 11 bp, Homo sapiens
aaattgagatg

SEQ ID NO: 5087797 - DNA, 17 bp, Homo sapiens
aaattgagctagttaag

SEQ ID NO: 5087798 - DNA, 18 bp, Homo sapiens
aaattgagcttgcttctt

SEQ ID NO: 5087799 - DNA, 20 bp, Homo sapiens
aaattgaggacttaatttac

SEQ ID NO: 5087800 - DNA, 22 bp, Homo sapiens
aaattgaggtttggaagagtga

SEQ ID NO: 5087801 - DNA, 19 bp, Homo sapiens
aaattgagttgcacttatt

SEQ ID NO: 5087802 - DNA, 16 bp, Homo sapiens
aaattgagtttcagaa

SEQ ID NO: 5087803 - DNA, 20 bp, Homo sapiens
aaattgataatgctttcaca

SEQ ID NO: 5087804 - DNA, 14 bp, Homo sapiens
aaattgatctgttt

SEQ ID NO: 5087805 - DNA, 19 bp, Homo sapiens
aaattgatctgttttggat

SEQ ID NO: 5087806 - DNA, 12 bp, Homo sapiens
aaattgatgttg

SEQ ID NO: 5087807 - DNA, 13 bp, Homo sapiens
aaattgatgttga

SEQ ID NO: 5087808 - DNA, 14 bp, Homo sapiens
aaattgatgttgat

SEQ ID NO: 5087809 - DNA, 18 bp, Homo sapiens
aaattgatgttgatgcaa

SEQ ID NO: 5087810 - DNA, 19 bp, Homo sapiens
aaattgatttccatatttt

SEQ ID NO: 5087811 - DNA, 17 bp, Homo sapiens
aaattgatttgttatgg

SEQ ID NO: 5087812 - DNA, 15 bp, Homo sapiens
aaattgattttgaaa

SEQ ID NO: 5087813 - DNA, 18 bp, Homo sapiens
aaattgatttttctcttc

SEQ ID NO: 5087814 - DNA, 15 bp, Homo sapiens
aaattgcaaagaaaa

SEQ ID NO: 5087815 - DNA, 21 bp, Homo sapiens
aaattgcaaagaaaattctca

SEQ ID NO: 5087816 - DNA, 22 bp, Homo sapiens
aaattgcaaagaaaattctcaa

SEQ ID NO: 5087817 - DNA, 12 bp, Homo sapiens
aaattgcacaat

SEQ ID NO: 5087818 - DNA, 13 bp, Homo sapiens
aaattgcacaatt

SEQ ID NO: 5087819 - DNA, 16 bp, Homo sapiens
aaattgcacaatttga

SEQ ID NO: 5087820 - DNA, 22 bp, Homo sapiens
aaattgcacaatttgagcaatt

SEQ ID NO: 5087821 - DNA, 20 bp, Homo sapiens
aaattgcacagaagtcctgt

SEQ ID NO: 5087822 - DNA, 14 bp, Homo sapiens
aaattgcactaaat

SEQ ID NO: 5087823 - DNA, 15 bp, Homo sapiens
aaattgcactaaatg

SEQ ID NO: 5087824 - DNA, 16 bp, Homo sapiens
aaattgcactgaagtt

SEQ ID NO: 5087825 - DNA, 13 bp, Homo sapiens
aaattgcagaaga

SEQ ID NO: 5087826 - DNA, 12 bp, Homo sapiens
aaattgcagttt

SEQ ID NO: 5087827 - DNA, 18 bp, Homo sapiens
aaattgcagtttcatgta

SEQ ID NO: 5087828 - DNA, 19 bp, Homo sapiens
aaattgcataattttctaa

SEQ ID NO: 5087829 - DNA, 16 bp, Homo sapiens
aaattgcatgctgctt

SEQ ID NO: 5087830 - DNA, 18 bp, Homo sapiens
aaattgcatgctgcttta

SEQ ID NO: 5087831 - DNA, 22 bp, Homo sapiens
aaattgcatgggttttgtaggt

SEQ ID NO: 5087832 - DNA, 23 bp, Homo sapiens
aaattgcatgggttttgtaggta

SEQ ID NO: 5087833 - DNA, 14 bp, Homo sapiens
aaattgcatttgtg

SEQ ID NO: 5087834 - DNA, 12 bp, Homo sapiens
aaattgccaaaa

SEQ ID NO: 5087835 - DNA, 14 bp, Homo sapiens
aaattgccatattg

SEQ ID NO: 5087836 - DNA, 16 bp, Homo sapiens
aaattgccatattgca

SEQ ID NO: 5087837 - DNA, 18 bp, Homo sapiens
aaattgccatattgcaca

SEQ ID NO: 5087838 - DNA, 19 bp, Homo sapiens
aaattgccatattgcacat

SEQ ID NO: 5087839 - DNA, 19 bp, Homo sapiens
aaattgccctatgctgtgc

SEQ ID NO: 5087840 - DNA, 21 bp, Homo sapiens
aaattgccttctagacactga

SEQ ID NO: 5087841 - DNA, 20 bp, Homo sapiens
aaattgcctttctgtgttta

SEQ ID NO: 5087842 - DNA, 16 bp, Homo sapiens
aaattgcgaaatctgt

SEQ ID NO: 5087843 - DNA, 19 bp, Homo sapiens
aacaaagtatttttttctt

SEQ ID NO: 5087844 - DNA, 22 bp, Homo sapiens
aacaaagtatttttttcttttt

SEQ ID NO: 5087845 - DNA, 13 bp, Homo sapiens
aacaaagtgcaaa

SEQ ID NO: 5087846 - DNA, 18 bp, Homo sapiens
aacaaagtgcaaagctgc

SEQ ID NO: 5087847 - DNA, 17 bp, Homo sapiens
aacaaagtgctagactt

SEQ ID NO: 5087848 - DNA, 15 bp, Homo sapiens
aacaaagttaattgt

SEQ ID NO: 5087849 - DNA, 19 bp, Homo sapiens
aacaaagttactggctctt

SEQ ID NO: 5087850 - DNA, 22 bp, Homo sapiens
aacaaagttactggctctttgt

SEQ ID NO: 5087851 - DNA, 12 bp, Homo sapiens
aacaaataaata

SEQ ID NO: 5087852 - DNA, 18 bp, Homo sapiens
aacaaataatttgaactt

SEQ ID NO: 5087853 - DNA, 20 bp, Homo sapiens
aacaaataatttgaactttg

SEQ ID NO: 5087854 - DNA, 23 bp, Homo sapiens
aacaaataatttgaactttggaa

SEQ ID NO: 5087855 - DNA, 15 bp, Homo sapiens
aacaaatacattcaa

SEQ ID NO: 5087856 - DNA, 18 bp, Homo sapiens
aacaaatacattcaaatt

SEQ ID NO: 5087857 - DNA, 19 bp, Homo sapiens
aacaaatacattcaaattc

SEQ ID NO: 5087858 - DNA, 22 bp, Homo sapiens
aacaaatacattcaaattcttt

SEQ ID NO: 5087859 - DNA, 22 bp, Homo sapiens
aacaaatatacattttctaaat

SEQ ID NO: 5087860 - DNA, 16 bp, Homo sapiens
aacaaatatactcatt

SEQ ID NO: 5087861 - DNA, 17 bp, Homo sapiens
aacaaatatactcattt

SEQ ID NO: 5087862 - DNA, 18 bp, Homo sapiens
aacaaatatgctaatttg

SEQ ID NO: 5087863 - DNA, 14 bp, Homo sapiens
aacaaatatgcttt

SEQ ID NO: 5087864 - DNA, 22 bp, Homo sapiens
aacaaatatggctagttttcaa

SEQ ID NO: 5087865 - DNA, 13 bp, Homo sapiens
aacaaatatttag

SEQ ID NO: 5087866 - DNA, 18 bp, Homo sapiens
aacaaatatttatatatt

SEQ ID NO: 5087867 - DNA, 15 bp, Homo sapiens
aacaaatattttctt

SEQ ID NO: 5087868 - DNA, 23 bp, Homo sapiens
aacaaatcaaacacaacacaaga

SEQ ID NO: 5087869 - DNA, 14 bp, Homo sapiens
aacaaatcattttg

SEQ ID NO: 5087870 - DNA, 15 bp, Homo sapiens
aacaaatcattttga

SEQ ID NO: 5087871 - DNA, 17 bp, Homo sapiens
aacaaatcattttgatg

SEQ ID NO: 5087872 - DNA, 19 bp, Homo sapiens
aacaaatctaggaaaatat

SEQ ID NO: 5087873 - DNA, 15 bp, Homo sapiens
aacaaatgaaattta

SEQ ID NO: 5087874 - DNA, 14 bp, Homo sapiens
aacaaatgaagaca

SEQ ID NO: 5087875 - DNA, 10 bp, Homo sapiens
aacaaatgag

SEQ ID NO: 5087876 - DNA, 20 bp, Homo sapiens
aacaaatgctctgtcttcaa

SEQ ID NO: 5087877 - DNA, 21 bp, Homo sapiens
aacaaatgctctgtcttcaat

SEQ ID NO: 5087878 - DNA, 21 bp, Homo sapiens
aacaaatgctttattatttat

SEQ ID NO: 5087879 - DNA, 22 bp, Homo sapiens
aacaaatggaagagaagagaaa

SEQ ID NO: 5087880 - DNA, 22 bp, Homo sapiens
aacaaatggagctttctgtata

SEQ ID NO: 5087881 - DNA, 19 bp, Homo sapiens
aacaaatgtatcagtgatg

SEQ ID NO: 5087882 - DNA, 19 bp, Homo sapiens
aacaaatgtgtttttctat

SEQ ID NO: 5087883 - DNA, 20 bp, Homo sapiens
aacaaatgttagacttgtgt

SEQ ID NO: 5087884 - DNA, 12 bp, Homo sapiens
aacaaattaaaa

SEQ ID NO: 5087885 - DNA, 20 bp, Homo sapiens
aacaaattaaaaacacctaa

SEQ ID NO: 5087886 - DNA, 19 bp, Homo sapiens
aacaaattaggttttgtac

SEQ ID NO: 5087887 - DNA, 20 bp, Homo sapiens
aacaaattatgttacatctg

SEQ ID NO: 5087888 - DNA, 22 bp, Homo sapiens
aacaaattcatcaaatggaaga

SEQ ID NO: 5087889 - DNA, 12 bp, Homo sapiens
aacaaattcttt

SEQ ID NO: 5087890 - DNA, 14 bp, Homo sapiens
aacaaattctttag

SEQ ID NO: 5087891 - DNA, 17 bp, Homo sapiens
aacaaattgatctgttt

SEQ ID NO: 5087892 - DNA, 15 bp, Homo sapiens
aacaaattgcatttg

SEQ ID NO: 5087893 - DNA, 17 bp, Homo sapiens
aacaaattgcatttgtg

SEQ ID NO: 5087894 - DNA, 21 bp, Homo sapiens
aacaaattgggatctgtcttg

SEQ ID NO: 5087895 - DNA, 22 bp, Homo sapiens
aacaaatttacatcagaagttt

SEQ ID NO: 5087896 - DNA, 15 bp, Homo sapiens
aacaaatttagaaga

SEQ ID NO: 5087897 - DNA, 14 bp, Homo sapiens
aacaaatttcattg

SEQ ID NO: 5087898 - DNA, 17 bp, Homo sapiens
aacaaatttcattgcac

SEQ ID NO: 5087899 - DNA, 18 bp, Homo sapiens
aacaaatttcattgcact

SEQ ID NO: 5087900 - DNA, 15 bp, Homo sapiens
aacaaattttaagtg

SEQ ID NO: 5087901 - DNA, 12 bp, Homo sapiens
aacaaattttca

SEQ ID NO: 5087902 - DNA, 15 bp, Homo sapiens
aacaaattttctggt

SEQ ID NO: 5087903 - DNA, 21 bp, Homo sapiens
aacaaattttggttttctact

SEQ ID NO: 5087904 - DNA, 12 bp, Homo sapiens
aacaaatttttc

SEQ ID NO: 5087905 - DNA, 20 bp, Homo sapiens
aacaacaaaaaccaaaaaaa

SEQ ID NO: 5087906 - DNA, 22 bp, Homo sapiens
aacaacaaagcatgctcagtat

SEQ ID NO: 5087907 - DNA, 15 bp, Homo sapiens
aacaacaaaggaagt

SEQ ID NO: 5087908 - DNA, 19 bp, Homo sapiens
aacaacaaataatttaagt

SEQ ID NO: 5087909 - DNA, 13 bp, Homo sapiens
aacaacaacaata

SEQ ID NO: 5087910 - DNA, 15 bp, Homo sapiens
aacaacaacaataac

SEQ ID NO: 5087911 - DNA, 17 bp, Homo sapiens
aacaacaacaatacaac

SEQ ID NO: 5087912 - DNA, 15 bp, Homo sapiens
aacaacaacagaaca

SEQ ID NO: 5087913 - DNA, 19 bp, Homo sapiens
aacaacaaggacaacttta

SEQ ID NO: 5087914 - DNA, 14 bp, Homo sapiens
aacaacaaggaccc

SEQ ID NO: 5087915 - DNA, 15 bp, Homo sapiens
aacaacaataacaac

SEQ ID NO: 5087916 - DNA, 14 bp, Homo sapiens
aacaacaataataa

SEQ ID NO: 5087917 - DNA, 17 bp, Homo sapiens
aacaacacctcctcctg

SEQ ID NO: 5087918 - DNA, 12 bp, Homo sapiens
aacaacagcttc

SEQ ID NO: 5087919 - DNA, 12 bp, Homo sapiens
aacaacataaaa

SEQ ID NO: 5087920 - DNA, 14 bp, Homo sapiens
aacaacataaaatt

SEQ ID NO: 5087921 - DNA, 14 bp, Homo sapiens
aacaacatatacaa

SEQ ID NO: 5087922 - DNA, 14 bp, Homo sapiens
aacaacatgaaact

SEQ ID NO: 5087923 - DNA, 13 bp, Homo sapiens
aacaacatgtata

SEQ ID NO: 5087924 - DNA, 24 bp, Homo sapiens
aacaacatgtgagcatggtcacaa

SEQ ID NO: 5087925 - DNA, 20 bp, Homo sapiens
aacaacatgtttccagcatt

SEQ ID NO: 5087926 - DNA, 22 bp, Homo sapiens
aacaacattaggggattcttct

SEQ ID NO: 5087927 - DNA, 18 bp, Homo sapiens
aacaacattattttaaaa

SEQ ID NO: 5087928 - DNA, 22 bp, Homo sapiens
aacaacatttaagggaatgtga

SEQ ID NO: 5087929 - DNA, 12 bp, Homo sapiens
aacaaccaaaga

SEQ ID NO: 5087930 - DNA, 17 bp, Homo sapiens
aacaaccaaagaaaatt

SEQ ID NO: 5087931 - DNA, 18 bp, Homo sapiens
aacaaccaccaccacaat

SEQ ID NO: 5087932 - DNA, 22 bp, Homo sapiens
aacaacccacaccgtcttcctt

SEQ ID NO: 5087933 - DNA, 22 bp, Homo sapiens
aacaaccccccatcacaaactt

SEQ ID NO: 5087934 - DNA, 21 bp, Homo sapiens
aacaaccgtcctgctgtccct

SEQ ID NO: 5087935 - DNA, 14 bp, Homo sapiens
aacaacctcaactg

SEQ ID NO: 5087936 - DNA, 18 bp, Homo sapiens
aacaacctcggctcctgg

SEQ ID NO: 5087937 - DNA, 14 bp, Homo sapiens
aacaacctgaatct

SEQ ID NO: 5087938 - DNA, 15 bp, Homo sapiens
aacaacctgaatctt

SEQ ID NO: 5087939 - DNA, 19 bp, Homo sapiens
aacaaccttttacattgtg

SEQ ID NO: 5087940 - DNA, 20 bp, Homo sapiens
aacaacgtctttttgtttgt

SEQ ID NO: 5087941 - DNA, 23 bp, Homo sapiens
aacaacgtgagagaaagagagaa

SEQ ID NO: 5087942 - DNA, 21 bp, Homo sapiens
aacaacgttcttagtttactt

SEQ ID NO: 5087943 - DNA, 14 bp, Homo sapiens
aacaactaaaaaaa

SEQ ID NO: 5087944 - DNA, 19 bp, Homo sapiens
aacaactaattataatgca

SEQ ID NO: 5087945 - DNA, 16 bp, Homo sapiens
aacaactatggctgtt

SEQ ID NO: 5087946 - DNA, 21 bp, Homo sapiens
aacaactcatgtctttattag

SEQ ID NO: 5087947 - DNA, 22 bp, Homo sapiens
aacaactccctgaacctcagtt

SEQ ID NO: 5087948 - DNA, 22 bp, Homo sapiens
aacaactctgatgtggaatgca

SEQ ID NO: 5087949 - DNA, 13 bp, Homo sapiens
aacaactctgcct

SEQ ID NO: 5087950 - DNA, 15 bp, Homo sapiens
aacaactctttgaga

SEQ ID NO: 5087951 - DNA, 22 bp, Homo sapiens
aacaactgctactctcgggaag

SEQ ID NO: 5087952 - DNA, 16 bp, Homo sapiens
aacaactgtttgtctt

SEQ ID NO: 5087953 - DNA, 22 bp, Homo sapiens
aacaacttaatgttctgaataa

SEQ ID NO: 5087954 - DNA, 19 bp, Homo sapiens
aacaacttatgactaaaaa

SEQ ID NO: 5087955 - DNA, 19 bp, Homo sapiens
aacaacttgctacttatca

SEQ ID NO: 5087956 - DNA, 20 bp, Homo sapiens
aacaacttgctacttatcat

SEQ ID NO: 5087957 - DNA, 17 bp, Homo sapiens
aacaacttggcatttct

SEQ ID NO: 5087958 - DNA, 16 bp, Homo sapiens
aacaacttgtagcagc

SEQ ID NO: 5087959 - DNA, 16 bp, Homo sapiens
aacaactttcacttct

SEQ ID NO: 5087960 - DNA, 24 bp, Homo sapiens
aacaactttccactgacaacgaaa

SEQ ID NO: 5087961 - DNA, 21 bp, Homo sapiens
aacaactttctcttgtaaacg

SEQ ID NO: 5087962 - DNA, 12 bp, Homo sapiens
aacaactttgtt

SEQ ID NO: 5087963 - DNA, 17 bp, Homo sapiens
aacaactttgtttctca

SEQ ID NO: 5087964 - DNA, 15 bp, Homo sapiens
aacaacttttttttc

SEQ ID NO: 5087965 - DNA, 12 bp, Homo sapiens
aacaagaaaaat

SEQ ID NO: 5087966 - DNA, 14 bp, Homo sapiens
aacaagaaaacata

SEQ ID NO: 5087967 - DNA, 13 bp, Homo sapiens
aacaagaaaccaa

SEQ ID NO: 5087968 - DNA, 22 bp, Homo sapiens
aacaagaaaccaagtgggctgg

SEQ ID NO: 5087969 - DNA, 13 bp, Homo sapiens
aacaagaaagaaa

SEQ ID NO: 5087970 - DNA, 17 bp, Homo sapiens
aacaagaaagaaacgta

SEQ ID NO: 5087971 - DNA, 16 bp, Homo sapiens
aacaagaaagtttccc

SEQ ID NO: 5087972 - DNA, 22 bp, Homo sapiens
aacaagaaataatagaaatgtc

SEQ ID NO: 5087973 - DNA, 17 bp, Homo sapiens
aacaagaaccatttgca

SEQ ID NO: 5087974 - DNA, 13 bp, Homo sapiens
aacaagaagaaat

SEQ ID NO: 5087975 - DNA, 14 bp, Homo sapiens
aacaagaagaattt

SEQ ID NO: 5087976 - DNA, 13 bp, Homo sapiens
aacaagaagatga

SEQ ID NO: 5087977 - DNA, 14 bp, Homo sapiens
aacaagaagatgaa

SEQ ID NO: 5087978 - DNA, 23 bp, Homo sapiens
aacaagaataaaggcagctgttg

SEQ ID NO: 5087979 - DNA, 15 bp, Homo sapiens
aacaagaatgcattg

SEQ ID NO: 5087980 - DNA, 13 bp, Homo sapiens
aacaagacagcct

SEQ ID NO: 5087981 - DNA, 14 bp, Homo sapiens
aacaagacagcctt

SEQ ID NO: 5087982 - DNA, 22 bp, Homo sapiens
aacaagaccaccacttcgaaac

SEQ ID NO: 5087983 - DNA, 19 bp, Homo sapiens
aacaagaccacgtttctaa

SEQ ID NO: 5087984 - DNA, 19 bp, Homo sapiens
aacaagaccccgtctcaaa

SEQ ID NO: 5087985 - DNA, 15 bp, Homo sapiens
aacaagactgcctcc

SEQ ID NO: 5087986 - DNA, 22 bp, Homo sapiens
aacaagagaaaagaaaaatcaa

SEQ ID NO: 5087987 - DNA, 16 bp, Homo sapiens
aacaagagaagcattc

SEQ ID NO: 5087988 - DNA, 17 bp, Homo sapiens
aacaagagaagcattct

SEQ ID NO: 5087989 - DNA, 21 bp, Homo sapiens
aacaagagaagcattctcatt

SEQ ID NO: 5087990 - DNA, 22 bp, Homo sapiens
aacaagagactgcttgacaaag

SEQ ID NO: 5087991 - DNA, 21 bp, Homo sapiens
aacaagagcaaaactccgtct

SEQ ID NO: 5087992 - DNA, 19 bp, Homo sapiens
aacaagagcactacattca

SEQ ID NO: 5087993 - DNA, 15 bp, Homo sapiens
aacaagagcctgatt

SEQ ID NO: 5087994 - DNA, 23 bp, Homo sapiens
aacaagagtttgttctgttctgg

SEQ ID NO: 5087995 - DNA, 17 bp, Homo sapiens
aacaagatatttatatg

SEQ ID NO: 5087996 - DNA, 17 bp, Homo sapiens
aacaagattaaatatcc

SEQ ID NO: 5087997 - DNA, 12 bp, Homo sapiens
aacaagatttcc

SEQ ID NO: 5087998 - DNA, 17 bp, Homo sapiens
aacaagcatgcataaat

SEQ ID NO: 5087999 - DNA, 19 bp, Homo sapiens
aacaagcatgcataaatca

SEQ ID NO: 5088000 - DNA, 20 bp, Homo sapiens
aacaagcatgcataaatcaa

SEQ ID NO: 5088001 - DNA, 22 bp, Homo sapiens
aacaagccaaagagcctcccac

SEQ ID NO: 5088002 - DNA, 20 bp, Homo sapiens
aacaagccacgttgcagaaa

SEQ ID NO: 5088003 - DNA, 15 bp, Homo sapiens
aacaagccagagccg

SEQ ID NO: 5088004 - DNA, 14 bp, Homo sapiens
aacaagcccaaagc

SEQ ID NO: 5088005 - DNA, 16 bp, Homo sapiens
aacaagcctgaaagta

SEQ ID NO: 5088006 - DNA, 14 bp, Homo sapiens
aacaagctaggtgc

SEQ ID NO: 5088007 - DNA, 12 bp, Homo sapiens
aacaagctattt

SEQ ID NO: 5088008 - DNA, 18 bp, Homo sapiens
aacaagctgatagtgttt

SEQ ID NO: 5088009 - DNA, 19 bp, Homo sapiens
aacaagctgatagtgtttc

SEQ ID NO: 5088010 - DNA, 23 bp, Homo sapiens
aacaagcttcaaagccatatgga

SEQ ID NO: 5088011 - DNA, 16 bp, Homo sapiens
aacaaggaagccaaag

SEQ ID NO: 5088012 - DNA, 11 bp, Homo sapiens
aacaaggaagg

SEQ ID NO: 5088013 - DNA, 15 bp, Homo sapiens
aacaaggaaggacat

SEQ ID NO: 5088014 - DNA, 19 bp, Homo sapiens
aacaaggaatgcctgtgcc

SEQ ID NO: 5088015 - DNA, 21 bp, Homo sapiens
aacaaggagctcaccctgccc

SEQ ID NO: 5088016 - DNA, 16 bp, Homo sapiens
aacaaggcaaggctgt

SEQ ID NO: 5088017 - DNA, 21 bp, Homo sapiens
aacaaggccctttaacttgtc

SEQ ID NO: 5088018 - DNA, 19 bp, Homo sapiens
aacaaggcttaaaagagta

SEQ ID NO: 5088019 - DNA, 20 bp, Homo sapiens
aacaaggcttaaaagagtag

SEQ ID NO: 5088020 - DNA, 17 bp, Homo sapiens
aacaagggaaggggcct

SEQ ID NO: 5088021 - DNA, 22 bp, Homo sapiens
aaattgctaacgttttttcttc

SEQ ID NO: 5088022 - DNA, 17 bp, Homo sapiens
aaattgctatgttacta

SEQ ID NO: 5088023 - DNA, 22 bp, Homo sapiens
aaattgctatgttactattttc

SEQ ID NO: 5088024 - DNA, 20 bp, Homo sapiens
aaattgctattttatttgta

SEQ ID NO: 5088025 - DNA, 16 bp, Homo sapiens
aaattgctcaaaaaag

SEQ ID NO: 5088026 - DNA, 13 bp, Homo sapiens
aaattgctcataa

SEQ ID NO: 5088027 - DNA, 22 bp, Homo sapiens
aaattgctcctaagcttcaaat

SEQ ID NO: 5088028 - DNA, 14 bp, Homo sapiens
aaattgctccttga

SEQ ID NO: 5088029 - DNA, 13 bp, Homo sapiens
aaattgctctgtg

SEQ ID NO: 5088030 - DNA, 18 bp, Homo sapiens
aaattgctctgtgtatat

SEQ ID NO: 5088031 - DNA, 13 bp, Homo sapiens
aaattgctctgtt

SEQ ID NO: 5088032 - DNA, 15 bp, Homo sapiens
aaattgctgcttgga

SEQ ID NO: 5088033 - DNA, 18 bp, Homo sapiens
aaattgcttctaaaacaa

SEQ ID NO: 5088034 - DNA, 20 bp, Homo sapiens
aaattgcttctaaaacaata

SEQ ID NO: 5088035 - DNA, 21 bp, Homo sapiens
aaattgcttctaaaacaataa

SEQ ID NO: 5088036 - DNA, 17 bp, Homo sapiens
aaattgctttacagttt

SEQ ID NO: 5088037 - DNA, 13 bp, Homo sapiens
aaattgcttttga

SEQ ID NO: 5088038 - DNA, 16 bp, Homo sapiens
aaattggaaagcaggt

SEQ ID NO: 5088039 - DNA, 16 bp, Homo sapiens
aaattggaatggaact

SEQ ID NO: 5088040 - DNA, 15 bp, Homo sapiens
aaattggaattttct

SEQ ID NO: 5088041 - DNA, 12 bp, Homo sapiens
aaattggagaaa

SEQ ID NO: 5088042 - DNA, 19 bp, Homo sapiens
aaattggagaaaagcactt

SEQ ID NO: 5088043 - DNA, 20 bp, Homo sapiens
aaattggagaaaagcactta

SEQ ID NO: 5088044 - DNA, 23 bp, Homo sapiens
aaattggattcccttaaacaaaa

SEQ ID NO: 5088045 - DNA, 15 bp, Homo sapiens
aaattggcaccatgt

SEQ ID NO: 5088046 - DNA, 21 bp, Homo sapiens
aaattggcatggaaatttaaa

SEQ ID NO: 5088047 - DNA, 18 bp, Homo sapiens
aaattggcattaaaactt

SEQ ID NO: 5088048 - DNA, 17 bp, Homo sapiens
aaattggcattttaagt

SEQ ID NO: 5088049 - DNA, 22 bp, Homo sapiens
aaattggcctggtatggctgca

SEQ ID NO: 5088050 - DNA, 12 bp, Homo sapiens
aaattggctcct

SEQ ID NO: 5088051 - DNA, 21 bp, Homo sapiens
aaattggctcctttcccacag

SEQ ID NO: 5088052 - DNA, 22 bp, Homo sapiens
aaattggctcctttcccacagt

SEQ ID NO: 5088053 - DNA, 20 bp, Homo sapiens
aaattgggcttcaatcactg

SEQ ID NO: 5088054 - DNA, 18 bp, Homo sapiens
aaattggggattcttaaa

SEQ ID NO: 5088055 - DNA, 19 bp, Homo sapiens
aaattggggattcttaaag

SEQ ID NO: 5088056 - DNA, 20 bp, Homo sapiens
aaattggggattcttaaagt

SEQ ID NO: 5088057 - DNA, 18 bp, Homo sapiens
aaattgggtgaagagctt

SEQ ID NO: 5088058 - DNA, 22 bp, Homo sapiens
aaattgggtgtgccctggctcc

SEQ ID NO: 5088059 - DNA, 14 bp, Homo sapiens
aaattggtaaaaat

SEQ ID NO: 5088060 - DNA, 21 bp, Homo sapiens
aaattggtaattgaatggaag

SEQ ID NO: 5088061 - DNA, 16 bp, Homo sapiens
aaattggtaccttgca

SEQ ID NO: 5088062 - DNA, 19 bp, Homo sapiens
aaattggtatatttgaaat

SEQ ID NO: 5088063 - DNA, 15 bp, Homo sapiens
aaattggtgataagt

SEQ ID NO: 5088064 - DNA, 22 bp, Homo sapiens
aaattggtgataagtggaaaaa

SEQ ID NO: 5088065 - DNA, 23 bp, Homo sapiens
aaattggttcagggtgataacta

SEQ ID NO: 5088066 - DNA, 16 bp, Homo sapiens
aaattggttctttatt

SEQ ID NO: 5088067 - DNA, 20 bp, Homo sapiens
aaattggttttgtactggat

SEQ ID NO: 5088068 - DNA, 18 bp, Homo sapiens
aaattgtaaatcctgtgt

SEQ ID NO: 5088069 - DNA, 19 bp, Homo sapiens
aaattgtaagcatgcacaa

SEQ ID NO: 5088070 - DNA, 15 bp, Homo sapiens
aaattgtaatttggg

SEQ ID NO: 5088071 - DNA, 15 bp, Homo sapiens
aaattgtacagccgg

SEQ ID NO: 5088072 - DNA, 15 bp, Homo sapiens
aaattgtacatattt

SEQ ID NO: 5088073 - DNA, 13 bp, Homo sapiens
aaattgtacattt

SEQ ID NO: 5088074 - DNA, 16 bp, Homo sapiens
aaattgtagcgtttcc

SEQ ID NO: 5088075 - DNA, 12 bp, Homo sapiens
aaattgtataaa

SEQ ID NO: 5088076 - DNA, 18 bp, Homo sapiens
aaattgtatacattttgt

SEQ ID NO: 5088077 - DNA, 20 bp, Homo sapiens
aaattgtatacattttgtta

SEQ ID NO: 5088078 - DNA, 13 bp, Homo sapiens
aaattgtatacca

SEQ ID NO: 5088079 - DNA, 14 bp, Homo sapiens
aaattgtatattca

SEQ ID NO: 5088080 - DNA, 17 bp, Homo sapiens
aaattgtatattcactt

SEQ ID NO: 5088081 - DNA, 13 bp, Homo sapiens
aaattgtatattg

SEQ ID NO: 5088082 - DNA, 22 bp, Homo sapiens
aaattgtatctagtgcagctga

SEQ ID NO: 5088083 - DNA, 16 bp, Homo sapiens
aaattgtcagatcgtt

SEQ ID NO: 5088084 - DNA, 22 bp, Homo sapiens
aaattgtccttgaagcttgtat

SEQ ID NO: 5088085 - DNA, 23 bp, Homo sapiens
aaattgtccttgaagcttgtatc

SEQ ID NO: 5088086 - DNA, 19 bp, Homo sapiens
aaattgtcgggggagagag

SEQ ID NO: 5088087 - DNA, 23 bp, Homo sapiens
aaattgtcgtttttttcttgtgc

SEQ ID NO: 5088088 - DNA, 18 bp, Homo sapiens
aaattgtctaaaatgtca

SEQ ID NO: 5088089 - DNA, 15 bp, Homo sapiens
aaattgtctgccatt

SEQ ID NO: 5088090 - DNA, 14 bp, Homo sapiens
aaattgtctggtac

SEQ ID NO: 5088091 - DNA, 19 bp, Homo sapiens
aaattgtctgtctgctctt

SEQ ID NO: 5088092 - DNA, 15 bp, Homo sapiens
aaattgtctttatga

SEQ ID NO: 5088093 - DNA, 17 bp, Homo sapiens
aaattgtgaaaaatgag

SEQ ID NO: 5088094 - DNA, 20 bp, Homo sapiens
aaattgtgaaagctccatgt

SEQ ID NO: 5088095 - DNA, 13 bp, Homo sapiens
aaattgtgatgtt

SEQ ID NO: 5088096 - DNA, 15 bp, Homo sapiens
aaattgtgatgtttt

SEQ ID NO: 5088097 - DNA, 15 bp, Homo sapiens
aaattgtgcaaaata

SEQ ID NO: 5088098 - DNA, 15 bp, Homo sapiens
aaattgtgcataatg

SEQ ID NO: 5088099 - DNA, 19 bp, Homo sapiens
aaattgtgcataatgcttt

SEQ ID NO: 5088100 - DNA, 11 bp, Homo sapiens
aaattgtgtta

SEQ ID NO: 5088101 - DNA, 20 bp, Homo sapiens
aaattgtgttcttaaaatat

SEQ ID NO: 5088102 - DNA, 14 bp, Homo sapiens
aaattgtgtttgct

SEQ ID NO: 5088103 - DNA, 19 bp, Homo sapiens
aaattgttaagagtatcat

SEQ ID NO: 5088104 - DNA, 16 bp, Homo sapiens
aaattgttacccattt

SEQ ID NO: 5088105 - DNA, 20 bp, Homo sapiens
aaattgttacccatttgaaa

SEQ ID NO: 5088106 - DNA, 17 bp, Homo sapiens
aaattgttctacttgaa

SEQ ID NO: 5088107 - DNA, 21 bp, Homo sapiens
aaattgttgtatatcactaaa

SEQ ID NO: 5088108 - DNA, 22 bp, Homo sapiens
aaattgttgtatatcactaaaa

SEQ ID NO: 5088109 - DNA, 22 bp, Homo sapiens
aaattgttgtccggtttacttt

SEQ ID NO: 5088110 - DNA, 21 bp, Homo sapiens
aaattgttgtgcttagaattg

SEQ ID NO: 5088111 - DNA, 19 bp, Homo sapiens
aaattgtttagtggaaaat

SEQ ID NO: 5088112 - DNA, 22 bp, Homo sapiens
aaattgtttggcttcctcctga

SEQ ID NO: 5088113 - DNA, 12 bp, Homo sapiens
aaattgtttgta

SEQ ID NO: 5088114 - DNA, 15 bp, Homo sapiens
aaattgttttcactt

SEQ ID NO: 5088115 - DNA, 17 bp, Homo sapiens
aaattgttttcacttgt

SEQ ID NO: 5088116 - DNA, 19 bp, Homo sapiens
aaattgttttcacttgtat

SEQ ID NO: 5088117 - DNA, 12 bp, Homo sapiens
aaatttaaaaaa

SEQ ID NO: 5088118 - DNA, 16 bp, Homo sapiens
aaatttaaaaaataaa

SEQ ID NO: 5088119 - DNA, 19 bp, Homo sapiens
aaatttaaaaaataaataa

SEQ ID NO: 5088120 - DNA, 18 bp, Homo sapiens
aaatttaaaaagcccaac

SEQ ID NO: 5088121 - DNA, 17 bp, Homo sapiens
aaatttaaaaataaagc

SEQ ID NO: 5088122 - DNA, 21 bp, Homo sapiens
aaatttaaaaataaagctact

SEQ ID NO: 5088123 - DNA, 12 bp, Homo sapiens
aaatttaaaaca

SEQ ID NO: 5088124 - DNA, 16 bp, Homo sapiens
aaatttaaaacaaaca

SEQ ID NO: 5088125 - DNA, 16 bp, Homo sapiens
aaatttaaaacacagt

SEQ ID NO: 5088126 - DNA, 14 bp, Homo sapiens
aaatttaaaatgtt

SEQ ID NO: 5088127 - DNA, 19 bp, Homo sapiens
aaatttaaaatgttactta

SEQ ID NO: 5088128 - DNA, 14 bp, Homo sapiens
aaatttaaacatta

SEQ ID NO: 5088129 - DNA, 14 bp, Homo sapiens
aaatttaaactata

SEQ ID NO: 5088130 - DNA, 19 bp, Homo sapiens
aaatttaaactataagcaa

SEQ ID NO: 5088131 - DNA, 18 bp, Homo sapiens
aaatttaaagcaggttct

SEQ ID NO: 5088132 - DNA, 21 bp, Homo sapiens
aaatttaactgcctaaaatgt

SEQ ID NO: 5088133 - DNA, 23 bp, Homo sapiens
aaatttaactgcctaaaatgttc

SEQ ID NO: 5088134 - DNA, 13 bp, Homo sapiens
aaatttaagcaaa

SEQ ID NO: 5088135 - DNA, 14 bp, Homo sapiens
aaatttaagcattg

SEQ ID NO: 5088136 - DNA, 23 bp, Homo sapiens
aaatttaagtatcttttttcaaa

SEQ ID NO: 5088137 - DNA, 16 bp, Homo sapiens
aaatttaagtgcgtgt

SEQ ID NO: 5088138 - DNA, 21 bp, Homo sapiens
aaatttaagttaactgttgct

SEQ ID NO: 5088139 - DNA, 21 bp, Homo sapiens
aaatttaataaaaacttcaga

SEQ ID NO: 5088140 - DNA, 21 bp, Homo sapiens
aaatttaatgtttttctggaa

SEQ ID NO: 5088141 - DNA, 22 bp, Homo sapiens
aaatttaatgtttttctggaag

SEQ ID NO: 5088142 - DNA, 15 bp, Homo sapiens
aaatttaattacaaa

SEQ ID NO: 5088143 - DNA, 18 bp, Homo sapiens
aaatttaattacaaacaa

SEQ ID NO: 5088144 - DNA, 22 bp, Homo sapiens
aaatttaattgtgtaactgttc

SEQ ID NO: 5088145 - DNA, 23 bp, Homo sapiens
aaatttacacaaaaagaaagctg

SEQ ID NO: 5088146 - DNA, 12 bp, Homo sapiens
aaatttacatca

SEQ ID NO: 5088147 - DNA, 19 bp, Homo sapiens
aaatttacatttaatacag

SEQ ID NO: 5088148 - DNA, 20 bp, Homo sapiens
aaatttaccacaaaagcaaa

SEQ ID NO: 5088149 - DNA, 23 bp, Homo sapiens
aaatttaccacaaaagcaaaatt

SEQ ID NO: 5088150 - DNA, 19 bp, Homo sapiens
aaatttacctttttttagt

SEQ ID NO: 5088151 - DNA, 21 bp, Homo sapiens
aaatttactacaatatgtaca

SEQ ID NO: 5088152 - DNA, 12 bp, Homo sapiens
aaatttactata

SEQ ID NO: 5088153 - DNA, 15 bp, Homo sapiens
aaatttactatgtaa

SEQ ID NO: 5088154 - DNA, 16 bp, Homo sapiens
aaatttactatgtaaa

SEQ ID NO: 5088155 - DNA, 19 bp, Homo sapiens
aaatttactctgttgaata

SEQ ID NO: 5088156 - DNA, 18 bp, Homo sapiens
aaatttagatttaattta

SEQ ID NO: 5088157 - DNA, 18 bp, Homo sapiens
aaatttagccctttaaaa

SEQ ID NO: 5088158 - DNA, 21 bp, Homo sapiens
aaatttaggtaaataaagctc

SEQ ID NO: 5088159 - DNA, 22 bp, Homo sapiens
aaatttaggtcagggaaaagac

SEQ ID NO: 5088160 - DNA, 20 bp, Homo sapiens
aaatttagtgctcagaatcc

SEQ ID NO: 5088161 - DNA, 15 bp, Homo sapiens
aaatttagtgctctt

SEQ ID NO: 5088162 - DNA, 18 bp, Homo sapiens
aaatttagtttttgttct

SEQ ID NO: 5088163 - DNA, 16 bp, Homo sapiens
aaatttataaaggtct

SEQ ID NO: 5088164 - DNA, 19 bp, Homo sapiens
aaatttatacaaagaaact

SEQ ID NO: 5088165 - DNA, 14 bp, Homo sapiens
aaatttatataact

SEQ ID NO: 5088166 - DNA, 23 bp, Homo sapiens
aaatttatatcttatatataata

SEQ ID NO: 5088167 - DNA, 14 bp, Homo sapiens
aaatttatatgaaa

SEQ ID NO: 5088168 - DNA, 13 bp, Homo sapiens
aaatttatatgta

SEQ ID NO: 5088169 - DNA, 16 bp, Homo sapiens
aaatttatattgtaaa

SEQ ID NO: 5088170 - DNA, 13 bp, Homo sapiens
aaatttatcaaag

SEQ ID NO: 5088171 - DNA, 20 bp, Homo sapiens
aaatttatgcatttcattca

SEQ ID NO: 5088172 - DNA, 17 bp, Homo sapiens
aaatttatgtcattttc

SEQ ID NO: 5088173 - DNA, 16 bp, Homo sapiens
aaatttattaaatgtt

SEQ ID NO: 5088174 - DNA, 13 bp, Homo sapiens
aaatttattatgt

SEQ ID NO: 5088175 - DNA, 21 bp, Homo sapiens
aaatttattcttatcttagga

SEQ ID NO: 5088176 - DNA, 15 bp, Homo sapiens
aaatttattgaggaa

SEQ ID NO: 5088177 - DNA, 16 bp, Homo sapiens
aaatttattgaggaaa

SEQ ID NO: 5088178 - DNA, 14 bp, Homo sapiens
aaatttatttactg

SEQ ID NO: 5088179 - DNA, 19 bp, Homo sapiens
aaatttatttactgctagt

SEQ ID NO: 5088180 - DNA, 21 bp, Homo sapiens
aaatttatttactgctagtct

SEQ ID NO: 5088181 - DNA, 14 bp, Homo sapiens
aaatttatttgcaa

SEQ ID NO: 5088182 - DNA, 19 bp, Homo sapiens
aaatttattttaatgtaaa

SEQ ID NO: 5088183 - DNA, 20 bp, Homo sapiens
aaatttcacttgaaattaaa

SEQ ID NO: 5088184 - DNA, 17 bp, Homo sapiens
aaatttcagcagctgca

SEQ ID NO: 5088185 - DNA, 19 bp, Homo sapiens
aaatttcaggattaactaa

SEQ ID NO: 5088186 - DNA, 15 bp, Homo sapiens
aaatttcagggaaaa

SEQ ID NO: 5088187 - DNA, 20 bp, Homo sapiens
aaatttcagtcaattctgat

SEQ ID NO: 5088188 - DNA, 17 bp, Homo sapiens
aaatttcatgattggct

SEQ ID NO: 5088189 - DNA, 21 bp, Homo sapiens
aaatttcattatctaatgagt

SEQ ID NO: 5088190 - DNA, 12 bp, Homo sapiens
aaatttcattgc

SEQ ID NO: 5088191 - DNA, 14 bp, Homo sapiens
aaatttcattgcac

SEQ ID NO: 5088192 - DNA, 22 bp, Homo sapiens
aaatttcatttcacatttttgt

SEQ ID NO: 5088193 - DNA, 13 bp, Homo sapiens
aaatttcattttc

SEQ ID NO: 5088194 - DNA, 22 bp, Homo sapiens
aaatttccactcaggtctgttt

SEQ ID NO: 5088195 - DNA, 19 bp, Homo sapiens
aaatttccagtgagcttat

SEQ ID NO: 5088196 - DNA, 23 bp, Homo sapiens
aaatttcccagttaaagattatt

SEQ ID NO: 5088197 - DNA, 16 bp, Homo sapiens
aaatttccccaacagt

SEQ ID NO: 5088198 - DNA, 20 bp, Homo sapiens
aaatttccccaacagtgtga

SEQ ID NO: 5088199 - DNA, 23 bp, Homo sapiens
aacaagggaaggggcctccctcc

SEQ ID NO: 5088200 - DNA, 23 bp, Homo sapiens
aacaaggtgccctttagccagat

SEQ ID NO: 5088201 - DNA, 20 bp, Homo sapiens
aacaaggttatatgaatata

SEQ ID NO: 5088202 - DNA, 16 bp, Homo sapiens
aacaaggttcttctaa

SEQ ID NO: 5088203 - DNA, 13 bp, Homo sapiens
aacaagtaatgta

SEQ ID NO: 5088204 - DNA, 20 bp, Homo sapiens
aacaagtacctgtgaacagt

SEQ ID NO: 5088205 - DNA, 17 bp, Homo sapiens
aacaagtataattacat

SEQ ID NO: 5088206 - DNA, 12 bp, Homo sapiens
aacaagtattta

SEQ ID NO: 5088207 - DNA, 14 bp, Homo sapiens
aacaagtcaattct

SEQ ID NO: 5088208 - DNA, 17 bp, Homo sapiens
aacaagtcacagctgca

SEQ ID NO: 5088209 - DNA, 18 bp, Homo sapiens
aacaagtcagtcattcag

SEQ ID NO: 5088210 - DNA, 16 bp, Homo sapiens
aacaagtccctgtaat

SEQ ID NO: 5088211 - DNA, 17 bp, Homo sapiens
aacaagtctttagtgtt

SEQ ID NO: 5088212 - DNA, 20 bp, Homo sapiens
aacaagtgaacacattgtgt

SEQ ID NO: 5088213 - DNA, 20 bp, Homo sapiens
aacaagtgcctcctggactg

SEQ ID NO: 5088214 - DNA, 14 bp, Homo sapiens
aacaagtgtacaga

SEQ ID NO: 5088215 - DNA, 19 bp, Homo sapiens
aacaagttagtttctcata

SEQ ID NO: 5088216 - DNA, 20 bp, Homo sapiens
aacaagttccattatgaaaa

SEQ ID NO: 5088217 - DNA, 14 bp, Homo sapiens
aacaagttgaagaa

SEQ ID NO: 5088218 - DNA, 15 bp, Homo sapiens
aacaagttgaagaag

SEQ ID NO: 5088219 - DNA, 17 bp, Homo sapiens
aacaagttgagctatga

SEQ ID NO: 5088220 - DNA, 18 bp, Homo sapiens
aacaagttggctagaaga

SEQ ID NO: 5088221 - DNA, 22 bp, Homo sapiens
aacaagttggctagaagaaagt

SEQ ID NO: 5088222 - DNA, 16 bp, Homo sapiens
aacaagttgttaaaac

SEQ ID NO: 5088223 - DNA, 22 bp, Homo sapiens
aacaagttgttaaaacatttaa

SEQ ID NO: 5088224 - DNA, 13 bp, Homo sapiens
aacaagtttgcta

SEQ ID NO: 5088225 - DNA, 19 bp, Homo sapiens
aacaagttttggcagccat

SEQ ID NO: 5088226 - DNA, 17 bp, Homo sapiens
aacaagtttttctgtca

SEQ ID NO: 5088227 - DNA, 17 bp, Homo sapiens
aacaataaaaaaaaacc

SEQ ID NO: 5088228 - DNA, 15 bp, Homo sapiens
aacaataaaaaccaa

SEQ ID NO: 5088229 - DNA, 16 bp, Homo sapiens
aacaataaaatttttt

SEQ ID NO: 5088230 - DNA, 14 bp, Homo sapiens
aacaataaagagct

SEQ ID NO: 5088231 - DNA, 19 bp, Homo sapiens
aacaataaagatacatgat

SEQ ID NO: 5088232 - DNA, 22 bp, Homo sapiens
aacaataaagcattttgcaaac

SEQ ID NO: 5088233 - DNA, 20 bp, Homo sapiens
aacaataactactgtgttcc

SEQ ID NO: 5088234 - DNA, 21 bp, Homo sapiens
aacaataactactgtgttcct

SEQ ID NO: 5088235 - DNA, 17 bp, Homo sapiens
aacaataagacatgctt

SEQ ID NO: 5088236 - DNA, 15 bp, Homo sapiens
aacaataataaatgt

SEQ ID NO: 5088237 - DNA, 15 bp, Homo sapiens
aacaataatatttca

SEQ ID NO: 5088238 - DNA, 14 bp, Homo sapiens
aacaataattcatc

SEQ ID NO: 5088239 - DNA, 16 bp, Homo sapiens
aacaatacaaatggat

SEQ ID NO: 5088240 - DNA, 18 bp, Homo sapiens
aacaatacaacaagaaca

SEQ ID NO: 5088241 - DNA, 20 bp, Homo sapiens
aacaatacaacaagaacaac

SEQ ID NO: 5088242 - DNA, 21 bp, Homo sapiens
aacaatacctgaatgctctgt

SEQ ID NO: 5088243 - DNA, 19 bp, Homo sapiens
aacaatactcataatgtga

SEQ ID NO: 5088244 - DNA, 21 bp, Homo sapiens
aacaatacttttcaggcactt

SEQ ID NO: 5088245 - DNA, 14 bp, Homo sapiens
aacaatagctattg

SEQ ID NO: 5088246 - DNA, 14 bp, Homo sapiens
aacaatatatttgt

SEQ ID NO: 5088247 - DNA, 13 bp, Homo sapiens
aacaatatcatat

SEQ ID NO: 5088248 - DNA, 18 bp, Homo sapiens
aacaatatcatatcatca

SEQ ID NO: 5088249 - DNA, 15 bp, Homo sapiens
aacaatatgattgca

SEQ ID NO: 5088250 - DNA, 19 bp, Homo sapiens
aacaatatgattgcactaa

SEQ ID NO: 5088251 - DNA, 15 bp, Homo sapiens
aacaatatgctttac

SEQ ID NO: 5088252 - DNA, 21 bp, Homo sapiens
aacaatatgtaatcaaacttc

SEQ ID NO: 5088253 - DNA, 21 bp, Homo sapiens
aacaatatgtttgcaaacttg

SEQ ID NO: 5088254 - DNA, 21 bp, Homo sapiens
aacaatattttatggttatgt

SEQ ID NO: 5088255 - DNA, 22 bp, Homo sapiens
aacaatattttatggttatgtt

SEQ ID NO: 5088256 - DNA, 18 bp, Homo sapiens
aacaatcaaggcaactag

SEQ ID NO: 5088257 - DNA, 15 bp, Homo sapiens
aacaatcactattct

SEQ ID NO: 5088258 - DNA, 17 bp, Homo sapiens
aacaatcactattctta

SEQ ID NO: 5088259 - DNA, 20 bp, Homo sapiens
aacaatcagtcatcatgggt

SEQ ID NO: 5088260 - DNA, 14 bp, Homo sapiens
aacaatccaaatgc

SEQ ID NO: 5088261 - DNA, 16 bp, Homo sapiens
aacaatccattcacaa

SEQ ID NO: 5088262 - DNA, 20 bp, Homo sapiens
aacaatccattcacaagcct

SEQ ID NO: 5088263 - DNA, 20 bp, Homo sapiens
aacaatcccagcatctgatt

SEQ ID NO: 5088264 - DNA, 16 bp, Homo sapiens
aacaatcccctaacac

SEQ ID NO: 5088265 - DNA, 17 bp, Homo sapiens
aacaatccttactaagt

SEQ ID NO: 5088266 - DNA, 16 bp, Homo sapiens
aacaatctatagttat

SEQ ID NO: 5088267 - DNA, 13 bp, Homo sapiens
aacaatctattta

SEQ ID NO: 5088268 - DNA, 16 bp, Homo sapiens
aacaatcttattccga

SEQ ID NO: 5088269 - DNA, 18 bp, Homo sapiens
aacaatcttattccgagc

SEQ ID NO: 5088270 - DNA, 22 bp, Homo sapiens
aacaatcttattccgagcattc

SEQ ID NO: 5088271 - DNA, 23 bp, Homo sapiens
aacaatcttattccgagcattcc

SEQ ID NO: 5088272 - DNA, 18 bp, Homo sapiens
aacaatctttcatgtctt

SEQ ID NO: 5088273 - DNA, 18 bp, Homo sapiens
aacaatgaaattgaccta

SEQ ID NO: 5088274 - DNA, 14 bp, Homo sapiens
aacaatgaagataa

SEQ ID NO: 5088275 - DNA, 21 bp, Homo sapiens
aacaatgaagtgttttacaat

SEQ ID NO: 5088276 - DNA, 15 bp, Homo sapiens
aacaatgaagttgaa

SEQ ID NO: 5088277 - DNA, 16 bp, Homo sapiens
aacaatgaagttgaaa

SEQ ID NO: 5088278 - DNA, 24 bp, Homo sapiens
aacaatgaataaaaactcaaggag

SEQ ID NO: 5088279 - DNA, 19 bp, Homo sapiens
aacaatgaatcagaacaga

SEQ ID NO: 5088280 - DNA, 18 bp, Homo sapiens
aacaatgacaaagcagat

SEQ ID NO: 5088281 - DNA, 16 bp, Homo sapiens
aacaatgacaagatgt

SEQ ID NO: 5088282 - DNA, 19 bp, Homo sapiens
aacaatgacatccagaaag

SEQ ID NO: 5088283 - DNA, 20 bp, Homo sapiens
aacaatgactaattcttgca

SEQ ID NO: 5088284 - DNA, 15 bp, Homo sapiens
aacaatgatatatgg

SEQ ID NO: 5088285 - DNA, 14 bp, Homo sapiens
aacaatgattaatc

SEQ ID NO: 5088286 - DNA, 16 bp, Homo sapiens
aacaatgcaactttta

SEQ ID NO: 5088287 - DNA, 18 bp, Homo sapiens
aacaatgccagggcccag

SEQ ID NO: 5088288 - DNA, 13 bp, Homo sapiens
aacaatgccatga

SEQ ID NO: 5088289 - DNA, 17 bp, Homo sapiens
aacaatgccatgaacaa

SEQ ID NO: 5088290 - DNA, 19 bp, Homo sapiens
aacaatgccatgaacaaat

SEQ ID NO: 5088291 - DNA, 20 bp, Homo sapiens
aacaatgccatgaacaaatt

SEQ ID NO: 5088292 - DNA, 22 bp, Homo sapiens
aacaatgccatgaacaaattct

SEQ ID NO: 5088293 - DNA, 23 bp, Homo sapiens
aacaatgccgcctgtcaataaat

SEQ ID NO: 5088294 - DNA, 18 bp, Homo sapiens
aacaatgcctattgtaat

SEQ ID NO: 5088295 - DNA, 23 bp, Homo sapiens
aacaatgcctattgtaatataga

SEQ ID NO: 5088296 - DNA, 17 bp, Homo sapiens
aacaatgccttgttgta

SEQ ID NO: 5088297 - DNA, 23 bp, Homo sapiens
aacaatgccttgttgtattcctg

SEQ ID NO: 5088298 - DNA, 15 bp, Homo sapiens
aacaatgctgtattt

SEQ ID NO: 5088299 - DNA, 17 bp, Homo sapiens
aacaatgctgtatttta

SEQ ID NO: 5088300 - DNA, 17 bp, Homo sapiens
aacaatggaaactgaat

SEQ ID NO: 5088301 - DNA, 18 bp, Homo sapiens
aacaatggaaactgaatg

SEQ ID NO: 5088302 - DNA, 16 bp, Homo sapiens
aacaatggagtattct

SEQ ID NO: 5088303 - DNA, 22 bp, Homo sapiens
aacaatggtgtggtgaatgtgt

SEQ ID NO: 5088304 - DNA, 23 bp, Homo sapiens
aacaatggttgaatgaataaaac

SEQ ID NO: 5088305 - DNA, 20 bp, Homo sapiens
aacaatggtttacatgaaca

SEQ ID NO: 5088306 - DNA, 21 bp, Homo sapiens
aacaatgtataaagattgtac

SEQ ID NO: 5088307 - DNA, 16 bp, Homo sapiens
aacaatgtattttctt

SEQ ID NO: 5088308 - DNA, 16 bp, Homo sapiens
aacaatgtcagaaact

SEQ ID NO: 5088309 - DNA, 17 bp, Homo sapiens
aacaatgtcctctttga

SEQ ID NO: 5088310 - DNA, 20 bp, Homo sapiens
aacaatgtgtctatttctga

SEQ ID NO: 5088311 - DNA, 11 bp, Homo sapiens
aacaatgtgtg

SEQ ID NO: 5088312 - DNA, 13 bp, Homo sapiens
aacaatgttaagg

SEQ ID NO: 5088313 - DNA, 22 bp, Homo sapiens
aacaatgttaaggaaactctta

SEQ ID NO: 5088314 - DNA, 21 bp, Homo sapiens
aacaatgttgtccaacaataa

SEQ ID NO: 5088315 - DNA, 23 bp, Homo sapiens
aacaatgttgtccaacaataaac

SEQ ID NO: 5088316 - DNA, 22 bp, Homo sapiens
aacaatgtttgggggaaaaaaa

SEQ ID NO: 5088317 - DNA, 15 bp, Homo sapiens
aacaatgtttttcat

SEQ ID NO: 5088318 - DNA, 23 bp, Homo sapiens
aacaatgttttttatacttcaaa

SEQ ID NO: 5088319 - DNA, 14 bp, Homo sapiens
aacaattatttgaa

SEQ ID NO: 5088320 - DNA, 15 bp, Homo sapiens
aacaattattttatt

SEQ ID NO: 5088321 - DNA, 16 bp, Homo sapiens
aacaattcaagctgag

SEQ ID NO: 5088322 - DNA, 15 bp, Homo sapiens
aacaattcaatcaaa

SEQ ID NO: 5088323 - DNA, 19 bp, Homo sapiens
aacaattcaatcaaagcta

SEQ ID NO: 5088324 - DNA, 16 bp, Homo sapiens
aacaattcatgccttt

SEQ ID NO: 5088325 - DNA, 20 bp, Homo sapiens
aacaattcatgcctttcata

SEQ ID NO: 5088326 - DNA, 23 bp, Homo sapiens
aacaattctcccgggactctgca

SEQ ID NO: 5088327 - DNA, 14 bp, Homo sapiens
aacaattctgatga

SEQ ID NO: 5088328 - DNA, 20 bp, Homo sapiens
aacaattgcaacagaagcaa

SEQ ID NO: 5088329 - DNA, 17 bp, Homo sapiens
aacaattggtgtcattt

SEQ ID NO: 5088330 - DNA, 14 bp, Homo sapiens
aacaattgtgaagt

SEQ ID NO: 5088331 - DNA, 22 bp, Homo sapiens
aacaattgtgtagcctttttgt

SEQ ID NO: 5088332 - DNA, 23 bp, Homo sapiens
aacaattgtgtagcctttttgta

SEQ ID NO: 5088333 - DNA, 19 bp, Homo sapiens
aacaatttagccagaatgt

SEQ ID NO: 5088334 - DNA, 21 bp, Homo sapiens
aacaatttagccagaatgttt

SEQ ID NO: 5088335 - DNA, 19 bp, Homo sapiens
aacaatttaggaatgctca

SEQ ID NO: 5088336 - DNA, 20 bp, Homo sapiens
aacaatttaggaatgctcaa

SEQ ID NO: 5088337 - DNA, 13 bp, Homo sapiens
aacaatttatgaa

SEQ ID NO: 5088338 - DNA, 20 bp, Homo sapiens
aacaatttcctttatattta

SEQ ID NO: 5088339 - DNA, 20 bp, Homo sapiens
aacaatttgagatgtatttc

SEQ ID NO: 5088340 - DNA, 18 bp, Homo sapiens
aacaatttggcaattttg

SEQ ID NO: 5088341 - DNA, 20 bp, Homo sapiens
aacaatttgggcttcctgtt

SEQ ID NO: 5088342 - DNA, 17 bp, Homo sapiens
aacaattttaaataaga

SEQ ID NO: 5088343 - DNA, 23 bp, Homo sapiens
aacaattttaggaggaccagagc

SEQ ID NO: 5088344 - DNA, 13 bp, Homo sapiens
aacaattttcaga

SEQ ID NO: 5088345 - DNA, 17 bp, Homo sapiens
aacaattttcagatttg

SEQ ID NO: 5088346 - DNA, 19 bp, Homo sapiens
aacaattttcagatttgca

SEQ ID NO: 5088347 - DNA, 15 bp, Homo sapiens
aacaattttttgtga

SEQ ID NO: 5088348 - DNA, 12 bp, Homo sapiens
aacacaaaaaaa

SEQ ID NO: 5088349 - DNA, 22 bp, Homo sapiens
aacacaaaacattcatgtaact

SEQ ID NO: 5088350 - DNA, 15 bp, Homo sapiens
aacacaaaacattta

SEQ ID NO: 5088351 - DNA, 16 bp, Homo sapiens
aacacaaaacttgaaa

SEQ ID NO: 5088352 - DNA, 14 bp, Homo sapiens
aacacaaaatgaat

SEQ ID NO: 5088353 - DNA, 15 bp, Homo sapiens
aacacaaaatgaata

SEQ ID NO: 5088354 - DNA, 15 bp, Homo sapiens
aacacaaactgtaaa

SEQ ID NO: 5088355 - DNA, 11 bp, Homo sapiens
aacacaaagac

SEQ ID NO: 5088356 - DNA, 19 bp, Homo sapiens
aacacaaagacatggaaga

SEQ ID NO: 5088357 - DNA, 12 bp, Homo sapiens
aacacaaagctt

SEQ ID NO: 5088358 - DNA, 18 bp, Homo sapiens
aacacaaagcttttgcat

SEQ ID NO: 5088359 - DNA, 19 bp, Homo sapiens
aacacaaagcttttgcata

SEQ ID NO: 5088360 - DNA, 17 bp, Homo sapiens
aacacaaatgaaaatga

SEQ ID NO: 5088361 - DNA, 14 bp, Homo sapiens
aacacaaatgtaaa

SEQ ID NO: 5088362 - DNA, 17 bp, Homo sapiens
aacacaaatgtctagtt

SEQ ID NO: 5088363 - DNA, 17 bp, Homo sapiens
aacacaacacaagaaaa

SEQ ID NO: 5088364 - DNA, 14 bp, Homo sapiens
aacacaacatttgt

SEQ ID NO: 5088365 - DNA, 15 bp, Homo sapiens
aacacaactatattg

SEQ ID NO: 5088366 - DNA, 16 bp, Homo sapiens
aacacaactatattgt

SEQ ID NO: 5088367 - DNA, 14 bp, Homo sapiens
aacacaagaaaaag

SEQ ID NO: 5088368 - DNA, 18 bp, Homo sapiens
aacacaagacaccttttg

SEQ ID NO: 5088369 - DNA, 12 bp, Homo sapiens
aacacaagcaaa

SEQ ID NO: 5088370 - DNA, 16 bp, Homo sapiens
aacacaagcaaaaaaa

SEQ ID NO: 5088371 - DNA, 23 bp, Homo sapiens
aacacaagtagatgcctgaactt

SEQ ID NO: 5088372 - DNA, 11 bp, Homo sapiens
aacacaataag

SEQ ID NO: 5088373 - DNA, 18 bp, Homo sapiens
aacacaataatgtgtcct

SEQ ID NO: 5088374 - DNA, 13 bp, Homo sapiens
aacacaataccta

SEQ ID NO: 5088375 - DNA, 17 bp, Homo sapiens
aacacaatgttattcgt

SEQ ID NO: 5088376 - DNA, 12 bp, Homo sapiens
aacacaattcta

SEQ ID NO: 5088377 - DNA, 19 bp, Homo sapiens
aaatttccggaagtaaata

SEQ ID NO: 5088378 - DNA, 15 bp, Homo sapiens
aaatttcctgtttga

SEQ ID NO: 5088379 - DNA, 15 bp, Homo sapiens
aaatttcgttgtcca

SEQ ID NO: 5088380 - DNA, 20 bp, Homo sapiens
aaatttcgttgtccaatttg

SEQ ID NO: 5088381 - DNA, 15 bp, Homo sapiens
aaatttctaaatctc

SEQ ID NO: 5088382 - DNA, 21 bp, Homo sapiens
aaatttctcagtttttgctga

SEQ ID NO: 5088383 - DNA, 14 bp, Homo sapiens
aaatttctggacct

SEQ ID NO: 5088384 - DNA, 12 bp, Homo sapiens
aaatttctggca

SEQ ID NO: 5088385 - DNA, 18 bp, Homo sapiens
aaatttctgtaaaacagg

SEQ ID NO: 5088386 - DNA, 20 bp, Homo sapiens
aaatttcttatgtgacatta

SEQ ID NO: 5088387 - DNA, 21 bp, Homo sapiens
aaatttcttttattaatactt

SEQ ID NO: 5088388 - DNA, 15 bp, Homo sapiens
aaatttcttttgcta

SEQ ID NO: 5088389 - DNA, 18 bp, Homo sapiens
aaatttgaaaaaactttc

SEQ ID NO: 5088390 - DNA, 13 bp, Homo sapiens
aaatttgaaacat

SEQ ID NO: 5088391 - DNA, 12 bp, Homo sapiens
aaatttgaacta

SEQ ID NO: 5088392 - DNA, 16 bp, Homo sapiens
aaatttgaagaatgaa

SEQ ID NO: 5088393 - DNA, 10 bp, Homo sapiens
aaatttgaat

SEQ ID NO: 5088394 - DNA, 21 bp, Homo sapiens
aaatttgaatggattaaatgg

SEQ ID NO: 5088395 - DNA, 15 bp, Homo sapiens
aaatttgaattttgt

SEQ ID NO: 5088396 - DNA, 15 bp, Homo sapiens
aaatttgacattgtc

SEQ ID NO: 5088397 - DNA, 20 bp, Homo sapiens
aaatttgactaattttacat

SEQ ID NO: 5088398 - DNA, 16 bp, Homo sapiens
aaatttgacttttctg

SEQ ID NO: 5088399 - DNA, 18 bp, Homo sapiens
aaatttgacttttctgta

SEQ ID NO: 5088400 - DNA, 19 bp, Homo sapiens
aaatttgataaactgaatt

SEQ ID NO: 5088401 - DNA, 18 bp, Homo sapiens
aaatttgatacttatatt

SEQ ID NO: 5088402 - DNA, 20 bp, Homo sapiens
aaatttgatggactaattat

SEQ ID NO: 5088403 - DNA, 18 bp, Homo sapiens
aaatttgatttccatctt

SEQ ID NO: 5088404 - DNA, 13 bp, Homo sapiens
aaatttgcaaaat

SEQ ID NO: 5088405 - DNA, 18 bp, Homo sapiens
aaatttgcaacatataaa

SEQ ID NO: 5088406 - DNA, 18 bp, Homo sapiens
aaatttgcaactcactga

SEQ ID NO: 5088407 - DNA, 21 bp, Homo sapiens
aaatttgccatgacatttcat

SEQ ID NO: 5088408 - DNA, 12 bp, Homo sapiens
aaatttgcttta

SEQ ID NO: 5088409 - DNA, 22 bp, Homo sapiens
aaatttgctttgggattttctt

SEQ ID NO: 5088410 - DNA, 19 bp, Homo sapiens
aaatttgctttttgagatg

SEQ ID NO: 5088411 - DNA, 14 bp, Homo sapiens
aaatttggagtaaa

SEQ ID NO: 5088412 - DNA, 13 bp, Homo sapiens
aaatttggcctta

SEQ ID NO: 5088413 - DNA, 17 bp, Homo sapiens
aaatttggccttaagaa

SEQ ID NO: 5088414 - DNA, 20 bp, Homo sapiens
aaatttggccttaagaactg

SEQ ID NO: 5088415 - DNA, 23 bp, Homo sapiens
aaatttggccttaagaactgtgt

SEQ ID NO: 5088416 - DNA, 22 bp, Homo sapiens
aaatttggctcacttgccttag

SEQ ID NO: 5088417 - DNA, 23 bp, Homo sapiens
aaatttgggacctgcttcattca

SEQ ID NO: 5088418 - DNA, 20 bp, Homo sapiens
aaatttgggttgcaaagcta

SEQ ID NO: 5088419 - DNA, 16 bp, Homo sapiens
aaatttgtaaactttg

SEQ ID NO: 5088420 - DNA, 23 bp, Homo sapiens
aaatttgtaaactttgcttctcc

SEQ ID NO: 5088421 - DNA, 13 bp, Homo sapiens
aaatttgtaactt

SEQ ID NO: 5088422 - DNA, 19 bp, Homo sapiens
aaatttgtaagtttcaggt

SEQ ID NO: 5088423 - DNA, 22 bp, Homo sapiens
aaatttgtaagtttcaggtgac

SEQ ID NO: 5088424 - DNA, 19 bp, Homo sapiens
aaatttgtaataaaactat

SEQ ID NO: 5088425 - DNA, 21 bp, Homo sapiens
aaatttgtaataaaactattt

SEQ ID NO: 5088426 - DNA, 13 bp, Homo sapiens
aaatttgtaatat

SEQ ID NO: 5088427 - DNA, 20 bp, Homo sapiens
aaatttgtaatatatcctgt

SEQ ID NO: 5088428 - DNA, 12 bp, Homo sapiens
aaatttgtacag

SEQ ID NO: 5088429 - DNA, 20 bp, Homo sapiens
aaatttgtacaggactgtaa

SEQ ID NO: 5088430 - DNA, 11 bp, Homo sapiens
aaatttgtact

SEQ ID NO: 5088431 - DNA, 24 bp, Homo sapiens
aaatttgtccaatggctgtaaact

SEQ ID NO: 5088432 - DNA, 22 bp, Homo sapiens
aaatttgtcttaaaaatttata

SEQ ID NO: 5088433 - DNA, 13 bp, Homo sapiens
aaatttgtgaact

SEQ ID NO: 5088434 - DNA, 12 bp, Homo sapiens
aaatttgtgtaa

SEQ ID NO: 5088435 - DNA, 14 bp, Homo sapiens
aaatttgtgtcata

SEQ ID NO: 5088436 - DNA, 17 bp, Homo sapiens
aaatttgttaatatata

SEQ ID NO: 5088437 - DNA, 18 bp, Homo sapiens
aaatttgttataatgaat

SEQ ID NO: 5088438 - DNA, 15 bp, Homo sapiens
aaatttgttcttgta

SEQ ID NO: 5088439 - DNA, 18 bp, Homo sapiens
aaatttgttcttgtattt

SEQ ID NO: 5088440 - DNA, 13 bp, Homo sapiens
aaatttgttcttt

SEQ ID NO: 5088441 - DNA, 16 bp, Homo sapiens
aaatttgttgtttgtt

SEQ ID NO: 5088442 - DNA, 15 bp, Homo sapiens
aaatttgtttaaagt

SEQ ID NO: 5088443 - DNA, 14 bp, Homo sapiens
aaatttgtttgaaa

SEQ ID NO: 5088444 - DNA, 18 bp, Homo sapiens
aaatttgtttgaaatctt

SEQ ID NO: 5088445 - DNA, 22 bp, Homo sapiens
aaatttgttttgacggatgatt

SEQ ID NO: 5088446 - DNA, 10 bp, Homo sapiens
aaattttaaa

SEQ ID NO: 5088447 - DNA, 12 bp, Homo sapiens
aaattttaaaaa

SEQ ID NO: 5088448 - DNA, 13 bp, Homo sapiens
aaattttaaaaaa

SEQ ID NO: 5088449 - DNA, 15 bp, Homo sapiens
aaattttaaatgttt

SEQ ID NO: 5088450 - DNA, 10 bp, Homo sapiens
aaattttaac

SEQ ID NO: 5088451 - DNA, 10 bp, Homo sapiens
aaattttaat

SEQ ID NO: 5088452 - DNA, 22 bp, Homo sapiens
aaattttaatatgggttctttt

SEQ ID NO: 5088453 - DNA, 16 bp, Homo sapiens
aaattttaatattcca

SEQ ID NO: 5088454 - DNA, 23 bp, Homo sapiens
aaattttaatgttaactttcaaa

SEQ ID NO: 5088455 - DNA, 14 bp, Homo sapiens
aaattttacatgac

SEQ ID NO: 5088456 - DNA, 22 bp, Homo sapiens
aaattttaccaagttatataaa

SEQ ID NO: 5088457 - DNA, 20 bp, Homo sapiens
aaattttacctctctctggg

SEQ ID NO: 5088458 - DNA, 18 bp, Homo sapiens
aaattttactgacagaaa

SEQ ID NO: 5088459 - DNA, 16 bp, Homo sapiens
aaattttagagcatac

SEQ ID NO: 5088460 - DNA, 15 bp, Homo sapiens
aaattttagatatta

SEQ ID NO: 5088461 - DNA, 23 bp, Homo sapiens
aaattttagcgtgctcactgacc

SEQ ID NO: 5088462 - DNA, 20 bp, Homo sapiens
aaattttagttatagtgttt

SEQ ID NO: 5088463 - DNA, 18 bp, Homo sapiens
aaattttataatgtcata

SEQ ID NO: 5088464 - DNA, 20 bp, Homo sapiens
aaattttatctcttcttcct

SEQ ID NO: 5088465 - DNA, 19 bp, Homo sapiens
aaattttattaaacaattt

SEQ ID NO: 5088466 - DNA, 16 bp, Homo sapiens
aaattttattgaatat

SEQ ID NO: 5088467 - DNA, 16 bp, Homo sapiens
aaattttatttagttc

SEQ ID NO: 5088468 - DNA, 19 bp, Homo sapiens
aaattttatttattttaat

SEQ ID NO: 5088469 - DNA, 16 bp, Homo sapiens
aaattttcagaaagca

SEQ ID NO: 5088470 - DNA, 20 bp, Homo sapiens
aaattttcatgaatgtgctg

SEQ ID NO: 5088471 - DNA, 22 bp, Homo sapiens
aaattttccattacatgatctt

SEQ ID NO: 5088472 - DNA, 22 bp, Homo sapiens
aaattttcctgtcctctttcag

SEQ ID NO: 5088473 - DNA, 16 bp, Homo sapiens
aaattttctaaataac

SEQ ID NO: 5088474 - DNA, 19 bp, Homo sapiens
aaattttctagactttctg

SEQ ID NO: 5088475 - DNA, 20 bp, Homo sapiens
aaattttctagactttctgt

SEQ ID NO: 5088476 - DNA, 14 bp, Homo sapiens
aaattttctccagt

SEQ ID NO: 5088477 - DNA, 20 bp, Homo sapiens
aaattttctctaaactgttt

SEQ ID NO: 5088478 - DNA, 12 bp, Homo sapiens
aaattttctggt

SEQ ID NO: 5088479 - DNA, 21 bp, Homo sapiens
aaattttcttttaagcatttg

SEQ ID NO: 5088480 - DNA, 22 bp, Homo sapiens
aaattttcttttaagcatttgt

SEQ ID NO: 5088481 - DNA, 13 bp, Homo sapiens
aaattttcttttt

SEQ ID NO: 5088482 - DNA, 13 bp, Homo sapiens
aaattttgaaaag

SEQ ID NO: 5088483 - DNA, 14 bp, Homo sapiens
aaattttgaaaagt

SEQ ID NO: 5088484 - DNA, 17 bp, Homo sapiens
aaattttgaaaagtaat

SEQ ID NO: 5088485 - DNA, 12 bp, Homo sapiens
aaattttgaatg

SEQ ID NO: 5088486 - DNA, 17 bp, Homo sapiens
aaattttgaggtctttt

SEQ ID NO: 5088487 - DNA, 21 bp, Homo sapiens
aaattttgattaaccttttca

SEQ ID NO: 5088488 - DNA, 13 bp, Homo sapiens
aaattttgcaaat

SEQ ID NO: 5088489 - DNA, 15 bp, Homo sapiens
aaattttgcaaatat

SEQ ID NO: 5088490 - DNA, 16 bp, Homo sapiens
aaattttgcaaatata

SEQ ID NO: 5088491 - DNA, 20 bp, Homo sapiens
aaattttgcaaatataaaca

SEQ ID NO: 5088492 - DNA, 17 bp, Homo sapiens
aaattttgcatattctc

SEQ ID NO: 5088493 - DNA, 12 bp, Homo sapiens
aaattttgcatt

SEQ ID NO: 5088494 - DNA, 13 bp, Homo sapiens
aaattttgcattt

SEQ ID NO: 5088495 - DNA, 20 bp, Homo sapiens
aaattttgccagagaaacta

SEQ ID NO: 5088496 - DNA, 20 bp, Homo sapiens
aaattttgctaccaaagaat

SEQ ID NO: 5088497 - DNA, 21 bp, Homo sapiens
aaattttgctatcaacaataa

SEQ ID NO: 5088498 - DNA, 18 bp, Homo sapiens
aaattttgtaatgaattc

SEQ ID NO: 5088499 - DNA, 14 bp, Homo sapiens
aaattttgtaattt

SEQ ID NO: 5088500 - DNA, 15 bp, Homo sapiens
aaattttgtaatttt

SEQ ID NO: 5088501 - DNA, 15 bp, Homo sapiens
aaattttgtacattt

SEQ ID NO: 5088502 - DNA, 24 bp, Homo sapiens
aaattttgtacatttttgatcaaa

SEQ ID NO: 5088503 - DNA, 21 bp, Homo sapiens
aaattttgtcctttcatgtaa

SEQ ID NO: 5088504 - DNA, 13 bp, Homo sapiens
aaattttgtgcaa

SEQ ID NO: 5088505 - DNA, 23 bp, Homo sapiens
aaattttgtttcagaattttgta

SEQ ID NO: 5088506 - DNA, 14 bp, Homo sapiens
aaattttgttttct

SEQ ID NO: 5088507 - DNA, 13 bp, Homo sapiens
aaatttttaaaac

SEQ ID NO: 5088508 - DNA, 16 bp, Homo sapiens
aaatttttaaaatctg

SEQ ID NO: 5088509 - DNA, 20 bp, Homo sapiens
aaatttttaaatcatttcat

SEQ ID NO: 5088510 - DNA, 24 bp, Homo sapiens
aaatttttaaatcatttcatgtta

SEQ ID NO: 5088511 - DNA, 22 bp, Homo sapiens
aaatttttaactgcctttttgt

SEQ ID NO: 5088512 - DNA, 21 bp, Homo sapiens
aaatttttaagtaatttcatg

SEQ ID NO: 5088513 - DNA, 12 bp, Homo sapiens
aaatttttacaa

SEQ ID NO: 5088514 - DNA, 21 bp, Homo sapiens
aaatttttcaaccccaccctg

SEQ ID NO: 5088515 - DNA, 17 bp, Homo sapiens
aaatttttcagatgctt

SEQ ID NO: 5088516 - DNA, 18 bp, Homo sapiens
aaatttttcagatgcttc

SEQ ID NO: 5088517 - DNA, 16 bp, Homo sapiens
aaatttttccacacta

SEQ ID NO: 5088518 - DNA, 17 bp, Homo sapiens
aaatttttcttcttgag

SEQ ID NO: 5088519 - DNA, 15 bp, Homo sapiens
aaatttttgaaaaat

SEQ ID NO: 5088520 - DNA, 16 bp, Homo sapiens
aaatttttgaaaaata

SEQ ID NO: 5088521 - DNA, 17 bp, Homo sapiens
aaatttttgaaaaatat

SEQ ID NO: 5088522 - DNA, 19 bp, Homo sapiens
aaatttttgaaaaatattg

SEQ ID NO: 5088523 - DNA, 13 bp, Homo sapiens
aaatttttgcaaa

SEQ ID NO: 5088524 - DNA, 14 bp, Homo sapiens
aaatttttgcaaat

SEQ ID NO: 5088525 - DNA, 18 bp, Homo sapiens
aaatttttgcatgtttaa

SEQ ID NO: 5088526 - DNA, 22 bp, Homo sapiens
aaatttttgcatgtttaataat

SEQ ID NO: 5088527 - DNA, 13 bp, Homo sapiens
aaatttttggatt

SEQ ID NO: 5088528 - DNA, 19 bp, Homo sapiens
aaatttttggattgacagt

SEQ ID NO: 5088529 - DNA, 13 bp, Homo sapiens
aaatttttgtaaa

SEQ ID NO: 5088530 - DNA, 14 bp, Homo sapiens
aaatttttgtaaat

SEQ ID NO: 5088531 - DNA, 17 bp, Homo sapiens
aaatttttgtcatttta

SEQ ID NO: 5088532 - DNA, 13 bp, Homo sapiens
aaattttttacgt

SEQ ID NO: 5088533 - DNA, 21 bp, Homo sapiens
aaattttttacgtagctattt

SEQ ID NO: 5088534 - DNA, 17 bp, Homo sapiens
aaattttttattttaat

SEQ ID NO: 5088535 - DNA, 15 bp, Homo sapiens
aaattttttgaaaca

SEQ ID NO: 5088536 - DNA, 20 bp, Homo sapiens
aaattttttgatgtcagcct

SEQ ID NO: 5088537 - DNA, 16 bp, Homo sapiens
aaattttttgattaat

SEQ ID NO: 5088538 - DNA, 13 bp, Homo sapiens
aaattttttggca

SEQ ID NO: 5088539 - DNA, 19 bp, Homo sapiens
aaatttttttccagaattg

SEQ ID NO: 5088540 - DNA, 14 bp, Homo sapiens
aaatttttttggtc

SEQ ID NO: 5088541 - DNA, 23 bp, Homo sapiens
aaatttttttggtctttttgtaa

SEQ ID NO: 5088542 - DNA, 20 bp, Homo sapiens
aaatttttttgtatgaaaac

SEQ ID NO: 5088543 - DNA, 23 bp, Homo sapiens
aaatttttttgttgtttaacttg

SEQ ID NO: 5088544 - DNA, 16 bp, Homo sapiens
aaattttttttacatt

SEQ ID NO: 5088545 - DNA, 17 bp, Homo sapiens
aaattttttttacattt

SEQ ID NO: 5088546 - DNA, 23 bp, Homo sapiens
aaatttttttttctctttttggt

SEQ ID NO: 5088547 - DNA, 17 bp, Homo sapiens
aacaaaaaaaagaaaga

SEQ ID NO: 5088548 - DNA, 17 bp, Homo sapiens
aacaaaaaaaatgttaa

SEQ ID NO: 5088549 - DNA, 19 bp, Homo sapiens
aacaaaaaaagacaagaga

SEQ ID NO: 5088550 - DNA, 13 bp, Homo sapiens
aacaaaaaaatct

SEQ ID NO: 5088551 - DNA, 16 bp, Homo sapiens
aacaaaaaagagaaac

SEQ ID NO: 5088552 - DNA, 16 bp, Homo sapiens
aacaaaaaatattcat

SEQ ID NO: 5088553 - DNA, 20 bp, Homo sapiens
aacaaaaaatgtgctgttca

SEQ ID NO: 5088554 - DNA, 13 bp, Homo sapiens
aacaaaaacagaa

SEQ ID NO: 5088555 - DNA, 14 bp, Homo sapiens
aacaaaaaccaaaa

SEQ ID NO: 5088556 - DNA, 13 bp, Homo sapiens
aacaaaaagatgt

SEQ ID NO: 5088557 - DNA, 13 bp, Homo sapiens
aacacacaaaaag

SEQ ID NO: 5088558 - DNA, 20 bp, Homo sapiens
aacacacaaaagattatgta

SEQ ID NO: 5088559 - DNA, 10 bp, Homo sapiens
aacacacaca

SEQ ID NO: 5088560 - DNA, 16 bp, Homo sapiens
aacacacacacattct

SEQ ID NO: 5088561 - DNA, 15 bp, Homo sapiens
aacacacacatatac

SEQ ID NO: 5088562 - DNA, 17 bp, Homo sapiens
aacacacacatatacac

SEQ ID NO: 5088563 - DNA, 21 bp, Homo sapiens
aacacacaccagtttacagga

SEQ ID NO: 5088564 - DNA, 18 bp, Homo sapiens
aacacacacgccagctcc

SEQ ID NO: 5088565 - DNA, 22 bp, Homo sapiens
aacacacacgccagctcctctc

SEQ ID NO: 5088566 - DNA, 21 bp, Homo sapiens
aacacacaggtgcaacagact

SEQ ID NO: 5088567 - DNA, 23 bp, Homo sapiens
aacacacagtattcgtgaataag

SEQ ID NO: 5088568 - DNA, 21 bp, Homo sapiens
aacacacagtgaccaagggaa

SEQ ID NO: 5088569 - DNA, 14 bp, Homo sapiens
aacacacataaagg

SEQ ID NO: 5088570 - DNA, 15 bp, Homo sapiens
aacacacataaagga

SEQ ID NO: 5088571 - DNA, 17 bp, Homo sapiens
aacacaccctgcttcat

SEQ ID NO: 5088572 - DNA, 15 bp, Homo sapiens
aacacaccgatgcac

SEQ ID NO: 5088573 - DNA, 10 bp, Homo sapiens
aacacacctc

SEQ ID NO: 5088574 - DNA, 13 bp, Homo sapiens
aacacacctctgc

SEQ ID NO: 5088575 - DNA, 15 bp, Homo sapiens
aacacacctctgcca

SEQ ID NO: 5088576 - DNA, 12 bp, Homo sapiens
aacacacctggt

SEQ ID NO: 5088577 - DNA, 19 bp, Homo sapiens
aacacacgctcctctgccc

SEQ ID NO: 5088578 - DNA, 23 bp, Homo sapiens
aacacactaccgaatgtgtcttt

SEQ ID NO: 5088579 - DNA, 20 bp, Homo sapiens
aacacactgaggcagggaag

SEQ ID NO: 5088580 - DNA, 21 bp, Homo sapiens
aacacactgtgtcctggtgct

SEQ ID NO: 5088581 - DNA, 18 bp, Homo sapiens
aacacactgttgtttagt

SEQ ID NO: 5088582 - DNA, 20 bp, Homo sapiens
aacacacttttctttttaaa

SEQ ID NO: 5088583 - DNA, 19 bp, Homo sapiens
aacacagaaacctttttaa

SEQ ID NO: 5088584 - DNA, 22 bp, Homo sapiens
aacacagaaagcctatcaaaga

SEQ ID NO: 5088585 - DNA, 17 bp, Homo sapiens
aacacagacccctaggg

SEQ ID NO: 5088586 - DNA, 14 bp, Homo sapiens
aacacagatcaagt

SEQ ID NO: 5088587 - DNA, 21 bp, Homo sapiens
aacacagatcaagtgaacatt

SEQ ID NO: 5088588 - DNA, 21 bp, Homo sapiens
aacacagatgtgttgcaaagg

SEQ ID NO: 5088589 - DNA, 15 bp, Homo sapiens
aacacagcaagggtg

SEQ ID NO: 5088590 - DNA, 21 bp, Homo sapiens
aacacagcatgggtccagaag

SEQ ID NO: 5088591 - DNA, 16 bp, Homo sapiens
aacacagcatgtgcca

SEQ ID NO: 5088592 - DNA, 17 bp, Homo sapiens
aacacagcatgtgccaa

SEQ ID NO: 5088593 - DNA, 18 bp, Homo sapiens
aacacagcatgtgtattt

SEQ ID NO: 5088594 - DNA, 15 bp, Homo sapiens
aacacagccttcctt

SEQ ID NO: 5088595 - DNA, 24 bp, Homo sapiens
aacacagccttccttctgctccca

SEQ ID NO: 5088596 - DNA, 19 bp, Homo sapiens
aacacagcgagactccgtc

SEQ ID NO: 5088597 - DNA, 20 bp, Homo sapiens
aacacagcttacaatcgcaa

SEQ ID NO: 5088598 - DNA, 15 bp, Homo sapiens
aacacagctttacaa

SEQ ID NO: 5088599 - DNA, 17 bp, Homo sapiens
aacacaggataaagtta

SEQ ID NO: 5088600 - DNA, 11 bp, Homo sapiens
aacacaggcaa

SEQ ID NO: 5088601 - DNA, 15 bp, Homo sapiens
aacacaggcaaaatc

SEQ ID NO: 5088602 - DNA, 22 bp, Homo sapiens
aacacaggcaaaatccttgctt

SEQ ID NO: 5088603 - DNA, 17 bp, Homo sapiens
aacacagggttttgtat

SEQ ID NO: 5088604 - DNA, 14 bp, Homo sapiens
aacacagtaaaata

SEQ ID NO: 5088605 - DNA, 20 bp, Homo sapiens
aacacagtaagataggttct

SEQ ID NO: 5088606 - DNA, 18 bp, Homo sapiens
aacacagtattgtagaaa

SEQ ID NO: 5088607 - DNA, 20 bp, Homo sapiens
aacacagtattgtagaaagc

SEQ ID NO: 5088608 - DNA, 12 bp, Homo sapiens
aacacagtattt

SEQ ID NO: 5088609 - DNA, 13 bp, Homo sapiens
aacacagtatttt

SEQ ID NO: 5088610 - DNA, 20 bp, Homo sapiens
aacacagtccagactcaaac

SEQ ID NO: 5088611 - DNA, 12 bp, Homo sapiens
aacacagtgcat

SEQ ID NO: 5088612 - DNA, 21 bp, Homo sapiens
aacacagtgccccagtggtgc

SEQ ID NO: 5088613 - DNA, 22 bp, Homo sapiens
aacacagtgcctggcaaggcct

SEQ ID NO: 5088614 - DNA, 19 bp, Homo sapiens
aacacagtgccttcaataa

SEQ ID NO: 5088615 - DNA, 12 bp, Homo sapiens
aacacagtgctg

SEQ ID NO: 5088616 - DNA, 12 bp, Homo sapiens
aacacagtgtct

SEQ ID NO: 5088617 - DNA, 14 bp, Homo sapiens
aacacagtgtctgt

SEQ ID NO: 5088618 - DNA, 20 bp, Homo sapiens
aacacagtgtttttgtaaag

SEQ ID NO: 5088619 - DNA, 22 bp, Homo sapiens
aacacagtgtttttgtaaagtg

SEQ ID NO: 5088620 - DNA, 19 bp, Homo sapiens
aacacagtttagtgcttta

SEQ ID NO: 5088621 - DNA, 20 bp, Homo sapiens
aacacagttttgaaagaaaa

SEQ ID NO: 5088622 - DNA, 14 bp, Homo sapiens
aacacataaatgaa

SEQ ID NO: 5088623 - DNA, 21 bp, Homo sapiens
aacacataactagaaacctga

SEQ ID NO: 5088624 - DNA, 18 bp, Homo sapiens
aacacataattaacactt

SEQ ID NO: 5088625 - DNA, 14 bp, Homo sapiens
aacacataatttct

SEQ ID NO: 5088626 - DNA, 21 bp, Homo sapiens
aacacatagcgccgtgctgta

SEQ ID NO: 5088627 - DNA, 16 bp, Homo sapiens
aacacatcacagatga

SEQ ID NO: 5088628 - DNA, 22 bp, Homo sapiens
aacacatcagctagcaaaagaa

SEQ ID NO: 5088629 - DNA, 21 bp, Homo sapiens
aacacatcaggaaagagagca

SEQ ID NO: 5088630 - DNA, 22 bp, Homo sapiens
aacacatctggctgcacaggct

SEQ ID NO: 5088631 - DNA, 17 bp, Homo sapiens
aacacatctttcctgtc

SEQ ID NO: 5088632 - DNA, 13 bp, Homo sapiens
aacacatgcacac

SEQ ID NO: 5088633 - DNA, 14 bp, Homo sapiens
aacacatggcagaa

SEQ ID NO: 5088634 - DNA, 18 bp, Homo sapiens
aacacatggggaaaaaaa

SEQ ID NO: 5088635 - DNA, 17 bp, Homo sapiens
aacacatgtttttatac

SEQ ID NO: 5088636 - DNA, 20 bp, Homo sapiens
aacacatgtttttatttcct

SEQ ID NO: 5088637 - DNA, 16 bp, Homo sapiens
aacacattacttgcac

SEQ ID NO: 5088638 - DNA, 17 bp, Homo sapiens
aacacattctttataaa

SEQ ID NO: 5088639 - DNA, 20 bp, Homo sapiens
aacacattctttataaaatg

SEQ ID NO: 5088640 - DNA, 20 bp, Homo sapiens
aacacattgaaactgtattt

SEQ ID NO: 5088641 - DNA, 21 bp, Homo sapiens
aacacatttcaaatgagtttt

SEQ ID NO: 5088642 - DNA, 21 bp, Homo sapiens
aacacatttcctttaccctcc

SEQ ID NO: 5088643 - DNA, 12 bp, Homo sapiens
aacacatttcgt

SEQ ID NO: 5088644 - DNA, 18 bp, Homo sapiens
aacacatttgattctgtg

SEQ ID NO: 5088645 - DNA, 20 bp, Homo sapiens
aacacatttgattctgtgtg

SEQ ID NO: 5088646 - DNA, 22 bp, Homo sapiens
aacacattttggttcttctcaa

SEQ ID NO: 5088647 - DNA, 15 bp, Homo sapiens
aacacattttgtata

SEQ ID NO: 5088648 - DNA, 19 bp, Homo sapiens
aacacatttttaaagcttt

SEQ ID NO: 5088649 - DNA, 20 bp, Homo sapiens
aacacatttttttgcatgca

SEQ ID NO: 5088650 - DNA, 22 bp, Homo sapiens
aacaccaaaaaaatccagaaac

SEQ ID NO: 5088651 - DNA, 21 bp, Homo sapiens
aacaccaagcacagcagcctg

SEQ ID NO: 5088652 - DNA, 16 bp, Homo sapiens
aacaccaatcccaggg

SEQ ID NO: 5088653 - DNA, 14 bp, Homo sapiens
aacaccacactgac

SEQ ID NO: 5088654 - DNA, 16 bp, Homo sapiens
aacaccacagacacac

SEQ ID NO: 5088655 - DNA, 19 bp, Homo sapiens
aacaccacagacacacaca

SEQ ID NO: 5088656 - DNA, 16 bp, Homo sapiens
aacaccagcaacatta

SEQ ID NO: 5088657 - DNA, 17 bp, Homo sapiens
aacaccagcagcactgg

SEQ ID NO: 5088658 - DNA, 15 bp, Homo sapiens
aacaccagcccctgc

SEQ ID NO: 5088659 - DNA, 16 bp, Homo sapiens
aacaccagcccctgcc

SEQ ID NO: 5088660 - DNA, 20 bp, Homo sapiens
aacaccatgattcctttaac

SEQ ID NO: 5088661 - DNA, 19 bp, Homo sapiens
aacaccattataaaaacac

SEQ ID NO: 5088662 - DNA, 22 bp, Homo sapiens
aacaccattttttttttctttt

SEQ ID NO: 5088663 - DNA, 12 bp, Homo sapiens
aacacccaaaaa

SEQ ID NO: 5088664 - DNA, 14 bp, Homo sapiens
aacacccaaaagaa

SEQ ID NO: 5088665 - DNA, 13 bp, Homo sapiens
aacacccaagtcc

SEQ ID NO: 5088666 - DNA, 15 bp, Homo sapiens
aacacccaagtccac

SEQ ID NO: 5088667 - DNA, 12 bp, Homo sapiens
aacacccactgg

SEQ ID NO: 5088668 - DNA, 14 bp, Homo sapiens
aacacccactggcc

SEQ ID NO: 5088669 - DNA, 23 bp, Homo sapiens
aacacccatcgtataaggaaatc

SEQ ID NO: 5088670 - DNA, 23 bp, Homo sapiens
aacacccccataacaattccccc

SEQ ID NO: 5088671 - DNA, 14 bp, Homo sapiens
aacaccccgcctgc

SEQ ID NO: 5088672 - DNA, 16 bp, Homo sapiens
aacaccccgcctgcct

SEQ ID NO: 5088673 - DNA, 17 bp, Homo sapiens
aacaccccgcctgcctc

SEQ ID NO: 5088674 - DNA, 15 bp, Homo sapiens
aacacccctctgtct

SEQ ID NO: 5088675 - DNA, 15 bp, Homo sapiens
aacaccctgcttctc

SEQ ID NO: 5088676 - DNA, 17 bp, Homo sapiens
aacacccttcagcaatg

SEQ ID NO: 5088677 - DNA, 14 bp, Homo sapiens
aacacccttccttc

SEQ ID NO: 5088678 - DNA, 19 bp, Homo sapiens
aacacctagctttattctt

SEQ ID NO: 5088679 - DNA, 22 bp, Homo sapiens
aacacctaggtcgccagtgaaa

SEQ ID NO: 5088680 - DNA, 13 bp, Homo sapiens
aacacctcccagg

SEQ ID NO: 5088681 - DNA, 23 bp, Homo sapiens
aacacctcccaggagacagttca

SEQ ID NO: 5088682 - DNA, 14 bp, Homo sapiens
aacacctcctcctg

SEQ ID NO: 5088683 - DNA, 14 bp, Homo sapiens
aacacctgacacat

SEQ ID NO: 5088684 - DNA, 15 bp, Homo sapiens
aacacctgacacatc

SEQ ID NO: 5088685 - DNA, 15 bp, Homo sapiens
aacacctgatgtgta

SEQ ID NO: 5088686 - DNA, 22 bp, Homo sapiens
aacacctgccttctaccctctg

SEQ ID NO: 5088687 - DNA, 11 bp, Homo sapiens
aacacctgctg

SEQ ID NO: 5088688 - DNA, 15 bp, Homo sapiens
aacacctgctgcgct

SEQ ID NO: 5088689 - DNA, 19 bp, Homo sapiens
aacacctgggcttaagaaa

SEQ ID NO: 5088690 - DNA, 20 bp, Homo sapiens
aacacctgtggataaaacat

SEQ ID NO: 5088691 - DNA, 14 bp, Homo sapiens
aacaccttaatatg

SEQ ID NO: 5088692 - DNA, 15 bp, Homo sapiens
aacaccttaatatgc

SEQ ID NO: 5088693 - DNA, 22 bp, Homo sapiens
aacaccttcttattatatatat

SEQ ID NO: 5088694 - DNA, 14 bp, Homo sapiens
aacacctttatttt

SEQ ID NO: 5088695 - DNA, 14 bp, Homo sapiens
aacacgaaacttgt

SEQ ID NO: 5088696 - DNA, 16 bp, Homo sapiens
aacacgaaacttgtta

SEQ ID NO: 5088697 - DNA, 17 bp, Homo sapiens
aacacgcacaccctgcc

SEQ ID NO: 5088698 - DNA, 19 bp, Homo sapiens
aacacgcatggtcaaccct

SEQ ID NO: 5088699 - DNA, 21 bp, Homo sapiens
aacacgccttgttcctgctct

SEQ ID NO: 5088700 - DNA, 13 bp, Homo sapiens
aacacggccacat

SEQ ID NO: 5088701 - DNA, 21 bp, Homo sapiens
aacacggccacatcaaagagg

SEQ ID NO: 5088702 - DNA, 15 bp, Homo sapiens
aacacggccctcctg

SEQ ID NO: 5088703 - DNA, 19 bp, Homo sapiens
aacacggccctcctgggaa

SEQ ID NO: 5088704 - DNA, 17 bp, Homo sapiens
aacacgtcattgtgtaa

SEQ ID NO: 5088705 - DNA, 19 bp, Homo sapiens
aacacgtcattgtgtaagg

SEQ ID NO: 5088706 - DNA, 24 bp, Homo sapiens
aacacgtggaggtgaagtccctgt

SEQ ID NO: 5088707 - DNA, 14 bp, Homo sapiens
aacacgttgccagg

SEQ ID NO: 5088708 - DNA, 18 bp, Homo sapiens
aacacgtttttacatact

SEQ ID NO: 5088709 - DNA, 21 bp, Homo sapiens
aacacgtttttacatactttt

SEQ ID NO: 5088710 - DNA, 13 bp, Homo sapiens
aacactaaacatt

SEQ ID NO: 5088711 - DNA, 15 bp, Homo sapiens
aacactaaagagcta

SEQ ID NO: 5088712 - DNA, 20 bp, Homo sapiens
aacactaaagatccaagaag

SEQ ID NO: 5088713 - DNA, 14 bp, Homo sapiens
aacactaaatgtta

SEQ ID NO: 5088714 - DNA, 15 bp, Homo sapiens
aacactaaatgttaa

SEQ ID NO: 5088715 - DNA, 21 bp, Homo sapiens
aacactaaatgttaaagatgt

SEQ ID NO: 5088716 - DNA, 14 bp, Homo sapiens
aacactaacaaaat

SEQ ID NO: 5088717 - DNA, 19 bp, Homo sapiens
aacactaacaaaatttgaa

SEQ ID NO: 5088718 - DNA, 17 bp, Homo sapiens
aacactaactcaccagc

SEQ ID NO: 5088719 - DNA, 13 bp, Homo sapiens
aacactaatatat

SEQ ID NO: 5088720 - DNA, 14 bp, Homo sapiens
aacactaatatatt

SEQ ID NO: 5088721 - DNA, 16 bp, Homo sapiens
aacactaattcataat

SEQ ID NO: 5088722 - DNA, 18 bp, Homo sapiens
aacactacctcttttgag

SEQ ID NO: 5088723 - DNA, 13 bp, Homo sapiens
aacactagcattt

SEQ ID NO: 5088724 - DNA, 14 bp, Homo sapiens
aacactatagagaa

SEQ ID NO: 5088725 - DNA, 21 bp, Homo sapiens
aacactatatggcagtgtctt

SEQ ID NO: 5088726 - DNA, 16 bp, Homo sapiens
aacactatatttattt

SEQ ID NO: 5088727 - DNA, 20 bp, Homo sapiens
aacactatccaatgaatgat

SEQ ID NO: 5088728 - DNA, 13 bp, Homo sapiens
aacactatgtata

SEQ ID NO: 5088729 - DNA, 13 bp, Homo sapiens
aacactattttat

SEQ ID NO: 5088730 - DNA, 17 bp, Homo sapiens
aacactattttcagaat

SEQ ID NO: 5088731 - DNA, 18 bp, Homo sapiens
aacactattttcagaatc

SEQ ID NO: 5088732 - DNA, 17 bp, Homo sapiens
aacactcaagaagcagg

SEQ ID NO: 5088733 - DNA, 12 bp, Homo sapiens
aacactcaccat

SEQ ID NO: 5088734 - DNA, 13 bp, Homo sapiens
aacactcacttaa

SEQ ID NO: 5088735 - DNA, 14 bp, Homo sapiens
aacactcacttaat

SEQ ID NO: 5088736 - DNA, 19 bp, Homo sapiens
aacactcagaagcctgggg

SEQ ID NO: 5088737 - DNA, 13 bp, Homo sapiens
aacaaaaagctaa

SEQ ID NO: 5088738 - DNA, 16 bp, Homo sapiens
aacaaaaagcttcccc

SEQ ID NO: 5088739 - DNA, 22 bp, Homo sapiens
aacaaaaagtaaagtaatgcat

SEQ ID NO: 5088740 - DNA, 11 bp, Homo sapiens
aacaaaaataa

SEQ ID NO: 5088741 - DNA, 20 bp, Homo sapiens
aacaaaaatagaatatataa

SEQ ID NO: 5088742 - DNA, 15 bp, Homo sapiens
aacaaaaatcaccat

SEQ ID NO: 5088743 - DNA, 14 bp, Homo sapiens
aacaaaaatgccag

SEQ ID NO: 5088744 - DNA, 13 bp, Homo sapiens
aacaaaaattagg

SEQ ID NO: 5088745 - DNA, 14 bp, Homo sapiens
aacaaaaattgtct

SEQ ID NO: 5088746 - DNA, 20 bp, Homo sapiens
aacaaaaattgtctttatga

SEQ ID NO: 5088747 - DNA, 11 bp, Homo sapiens
aacaaaaattt

SEQ ID NO: 5088748 - DNA, 12 bp, Homo sapiens
aacaaaacaaaa

SEQ ID NO: 5088749 - DNA, 17 bp, Homo sapiens
aacaaaacaaaaaactt

SEQ ID NO: 5088750 - DNA, 18 bp, Homo sapiens
aacaaaacaaaacaacat

SEQ ID NO: 5088751 - DNA, 15 bp, Homo sapiens
aacaaaacaaacttc

SEQ ID NO: 5088752 - DNA, 14 bp, Homo sapiens
aacaaaacaacaac

SEQ ID NO: 5088753 - DNA, 14 bp, Homo sapiens
aacaaaaccaagcc

SEQ ID NO: 5088754 - DNA, 21 bp, Homo sapiens
aacaaaaccgcattcagtgca

SEQ ID NO: 5088755 - DNA, 14 bp, Homo sapiens
aacaaaactatact

SEQ ID NO: 5088756 - DNA, 17 bp, Homo sapiens
aacaaaactatacttga

SEQ ID NO: 5088757 - DNA, 20 bp, Homo sapiens
aacaaaactatggaaataat

SEQ ID NO: 5088758 - DNA, 15 bp, Homo sapiens
aacaaaagagagaat

SEQ ID NO: 5088759 - DNA, 11 bp, Homo sapiens
aacaaaagata

SEQ ID NO: 5088760 - DNA, 14 bp, Homo sapiens
aacaaaagcccttt

SEQ ID NO: 5088761 - DNA, 23 bp, Homo sapiens
aacaaaaggaagactggagaaat

SEQ ID NO: 5088762 - DNA, 11 bp, Homo sapiens
aacaaaaggca

SEQ ID NO: 5088763 - DNA, 13 bp, Homo sapiens
aacaaaaggcttt

SEQ ID NO: 5088764 - DNA, 22 bp, Homo sapiens
aacaaaagggttcatagaaact

SEQ ID NO: 5088765 - DNA, 15 bp, Homo sapiens
aacaaaagtgtttaa

SEQ ID NO: 5088766 - DNA, 11 bp, Homo sapiens
aacaaaagttt

SEQ ID NO: 5088767 - DNA, 18 bp, Homo sapiens
aacaaaatacattctttt

SEQ ID NO: 5088768 - DNA, 12 bp, Homo sapiens
aacaaaatatct

SEQ ID NO: 5088769 - DNA, 21 bp, Homo sapiens
aacaaaatatttatttgtttt

SEQ ID NO: 5088770 - DNA, 13 bp, Homo sapiens
aacaaaatcacaa

SEQ ID NO: 5088771 - DNA, 20 bp, Homo sapiens
aacaaaatctcctcttttag

SEQ ID NO: 5088772 - DNA, 14 bp, Homo sapiens
aacaaaatgatggg

SEQ ID NO: 5088773 - DNA, 13 bp, Homo sapiens
aacaaaatgcctt

SEQ ID NO: 5088774 - DNA, 17 bp, Homo sapiens
aacaaaatggcttcagt

SEQ ID NO: 5088775 - DNA, 17 bp, Homo sapiens
aacaaaatgtatgtctg

SEQ ID NO: 5088776 - DNA, 16 bp, Homo sapiens
aacaaaattgcaattt

SEQ ID NO: 5088777 - DNA, 20 bp, Homo sapiens
aacaaaattgttcttgggag

SEQ ID NO: 5088778 - DNA, 22 bp, Homo sapiens
aacaaaatttagtttttgttct

SEQ ID NO: 5088779 - DNA, 12 bp, Homo sapiens
aacaaaatttat

SEQ ID NO: 5088780 - DNA, 21 bp, Homo sapiens
aacaaaatttatgtcattttc

SEQ ID NO: 5088781 - DNA, 15 bp, Homo sapiens
aacaaaatttctatt

SEQ ID NO: 5088782 - DNA, 13 bp, Homo sapiens
aacaaacaaaact

SEQ ID NO: 5088783 - DNA, 14 bp, Homo sapiens
aacaaacaaaactt

SEQ ID NO: 5088784 - DNA, 15 bp, Homo sapiens
aacaaacaaaactta

SEQ ID NO: 5088785 - DNA, 17 bp, Homo sapiens
aacaaacaaatcaaaca

SEQ ID NO: 5088786 - DNA, 12 bp, Homo sapiens
aacaaacaagcc

SEQ ID NO: 5088787 - DNA, 18 bp, Homo sapiens
aacaaacaagccccctgc

SEQ ID NO: 5088788 - DNA, 13 bp, Homo sapiens
aacaaacacacac

SEQ ID NO: 5088789 - DNA, 24 bp, Homo sapiens
aacaaacactgaatcatgttaata

SEQ ID NO: 5088790 - DNA, 23 bp, Homo sapiens
aacaaacactgcagtttcctgga

SEQ ID NO: 5088791 - DNA, 21 bp, Homo sapiens
aacaaacagaaacgagatttg

SEQ ID NO: 5088792 - DNA, 14 bp, Homo sapiens
aacaaacagatgct

SEQ ID NO: 5088793 - DNA, 20 bp, Homo sapiens
aacaaacatggatacttcct

SEQ ID NO: 5088794 - DNA, 21 bp, Homo sapiens
aacaaacatggatacttcctg

SEQ ID NO: 5088795 - DNA, 20 bp, Homo sapiens
aacaaacattgtgttgacat

SEQ ID NO: 5088796 - DNA, 21 bp, Homo sapiens
aacaaacattgtgttgacatt

SEQ ID NO: 5088797 - DNA, 22 bp, Homo sapiens
aacaaacattgtgttgacatta

SEQ ID NO: 5088798 - DNA, 19 bp, Homo sapiens
aacaaaccagcaacttttc

SEQ ID NO: 5088799 - DNA, 10 bp, Homo sapiens
aacaaaccat

SEQ ID NO: 5088800 - DNA, 22 bp, Homo sapiens
aacaaacctgtttctgcagcca

SEQ ID NO: 5088801 - DNA, 18 bp, Homo sapiens
aacaaacgtgttttttaa

SEQ ID NO: 5088802 - DNA, 18 bp, Homo sapiens
aacaaactaaaaatattc

SEQ ID NO: 5088803 - DNA, 23 bp, Homo sapiens
aacaaactaaaaatattcctcca

SEQ ID NO: 5088804 - DNA, 15 bp, Homo sapiens
aacaaactaaatgta

SEQ ID NO: 5088805 - DNA, 17 bp, Homo sapiens
aacaaactctactaatt

SEQ ID NO: 5088806 - DNA, 14 bp, Homo sapiens
aacaaactcttcag

SEQ ID NO: 5088807 - DNA, 24 bp, Homo sapiens
aacaaactgcacatgatttcacaa

SEQ ID NO: 5088808 - DNA, 19 bp, Homo sapiens
aacaaacttactgtcagag

SEQ ID NO: 5088809 - DNA, 13 bp, Homo sapiens
aacaaacttctcg

SEQ ID NO: 5088810 - DNA, 22 bp, Homo sapiens
aacaaacttttcaaggcttata

SEQ ID NO: 5088811 - DNA, 11 bp, Homo sapiens
aacaaagaaac

SEQ ID NO: 5088812 - DNA, 12 bp, Homo sapiens
aacaaagacaat

SEQ ID NO: 5088813 - DNA, 19 bp, Homo sapiens
aacaaagacatgctttcca

SEQ ID NO: 5088814 - DNA, 22 bp, Homo sapiens
aacaaagacattgacagcaatt

SEQ ID NO: 5088815 - DNA, 13 bp, Homo sapiens
aacaaagacattt

SEQ ID NO: 5088816 - DNA, 14 bp, Homo sapiens
aacaaagagtgaaa

SEQ ID NO: 5088817 - DNA, 18 bp, Homo sapiens
aacaaagagtgaaatatt

SEQ ID NO: 5088818 - DNA, 21 bp, Homo sapiens
aacaaagagtgaaatattgta

SEQ ID NO: 5088819 - DNA, 17 bp, Homo sapiens
aacaaagcagctttaaa

SEQ ID NO: 5088820 - DNA, 14 bp, Homo sapiens
aacaaagcatgttt

SEQ ID NO: 5088821 - DNA, 13 bp, Homo sapiens
aacaaagccaaac

SEQ ID NO: 5088822 - DNA, 21 bp, Homo sapiens
aacaaagccaaacaaaactga

SEQ ID NO: 5088823 - DNA, 11 bp, Homo sapiens
aacaaagccag

SEQ ID NO: 5088824 - DNA, 17 bp, Homo sapiens
aacaaagccagaagctg

SEQ ID NO: 5088825 - DNA, 12 bp, Homo sapiens
aacaaagctgtt

SEQ ID NO: 5088826 - DNA, 14 bp, Homo sapiens
aacaaagcttagca

SEQ ID NO: 5088827 - DNA, 19 bp, Homo sapiens
aacaaaggatacttattta

SEQ ID NO: 5088828 - DNA, 22 bp, Homo sapiens
aacaaaggattaattgctgcaa

SEQ ID NO: 5088829 - DNA, 15 bp, Homo sapiens
aacaaaggcagctgt

SEQ ID NO: 5088830 - DNA, 22 bp, Homo sapiens
aacaaaggcctaattctatgcc

SEQ ID NO: 5088831 - DNA, 15 bp, Homo sapiens
aacaaagggttttct

SEQ ID NO: 5088832 - DNA, 18 bp, Homo sapiens
aacaaagtcaagattccc

SEQ ID NO: 5088833 - DNA, 21 bp, Homo sapiens
aacaaagtgactgtttggctt

SEQ ID NO: 5088834 - DNA, 18 bp, Homo sapiens
aacaaagtgagaaatgaa

SEQ ID NO: 5088835 - DNA, 14 bp, Homo sapiens
aacaaagtgcaaag

SEQ ID NO: 5088836 - DNA, 13 bp, Homo sapiens
aacaaagtgcttt

SEQ ID NO: 5088837 - DNA, 17 bp, Homo sapiens
aacaaagtggaaggaaa

SEQ ID NO: 5088838 - DNA, 19 bp, Homo sapiens
aacaaagtggaaggaaaga

SEQ ID NO: 5088839 - DNA, 18 bp, Homo sapiens
aacaaagttactggctct

SEQ ID NO: 5088840 - DNA, 19 bp, Homo sapiens
aacaaataaaaaagctctt

SEQ ID NO: 5088841 - DNA, 13 bp, Homo sapiens
aacaaataaataa

SEQ ID NO: 5088842 - DNA, 16 bp, Homo sapiens
aacaaataaatatgaa

SEQ ID NO: 5088843 - DNA, 12 bp, Homo sapiens
aacaaataaatt

SEQ ID NO: 5088844 - DNA, 13 bp, Homo sapiens
aacaaataagtca

SEQ ID NO: 5088845 - DNA, 19 bp, Homo sapiens
aacaaataatttgaacttt

SEQ ID NO: 5088846 - DNA, 16 bp, Homo sapiens
aacaaatagtctatca

SEQ ID NO: 5088847 - DNA, 11 bp, Homo sapiens
aacaaatatac

SEQ ID NO: 5088848 - DNA, 13 bp, Homo sapiens
aacaaatatgaaa

SEQ ID NO: 5088849 - DNA, 14 bp, Homo sapiens
aacaaatatgaaaa

SEQ ID NO: 5088850 - DNA, 22 bp, Homo sapiens
aacaaatatgaaaaatgtaaat

SEQ ID NO: 5088851 - DNA, 12 bp, Homo sapiens
aacaaatatgca

SEQ ID NO: 5088852 - DNA, 16 bp, Homo sapiens
aacaaatatgctaatt

SEQ ID NO: 5088853 - DNA, 23 bp, Homo sapiens
aacaaatattgccaactcttcta

SEQ ID NO: 5088854 - DNA, 16 bp, Homo sapiens
aacaaatcataatgta

SEQ ID NO: 5088855 - DNA, 16 bp, Homo sapiens
aacaaatcattttgat

SEQ ID NO: 5088856 - DNA, 18 bp, Homo sapiens
aacaaatcgtttctcaga

SEQ ID NO: 5088857 - DNA, 20 bp, Homo sapiens
aacaaatctaggaaaatatt

SEQ ID NO: 5088858 - DNA, 21 bp, Homo sapiens
aacaaatctaggaaaatattt

SEQ ID NO: 5088859 - DNA, 14 bp, Homo sapiens
aacaaatcttcctg

SEQ ID NO: 5088860 - DNA, 12 bp, Homo sapiens
aacaaatgaaga

SEQ ID NO: 5088861 - DNA, 11 bp, Homo sapiens
aacaaatgagc

SEQ ID NO: 5088862 - DNA, 14 bp, Homo sapiens
aacaaatgatttcc

SEQ ID NO: 5088863 - DNA, 23 bp, Homo sapiens
aacaaatgatttccacaaacaga

SEQ ID NO: 5088864 - DNA, 19 bp, Homo sapiens
aacaaatgccaaattaaaa

SEQ ID NO: 5088865 - DNA, 19 bp, Homo sapiens
aacaaatgctctgtcttca

SEQ ID NO: 5088866 - DNA, 16 bp, Homo sapiens
aacaaatggaagagaa

SEQ ID NO: 5088867 - DNA, 21 bp, Homo sapiens
aacaaatggcttacttacaaa

SEQ ID NO: 5088868 - DNA, 19 bp, Homo sapiens
aacaaatgtaaaattatga

SEQ ID NO: 5088869 - DNA, 14 bp, Homo sapiens
aacaaatgtcttaa

SEQ ID NO: 5088870 - DNA, 15 bp, Homo sapiens
aacaaatgttttcat

SEQ ID NO: 5088871 - DNA, 20 bp, Homo sapiens
aacaaatgttttcatttaca

SEQ ID NO: 5088872 - DNA, 14 bp, Homo sapiens
aacaaattaaaaac

SEQ ID NO: 5088873 - DNA, 16 bp, Homo sapiens
aacaaattaaataaat

SEQ ID NO: 5088874 - DNA, 15 bp, Homo sapiens
aacaaattatttttg

SEQ ID NO: 5088875 - DNA, 15 bp, Homo sapiens
aacaaattcaaataa

SEQ ID NO: 5088876 - DNA, 12 bp, Homo sapiens
aacaaattcagt

SEQ ID NO: 5088877 - DNA, 17 bp, Homo sapiens
aacaaattctttagtac

SEQ ID NO: 5088878 - DNA, 18 bp, Homo sapiens
aacaaattctttagtact

SEQ ID NO: 5088879 - DNA, 19 bp, Homo sapiens
aacaaattctttagtactc

SEQ ID NO: 5088880 - DNA, 23 bp, Homo sapiens
aacaaattctttagtactcaatg

SEQ ID NO: 5088881 - DNA, 16 bp, Homo sapiens
aacaaattgaactctt

SEQ ID NO: 5088882 - DNA, 18 bp, Homo sapiens
aacaaattggacagctac

SEQ ID NO: 5088883 - DNA, 20 bp, Homo sapiens
aacaaatttcattgcacttt

SEQ ID NO: 5088884 - DNA, 11 bp, Homo sapiens
aacaacaaaaa

SEQ ID NO: 5088885 - DNA, 15 bp, Homo sapiens
aacaacaaaaaaagt

SEQ ID NO: 5088886 - DNA, 13 bp, Homo sapiens
aacaacaaaaaat

SEQ ID NO: 5088887 - DNA, 13 bp, Homo sapiens
aacaacaaaaacc

SEQ ID NO: 5088888 - DNA, 16 bp, Homo sapiens
aacaacaaaaaccaaa

SEQ ID NO: 5088889 - DNA, 11 bp, Homo sapiens
aacaacaaata

SEQ ID NO: 5088890 - DNA, 16 bp, Homo sapiens
aacaacaaataattta

SEQ ID NO: 5088891 - DNA, 14 bp, Homo sapiens
aacaacaacaatac

SEQ ID NO: 5088892 - DNA, 12 bp, Homo sapiens
aacaacaataac

SEQ ID NO: 5088893 - DNA, 20 bp, Homo sapiens
aacaacaatggtttacatga

SEQ ID NO: 5088894 - DNA, 12 bp, Homo sapiens
aacaacaattat

SEQ ID NO: 5088895 - DNA, 13 bp, Homo sapiens
aacaacaattggt

SEQ ID NO: 5088896 - DNA, 19 bp, Homo sapiens
aacaacaattttaaataag

SEQ ID NO: 5088897 - DNA, 21 bp, Homo sapiens
aacaacaattttaaataagat

SEQ ID NO: 5088898 - DNA, 12 bp, Homo sapiens
aacaacagtacc

SEQ ID NO: 5088899 - DNA, 15 bp, Homo sapiens
aacaacagtcagcca

SEQ ID NO: 5088900 - DNA, 19 bp, Homo sapiens
aacaacagtcagccagctt

SEQ ID NO: 5088901 - DNA, 11 bp, Homo sapiens
aacaacataaa

SEQ ID NO: 5088902 - DNA, 15 bp, Homo sapiens
aacaacataaaatta

SEQ ID NO: 5088903 - DNA, 14 bp, Homo sapiens
aacaacattatttt

SEQ ID NO: 5088904 - DNA, 16 bp, Homo sapiens
aacaacatttaaggga

SEQ ID NO: 5088905 - DNA, 17 bp, Homo sapiens
aacaacatttatatgta

SEQ ID NO: 5088906 - DNA, 12 bp, Homo sapiens
aacaacattttg

SEQ ID NO: 5088907 - DNA, 19 bp, Homo sapiens
aacaaccaccaccttatac

SEQ ID NO: 5088908 - DNA, 18 bp, Homo sapiens
aacaaccccccatcacaa

SEQ ID NO: 5088909 - DNA, 23 bp, Homo sapiens
aacaaccgtcctgctgtccctgt

SEQ ID NO: 5088910 - DNA, 18 bp, Homo sapiens
aacaacctgaatcttttt

SEQ ID NO: 5088911 - DNA, 24 bp, Homo sapiens
aacaacctgccacaatgtgatatg

SEQ ID NO: 5088912 - DNA, 14 bp, Homo sapiens
aacaacctgcccaa

SEQ ID NO: 5088913 - DNA, 16 bp, Homo sapiens
aacaaccttcagcttt

SEQ ID NO: 5088914 - DNA, 14 bp, Homo sapiens
aacaacgaaagaag

SEQ ID NO: 5088915 - DNA, 14 bp, Homo sapiens
aacaacgtcttttt

SEQ ID NO: 5088916 - DNA, 15 bp, Homo sapiens
aacaactaaaaaaat

SEQ ID NO: 5088917 - DNA, 21 bp, Homo sapiens
aacaactaaaaaaatttttga

SEQ ID NO: 5088918 - DNA, 14 bp, Homo sapiens
aacaactatttact

SEQ ID NO: 5088919 - DNA, 19 bp, Homo sapiens
aacaactattttttaagaa

SEQ ID NO: 5088920 - DNA, 12 bp, Homo sapiens
aacactcagctg

SEQ ID NO: 5088921 - DNA, 13 bp, Homo sapiens
aacactcagctgt

SEQ ID NO: 5088922 - DNA, 17 bp, Homo sapiens
aacactcattgacctga

SEQ ID NO: 5088923 - DNA, 14 bp, Homo sapiens
aacactcatttcca

SEQ ID NO: 5088924 - DNA, 17 bp, Homo sapiens
aacactccacagtgttt

SEQ ID NO: 5088925 - DNA, 15 bp, Homo sapiens
aacactccaggccct

SEQ ID NO: 5088926 - DNA, 19 bp, Homo sapiens
aacactccaggccctgccc

SEQ ID NO: 5088927 - DNA, 13 bp, Homo sapiens
aacactcctctgc

SEQ ID NO: 5088928 - DNA, 16 bp, Homo sapiens
aacactccttgcatca

SEQ ID NO: 5088929 - DNA, 18 bp, Homo sapiens
aacactcgaaaagagcac

SEQ ID NO: 5088930 - DNA, 19 bp, Homo sapiens
aacactcgtgtgcatgaga

SEQ ID NO: 5088931 - DNA, 21 bp, Homo sapiens
aacactctataacaaaggata

SEQ ID NO: 5088932 - DNA, 21 bp, Homo sapiens
aacactctctgagatgcccct

SEQ ID NO: 5088933 - DNA, 13 bp, Homo sapiens
aacactctgagac

SEQ ID NO: 5088934 - DNA, 12 bp, Homo sapiens
aacactgaaaaa

SEQ ID NO: 5088935 - DNA, 14 bp, Homo sapiens
aacactgaaaaaat

SEQ ID NO: 5088936 - DNA, 14 bp, Homo sapiens
aacactgagaaaga

SEQ ID NO: 5088937 - DNA, 15 bp, Homo sapiens
aacactgagaaagag

SEQ ID NO: 5088938 - DNA, 10 bp, Homo sapiens
aacactgagc

SEQ ID NO: 5088939 - DNA, 17 bp, Homo sapiens
aacactgagtgaaatat

SEQ ID NO: 5088940 - DNA, 21 bp, Homo sapiens
aacactgagtgaaatattact

SEQ ID NO: 5088941 - DNA, 15 bp, Homo sapiens
aacactgatttcccc

SEQ ID NO: 5088942 - DNA, 22 bp, Homo sapiens
aacactgatttccccttttgca

SEQ ID NO: 5088943 - DNA, 14 bp, Homo sapiens
aacactgcaagaag

SEQ ID NO: 5088944 - DNA, 15 bp, Homo sapiens
aacactgcaagaagt

SEQ ID NO: 5088945 - DNA, 11 bp, Homo sapiens
aacactgccat

SEQ ID NO: 5088946 - DNA, 14 bp, Homo sapiens
aacactgcctctga

SEQ ID NO: 5088947 - DNA, 14 bp, Homo sapiens
aacactgccttttt

SEQ ID NO: 5088948 - DNA, 14 bp, Homo sapiens
aacactgctgtcca

SEQ ID NO: 5088949 - DNA, 23 bp, Homo sapiens
aacactggcacactgctcttaag

SEQ ID NO: 5088950 - DNA, 15 bp, Homo sapiens
aacactggggctggc

SEQ ID NO: 5088951 - DNA, 18 bp, Homo sapiens
aacactggggctggcaca

SEQ ID NO: 5088952 - DNA, 16 bp, Homo sapiens
aacactgggggagggg

SEQ ID NO: 5088953 - DNA, 16 bp, Homo sapiens
aacactggtgccaacc

SEQ ID NO: 5088954 - DNA, 17 bp, Homo sapiens
aacactggtgccaacca

SEQ ID NO: 5088955 - DNA, 23 bp, Homo sapiens
aacactggtggaggatggaaagg

SEQ ID NO: 5088956 - DNA, 17 bp, Homo sapiens
aacactggtgtgacctg

SEQ ID NO: 5088957 - DNA, 22 bp, Homo sapiens
aacactggtgtgacctgagggc

SEQ ID NO: 5088958 - DNA, 17 bp, Homo sapiens
aacactggttaaattaa

SEQ ID NO: 5088959 - DNA, 18 bp, Homo sapiens
aacactggttttaaatat

SEQ ID NO: 5088960 - DNA, 19 bp, Homo sapiens
aacactgtaatatctttaa

SEQ ID NO: 5088961 - DNA, 17 bp, Homo sapiens
aacactgtattgtaagt

SEQ ID NO: 5088962 - DNA, 13 bp, Homo sapiens
aacactgtatttt

SEQ ID NO: 5088963 - DNA, 16 bp, Homo sapiens
aacactgtccttccct

SEQ ID NO: 5088964 - DNA, 21 bp, Homo sapiens
aacactgtccttccctgccac

SEQ ID NO: 5088965 - DNA, 12 bp, Homo sapiens
aacactgtgaaa

SEQ ID NO: 5088966 - DNA, 15 bp, Homo sapiens
aacactgtgaccagg

SEQ ID NO: 5088967 - DNA, 21 bp, Homo sapiens
aacactgtgccctggtggaga

SEQ ID NO: 5088968 - DNA, 22 bp, Homo sapiens
aacactgtgtacacctcaaata

SEQ ID NO: 5088969 - DNA, 16 bp, Homo sapiens
aacactgttctctgcc

SEQ ID NO: 5088970 - DNA, 17 bp, Homo sapiens
aacactgttctctgccc

SEQ ID NO: 5088971 - DNA, 14 bp, Homo sapiens
aacacttaatagca

SEQ ID NO: 5088972 - DNA, 14 bp, Homo sapiens
aacacttaggaaga

SEQ ID NO: 5088973 - DNA, 15 bp, Homo sapiens
aacacttatcctcct

SEQ ID NO: 5088974 - DNA, 18 bp, Homo sapiens
aacacttcagacacagga

SEQ ID NO: 5088975 - DNA, 14 bp, Homo sapiens
aacacttctcctta

SEQ ID NO: 5088976 - DNA, 16 bp, Homo sapiens
aacacttctccttaac

SEQ ID NO: 5088977 - DNA, 21 bp, Homo sapiens
aacacttctgtatgcatcaga

SEQ ID NO: 5088978 - DNA, 19 bp, Homo sapiens
aacacttctgtcctgtgag

SEQ ID NO: 5088979 - DNA, 23 bp, Homo sapiens
aacacttgcaggggtccctgcta

SEQ ID NO: 5088980 - DNA, 19 bp, Homo sapiens
aacacttggcatacaaaat

SEQ ID NO: 5088981 - DNA, 20 bp, Homo sapiens
aacacttggtgctgggaacc

SEQ ID NO: 5088982 - DNA, 12 bp, Homo sapiens
aacacttgtaat

SEQ ID NO: 5088983 - DNA, 17 bp, Homo sapiens
aacacttgtagagcaga

SEQ ID NO: 5088984 - DNA, 21 bp, Homo sapiens
aacacttgtgacttttgcttt

SEQ ID NO: 5088985 - DNA, 22 bp, Homo sapiens
aacacttgtgacttttgcttta

SEQ ID NO: 5088986 - DNA, 15 bp, Homo sapiens
aacactttcctggat

SEQ ID NO: 5088987 - DNA, 19 bp, Homo sapiens
aacactttctcttcttgtt

SEQ ID NO: 5088988 - DNA, 19 bp, Homo sapiens
aacactttgagcattttta

SEQ ID NO: 5088989 - DNA, 17 bp, Homo sapiens
aacactttgcctcctgt

SEQ ID NO: 5088990 - DNA, 17 bp, Homo sapiens
aacactttgctaggaga

SEQ ID NO: 5088991 - DNA, 20 bp, Homo sapiens
aacacttttgaaaatgtaca

SEQ ID NO: 5088992 - DNA, 22 bp, Homo sapiens
aacacttttgctctgcaggcag

SEQ ID NO: 5088993 - DNA, 15 bp, Homo sapiens
aacagaaaaaaaaca

SEQ ID NO: 5088994 - DNA, 11 bp, Homo sapiens
aacagaaaaac

SEQ ID NO: 5088995 - DNA, 13 bp, Homo sapiens
aacagaaaaataa

SEQ ID NO: 5088996 - DNA, 15 bp, Homo sapiens
aacagaaaaataagt

SEQ ID NO: 5088997 - DNA, 16 bp, Homo sapiens
aacagaaaaataagtc

SEQ ID NO: 5088998 - DNA, 19 bp, Homo sapiens
aacagaaaaataagtcaaa

SEQ ID NO: 5088999 - DNA, 22 bp, Homo sapiens
aacagaaaactcccaatacaaa

SEQ ID NO: 5089000 - DNA, 14 bp, Homo sapiens
aacagaaaagagaa

SEQ ID NO: 5089001 - DNA, 16 bp, Homo sapiens
aacagaaaagagaaga

SEQ ID NO: 5089002 - DNA, 11 bp, Homo sapiens
aacagaaaagg

SEQ ID NO: 5089003 - DNA, 20 bp, Homo sapiens
aacagaaacgagatttgcca

SEQ ID NO: 5089004 - DNA, 11 bp, Homo sapiens
aacagaaacta

SEQ ID NO: 5089005 - DNA, 14 bp, Homo sapiens
aacagaaactacat

SEQ ID NO: 5089006 - DNA, 16 bp, Homo sapiens
aacagaaacttctcag

SEQ ID NO: 5089007 - DNA, 12 bp, Homo sapiens
aacagaaagttg

SEQ ID NO: 5089008 - DNA, 19 bp, Homo sapiens
aacagaaagttggaaagga

SEQ ID NO: 5089009 - DNA, 13 bp, Homo sapiens
aacagaaatacat

SEQ ID NO: 5089010 - DNA, 21 bp, Homo sapiens
aacagaaatcggggaagtggg

SEQ ID NO: 5089011 - DNA, 14 bp, Homo sapiens
aacagaaatgtaca

SEQ ID NO: 5089012 - DNA, 13 bp, Homo sapiens
aacagaaattatt

SEQ ID NO: 5089013 - DNA, 12 bp, Homo sapiens
aacagaaattgg

SEQ ID NO: 5089014 - DNA, 13 bp, Homo sapiens
aacagaaattggt

SEQ ID NO: 5089015 - DNA, 15 bp, Homo sapiens
aacagaaattggtac

SEQ ID NO: 5089016 - DNA, 17 bp, Homo sapiens
aacagaaattgtatatt

SEQ ID NO: 5089017 - DNA, 18 bp, Homo sapiens
aacagaaattgtatattg

SEQ ID NO: 5089018 - DNA, 12 bp, Homo sapiens
aacagaacaggg

SEQ ID NO: 5089019 - DNA, 14 bp, Homo sapiens
aacagaacagggtc

SEQ ID NO: 5089020 - DNA, 14 bp, Homo sapiens
aacagaacatttct

SEQ ID NO: 5089021 - DNA, 15 bp, Homo sapiens
aacagaacatttctc

SEQ ID NO: 5089022 - DNA, 13 bp, Homo sapiens
aacagaaccagag

SEQ ID NO: 5089023 - DNA, 15 bp, Homo sapiens
aacagaacccacagt

SEQ ID NO: 5089024 - DNA, 15 bp, Homo sapiens
aacagaactaaatgt

SEQ ID NO: 5089025 - DNA, 16 bp, Homo sapiens
aacagaactcgatgca

SEQ ID NO: 5089026 - DNA, 15 bp, Homo sapiens
aacagaacttttcct

SEQ ID NO: 5089027 - DNA, 13 bp, Homo sapiens
aacagaagaaaaa

SEQ ID NO: 5089028 - DNA, 13 bp, Homo sapiens
aacagaagaaaat

SEQ ID NO: 5089029 - DNA, 16 bp, Homo sapiens
aacagaagaggaggga

SEQ ID NO: 5089030 - DNA, 15 bp, Homo sapiens
aacagaagattacaa

SEQ ID NO: 5089031 - DNA, 15 bp, Homo sapiens
aacagaagcatttgt

SEQ ID NO: 5089032 - DNA, 17 bp, Homo sapiens
aacagaagcatttgtat

SEQ ID NO: 5089033 - DNA, 14 bp, Homo sapiens
aacagaagcttcca

SEQ ID NO: 5089034 - DNA, 16 bp, Homo sapiens
aacagaagcttccatt

SEQ ID NO: 5089035 - DNA, 11 bp, Homo sapiens
aacagaaggag

SEQ ID NO: 5089036 - DNA, 12 bp, Homo sapiens
aacagaaggaga

SEQ ID NO: 5089037 - DNA, 22 bp, Homo sapiens
aacagaagtccttaagcagagg

SEQ ID NO: 5089038 - DNA, 17 bp, Homo sapiens
aacagaagtgaggatga

SEQ ID NO: 5089039 - DNA, 13 bp, Homo sapiens
aacagaagtgcat

SEQ ID NO: 5089040 - DNA, 16 bp, Homo sapiens
aacagaataaagcagc

SEQ ID NO: 5089041 - DNA, 14 bp, Homo sapiens
aacagaataatgca

SEQ ID NO: 5089042 - DNA, 16 bp, Homo sapiens
aacagaataatgcatg

SEQ ID NO: 5089043 - DNA, 17 bp, Homo sapiens
aacagaatagagaattt

SEQ ID NO: 5089044 - DNA, 15 bp, Homo sapiens
aacagaatcttctgg

SEQ ID NO: 5089045 - DNA, 19 bp, Homo sapiens
aacagaatgaaaaatgaaa

SEQ ID NO: 5089046 - DNA, 14 bp, Homo sapiens
aacagaattgttct

SEQ ID NO: 5089047 - DNA, 17 bp, Homo sapiens
aacagacaagtgactgt

SEQ ID NO: 5089048 - DNA, 13 bp, Homo sapiens
aacagacacaatt

SEQ ID NO: 5089049 - DNA, 21 bp, Homo sapiens
aacagacaggaatttagaaaa

SEQ ID NO: 5089050 - DNA, 14 bp, Homo sapiens
aacagacaggagaa

SEQ ID NO: 5089051 - DNA, 15 bp, Homo sapiens
aacagacaggagaaa

SEQ ID NO: 5089052 - DNA, 13 bp, Homo sapiens
aacagaccagtga

SEQ ID NO: 5089053 - DNA, 17 bp, Homo sapiens
aacagacccagctctgt

SEQ ID NO: 5089054 - DNA, 20 bp, Homo sapiens
aacagactagaagtatttgt

SEQ ID NO: 5089055 - DNA, 13 bp, Homo sapiens
aacagactattta

SEQ ID NO: 5089056 - DNA, 20 bp, Homo sapiens
aacagactatttaacttgag

SEQ ID NO: 5089057 - DNA, 13 bp, Homo sapiens
aacagactctcac

SEQ ID NO: 5089058 - DNA, 23 bp, Homo sapiens
aacagactgaattttaaatgttc

SEQ ID NO: 5089059 - DNA, 14 bp, Homo sapiens
aacagagaaagaaa

SEQ ID NO: 5089060 - DNA, 15 bp, Homo sapiens
aacagagaaagaaaa

SEQ ID NO: 5089061 - DNA, 14 bp, Homo sapiens
aacagagaaataga

SEQ ID NO: 5089062 - DNA, 15 bp, Homo sapiens
aacagagagaaaaag

SEQ ID NO: 5089063 - DNA, 13 bp, Homo sapiens
aacagagagaacc

SEQ ID NO: 5089064 - DNA, 21 bp, Homo sapiens
aacagagagaaccaggagggt

SEQ ID NO: 5089065 - DNA, 18 bp, Homo sapiens
aacagagaggaccaacat

SEQ ID NO: 5089066 - DNA, 15 bp, Homo sapiens
aacagagaggggcag

SEQ ID NO: 5089067 - DNA, 14 bp, Homo sapiens
aacagagcctgcct

SEQ ID NO: 5089068 - DNA, 19 bp, Homo sapiens
aacagagcctgcctaacca

SEQ ID NO: 5089069 - DNA, 14 bp, Homo sapiens
aacagagcgggcct

SEQ ID NO: 5089070 - DNA, 15 bp, Homo sapiens
aacagagcgggcctc

SEQ ID NO: 5089071 - DNA, 15 bp, Homo sapiens
aacagagctactgag

SEQ ID NO: 5089072 - DNA, 13 bp, Homo sapiens
aacagaggaccag

SEQ ID NO: 5089073 - DNA, 18 bp, Homo sapiens
aacagaggaccagcacac

SEQ ID NO: 5089074 - DNA, 21 bp, Homo sapiens
aacagaggaccagcacactcc

SEQ ID NO: 5089075 - DNA, 17 bp, Homo sapiens
aacagaggaggccagcc

SEQ ID NO: 5089076 - DNA, 15 bp, Homo sapiens
aacagaggcatttaa

SEQ ID NO: 5089077 - DNA, 23 bp, Homo sapiens
aacagaggcctcccccagccagg

SEQ ID NO: 5089078 - DNA, 19 bp, Homo sapiens
aacagaggtaaaaaaaaga

SEQ ID NO: 5089079 - DNA, 13 bp, Homo sapiens
aacagagtatata

SEQ ID NO: 5089080 - DNA, 21 bp, Homo sapiens
aacagagtatatatgtacagt

SEQ ID NO: 5089081 - DNA, 20 bp, Homo sapiens
aacagagtccaatttaagga

SEQ ID NO: 5089082 - DNA, 15 bp, Homo sapiens
aacagagtgaaaaat

SEQ ID NO: 5089083 - DNA, 18 bp, Homo sapiens
aacagagtggcctccctg

SEQ ID NO: 5089084 - DNA, 16 bp, Homo sapiens
aacagagttttctgtt

SEQ ID NO: 5089085 - DNA, 14 bp, Homo sapiens
aacagataaagatt

SEQ ID NO: 5089086 - DNA, 23 bp, Homo sapiens
aacagatactggaagttttgcat

SEQ ID NO: 5089087 - DNA, 20 bp, Homo sapiens
aacagatagttgtgttttta

SEQ ID NO: 5089088 - DNA, 21 bp, Homo sapiens
aacagatattacagcttattt

SEQ ID NO: 5089089 - DNA, 18 bp, Homo sapiens
aacagatattccagacca

SEQ ID NO: 5089090 - DNA, 13 bp, Homo sapiens
aacagatatttaa

SEQ ID NO: 5089091 - DNA, 21 bp, Homo sapiens
aacagatcaacaatacctttt

SEQ ID NO: 5089092 - DNA, 23 bp, Homo sapiens
aacagatcacatgcccctcttag

SEQ ID NO: 5089093 - DNA, 18 bp, Homo sapiens
aacagatctccaaagctt

SEQ ID NO: 5089094 - DNA, 13 bp, Homo sapiens
aacagatgaaaag

SEQ ID NO: 5089095 - DNA, 18 bp, Homo sapiens
aacagatgaccataattt

SEQ ID NO: 5089096 - DNA, 20 bp, Homo sapiens
aacagatgaccgtgtacaat

SEQ ID NO: 5089097 - DNA, 22 bp, Homo sapiens
aacagatgcaatgtgctactga

SEQ ID NO: 5089098 - DNA, 23 bp, Homo sapiens
aacagatgcaatgtgctactgat

SEQ ID NO: 5089099 - DNA, 17 bp, Homo sapiens
aacagatggctgtgaaa

SEQ ID NO: 5089100 - DNA, 18 bp, Homo sapiens
aacagatggtagagagag

SEQ ID NO: 5089101 - DNA, 19 bp, Homo sapiens
aacagatgtccatcagatg

SEQ ID NO: 5089102 - DNA, 15 bp, Homo sapiens
aacagatgtgaaaat

SEQ ID NO: 5089103 - DNA, 21 bp, Homo sapiens
aacaactcctagggccactga

SEQ ID NO: 5089104 - DNA, 20 bp, Homo sapiens
aacaactcgaatcactcatt

SEQ ID NO: 5089105 - DNA, 20 bp, Homo sapiens
aacaactctgatgtggaatg

SEQ ID NO: 5089106 - DNA, 21 bp, Homo sapiens
aacaactgagatgttaaaata

SEQ ID NO: 5089107 - DNA, 17 bp, Homo sapiens
aacaactgccaaataaa

SEQ ID NO: 5089108 - DNA, 19 bp, Homo sapiens
aacaactggaaataaagta

SEQ ID NO: 5089109 - DNA, 12 bp, Homo sapiens
aacaactgggtc

SEQ ID NO: 5089110 - DNA, 14 bp, Homo sapiens
aacaactgtcagtt

SEQ ID NO: 5089111 - DNA, 19 bp, Homo sapiens
aacaactgtcagttcatcc

SEQ ID NO: 5089112 - DNA, 22 bp, Homo sapiens
aacaacttatgactaaaaatat

SEQ ID NO: 5089113 - DNA, 16 bp, Homo sapiens
aacaacttctttgtaa

SEQ ID NO: 5089114 - DNA, 17 bp, Homo sapiens
aacaacttctttgtaat

SEQ ID NO: 5089115 - DNA, 22 bp, Homo sapiens
aacaacttgaaacccattttaa

SEQ ID NO: 5089116 - DNA, 14 bp, Homo sapiens
aacaacttggcatt

SEQ ID NO: 5089117 - DNA, 16 bp, Homo sapiens
aacaacttggcatttc

SEQ ID NO: 5089118 - DNA, 23 bp, Homo sapiens
aacaactttagcatcagaaggtt

SEQ ID NO: 5089119 - DNA, 15 bp, Homo sapiens
aacaactttcacttc

SEQ ID NO: 5089120 - DNA, 14 bp, Homo sapiens
aacaactttctgga

SEQ ID NO: 5089121 - DNA, 17 bp, Homo sapiens
aacaagaaaaataaaga

SEQ ID NO: 5089122 - DNA, 19 bp, Homo sapiens
aacaagaaaaataaagaaa

SEQ ID NO: 5089123 - DNA, 12 bp, Homo sapiens
aacaagaaaaca

SEQ ID NO: 5089124 - DNA, 12 bp, Homo sapiens
aacaagaaagaa

SEQ ID NO: 5089125 - DNA, 12 bp, Homo sapiens
aacaagaaagga

SEQ ID NO: 5089126 - DNA, 16 bp, Homo sapiens
aacaagaaaggagagt

SEQ ID NO: 5089127 - DNA, 17 bp, Homo sapiens
aacaagaaaggagagtc

SEQ ID NO: 5089128 - DNA, 15 bp, Homo sapiens
aacaagaaagtggtc

SEQ ID NO: 5089129 - DNA, 15 bp, Homo sapiens
aacaagaaagtttcc

SEQ ID NO: 5089130 - DNA, 12 bp, Homo sapiens
aacaagaagaaa

SEQ ID NO: 5089131 - DNA, 17 bp, Homo sapiens
aacaagaagaaatatga

SEQ ID NO: 5089132 - DNA, 15 bp, Homo sapiens
aacaagaagagtaaa

SEQ ID NO: 5089133 - DNA, 14 bp, Homo sapiens
aacaagaatactga

SEQ ID NO: 5089134 - DNA, 16 bp, Homo sapiens
aacaagaatgcattga

SEQ ID NO: 5089135 - DNA, 17 bp, Homo sapiens
aacaagaatgcattgat

SEQ ID NO: 5089136 - DNA, 15 bp, Homo sapiens
aacaagacaagctcc

SEQ ID NO: 5089137 - DNA, 17 bp, Homo sapiens
aacaagaccacgtttct

SEQ ID NO: 5089138 - DNA, 23 bp, Homo sapiens
aacaagacctcagtgccttcctg

SEQ ID NO: 5089139 - DNA, 15 bp, Homo sapiens
aacaagactgccagg

SEQ ID NO: 5089140 - DNA, 14 bp, Homo sapiens
aacaagacttcaga

SEQ ID NO: 5089141 - DNA, 18 bp, Homo sapiens
aacaagacttcagattcc

SEQ ID NO: 5089142 - DNA, 11 bp, Homo sapiens
aacaagagacc

SEQ ID NO: 5089143 - DNA, 14 bp, Homo sapiens
aacaagagaccact

SEQ ID NO: 5089144 - DNA, 18 bp, Homo sapiens
aacaagagcaaaactcag

SEQ ID NO: 5089145 - DNA, 16 bp, Homo sapiens
aacaagagcctgattt

SEQ ID NO: 5089146 - DNA, 18 bp, Homo sapiens
aacaagagtttgttctgt

SEQ ID NO: 5089147 - DNA, 17 bp, Homo sapiens
aacaagatcattatctt

SEQ ID NO: 5089148 - DNA, 22 bp, Homo sapiens
aacaagatgctggatgtctgcc

SEQ ID NO: 5089149 - DNA, 14 bp, Homo sapiens
aacaagatttccct

SEQ ID NO: 5089150 - DNA, 20 bp, Homo sapiens
aacaagatttgtaattacag

SEQ ID NO: 5089151 - DNA, 14 bp, Homo sapiens
aacaagcaaactga

SEQ ID NO: 5089152 - DNA, 17 bp, Homo sapiens
aacaagcaaactgaaat

SEQ ID NO: 5089153 - DNA, 19 bp, Homo sapiens
aacaagcaaggatatcaga

SEQ ID NO: 5089154 - DNA, 16 bp, Homo sapiens
aacaagcaataaacaa

SEQ ID NO: 5089155 - DNA, 16 bp, Homo sapiens
aacaagcatataaaat

SEQ ID NO: 5089156 - DNA, 13 bp, Homo sapiens
aacaagcatgcag

SEQ ID NO: 5089157 - DNA, 17 bp, Homo sapiens
aacaagcatgtctctct

SEQ ID NO: 5089158 - DNA, 21 bp, Homo sapiens
aacaagcatttcccccaggga

SEQ ID NO: 5089159 - DNA, 21 bp, Homo sapiens
aacaagccaaacattcttatt

SEQ ID NO: 5089160 - DNA, 18 bp, Homo sapiens
aacaagccaagaaagatg

SEQ ID NO: 5089161 - DNA, 22 bp, Homo sapiens
aacaagccctgcttttgcataa

SEQ ID NO: 5089162 - DNA, 21 bp, Homo sapiens
aacaagcctccttttaaagta

SEQ ID NO: 5089163 - DNA, 22 bp, Homo sapiens
aacaagcctgaccctgtaaaat

SEQ ID NO: 5089164 - DNA, 19 bp, Homo sapiens
aacaagctaggtgctaatt

SEQ ID NO: 5089165 - DNA, 22 bp, Homo sapiens
aacaaggaaaaatgccactccc

SEQ ID NO: 5089166 - DNA, 17 bp, Homo sapiens
aacaaggaaactttcct

SEQ ID NO: 5089167 - DNA, 14 bp, Homo sapiens
aacaaggaaggaca

SEQ ID NO: 5089168 - DNA, 14 bp, Homo sapiens
aacaaggaagtcaa

SEQ ID NO: 5089169 - DNA, 15 bp, Homo sapiens
aacaaggaccctgtt

SEQ ID NO: 5089170 - DNA, 23 bp, Homo sapiens
aacaaggcattcagcagtttctg

SEQ ID NO: 5089171 - DNA, 16 bp, Homo sapiens
aacaaggcttgctgca

SEQ ID NO: 5089172 - DNA, 14 bp, Homo sapiens
aacaagggcagtgg

SEQ ID NO: 5089173 - DNA, 18 bp, Homo sapiens
aacaagggctacctctga

SEQ ID NO: 5089174 - DNA, 19 bp, Homo sapiens
aacaagggctgcaatgccc

SEQ ID NO: 5089175 - DNA, 20 bp, Homo sapiens
aacaaggggcctccaacctt

SEQ ID NO: 5089176 - DNA, 19 bp, Homo sapiens
aacaaggggctgttacata

SEQ ID NO: 5089177 - DNA, 15 bp, Homo sapiens
aacaaggggtcaatg

SEQ ID NO: 5089178 - DNA, 18 bp, Homo sapiens
aacaaggtgcacagacct

SEQ ID NO: 5089179 - DNA, 22 bp, Homo sapiens
aacaaggtgccctttagccaga

SEQ ID NO: 5089180 - DNA, 14 bp, Homo sapiens
aacaagtaagaaaa

SEQ ID NO: 5089181 - DNA, 17 bp, Homo sapiens
aacaagtaagaaaaata

SEQ ID NO: 5089182 - DNA, 15 bp, Homo sapiens
aacaagtagaaaagt

SEQ ID NO: 5089183 - DNA, 14 bp, Homo sapiens
aacaagtatataat

SEQ ID NO: 5089184 - DNA, 17 bp, Homo sapiens
aacaagtatttattccc

SEQ ID NO: 5089185 - DNA, 23 bp, Homo sapiens
aacaagtatttgttaatttagaa

SEQ ID NO: 5089186 - DNA, 19 bp, Homo sapiens
aacaagtcacagctgcagc

SEQ ID NO: 5089187 - DNA, 21 bp, Homo sapiens
aacaagtcacagctgcagctg

SEQ ID NO: 5089188 - DNA, 20 bp, Homo sapiens
aacaagtcatttttgtattt

SEQ ID NO: 5089189 - DNA, 21 bp, Homo sapiens
aacaagtcatttttgtatttt

SEQ ID NO: 5089190 - DNA, 21 bp, Homo sapiens
aacaagtgaaataacaaaatg

SEQ ID NO: 5089191 - DNA, 22 bp, Homo sapiens
aacaagtggatgtttttaatga

SEQ ID NO: 5089192 - DNA, 15 bp, Homo sapiens
aacaagtgtacagaa

SEQ ID NO: 5089193 - DNA, 18 bp, Homo sapiens
aacaagtgtacagaagaa

SEQ ID NO: 5089194 - DNA, 19 bp, Homo sapiens
aacaagttccattatgaaa

SEQ ID NO: 5089195 - DNA, 14 bp, Homo sapiens
aacaagttgagcta

SEQ ID NO: 5089196 - DNA, 17 bp, Homo sapiens
aacaagttgttaaaaca

SEQ ID NO: 5089197 - DNA, 18 bp, Homo sapiens
aacaagttgttaaaacat

SEQ ID NO: 5089198 - DNA, 13 bp, Homo sapiens
aacaagttttaga

SEQ ID NO: 5089199 - DNA, 13 bp, Homo sapiens
aacaataaaaaca

SEQ ID NO: 5089200 - DNA, 16 bp, Homo sapiens
aacaataaaacattat

SEQ ID NO: 5089201 - DNA, 19 bp, Homo sapiens
aacaataaaagtgtccatt

SEQ ID NO: 5089202 - DNA, 16 bp, Homo sapiens
aacaataaacaggaat

SEQ ID NO: 5089203 - DNA, 15 bp, Homo sapiens
aacaataaagactga

SEQ ID NO: 5089204 - DNA, 13 bp, Homo sapiens
aacaataaagagc

SEQ ID NO: 5089205 - DNA, 20 bp, Homo sapiens
aacaataaagcattttgcaa

SEQ ID NO: 5089206 - DNA, 15 bp, Homo sapiens
aacaataaagggaga

SEQ ID NO: 5089207 - DNA, 16 bp, Homo sapiens
aacaataaagtgacaa

SEQ ID NO: 5089208 - DNA, 17 bp, Homo sapiens
aacaataaatgaatgaa

SEQ ID NO: 5089209 - DNA, 19 bp, Homo sapiens
aacaataaatgttggcttg

SEQ ID NO: 5089210 - DNA, 12 bp, Homo sapiens
aacaataacaac

SEQ ID NO: 5089211 - DNA, 14 bp, Homo sapiens
aacaataacaacaa

SEQ ID NO: 5089212 - DNA, 15 bp, Homo sapiens
aacaataacaacaat

SEQ ID NO: 5089213 - DNA, 17 bp, Homo sapiens
aacaataactactgtgt

SEQ ID NO: 5089214 - DNA, 13 bp, Homo sapiens
aacaataagaaca

SEQ ID NO: 5089215 - DNA, 20 bp, Homo sapiens
aacaataagagcgtttgccc

SEQ ID NO: 5089216 - DNA, 12 bp, Homo sapiens
aacaataataaa

SEQ ID NO: 5089217 - DNA, 13 bp, Homo sapiens
aacaataataaag

SEQ ID NO: 5089218 - DNA, 20 bp, Homo sapiens
aacaataatatttcaagtgc

SEQ ID NO: 5089219 - DNA, 14 bp, Homo sapiens
aacaatacaaatgg

SEQ ID NO: 5089220 - DNA, 17 bp, Homo sapiens
aacaatacaaatggatt

SEQ ID NO: 5089221 - DNA, 13 bp, Homo sapiens
aacaatacaacaa

SEQ ID NO: 5089222 - DNA, 22 bp, Homo sapiens
aacaatacaacaagaacaacaa

SEQ ID NO: 5089223 - DNA, 23 bp, Homo sapiens
aacaatacaacaagaacaacaac

SEQ ID NO: 5089224 - DNA, 15 bp, Homo sapiens
aacaatacatgagaa

SEQ ID NO: 5089225 - DNA, 16 bp, Homo sapiens
aacaatagctattgca

SEQ ID NO: 5089226 - DNA, 22 bp, Homo sapiens
aacaatagctattgcatgtaaa

SEQ ID NO: 5089227 - DNA, 15 bp, Homo sapiens
aacaatatctgcagc

SEQ ID NO: 5089228 - DNA, 23 bp, Homo sapiens
aacaatattactttgtcttttca

SEQ ID NO: 5089229 - DNA, 16 bp, Homo sapiens
aacaatattgtctgaa

SEQ ID NO: 5089230 - DNA, 15 bp, Homo sapiens
aacaatatttattgt

SEQ ID NO: 5089231 - DNA, 23 bp, Homo sapiens
aacaatcaaagcacttggactct

SEQ ID NO: 5089232 - DNA, 15 bp, Homo sapiens
aacaatcacaaaagc

SEQ ID NO: 5089233 - DNA, 20 bp, Homo sapiens
aacaatcacaaaagctgtgt

SEQ ID NO: 5089234 - DNA, 23 bp, Homo sapiens
aacaatcacaaaagctgtgtctc

SEQ ID NO: 5089235 - DNA, 16 bp, Homo sapiens
aacaatcactattctt

SEQ ID NO: 5089236 - DNA, 22 bp, Homo sapiens
aacaatccatgtgattaatgtt

SEQ ID NO: 5089237 - DNA, 15 bp, Homo sapiens
aacaatccattcaca

SEQ ID NO: 5089238 - DNA, 18 bp, Homo sapiens
aacaatcccaatctttct

SEQ ID NO: 5089239 - DNA, 21 bp, Homo sapiens
aacaatcccaatctttctata

SEQ ID NO: 5089240 - DNA, 20 bp, Homo sapiens
aacaatcccagcaggaggga

SEQ ID NO: 5089241 - DNA, 15 bp, Homo sapiens
aacaatctaacaata

SEQ ID NO: 5089242 - DNA, 19 bp, Homo sapiens
aacaatctaacaataatat

SEQ ID NO: 5089243 - DNA, 15 bp, Homo sapiens
aacaatctatttaaa

SEQ ID NO: 5089244 - DNA, 17 bp, Homo sapiens
aacaatctatttaaaaa

SEQ ID NO: 5089245 - DNA, 18 bp, Homo sapiens
aacaatctatttaaaaaa

SEQ ID NO: 5089246 - DNA, 19 bp, Homo sapiens
aacaatctatttaaaaaac

SEQ ID NO: 5089247 - DNA, 22 bp, Homo sapiens
aacaatcttaagagcttgatct

SEQ ID NO: 5089248 - DNA, 14 bp, Homo sapiens
aacaatcttattcc

SEQ ID NO: 5089249 - DNA, 17 bp, Homo sapiens
aacaatcttattccgag

SEQ ID NO: 5089250 - DNA, 24 bp, Homo sapiens
aacaatcttattccgagcattcca

SEQ ID NO: 5089251 - DNA, 23 bp, Homo sapiens
aacaatcttccaaagaactgtat

SEQ ID NO: 5089252 - DNA, 14 bp, Homo sapiens
aacaatcttcctgt

SEQ ID NO: 5089253 - DNA, 17 bp, Homo sapiens
aacaatcttcctgttta

SEQ ID NO: 5089254 - DNA, 14 bp, Homo sapiens
aacaatctttgctg

SEQ ID NO: 5089255 - DNA, 18 bp, Homo sapiens
aacaatgaagataaaaag

SEQ ID NO: 5089256 - DNA, 15 bp, Homo sapiens
aacaatgaagtgaaa

SEQ ID NO: 5089257 - DNA, 23 bp, Homo sapiens
aacaatgaagtgttttacaatga

SEQ ID NO: 5089258 - DNA, 12 bp, Homo sapiens
aacaatgaagtt

SEQ ID NO: 5089259 - DNA, 18 bp, Homo sapiens
aacaatgaagttgaaaat

SEQ ID NO: 5089260 - DNA, 17 bp, Homo sapiens
aacaatgacaaagcaga

SEQ ID NO: 5089261 - DNA, 20 bp, Homo sapiens
aacaatgacactagaaaact

SEQ ID NO: 5089262 - DNA, 14 bp, Homo sapiens
aacaatgacatcca

SEQ ID NO: 5089263 - DNA, 15 bp, Homo sapiens
aacaatgatgccctg

SEQ ID NO: 5089264 - DNA, 15 bp, Homo sapiens
aacaatgattaatca

SEQ ID NO: 5089265 - DNA, 19 bp, Homo sapiens
aacaatgcagcaaggccct

SEQ ID NO: 5089266 - DNA, 23 bp, Homo sapiens
aacaatgccatgaacaaattctt

SEQ ID NO: 5089267 - DNA, 18 bp, Homo sapiens
aacaatgcctacagctgt

SEQ ID NO: 5089268 - DNA, 17 bp, Homo sapiens
aacaatgcctattgtaa

SEQ ID NO: 5089269 - DNA, 16 bp, Homo sapiens
aacaatgcgaatggta

SEQ ID NO: 5089270 - DNA, 22 bp, Homo sapiens
aacaatgctgtattttaaaaga

SEQ ID NO: 5089271 - DNA, 21 bp, Homo sapiens
aacaatgctttgataaaatat

SEQ ID NO: 5089272 - DNA, 23 bp, Homo sapiens
aacaatgctttgataaaatattt

SEQ ID NO: 5089273 - DNA, 15 bp, Homo sapiens
aacaatggagtattc

SEQ ID NO: 5089274 - DNA, 19 bp, Homo sapiens
aacaatggcaggttttaca

SEQ ID NO: 5089275 - DNA, 13 bp, Homo sapiens
aacaatggtaaca

SEQ ID NO: 5089276 - DNA, 18 bp, Homo sapiens
aacaatggtgtggtgaat

SEQ ID NO: 5089277 - DNA, 21 bp, Homo sapiens
aacaatggtttacatgaacac

SEQ ID NO: 5089278 - DNA, 16 bp, Homo sapiens
aacaatgtaattacat

SEQ ID NO: 5089279 - DNA, 16 bp, Homo sapiens
aacaatgtataaagat

SEQ ID NO: 5089280 - DNA, 17 bp, Homo sapiens
aacaatgtataaagatt

SEQ ID NO: 5089281 - DNA, 16 bp, Homo sapiens
aacaatgtattttaat

SEQ ID NO: 5089282 - DNA, 20 bp, Homo sapiens
aacagatgtgaaaatatact

SEQ ID NO: 5089283 - DNA, 19 bp, Homo sapiens
aacagattattaccttaca

SEQ ID NO: 5089284 - DNA, 17 bp, Homo sapiens
aacagattattttggaa

SEQ ID NO: 5089285 - DNA, 20 bp, Homo sapiens
aacagattattttggaaagt

SEQ ID NO: 5089286 - DNA, 13 bp, Homo sapiens
aacagattcagaa

SEQ ID NO: 5089287 - DNA, 18 bp, Homo sapiens
aacagattcaggccagcc

SEQ ID NO: 5089288 - DNA, 13 bp, Homo sapiens
aacagattctcca

SEQ ID NO: 5089289 - DNA, 14 bp, Homo sapiens
aacagattctgatt

SEQ ID NO: 5089290 - DNA, 20 bp, Homo sapiens
aacagattgctacacacaca

SEQ ID NO: 5089291 - DNA, 17 bp, Homo sapiens
aacagattggattttat

SEQ ID NO: 5089292 - DNA, 23 bp, Homo sapiens
aacagattggattttatgttgac

SEQ ID NO: 5089293 - DNA, 24 bp, Homo sapiens
aacagattggattttatgttgaca

SEQ ID NO: 5089294 - DNA, 15 bp, Homo sapiens
aacagattgtttgca

SEQ ID NO: 5089295 - DNA, 14 bp, Homo sapiens
aacagatttaaaga

SEQ ID NO: 5089296 - DNA, 13 bp, Homo sapiens
aacagatttcaaa

SEQ ID NO: 5089297 - DNA, 15 bp, Homo sapiens
aacagatttggaaag

SEQ ID NO: 5089298 - DNA, 22 bp, Homo sapiens
aacagatttggtgaatttgaat

SEQ ID NO: 5089299 - DNA, 15 bp, Homo sapiens
aacagatttgtgaac

SEQ ID NO: 5089300 - DNA, 18 bp, Homo sapiens
aacagatttgtgaactca

SEQ ID NO: 5089301 - DNA, 15 bp, Homo sapiens
aacagatttgttcat

SEQ ID NO: 5089302 - DNA, 18 bp, Homo sapiens
aacagattttattaatca

SEQ ID NO: 5089303 - DNA, 17 bp, Homo sapiens
aacagatttttacaaat

SEQ ID NO: 5089304 - DNA, 17 bp, Homo sapiens
aacagcaaaagttcttt

SEQ ID NO: 5089305 - DNA, 15 bp, Homo sapiens
aacagcaaaccaaga

SEQ ID NO: 5089306 - DNA, 16 bp, Homo sapiens
aacagcaaaccaagag

SEQ ID NO: 5089307 - DNA, 17 bp, Homo sapiens
aacagcaaaccaagaga

SEQ ID NO: 5089308 - DNA, 18 bp, Homo sapiens
aacagcaaaccaagagat

SEQ ID NO: 5089309 - DNA, 14 bp, Homo sapiens
aacagcaaataacc

SEQ ID NO: 5089310 - DNA, 17 bp, Homo sapiens
aacagcaaattaatgtg

SEQ ID NO: 5089311 - DNA, 19 bp, Homo sapiens
aacagcaaattaatgtgta

SEQ ID NO: 5089312 - DNA, 23 bp, Homo sapiens
aacagcaaattaatgtgtaaaat

SEQ ID NO: 5089313 - DNA, 22 bp, Homo sapiens
aacagcaacacaaagcttttgc

SEQ ID NO: 5089314 - DNA, 21 bp, Homo sapiens
aacagcaaccttgaaaaaata

SEQ ID NO: 5089315 - DNA, 18 bp, Homo sapiens
aacagcacacaggcagcc

SEQ ID NO: 5089316 - DNA, 13 bp, Homo sapiens
aacagcacacctg

SEQ ID NO: 5089317 - DNA, 15 bp, Homo sapiens
aacagcacacctgtg

SEQ ID NO: 5089318 - DNA, 16 bp, Homo sapiens
aacagcacagtctttt

SEQ ID NO: 5089319 - DNA, 21 bp, Homo sapiens
aacagcactggctctctccag

SEQ ID NO: 5089320 - DNA, 18 bp, Homo sapiens
aacagcagaaacccatgt

SEQ ID NO: 5089321 - DNA, 13 bp, Homo sapiens
aacagcagaaaga

SEQ ID NO: 5089322 - DNA, 19 bp, Homo sapiens
aacagcagactcagctctg

SEQ ID NO: 5089323 - DNA, 21 bp, Homo sapiens
aacagcagaggttcttttaaa

SEQ ID NO: 5089324 - DNA, 9 bp, Homo sapiens
aacagcagc

SEQ ID NO: 5089325 - DNA, 19 bp, Homo sapiens
aacagcagctcatagaatt

SEQ ID NO: 5089326 - DNA, 22 bp, Homo sapiens
aacagcagctgaagccagctcc

SEQ ID NO: 5089327 - DNA, 18 bp, Homo sapiens
aacagcaggaggcacagc

SEQ ID NO: 5089328 - DNA, 18 bp, Homo sapiens
aacagcaggatgccctgt

SEQ ID NO: 5089329 - DNA, 20 bp, Homo sapiens
aacagcaggccatcttttta

SEQ ID NO: 5089330 - DNA, 15 bp, Homo sapiens
aacagcagggtttga

SEQ ID NO: 5089331 - DNA, 22 bp, Homo sapiens
aacagcagggtttgagcacaat

SEQ ID NO: 5089332 - DNA, 19 bp, Homo sapiens
aacagcagtgatctcaggg

SEQ ID NO: 5089333 - DNA, 13 bp, Homo sapiens
aacagcagtgttc

SEQ ID NO: 5089334 - DNA, 18 bp, Homo sapiens
aacagcagtgttctcaca

SEQ ID NO: 5089335 - DNA, 19 bp, Homo sapiens
aacagcagtgttctcacag

SEQ ID NO: 5089336 - DNA, 15 bp, Homo sapiens
aacagcatcaaaata

SEQ ID NO: 5089337 - DNA, 22 bp, Homo sapiens
aacagcatccccaaaacaaagt

SEQ ID NO: 5089338 - DNA, 21 bp, Homo sapiens
aacagcatctccaagcagctt

SEQ ID NO: 5089339 - DNA, 23 bp, Homo sapiens
aacagcatctgcctctattcaat

SEQ ID NO: 5089340 - DNA, 17 bp, Homo sapiens
aacagcatgacaaaaat

SEQ ID NO: 5089341 - DNA, 18 bp, Homo sapiens
aacagcatgacaaaaatt

SEQ ID NO: 5089342 - DNA, 23 bp, Homo sapiens
aacagcattcttgtcacaataaa

SEQ ID NO: 5089343 - DNA, 12 bp, Homo sapiens
aacagcattgct

SEQ ID NO: 5089344 - DNA, 16 bp, Homo sapiens
aacagcattgctttct

SEQ ID NO: 5089345 - DNA, 17 bp, Homo sapiens
aacagcattgctttctg

SEQ ID NO: 5089346 - DNA, 19 bp, Homo sapiens
aacagcattggcctggcca

SEQ ID NO: 5089347 - DNA, 15 bp, Homo sapiens
aacagccaaagaaac

SEQ ID NO: 5089348 - DNA, 17 bp, Homo sapiens
aacagccaaagaaactc

SEQ ID NO: 5089349 - DNA, 18 bp, Homo sapiens
aacagccaaagaaactca

SEQ ID NO: 5089350 - DNA, 19 bp, Homo sapiens
aacagccaactagcccctg

SEQ ID NO: 5089351 - DNA, 18 bp, Homo sapiens
aacagccaagattttcct

SEQ ID NO: 5089352 - DNA, 16 bp, Homo sapiens
aacagccaagctggca

SEQ ID NO: 5089353 - DNA, 16 bp, Homo sapiens
aacagccaagtgtgac

SEQ ID NO: 5089354 - DNA, 23 bp, Homo sapiens
aacagccaccctgcccagtctgg

SEQ ID NO: 5089355 - DNA, 18 bp, Homo sapiens
aacagccactcccctcca

SEQ ID NO: 5089356 - DNA, 12 bp, Homo sapiens
aacagccagcaa

SEQ ID NO: 5089357 - DNA, 22 bp, Homo sapiens
aacagcccaggcatctccttgg

SEQ ID NO: 5089358 - DNA, 19 bp, Homo sapiens
aacagccccagtcttcctt

SEQ ID NO: 5089359 - DNA, 16 bp, Homo sapiens
aacagccccggggccc

SEQ ID NO: 5089360 - DNA, 13 bp, Homo sapiens
aacagccgagtgg

SEQ ID NO: 5089361 - DNA, 23 bp, Homo sapiens
aacagccgagtggatagatgccc

SEQ ID NO: 5089362 - DNA, 21 bp, Homo sapiens
aacagccgctcctgtctgcca

SEQ ID NO: 5089363 - DNA, 21 bp, Homo sapiens
aacagcctactgaaaatgcat

SEQ ID NO: 5089364 - DNA, 12 bp, Homo sapiens
aacagcctgaga

SEQ ID NO: 5089365 - DNA, 12 bp, Homo sapiens
aacagcctgggg

SEQ ID NO: 5089366 - DNA, 21 bp, Homo sapiens
aacagcctggggttgtccccg

SEQ ID NO: 5089367 - DNA, 12 bp, Homo sapiens
aacagcctgtgt

SEQ ID NO: 5089368 - DNA, 20 bp, Homo sapiens
aacagcggctggacttggag

SEQ ID NO: 5089369 - DNA, 21 bp, Homo sapiens
aacagcgggagacctgtgcta

SEQ ID NO: 5089370 - DNA, 17 bp, Homo sapiens
aacagcgtcttccttct

SEQ ID NO: 5089371 - DNA, 16 bp, Homo sapiens
aacagcgtggcttaga

SEQ ID NO: 5089372 - DNA, 19 bp, Homo sapiens
aacagcgttcctagagaag

SEQ ID NO: 5089373 - DNA, 19 bp, Homo sapiens
aacagctaatctttaatat

SEQ ID NO: 5089374 - DNA, 13 bp, Homo sapiens
aacagctacaaca

SEQ ID NO: 5089375 - DNA, 21 bp, Homo sapiens
aacagctatttcccttttctg

SEQ ID NO: 5089376 - DNA, 19 bp, Homo sapiens
aacagctattttagtaacc

SEQ ID NO: 5089377 - DNA, 18 bp, Homo sapiens
aacagctcaagtcttccc

SEQ ID NO: 5089378 - DNA, 11 bp, Homo sapiens
aacagctcaga

SEQ ID NO: 5089379 - DNA, 14 bp, Homo sapiens
aacagctcaggatc

SEQ ID NO: 5089380 - DNA, 15 bp, Homo sapiens
aacagctccctagtg

SEQ ID NO: 5089381 - DNA, 10 bp, Homo sapiens
aacagctcct

SEQ ID NO: 5089382 - DNA, 14 bp, Homo sapiens
aacagctccttggg

SEQ ID NO: 5089383 - DNA, 15 bp, Homo sapiens
aacagctccttggga

SEQ ID NO: 5089384 - DNA, 13 bp, Homo sapiens
aacagctcgactt

SEQ ID NO: 5089385 - DNA, 24 bp, Homo sapiens
aacagctcgatccaaattgtgctt

SEQ ID NO: 5089386 - DNA, 23 bp, Homo sapiens
aacagctctcttcaatgacatag

SEQ ID NO: 5089387 - DNA, 23 bp, Homo sapiens
aacagctcttcactcagccacac

SEQ ID NO: 5089388 - DNA, 14 bp, Homo sapiens
aacagctgaaagag

SEQ ID NO: 5089389 - DNA, 20 bp, Homo sapiens
aacagctgaggtctcttgag

SEQ ID NO: 5089390 - DNA, 21 bp, Homo sapiens
aacagctgaggtctcttgagg

SEQ ID NO: 5089391 - DNA, 11 bp, Homo sapiens
aacagctgcaa

SEQ ID NO: 5089392 - DNA, 19 bp, Homo sapiens
aacagctgcaattccctgg

SEQ ID NO: 5089393 - DNA, 21 bp, Homo sapiens
aacagctgcaattccctggat

SEQ ID NO: 5089394 - DNA, 16 bp, Homo sapiens
aacagctgcattagaa

SEQ ID NO: 5089395 - DNA, 13 bp, Homo sapiens
aacagctgcctct

SEQ ID NO: 5089396 - DNA, 12 bp, Homo sapiens
aacagctgcctt

SEQ ID NO: 5089397 - DNA, 13 bp, Homo sapiens
aacagctgcctta

SEQ ID NO: 5089398 - DNA, 14 bp, Homo sapiens
aacagctgccttag

SEQ ID NO: 5089399 - DNA, 15 bp, Homo sapiens
aacagctgccttagc

SEQ ID NO: 5089400 - DNA, 18 bp, Homo sapiens
aacagctgcttctccccc

SEQ ID NO: 5089401 - DNA, 19 bp, Homo sapiens
aacagctgcttctcccccc

SEQ ID NO: 5089402 - DNA, 22 bp, Homo sapiens
aacagctggacacccccttggt

SEQ ID NO: 5089403 - DNA, 23 bp, Homo sapiens
aacagctggaccctgaccagctc

SEQ ID NO: 5089404 - DNA, 23 bp, Homo sapiens
aacagctggaggaatacatttta

SEQ ID NO: 5089405 - DNA, 21 bp, Homo sapiens
aacagctggggacaactgcgg

SEQ ID NO: 5089406 - DNA, 11 bp, Homo sapiens
aacagctggtg

SEQ ID NO: 5089407 - DNA, 17 bp, Homo sapiens
aacagctggtgccctgc

SEQ ID NO: 5089408 - DNA, 20 bp, Homo sapiens
aacagctggtgtagctacag

SEQ ID NO: 5089409 - DNA, 23 bp, Homo sapiens
aacagctggtgtagctacagaga

SEQ ID NO: 5089410 - DNA, 12 bp, Homo sapiens
aacagctgtcaa

SEQ ID NO: 5089411 - DNA, 18 bp, Homo sapiens
aacagctgtcacaacttg

SEQ ID NO: 5089412 - DNA, 13 bp, Homo sapiens
aacagctgtggct

SEQ ID NO: 5089413 - DNA, 23 bp, Homo sapiens
aacagctgtgtctgccaaacaca

SEQ ID NO: 5089414 - DNA, 18 bp, Homo sapiens
aacagctgttcctgtgtt

SEQ ID NO: 5089415 - DNA, 15 bp, Homo sapiens
aacagctgtttttag

SEQ ID NO: 5089416 - DNA, 16 bp, Homo sapiens
aacagcttctcaattt

SEQ ID NO: 5089417 - DNA, 14 bp, Homo sapiens
aacagcttcttgct

SEQ ID NO: 5089418 - DNA, 19 bp, Homo sapiens
aacagcttgaaaactggat

SEQ ID NO: 5089419 - DNA, 19 bp, Homo sapiens
aacagcttgaccagaccta

SEQ ID NO: 5089420 - DNA, 15 bp, Homo sapiens
aacagcttgctgtca

SEQ ID NO: 5089421 - DNA, 13 bp, Homo sapiens
aacagctttctta

SEQ ID NO: 5089422 - DNA, 14 bp, Homo sapiens
aacagctttcttat

SEQ ID NO: 5089423 - DNA, 15 bp, Homo sapiens
aacagctttcttatt

SEQ ID NO: 5089424 - DNA, 23 bp, Homo sapiens
aacagctttcttattcagtgaaa

SEQ ID NO: 5089425 - DNA, 22 bp, Homo sapiens
aacagctttggggtgtcttttt

SEQ ID NO: 5089426 - DNA, 13 bp, Homo sapiens
aacagctttgtct

SEQ ID NO: 5089427 - DNA, 23 bp, Homo sapiens
aacagctttgtctccaaagaaga

SEQ ID NO: 5089428 - DNA, 11 bp, Homo sapiens
aacaggaaaaa

SEQ ID NO: 5089429 - DNA, 19 bp, Homo sapiens
aacaggaaaaaaaataatg

SEQ ID NO: 5089430 - DNA, 12 bp, Homo sapiens
aacaggaaaaga

SEQ ID NO: 5089431 - DNA, 19 bp, Homo sapiens
aacaggaactagtaaacat

SEQ ID NO: 5089432 - DNA, 14 bp, Homo sapiens
aacaggaagatctt

SEQ ID NO: 5089433 - DNA, 23 bp, Homo sapiens
aacaggaatccttactgatattt

SEQ ID NO: 5089434 - DNA, 14 bp, Homo sapiens
aacaggaatctcag

SEQ ID NO: 5089435 - DNA, 16 bp, Homo sapiens
aacaggaatctcagag

SEQ ID NO: 5089436 - DNA, 21 bp, Homo sapiens
aacaggaatctcagagacagg

SEQ ID NO: 5089437 - DNA, 14 bp, Homo sapiens
aacaggaatgtctg

SEQ ID NO: 5089438 - DNA, 15 bp, Homo sapiens
aacaggaattttatt

SEQ ID NO: 5089439 - DNA, 18 bp, Homo sapiens
aacaggaattttattttg

SEQ ID NO: 5089440 - DNA, 21 bp, Homo sapiens
aacaggacagagttcacagga

SEQ ID NO: 5089441 - DNA, 13 bp, Homo sapiens
aacaggacagcac

SEQ ID NO: 5089442 - DNA, 16 bp, Homo sapiens
aacaggaccaggagcc

SEQ ID NO: 5089443 - DNA, 17 bp, Homo sapiens
aacaggaccaggagcca

SEQ ID NO: 5089444 - DNA, 18 bp, Homo sapiens
aacaggaccaggagccag

SEQ ID NO: 5089445 - DNA, 19 bp, Homo sapiens
aacaggacttaaaatgaca

SEQ ID NO: 5089446 - DNA, 18 bp, Homo sapiens
aacaggagacccacctga

SEQ ID NO: 5089447 - DNA, 19 bp, Homo sapiens
aacaggagctgggatccta

SEQ ID NO: 5089448 - DNA, 15 bp, Homo sapiens
aacaggaggaactgg

SEQ ID NO: 5089449 - DNA, 14 bp, Homo sapiens
aacaggagggcagc

SEQ ID NO: 5089450 - DNA, 20 bp, Homo sapiens
aacaggaggtgtgaatgcac

SEQ ID NO: 5089451 - DNA, 23 bp, Homo sapiens
aacaggagtcagtctctttctgt

SEQ ID NO: 5089452 - DNA, 15 bp, Homo sapiens
aacaggagtgactct

SEQ ID NO: 5089453 - DNA, 14 bp, Homo sapiens
aacaggataaccct

SEQ ID NO: 5089454 - DNA, 20 bp, Homo sapiens
aacaggatcagttaactatt

SEQ ID NO: 5089455 - DNA, 16 bp, Homo sapiens
aacaggattagacagt

SEQ ID NO: 5089456 - DNA, 13 bp, Homo sapiens
aacaggcacttgg

SEQ ID NO: 5089457 - DNA, 16 bp, Homo sapiens
aacaggcagaaatata

SEQ ID NO: 5089458 - DNA, 16 bp, Homo sapiens
aacaggcaggtacagg

SEQ ID NO: 5089459 - DNA, 13 bp, Homo sapiens
aacaggcattcca

SEQ ID NO: 5089460 - DNA, 11 bp, Homo sapiens
aacaggcccag

SEQ ID NO: 5089461 - DNA, 22 bp, Homo sapiens
aacaatgtattttaataacata

SEQ ID NO: 5089462 - DNA, 21 bp, Homo sapiens
aacaatgtcaaggtgctgttg

SEQ ID NO: 5089463 - DNA, 14 bp, Homo sapiens
aacaatgtcagaaa

SEQ ID NO: 5089464 - DNA, 20 bp, Homo sapiens
aacaatgtctcatgatgtaa

SEQ ID NO: 5089465 - DNA, 20 bp, Homo sapiens
aacaatgtgggcgtttgtaa

SEQ ID NO: 5089466 - DNA, 22 bp, Homo sapiens
aacaatgtgtctatttctgaaa

SEQ ID NO: 5089467 - DNA, 23 bp, Homo sapiens
aacaatgtgtctatttctgaaag

SEQ ID NO: 5089468 - DNA, 11 bp, Homo sapiens
aacaatgttaa

SEQ ID NO: 5089469 - DNA, 12 bp, Homo sapiens
aacaatgttaag

SEQ ID NO: 5089470 - DNA, 21 bp, Homo sapiens
aacaatgttaaggaaactctt

SEQ ID NO: 5089471 - DNA, 22 bp, Homo sapiens
aacaatgttgtccaacaataaa

SEQ ID NO: 5089472 - DNA, 20 bp, Homo sapiens
aacaatgttgttttaagact

SEQ ID NO: 5089473 - DNA, 21 bp, Homo sapiens
aacaatgttttttatacttca

SEQ ID NO: 5089474 - DNA, 13 bp, Homo sapiens
aacaattaactgc

SEQ ID NO: 5089475 - DNA, 17 bp, Homo sapiens
aacaattaattttctat

SEQ ID NO: 5089476 - DNA, 22 bp, Homo sapiens
aacaattatgtttcttgctgta

SEQ ID NO: 5089477 - DNA, 20 bp, Homo sapiens
aacaattcaaagaatcacct

SEQ ID NO: 5089478 - DNA, 20 bp, Homo sapiens
aacaattcaagctgagaaaa

SEQ ID NO: 5089479 - DNA, 17 bp, Homo sapiens
aacaattcagtaacaaa

SEQ ID NO: 5089480 - DNA, 13 bp, Homo sapiens
aacaattcagtgg

SEQ ID NO: 5089481 - DNA, 22 bp, Homo sapiens
aacaattcccttctttttcatc

SEQ ID NO: 5089482 - DNA, 12 bp, Homo sapiens
aacaattctaaa

SEQ ID NO: 5089483 - DNA, 19 bp, Homo sapiens
aacaattctaaaatgattg

SEQ ID NO: 5089484 - DNA, 22 bp, Homo sapiens
aacaattctaaaatgattgtag

SEQ ID NO: 5089485 - DNA, 22 bp, Homo sapiens
aacaattctcccgggactctgc

SEQ ID NO: 5089486 - DNA, 13 bp, Homo sapiens
aacaattctgatg

SEQ ID NO: 5089487 - DNA, 23 bp, Homo sapiens
aacaattggtaaaactcactgtg

SEQ ID NO: 5089488 - DNA, 17 bp, Homo sapiens
aacaattggttgtatat

SEQ ID NO: 5089489 - DNA, 20 bp, Homo sapiens
aacaattggttgtatataaa

SEQ ID NO: 5089490 - DNA, 22 bp, Homo sapiens
aacaattgtcgaaaagagtctt

SEQ ID NO: 5089491 - DNA, 16 bp, Homo sapiens
aacaattgtgtgaatt

SEQ ID NO: 5089492 - DNA, 16 bp, Homo sapiens
aacaatttatgaattg

SEQ ID NO: 5089493 - DNA, 15 bp, Homo sapiens
aacaatttattctga

SEQ ID NO: 5089494 - DNA, 22 bp, Homo sapiens
aacaatttgcataatactaatt

SEQ ID NO: 5089495 - DNA, 14 bp, Homo sapiens
aacaatttggcaat

SEQ ID NO: 5089496 - DNA, 19 bp, Homo sapiens
aacaatttggcaattttgt

SEQ ID NO: 5089497 - DNA, 14 bp, Homo sapiens
aacaattttaaata

SEQ ID NO: 5089498 - DNA, 18 bp, Homo sapiens
aacaattttaaataagat

SEQ ID NO: 5089499 - DNA, 16 bp, Homo sapiens
aacaattttcagattt

SEQ ID NO: 5089500 - DNA, 20 bp, Homo sapiens
aacaattttcagatttgcac

SEQ ID NO: 5089501 - DNA, 12 bp, Homo sapiens
aacaattttcta

SEQ ID NO: 5089502 - DNA, 14 bp, Homo sapiens
aacaattttctgca

SEQ ID NO: 5089503 - DNA, 20 bp, Homo sapiens
aacaattttctgtaatcttt

SEQ ID NO: 5089504 - DNA, 12 bp, Homo sapiens
aacaattttctt

SEQ ID NO: 5089505 - DNA, 18 bp, Homo sapiens
aacaattttcttgtgaca

SEQ ID NO: 5089506 - DNA, 18 bp, Homo sapiens
aacaatttttgaaaaaga

SEQ ID NO: 5089507 - DNA, 19 bp, Homo sapiens
aacacaaaaaaaattttag

SEQ ID NO: 5089508 - DNA, 14 bp, Homo sapiens
aacacaaaaaaaga

SEQ ID NO: 5089509 - DNA, 17 bp, Homo sapiens
aacacaaaaaaataata

SEQ ID NO: 5089510 - DNA, 18 bp, Homo sapiens
aacacaaaacattcatgt

SEQ ID NO: 5089511 - DNA, 18 bp, Homo sapiens
aacacaaaacttgaaaga

SEQ ID NO: 5089512 - DNA, 17 bp, Homo sapiens
aacacaaacccccactc

SEQ ID NO: 5089513 - DNA, 19 bp, Homo sapiens
aacacaaacgggctcagca

SEQ ID NO: 5089514 - DNA, 19 bp, Homo sapiens
aacacaaactgtaaataaa

SEQ ID NO: 5089515 - DNA, 17 bp, Homo sapiens
aacacaaagagatattt

SEQ ID NO: 5089516 - DNA, 20 bp, Homo sapiens
aacacaaagcttttgcatat

SEQ ID NO: 5089517 - DNA, 20 bp, Homo sapiens
aacacaaatgtctagtttct

SEQ ID NO: 5089518 - DNA, 17 bp, Homo sapiens
aacacaaatgtgtattt

SEQ ID NO: 5089519 - DNA, 14 bp, Homo sapiens
aacacaacatttta

SEQ ID NO: 5089520 - DNA, 21 bp, Homo sapiens
aacacaaccagaggtggcagg

SEQ ID NO: 5089521 - DNA, 17 bp, Homo sapiens
aacacaactatattgtt

SEQ ID NO: 5089522 - DNA, 19 bp, Homo sapiens
aacacaagactgtcattag

SEQ ID NO: 5089523 - DNA, 21 bp, Homo sapiens
aacacaagattggtgtttttt

SEQ ID NO: 5089524 - DNA, 13 bp, Homo sapiens
aacacaagcaaaa

SEQ ID NO: 5089525 - DNA, 17 bp, Homo sapiens
aacacaagggatataaa

SEQ ID NO: 5089526 - DNA, 19 bp, Homo sapiens
aacacaagggatataaaat

SEQ ID NO: 5089527 - DNA, 22 bp, Homo sapiens
aacacaagggatataaaatgaa

SEQ ID NO: 5089528 - DNA, 23 bp, Homo sapiens
aacacaagggatataaaatgaaa

SEQ ID NO: 5089529 - DNA, 15 bp, Homo sapiens
aacacaaggtgggca

SEQ ID NO: 5089530 - DNA, 14 bp, Homo sapiens
aacacaataagagt

SEQ ID NO: 5089531 - DNA, 21 bp, Homo sapiens
aacacaataagagtctccttc

SEQ ID NO: 5089532 - DNA, 13 bp, Homo sapiens
aacacaatgttat

SEQ ID NO: 5089533 - DNA, 20 bp, Homo sapiens
aacacaattgatacttcagg

SEQ ID NO: 5089534 - DNA, 20 bp, Homo sapiens
aacacacacaacgtaaaaat

SEQ ID NO: 5089535 - DNA, 13 bp, Homo sapiens
aacacacacacac

SEQ ID NO: 5089536 - DNA, 21 bp, Homo sapiens
aacacacacacacacaacaaa

SEQ ID NO: 5089537 - DNA, 23 bp, Homo sapiens
aacacacacacacgcagacacac

SEQ ID NO: 5089538 - DNA, 13 bp, Homo sapiens
aacacacacacat

SEQ ID NO: 5089539 - DNA, 13 bp, Homo sapiens
aacacacacacta

SEQ ID NO: 5089540 - DNA, 12 bp, Homo sapiens
aacacacacaga

SEQ ID NO: 5089541 - DNA, 17 bp, Homo sapiens
aacacacaccagtttac

SEQ ID NO: 5089542 - DNA, 20 bp, Homo sapiens
aacacacacgccagctcctc

SEQ ID NO: 5089543 - DNA, 22 bp, Homo sapiens
aacacacagaaggggactgcca

SEQ ID NO: 5089544 - DNA, 12 bp, Homo sapiens
aacacacagaca

SEQ ID NO: 5089545 - DNA, 21 bp, Homo sapiens
aacacacagactttctgtgac

SEQ ID NO: 5089546 - DNA, 17 bp, Homo sapiens
aacacacagagctcacc

SEQ ID NO: 5089547 - DNA, 20 bp, Homo sapiens
aacacacagatacacacaca

SEQ ID NO: 5089548 - DNA, 17 bp, Homo sapiens
aacacacataaaccaaa

SEQ ID NO: 5089549 - DNA, 17 bp, Homo sapiens
aacacacatggatgcac

SEQ ID NO: 5089550 - DNA, 15 bp, Homo sapiens
aacacaccaggctgt

SEQ ID NO: 5089551 - DNA, 15 bp, Homo sapiens
aacacaccttaaaac

SEQ ID NO: 5089552 - DNA, 14 bp, Homo sapiens
aacacaccttggag

SEQ ID NO: 5089553 - DNA, 23 bp, Homo sapiens
aacacaccttggagaagtggcat

SEQ ID NO: 5089554 - DNA, 14 bp, Homo sapiens
aacacacgctcctc

SEQ ID NO: 5089555 - DNA, 21 bp, Homo sapiens
aacacactactacctcttaag

SEQ ID NO: 5089556 - DNA, 12 bp, Homo sapiens
aacacactgaac

SEQ ID NO: 5089557 - DNA, 12 bp, Homo sapiens
aacacactgtaa

SEQ ID NO: 5089558 - DNA, 14 bp, Homo sapiens
aacacactgtaaat

SEQ ID NO: 5089559 - DNA, 22 bp, Homo sapiens
aacacactgtaaatatccacag

SEQ ID NO: 5089560 - DNA, 16 bp, Homo sapiens
aacacactgtgtcctg

SEQ ID NO: 5089561 - DNA, 15 bp, Homo sapiens
aacacacttagaata

SEQ ID NO: 5089562 - DNA, 21 bp, Homo sapiens
aacacacttgggagcagtcct

SEQ ID NO: 5089563 - DNA, 19 bp, Homo sapiens
aacacagacattctgccag

SEQ ID NO: 5089564 - DNA, 23 bp, Homo sapiens
aacacagagaagcggatttccag

SEQ ID NO: 5089565 - DNA, 21 bp, Homo sapiens
aacacagagctggcgactgca

SEQ ID NO: 5089566 - DNA, 22 bp, Homo sapiens
aacacagaggaatttatacctc

SEQ ID NO: 5089567 - DNA, 17 bp, Homo sapiens
aacacagatctcttgtt

SEQ ID NO: 5089568 - DNA, 13 bp, Homo sapiens
aacacagattatt

SEQ ID NO: 5089569 - DNA, 18 bp, Homo sapiens
aacacagcaagggtgatg

SEQ ID NO: 5089570 - DNA, 19 bp, Homo sapiens
aacacagcagttctgcaga

SEQ ID NO: 5089571 - DNA, 15 bp, Homo sapiens
aacacagcatgcatt

SEQ ID NO: 5089572 - DNA, 14 bp, Homo sapiens
aacacagcatgtgc

SEQ ID NO: 5089573 - DNA, 19 bp, Homo sapiens
aacacagcatgtgccaaga

SEQ ID NO: 5089574 - DNA, 14 bp, Homo sapiens
aacacagcctccct

SEQ ID NO: 5089575 - DNA, 17 bp, Homo sapiens
aacacagcctccctgag

SEQ ID NO: 5089576 - DNA, 14 bp, Homo sapiens
aacacagcctgggc

SEQ ID NO: 5089577 - DNA, 19 bp, Homo sapiens
aacacagctgagagacttt

SEQ ID NO: 5089578 - DNA, 16 bp, Homo sapiens
aacacagctgctgaag

SEQ ID NO: 5089579 - DNA, 17 bp, Homo sapiens
aacacagctgctgaaga

SEQ ID NO: 5089580 - DNA, 21 bp, Homo sapiens
aacacagctgctgaagaggca

SEQ ID NO: 5089581 - DNA, 11 bp, Homo sapiens
aacacagctgt

SEQ ID NO: 5089582 - DNA, 24 bp, Homo sapiens
aacacagctgttcttctgttctgc

SEQ ID NO: 5089583 - DNA, 22 bp, Homo sapiens
aacacagctttacaacttccat

SEQ ID NO: 5089584 - DNA, 10 bp, Homo sapiens
aacacaggca

SEQ ID NO: 5089585 - DNA, 16 bp, Homo sapiens
aacacaggcaaagagg

SEQ ID NO: 5089586 - DNA, 22 bp, Homo sapiens
aacacaggcagctttctagaag

SEQ ID NO: 5089587 - DNA, 16 bp, Homo sapiens
aacacagtagtgttct

SEQ ID NO: 5089588 - DNA, 15 bp, Homo sapiens
aacacagtattgtag

SEQ ID NO: 5089589 - DNA, 14 bp, Homo sapiens
aacacagtattttc

SEQ ID NO: 5089590 - DNA, 16 bp, Homo sapiens
aacacagtcaaaataa

SEQ ID NO: 5089591 - DNA, 19 bp, Homo sapiens
aacacagtcaaaataattc

SEQ ID NO: 5089592 - DNA, 20 bp, Homo sapiens
aacacagtcatgtgtcagct

SEQ ID NO: 5089593 - DNA, 15 bp, Homo sapiens
aacacagtgtctgtt

SEQ ID NO: 5089594 - DNA, 22 bp, Homo sapiens
aacacagtgtctgttcagcaaa

SEQ ID NO: 5089595 - DNA, 17 bp, Homo sapiens
aacacagtgtttcaatt

SEQ ID NO: 5089596 - DNA, 21 bp, Homo sapiens
aacacagtgtttttgtaaagt

SEQ ID NO: 5089597 - DNA, 14 bp, Homo sapiens
aacacagttttgaa

SEQ ID NO: 5089598 - DNA, 13 bp, Homo sapiens
aacacataaatta

SEQ ID NO: 5089599 - DNA, 17 bp, Homo sapiens
aacacataactagaaac

SEQ ID NO: 5089600 - DNA, 14 bp, Homo sapiens
aacacatacaaaag

SEQ ID NO: 5089601 - DNA, 17 bp, Homo sapiens
aacacatactagaaagc

SEQ ID NO: 5089602 - DNA, 18 bp, Homo sapiens
aacacatagattcacctg

SEQ ID NO: 5089603 - DNA, 20 bp, Homo sapiens
aacacatagattcacctgta

SEQ ID NO: 5089604 - DNA, 20 bp, Homo sapiens
aacacatcaataaatacttt

SEQ ID NO: 5089605 - DNA, 21 bp, Homo sapiens
aacacatctagtagttgttct

SEQ ID NO: 5089606 - DNA, 18 bp, Homo sapiens
aacacatctggctgcaca

SEQ ID NO: 5089607 - DNA, 13 bp, Homo sapiens
aacacatgatacc

SEQ ID NO: 5089608 - DNA, 19 bp, Homo sapiens
aacacatgataccagcagc

SEQ ID NO: 5089609 - DNA, 11 bp, Homo sapiens
aacacatgcac

SEQ ID NO: 5089610 - DNA, 16 bp, Homo sapiens
aacacatgcacacaca

SEQ ID NO: 5089611 - DNA, 17 bp, Homo sapiens
aacacatggctgggcct

SEQ ID NO: 5089612 - DNA, 21 bp, Homo sapiens
aacacatggggaaaaaaatca

SEQ ID NO: 5089613 - DNA, 22 bp, Homo sapiens
aacacatggggaaaaaaatcat

SEQ ID NO: 5089614 - DNA, 16 bp, Homo sapiens
aacacatgggggagag

SEQ ID NO: 5089615 - DNA, 21 bp, Homo sapiens
aacacatgtttttatttcctc

SEQ ID NO: 5089616 - DNA, 19 bp, Homo sapiens
aacacattaaaagacaaat

SEQ ID NO: 5089617 - DNA, 15 bp, Homo sapiens
aacacattacttgca

SEQ ID NO: 5089618 - DNA, 18 bp, Homo sapiens
aacacattacttgcacaa

SEQ ID NO: 5089619 - DNA, 21 bp, Homo sapiens
aacacattatcgggagcagtg

SEQ ID NO: 5089620 - DNA, 14 bp, Homo sapiens
aacacattatgtat

SEQ ID NO: 5089621 - DNA, 15 bp, Homo sapiens
aacacattcctttgc

SEQ ID NO: 5089622 - DNA, 21 bp, Homo sapiens
aacacattctttataaaatgt

SEQ ID NO: 5089623 - DNA, 19 bp, Homo sapiens
aacacattgaaactgtatt

SEQ ID NO: 5089624 - DNA, 23 bp, Homo sapiens
aacacattgaatgcgctttattg

SEQ ID NO: 5089625 - DNA, 17 bp, Homo sapiens
aacacattgttattttc

SEQ ID NO: 5089626 - DNA, 19 bp, Homo sapiens
aacacattgttattttcag

SEQ ID NO: 5089627 - DNA, 20 bp, Homo sapiens
aacacattgttattttcagt

SEQ ID NO: 5089628 - DNA, 22 bp, Homo sapiens
aacacattgttattttcagtga

SEQ ID NO: 5089629 - DNA, 14 bp, Homo sapiens
aacacatttcaaat

SEQ ID NO: 5089630 - DNA, 23 bp, Homo sapiens
aacacatttccattcatggatat

SEQ ID NO: 5089631 - DNA, 14 bp, Homo sapiens
aacacatttcccta

SEQ ID NO: 5089632 - DNA, 12 bp, Homo sapiens
aacacatttctt

SEQ ID NO: 5089633 - DNA, 22 bp, Homo sapiens
aacacatttctttttaaaaaaa

SEQ ID NO: 5089634 - DNA, 21 bp, Homo sapiens
aacacatttgctttttgtgat

SEQ ID NO: 5089635 - DNA, 13 bp, Homo sapiens
aacacattttaaa

SEQ ID NO: 5089636 - DNA, 19 bp, Homo sapiens
aacacattttgtataattg

SEQ ID NO: 5089637 - DNA, 14 bp, Homo sapiens
aacacatttttaag

SEQ ID NO: 5089638 - DNA, 20 bp, Homo sapiens
aacacatttttaagatgcat

SEQ ID NO: 5089639 - DNA, 18 bp, Homo sapiens
aacaggcccagagaggaa

SEQ ID NO: 5089640 - DNA, 13 bp, Homo sapiens
aacaggcccagca

SEQ ID NO: 5089641 - DNA, 20 bp, Homo sapiens
aacaggccccacgccctctc

SEQ ID NO: 5089642 - DNA, 23 bp, Homo sapiens
aacaggcccttggtagagctggt

SEQ ID NO: 5089643 - DNA, 14 bp, Homo sapiens
aacaggcctcaggg

SEQ ID NO: 5089644 - DNA, 20 bp, Homo sapiens
aacaggctccaagaggctga

SEQ ID NO: 5089645 - DNA, 13 bp, Homo sapiens
aacaggctgggct

SEQ ID NO: 5089646 - DNA, 23 bp, Homo sapiens
aacaggctgggcttcagtggcag

SEQ ID NO: 5089647 - DNA, 10 bp, Homo sapiens
aacaggctgt

SEQ ID NO: 5089648 - DNA, 21 bp, Homo sapiens
aacaggctgttctgcactgaa

SEQ ID NO: 5089649 - DNA, 12 bp, Homo sapiens
aacaggcttgga

SEQ ID NO: 5089650 - DNA, 22 bp, Homo sapiens
aacagggaaggcaggcagggct

SEQ ID NO: 5089651 - DNA, 23 bp, Homo sapiens
aacagggaaggcaggcagggctc

SEQ ID NO: 5089652 - DNA, 18 bp, Homo sapiens
aacagggagaagtagcta

SEQ ID NO: 5089653 - DNA, 22 bp, Homo sapiens
aacagggagactgcatctcaaa

SEQ ID NO: 5089654 - DNA, 11 bp, Homo sapiens
aacagggaggg

SEQ ID NO: 5089655 - DNA, 17 bp, Homo sapiens
aacagggattgatttta

SEQ ID NO: 5089656 - DNA, 22 bp, Homo sapiens
aacagggattgattttaaaatg

SEQ ID NO: 5089657 - DNA, 18 bp, Homo sapiens
aacagggcaaccaataaa

SEQ ID NO: 5089658 - DNA, 15 bp, Homo sapiens
aacagggcagtgaca

SEQ ID NO: 5089659 - DNA, 16 bp, Homo sapiens
aacagggccacataga

SEQ ID NO: 5089660 - DNA, 23 bp, Homo sapiens
aacagggccatgtgctgccctgt

SEQ ID NO: 5089661 - DNA, 17 bp, Homo sapiens
aacagggcccaggcctg

SEQ ID NO: 5089662 - DNA, 18 bp, Homo sapiens
aacagggcccaggcctgg

SEQ ID NO: 5089663 - DNA, 19 bp, Homo sapiens
aacagggcccaggcctgga

SEQ ID NO: 5089664 - DNA, 20 bp, Homo sapiens
aacaggggaggaaaaaagaa

SEQ ID NO: 5089665 - DNA, 17 bp, Homo sapiens
aacaggggatcaaagtt

SEQ ID NO: 5089666 - DNA, 22 bp, Homo sapiens
aacaggggctggagggctgggc

SEQ ID NO: 5089667 - DNA, 15 bp, Homo sapiens
aacaggggctggtgg

SEQ ID NO: 5089668 - DNA, 19 bp, Homo sapiens
aacagggtagatttctctt

SEQ ID NO: 5089669 - DNA, 17 bp, Homo sapiens
aacagggtccaggaatg

SEQ ID NO: 5089670 - DNA, 23 bp, Homo sapiens
aacagggtccaggaatggtgctt

SEQ ID NO: 5089671 - DNA, 13 bp, Homo sapiens
aacagggtctcta

SEQ ID NO: 5089672 - DNA, 22 bp, Homo sapiens
aacagggtctctagtgctgtga

SEQ ID NO: 5089673 - DNA, 15 bp, Homo sapiens
aacagggttggcatt

SEQ ID NO: 5089674 - DNA, 13 bp, Homo sapiens
aacaggtattttc

SEQ ID NO: 5089675 - DNA, 22 bp, Homo sapiens
aacaggtattttgtttctttta

SEQ ID NO: 5089676 - DNA, 22 bp, Homo sapiens
aacaggtatttttttaaatcaa

SEQ ID NO: 5089677 - DNA, 17 bp, Homo sapiens
aacaggtctcctcttaa

SEQ ID NO: 5089678 - DNA, 18 bp, Homo sapiens
aacaggtctcctcttaaa

SEQ ID NO: 5089679 - DNA, 21 bp, Homo sapiens
aacaggtgctggcccagcatg

SEQ ID NO: 5089680 - DNA, 21 bp, Homo sapiens
aacaggtggcaggaccaggac

SEQ ID NO: 5089681 - DNA, 12 bp, Homo sapiens
aacaggtgggct

SEQ ID NO: 5089682 - DNA, 18 bp, Homo sapiens
aacaggtgtgtgtgaact

SEQ ID NO: 5089683 - DNA, 15 bp, Homo sapiens
aacaggtgttcctcc

SEQ ID NO: 5089684 - DNA, 18 bp, Homo sapiens
aacaggtgttggtgacaa

SEQ ID NO: 5089685 - DNA, 16 bp, Homo sapiens
aacaggttattttagt

SEQ ID NO: 5089686 - DNA, 23 bp, Homo sapiens
aacaggttcctgtggagacactg

SEQ ID NO: 5089687 - DNA, 13 bp, Homo sapiens
aacaggttttttt

SEQ ID NO: 5089688 - DNA, 22 bp, Homo sapiens
aacagtaaaatccaaagaacta

SEQ ID NO: 5089689 - DNA, 16 bp, Homo sapiens
aacagtaaaccactga

SEQ ID NO: 5089690 - DNA, 17 bp, Homo sapiens
aacagtaaaccactgaa

SEQ ID NO: 5089691 - DNA, 18 bp, Homo sapiens
aacagtaaaccactgaaa

SEQ ID NO: 5089692 - DNA, 10 bp, Homo sapiens
aacagtaaat

SEQ ID NO: 5089693 - DNA, 13 bp, Homo sapiens
aacagtaaatata

SEQ ID NO: 5089694 - DNA, 17 bp, Homo sapiens
aacagtaaatatacact

SEQ ID NO: 5089695 - DNA, 14 bp, Homo sapiens
aacagtaaatgtgc

SEQ ID NO: 5089696 - DNA, 16 bp, Homo sapiens
aacagtaacacatctt

SEQ ID NO: 5089697 - DNA, 17 bp, Homo sapiens
aacagtaactgccattt

SEQ ID NO: 5089698 - DNA, 22 bp, Homo sapiens
aacagtaattactttcagaatg

SEQ ID NO: 5089699 - DNA, 20 bp, Homo sapiens
aacagtacagaaggcaaagt

SEQ ID NO: 5089700 - DNA, 21 bp, Homo sapiens
aacagtaccctggttgtgtgt

SEQ ID NO: 5089701 - DNA, 22 bp, Homo sapiens
aacagtagccccatcacatttg

SEQ ID NO: 5089702 - DNA, 19 bp, Homo sapiens
aacagtagttgtattcttc

SEQ ID NO: 5089703 - DNA, 21 bp, Homo sapiens
aacagtatgatggaacagtga

SEQ ID NO: 5089704 - DNA, 20 bp, Homo sapiens
aacagtatgtgggatattga

SEQ ID NO: 5089705 - DNA, 16 bp, Homo sapiens
aacagtattgggcagg

SEQ ID NO: 5089706 - DNA, 18 bp, Homo sapiens
aacagtattgggcaggag

SEQ ID NO: 5089707 - DNA, 12 bp, Homo sapiens
aacagtatttat

SEQ ID NO: 5089708 - DNA, 19 bp, Homo sapiens
aacagtatttattttgtaa

SEQ ID NO: 5089709 - DNA, 20 bp, Homo sapiens
aacagtatttattttgtaat

SEQ ID NO: 5089710 - DNA, 23 bp, Homo sapiens
aacagtatttattttgtaattat

SEQ ID NO: 5089711 - DNA, 22 bp, Homo sapiens
aacagtatttcattgcctgtgt

SEQ ID NO: 5089712 - DNA, 16 bp, Homo sapiens
aacagtattttaagaa

SEQ ID NO: 5089713 - DNA, 23 bp, Homo sapiens
aacagtcaaatatcatttactct

SEQ ID NO: 5089714 - DNA, 12 bp, Homo sapiens
aacagtcaagaa

SEQ ID NO: 5089715 - DNA, 15 bp, Homo sapiens
aacagtcaccactgt

SEQ ID NO: 5089716 - DNA, 15 bp, Homo sapiens
aacagtcacccttct

SEQ ID NO: 5089717 - DNA, 17 bp, Homo sapiens
aacagtcactggaaaga

SEQ ID NO: 5089718 - DNA, 13 bp, Homo sapiens
aacagtcatgtat

SEQ ID NO: 5089719 - DNA, 15 bp, Homo sapiens
aacagtcatgtttta

SEQ ID NO: 5089720 - DNA, 23 bp, Homo sapiens
aacagtccagacatttgtttcat

SEQ ID NO: 5089721 - DNA, 18 bp, Homo sapiens
aacagtccattgaaaggg

SEQ ID NO: 5089722 - DNA, 23 bp, Homo sapiens
aacagtccccgtggccatccctg

SEQ ID NO: 5089723 - DNA, 13 bp, Homo sapiens
aacagtccttgct

SEQ ID NO: 5089724 - DNA, 17 bp, Homo sapiens
aacagtctaaaaattga

SEQ ID NO: 5089725 - DNA, 19 bp, Homo sapiens
aacagtctcaggaaatcaa

SEQ ID NO: 5089726 - DNA, 16 bp, Homo sapiens
aacagtctctggaaga

SEQ ID NO: 5089727 - DNA, 18 bp, Homo sapiens
aacagtcttactgcaggc

SEQ ID NO: 5089728 - DNA, 14 bp, Homo sapiens
aacagtgaaagtca

SEQ ID NO: 5089729 - DNA, 12 bp, Homo sapiens
aacagtgaagat

SEQ ID NO: 5089730 - DNA, 21 bp, Homo sapiens
aacagtgaagttttactgtct

SEQ ID NO: 5089731 - DNA, 15 bp, Homo sapiens
aacagtgagcatatc

SEQ ID NO: 5089732 - DNA, 20 bp, Homo sapiens
aacagtgagcatatctggta

SEQ ID NO: 5089733 - DNA, 13 bp, Homo sapiens
aacagtgagcctg

SEQ ID NO: 5089734 - DNA, 14 bp, Homo sapiens
aacagtgaggctgg

SEQ ID NO: 5089735 - DNA, 16 bp, Homo sapiens
aacagtgaggctggga

SEQ ID NO: 5089736 - DNA, 15 bp, Homo sapiens
aacagtgattaccag

SEQ ID NO: 5089737 - DNA, 22 bp, Homo sapiens
aacagtgattaccagggactga

SEQ ID NO: 5089738 - DNA, 13 bp, Homo sapiens
aacagtgcatgtg

SEQ ID NO: 5089739 - DNA, 14 bp, Homo sapiens
aacagtgcctgctg

SEQ ID NO: 5089740 - DNA, 15 bp, Homo sapiens
aacagtgcctgctga

SEQ ID NO: 5089741 - DNA, 16 bp, Homo sapiens
aacagtgctattctga

SEQ ID NO: 5089742 - DNA, 16 bp, Homo sapiens
aacagtgctctgcctc

SEQ ID NO: 5089743 - DNA, 20 bp, Homo sapiens
aacagtgcttgccacagagc

SEQ ID NO: 5089744 - DNA, 22 bp, Homo sapiens
aacagtggagctgaattttctg

SEQ ID NO: 5089745 - DNA, 23 bp, Homo sapiens
aacagtggccttgcttcttagac

SEQ ID NO: 5089746 - DNA, 11 bp, Homo sapiens
aacagtggctg

SEQ ID NO: 5089747 - DNA, 16 bp, Homo sapiens
aacagtggctgggtgg

SEQ ID NO: 5089748 - DNA, 17 bp, Homo sapiens
aacagtggctgggtggg

SEQ ID NO: 5089749 - DNA, 20 bp, Homo sapiens
aacagtgggagccctgacct

SEQ ID NO: 5089750 - DNA, 12 bp, Homo sapiens
aacagtggggaa

SEQ ID NO: 5089751 - DNA, 16 bp, Homo sapiens
aacagtggggaagagt

SEQ ID NO: 5089752 - DNA, 15 bp, Homo sapiens
aacagtgtaaagtta

SEQ ID NO: 5089753 - DNA, 20 bp, Homo sapiens
aacagtgtatttggaaaatg

SEQ ID NO: 5089754 - DNA, 15 bp, Homo sapiens
aacagtgtgaagtta

SEQ ID NO: 5089755 - DNA, 17 bp, Homo sapiens
aacagtgtgaagttaga

SEQ ID NO: 5089756 - DNA, 18 bp, Homo sapiens
aacagtgtgaagttagaa

SEQ ID NO: 5089757 - DNA, 20 bp, Homo sapiens
aacagtgtgaagttagaatt

SEQ ID NO: 5089758 - DNA, 22 bp, Homo sapiens
aacagtgtgaagttagaattcc

SEQ ID NO: 5089759 - DNA, 13 bp, Homo sapiens
aacagtgtgactc

SEQ ID NO: 5089760 - DNA, 19 bp, Homo sapiens
aacagtgtgcaaggcagcc

SEQ ID NO: 5089761 - DNA, 20 bp, Homo sapiens
aacagtgtggcctcttctga

SEQ ID NO: 5089762 - DNA, 22 bp, Homo sapiens
aacagtgtggcttaaacatttt

SEQ ID NO: 5089763 - DNA, 22 bp, Homo sapiens
aacagtgtggtagttaataaaa

SEQ ID NO: 5089764 - DNA, 22 bp, Homo sapiens
aacagtgtggtttgggaaagat

SEQ ID NO: 5089765 - DNA, 23 bp, Homo sapiens
aacagtgtgtaaacaaaatgaag

SEQ ID NO: 5089766 - DNA, 16 bp, Homo sapiens
aacagtgtttacttta

SEQ ID NO: 5089767 - DNA, 17 bp, Homo sapiens
aacagtgtttatgacga

SEQ ID NO: 5089768 - DNA, 15 bp, Homo sapiens
aacagtgtttccagt

SEQ ID NO: 5089769 - DNA, 18 bp, Homo sapiens
aacagtgtttcccataat

SEQ ID NO: 5089770 - DNA, 21 bp, Homo sapiens
aacagtgtttcccataatttt

SEQ ID NO: 5089771 - DNA, 23 bp, Homo sapiens
aacagtgtttcccataattttct

SEQ ID NO: 5089772 - DNA, 20 bp, Homo sapiens
aacagtgttttggaataaaa

SEQ ID NO: 5089773 - DNA, 18 bp, Homo sapiens
aacagttaactttcagaa

SEQ ID NO: 5089774 - DNA, 21 bp, Homo sapiens
aacagttaagacaacaggcat

SEQ ID NO: 5089775 - DNA, 19 bp, Homo sapiens
aacagttagtaatggtgct

SEQ ID NO: 5089776 - DNA, 16 bp, Homo sapiens
aacagttataaagaaa

SEQ ID NO: 5089777 - DNA, 23 bp, Homo sapiens
aacagttataaagaaagattgta

SEQ ID NO: 5089778 - DNA, 13 bp, Homo sapiens
aacagttatattt

SEQ ID NO: 5089779 - DNA, 17 bp, Homo sapiens
aacagttatatttttgt

SEQ ID NO: 5089780 - DNA, 16 bp, Homo sapiens
aacagttatttctgtt

SEQ ID NO: 5089781 - DNA, 14 bp, Homo sapiens
aacagttcaaagaa

SEQ ID NO: 5089782 - DNA, 15 bp, Homo sapiens
aacagttctcactgg

SEQ ID NO: 5089783 - DNA, 18 bp, Homo sapiens
aacagttctgagctgtaa

SEQ ID NO: 5089784 - DNA, 21 bp, Homo sapiens
aacagttctgagctgtaattt

SEQ ID NO: 5089785 - DNA, 20 bp, Homo sapiens
aacagttctgcactcttgta

SEQ ID NO: 5089786 - DNA, 18 bp, Homo sapiens
aacagttgcacagcatct

SEQ ID NO: 5089787 - DNA, 22 bp, Homo sapiens
aacagttgcacagcatctcagc

SEQ ID NO: 5089788 - DNA, 20 bp, Homo sapiens
aacagttgcatgtagtaaca

SEQ ID NO: 5089789 - DNA, 17 bp, Homo sapiens
aacagttgcatttagct

SEQ ID NO: 5089790 - DNA, 14 bp, Homo sapiens
aacagttgccacat

SEQ ID NO: 5089791 - DNA, 19 bp, Homo sapiens
aacagttgggctgtcaaca

SEQ ID NO: 5089792 - DNA, 14 bp, Homo sapiens
aacagttggtaact

SEQ ID NO: 5089793 - DNA, 23 bp, Homo sapiens
aacagttgtatttaacagaaatt

SEQ ID NO: 5089794 - DNA, 19 bp, Homo sapiens
aacagttgtgtttgaagca

SEQ ID NO: 5089795 - DNA, 12 bp, Homo sapiens
aacagtttaaaa

SEQ ID NO: 5089796 - DNA, 20 bp, Homo sapiens
aacagtttatttttattatt

SEQ ID NO: 5089797 - DNA, 23 bp, Homo sapiens
aacagtttcttgcttggaagcca

SEQ ID NO: 5089798 - DNA, 19 bp, Homo sapiens
aacagttttacttctggcc

SEQ ID NO: 5089799 - DNA, 11 bp, Homo sapiens
aacagttttcc

SEQ ID NO: 5089800 - DNA, 14 bp, Homo sapiens
aacagttttccatg

SEQ ID NO: 5089801 - DNA, 12 bp, Homo sapiens
aacagttttcct

SEQ ID NO: 5089802 - DNA, 21 bp, Homo sapiens
aacagttttcctatgctttga

SEQ ID NO: 5089803 - DNA, 15 bp, Homo sapiens
aacagttttgagtaa

SEQ ID NO: 5089804 - DNA, 17 bp, Homo sapiens
aacagttttgtgtaact

SEQ ID NO: 5089805 - DNA, 16 bp, Homo sapiens
aacataaaaaaacttc

SEQ ID NO: 5089806 - DNA, 23 bp, Homo sapiens
aacataaaaagcagaattttaat

SEQ ID NO: 5089807 - DNA, 15 bp, Homo sapiens
aacataaaaaggaca

SEQ ID NO: 5089808 - DNA, 14 bp, Homo sapiens
aacataaaaatgat

SEQ ID NO: 5089809 - DNA, 12 bp, Homo sapiens
aacataaaacaa

SEQ ID NO: 5089810 - DNA, 16 bp, Homo sapiens
aacataaaatgaggca

SEQ ID NO: 5089811 - DNA, 17 bp, Homo sapiens
aacataaacttgtactt

SEQ ID NO: 5089812 - DNA, 12 bp, Homo sapiens
aacataaaggtt

SEQ ID NO: 5089813 - DNA, 21 bp, Homo sapiens
aacataaagttgtattgcatg

SEQ ID NO: 5089814 - DNA, 12 bp, Homo sapiens
aacataaataaa

SEQ ID NO: 5089815 - DNA, 14 bp, Homo sapiens
aacataaataaaat

SEQ ID NO: 5089816 - DNA, 17 bp, Homo sapiens
aacataaattgtactgt

SEQ ID NO: 5089817 - DNA, 19 bp, Homo sapiens
aacacatttttcttaggga

SEQ ID NO: 5089818 - DNA, 15 bp, Homo sapiens
aacaccaaaaaatat

SEQ ID NO: 5089819 - DNA, 17 bp, Homo sapiens
aacaccaaaaaatatct

SEQ ID NO: 5089820 - DNA, 16 bp, Homo sapiens
aacaccaacccaggaa

SEQ ID NO: 5089821 - DNA, 22 bp, Homo sapiens
aacaccaagacttgaaggtgcc

SEQ ID NO: 5089822 - DNA, 14 bp, Homo sapiens
aacaccaagcacag

SEQ ID NO: 5089823 - DNA, 18 bp, Homo sapiens
aacaccaagcacagcagc

SEQ ID NO: 5089824 - DNA, 12 bp, Homo sapiens
aacaccacactg

SEQ ID NO: 5089825 - DNA, 15 bp, Homo sapiens
aacaccacactgacc

SEQ ID NO: 5089826 - DNA, 14 bp, Homo sapiens
aacaccacagacac

SEQ ID NO: 5089827 - DNA, 15 bp, Homo sapiens
aacaccacagacaca

SEQ ID NO: 5089828 - DNA, 23 bp, Homo sapiens
aacaccactgaacagaaatttct

SEQ ID NO: 5089829 - DNA, 12 bp, Homo sapiens
aacaccagaaag

SEQ ID NO: 5089830 - DNA, 21 bp, Homo sapiens
aacaccagcaacattataatg

SEQ ID NO: 5089831 - DNA, 21 bp, Homo sapiens
aacaccagccccacttctggg

SEQ ID NO: 5089832 - DNA, 17 bp, Homo sapiens
aacaccagcccctgccc

SEQ ID NO: 5089833 - DNA, 16 bp, Homo sapiens
aacaccagctgtatat

SEQ ID NO: 5089834 - DNA, 14 bp, Homo sapiens
aacaccaggactta

SEQ ID NO: 5089835 - DNA, 22 bp, Homo sapiens
aacaccaggacttaagacaaat

SEQ ID NO: 5089836 - DNA, 16 bp, Homo sapiens
aacaccaggactttaa

SEQ ID NO: 5089837 - DNA, 21 bp, Homo sapiens
aacaccagtcccgaaatttgg

SEQ ID NO: 5089838 - DNA, 18 bp, Homo sapiens
aacaccagtgttagctta

SEQ ID NO: 5089839 - DNA, 20 bp, Homo sapiens
aacaccataggtagaatgta

SEQ ID NO: 5089840 - DNA, 13 bp, Homo sapiens
aacaccatcatta

SEQ ID NO: 5089841 - DNA, 18 bp, Homo sapiens
aacaccatcattaagaat

SEQ ID NO: 5089842 - DNA, 21 bp, Homo sapiens
aacaccatcattaagaataat

SEQ ID NO: 5089843 - DNA, 15 bp, Homo sapiens
aacaccattgaaggc

SEQ ID NO: 5089844 - DNA, 17 bp, Homo sapiens
aacaccattgaaggctt

SEQ ID NO: 5089845 - DNA, 20 bp, Homo sapiens
aacacccaagcacaaactgt

SEQ ID NO: 5089846 - DNA, 11 bp, Homo sapiens
aacacccactg

SEQ ID NO: 5089847 - DNA, 15 bp, Homo sapiens
aacacccactggcca

SEQ ID NO: 5089848 - DNA, 16 bp, Homo sapiens
aacacccactggccag

SEQ ID NO: 5089849 - DNA, 22 bp, Homo sapiens
aacacccatcgtataaggaaat

SEQ ID NO: 5089850 - DNA, 21 bp, Homo sapiens
aacacccatgaatcaaagaca

SEQ ID NO: 5089851 - DNA, 16 bp, Homo sapiens
aacacccatttttcct

SEQ ID NO: 5089852 - DNA, 19 bp, Homo sapiens
aacacccccgacggcctcc

SEQ ID NO: 5089853 - DNA, 13 bp, Homo sapiens
aacacccctctgt

SEQ ID NO: 5089854 - DNA, 19 bp, Homo sapiens
aacacccgccccccccatg

SEQ ID NO: 5089855 - DNA, 14 bp, Homo sapiens
aacacccggaaaga

SEQ ID NO: 5089856 - DNA, 20 bp, Homo sapiens
aacacccggaaagactgaaa

SEQ ID NO: 5089857 - DNA, 21 bp, Homo sapiens
aacaccctcacactgggactt

SEQ ID NO: 5089858 - DNA, 18 bp, Homo sapiens
aacaccctcgaagcgcgc

SEQ ID NO: 5089859 - DNA, 14 bp, Homo sapiens
aacaccctgcttct

SEQ ID NO: 5089860 - DNA, 17 bp, Homo sapiens
aacaccctgcttctccc

SEQ ID NO: 5089861 - DNA, 17 bp, Homo sapiens
aacaccctggatgctgt

SEQ ID NO: 5089862 - DNA, 15 bp, Homo sapiens
aacacccttagaaaa

SEQ ID NO: 5089863 - DNA, 20 bp, Homo sapiens
aacacccttagaaaatgtgt

SEQ ID NO: 5089864 - DNA, 19 bp, Homo sapiens
aacacccttccttctgtaa

SEQ ID NO: 5089865 - DNA, 20 bp, Homo sapiens
aacaccgcttctgccttttc

SEQ ID NO: 5089866 - DNA, 13 bp, Homo sapiens
aacaccggcagaa

SEQ ID NO: 5089867 - DNA, 21 bp, Homo sapiens
aacacctcacacctcactctt

SEQ ID NO: 5089868 - DNA, 17 bp, Homo sapiens
aacacctcagctgcctc

SEQ ID NO: 5089869 - DNA, 18 bp, Homo sapiens
aacacctcagctgcctcc

SEQ ID NO: 5089870 - DNA, 17 bp, Homo sapiens
aacacctgacacatctt

SEQ ID NO: 5089871 - DNA, 13 bp, Homo sapiens
aacacctgatctg

SEQ ID NO: 5089872 - DNA, 16 bp, Homo sapiens
aacacctgatctggcc

SEQ ID NO: 5089873 - DNA, 17 bp, Homo sapiens
aacacctgatgtgtaca

SEQ ID NO: 5089874 - DNA, 11 bp, Homo sapiens
aacacctgcct

SEQ ID NO: 5089875 - DNA, 21 bp, Homo sapiens
aacacctgcctaggtttttcc

SEQ ID NO: 5089876 - DNA, 15 bp, Homo sapiens
aacacctgccttcta

SEQ ID NO: 5089877 - DNA, 21 bp, Homo sapiens
aacacctgccttctaccctct

SEQ ID NO: 5089878 - DNA, 13 bp, Homo sapiens
aacacctgctgcg

SEQ ID NO: 5089879 - DNA, 17 bp, Homo sapiens
aacaccttcatccagat

SEQ ID NO: 5089880 - DNA, 16 bp, Homo sapiens
aacaccttcctcctgc

SEQ ID NO: 5089881 - DNA, 19 bp, Homo sapiens
aacaccttctatagcatca

SEQ ID NO: 5089882 - DNA, 13 bp, Homo sapiens
aacaccttctctg

SEQ ID NO: 5089883 - DNA, 12 bp, Homo sapiens
aacacctttcct

SEQ ID NO: 5089884 - DNA, 21 bp, Homo sapiens
aacacctttgttttgcactga

SEQ ID NO: 5089885 - DNA, 17 bp, Homo sapiens
aacacctttgttttgtt

SEQ ID NO: 5089886 - DNA, 19 bp, Homo sapiens
aacacctttgttttgttgc

SEQ ID NO: 5089887 - DNA, 16 bp, Homo sapiens
aacacgattttcaaga

SEQ ID NO: 5089888 - DNA, 14 bp, Homo sapiens
aacacgcacctgcc

SEQ ID NO: 5089889 - DNA, 13 bp, Homo sapiens
aacacgcaggagc

SEQ ID NO: 5089890 - DNA, 14 bp, Homo sapiens
aacacgcattgtac

SEQ ID NO: 5089891 - DNA, 20 bp, Homo sapiens
aacacgcctaaaactcaaaa

SEQ ID NO: 5089892 - DNA, 22 bp, Homo sapiens
aacacggagtttccatttggat

SEQ ID NO: 5089893 - DNA, 18 bp, Homo sapiens
aacacggcagctgtagct

SEQ ID NO: 5089894 - DNA, 14 bp, Homo sapiens
aacacggccctcct

SEQ ID NO: 5089895 - DNA, 21 bp, Homo sapiens
aacacgtatcccacctgacat

SEQ ID NO: 5089896 - DNA, 16 bp, Homo sapiens
aacacgtgatgtgata

SEQ ID NO: 5089897 - DNA, 16 bp, Homo sapiens
aacacgtgtctataat

SEQ ID NO: 5089898 - DNA, 15 bp, Homo sapiens
aacacgtttttacat

SEQ ID NO: 5089899 - DNA, 19 bp, Homo sapiens
aacacgtttttacatactt

SEQ ID NO: 5089900 - DNA, 14 bp, Homo sapiens
aacactaaaaataa

SEQ ID NO: 5089901 - DNA, 15 bp, Homo sapiens
aacactaaaaataaa

SEQ ID NO: 5089902 - DNA, 18 bp, Homo sapiens
aacactaaatgttaaaga

SEQ ID NO: 5089903 - DNA, 19 bp, Homo sapiens
aacactaaatgttaaagat

SEQ ID NO: 5089904 - DNA, 12 bp, Homo sapiens
aacactaacaaa

SEQ ID NO: 5089905 - DNA, 16 bp, Homo sapiens
aacactaacaaaattt

SEQ ID NO: 5089906 - DNA, 17 bp, Homo sapiens
aacactaacatgatttg

SEQ ID NO: 5089907 - DNA, 13 bp, Homo sapiens
aacactaaccaaa

SEQ ID NO: 5089908 - DNA, 19 bp, Homo sapiens
aacactaactcaccagccc

SEQ ID NO: 5089909 - DNA, 13 bp, Homo sapiens
aacactaataata

SEQ ID NO: 5089910 - DNA, 22 bp, Homo sapiens
aacactaattgtccacagcaaa

SEQ ID NO: 5089911 - DNA, 14 bp, Homo sapiens
aacactactcttac

SEQ ID NO: 5089912 - DNA, 18 bp, Homo sapiens
aacactactcttacatgt

SEQ ID NO: 5089913 - DNA, 14 bp, Homo sapiens
aacactacttccct

SEQ ID NO: 5089914 - DNA, 18 bp, Homo sapiens
aacactagacaagccaga

SEQ ID NO: 5089915 - DNA, 19 bp, Homo sapiens
aacactagacaagccagaa

SEQ ID NO: 5089916 - DNA, 14 bp, Homo sapiens
aacactagcatttt

SEQ ID NO: 5089917 - DNA, 14 bp, Homo sapiens
aacactagccagac

SEQ ID NO: 5089918 - DNA, 18 bp, Homo sapiens
aacactagtagctgtttt

SEQ ID NO: 5089919 - DNA, 20 bp, Homo sapiens
aacactatatggcagtgtct

SEQ ID NO: 5089920 - DNA, 18 bp, Homo sapiens
aacactattctccagaaa

SEQ ID NO: 5089921 - DNA, 21 bp, Homo sapiens
aacactattctccagaaaaat

SEQ ID NO: 5089922 - DNA, 19 bp, Homo sapiens
aacactattgtaatcattt

SEQ ID NO: 5089923 - DNA, 19 bp, Homo sapiens
aacactatttaagtaaata

SEQ ID NO: 5089924 - DNA, 16 bp, Homo sapiens
aacactatttctggaa

SEQ ID NO: 5089925 - DNA, 16 bp, Homo sapiens
aacactatttgtgact

SEQ ID NO: 5089926 - DNA, 18 bp, Homo sapiens
aacactatttgtgacttt

SEQ ID NO: 5089927 - DNA, 22 bp, Homo sapiens
aacactatttgtgactttttaa

SEQ ID NO: 5089928 - DNA, 16 bp, Homo sapiens
aacactattttatgca

SEQ ID NO: 5089929 - DNA, 12 bp, Homo sapiens
aacactattttc

SEQ ID NO: 5089930 - DNA, 15 bp, Homo sapiens
aacactattttcaga

SEQ ID NO: 5089931 - DNA, 16 bp, Homo sapiens
aacactcagaagcctg

SEQ ID NO: 5089932 - DNA, 17 bp, Homo sapiens
aacactcagaagcctgg

SEQ ID NO: 5089933 - DNA, 18 bp, Homo sapiens
aacactcagaagcctggg

SEQ ID NO: 5089934 - DNA, 20 bp, Homo sapiens
aacactcagaagcctggggg

SEQ ID NO: 5089935 - DNA, 14 bp, Homo sapiens
aacactcagctgtt

SEQ ID NO: 5089936 - DNA, 14 bp, Homo sapiens
aacactcatgctga

SEQ ID NO: 5089937 - DNA, 15 bp, Homo sapiens
aacactcatgctgaa

SEQ ID NO: 5089938 - DNA, 21 bp, Homo sapiens
aacactcattcttttttctat

SEQ ID NO: 5089939 - DNA, 15 bp, Homo sapiens
aacactcatttccaa

SEQ ID NO: 5089940 - DNA, 17 bp, Homo sapiens
aacactccaattaagga

SEQ ID NO: 5089941 - DNA, 10 bp, Homo sapiens
aacactccag

SEQ ID NO: 5089942 - DNA, 13 bp, Homo sapiens
aacactccaggcc

SEQ ID NO: 5089943 - DNA, 16 bp, Homo sapiens
aacactccaggccctg

SEQ ID NO: 5089944 - DNA, 21 bp, Homo sapiens
aacactccaggccctgccccc

SEQ ID NO: 5089945 - DNA, 21 bp, Homo sapiens
aacactccccattaacagatg

SEQ ID NO: 5089946 - DNA, 23 bp, Homo sapiens
aacactccggtcagcccctggca

SEQ ID NO: 5089947 - DNA, 15 bp, Homo sapiens
aacactcctgaatgc

SEQ ID NO: 5089948 - DNA, 12 bp, Homo sapiens
aacactccttca

SEQ ID NO: 5089949 - DNA, 16 bp, Homo sapiens
aacactcgtgtgcatg

SEQ ID NO: 5089950 - DNA, 23 bp, Homo sapiens
aacactcgtgtgcatgagaatgt

SEQ ID NO: 5089951 - DNA, 22 bp, Homo sapiens
aacactctcactatgctgctat

SEQ ID NO: 5089952 - DNA, 17 bp, Homo sapiens
aacactcttggggacca

SEQ ID NO: 5089953 - DNA, 16 bp, Homo sapiens
aacactcttttgcttt

SEQ ID NO: 5089954 - DNA, 17 bp, Homo sapiens
aacactgaaaaaatact

SEQ ID NO: 5089955 - DNA, 15 bp, Homo sapiens
aacactgaaatgaaa

SEQ ID NO: 5089956 - DNA, 20 bp, Homo sapiens
aacactgagatccagagagg

SEQ ID NO: 5089957 - DNA, 19 bp, Homo sapiens
aacactgaggcagccttgg

SEQ ID NO: 5089958 - DNA, 19 bp, Homo sapiens
aacactgataatcacactg

SEQ ID NO: 5089959 - DNA, 22 bp, Homo sapiens
aacactgatggattccaacctt

SEQ ID NO: 5089960 - DNA, 16 bp, Homo sapiens
aacactgcaagaagtc

SEQ ID NO: 5089961 - DNA, 15 bp, Homo sapiens
aacactgcagcattt

SEQ ID NO: 5089962 - DNA, 12 bp, Homo sapiens
aacactgcagcc

SEQ ID NO: 5089963 - DNA, 14 bp, Homo sapiens
aacactgcaggaca

SEQ ID NO: 5089964 - DNA, 16 bp, Homo sapiens
aacactgcagtttcct

SEQ ID NO: 5089965 - DNA, 21 bp, Homo sapiens
aacactgccatattgtgtaat

SEQ ID NO: 5089966 - DNA, 21 bp, Homo sapiens
aacactgccctcgcacggccc

SEQ ID NO: 5089967 - DNA, 15 bp, Homo sapiens
aacactgcctatata

SEQ ID NO: 5089968 - DNA, 13 bp, Homo sapiens
aacactgcctgcc

SEQ ID NO: 5089969 - DNA, 15 bp, Homo sapiens
aacactgccttttta

SEQ ID NO: 5089970 - DNA, 23 bp, Homo sapiens
aacactgcctttttatttatatg

SEQ ID NO: 5089971 - DNA, 14 bp, Homo sapiens
aacactgctcacag

SEQ ID NO: 5089972 - DNA, 14 bp, Homo sapiens
aacactgcttaagg

SEQ ID NO: 5089973 - DNA, 21 bp, Homo sapiens
aacactgcttctcggccagcc

SEQ ID NO: 5089974 - DNA, 17 bp, Homo sapiens
aacactgcttgtgtttt

SEQ ID NO: 5089975 - DNA, 17 bp, Homo sapiens
aacactggacctggggg

SEQ ID NO: 5089976 - DNA, 19 bp, Homo sapiens
aacactggattcatttcat

SEQ ID NO: 5089977 - DNA, 19 bp, Homo sapiens
aacactggcaacaacaaag

SEQ ID NO: 5089978 - DNA, 15 bp, Homo sapiens
aacactggcccctag

SEQ ID NO: 5089979 - DNA, 17 bp, Homo sapiens
aacactggcctgggtct

SEQ ID NO: 5089980 - DNA, 16 bp, Homo sapiens
aacactggctctggga

SEQ ID NO: 5089981 - DNA, 17 bp, Homo sapiens
aacactggctctgggac

SEQ ID NO: 5089982 - DNA, 21 bp, Homo sapiens
aacactgggagaaatgaaaaa

SEQ ID NO: 5089983 - DNA, 19 bp, Homo sapiens
aacactggggacttggcct

SEQ ID NO: 5089984 - DNA, 23 bp, Homo sapiens
aacactggggacttggcctctct

SEQ ID NO: 5089985 - DNA, 22 bp, Homo sapiens
aacactggtctgctgttccagt

SEQ ID NO: 5089986 - DNA, 16 bp, Homo sapiens
aacactgtaacattta

SEQ ID NO: 5089987 - DNA, 16 bp, Homo sapiens
aacactgtaatcttaa

SEQ ID NO: 5089988 - DNA, 13 bp, Homo sapiens
aacactgtactga

SEQ ID NO: 5089989 - DNA, 22 bp, Homo sapiens
aacactgtagtaaataatgctt

SEQ ID NO: 5089990 - DNA, 12 bp, Homo sapiens
aacactgtcaat

SEQ ID NO: 5089991 - DNA, 16 bp, Homo sapiens
aacactgtcttgaaga

SEQ ID NO: 5089992 - DNA, 18 bp, Homo sapiens
aacactgtgattactctt

SEQ ID NO: 5089993 - DNA, 18 bp, Homo sapiens
aacactgtgatttatctt

SEQ ID NO: 5089994 - DNA, 15 bp, Homo sapiens
aacactgtgccctgg

SEQ ID NO: 5089995 - DNA, 16 bp, Homo sapiens
aacactgtgccctggt

SEQ ID NO: 5089996 - DNA, 18 bp, Homo sapiens
aacactgtgccctggtgg

SEQ ID NO: 5089997 - DNA, 15 bp, Homo sapiens
aacataacaaccttt

SEQ ID NO: 5089998 - DNA, 13 bp, Homo sapiens
aacataacataaa

SEQ ID NO: 5089999 - DNA, 21 bp, Homo sapiens
aacataacccacttgtcactg

SEQ ID NO: 5090000 - DNA, 21 bp, Homo sapiens
aacataactcacacccctgcc

SEQ ID NO: 5090001 - DNA, 17 bp, Homo sapiens
aacataactgcttcttg

SEQ ID NO: 5090002 - DNA, 13 bp, Homo sapiens
aacataagctatt

SEQ ID NO: 5090003 - DNA, 20 bp, Homo sapiens
aacataagctatttttctaa

SEQ ID NO: 5090004 - DNA, 17 bp, Homo sapiens
aacataagttgcattta

SEQ ID NO: 5090005 - DNA, 18 bp, Homo sapiens
aacataatataagaatca

SEQ ID NO: 5090006 - DNA, 19 bp, Homo sapiens
aacataatatagcttaaaa

SEQ ID NO: 5090007 - DNA, 22 bp, Homo sapiens
aacataatatcttgaagaatat

SEQ ID NO: 5090008 - DNA, 14 bp, Homo sapiens
aacataatcttaaa

SEQ ID NO: 5090009 - DNA, 22 bp, Homo sapiens
aacataatcttctgccttctca

SEQ ID NO: 5090010 - DNA, 13 bp, Homo sapiens
aacataatgaaca

SEQ ID NO: 5090011 - DNA, 20 bp, Homo sapiens
aacataatgaacagaattta

SEQ ID NO: 5090012 - DNA, 17 bp, Homo sapiens
aacataatgatactgaa

SEQ ID NO: 5090013 - DNA, 22 bp, Homo sapiens
aacataatggttgtgaaatgta

SEQ ID NO: 5090014 - DNA, 15 bp, Homo sapiens
aacataattcttatt

SEQ ID NO: 5090015 - DNA, 18 bp, Homo sapiens
aacataattcttgtatat

SEQ ID NO: 5090016 - DNA, 22 bp, Homo sapiens
aacatacaaatgcatctttgat

SEQ ID NO: 5090017 - DNA, 16 bp, Homo sapiens
aacatacaatttactt

SEQ ID NO: 5090018 - DNA, 18 bp, Homo sapiens
aacatacaatttactttt

SEQ ID NO: 5090019 - DNA, 20 bp, Homo sapiens
aacatacaatttacttttaa

SEQ ID NO: 5090020 - DNA, 23 bp, Homo sapiens
aacatacaatttacttttaataa

SEQ ID NO: 5090021 - DNA, 23 bp, Homo sapiens
aacatacacaaggccagaaaaag

SEQ ID NO: 5090022 - DNA, 19 bp, Homo sapiens
aacatacacgttaactgca

SEQ ID NO: 5090023 - DNA, 20 bp, Homo sapiens
aacatacattggttttgaaa

SEQ ID NO: 5090024 - DNA, 21 bp, Homo sapiens
aacatacattggttttgaaat

SEQ ID NO: 5090025 - DNA, 16 bp, Homo sapiens
aacatacattttgtac

SEQ ID NO: 5090026 - DNA, 20 bp, Homo sapiens
aacataccccttacaaatga

SEQ ID NO: 5090027 - DNA, 17 bp, Homo sapiens
aacatacccttctttaa

SEQ ID NO: 5090028 - DNA, 18 bp, Homo sapiens
aacatacccttctttaaa

SEQ ID NO: 5090029 - DNA, 21 bp, Homo sapiens
aacatacccttctttaaatca

SEQ ID NO: 5090030 - DNA, 22 bp, Homo sapiens
aacatacccttctttaaatcaa

SEQ ID NO: 5090031 - DNA, 19 bp, Homo sapiens
aacatacgggaagtttatt

SEQ ID NO: 5090032 - DNA, 21 bp, Homo sapiens
aacatacgtgtgcatgtgtct

SEQ ID NO: 5090033 - DNA, 18 bp, Homo sapiens
aacatactcccatctgtg

SEQ ID NO: 5090034 - DNA, 20 bp, Homo sapiens
aacatactcccatctgtgaa

SEQ ID NO: 5090035 - DNA, 14 bp, Homo sapiens
aacatactgattgg

SEQ ID NO: 5090036 - DNA, 11 bp, Homo sapiens
aacatactgta

SEQ ID NO: 5090037 - DNA, 13 bp, Homo sapiens
aacatacttacat

SEQ ID NO: 5090038 - DNA, 13 bp, Homo sapiens
aacatagaaaaat

SEQ ID NO: 5090039 - DNA, 23 bp, Homo sapiens
aacatagaaaaatgatgtcttta

SEQ ID NO: 5090040 - DNA, 14 bp, Homo sapiens
aacatagaaagaca

SEQ ID NO: 5090041 - DNA, 16 bp, Homo sapiens
aacatagaaagacatg

SEQ ID NO: 5090042 - DNA, 21 bp, Homo sapiens
aacatagaattgcaatctata

SEQ ID NO: 5090043 - DNA, 19 bp, Homo sapiens
aacatagacagaagaaaca

SEQ ID NO: 5090044 - DNA, 21 bp, Homo sapiens
aacatagacagaagaaacaag

SEQ ID NO: 5090045 - DNA, 14 bp, Homo sapiens
aacatagacagatg

SEQ ID NO: 5090046 - DNA, 12 bp, Homo sapiens
aacatagataaa

SEQ ID NO: 5090047 - DNA, 15 bp, Homo sapiens
aacatagatgctaca

SEQ ID NO: 5090048 - DNA, 12 bp, Homo sapiens
aacatagattta

SEQ ID NO: 5090049 - DNA, 15 bp, Homo sapiens
aacatagctgtgatt

SEQ ID NO: 5090050 - DNA, 16 bp, Homo sapiens
aacatagctttcttcc

SEQ ID NO: 5090051 - DNA, 13 bp, Homo sapiens
aacataggcaaga

SEQ ID NO: 5090052 - DNA, 16 bp, Homo sapiens
aacataggttttgatt

SEQ ID NO: 5090053 - DNA, 16 bp, Homo sapiens
aacatagtgagacact

SEQ ID NO: 5090054 - DNA, 19 bp, Homo sapiens
aacatagtggtattttaac

SEQ ID NO: 5090055 - DNA, 17 bp, Homo sapiens
aacatataaaataatgc

SEQ ID NO: 5090056 - DNA, 15 bp, Homo sapiens
aacatataaattaat

SEQ ID NO: 5090057 - DNA, 21 bp, Homo sapiens
aacatataatatatgttttaa

SEQ ID NO: 5090058 - DNA, 18 bp, Homo sapiens
aacatataatgttgttat

SEQ ID NO: 5090059 - DNA, 22 bp, Homo sapiens
aacatataatgttgttatttaa

SEQ ID NO: 5090060 - DNA, 16 bp, Homo sapiens
aacatatactatttag

SEQ ID NO: 5090061 - DNA, 13 bp, Homo sapiens
aacatatatgaaa

SEQ ID NO: 5090062 - DNA, 12 bp, Homo sapiens
aacatatatgga

SEQ ID NO: 5090063 - DNA, 14 bp, Homo sapiens
aacatatcaattca

SEQ ID NO: 5090064 - DNA, 15 bp, Homo sapiens
aacatatcaattcaa

SEQ ID NO: 5090065 - DNA, 16 bp, Homo sapiens
aacatatcaattcaac

SEQ ID NO: 5090066 - DNA, 21 bp, Homo sapiens
aacatatcatggtaatgacag

SEQ ID NO: 5090067 - DNA, 13 bp, Homo sapiens
aacatatcatttg

SEQ ID NO: 5090068 - DNA, 18 bp, Homo sapiens
aacatatcatttgtgaag

SEQ ID NO: 5090069 - DNA, 21 bp, Homo sapiens
aacatatcatttgtgaagaat

SEQ ID NO: 5090070 - DNA, 13 bp, Homo sapiens
aacatatcatttt

SEQ ID NO: 5090071 - DNA, 19 bp, Homo sapiens
aacatatccaagtttgaat

SEQ ID NO: 5090072 - DNA, 14 bp, Homo sapiens
aacatatctaaagt

SEQ ID NO: 5090073 - DNA, 14 bp, Homo sapiens
aacatatctctgcc

SEQ ID NO: 5090074 - DNA, 16 bp, Homo sapiens
aacatatctttatctt

SEQ ID NO: 5090075 - DNA, 17 bp, Homo sapiens
aacatatgaaaatacaa

SEQ ID NO: 5090076 - DNA, 15 bp, Homo sapiens
aacatatgaaatata

SEQ ID NO: 5090077 - DNA, 20 bp, Homo sapiens
aacatatgaaatataaatta

SEQ ID NO: 5090078 - DNA, 21 bp, Homo sapiens
aacatatgaaatataaattat

SEQ ID NO: 5090079 - DNA, 14 bp, Homo sapiens
aacatatgatttca

SEQ ID NO: 5090080 - DNA, 14 bp, Homo sapiens
aacatatggtctcc

SEQ ID NO: 5090081 - DNA, 19 bp, Homo sapiens
aacatatgtacataaattg

SEQ ID NO: 5090082 - DNA, 17 bp, Homo sapiens
aacatatgtatctttgg

SEQ ID NO: 5090083 - DNA, 13 bp, Homo sapiens
aacatatgtctgt

SEQ ID NO: 5090084 - DNA, 15 bp, Homo sapiens
aacatattatttcat

SEQ ID NO: 5090085 - DNA, 11 bp, Homo sapiens
aacatattctt

SEQ ID NO: 5090086 - DNA, 22 bp, Homo sapiens
aacatattcttgctttcacaaa

SEQ ID NO: 5090087 - DNA, 22 bp, Homo sapiens
aacatattcttttgatcacatt

SEQ ID NO: 5090088 - DNA, 14 bp, Homo sapiens
aacatattgttgaa

SEQ ID NO: 5090089 - DNA, 16 bp, Homo sapiens
aacatatttaaggaac

SEQ ID NO: 5090090 - DNA, 22 bp, Homo sapiens
aacatatttatttttacctgct

SEQ ID NO: 5090091 - DNA, 15 bp, Homo sapiens
aacatatttcatttt

SEQ ID NO: 5090092 - DNA, 17 bp, Homo sapiens
aacatatttcattttaa

SEQ ID NO: 5090093 - DNA, 16 bp, Homo sapiens
aacatatttttatact

SEQ ID NO: 5090094 - DNA, 19 bp, Homo sapiens
aacatcaaaacttaagatg

SEQ ID NO: 5090095 - DNA, 19 bp, Homo sapiens
aacatcaaataaatttctg

SEQ ID NO: 5090096 - DNA, 20 bp, Homo sapiens
aacatcaattgggttttgat

SEQ ID NO: 5090097 - DNA, 16 bp, Homo sapiens
aacatcacacctgccc

SEQ ID NO: 5090098 - DNA, 22 bp, Homo sapiens
aacatcacatggcatgttttgt

SEQ ID NO: 5090099 - DNA, 12 bp, Homo sapiens
aacatcacattc

SEQ ID NO: 5090100 - DNA, 16 bp, Homo sapiens
aacatcaccagtgcca

SEQ ID NO: 5090101 - DNA, 17 bp, Homo sapiens
aacatcactgaaatgct

SEQ ID NO: 5090102 - DNA, 15 bp, Homo sapiens
aacatcagacctgtc

SEQ ID NO: 5090103 - DNA, 19 bp, Homo sapiens
aacatcagctttctaatgt

SEQ ID NO: 5090104 - DNA, 22 bp, Homo sapiens
aacatcagtgtctgtttcagaa

SEQ ID NO: 5090105 - DNA, 14 bp, Homo sapiens
aacatcataaatag

SEQ ID NO: 5090106 - DNA, 17 bp, Homo sapiens
aacatcataattacatt

SEQ ID NO: 5090107 - DNA, 21 bp, Homo sapiens
aacatcatagaaactgtctag

SEQ ID NO: 5090108 - DNA, 20 bp, Homo sapiens
aacatcatatacctcttgaa

SEQ ID NO: 5090109 - DNA, 14 bp, Homo sapiens
aacatcatcaaggc

SEQ ID NO: 5090110 - DNA, 22 bp, Homo sapiens
aacatcatcaaggcactgcctg

SEQ ID NO: 5090111 - DNA, 22 bp, Homo sapiens
aacatcatgaatttattgcaca

SEQ ID NO: 5090112 - DNA, 17 bp, Homo sapiens
aacatcatgcattcaca

SEQ ID NO: 5090113 - DNA, 14 bp, Homo sapiens
aacatcattagaac

SEQ ID NO: 5090114 - DNA, 20 bp, Homo sapiens
aacatcattcctttttattt

SEQ ID NO: 5090115 - DNA, 21 bp, Homo sapiens
aacatccaaaaaaagggaagg

SEQ ID NO: 5090116 - DNA, 14 bp, Homo sapiens
aacatccaagccag

SEQ ID NO: 5090117 - DNA, 15 bp, Homo sapiens
aacatccaagccaga

SEQ ID NO: 5090118 - DNA, 19 bp, Homo sapiens
aacatccaaggagaaacag

SEQ ID NO: 5090119 - DNA, 13 bp, Homo sapiens
aacatccactctc

SEQ ID NO: 5090120 - DNA, 16 bp, Homo sapiens
aacatccactctctct

SEQ ID NO: 5090121 - DNA, 20 bp, Homo sapiens
aacatccacttaagttcttt

SEQ ID NO: 5090122 - DNA, 17 bp, Homo sapiens
aacatccatgtcctatg

SEQ ID NO: 5090123 - DNA, 22 bp, Homo sapiens
aacatccatgtcctatgtgtga

SEQ ID NO: 5090124 - DNA, 19 bp, Homo sapiens
aacatcccaaactttaaaa

SEQ ID NO: 5090125 - DNA, 22 bp, Homo sapiens
aacatcccaagattttttcatt

SEQ ID NO: 5090126 - DNA, 16 bp, Homo sapiens
aacatcccattgccct

SEQ ID NO: 5090127 - DNA, 15 bp, Homo sapiens
aacatcccttacctc

SEQ ID NO: 5090128 - DNA, 22 bp, Homo sapiens
aacatccggaacagccaaagaa

SEQ ID NO: 5090129 - DNA, 15 bp, Homo sapiens
aacatcctacaagac

SEQ ID NO: 5090130 - DNA, 19 bp, Homo sapiens
aacatcctccaattccaca

SEQ ID NO: 5090131 - DNA, 13 bp, Homo sapiens
aacatcctgactt

SEQ ID NO: 5090132 - DNA, 18 bp, Homo sapiens
aacatccttaaatgtcta

SEQ ID NO: 5090133 - DNA, 16 bp, Homo sapiens
aacatcgttgttttgc

SEQ ID NO: 5090134 - DNA, 18 bp, Homo sapiens
aacatctacaaaacatta

SEQ ID NO: 5090135 - DNA, 20 bp, Homo sapiens
aacatctacaaaacattaaa

SEQ ID NO: 5090136 - DNA, 17 bp, Homo sapiens
aacatctagcagtaaat

SEQ ID NO: 5090137 - DNA, 13 bp, Homo sapiens
aacatctcacttt

SEQ ID NO: 5090138 - DNA, 23 bp, Homo sapiens
aacatctcaggaaaatctgtgat

SEQ ID NO: 5090139 - DNA, 24 bp, Homo sapiens
aacatctcaggaaaatctgtgatt

SEQ ID NO: 5090140 - DNA, 18 bp, Homo sapiens
aacatctccatggggagg

SEQ ID NO: 5090141 - DNA, 19 bp, Homo sapiens
aacatctcctccaataaac

SEQ ID NO: 5090142 - DNA, 14 bp, Homo sapiens
aacatctcgagccc

SEQ ID NO: 5090143 - DNA, 12 bp, Homo sapiens
aacatctctgtt

SEQ ID NO: 5090144 - DNA, 13 bp, Homo sapiens
aacatctctttct

SEQ ID NO: 5090145 - DNA, 23 bp, Homo sapiens
aacatctctttctcattagagat

SEQ ID NO: 5090146 - DNA, 13 bp, Homo sapiens
aacatctgaaaag

SEQ ID NO: 5090147 - DNA, 14 bp, Homo sapiens
aacatctgaaaaga

SEQ ID NO: 5090148 - DNA, 16 bp, Homo sapiens
aacatctgaaagccac

SEQ ID NO: 5090149 - DNA, 21 bp, Homo sapiens
aacatctgagaaaagctttga

SEQ ID NO: 5090150 - DNA, 16 bp, Homo sapiens
aacatctgagtcctgg

SEQ ID NO: 5090151 - DNA, 21 bp, Homo sapiens
aacatctgatttctgaactat

SEQ ID NO: 5090152 - DNA, 19 bp, Homo sapiens
aacatctgcagtgttctgt

SEQ ID NO: 5090153 - DNA, 18 bp, Homo sapiens
aacatctgtgtctgtgtc

SEQ ID NO: 5090154 - DNA, 15 bp, Homo sapiens
aacatcttacttgtc

SEQ ID NO: 5090155 - DNA, 16 bp, Homo sapiens
aacatcttcaacatgt

SEQ ID NO: 5090156 - DNA, 14 bp, Homo sapiens
aacatcttcatata

SEQ ID NO: 5090157 - DNA, 18 bp, Homo sapiens
aacatcttcatgttttag

SEQ ID NO: 5090158 - DNA, 12 bp, Homo sapiens
aacatctttaag

SEQ ID NO: 5090159 - DNA, 18 bp, Homo sapiens
aacatctttacgtactgt

SEQ ID NO: 5090160 - DNA, 16 bp, Homo sapiens
aacatctttcttttta

SEQ ID NO: 5090161 - DNA, 17 bp, Homo sapiens
aacatctttctttttaa

SEQ ID NO: 5090162 - DNA, 20 bp, Homo sapiens
aacatctttgaaaagaaaaa

SEQ ID NO: 5090163 - DNA, 20 bp, Homo sapiens
aacatctttgacactctgca

SEQ ID NO: 5090164 - DNA, 22 bp, Homo sapiens
aacatctttgacactctgcaga

SEQ ID NO: 5090165 - DNA, 22 bp, Homo sapiens
aacatcttttggaagttttgct

SEQ ID NO: 5090166 - DNA, 21 bp, Homo sapiens
aacatctttttaacctgcaaa

SEQ ID NO: 5090167 - DNA, 15 bp, Homo sapiens
aacatgaaaacattg

SEQ ID NO: 5090168 - DNA, 20 bp, Homo sapiens
aacatgaaacaactcatgtc

SEQ ID NO: 5090169 - DNA, 15 bp, Homo sapiens
aacatgaaactgcct

SEQ ID NO: 5090170 - DNA, 18 bp, Homo sapiens
aacatgaaatgatagatt

SEQ ID NO: 5090171 - DNA, 15 bp, Homo sapiens
aacatgaacaaattt

SEQ ID NO: 5090172 - DNA, 22 bp, Homo sapiens
aacatgaacacccttagaaaat

SEQ ID NO: 5090173 - DNA, 16 bp, Homo sapiens
aacatgaagcaaacta

SEQ ID NO: 5090174 - DNA, 15 bp, Homo sapiens
aacatgaagcataat

SEQ ID NO: 5090175 - DNA, 16 bp, Homo sapiens
aacatgaagcataatt

SEQ ID NO: 5090176 - DNA, 20 bp, Homo sapiens
aacactgtggaactaataaa

SEQ ID NO: 5090177 - DNA, 21 bp, Homo sapiens
aacactgtgtattgttgtaaa

SEQ ID NO: 5090178 - DNA, 16 bp, Homo sapiens
aacactgtgtatttat

SEQ ID NO: 5090179 - DNA, 15 bp, Homo sapiens
aacactgttctctgc

SEQ ID NO: 5090180 - DNA, 21 bp, Homo sapiens
aacactgttctctgccctcca

SEQ ID NO: 5090181 - DNA, 18 bp, Homo sapiens
aacactgttggcacttat

SEQ ID NO: 5090182 - DNA, 15 bp, Homo sapiens
aacacttaaatttct

SEQ ID NO: 5090183 - DNA, 14 bp, Homo sapiens
aacacttaatcatt

SEQ ID NO: 5090184 - DNA, 19 bp, Homo sapiens
aacacttaatcattttatg

SEQ ID NO: 5090185 - DNA, 15 bp, Homo sapiens
aacacttaggaagaa

SEQ ID NO: 5090186 - DNA, 17 bp, Homo sapiens
aacacttatcttctgga

SEQ ID NO: 5090187 - DNA, 19 bp, Homo sapiens
aacacttattgctttgaaa

SEQ ID NO: 5090188 - DNA, 15 bp, Homo sapiens
aacacttcaataatt

SEQ ID NO: 5090189 - DNA, 18 bp, Homo sapiens
aacacttcagcctgtgca

SEQ ID NO: 5090190 - DNA, 16 bp, Homo sapiens
aacacttccagtctgg

SEQ ID NO: 5090191 - DNA, 20 bp, Homo sapiens
aacacttctcatcatattgt

SEQ ID NO: 5090192 - DNA, 17 bp, Homo sapiens
aacacttctgtatgcat

SEQ ID NO: 5090193 - DNA, 21 bp, Homo sapiens
aacacttctgtcctgtgaggt

SEQ ID NO: 5090194 - DNA, 18 bp, Homo sapiens
aacacttgcttgccaact

SEQ ID NO: 5090195 - DNA, 20 bp, Homo sapiens
aacacttggcatacaaaata

SEQ ID NO: 5090196 - DNA, 21 bp, Homo sapiens
aacacttggcatacaaaatat

SEQ ID NO: 5090197 - DNA, 13 bp, Homo sapiens
aacacttggtgct

SEQ ID NO: 5090198 - DNA, 16 bp, Homo sapiens
aacacttgtgactttt

SEQ ID NO: 5090199 - DNA, 20 bp, Homo sapiens
aacacttgtgttgctttctg

SEQ ID NO: 5090200 - DNA, 14 bp, Homo sapiens
aacactttaatggg

SEQ ID NO: 5090201 - DNA, 18 bp, Homo sapiens
aacactttacaatgttca

SEQ ID NO: 5090202 - DNA, 23 bp, Homo sapiens
aacactttgagcatttttaaggg

SEQ ID NO: 5090203 - DNA, 14 bp, Homo sapiens
aacactttgctttc

SEQ ID NO: 5090204 - DNA, 16 bp, Homo sapiens
aacactttgtattact

SEQ ID NO: 5090205 - DNA, 12 bp, Homo sapiens
aacacttttcaa

SEQ ID NO: 5090206 - DNA, 21 bp, Homo sapiens
aacacttttctccagggttca

SEQ ID NO: 5090207 - DNA, 11 bp, Homo sapiens
aacacttttga

SEQ ID NO: 5090208 - DNA, 21 bp, Homo sapiens
aacacttttgaaaatgtacat

SEQ ID NO: 5090209 - DNA, 24 bp, Homo sapiens
aacactttttccatttcttcagag

SEQ ID NO: 5090210 - DNA, 13 bp, Homo sapiens
aacacttttttgg

SEQ ID NO: 5090211 - DNA, 18 bp, Homo sapiens
aacacttttttgggggta

SEQ ID NO: 5090212 - DNA, 12 bp, Homo sapiens
aacagaaaaaaa

SEQ ID NO: 5090213 - DNA, 16 bp, Homo sapiens
aacagaaaaaaaacac

SEQ ID NO: 5090214 - DNA, 16 bp, Homo sapiens
aacagaaaaacaatct

SEQ ID NO: 5090215 - DNA, 14 bp, Homo sapiens
aacagaaaacatcc

SEQ ID NO: 5090216 - DNA, 14 bp, Homo sapiens
aacagaaaacattc

SEQ ID NO: 5090217 - DNA, 13 bp, Homo sapiens
aacagaaactaca

SEQ ID NO: 5090218 - DNA, 14 bp, Homo sapiens
aacagaaagcatag

SEQ ID NO: 5090219 - DNA, 15 bp, Homo sapiens
aacagaaagcataga

SEQ ID NO: 5090220 - DNA, 21 bp, Homo sapiens
aacagaaatatataaaaatat

SEQ ID NO: 5090221 - DNA, 22 bp, Homo sapiens
aacagaaatattggttgaaagt

SEQ ID NO: 5090222 - DNA, 21 bp, Homo sapiens
aacagaaatcaggtgttttaa

SEQ ID NO: 5090223 - DNA, 16 bp, Homo sapiens
aacagaaatgctctga

SEQ ID NO: 5090224 - DNA, 14 bp, Homo sapiens
aacagaaatggaaa

SEQ ID NO: 5090225 - DNA, 11 bp, Homo sapiens
aacagaaatgt

SEQ ID NO: 5090226 - DNA, 15 bp, Homo sapiens
aacagaaatgtacag

SEQ ID NO: 5090227 - DNA, 21 bp, Homo sapiens
aacagaaatgtacagcaagga

SEQ ID NO: 5090228 - DNA, 21 bp, Homo sapiens
aacagaaatgtttctgtgtca

SEQ ID NO: 5090229 - DNA, 12 bp, Homo sapiens
aacagaacactt

SEQ ID NO: 5090230 - DNA, 13 bp, Homo sapiens
aacagaacactta

SEQ ID NO: 5090231 - DNA, 16 bp, Homo sapiens
aacagaacagcaagta

SEQ ID NO: 5090232 - DNA, 15 bp, Homo sapiens
aacagaacagcttca

SEQ ID NO: 5090233 - DNA, 18 bp, Homo sapiens
aacagaacatagacagaa

SEQ ID NO: 5090234 - DNA, 17 bp, Homo sapiens
aacagaacatttctcat

SEQ ID NO: 5090235 - DNA, 16 bp, Homo sapiens
aacagaaccagagggt

SEQ ID NO: 5090236 - DNA, 14 bp, Homo sapiens
aacagaactaaatg

SEQ ID NO: 5090237 - DNA, 16 bp, Homo sapiens
aacagaactaaatgtt

SEQ ID NO: 5090238 - DNA, 17 bp, Homo sapiens
aacagaactaaatgttc

SEQ ID NO: 5090239 - DNA, 22 bp, Homo sapiens
aacagaagcagacttttcagaa

SEQ ID NO: 5090240 - DNA, 21 bp, Homo sapiens
aacagaagggagggcagagct

SEQ ID NO: 5090241 - DNA, 22 bp, Homo sapiens
aacagaagggagggcagagctg

SEQ ID NO: 5090242 - DNA, 21 bp, Homo sapiens
aacagaagtgacttctggaga

SEQ ID NO: 5090243 - DNA, 13 bp, Homo sapiens
aacagaagtgagg

SEQ ID NO: 5090244 - DNA, 15 bp, Homo sapiens
aacagaagttgtgaa

SEQ ID NO: 5090245 - DNA, 17 bp, Homo sapiens
aacagaagttgtgaaac

SEQ ID NO: 5090246 - DNA, 15 bp, Homo sapiens
aacagaataaagcag

SEQ ID NO: 5090247 - DNA, 17 bp, Homo sapiens
aacagaataaagcagcc

SEQ ID NO: 5090248 - DNA, 21 bp, Homo sapiens
aacagaataaagcagcctgat

SEQ ID NO: 5090249 - DNA, 23 bp, Homo sapiens
aacagaatactgttaaaggaaaa

SEQ ID NO: 5090250 - DNA, 18 bp, Homo sapiens
aacagaatattctgtaaa

SEQ ID NO: 5090251 - DNA, 22 bp, Homo sapiens
aacagaatattgacaagctagg

SEQ ID NO: 5090252 - DNA, 23 bp, Homo sapiens
aacagaatcagtgttaaattcat

SEQ ID NO: 5090253 - DNA, 17 bp, Homo sapiens
aacagaatcttctgggt

SEQ ID NO: 5090254 - DNA, 15 bp, Homo sapiens
aacagaatgaaaaat

SEQ ID NO: 5090255 - DNA, 16 bp, Homo sapiens
aacagaatgaaaaatg

SEQ ID NO: 5090256 - DNA, 18 bp, Homo sapiens
aacagaatgaaaaatgaa

SEQ ID NO: 5090257 - DNA, 21 bp, Homo sapiens
aacagaatgtctcttcctggt

SEQ ID NO: 5090258 - DNA, 13 bp, Homo sapiens
aacagaattttaa

SEQ ID NO: 5090259 - DNA, 18 bp, Homo sapiens
aacagacaaaaacagcct

SEQ ID NO: 5090260 - DNA, 21 bp, Homo sapiens
aacagacaaaaacagcctcac

SEQ ID NO: 5090261 - DNA, 18 bp, Homo sapiens
aacagacaaaacaatccc

SEQ ID NO: 5090262 - DNA, 18 bp, Homo sapiens
aacagacaacagaagtca

SEQ ID NO: 5090263 - DNA, 11 bp, Homo sapiens
aacagacaagt

SEQ ID NO: 5090264 - DNA, 21 bp, Homo sapiens
aacagacaatatgtgagtgcc

SEQ ID NO: 5090265 - DNA, 19 bp, Homo sapiens
aacagacaccatcttttgt

SEQ ID NO: 5090266 - DNA, 15 bp, Homo sapiens
aacagacaccctcca

SEQ ID NO: 5090267 - DNA, 11 bp, Homo sapiens
aacagacagga

SEQ ID NO: 5090268 - DNA, 12 bp, Homo sapiens
aacagacatgta

SEQ ID NO: 5090269 - DNA, 14 bp, Homo sapiens
aacagacatgtata

SEQ ID NO: 5090270 - DNA, 14 bp, Homo sapiens
aacagacattgttt

SEQ ID NO: 5090271 - DNA, 17 bp, Homo sapiens
aacagaccaatagacat

SEQ ID NO: 5090272 - DNA, 19 bp, Homo sapiens
aacagaccaatagacattt

SEQ ID NO: 5090273 - DNA, 21 bp, Homo sapiens
aacagactagaagtatttgtg

SEQ ID NO: 5090274 - DNA, 13 bp, Homo sapiens
aacagactcaggt

SEQ ID NO: 5090275 - DNA, 22 bp, Homo sapiens
aacagactcgatgcaagtgttt

SEQ ID NO: 5090276 - DNA, 14 bp, Homo sapiens
aacagactctcaca

SEQ ID NO: 5090277 - DNA, 23 bp, Homo sapiens
aacagactggcctgaggagcagc

SEQ ID NO: 5090278 - DNA, 17 bp, Homo sapiens
aacagagaaagaaaagg

SEQ ID NO: 5090279 - DNA, 21 bp, Homo sapiens
aacagagacaagaaaggcaga

SEQ ID NO: 5090280 - DNA, 19 bp, Homo sapiens
aacagagacaggcccaaga

SEQ ID NO: 5090281 - DNA, 16 bp, Homo sapiens
aacagagactggaggc

SEQ ID NO: 5090282 - DNA, 16 bp, Homo sapiens
aacagagagaatgaga

SEQ ID NO: 5090283 - DNA, 14 bp, Homo sapiens
aacagagatgccat

SEQ ID NO: 5090284 - DNA, 16 bp, Homo sapiens
aacagagcaaatttga

SEQ ID NO: 5090285 - DNA, 12 bp, Homo sapiens
aacagagcaaga

SEQ ID NO: 5090286 - DNA, 12 bp, Homo sapiens
aacagagcctgc

SEQ ID NO: 5090287 - DNA, 16 bp, Homo sapiens
aacagagcgggcctct

SEQ ID NO: 5090288 - DNA, 22 bp, Homo sapiens
aacagaggaatctacctgtggt

SEQ ID NO: 5090289 - DNA, 20 bp, Homo sapiens
aacagaggaccagcacactc

SEQ ID NO: 5090290 - DNA, 14 bp, Homo sapiens
aacagaggaggcca

SEQ ID NO: 5090291 - DNA, 15 bp, Homo sapiens
aacagaggaggccag

SEQ ID NO: 5090292 - DNA, 13 bp, Homo sapiens
aacagaggatgct

SEQ ID NO: 5090293 - DNA, 13 bp, Homo sapiens
aacagaggcagga

SEQ ID NO: 5090294 - DNA, 20 bp, Homo sapiens
aacagaggcaggagtggcag

SEQ ID NO: 5090295 - DNA, 21 bp, Homo sapiens
aacagaggccatggcagaata

SEQ ID NO: 5090296 - DNA, 20 bp, Homo sapiens
aacagaggcgtctcacattt

SEQ ID NO: 5090297 - DNA, 21 bp, Homo sapiens
aacagaggcgtctcacatttt

SEQ ID NO: 5090298 - DNA, 19 bp, Homo sapiens
aacagagggaccaaattgc

SEQ ID NO: 5090299 - DNA, 23 bp, Homo sapiens
aacagagggaccaaattgcttct

SEQ ID NO: 5090300 - DNA, 21 bp, Homo sapiens
aacagagggaggaatgtgtgc

SEQ ID NO: 5090301 - DNA, 13 bp, Homo sapiens
aacagagggctgc

SEQ ID NO: 5090302 - DNA, 16 bp, Homo sapiens
aacagaggtaaaaaaa

SEQ ID NO: 5090303 - DNA, 18 bp, Homo sapiens
aacagagtatatatgtac

SEQ ID NO: 5090304 - DNA, 19 bp, Homo sapiens
aacagagtgagaccctgtc

SEQ ID NO: 5090305 - DNA, 15 bp, Homo sapiens
aacagagtggcctcc

SEQ ID NO: 5090306 - DNA, 19 bp, Homo sapiens
aacagagtggcctccctgc

SEQ ID NO: 5090307 - DNA, 16 bp, Homo sapiens
aacagataaatagttt

SEQ ID NO: 5090308 - DNA, 22 bp, Homo sapiens
aacagatatcttcagtttaatg

SEQ ID NO: 5090309 - DNA, 14 bp, Homo sapiens
aacagatcttttac

SEQ ID NO: 5090310 - DNA, 19 bp, Homo sapiens
aacagatgacccctgccca

SEQ ID NO: 5090311 - DNA, 19 bp, Homo sapiens
aacagatgagaagactagc

SEQ ID NO: 5090312 - DNA, 23 bp, Homo sapiens
aacagatgagaagactagcagct

SEQ ID NO: 5090313 - DNA, 18 bp, Homo sapiens
aacagatgataaatattt

SEQ ID NO: 5090314 - DNA, 14 bp, Homo sapiens
aacagatgctctga

SEQ ID NO: 5090315 - DNA, 22 bp, Homo sapiens
aacagatggggtctgtgactgg

SEQ ID NO: 5090316 - DNA, 17 bp, Homo sapiens
aacagatggtagagaga

SEQ ID NO: 5090317 - DNA, 21 bp, Homo sapiens
aacagatggtagagagagttg

SEQ ID NO: 5090318 - DNA, 14 bp, Homo sapiens
aacagatgtaaatc

SEQ ID NO: 5090319 - DNA, 20 bp, Homo sapiens
aacagatgtccatcagatga

SEQ ID NO: 5090320 - DNA, 15 bp, Homo sapiens
aacagatgtccctga

SEQ ID NO: 5090321 - DNA, 22 bp, Homo sapiens
aacagatgtccctgaagtcttg

SEQ ID NO: 5090322 - DNA, 12 bp, Homo sapiens
aacagatgtgaa

SEQ ID NO: 5090323 - DNA, 21 bp, Homo sapiens
aacagatgtgaaaatatactt

SEQ ID NO: 5090324 - DNA, 24 bp, Homo sapiens
aacagatgtttcttttgtatgtaa

SEQ ID NO: 5090325 - DNA, 17 bp, Homo sapiens
aacagatgtttgttttc

SEQ ID NO: 5090326 - DNA, 17 bp, Homo sapiens
aacagattataataaat

SEQ ID NO: 5090327 - DNA, 18 bp, Homo sapiens
aacagattataataaatt

SEQ ID NO: 5090328 - DNA, 19 bp, Homo sapiens
aacagattataataaattg

SEQ ID NO: 5090329 - DNA, 21 bp, Homo sapiens
aacagattcaaagcgaacagt

SEQ ID NO: 5090330 - DNA, 12 bp, Homo sapiens
aacagattcaga

SEQ ID NO: 5090331 - DNA, 17 bp, Homo sapiens
aacagattcaggccagc

SEQ ID NO: 5090332 - DNA, 23 bp, Homo sapiens
aacagattcaggccagcccagcc

SEQ ID NO: 5090333 - DNA, 19 bp, Homo sapiens
aacagattgctacacacac

SEQ ID NO: 5090334 - DNA, 18 bp, Homo sapiens
aacagatttaagcaagac

SEQ ID NO: 5090335 - DNA, 13 bp, Homo sapiens
aacagatttctaa

SEQ ID NO: 5090336 - DNA, 14 bp, Homo sapiens
aacagatttgtgaa

SEQ ID NO: 5090337 - DNA, 16 bp, Homo sapiens
aacagatttgtgaact

SEQ ID NO: 5090338 - DNA, 22 bp, Homo sapiens
aacagatttgtgaactcagcca

SEQ ID NO: 5090339 - DNA, 16 bp, Homo sapiens
aacagattttggggtt

SEQ ID NO: 5090340 - DNA, 13 bp, Homo sapiens
aacagatttttac

SEQ ID NO: 5090341 - DNA, 17 bp, Homo sapiens
aacagcaaacagtgggg

SEQ ID NO: 5090342 - DNA, 14 bp, Homo sapiens
aacagcaaagccat

SEQ ID NO: 5090343 - DNA, 15 bp, Homo sapiens
aacagcaaagccata

SEQ ID NO: 5090344 - DNA, 22 bp, Homo sapiens
aacagcaaattaatgtgtaaaa

SEQ ID NO: 5090345 - DNA, 11 bp, Homo sapiens
aacagcaacaa

SEQ ID NO: 5090346 - DNA, 17 bp, Homo sapiens
aacagcaacacaaagct

SEQ ID NO: 5090347 - DNA, 15 bp, Homo sapiens
aacagcaaggaaaca

SEQ ID NO: 5090348 - DNA, 21 bp, Homo sapiens
aacagcaagtatgaaccacat

SEQ ID NO: 5090349 - DNA, 16 bp, Homo sapiens
aacagcaagtgtgaat

SEQ ID NO: 5090350 - DNA, 16 bp, Homo sapiens
aacagcaattttcata

SEQ ID NO: 5090351 - DNA, 16 bp, Homo sapiens
aacagcacacctgtgt

SEQ ID NO: 5090352 - DNA, 22 bp, Homo sapiens
aacagcacagtcttttcctacg

SEQ ID NO: 5090353 - DNA, 18 bp, Homo sapiens
aacagcaccaccatttaa

SEQ ID NO: 5090354 - DNA, 23 bp, Homo sapiens
aacagcaccccatagagttgtga

SEQ ID NO: 5090355 - DNA, 18 bp, Homo sapiens
aacatgaaggatcaaaaa

SEQ ID NO: 5090356 - DNA, 12 bp, Homo sapiens
aacatgaatctc

SEQ ID NO: 5090357 - DNA, 22 bp, Homo sapiens
aacatgaatttagaaatattca

SEQ ID NO: 5090358 - DNA, 13 bp, Homo sapiens
aacatgacactga

SEQ ID NO: 5090359 - DNA, 18 bp, Homo sapiens
aacatgaccaaaaaccaa

SEQ ID NO: 5090360 - DNA, 18 bp, Homo sapiens
aacatgaccactcttggc

SEQ ID NO: 5090361 - DNA, 16 bp, Homo sapiens
aacatgacccagcctg

SEQ ID NO: 5090362 - DNA, 20 bp, Homo sapiens
aacatgaccctaaatcttga

SEQ ID NO: 5090363 - DNA, 12 bp, Homo sapiens
aacatgagaaat

SEQ ID NO: 5090364 - DNA, 14 bp, Homo sapiens
aacatgagaaatgt

SEQ ID NO: 5090365 - DNA, 17 bp, Homo sapiens
aacatgagaaatgtgaa

SEQ ID NO: 5090366 - DNA, 15 bp, Homo sapiens
aacatgagactgtaa

SEQ ID NO: 5090367 - DNA, 15 bp, Homo sapiens
aacatgaggacagaa

SEQ ID NO: 5090368 - DNA, 16 bp, Homo sapiens
aacatgaggacagaag

SEQ ID NO: 5090369 - DNA, 21 bp, Homo sapiens
aacatgaggggacattttggt

SEQ ID NO: 5090370 - DNA, 14 bp, Homo sapiens
aacatgagtgctga

SEQ ID NO: 5090371 - DNA, 16 bp, Homo sapiens
aacatgagttattcat

SEQ ID NO: 5090372 - DNA, 17 bp, Homo sapiens
aacatgatactgctgct

SEQ ID NO: 5090373 - DNA, 15 bp, Homo sapiens
aacatgatgggcctg

SEQ ID NO: 5090374 - DNA, 15 bp, Homo sapiens
aacatgatttcaaaa

SEQ ID NO: 5090375 - DNA, 18 bp, Homo sapiens
aacatgcaacaaaaatgt

SEQ ID NO: 5090376 - DNA, 23 bp, Homo sapiens
aacatgcaataacaagcatgcat

SEQ ID NO: 5090377 - DNA, 12 bp, Homo sapiens
aacatgcacatt

SEQ ID NO: 5090378 - DNA, 19 bp, Homo sapiens
aacatgcacattttgtaca

SEQ ID NO: 5090379 - DNA, 22 bp, Homo sapiens
aacatgcagctcttcaacatga

SEQ ID NO: 5090380 - DNA, 23 bp, Homo sapiens
aacatgcagctcttcaacatgac

SEQ ID NO: 5090381 - DNA, 15 bp, Homo sapiens
aacatgcagtacttt

SEQ ID NO: 5090382 - DNA, 16 bp, Homo sapiens
aacatgcagttcatta

SEQ ID NO: 5090383 - DNA, 20 bp, Homo sapiens
aacatgcagttcattatttt

SEQ ID NO: 5090384 - DNA, 21 bp, Homo sapiens
aacatgcagttcattattttg

SEQ ID NO: 5090385 - DNA, 13 bp, Homo sapiens
aacatgcagtttg

SEQ ID NO: 5090386 - DNA, 19 bp, Homo sapiens
aacatgcagtttgaaattc

SEQ ID NO: 5090387 - DNA, 13 bp, Homo sapiens
aacatgccccctg

SEQ ID NO: 5090388 - DNA, 14 bp, Homo sapiens
aacatgccccctgc

SEQ ID NO: 5090389 - DNA, 18 bp, Homo sapiens
aacatgccctcaggcttg

SEQ ID NO: 5090390 - DNA, 17 bp, Homo sapiens
aacatgccgcagggagg

SEQ ID NO: 5090391 - DNA, 12 bp, Homo sapiens
aacatgcctagt

SEQ ID NO: 5090392 - DNA, 15 bp, Homo sapiens
aacatgcctcctcct

SEQ ID NO: 5090393 - DNA, 23 bp, Homo sapiens
aacatgcctcctcctgccctccg

SEQ ID NO: 5090394 - DNA, 20 bp, Homo sapiens
aacatgcctgattttaaaag

SEQ ID NO: 5090395 - DNA, 22 bp, Homo sapiens
aacatgctacacactgcatgtt

SEQ ID NO: 5090396 - DNA, 22 bp, Homo sapiens
aacatgctatccaatctcatct

SEQ ID NO: 5090397 - DNA, 21 bp, Homo sapiens
aacatgctcagtacctgtgtt

SEQ ID NO: 5090398 - DNA, 22 bp, Homo sapiens
aacatgctggaaataaaacagc

SEQ ID NO: 5090399 - DNA, 19 bp, Homo sapiens
aacatgctgtacatacttt

SEQ ID NO: 5090400 - DNA, 19 bp, Homo sapiens
aacatgctgttatttaggt

SEQ ID NO: 5090401 - DNA, 16 bp, Homo sapiens
aacatgcttataacat

SEQ ID NO: 5090402 - DNA, 17 bp, Homo sapiens
aacatgcttttacttta

SEQ ID NO: 5090403 - DNA, 16 bp, Homo sapiens
aacatgcttttccaaa

SEQ ID NO: 5090404 - DNA, 22 bp, Homo sapiens
aacatggaactcattcctgcct

SEQ ID NO: 5090405 - DNA, 15 bp, Homo sapiens
aacatggaatttaat

SEQ ID NO: 5090406 - DNA, 19 bp, Homo sapiens
aacatggaatttaatttat

SEQ ID NO: 5090407 - DNA, 14 bp, Homo sapiens
aacatggacttgta

SEQ ID NO: 5090408 - DNA, 23 bp, Homo sapiens
aacatggacttgtatatttgtac

SEQ ID NO: 5090409 - DNA, 17 bp, Homo sapiens
aacatggagaggacttt

SEQ ID NO: 5090410 - DNA, 15 bp, Homo sapiens
aacatggaggatggt

SEQ ID NO: 5090411 - DNA, 15 bp, Homo sapiens
aacatggattccaaa

SEQ ID NO: 5090412 - DNA, 17 bp, Homo sapiens
aacatggattccaaagc

SEQ ID NO: 5090413 - DNA, 18 bp, Homo sapiens
aacatggattccaaagca

SEQ ID NO: 5090414 - DNA, 20 bp, Homo sapiens
aacatggattccaaagcatt

SEQ ID NO: 5090415 - DNA, 21 bp, Homo sapiens
aacatggccaatagtcatatg

SEQ ID NO: 5090416 - DNA, 16 bp, Homo sapiens
aacatggccagactcc

SEQ ID NO: 5090417 - DNA, 14 bp, Homo sapiens
aacatggctggcct

SEQ ID NO: 5090418 - DNA, 17 bp, Homo sapiens
aacatggcttaatctta

SEQ ID NO: 5090419 - DNA, 23 bp, Homo sapiens
aacatgggagggatcagccccgc

SEQ ID NO: 5090420 - DNA, 23 bp, Homo sapiens
aacatggggttggctgggcccag

SEQ ID NO: 5090421 - DNA, 22 bp, Homo sapiens
aacatggtaattcacttcagtt

SEQ ID NO: 5090422 - DNA, 18 bp, Homo sapiens
aacatggtctagtgacac

SEQ ID NO: 5090423 - DNA, 21 bp, Homo sapiens
aacatggtgaaaccctgtctc

SEQ ID NO: 5090424 - DNA, 18 bp, Homo sapiens
aacatggtgtctggattc

SEQ ID NO: 5090425 - DNA, 20 bp, Homo sapiens
aacatggtgtgtgtctctga

SEQ ID NO: 5090426 - DNA, 20 bp, Homo sapiens
aacatggttacaatcattgc

SEQ ID NO: 5090427 - DNA, 23 bp, Homo sapiens
aacatggttcaggtacacatatt

SEQ ID NO: 5090428 - DNA, 20 bp, Homo sapiens
aacatggtttaaaagaaaaa

SEQ ID NO: 5090429 - DNA, 15 bp, Homo sapiens
aacatgtaaaatgtt

SEQ ID NO: 5090430 - DNA, 12 bp, Homo sapiens
aacatgtaatat

SEQ ID NO: 5090431 - DNA, 22 bp, Homo sapiens
aacatgtaatataaagatgtta

SEQ ID NO: 5090432 - DNA, 21 bp, Homo sapiens
aacatgtaattaagtactatg

SEQ ID NO: 5090433 - DNA, 12 bp, Homo sapiens
aacatgtacttt

SEQ ID NO: 5090434 - DNA, 20 bp, Homo sapiens
aacatgtatctctaatgaaa

SEQ ID NO: 5090435 - DNA, 19 bp, Homo sapiens
aacatgtatctgtctactt

SEQ ID NO: 5090436 - DNA, 11 bp, Homo sapiens
aacatgtatgt

SEQ ID NO: 5090437 - DNA, 15 bp, Homo sapiens
aacatgtatttatgt

SEQ ID NO: 5090438 - DNA, 16 bp, Homo sapiens
aacatgtatttatgta

SEQ ID NO: 5090439 - DNA, 15 bp, Homo sapiens
aacatgtcagtttta

SEQ ID NO: 5090440 - DNA, 17 bp, Homo sapiens
aacatgtccccttccct

SEQ ID NO: 5090441 - DNA, 19 bp, Homo sapiens
aacatgtcggagtagaaat

SEQ ID NO: 5090442 - DNA, 19 bp, Homo sapiens
aacatgtctcctatcctgg

SEQ ID NO: 5090443 - DNA, 18 bp, Homo sapiens
aacatgtgaatgaataca

SEQ ID NO: 5090444 - DNA, 14 bp, Homo sapiens
aacatgtgatgtgt

SEQ ID NO: 5090445 - DNA, 15 bp, Homo sapiens
aacatgtgatgtgtt

SEQ ID NO: 5090446 - DNA, 13 bp, Homo sapiens
aacatgtgcccct

SEQ ID NO: 5090447 - DNA, 17 bp, Homo sapiens
aacatgtgcccctgcca

SEQ ID NO: 5090448 - DNA, 13 bp, Homo sapiens
aacatgtgtactt

SEQ ID NO: 5090449 - DNA, 13 bp, Homo sapiens
aacatgtgtttta

SEQ ID NO: 5090450 - DNA, 22 bp, Homo sapiens
aacatgtgttttcatcatttca

SEQ ID NO: 5090451 - DNA, 20 bp, Homo sapiens
aacatgttaatgacaatatt

SEQ ID NO: 5090452 - DNA, 14 bp, Homo sapiens
aacatgttctccat

SEQ ID NO: 5090453 - DNA, 14 bp, Homo sapiens
aacatgttggtatt

SEQ ID NO: 5090454 - DNA, 16 bp, Homo sapiens
aacatgttggtattta

SEQ ID NO: 5090455 - DNA, 21 bp, Homo sapiens
aacatgttggtatttatctat

SEQ ID NO: 5090456 - DNA, 15 bp, Homo sapiens
aacatgtttcactta

SEQ ID NO: 5090457 - DNA, 22 bp, Homo sapiens
aacatgtttccagcattcccag

SEQ ID NO: 5090458 - DNA, 17 bp, Homo sapiens
aacatgtttctctataa

SEQ ID NO: 5090459 - DNA, 14 bp, Homo sapiens
aacatgtttctgtt

SEQ ID NO: 5090460 - DNA, 15 bp, Homo sapiens
aacattaaaaatgga

SEQ ID NO: 5090461 - DNA, 19 bp, Homo sapiens
aacattaaaaatggaactg

SEQ ID NO: 5090462 - DNA, 13 bp, Homo sapiens
aacattaaaatat

SEQ ID NO: 5090463 - DNA, 15 bp, Homo sapiens
aacattaaacactgt

SEQ ID NO: 5090464 - DNA, 12 bp, Homo sapiens
aacattaaatgt

SEQ ID NO: 5090465 - DNA, 18 bp, Homo sapiens
aacattaacatctattat

SEQ ID NO: 5090466 - DNA, 16 bp, Homo sapiens
aacattaactctaact

SEQ ID NO: 5090467 - DNA, 13 bp, Homo sapiens
aacattaagaaaa

SEQ ID NO: 5090468 - DNA, 22 bp, Homo sapiens
aacattaagaaaaacaataaag

SEQ ID NO: 5090469 - DNA, 23 bp, Homo sapiens
aacattaagaaaaacaataaaga

SEQ ID NO: 5090470 - DNA, 21 bp, Homo sapiens
aacattaagattgaggcctgc

SEQ ID NO: 5090471 - DNA, 19 bp, Homo sapiens
aacattaatagcagccttt

SEQ ID NO: 5090472 - DNA, 20 bp, Homo sapiens
aacattaatagcagcctttc

SEQ ID NO: 5090473 - DNA, 21 bp, Homo sapiens
aacattaatatttaccaaagt

SEQ ID NO: 5090474 - DNA, 18 bp, Homo sapiens
aacattaatgcctgcttt

SEQ ID NO: 5090475 - DNA, 19 bp, Homo sapiens
aacattaatgttgatttct

SEQ ID NO: 5090476 - DNA, 20 bp, Homo sapiens
aacattaatgttgatttcta

SEQ ID NO: 5090477 - DNA, 14 bp, Homo sapiens
aacattaattttat

SEQ ID NO: 5090478 - DNA, 17 bp, Homo sapiens
aacattaattttgtgca

SEQ ID NO: 5090479 - DNA, 18 bp, Homo sapiens
aacattaattttgtgcat

SEQ ID NO: 5090480 - DNA, 21 bp, Homo sapiens
aacattaattttgtgcattct

SEQ ID NO: 5090481 - DNA, 22 bp, Homo sapiens
aacattaattttgtgcattctt

SEQ ID NO: 5090482 - DNA, 22 bp, Homo sapiens
aacattacagggaatgcctgag

SEQ ID NO: 5090483 - DNA, 17 bp, Homo sapiens
aacattaccttgtcttt

SEQ ID NO: 5090484 - DNA, 19 bp, Homo sapiens
aacattagaagaaaacata

SEQ ID NO: 5090485 - DNA, 21 bp, Homo sapiens
aacattagaagaaaacatata

SEQ ID NO: 5090486 - DNA, 13 bp, Homo sapiens
aacattagaatat

SEQ ID NO: 5090487 - DNA, 18 bp, Homo sapiens
aacattagaatattgtaa

SEQ ID NO: 5090488 - DNA, 15 bp, Homo sapiens
aacattagatgtcat

SEQ ID NO: 5090489 - DNA, 17 bp, Homo sapiens
aacattaggccccagca

SEQ ID NO: 5090490 - DNA, 24 bp, Homo sapiens
aacattagtactttatagaagaat

SEQ ID NO: 5090491 - DNA, 20 bp, Homo sapiens
aacattagtatacgttttta

SEQ ID NO: 5090492 - DNA, 16 bp, Homo sapiens
aacattagttgcacta

SEQ ID NO: 5090493 - DNA, 12 bp, Homo sapiens
aacattataatt

SEQ ID NO: 5090494 - DNA, 14 bp, Homo sapiens
aacattatataaca

SEQ ID NO: 5090495 - DNA, 23 bp, Homo sapiens
aacattatataacaaaaaaggtt

SEQ ID NO: 5090496 - DNA, 14 bp, Homo sapiens
aacattatgatcta

SEQ ID NO: 5090497 - DNA, 21 bp, Homo sapiens
aacattatgatctaataaact

SEQ ID NO: 5090498 - DNA, 12 bp, Homo sapiens
aacattatttat

SEQ ID NO: 5090499 - DNA, 23 bp, Homo sapiens
aacattatttattcagcttcatt

SEQ ID NO: 5090500 - DNA, 19 bp, Homo sapiens
aacattattttaaaatcaa

SEQ ID NO: 5090501 - DNA, 16 bp, Homo sapiens
aacattattttaattg

SEQ ID NO: 5090502 - DNA, 21 bp, Homo sapiens
aacattcaaaaacatggccac

SEQ ID NO: 5090503 - DNA, 20 bp, Homo sapiens
aacattcaaaagcacaaacc

SEQ ID NO: 5090504 - DNA, 17 bp, Homo sapiens
aacattcaaagcagcag

SEQ ID NO: 5090505 - DNA, 15 bp, Homo sapiens
aacattcacagccca

SEQ ID NO: 5090506 - DNA, 16 bp, Homo sapiens
aacattcagaggaaga

SEQ ID NO: 5090507 - DNA, 19 bp, Homo sapiens
aacattcagatttaccata

SEQ ID NO: 5090508 - DNA, 11 bp, Homo sapiens
aacattcatcc

SEQ ID NO: 5090509 - DNA, 18 bp, Homo sapiens
aacattcatgctcattgc

SEQ ID NO: 5090510 - DNA, 14 bp, Homo sapiens
aacattcatgtaac

SEQ ID NO: 5090511 - DNA, 16 bp, Homo sapiens
aacattcatgtaactc

SEQ ID NO: 5090512 - DNA, 13 bp, Homo sapiens
aacattccaagaa

SEQ ID NO: 5090513 - DNA, 23 bp, Homo sapiens
aacattccatccttgagtcaaaa

SEQ ID NO: 5090514 - DNA, 14 bp, Homo sapiens
aacattcccctccc

SEQ ID NO: 5090515 - DNA, 20 bp, Homo sapiens
aacattcctcatgaatgtaa

SEQ ID NO: 5090516 - DNA, 13 bp, Homo sapiens
aacattcctccag

SEQ ID NO: 5090517 - DNA, 16 bp, Homo sapiens
aacattcgaatctctg

SEQ ID NO: 5090518 - DNA, 20 bp, Homo sapiens
aacattcgaatctctgcccc

SEQ ID NO: 5090519 - DNA, 19 bp, Homo sapiens
aacattcgtgagctgggga

SEQ ID NO: 5090520 - DNA, 19 bp, Homo sapiens
aacattctacttgcttatt

SEQ ID NO: 5090521 - DNA, 22 bp, Homo sapiens
aacattctattgactttcttaa

SEQ ID NO: 5090522 - DNA, 19 bp, Homo sapiens
aacattctggatctgaccc

SEQ ID NO: 5090523 - DNA, 20 bp, Homo sapiens
aacattctggatctgaccct

SEQ ID NO: 5090524 - DNA, 21 bp, Homo sapiens
aacattcttttaacttctttc

SEQ ID NO: 5090525 - DNA, 22 bp, Homo sapiens
aacattcttttgtttatattgt

SEQ ID NO: 5090526 - DNA, 14 bp, Homo sapiens
aacattgaaatatt

SEQ ID NO: 5090527 - DNA, 15 bp, Homo sapiens
aacattgaaatatta

SEQ ID NO: 5090528 - DNA, 21 bp, Homo sapiens
aacattgaaatattagttact

SEQ ID NO: 5090529 - DNA, 19 bp, Homo sapiens
aacattgaccaagaactgc

SEQ ID NO: 5090530 - DNA, 21 bp, Homo sapiens
aacattgaccaagaactgcat

SEQ ID NO: 5090531 - DNA, 17 bp, Homo sapiens
aacattgacttcttggt

SEQ ID NO: 5090532 - DNA, 19 bp, Homo sapiens
aacattgacttcttggttt

SEQ ID NO: 5090533 - DNA, 14 bp, Homo sapiens
aacagcactggctc

SEQ ID NO: 5090534 - DNA, 20 bp, Homo sapiens
aacagcactggctctctcca

SEQ ID NO: 5090535 - DNA, 17 bp, Homo sapiens
aacagcagaggttcttt

SEQ ID NO: 5090536 - DNA, 20 bp, Homo sapiens
aacagcagagtaaaattaca

SEQ ID NO: 5090537 - DNA, 12 bp, Homo sapiens
aacagcaggagc

SEQ ID NO: 5090538 - DNA, 13 bp, Homo sapiens
aacagcaggaggc

SEQ ID NO: 5090539 - DNA, 17 bp, Homo sapiens
aacagcaggatgccctg

SEQ ID NO: 5090540 - DNA, 18 bp, Homo sapiens
aacagcaggccatctttt

SEQ ID NO: 5090541 - DNA, 22 bp, Homo sapiens
aacagcagggtacctgaaagag

SEQ ID NO: 5090542 - DNA, 12 bp, Homo sapiens
aacagcagtctc

SEQ ID NO: 5090543 - DNA, 21 bp, Homo sapiens
aacagcagtctccttcagcac

SEQ ID NO: 5090544 - DNA, 18 bp, Homo sapiens
aacagcatgaataaaaca

SEQ ID NO: 5090545 - DNA, 19 bp, Homo sapiens
aacagcatgaataaaacac

SEQ ID NO: 5090546 - DNA, 14 bp, Homo sapiens
aacagcatgacaaa

SEQ ID NO: 5090547 - DNA, 19 bp, Homo sapiens
aacagcatgacaaaaatta

SEQ ID NO: 5090548 - DNA, 22 bp, Homo sapiens
aacagcatgacaaaaattattt

SEQ ID NO: 5090549 - DNA, 22 bp, Homo sapiens
aacagcatgtacggattttcag

SEQ ID NO: 5090550 - DNA, 15 bp, Homo sapiens
aacagcatgtctact

SEQ ID NO: 5090551 - DNA, 18 bp, Homo sapiens
aacagcatgtctactgct

SEQ ID NO: 5090552 - DNA, 15 bp, Homo sapiens
aacagcattgctttc

SEQ ID NO: 5090553 - DNA, 20 bp, Homo sapiens
aacagcattgctttctgaaa

SEQ ID NO: 5090554 - DNA, 22 bp, Homo sapiens
aacagcattggcctggccagac

SEQ ID NO: 5090555 - DNA, 13 bp, Homo sapiens
aacagccaaagaa

SEQ ID NO: 5090556 - DNA, 22 bp, Homo sapiens
aacagccaaataaaacctcagg

SEQ ID NO: 5090557 - DNA, 12 bp, Homo sapiens
aacagccaacag

SEQ ID NO: 5090558 - DNA, 15 bp, Homo sapiens
aacagccaacagcta

SEQ ID NO: 5090559 - DNA, 15 bp, Homo sapiens
aacagccaacaggtg

SEQ ID NO: 5090560 - DNA, 18 bp, Homo sapiens
aacagccactacattact

SEQ ID NO: 5090561 - DNA, 15 bp, Homo sapiens
aacagccactcccct

SEQ ID NO: 5090562 - DNA, 17 bp, Homo sapiens
aacagccatgtccaagt

SEQ ID NO: 5090563 - DNA, 22 bp, Homo sapiens
aacagccattgcggccccagga

SEQ ID NO: 5090564 - DNA, 19 bp, Homo sapiens
aacagccatttatttttta

SEQ ID NO: 5090565 - DNA, 12 bp, Homo sapiens
aacagccatttt

SEQ ID NO: 5090566 - DNA, 20 bp, Homo sapiens
aacagcccaggcatctcctt

SEQ ID NO: 5090567 - DNA, 17 bp, Homo sapiens
aacagcccccactccag

SEQ ID NO: 5090568 - DNA, 20 bp, Homo sapiens
aacagccccggggccccctg

SEQ ID NO: 5090569 - DNA, 23 bp, Homo sapiens
aacagccccggggccccctggtc

SEQ ID NO: 5090570 - DNA, 15 bp, Homo sapiens
aacagccctaaataa

SEQ ID NO: 5090571 - DNA, 19 bp, Homo sapiens
aacagccctatttcttgat

SEQ ID NO: 5090572 - DNA, 11 bp, Homo sapiens
aacagccctgc

SEQ ID NO: 5090573 - DNA, 14 bp, Homo sapiens
aacagcccttcctt

SEQ ID NO: 5090574 - DNA, 15 bp, Homo sapiens
aacagccgctccaga

SEQ ID NO: 5090575 - DNA, 22 bp, Homo sapiens
aacagccgtcagccaaatgtaa

SEQ ID NO: 5090576 - DNA, 18 bp, Homo sapiens
aacagcctcttgcccgtc

SEQ ID NO: 5090577 - DNA, 18 bp, Homo sapiens
aacagcctgacaacattt

SEQ ID NO: 5090578 - DNA, 13 bp, Homo sapiens
aacagcctgagcc

SEQ ID NO: 5090579 - DNA, 14 bp, Homo sapiens
aacagcctgagccg

SEQ ID NO: 5090580 - DNA, 15 bp, Homo sapiens
aacagcctgcctgtc

SEQ ID NO: 5090581 - DNA, 15 bp, Homo sapiens
aacagcctgtgtctt

SEQ ID NO: 5090582 - DNA, 19 bp, Homo sapiens
aacagccttagagctcttg

SEQ ID NO: 5090583 - DNA, 22 bp, Homo sapiens
aacagccttagctgccagtgct

SEQ ID NO: 5090584 - DNA, 23 bp, Homo sapiens
aacagccttagctgccagtgctg

SEQ ID NO: 5090585 - DNA, 16 bp, Homo sapiens
aacagcctttgaatgt

SEQ ID NO: 5090586 - DNA, 20 bp, Homo sapiens
aacagcctttgggaaatgct

SEQ ID NO: 5090587 - DNA, 20 bp, Homo sapiens
aacagcgaagtagcttgctc

SEQ ID NO: 5090588 - DNA, 13 bp, Homo sapiens
aacagcgcccaaa

SEQ ID NO: 5090589 - DNA, 20 bp, Homo sapiens
aacagcgggagacctgtgct

SEQ ID NO: 5090590 - DNA, 14 bp, Homo sapiens
aacagcgtttaaga

SEQ ID NO: 5090591 - DNA, 16 bp, Homo sapiens
aacagctaacaataaa

SEQ ID NO: 5090592 - DNA, 16 bp, Homo sapiens
aacagctaatgggaca

SEQ ID NO: 5090593 - DNA, 15 bp, Homo sapiens
aacagctacaacagc

SEQ ID NO: 5090594 - DNA, 19 bp, Homo sapiens
aacagctacaacagcctca

SEQ ID NO: 5090595 - DNA, 20 bp, Homo sapiens
aacagctacaacagcctcac

SEQ ID NO: 5090596 - DNA, 15 bp, Homo sapiens
aacagctaccatgac

SEQ ID NO: 5090597 - DNA, 20 bp, Homo sapiens
aacagctagcttgaaaactt

SEQ ID NO: 5090598 - DNA, 16 bp, Homo sapiens
aacagctatgagagga

SEQ ID NO: 5090599 - DNA, 16 bp, Homo sapiens
aacagctatttaaggg

SEQ ID NO: 5090600 - DNA, 15 bp, Homo sapiens
aacagctcagccagt

SEQ ID NO: 5090601 - DNA, 18 bp, Homo sapiens
aacagctcagttctagtc

SEQ ID NO: 5090602 - DNA, 23 bp, Homo sapiens
aacagctccctagtggcttcctc

SEQ ID NO: 5090603 - DNA, 11 bp, Homo sapiens
aacagctcctt

SEQ ID NO: 5090604 - DNA, 16 bp, Homo sapiens
aacagctcgatccaaa

SEQ ID NO: 5090605 - DNA, 21 bp, Homo sapiens
aacagctctgcaggcttaata

SEQ ID NO: 5090606 - DNA, 17 bp, Homo sapiens
aacagctgcattagaaa

SEQ ID NO: 5090607 - DNA, 18 bp, Homo sapiens
aacagctgcattagaaaa

SEQ ID NO: 5090608 - DNA, 18 bp, Homo sapiens
aacagctgccttagcttc

SEQ ID NO: 5090609 - DNA, 19 bp, Homo sapiens
aacagctgccttagcttca

SEQ ID NO: 5090610 - DNA, 13 bp, Homo sapiens
aacagctgcttct

SEQ ID NO: 5090611 - DNA, 17 bp, Homo sapiens
aacagctggtactgatg

SEQ ID NO: 5090612 - DNA, 21 bp, Homo sapiens
aacagctggtcctccactttg

SEQ ID NO: 5090613 - DNA, 19 bp, Homo sapiens
aacagctggtgccctgctt

SEQ ID NO: 5090614 - DNA, 12 bp, Homo sapiens
aacagctggtgt

SEQ ID NO: 5090615 - DNA, 13 bp, Homo sapiens
aacagctggtgta

SEQ ID NO: 5090616 - DNA, 13 bp, Homo sapiens
aacagctgtatta

SEQ ID NO: 5090617 - DNA, 23 bp, Homo sapiens
aacagctgtgagccatgcctccc

SEQ ID NO: 5090618 - DNA, 16 bp, Homo sapiens
aacagctgtgtctgcc

SEQ ID NO: 5090619 - DNA, 17 bp, Homo sapiens
aacagctgttcctgtgt

SEQ ID NO: 5090620 - DNA, 15 bp, Homo sapiens
aacagctgttgactc

SEQ ID NO: 5090621 - DNA, 14 bp, Homo sapiens
aacagctgttttta

SEQ ID NO: 5090622 - DNA, 17 bp, Homo sapiens
aacagcttaaagagaaa

SEQ ID NO: 5090623 - DNA, 19 bp, Homo sapiens
aacagcttaaagagaaaaa

SEQ ID NO: 5090624 - DNA, 15 bp, Homo sapiens
aacagcttcaggtta

SEQ ID NO: 5090625 - DNA, 20 bp, Homo sapiens
aacagcttcatgcctttgta

SEQ ID NO: 5090626 - DNA, 21 bp, Homo sapiens
aacagcttcatgcctttgtaa

SEQ ID NO: 5090627 - DNA, 22 bp, Homo sapiens
aacagcttcatgcctttgtaag

SEQ ID NO: 5090628 - DNA, 15 bp, Homo sapiens
aacagcttcatgttc

SEQ ID NO: 5090629 - DNA, 12 bp, Homo sapiens
aacagcttccct

SEQ ID NO: 5090630 - DNA, 18 bp, Homo sapiens
aacagcttgaaaactgga

SEQ ID NO: 5090631 - DNA, 15 bp, Homo sapiens
aacagcttgaccaga

SEQ ID NO: 5090632 - DNA, 17 bp, Homo sapiens
aacagcttgaccagacc

SEQ ID NO: 5090633 - DNA, 18 bp, Homo sapiens
aacagcttgaccagacct

SEQ ID NO: 5090634 - DNA, 15 bp, Homo sapiens
aacagcttgccaggg

SEQ ID NO: 5090635 - DNA, 13 bp, Homo sapiens
aacagcttgctgt

SEQ ID NO: 5090636 - DNA, 12 bp, Homo sapiens
aacagctttctc

SEQ ID NO: 5090637 - DNA, 20 bp, Homo sapiens
aacagctttcttattcagtg

SEQ ID NO: 5090638 - DNA, 21 bp, Homo sapiens
aacagctttcttattcagtga

SEQ ID NO: 5090639 - DNA, 16 bp, Homo sapiens
aacagctttgtctcca

SEQ ID NO: 5090640 - DNA, 17 bp, Homo sapiens
aacagctttgtctccaa

SEQ ID NO: 5090641 - DNA, 16 bp, Homo sapiens
aacaggaaaaaaactt

SEQ ID NO: 5090642 - DNA, 22 bp, Homo sapiens
aacaggaaaaaaacttttataa

SEQ ID NO: 5090643 - DNA, 20 bp, Homo sapiens
aacaggaaactcctgtgacc

SEQ ID NO: 5090644 - DNA, 20 bp, Homo sapiens
aacaggaatcaagagctgcc

SEQ ID NO: 5090645 - DNA, 19 bp, Homo sapiens
aacaggaatctcagagaca

SEQ ID NO: 5090646 - DNA, 21 bp, Homo sapiens
aacaggaatttctgttagcaa

SEQ ID NO: 5090647 - DNA, 21 bp, Homo sapiens
aacaggaattttattttgctg

SEQ ID NO: 5090648 - DNA, 19 bp, Homo sapiens
aacaggacagagttcacag

SEQ ID NO: 5090649 - DNA, 20 bp, Homo sapiens
aacaggaccacaaaaatgaa

SEQ ID NO: 5090650 - DNA, 14 bp, Homo sapiens
aacaggaccaggag

SEQ ID NO: 5090651 - DNA, 20 bp, Homo sapiens
aacaggaccaggagccaggt

SEQ ID NO: 5090652 - DNA, 12 bp, Homo sapiens
aacaggaccggg

SEQ ID NO: 5090653 - DNA, 16 bp, Homo sapiens
aacaggagaaaggaca

SEQ ID NO: 5090654 - DNA, 23 bp, Homo sapiens
aacaggagaatggggttcctgct

SEQ ID NO: 5090655 - DNA, 12 bp, Homo sapiens
aacaggagatcc

SEQ ID NO: 5090656 - DNA, 11 bp, Homo sapiens
aacaggaggaa

SEQ ID NO: 5090657 - DNA, 18 bp, Homo sapiens
aacaggaggaactggtcc

SEQ ID NO: 5090658 - DNA, 20 bp, Homo sapiens
aacaggaggaactggtccag

SEQ ID NO: 5090659 - DNA, 21 bp, Homo sapiens
aacaggaggaactggtccagg

SEQ ID NO: 5090660 - DNA, 20 bp, Homo sapiens
aacaggagtgactctggctg

SEQ ID NO: 5090661 - DNA, 20 bp, Homo sapiens
aacaggagttcagcggagct

SEQ ID NO: 5090662 - DNA, 16 bp, Homo sapiens
aacaggattttcaagt

SEQ ID NO: 5090663 - DNA, 22 bp, Homo sapiens
aacaggcaaacattttctctta

SEQ ID NO: 5090664 - DNA, 16 bp, Homo sapiens
aacaggcaaagtttta

SEQ ID NO: 5090665 - DNA, 20 bp, Homo sapiens
aacaggcaaagttttacaga

SEQ ID NO: 5090666 - DNA, 14 bp, Homo sapiens
aacaggcacaggct

SEQ ID NO: 5090667 - DNA, 17 bp, Homo sapiens
aacaggcactgccctgg

SEQ ID NO: 5090668 - DNA, 18 bp, Homo sapiens
aacaggcactgccctggt

SEQ ID NO: 5090669 - DNA, 21 bp, Homo sapiens
aacaggcacttggcagccttg

SEQ ID NO: 5090670 - DNA, 14 bp, Homo sapiens
aacaggcagaaata

SEQ ID NO: 5090671 - DNA, 17 bp, Homo sapiens
aacaggcagaaatataa

SEQ ID NO: 5090672 - DNA, 19 bp, Homo sapiens
aacaggcattgcactaaaa

SEQ ID NO: 5090673 - DNA, 14 bp, Homo sapiens
aacaggcccagaga

SEQ ID NO: 5090674 - DNA, 20 bp, Homo sapiens
aacaggcccagggagggaag

SEQ ID NO: 5090675 - DNA, 16 bp, Homo sapiens
aacaggccctcctccc

SEQ ID NO: 5090676 - DNA, 16 bp, Homo sapiens
aacaggcctcaagcgt

SEQ ID NO: 5090677 - DNA, 20 bp, Homo sapiens
aacaggcctcagggctcctt

SEQ ID NO: 5090678 - DNA, 17 bp, Homo sapiens
aacaggcgtgggatcag

SEQ ID NO: 5090679 - DNA, 21 bp, Homo sapiens
aacaggcgttctcagcctccg

SEQ ID NO: 5090680 - DNA, 20 bp, Homo sapiens
aacaggctcaatattcctga

SEQ ID NO: 5090681 - DNA, 14 bp, Homo sapiens
aacaggctcagagg

SEQ ID NO: 5090682 - DNA, 22 bp, Homo sapiens
aacaggctgggcttcagtggca

SEQ ID NO: 5090683 - DNA, 14 bp, Homo sapiens
aacaggctgtgtgt

SEQ ID NO: 5090684 - DNA, 22 bp, Homo sapiens
aacaggctgttctgcactgaaa

SEQ ID NO: 5090685 - DNA, 18 bp, Homo sapiens
aacaggcttagtgatgta

SEQ ID NO: 5090686 - DNA, 15 bp, Homo sapiens
aacagggaaggcagg

SEQ ID NO: 5090687 - DNA, 17 bp, Homo sapiens
aacagggacaaagaaat

SEQ ID NO: 5090688 - DNA, 15 bp, Homo sapiens
aacagggaccagctc

SEQ ID NO: 5090689 - DNA, 18 bp, Homo sapiens
aacagggaccagctcccc

SEQ ID NO: 5090690 - DNA, 23 bp, Homo sapiens
aacagggacttgtttagagagcc

SEQ ID NO: 5090691 - DNA, 19 bp, Homo sapiens
aacagggagaagtagctag

SEQ ID NO: 5090692 - DNA, 15 bp, Homo sapiens
aacagggagcacctg

SEQ ID NO: 5090693 - DNA, 19 bp, Homo sapiens
aacagggattgattttaaa

SEQ ID NO: 5090694 - DNA, 12 bp, Homo sapiens
aacagggcagca

SEQ ID NO: 5090695 - DNA, 21 bp, Homo sapiens
aacagggcccaggcctggagc

SEQ ID NO: 5090696 - DNA, 14 bp, Homo sapiens
aacagggcctctgc

SEQ ID NO: 5090697 - DNA, 21 bp, Homo sapiens
aacagggctgccttctggcct

SEQ ID NO: 5090698 - DNA, 15 bp, Homo sapiens
aacaggggaggaaaa

SEQ ID NO: 5090699 - DNA, 17 bp, Homo sapiens
aacaggggaggaaaaaa

SEQ ID NO: 5090700 - DNA, 16 bp, Homo sapiens
aacaggggatcaaagt

SEQ ID NO: 5090701 - DNA, 19 bp, Homo sapiens
aacaggggatcaaagttcc

SEQ ID NO: 5090702 - DNA, 22 bp, Homo sapiens
aacaggggatcaaagttcctgt

SEQ ID NO: 5090703 - DNA, 16 bp, Homo sapiens
aacaggggctggaggg

SEQ ID NO: 5090704 - DNA, 13 bp, Homo sapiens
aacaggggctggt

SEQ ID NO: 5090705 - DNA, 20 bp, Homo sapiens
aacagggtctctagtgctgt

SEQ ID NO: 5090706 - DNA, 15 bp, Homo sapiens
aacaggtaaacacat

SEQ ID NO: 5090707 - DNA, 17 bp, Homo sapiens
aacaggtatatactttg

SEQ ID NO: 5090708 - DNA, 18 bp, Homo sapiens
aacaggtatatactttga

SEQ ID NO: 5090709 - DNA, 21 bp, Homo sapiens
aacaggtattttgtttctttt

SEQ ID NO: 5090710 - DNA, 20 bp, Homo sapiens
aacaggtatttttttaaatc

SEQ ID NO: 5090711 - DNA, 20 bp, Homo sapiens
aacaggtctcctcttaaaaa

SEQ ID NO: 5090712 - DNA, 12 bp, Homo sapiens
aacattgagact

SEQ ID NO: 5090713 - DNA, 17 bp, Homo sapiens
aacattgatctgtttta

SEQ ID NO: 5090714 - DNA, 18 bp, Homo sapiens
aacattgatgaatgagga

SEQ ID NO: 5090715 - DNA, 18 bp, Homo sapiens
aacattgattgctgtgtc

SEQ ID NO: 5090716 - DNA, 12 bp, Homo sapiens
aacattgatttt

SEQ ID NO: 5090717 - DNA, 22 bp, Homo sapiens
aacattgattttaaaaatacat

SEQ ID NO: 5090718 - DNA, 22 bp, Homo sapiens
aacattgcatataacttatatt

SEQ ID NO: 5090719 - DNA, 20 bp, Homo sapiens
aacattgcctatttcagtgg

SEQ ID NO: 5090720 - DNA, 18 bp, Homo sapiens
aacattgcctttgaatgt

SEQ ID NO: 5090721 - DNA, 22 bp, Homo sapiens
aacattgcctttgaatgttaat

SEQ ID NO: 5090722 - DNA, 17 bp, Homo sapiens
aacattgctgcctttgt

SEQ ID NO: 5090723 - DNA, 19 bp, Homo sapiens
aacattgctttagacaaat

SEQ ID NO: 5090724 - DNA, 17 bp, Homo sapiens
aacattgcttttaaaac

SEQ ID NO: 5090725 - DNA, 19 bp, Homo sapiens
aacattgcttttaaaacta

SEQ ID NO: 5090726 - DNA, 16 bp, Homo sapiens
aacattggaatgttct

SEQ ID NO: 5090727 - DNA, 21 bp, Homo sapiens
aacattggaatgttctcagat

SEQ ID NO: 5090728 - DNA, 12 bp, Homo sapiens
aacattggatta

SEQ ID NO: 5090729 - DNA, 21 bp, Homo sapiens
aacattggcacatgccacctg

SEQ ID NO: 5090730 - DNA, 18 bp, Homo sapiens
aacattgggaaatcttat

SEQ ID NO: 5090731 - DNA, 12 bp, Homo sapiens
aacattgtaaag

SEQ ID NO: 5090732 - DNA, 18 bp, Homo sapiens
aacattgtactgttgctt

SEQ ID NO: 5090733 - DNA, 14 bp, Homo sapiens
aacattgtatgtta

SEQ ID NO: 5090734 - DNA, 15 bp, Homo sapiens
aacattgtatgttaa

SEQ ID NO: 5090735 - DNA, 12 bp, Homo sapiens
aacattgtatta

SEQ ID NO: 5090736 - DNA, 20 bp, Homo sapiens
aacattgttaatataattta

SEQ ID NO: 5090737 - DNA, 19 bp, Homo sapiens
aacattgttattcttaagc

SEQ ID NO: 5090738 - DNA, 18 bp, Homo sapiens
aacattgttccagattca

SEQ ID NO: 5090739 - DNA, 19 bp, Homo sapiens
aacattgttgctccctgtg

SEQ ID NO: 5090740 - DNA, 15 bp, Homo sapiens
aacatttaaaattaa

SEQ ID NO: 5090741 - DNA, 18 bp, Homo sapiens
aacatttaaactttttaa

SEQ ID NO: 5090742 - DNA, 22 bp, Homo sapiens
aacatttaaactttttaaaata

SEQ ID NO: 5090743 - DNA, 13 bp, Homo sapiens
aacatttaaagag

SEQ ID NO: 5090744 - DNA, 21 bp, Homo sapiens
aacatttaaagagatttccct

SEQ ID NO: 5090745 - DNA, 13 bp, Homo sapiens
aacatttaacata

SEQ ID NO: 5090746 - DNA, 13 bp, Homo sapiens
aacatttaagcct

SEQ ID NO: 5090747 - DNA, 15 bp, Homo sapiens
aacatttaatttaga

SEQ ID NO: 5090748 - DNA, 17 bp, Homo sapiens
aacatttaatttagata

SEQ ID NO: 5090749 - DNA, 18 bp, Homo sapiens
aacatttaatttagatat

SEQ ID NO: 5090750 - DNA, 16 bp, Homo sapiens
aacatttacatcaaat

SEQ ID NO: 5090751 - DNA, 17 bp, Homo sapiens
aacatttactacagttt

SEQ ID NO: 5090752 - DNA, 15 bp, Homo sapiens
aacatttaggagaag

SEQ ID NO: 5090753 - DNA, 17 bp, Homo sapiens
aacatttagtaccctgc

SEQ ID NO: 5090754 - DNA, 18 bp, Homo sapiens
aacatttagtaccctgca

SEQ ID NO: 5090755 - DNA, 20 bp, Homo sapiens
aacatttatctaaaagaatt

SEQ ID NO: 5090756 - DNA, 14 bp, Homo sapiens
aacatttatctttg

SEQ ID NO: 5090757 - DNA, 22 bp, Homo sapiens
aacatttatgacctaagtcagg

SEQ ID NO: 5090758 - DNA, 22 bp, Homo sapiens
aacatttatgtgaggtaattat

SEQ ID NO: 5090759 - DNA, 23 bp, Homo sapiens
aacatttattttatgagaaatgt

SEQ ID NO: 5090760 - DNA, 17 bp, Homo sapiens
aacatttattttcattg

SEQ ID NO: 5090761 - DNA, 15 bp, Homo sapiens
aacatttattttgac

SEQ ID NO: 5090762 - DNA, 18 bp, Homo sapiens
aacatttcaaattgaatt

SEQ ID NO: 5090763 - DNA, 22 bp, Homo sapiens
aacatttcaagggcaataccgt

SEQ ID NO: 5090764 - DNA, 17 bp, Homo sapiens
aacatttcaagtttact

SEQ ID NO: 5090765 - DNA, 11 bp, Homo sapiens
aacatttcaca

SEQ ID NO: 5090766 - DNA, 17 bp, Homo sapiens
aacatttcagtgttttg

SEQ ID NO: 5090767 - DNA, 22 bp, Homo sapiens
aacatttcagtgttttgctttt

SEQ ID NO: 5090768 - DNA, 17 bp, Homo sapiens
aacatttccgaataaag

SEQ ID NO: 5090769 - DNA, 16 bp, Homo sapiens
aacatttctcaataat

SEQ ID NO: 5090770 - DNA, 23 bp, Homo sapiens
aacatttctcatgttgaagcttt

SEQ ID NO: 5090771 - DNA, 15 bp, Homo sapiens
aacatttctgtaaat

SEQ ID NO: 5090772 - DNA, 19 bp, Homo sapiens
aacatttctgtaaatacca

SEQ ID NO: 5090773 - DNA, 15 bp, Homo sapiens
aacatttctgtatac

SEQ ID NO: 5090774 - DNA, 17 bp, Homo sapiens
aacatttctgtatactg

SEQ ID NO: 5090775 - DNA, 13 bp, Homo sapiens
aacatttctgtga

SEQ ID NO: 5090776 - DNA, 13 bp, Homo sapiens
aacatttctgttc

SEQ ID NO: 5090777 - DNA, 18 bp, Homo sapiens
aacatttcttatgatttt

SEQ ID NO: 5090778 - DNA, 14 bp, Homo sapiens
aacatttgataatt

SEQ ID NO: 5090779 - DNA, 21 bp, Homo sapiens
aacatttgatgtctagataac

SEQ ID NO: 5090780 - DNA, 18 bp, Homo sapiens
aacatttgattaataaaa

SEQ ID NO: 5090781 - DNA, 14 bp, Homo sapiens
aacatttgcaaaat

SEQ ID NO: 5090782 - DNA, 21 bp, Homo sapiens
aacatttgccaaaaattcatg

SEQ ID NO: 5090783 - DNA, 12 bp, Homo sapiens
aacatttgcctt

SEQ ID NO: 5090784 - DNA, 20 bp, Homo sapiens
aacatttgccttgcagaact

SEQ ID NO: 5090785 - DNA, 22 bp, Homo sapiens
aacatttgccttgcagaactgc

SEQ ID NO: 5090786 - DNA, 17 bp, Homo sapiens
aacatttgctgaatatg

SEQ ID NO: 5090787 - DNA, 20 bp, Homo sapiens
aacatttgctgaatatgcaa

SEQ ID NO: 5090788 - DNA, 16 bp, Homo sapiens
aacatttgctgtcagc

SEQ ID NO: 5090789 - DNA, 14 bp, Homo sapiens
aacatttgctgttt

SEQ ID NO: 5090790 - DNA, 23 bp, Homo sapiens
aacatttgggacctggataatta

SEQ ID NO: 5090791 - DNA, 20 bp, Homo sapiens
aacatttgggagactgagct

SEQ ID NO: 5090792 - DNA, 14 bp, Homo sapiens
aacatttggggaga

SEQ ID NO: 5090793 - DNA, 21 bp, Homo sapiens
aacatttgtgtaatatgaaat

SEQ ID NO: 5090794 - DNA, 17 bp, Homo sapiens
aacatttgttcctggag

SEQ ID NO: 5090795 - DNA, 20 bp, Homo sapiens
aacatttgttctatagcttt

SEQ ID NO: 5090796 - DNA, 21 bp, Homo sapiens
aacatttgtttatccttaaga

SEQ ID NO: 5090797 - DNA, 16 bp, Homo sapiens
aacatttgtttccccc

SEQ ID NO: 5090798 - DNA, 23 bp, Homo sapiens
aacatttgtttcccccacagttt

SEQ ID NO: 5090799 - DNA, 22 bp, Homo sapiens
aacattttaaaaacatagaaaa

SEQ ID NO: 5090800 - DNA, 15 bp, Homo sapiens
aacattttaaataaa

SEQ ID NO: 5090801 - DNA, 16 bp, Homo sapiens
aacattttaaatgaaa

SEQ ID NO: 5090802 - DNA, 18 bp, Homo sapiens
aacattttaaatggacag

SEQ ID NO: 5090803 - DNA, 13 bp, Homo sapiens
aacattttaagtt

SEQ ID NO: 5090804 - DNA, 13 bp, Homo sapiens
aacattttacaga

SEQ ID NO: 5090805 - DNA, 15 bp, Homo sapiens
aacattttacccaca

SEQ ID NO: 5090806 - DNA, 12 bp, Homo sapiens
aacattttctgg

SEQ ID NO: 5090807 - DNA, 16 bp, Homo sapiens
aacattttctggccag

SEQ ID NO: 5090808 - DNA, 22 bp, Homo sapiens
aacattttgaaaacccctggct

SEQ ID NO: 5090809 - DNA, 23 bp, Homo sapiens
aacattttgaaagtctgtccttg

SEQ ID NO: 5090810 - DNA, 15 bp, Homo sapiens
aacattttgaaggaa

SEQ ID NO: 5090811 - DNA, 15 bp, Homo sapiens
aacattttgaagtgt

SEQ ID NO: 5090812 - DNA, 22 bp, Homo sapiens
aacattttgacaactgaaagaa

SEQ ID NO: 5090813 - DNA, 18 bp, Homo sapiens
aacattttggaaattgtt

SEQ ID NO: 5090814 - DNA, 18 bp, Homo sapiens
aacattttggtgacagtt

SEQ ID NO: 5090815 - DNA, 13 bp, Homo sapiens
aacattttgtatg

SEQ ID NO: 5090816 - DNA, 22 bp, Homo sapiens
aacattttgtggtcattaagca

SEQ ID NO: 5090817 - DNA, 15 bp, Homo sapiens
aacattttgttctta

SEQ ID NO: 5090818 - DNA, 20 bp, Homo sapiens
aacattttgttcttacacat

SEQ ID NO: 5090819 - DNA, 17 bp, Homo sapiens
aacatttttgagatatt

SEQ ID NO: 5090820 - DNA, 18 bp, Homo sapiens
aacatttttgatttcagg

SEQ ID NO: 5090821 - DNA, 16 bp, Homo sapiens
aacatttttggtgtat

SEQ ID NO: 5090822 - DNA, 18 bp, Homo sapiens
aacatttttgtacattat

SEQ ID NO: 5090823 - DNA, 19 bp, Homo sapiens
aacatttttgtacattatg

SEQ ID NO: 5090824 - DNA, 22 bp, Homo sapiens
aacattttttaagaaaacattt

SEQ ID NO: 5090825 - DNA, 18 bp, Homo sapiens
aacattttttgtttcttg

SEQ ID NO: 5090826 - DNA, 20 bp, Homo sapiens
aacatttttttttctccata

SEQ ID NO: 5090827 - DNA, 19 bp, Homo sapiens
aacattttttttttaaatc

SEQ ID NO: 5090828 - DNA, 12 bp, Homo sapiens
aaccaaaaacat

SEQ ID NO: 5090829 - DNA, 19 bp, Homo sapiens
aaccaaaaagaccagacta

SEQ ID NO: 5090830 - DNA, 17 bp, Homo sapiens
aaccaaaaatagaaatt

SEQ ID NO: 5090831 - DNA, 14 bp, Homo sapiens
aaccaaaacatata

SEQ ID NO: 5090832 - DNA, 13 bp, Homo sapiens
aaccaaaacttcc

SEQ ID NO: 5090833 - DNA, 17 bp, Homo sapiens
aaccaaaacttccaagg

SEQ ID NO: 5090834 - DNA, 14 bp, Homo sapiens
aaccaaaataaaaa

SEQ ID NO: 5090835 - DNA, 16 bp, Homo sapiens
aaccaaaataaaaatt

SEQ ID NO: 5090836 - DNA, 21 bp, Homo sapiens
aaccaaacaacaggcccttgg

SEQ ID NO: 5090837 - DNA, 13 bp, Homo sapiens
aaccaaacaatta

SEQ ID NO: 5090838 - DNA, 23 bp, Homo sapiens
aaccaaacatcccccaatgacct

SEQ ID NO: 5090839 - DNA, 14 bp, Homo sapiens
aaccaaactagtat

SEQ ID NO: 5090840 - DNA, 15 bp, Homo sapiens
aaccaaactctgtgt

SEQ ID NO: 5090841 - DNA, 19 bp, Homo sapiens
aaccaaacttgttcattta

SEQ ID NO: 5090842 - DNA, 21 bp, Homo sapiens
aaccaaagagaatcccacatt

SEQ ID NO: 5090843 - DNA, 14 bp, Homo sapiens
aaccaaagatgctt

SEQ ID NO: 5090844 - DNA, 18 bp, Homo sapiens
aaccaaagcctcttcaaa

SEQ ID NO: 5090845 - DNA, 13 bp, Homo sapiens
aaccaaagctgcc

SEQ ID NO: 5090846 - DNA, 17 bp, Homo sapiens
aaccaaagctggcccag

SEQ ID NO: 5090847 - DNA, 13 bp, Homo sapiens
aaccaaaggacat

SEQ ID NO: 5090848 - DNA, 14 bp, Homo sapiens
aaccaaagggtgct

SEQ ID NO: 5090849 - DNA, 16 bp, Homo sapiens
aaccaaaggtgaagga

SEQ ID NO: 5090850 - DNA, 20 bp, Homo sapiens
aaccaaaggtgaaggaatat

SEQ ID NO: 5090851 - DNA, 21 bp, Homo sapiens
aaccaaaggtgaaggaatata

SEQ ID NO: 5090852 - DNA, 16 bp, Homo sapiens
aaccaaagtctaaact

SEQ ID NO: 5090853 - DNA, 16 bp, Homo sapiens
aaccaaagtctgccgc

SEQ ID NO: 5090854 - DNA, 18 bp, Homo sapiens
aaccaaagttagttcagt

SEQ ID NO: 5090855 - DNA, 21 bp, Homo sapiens
aaccaaagttagttcagtagc

SEQ ID NO: 5090856 - DNA, 13 bp, Homo sapiens
aaccaaatacctc

SEQ ID NO: 5090857 - DNA, 14 bp, Homo sapiens
aaccaaatacctca

SEQ ID NO: 5090858 - DNA, 19 bp, Homo sapiens
aaccaaataggctttagaa

SEQ ID NO: 5090859 - DNA, 17 bp, Homo sapiens
aaccaaatgcatcaatc

SEQ ID NO: 5090860 - DNA, 18 bp, Homo sapiens
aaccaaatgcatcaatcc

SEQ ID NO: 5090861 - DNA, 18 bp, Homo sapiens
aaccaaattgcactgaag

SEQ ID NO: 5090862 - DNA, 16 bp, Homo sapiens
aaccaaattttaaaag

SEQ ID NO: 5090863 - DNA, 20 bp, Homo sapiens
aaccaacaagaaccactcct

SEQ ID NO: 5090864 - DNA, 19 bp, Homo sapiens
aaccaacaaggaaactttc

SEQ ID NO: 5090865 - DNA, 17 bp, Homo sapiens
aaccaacaccatcacag

SEQ ID NO: 5090866 - DNA, 19 bp, Homo sapiens
aaccaacaccatcacagct

SEQ ID NO: 5090867 - DNA, 22 bp, Homo sapiens
aaccaacaccatcacagcttgt

SEQ ID NO: 5090868 - DNA, 14 bp, Homo sapiens
aaccaaccagcagg

SEQ ID NO: 5090869 - DNA, 15 bp, Homo sapiens
aaccaaccatttcta

SEQ ID NO: 5090870 - DNA, 13 bp, Homo sapiens
aaccaacccatgt

SEQ ID NO: 5090871 - DNA, 20 bp, Homo sapiens
aaccaacccttccctgaaaa

SEQ ID NO: 5090872 - DNA, 21 bp, Homo sapiens
aaccaacctttaaaattgtca

SEQ ID NO: 5090873 - DNA, 17 bp, Homo sapiens
aaccaactacaaccaag

SEQ ID NO: 5090874 - DNA, 15 bp, Homo sapiens
aaccaactctaatat

SEQ ID NO: 5090875 - DNA, 23 bp, Homo sapiens
aaccaactgcattggttttccat

SEQ ID NO: 5090876 - DNA, 21 bp, Homo sapiens
aaccaactgttgacatacaaa

SEQ ID NO: 5090877 - DNA, 16 bp, Homo sapiens
aaccaacttttctatt

SEQ ID NO: 5090878 - DNA, 12 bp, Homo sapiens
aaccaagacaag

SEQ ID NO: 5090879 - DNA, 10 bp, Homo sapiens
aaccaagagg

SEQ ID NO: 5090880 - DNA, 15 bp, Homo sapiens
aaccaagaggctggt

SEQ ID NO: 5090881 - DNA, 12 bp, Homo sapiens
aaccaagagtta

SEQ ID NO: 5090882 - DNA, 21 bp, Homo sapiens
aaccaagatctataaagcgat

SEQ ID NO: 5090883 - DNA, 16 bp, Homo sapiens
aaccaagattatgtga

SEQ ID NO: 5090884 - DNA, 18 bp, Homo sapiens
aaccaagcactaccagta

SEQ ID NO: 5090885 - DNA, 18 bp, Homo sapiens
aaccaagccgtggcttcc

SEQ ID NO: 5090886 - DNA, 24 bp, Homo sapiens
aaccaagctataaaagcccatgct

SEQ ID NO: 5090887 - DNA, 14 bp, Homo sapiens
aaccaagcttcaga

SEQ ID NO: 5090888 - DNA, 17 bp, Homo sapiens
aaccaagcttcagagcc

SEQ ID NO: 5090889 - DNA, 21 bp, Homo sapiens
aaccaagcttcagagcctagc

SEQ ID NO: 5090890 - DNA, 21 bp, Homo sapiens
aaccaaggaaatatattttac

SEQ ID NO: 5090891 - DNA, 15 bp, Homo sapiens
aacaggtgctggccc

SEQ ID NO: 5090892 - DNA, 16 bp, Homo sapiens
aacaggtgctggccca

SEQ ID NO: 5090893 - DNA, 22 bp, Homo sapiens
aacaggtgctggcccagcatgg

SEQ ID NO: 5090894 - DNA, 23 bp, Homo sapiens
aacaggtggcaggaccaggacta

SEQ ID NO: 5090895 - DNA, 20 bp, Homo sapiens
aacaggtgtgtatgtaaagt

SEQ ID NO: 5090896 - DNA, 13 bp, Homo sapiens
aacaggtgtgtgt

SEQ ID NO: 5090897 - DNA, 14 bp, Homo sapiens
aacaggtgtgtgtg

SEQ ID NO: 5090898 - DNA, 17 bp, Homo sapiens
aacaggtgtgtgtgaac

SEQ ID NO: 5090899 - DNA, 19 bp, Homo sapiens
aacaggtgttcctcctccc

SEQ ID NO: 5090900 - DNA, 17 bp, Homo sapiens
aacaggttaagtagcag

SEQ ID NO: 5090901 - DNA, 19 bp, Homo sapiens
aacaggttataacagtgtt

SEQ ID NO: 5090902 - DNA, 20 bp, Homo sapiens
aacaggttattttagtttct

SEQ ID NO: 5090903 - DNA, 22 bp, Homo sapiens
aacaggttattttagtttctgt

SEQ ID NO: 5090904 - DNA, 17 bp, Homo sapiens
aacaggtttatctgaag

SEQ ID NO: 5090905 - DNA, 16 bp, Homo sapiens
aacaggttttataatt

SEQ ID NO: 5090906 - DNA, 23 bp, Homo sapiens
aacaggtttttagtttgttcttc

SEQ ID NO: 5090907 - DNA, 15 bp, Homo sapiens
aacagtaaaccactg

SEQ ID NO: 5090908 - DNA, 19 bp, Homo sapiens
aacagtaaagaaagcagaa

SEQ ID NO: 5090909 - DNA, 11 bp, Homo sapiens
aacagtaaata

SEQ ID NO: 5090910 - DNA, 22 bp, Homo sapiens
aacagtaacatagctgtgattt

SEQ ID NO: 5090911 - DNA, 13 bp, Homo sapiens
aacagtaactgcc

SEQ ID NO: 5090912 - DNA, 20 bp, Homo sapiens
aacagtacagtatttacagt

SEQ ID NO: 5090913 - DNA, 14 bp, Homo sapiens
aacagtacattttt

SEQ ID NO: 5090914 - DNA, 22 bp, Homo sapiens
aacagtaccagtgtaaattcag

SEQ ID NO: 5090915 - DNA, 23 bp, Homo sapiens
aacagtaccagtgtaaattcagt

SEQ ID NO: 5090916 - DNA, 22 bp, Homo sapiens
aacagtactggttactttcaaa

SEQ ID NO: 5090917 - DNA, 17 bp, Homo sapiens
aacagtaggattgctgt

SEQ ID NO: 5090918 - DNA, 22 bp, Homo sapiens
aacagtagtgatagttgtaccg

SEQ ID NO: 5090919 - DNA, 15 bp, Homo sapiens
aacagtagtttctca

SEQ ID NO: 5090920 - DNA, 21 bp, Homo sapiens
aacagtattctgtaaagctta

SEQ ID NO: 5090921 - DNA, 11 bp, Homo sapiens
aacagtattta

SEQ ID NO: 5090922 - DNA, 16 bp, Homo sapiens
aacagtatttattttg

SEQ ID NO: 5090923 - DNA, 12 bp, Homo sapiens
aacagtatttcc

SEQ ID NO: 5090924 - DNA, 13 bp, Homo sapiens
aacagtatttcca

SEQ ID NO: 5090925 - DNA, 16 bp, Homo sapiens
aacagtatttgtacaa

SEQ ID NO: 5090926 - DNA, 20 bp, Homo sapiens
aacagtattttaagaagttg

SEQ ID NO: 5090927 - DNA, 17 bp, Homo sapiens
aacagtcaaaacagaga

SEQ ID NO: 5090928 - DNA, 17 bp, Homo sapiens
aacagtcacgcctgaaa

SEQ ID NO: 5090929 - DNA, 14 bp, Homo sapiens
aacagtcatcattt

SEQ ID NO: 5090930 - DNA, 20 bp, Homo sapiens
aacagtcatgaggcagcttt

SEQ ID NO: 5090931 - DNA, 13 bp, Homo sapiens
aacagtcatgttt

SEQ ID NO: 5090932 - DNA, 14 bp, Homo sapiens
aacagtcatgtttt

SEQ ID NO: 5090933 - DNA, 21 bp, Homo sapiens
aacagtcatgttttaaatgta

SEQ ID NO: 5090934 - DNA, 13 bp, Homo sapiens
aacagtcatttaa

SEQ ID NO: 5090935 - DNA, 14 bp, Homo sapiens
aacagtcatttaaa

SEQ ID NO: 5090936 - DNA, 15 bp, Homo sapiens
aacagtccaatcagt

SEQ ID NO: 5090937 - DNA, 16 bp, Homo sapiens
aacagtctaaagaaga

SEQ ID NO: 5090938 - DNA, 13 bp, Homo sapiens
aacagtctcagga

SEQ ID NO: 5090939 - DNA, 14 bp, Homo sapiens
aacagtctcaggaa

SEQ ID NO: 5090940 - DNA, 21 bp, Homo sapiens
aacagtctcattacagattta

SEQ ID NO: 5090941 - DNA, 18 bp, Homo sapiens
aacagtctctggaagaag

SEQ ID NO: 5090942 - DNA, 23 bp, Homo sapiens
aacagtctgatcgtgacgctgaa

SEQ ID NO: 5090943 - DNA, 21 bp, Homo sapiens
aacagtcttactctgtctccc

SEQ ID NO: 5090944 - DNA, 21 bp, Homo sapiens
aacagtcttgctgaattaagc

SEQ ID NO: 5090945 - DNA, 16 bp, Homo sapiens
aacagtgaaagccctg

SEQ ID NO: 5090946 - DNA, 24 bp, Homo sapiens
aacagtgaaagtcaattcagtgat

SEQ ID NO: 5090947 - DNA, 12 bp, Homo sapiens
aacagtgaattt

SEQ ID NO: 5090948 - DNA, 23 bp, Homo sapiens
aacagtgagagactccatagttt

SEQ ID NO: 5090949 - DNA, 21 bp, Homo sapiens
aacagtgagcctgaattttgt

SEQ ID NO: 5090950 - DNA, 15 bp, Homo sapiens
aacagtgaggctggg

SEQ ID NO: 5090951 - DNA, 23 bp, Homo sapiens
aacagtgattaaagcaagagaat

SEQ ID NO: 5090952 - DNA, 20 bp, Homo sapiens
aacagtgatttttttttaga

SEQ ID NO: 5090953 - DNA, 17 bp, Homo sapiens
aacagtgcaacactggt

SEQ ID NO: 5090954 - DNA, 16 bp, Homo sapiens
aacagtgcaagatttt

SEQ ID NO: 5090955 - DNA, 20 bp, Homo sapiens
aacagtgcagggcaaaatat

SEQ ID NO: 5090956 - DNA, 15 bp, Homo sapiens
aacagtgcatattcc

SEQ ID NO: 5090957 - DNA, 20 bp, Homo sapiens
aacagtgccattgtctttat

SEQ ID NO: 5090958 - DNA, 12 bp, Homo sapiens
aacagtgcctgc

SEQ ID NO: 5090959 - DNA, 23 bp, Homo sapiens
aacagtgctaaaaatgggacttc

SEQ ID NO: 5090960 - DNA, 17 bp, Homo sapiens
aacagtgctctgcctct

SEQ ID NO: 5090961 - DNA, 18 bp, Homo sapiens
aacagtgctggtttgtcc

SEQ ID NO: 5090962 - DNA, 15 bp, Homo sapiens
aacagtgctgtttcc

SEQ ID NO: 5090963 - DNA, 21 bp, Homo sapiens
aacagtggccttgcttcttag

SEQ ID NO: 5090964 - DNA, 18 bp, Homo sapiens
aacagtggttgcctgggg

SEQ ID NO: 5090965 - DNA, 22 bp, Homo sapiens
aacagtgtaaatcccagactga

SEQ ID NO: 5090966 - DNA, 13 bp, Homo sapiens
aacagtgtgaagt

SEQ ID NO: 5090967 - DNA, 18 bp, Homo sapiens
aacagtgtgcaaggcagc

SEQ ID NO: 5090968 - DNA, 21 bp, Homo sapiens
aacagtgtggatgtaaatttt

SEQ ID NO: 5090969 - DNA, 12 bp, Homo sapiens
aacagtgtggct

SEQ ID NO: 5090970 - DNA, 21 bp, Homo sapiens
aacagtgtggcttaaacattt

SEQ ID NO: 5090971 - DNA, 23 bp, Homo sapiens
aacagtgttaggcctggcacagt

SEQ ID NO: 5090972 - DNA, 17 bp, Homo sapiens
aacagtgtttactttaa

SEQ ID NO: 5090973 - DNA, 13 bp, Homo sapiens
aacagtgtttcca

SEQ ID NO: 5090974 - DNA, 14 bp, Homo sapiens
aacagtgtttccag

SEQ ID NO: 5090975 - DNA, 23 bp, Homo sapiens
aacagtgtttccagtgacacaac

SEQ ID NO: 5090976 - DNA, 13 bp, Homo sapiens
aacagtgtttccc

SEQ ID NO: 5090977 - DNA, 17 bp, Homo sapiens
aacagttaaacttgcaa

SEQ ID NO: 5090978 - DNA, 17 bp, Homo sapiens
aacagttaactttcaga

SEQ ID NO: 5090979 - DNA, 17 bp, Homo sapiens
aacagttaagacaacag

SEQ ID NO: 5090980 - DNA, 19 bp, Homo sapiens
aacagttaataccattttt

SEQ ID NO: 5090981 - DNA, 21 bp, Homo sapiens
aacagttaattagttaacagt

SEQ ID NO: 5090982 - DNA, 12 bp, Homo sapiens
aacagttataaa

SEQ ID NO: 5090983 - DNA, 19 bp, Homo sapiens
aacagttataaagaaagat

SEQ ID NO: 5090984 - DNA, 22 bp, Homo sapiens
aacagttataaagaaagattgt

SEQ ID NO: 5090985 - DNA, 16 bp, Homo sapiens
aacagttatatttttg

SEQ ID NO: 5090986 - DNA, 13 bp, Homo sapiens
aacagttctgagc

SEQ ID NO: 5090987 - DNA, 16 bp, Homo sapiens
aacagttgaagaaaaa

SEQ ID NO: 5090988 - DNA, 14 bp, Homo sapiens
aacagttgcatgta

SEQ ID NO: 5090989 - DNA, 21 bp, Homo sapiens
aacagttgcatgtagtaacac

SEQ ID NO: 5090990 - DNA, 14 bp, Homo sapiens
aacagttgctgtga

SEQ ID NO: 5090991 - DNA, 17 bp, Homo sapiens
aacagttggtaactttt

SEQ ID NO: 5090992 - DNA, 21 bp, Homo sapiens
aacagttggtaacttttgtga

SEQ ID NO: 5090993 - DNA, 19 bp, Homo sapiens
aacagttgtaccactgcta

SEQ ID NO: 5090994 - DNA, 18 bp, Homo sapiens
aacagttgtgtcataaat

SEQ ID NO: 5090995 - DNA, 20 bp, Homo sapiens
aacagttgtgtcataaatta

SEQ ID NO: 5090996 - DNA, 18 bp, Homo sapiens
aacagttgttacttagca

SEQ ID NO: 5090997 - DNA, 22 bp, Homo sapiens
aacagtttaaaaaaaaagttgg

SEQ ID NO: 5090998 - DNA, 13 bp, Homo sapiens
aacagtttaatga

SEQ ID NO: 5090999 - DNA, 21 bp, Homo sapiens
aacagtttaatgaagatctaa

SEQ ID NO: 5091000 - DNA, 18 bp, Homo sapiens
aacagtttacttggaaat

SEQ ID NO: 5091001 - DNA, 13 bp, Homo sapiens
aacagtttcaaaa

SEQ ID NO: 5091002 - DNA, 18 bp, Homo sapiens
aacagtttcatcaggacc

SEQ ID NO: 5091003 - DNA, 20 bp, Homo sapiens
aacagtttctcaagtttaaa

SEQ ID NO: 5091004 - DNA, 15 bp, Homo sapiens
aacagtttgcctgct

SEQ ID NO: 5091005 - DNA, 16 bp, Homo sapiens
aacagtttggaaaagt

SEQ ID NO: 5091006 - DNA, 19 bp, Homo sapiens
aacagtttggatgtcctca

SEQ ID NO: 5091007 - DNA, 14 bp, Homo sapiens
aacagtttgtacag

SEQ ID NO: 5091008 - DNA, 13 bp, Homo sapiens
aacagttttccat

SEQ ID NO: 5091009 - DNA, 15 bp, Homo sapiens
aacagttttccatga

SEQ ID NO: 5091010 - DNA, 18 bp, Homo sapiens
aacagttttccatgaaaa

SEQ ID NO: 5091011 - DNA, 19 bp, Homo sapiens
aacagttttccatgaaaac

SEQ ID NO: 5091012 - DNA, 20 bp, Homo sapiens
aacagttttggagaaaaatt

SEQ ID NO: 5091013 - DNA, 15 bp, Homo sapiens
aacagtttttatgtt

SEQ ID NO: 5091014 - DNA, 15 bp, Homo sapiens
aacataaaaactgat

SEQ ID NO: 5091015 - DNA, 20 bp, Homo sapiens
aacataaaaaggacatcagc

SEQ ID NO: 5091016 - DNA, 13 bp, Homo sapiens
aacataaaaatga

SEQ ID NO: 5091017 - DNA, 16 bp, Homo sapiens
aacataaaacaaaacc

SEQ ID NO: 5091018 - DNA, 21 bp, Homo sapiens
aacataaaacaaaaccaagcc

SEQ ID NO: 5091019 - DNA, 17 bp, Homo sapiens
aacataaaagagtggaa

SEQ ID NO: 5091020 - DNA, 15 bp, Homo sapiens
aacataaaatataca

SEQ ID NO: 5091021 - DNA, 12 bp, Homo sapiens
aacataaaatta

SEQ ID NO: 5091022 - DNA, 18 bp, Homo sapiens
aacataaacacatttcca

SEQ ID NO: 5091023 - DNA, 15 bp, Homo sapiens
aacataaacagcatg

SEQ ID NO: 5091024 - DNA, 18 bp, Homo sapiens
aacataaagaaacacttt

SEQ ID NO: 5091025 - DNA, 14 bp, Homo sapiens
aacataaagagcaa

SEQ ID NO: 5091026 - DNA, 19 bp, Homo sapiens
aacataaagcaaatagaca

SEQ ID NO: 5091027 - DNA, 12 bp, Homo sapiens
aacataaatctg

SEQ ID NO: 5091028 - DNA, 15 bp, Homo sapiens
aacataaatctgtga

SEQ ID NO: 5091029 - DNA, 14 bp, Homo sapiens
aacataacaaataa

SEQ ID NO: 5091030 - DNA, 18 bp, Homo sapiens
aacataacactaaatgct

SEQ ID NO: 5091031 - DNA, 17 bp, Homo sapiens
aacataacccacttgtc

SEQ ID NO: 5091032 - DNA, 20 bp, Homo sapiens
aacataactgtaacatatat

SEQ ID NO: 5091033 - DNA, 17 bp, Homo sapiens
aacataactttgtaaat

SEQ ID NO: 5091034 - DNA, 14 bp, Homo sapiens
aacataagctagaa

SEQ ID NO: 5091035 - DNA, 16 bp, Homo sapiens
aacataagctagaaaa

SEQ ID NO: 5091036 - DNA, 17 bp, Homo sapiens
aacataagctagaaaaa

SEQ ID NO: 5091037 - DNA, 22 bp, Homo sapiens
aacataagctagaaaaattaga

SEQ ID NO: 5091038 - DNA, 15 bp, Homo sapiens
aacataagctatttt

SEQ ID NO: 5091039 - DNA, 22 bp, Homo sapiens
aacataagctatttttctaact

SEQ ID NO: 5091040 - DNA, 20 bp, Homo sapiens
aacataataaatcacacatt

SEQ ID NO: 5091041 - DNA, 15 bp, Homo sapiens
aacataatgaaaata

SEQ ID NO: 5091042 - DNA, 21 bp, Homo sapiens
aacataatgatactgaattgt

SEQ ID NO: 5091043 - DNA, 18 bp, Homo sapiens
aacataatggttgtgaaa

SEQ ID NO: 5091044 - DNA, 19 bp, Homo sapiens
aacataatggttgtgaaat

SEQ ID NO: 5091045 - DNA, 15 bp, Homo sapiens
aacatacaagaaaat

SEQ ID NO: 5091046 - DNA, 24 bp, Homo sapiens
aacatacaaggacattcactgctg

SEQ ID NO: 5091047 - DNA, 14 bp, Homo sapiens
aacatacagacaca

SEQ ID NO: 5091048 - DNA, 15 bp, Homo sapiens
aacatacagacacat

SEQ ID NO: 5091049 - DNA, 16 bp, Homo sapiens
aacatacaggtgcctt

SEQ ID NO: 5091050 - DNA, 12 bp, Homo sapiens
aacatacatcta

SEQ ID NO: 5091051 - DNA, 19 bp, Homo sapiens
aacatacattttgtaccaa

SEQ ID NO: 5091052 - DNA, 19 bp, Homo sapiens
aacatacccttctttaaat

SEQ ID NO: 5091053 - DNA, 14 bp, Homo sapiens
aacatactcccatc

SEQ ID NO: 5091054 - DNA, 15 bp, Homo sapiens
aacatactcccatct

SEQ ID NO: 5091055 - DNA, 17 bp, Homo sapiens
aacatagaaaaatgatg

SEQ ID NO: 5091056 - DNA, 21 bp, Homo sapiens
aacatagaaaaatgatgtctt

SEQ ID NO: 5091057 - DNA, 13 bp, Homo sapiens
aacatagaaagac

SEQ ID NO: 5091058 - DNA, 15 bp, Homo sapiens
aacatagaaagacat

SEQ ID NO: 5091059 - DNA, 15 bp, Homo sapiens
aacatagacagaaga

SEQ ID NO: 5091060 - DNA, 16 bp, Homo sapiens
aacatagacagaagaa

SEQ ID NO: 5091061 - DNA, 19 bp, Homo sapiens
aacatagacagatgtggac

SEQ ID NO: 5091062 - DNA, 20 bp, Homo sapiens
aacatagactagagaaaccg

SEQ ID NO: 5091063 - DNA, 13 bp, Homo sapiens
aacatagactgaa

SEQ ID NO: 5091064 - DNA, 13 bp, Homo sapiens
aacatagagaact

SEQ ID NO: 5091065 - DNA, 17 bp, Homo sapiens
aacatagatagtgcttt

SEQ ID NO: 5091066 - DNA, 22 bp, Homo sapiens
aacatagatgcctgggcctgat

SEQ ID NO: 5091067 - DNA, 18 bp, Homo sapiens
aacatagcacagtattta

SEQ ID NO: 5091068 - DNA, 18 bp, Homo sapiens
aacataggcaagaggagt

SEQ ID NO: 5091069 - DNA, 18 bp, Homo sapiens
aacataggtgctcttcct

SEQ ID NO: 5091070 - DNA, 15 bp, Homo sapiens
aaccaaggaatttaa

SEQ ID NO: 5091071 - DNA, 16 bp, Homo sapiens
aaccaaggaatttaaa

SEQ ID NO: 5091072 - DNA, 13 bp, Homo sapiens
aaccaaggcagcc

SEQ ID NO: 5091073 - DNA, 22 bp, Homo sapiens
aaccaaggcagcctccagagcc

SEQ ID NO: 5091074 - DNA, 13 bp, Homo sapiens
aaccaaggccctg

SEQ ID NO: 5091075 - DNA, 18 bp, Homo sapiens
aaccaaggccctgtctct

SEQ ID NO: 5091076 - DNA, 18 bp, Homo sapiens
aaccaagggtacagatcc

SEQ ID NO: 5091077 - DNA, 20 bp, Homo sapiens
aaccaaggtagaatgacctt

SEQ ID NO: 5091078 - DNA, 22 bp, Homo sapiens
aaccaaggtagaatgaccttgt

SEQ ID NO: 5091079 - DNA, 17 bp, Homo sapiens
aaccaaggttttgaaat

SEQ ID NO: 5091080 - DNA, 20 bp, Homo sapiens
aaccaaggttttgaaatccc

SEQ ID NO: 5091081 - DNA, 15 bp, Homo sapiens
aaccaagtcaagtga

SEQ ID NO: 5091082 - DNA, 18 bp, Homo sapiens
aaccaagtcaggccaggt

SEQ ID NO: 5091083 - DNA, 15 bp, Homo sapiens
aaccaagtgggctgg

SEQ ID NO: 5091084 - DNA, 20 bp, Homo sapiens
aaccaagtgtctaaaatact

SEQ ID NO: 5091085 - DNA, 23 bp, Homo sapiens
aaccaagttaagtcccattcagt

SEQ ID NO: 5091086 - DNA, 24 bp, Homo sapiens
aaccaagttacacggggttacact

SEQ ID NO: 5091087 - DNA, 19 bp, Homo sapiens
aaccaataatggtcagtcc

SEQ ID NO: 5091088 - DNA, 15 bp, Homo sapiens
aaccaatatttgtag

SEQ ID NO: 5091089 - DNA, 15 bp, Homo sapiens
aaccaatcaagataa

SEQ ID NO: 5091090 - DNA, 19 bp, Homo sapiens
aaccaatcaagataaagga

SEQ ID NO: 5091091 - DNA, 16 bp, Homo sapiens
aaccaatcaataatag

SEQ ID NO: 5091092 - DNA, 15 bp, Homo sapiens
aaccaatcatcttaa

SEQ ID NO: 5091093 - DNA, 23 bp, Homo sapiens
aaccaatcccgtgaaagaattat

SEQ ID NO: 5091094 - DNA, 22 bp, Homo sapiens
aaccaatcctactaataaacca

SEQ ID NO: 5091095 - DNA, 13 bp, Homo sapiens
aaccaatcctgga

SEQ ID NO: 5091096 - DNA, 16 bp, Homo sapiens
aaccaatcgcaaagca

SEQ ID NO: 5091097 - DNA, 17 bp, Homo sapiens
aaccaatcgcaaagcaa

SEQ ID NO: 5091098 - DNA, 16 bp, Homo sapiens
aaccaatctacaatct

SEQ ID NO: 5091099 - DNA, 15 bp, Homo sapiens
aaccaatgaacgaag

SEQ ID NO: 5091100 - DNA, 18 bp, Homo sapiens
aaccaatgaagaagacaa

SEQ ID NO: 5091101 - DNA, 19 bp, Homo sapiens
aaccaatgaagaagacaaa

SEQ ID NO: 5091102 - DNA, 21 bp, Homo sapiens
aaccaatgaagaagacaaagt

SEQ ID NO: 5091103 - DNA, 23 bp, Homo sapiens
aaccaatgattcataacaatgta

SEQ ID NO: 5091104 - DNA, 15 bp, Homo sapiens
aaccaatgctgatga

SEQ ID NO: 5091105 - DNA, 19 bp, Homo sapiens
aaccaatggtgatcctcta

SEQ ID NO: 5091106 - DNA, 22 bp, Homo sapiens
aaccaatgtttaaaaaagttta

SEQ ID NO: 5091107 - DNA, 21 bp, Homo sapiens
aaccaattgaaaagtgttctg

SEQ ID NO: 5091108 - DNA, 12 bp, Homo sapiens
aaccaatttctt

SEQ ID NO: 5091109 - DNA, 16 bp, Homo sapiens
aaccaatttcttcctt

SEQ ID NO: 5091110 - DNA, 19 bp, Homo sapiens
aaccaatttcttccttcca

SEQ ID NO: 5091111 - DNA, 21 bp, Homo sapiens
aaccacaaacggagcccctga

SEQ ID NO: 5091112 - DNA, 15 bp, Homo sapiens
aaccacaaaggccaa

SEQ ID NO: 5091113 - DNA, 21 bp, Homo sapiens
aaccacaaaggccaaactgct

SEQ ID NO: 5091114 - DNA, 20 bp, Homo sapiens
aaccacaactgacacaggaa

SEQ ID NO: 5091115 - DNA, 20 bp, Homo sapiens
aaccacaagagatcagcagt

SEQ ID NO: 5091116 - DNA, 14 bp, Homo sapiens
aaccacaagcatct

SEQ ID NO: 5091117 - DNA, 21 bp, Homo sapiens
aaccacacacacaaggtgctc

SEQ ID NO: 5091118 - DNA, 13 bp, Homo sapiens
aaccacaccacat

SEQ ID NO: 5091119 - DNA, 22 bp, Homo sapiens
aaccacactgaaacctcttcgg

SEQ ID NO: 5091120 - DNA, 17 bp, Homo sapiens
aaccacactgttgagtt

SEQ ID NO: 5091121 - DNA, 17 bp, Homo sapiens
aaccacacttcttgaaa

SEQ ID NO: 5091122 - DNA, 20 bp, Homo sapiens
aaccacagaacagtttgtga

SEQ ID NO: 5091123 - DNA, 13 bp, Homo sapiens
aaccacagatgtg

SEQ ID NO: 5091124 - DNA, 14 bp, Homo sapiens
aaccacagcagaca

SEQ ID NO: 5091125 - DNA, 18 bp, Homo sapiens
aaccacagctgctggaga

SEQ ID NO: 5091126 - DNA, 18 bp, Homo sapiens
aaccacaggcccttgggg

SEQ ID NO: 5091127 - DNA, 21 bp, Homo sapiens
aaccacaggttttagcattgt

SEQ ID NO: 5091128 - DNA, 22 bp, Homo sapiens
aaccacagttattaattaaaga

SEQ ID NO: 5091129 - DNA, 21 bp, Homo sapiens
aaccacataatttttgtacat

SEQ ID NO: 5091130 - DNA, 13 bp, Homo sapiens
aaccacatcttgc

SEQ ID NO: 5091131 - DNA, 22 bp, Homo sapiens
aaccacatcttgctctgctgac

SEQ ID NO: 5091132 - DNA, 14 bp, Homo sapiens
aaccacatggcaca

SEQ ID NO: 5091133 - DNA, 17 bp, Homo sapiens
aaccacatggcacagag

SEQ ID NO: 5091134 - DNA, 13 bp, Homo sapiens
aaccacatgggct

SEQ ID NO: 5091135 - DNA, 19 bp, Homo sapiens
aaccacatgggctgggggc

SEQ ID NO: 5091136 - DNA, 20 bp, Homo sapiens
aaccacatgggctgggggcc

SEQ ID NO: 5091137 - DNA, 14 bp, Homo sapiens
aaccacatgtccca

SEQ ID NO: 5091138 - DNA, 22 bp, Homo sapiens
aaccacattgaagaatgttaga

SEQ ID NO: 5091139 - DNA, 13 bp, Homo sapiens
aaccaccattttt

SEQ ID NO: 5091140 - DNA, 16 bp, Homo sapiens
aaccacccaaaacacg

SEQ ID NO: 5091141 - DNA, 21 bp, Homo sapiens
aaccaccccataccagtcacc

SEQ ID NO: 5091142 - DNA, 22 bp, Homo sapiens
aaccaccccataccagtcacct

SEQ ID NO: 5091143 - DNA, 22 bp, Homo sapiens
aaccaccgcatatgcatgccag

SEQ ID NO: 5091144 - DNA, 15 bp, Homo sapiens
aaccaccgctcccca

SEQ ID NO: 5091145 - DNA, 15 bp, Homo sapiens
aaccacctacccctg

SEQ ID NO: 5091146 - DNA, 17 bp, Homo sapiens
aaccacctaggcaatga

SEQ ID NO: 5091147 - DNA, 16 bp, Homo sapiens
aaccacctatttttga

SEQ ID NO: 5091148 - DNA, 19 bp, Homo sapiens
aaccacctcagaaaggatt

SEQ ID NO: 5091149 - DNA, 16 bp, Homo sapiens
aaccacctcccaaagg

SEQ ID NO: 5091150 - DNA, 17 bp, Homo sapiens
aaccacctcccaaaggc

SEQ ID NO: 5091151 - DNA, 17 bp, Homo sapiens
aaccacctctctgtctt

SEQ ID NO: 5091152 - DNA, 13 bp, Homo sapiens
aaccacctctggc

SEQ ID NO: 5091153 - DNA, 16 bp, Homo sapiens
aaccacgaggctgccc

SEQ ID NO: 5091154 - DNA, 23 bp, Homo sapiens
aaccacgagtaagatattattta

SEQ ID NO: 5091155 - DNA, 15 bp, Homo sapiens
aaccacgcctcttga

SEQ ID NO: 5091156 - DNA, 22 bp, Homo sapiens
aaccacggtgaaagtgctgctc

SEQ ID NO: 5091157 - DNA, 18 bp, Homo sapiens
aaccacgtctgtcttcac

SEQ ID NO: 5091158 - DNA, 21 bp, Homo sapiens
aaccacgtctgtcttcacagc

SEQ ID NO: 5091159 - DNA, 22 bp, Homo sapiens
aaccactaatgcttgccaagaa

SEQ ID NO: 5091160 - DNA, 18 bp, Homo sapiens
aaccactaatgttagaat

SEQ ID NO: 5091161 - DNA, 19 bp, Homo sapiens
aaccactcaaattaatctt

SEQ ID NO: 5091162 - DNA, 19 bp, Homo sapiens
aaccactcagtaaaagcaa

SEQ ID NO: 5091163 - DNA, 18 bp, Homo sapiens
aaccactcccagtcccca

SEQ ID NO: 5091164 - DNA, 22 bp, Homo sapiens
aaccactctatcaagtattata

SEQ ID NO: 5091165 - DNA, 21 bp, Homo sapiens
aaccactctgtggccagcctg

SEQ ID NO: 5091166 - DNA, 13 bp, Homo sapiens
aaccactgaaaaa

SEQ ID NO: 5091167 - DNA, 15 bp, Homo sapiens
aaccactgaaaaaat

SEQ ID NO: 5091168 - DNA, 14 bp, Homo sapiens
aaccactgaacatt

SEQ ID NO: 5091169 - DNA, 14 bp, Homo sapiens
aaccactgcaacgg

SEQ ID NO: 5091170 - DNA, 16 bp, Homo sapiens
aaccactgcaagtcct

SEQ ID NO: 5091171 - DNA, 20 bp, Homo sapiens
aaccactgtaaaatgaaatt

SEQ ID NO: 5091172 - DNA, 13 bp, Homo sapiens
aaccactgtacat

SEQ ID NO: 5091173 - DNA, 15 bp, Homo sapiens
aaccacttcagctga

SEQ ID NO: 5091174 - DNA, 13 bp, Homo sapiens
aaccacttccctc

SEQ ID NO: 5091175 - DNA, 21 bp, Homo sapiens
aaccacttccctcatctctcc

SEQ ID NO: 5091176 - DNA, 13 bp, Homo sapiens
aaccacttctcca

SEQ ID NO: 5091177 - DNA, 20 bp, Homo sapiens
aaccacttctccatgctgca

SEQ ID NO: 5091178 - DNA, 17 bp, Homo sapiens
aaccacttgcctggggc

SEQ ID NO: 5091179 - DNA, 17 bp, Homo sapiens
aaccacttggctgctca

SEQ ID NO: 5091180 - DNA, 19 bp, Homo sapiens
aaccactttcacctgggat

SEQ ID NO: 5091181 - DNA, 13 bp, Homo sapiens
aaccagaaaaaat

SEQ ID NO: 5091182 - DNA, 22 bp, Homo sapiens
aaccagaaaagcaatactgttt

SEQ ID NO: 5091183 - DNA, 23 bp, Homo sapiens
aaccagaaaggtgattccaggag

SEQ ID NO: 5091184 - DNA, 16 bp, Homo sapiens
aaccagaacagtatga

SEQ ID NO: 5091185 - DNA, 15 bp, Homo sapiens
aaccagaaggaagcc

SEQ ID NO: 5091186 - DNA, 16 bp, Homo sapiens
aaccagaaggaagccc

SEQ ID NO: 5091187 - DNA, 22 bp, Homo sapiens
aaccagaaggaagccctctcag

SEQ ID NO: 5091188 - DNA, 18 bp, Homo sapiens
aaccagaataaagttctg

SEQ ID NO: 5091189 - DNA, 16 bp, Homo sapiens
aaccagaattgtcctc

SEQ ID NO: 5091190 - DNA, 15 bp, Homo sapiens
aaccagagagaaaga

SEQ ID NO: 5091191 - DNA, 14 bp, Homo sapiens
aaccagagcactgt

SEQ ID NO: 5091192 - DNA, 13 bp, Homo sapiens
aaccagagccccc

SEQ ID NO: 5091193 - DNA, 17 bp, Homo sapiens
aaccagagccccccaca

SEQ ID NO: 5091194 - DNA, 13 bp, Homo sapiens
aaccagagcctat

SEQ ID NO: 5091195 - DNA, 20 bp, Homo sapiens
aaccagagctggaacacaat

SEQ ID NO: 5091196 - DNA, 14 bp, Homo sapiens
aaccagagggcagt

SEQ ID NO: 5091197 - DNA, 23 bp, Homo sapiens
aaccagagggcatgctgaatgcc

SEQ ID NO: 5091198 - DNA, 17 bp, Homo sapiens
aaccagagtctgtattt

SEQ ID NO: 5091199 - DNA, 13 bp, Homo sapiens
aaccagataacat

SEQ ID NO: 5091200 - DNA, 13 bp, Homo sapiens
aaccagattccag

SEQ ID NO: 5091201 - DNA, 21 bp, Homo sapiens
aaccagatttgaggctggttt

SEQ ID NO: 5091202 - DNA, 13 bp, Homo sapiens
aaccagcagaaaa

SEQ ID NO: 5091203 - DNA, 20 bp, Homo sapiens
aaccagcagaaatgccccca

SEQ ID NO: 5091204 - DNA, 21 bp, Homo sapiens
aaccagcatcccttgaccagg

SEQ ID NO: 5091205 - DNA, 18 bp, Homo sapiens
aaccagcatctcagcgcc

SEQ ID NO: 5091206 - DNA, 14 bp, Homo sapiens
aaccagcattccct

SEQ ID NO: 5091207 - DNA, 15 bp, Homo sapiens
aaccagcattcccta

SEQ ID NO: 5091208 - DNA, 14 bp, Homo sapiens
aaccagcattttac

SEQ ID NO: 5091209 - DNA, 17 bp, Homo sapiens
aaccagcattttactac

SEQ ID NO: 5091210 - DNA, 13 bp, Homo sapiens
aaccagccacaca

SEQ ID NO: 5091211 - DNA, 15 bp, Homo sapiens
aaccagccaggcaga

SEQ ID NO: 5091212 - DNA, 16 bp, Homo sapiens
aaccagcccagcctgc

SEQ ID NO: 5091213 - DNA, 15 bp, Homo sapiens
aaccagccccatcag

SEQ ID NO: 5091214 - DNA, 13 bp, Homo sapiens
aaccagcctcagc

SEQ ID NO: 5091215 - DNA, 18 bp, Homo sapiens
aaccagcctcatgctctg

SEQ ID NO: 5091216 - DNA, 21 bp, Homo sapiens
aaccagcctcatgctctgatt

SEQ ID NO: 5091217 - DNA, 22 bp, Homo sapiens
aaccagcctggggccttcctgg

SEQ ID NO: 5091218 - DNA, 20 bp, Homo sapiens
aaccagctcgtgggctggga

SEQ ID NO: 5091219 - DNA, 20 bp, Homo sapiens
aaccagctggtctgggtgta

SEQ ID NO: 5091220 - DNA, 22 bp, Homo sapiens
aaccagctgtaacacagctgag

SEQ ID NO: 5091221 - DNA, 16 bp, Homo sapiens
aaccagcttccttcag

SEQ ID NO: 5091222 - DNA, 17 bp, Homo sapiens
aaccagcttccttcaga

SEQ ID NO: 5091223 - DNA, 20 bp, Homo sapiens
aaccagcttccttcagagag

SEQ ID NO: 5091224 - DNA, 23 bp, Homo sapiens
aaccagcttgcgaataacagtcc

SEQ ID NO: 5091225 - DNA, 20 bp, Homo sapiens
aaccagcttgttctgggctc

SEQ ID NO: 5091226 - DNA, 21 bp, Homo sapiens
aaccagcttgttctgggctca

SEQ ID NO: 5091227 - DNA, 12 bp, Homo sapiens
aaccaggaccca

SEQ ID NO: 5091228 - DNA, 14 bp, Homo sapiens
aaccaggacccagg

SEQ ID NO: 5091229 - DNA, 17 bp, Homo sapiens
aaccaggacccagggtc

SEQ ID NO: 5091230 - DNA, 11 bp, Homo sapiens
aaccaggagca

SEQ ID NO: 5091231 - DNA, 22 bp, Homo sapiens
aaccaggagcattttgtgtctt

SEQ ID NO: 5091232 - DNA, 17 bp, Homo sapiens
aaccaggaggcctggga

SEQ ID NO: 5091233 - DNA, 16 bp, Homo sapiens
aaccaggcacctcttc

SEQ ID NO: 5091234 - DNA, 21 bp, Homo sapiens
aaccaggccagagcaaacaga

SEQ ID NO: 5091235 - DNA, 22 bp, Homo sapiens
aaccaggccagagcaaacagaa

SEQ ID NO: 5091236 - DNA, 15 bp, Homo sapiens
aaccaggcccagcca

SEQ ID NO: 5091237 - DNA, 17 bp, Homo sapiens
aaccaggccccagcctc

SEQ ID NO: 5091238 - DNA, 16 bp, Homo sapiens
aaccaggcctctgctg

SEQ ID NO: 5091239 - DNA, 17 bp, Homo sapiens
aaccaggcctctgctgc

SEQ ID NO: 5091240 - DNA, 15 bp, Homo sapiens
aaccaggccttctga

SEQ ID NO: 5091241 - DNA, 19 bp, Homo sapiens
aaccaggctacagttgata

SEQ ID NO: 5091242 - DNA, 17 bp, Homo sapiens
aaccaggcttgcctggg

SEQ ID NO: 5091243 - DNA, 14 bp, Homo sapiens
aaccaggctttcta

SEQ ID NO: 5091244 - DNA, 17 bp, Homo sapiens
aaccaggctttctagaa

SEQ ID NO: 5091245 - DNA, 12 bp, Homo sapiens
aaccagggcctc

SEQ ID NO: 5091246 - DNA, 21 bp, Homo sapiens
aaccagggcctccctgttcac

SEQ ID NO: 5091247 - DNA, 17 bp, Homo sapiens
aaccaggggacactttg

SEQ ID NO: 5091248 - DNA, 15 bp, Homo sapiens
aacataggtttttaa

SEQ ID NO: 5091249 - DNA, 22 bp, Homo sapiens
aacatagtaattcttaagtctt

SEQ ID NO: 5091250 - DNA, 17 bp, Homo sapiens
aacatagtgagacactg

SEQ ID NO: 5091251 - DNA, 18 bp, Homo sapiens
aacatagtggtattttaa

SEQ ID NO: 5091252 - DNA, 24 bp, Homo sapiens
aacatagttgaaaaaagaagtttg

SEQ ID NO: 5091253 - DNA, 13 bp, Homo sapiens
aacatataaatta

SEQ ID NO: 5091254 - DNA, 19 bp, Homo sapiens
aacatataaattaatacat

SEQ ID NO: 5091255 - DNA, 22 bp, Homo sapiens
aacatataaattaatacataag

SEQ ID NO: 5091256 - DNA, 14 bp, Homo sapiens
aacatataactatt

SEQ ID NO: 5091257 - DNA, 14 bp, Homo sapiens
aacatataatatat

SEQ ID NO: 5091258 - DNA, 17 bp, Homo sapiens
aacatataatatatgtt

SEQ ID NO: 5091259 - DNA, 21 bp, Homo sapiens
aacatataatgttgttattta

SEQ ID NO: 5091260 - DNA, 15 bp, Homo sapiens
aacatatactattta

SEQ ID NO: 5091261 - DNA, 16 bp, Homo sapiens
aacatatataacaatg

SEQ ID NO: 5091262 - DNA, 15 bp, Homo sapiens
aacatatatatacta

SEQ ID NO: 5091263 - DNA, 19 bp, Homo sapiens
aacatatatttattgagta

SEQ ID NO: 5091264 - DNA, 19 bp, Homo sapiens
aacatatattttattttca

SEQ ID NO: 5091265 - DNA, 13 bp, Homo sapiens
aacatatcaattc

SEQ ID NO: 5091266 - DNA, 17 bp, Homo sapiens
aacatatcaattcaaca

SEQ ID NO: 5091267 - DNA, 22 bp, Homo sapiens
aacatatcaattcaacacatta

SEQ ID NO: 5091268 - DNA, 15 bp, Homo sapiens
aacatatcatggtaa

SEQ ID NO: 5091269 - DNA, 16 bp, Homo sapiens
aacatatcatggtaat

SEQ ID NO: 5091270 - DNA, 20 bp, Homo sapiens
aacatatcatggtaatgaca

SEQ ID NO: 5091271 - DNA, 17 bp, Homo sapiens
aacatatcattcagaat

SEQ ID NO: 5091272 - DNA, 14 bp, Homo sapiens
aacatatccaagtt

SEQ ID NO: 5091273 - DNA, 20 bp, Homo sapiens
aacatatccaagtttgaatt

SEQ ID NO: 5091274 - DNA, 12 bp, Homo sapiens
aacatatctaaa

SEQ ID NO: 5091275 - DNA, 13 bp, Homo sapiens
aacatatgatact

SEQ ID NO: 5091276 - DNA, 21 bp, Homo sapiens
aacatatgatttcactagaaa

SEQ ID NO: 5091277 - DNA, 17 bp, Homo sapiens
aacatatgcaaacataa

SEQ ID NO: 5091278 - DNA, 21 bp, Homo sapiens
aacatatgtacataaattgca

SEQ ID NO: 5091279 - DNA, 20 bp, Homo sapiens
aacatatgtctgtctttgca

SEQ ID NO: 5091280 - DNA, 19 bp, Homo sapiens
aacatattctgtatgaact

SEQ ID NO: 5091281 - DNA, 17 bp, Homo sapiens
aacatatttaagaaata

SEQ ID NO: 5091282 - DNA, 16 bp, Homo sapiens
aacatatttcatttta

SEQ ID NO: 5091283 - DNA, 22 bp, Homo sapiens
aacatatttcttgagtaattta

SEQ ID NO: 5091284 - DNA, 13 bp, Homo sapiens
aacatatttgata

SEQ ID NO: 5091285 - DNA, 13 bp, Homo sapiens
aacatatttgtta

SEQ ID NO: 5091286 - DNA, 22 bp, Homo sapiens
aacatatttgttaaatatttac

SEQ ID NO: 5091287 - DNA, 13 bp, Homo sapiens
aacatattttaca

SEQ ID NO: 5091288 - DNA, 14 bp, Homo sapiens
aacatattttacat

SEQ ID NO: 5091289 - DNA, 21 bp, Homo sapiens
aacatatttttatactttatt

SEQ ID NO: 5091290 - DNA, 13 bp, Homo sapiens
aacatcaaacacg

SEQ ID NO: 5091291 - DNA, 13 bp, Homo sapiens
aacatcaaataaa

SEQ ID NO: 5091292 - DNA, 16 bp, Homo sapiens
aacatcaaataaattt

SEQ ID NO: 5091293 - DNA, 13 bp, Homo sapiens
aacatcaatgttc

SEQ ID NO: 5091294 - DNA, 13 bp, Homo sapiens
aacatcacacaca

SEQ ID NO: 5091295 - DNA, 13 bp, Homo sapiens
aacatcacagccc

SEQ ID NO: 5091296 - DNA, 20 bp, Homo sapiens
aacatcaccagtgccacgtc

SEQ ID NO: 5091297 - DNA, 21 bp, Homo sapiens
aacatcaccagtgccacgtca

SEQ ID NO: 5091298 - DNA, 21 bp, Homo sapiens
aacatcaccctatatataatt

SEQ ID NO: 5091299 - DNA, 19 bp, Homo sapiens
aacatcacctatttaatgt

SEQ ID NO: 5091300 - DNA, 17 bp, Homo sapiens
aacatcactatcaattt

SEQ ID NO: 5091301 - DNA, 21 bp, Homo sapiens
aacatcactatcaattttaag

SEQ ID NO: 5091302 - DNA, 14 bp, Homo sapiens
aacatcagcttgac

SEQ ID NO: 5091303 - DNA, 20 bp, Homo sapiens
aacatcagctttctaatgtt

SEQ ID NO: 5091304 - DNA, 22 bp, Homo sapiens
aacatcagggtgtggcattttg

SEQ ID NO: 5091305 - DNA, 20 bp, Homo sapiens
aacatcagtcaattgcttga

SEQ ID NO: 5091306 - DNA, 18 bp, Homo sapiens
aacatcagttactctgaa

SEQ ID NO: 5091307 - DNA, 19 bp, Homo sapiens
aacatcagttactctgaag

SEQ ID NO: 5091308 - DNA, 14 bp, Homo sapiens
aacatcataattac

SEQ ID NO: 5091309 - DNA, 15 bp, Homo sapiens
aacatcataattaca

SEQ ID NO: 5091310 - DNA, 20 bp, Homo sapiens
aacatcataattacattcct

SEQ ID NO: 5091311 - DNA, 19 bp, Homo sapiens
aacatcatcaggcttggaa

SEQ ID NO: 5091312 - DNA, 15 bp, Homo sapiens
aacatcattagaaca

SEQ ID NO: 5091313 - DNA, 14 bp, Homo sapiens
aacatcattccaaa

SEQ ID NO: 5091314 - DNA, 14 bp, Homo sapiens
aacatcattccttt

SEQ ID NO: 5091315 - DNA, 21 bp, Homo sapiens
aacatcattcctttttattta

SEQ ID NO: 5091316 - DNA, 22 bp, Homo sapiens
aacatcattcctttttatttat

SEQ ID NO: 5091317 - DNA, 22 bp, Homo sapiens
aacatcattctacataatggaa

SEQ ID NO: 5091318 - DNA, 18 bp, Homo sapiens
aacatcattttgttttcc

SEQ ID NO: 5091319 - DNA, 16 bp, Homo sapiens
aacatccaaccttccc

SEQ ID NO: 5091320 - DNA, 17 bp, Homo sapiens
aacatccaaccttccca

SEQ ID NO: 5091321 - DNA, 13 bp, Homo sapiens
aacatccaagcca

SEQ ID NO: 5091322 - DNA, 17 bp, Homo sapiens
aacatccaagccagagt

SEQ ID NO: 5091323 - DNA, 22 bp, Homo sapiens
aacatccaaggagaaacagaga

SEQ ID NO: 5091324 - DNA, 17 bp, Homo sapiens
aacatccaagtggcctc

SEQ ID NO: 5091325 - DNA, 12 bp, Homo sapiens
aacatccactgt

SEQ ID NO: 5091326 - DNA, 17 bp, Homo sapiens
aacatccatataggatt

SEQ ID NO: 5091327 - DNA, 18 bp, Homo sapiens
aacatcccaaactttaaa

SEQ ID NO: 5091328 - DNA, 15 bp, Homo sapiens
aacatcccaagattt

SEQ ID NO: 5091329 - DNA, 22 bp, Homo sapiens
aacatcccacttagccgcaccc

SEQ ID NO: 5091330 - DNA, 15 bp, Homo sapiens
aacatccctcctggg

SEQ ID NO: 5091331 - DNA, 16 bp, Homo sapiens
aacatccctgggcaag

SEQ ID NO: 5091332 - DNA, 17 bp, Homo sapiens
aacatccctttttcaat

SEQ ID NO: 5091333 - DNA, 21 bp, Homo sapiens
aacatccggaacagccaaaga

SEQ ID NO: 5091334 - DNA, 22 bp, Homo sapiens
aacatcctaagtgggaagtgaa

SEQ ID NO: 5091335 - DNA, 22 bp, Homo sapiens
aacatcctacaagacacagtga

SEQ ID NO: 5091336 - DNA, 14 bp, Homo sapiens
aacatcctgacttc

SEQ ID NO: 5091337 - DNA, 14 bp, Homo sapiens
aacatcctgctgca

SEQ ID NO: 5091338 - DNA, 22 bp, Homo sapiens
aacatcctttctattgaaaaat

SEQ ID NO: 5091339 - DNA, 19 bp, Homo sapiens
aacatcctttgcagggcag

SEQ ID NO: 5091340 - DNA, 22 bp, Homo sapiens
aacatcctttgcagggcagccc

SEQ ID NO: 5091341 - DNA, 16 bp, Homo sapiens
aacatcgatatgtata

SEQ ID NO: 5091342 - DNA, 18 bp, Homo sapiens
aacatcgatatgtatatc

SEQ ID NO: 5091343 - DNA, 18 bp, Homo sapiens
aacatcgcaatagttttt

SEQ ID NO: 5091344 - DNA, 21 bp, Homo sapiens
aacatcgtgggtcactacagg

SEQ ID NO: 5091345 - DNA, 16 bp, Homo sapiens
aacatctagaaattgc

SEQ ID NO: 5091346 - DNA, 17 bp, Homo sapiens
aacatctagcaaatgtt

SEQ ID NO: 5091347 - DNA, 20 bp, Homo sapiens
aacatctattataaaaccat

SEQ ID NO: 5091348 - DNA, 14 bp, Homo sapiens
aacatctattctct

SEQ ID NO: 5091349 - DNA, 15 bp, Homo sapiens
aacatctcactttgc

SEQ ID NO: 5091350 - DNA, 13 bp, Homo sapiens
aacatctctgaat

SEQ ID NO: 5091351 - DNA, 15 bp, Homo sapiens
aacatctctgcagtt

SEQ ID NO: 5091352 - DNA, 21 bp, Homo sapiens
aacatctctggcccagaaagc

SEQ ID NO: 5091353 - DNA, 16 bp, Homo sapiens
aacatctctgttgaag

SEQ ID NO: 5091354 - DNA, 18 bp, Homo sapiens
aacatctctttcatctag

SEQ ID NO: 5091355 - DNA, 22 bp, Homo sapiens
aacatctgcagtgttctgtgaa

SEQ ID NO: 5091356 - DNA, 23 bp, Homo sapiens
aacatctgcagtgttctgtgaat

SEQ ID NO: 5091357 - DNA, 18 bp, Homo sapiens
aacatctgccatttattt

SEQ ID NO: 5091358 - DNA, 23 bp, Homo sapiens
aacatctgccatttatttcctca

SEQ ID NO: 5091359 - DNA, 14 bp, Homo sapiens
aacatctgtgtctg

SEQ ID NO: 5091360 - DNA, 21 bp, Homo sapiens
aacatcttaggcactttttaa

SEQ ID NO: 5091361 - DNA, 15 bp, Homo sapiens
aacatcttcaacatg

SEQ ID NO: 5091362 - DNA, 13 bp, Homo sapiens
aacatcttcatat

SEQ ID NO: 5091363 - DNA, 17 bp, Homo sapiens
aacatcttcatataaac

SEQ ID NO: 5091364 - DNA, 18 bp, Homo sapiens
aacatcttcatataaact

SEQ ID NO: 5091365 - DNA, 11 bp, Homo sapiens
aacatctttac

SEQ ID NO: 5091366 - DNA, 20 bp, Homo sapiens
aacatctttacgtactgtaa

SEQ ID NO: 5091367 - DNA, 23 bp, Homo sapiens
aacatctttacgtactgtaactg

SEQ ID NO: 5091368 - DNA, 19 bp, Homo sapiens
aacatctttgaaaagaaaa

SEQ ID NO: 5091369 - DNA, 22 bp, Homo sapiens
aacatctttgaaattatgtaaa

SEQ ID NO: 5091370 - DNA, 20 bp, Homo sapiens
aacatctttgcgaaaagata

SEQ ID NO: 5091371 - DNA, 17 bp, Homo sapiens
aacatctttgtttttaa

SEQ ID NO: 5091372 - DNA, 15 bp, Homo sapiens
aacatcttttcttgc

SEQ ID NO: 5091373 - DNA, 18 bp, Homo sapiens
aacatctttttcctccct

SEQ ID NO: 5091374 - DNA, 14 bp, Homo sapiens
aacatgaaaaacaa

SEQ ID NO: 5091375 - DNA, 12 bp, Homo sapiens
aacatgaaaaca

SEQ ID NO: 5091376 - DNA, 20 bp, Homo sapiens
aacatgaaaacattgatgaa

SEQ ID NO: 5091377 - DNA, 21 bp, Homo sapiens
aacatgaaaatttttgagtta

SEQ ID NO: 5091378 - DNA, 20 bp, Homo sapiens
aacatgaaagtctagaaata

SEQ ID NO: 5091379 - DNA, 20 bp, Homo sapiens
aacatgaacacccttagaaa

SEQ ID NO: 5091380 - DNA, 14 bp, Homo sapiens
aacatgaacccaaa

SEQ ID NO: 5091381 - DNA, 18 bp, Homo sapiens
aacatgaacccaaaaaga

SEQ ID NO: 5091382 - DNA, 14 bp, Homo sapiens
aacatgaagacctt

SEQ ID NO: 5091383 - DNA, 22 bp, Homo sapiens
aacatgaagcataatttgttta

SEQ ID NO: 5091384 - DNA, 21 bp, Homo sapiens
aacatgaagtcgttgtgaggg

SEQ ID NO: 5091385 - DNA, 22 bp, Homo sapiens
aacatgaatatggttggagagc

SEQ ID NO: 5091386 - DNA, 22 bp, Homo sapiens
aacatgaattaagaactgacac

SEQ ID NO: 5091387 - DNA, 13 bp, Homo sapiens
aacatgaccaaaa

SEQ ID NO: 5091388 - DNA, 19 bp, Homo sapiens
aacatgaccaaaaaccaaa

SEQ ID NO: 5091389 - DNA, 17 bp, Homo sapiens
aacatgacccagcctga

SEQ ID NO: 5091390 - DNA, 19 bp, Homo sapiens
aacatgacccgtacacacc

SEQ ID NO: 5091391 - DNA, 20 bp, Homo sapiens
aacatgactctttattgtct

SEQ ID NO: 5091392 - DNA, 14 bp, Homo sapiens
aacatgacttcctt

SEQ ID NO: 5091393 - DNA, 15 bp, Homo sapiens
aacatgagaaatgtg

SEQ ID NO: 5091394 - DNA, 21 bp, Homo sapiens
aacatgagcgctactcttgga

SEQ ID NO: 5091395 - DNA, 17 bp, Homo sapiens
aacatgaggttctctct

SEQ ID NO: 5091396 - DNA, 23 bp, Homo sapiens
aacatgagtagataatttcaggg

SEQ ID NO: 5091397 - DNA, 21 bp, Homo sapiens
aacatgagtgaatagctttca

SEQ ID NO: 5091398 - DNA, 17 bp, Homo sapiens
aacatgagtttatggga

SEQ ID NO: 5091399 - DNA, 19 bp, Homo sapiens
aacatgatactgctgcttg

SEQ ID NO: 5091400 - DNA, 18 bp, Homo sapiens
aacatgatagttaaacta

SEQ ID NO: 5091401 - DNA, 23 bp, Homo sapiens
aacatgatccccgtctctgccct

SEQ ID NO: 5091402 - DNA, 14 bp, Homo sapiens
aacatgatgaaacc

SEQ ID NO: 5091403 - DNA, 13 bp, Homo sapiens
aacatgatgtact

SEQ ID NO: 5091404 - DNA, 15 bp, Homo sapiens
aacatgatgtactaa

SEQ ID NO: 5091405 - DNA, 14 bp, Homo sapiens
aacatgatttcaaa

SEQ ID NO: 5091406 - DNA, 14 bp, Homo sapiens
aacatgcaaacagg

SEQ ID NO: 5091407 - DNA, 14 bp, Homo sapiens
aacatgcaacaaaa

SEQ ID NO: 5091408 - DNA, 22 bp, Homo sapiens
aacatgcaagaatttctggaag

SEQ ID NO: 5091409 - DNA, 19 bp, Homo sapiens
aacatgcacatttatatat

SEQ ID NO: 5091410 - DNA, 20 bp, Homo sapiens
aacatgcacattttgtacat

SEQ ID NO: 5091411 - DNA, 12 bp, Homo sapiens
aacatgcagaac

SEQ ID NO: 5091412 - DNA, 16 bp, Homo sapiens
aacatgcagtactttt

SEQ ID NO: 5091413 - DNA, 14 bp, Homo sapiens
aacatgcagtattt

SEQ ID NO: 5091414 - DNA, 18 bp, Homo sapiens
aacatgcagttcattatt

SEQ ID NO: 5091415 - DNA, 22 bp, Homo sapiens
aacatgcagttcattattttgt

SEQ ID NO: 5091416 - DNA, 16 bp, Homo sapiens
aacatgcatactttat

SEQ ID NO: 5091417 - DNA, 15 bp, Homo sapiens
aacatgccctcaggc

SEQ ID NO: 5091418 - DNA, 14 bp, Homo sapiens
aacatgcctcctcc

SEQ ID NO: 5091419 - DNA, 21 bp, Homo sapiens
aacatgcctcctcctgccctc

SEQ ID NO: 5091420 - DNA, 13 bp, Homo sapiens
aacatgcctgcca

SEQ ID NO: 5091421 - DNA, 21 bp, Homo sapiens
aacatgcctgccaaagacgtg

SEQ ID NO: 5091422 - DNA, 19 bp, Homo sapiens
aacatgcctgggattggga

SEQ ID NO: 5091423 - DNA, 23 bp, Homo sapiens
aacatgcgatgttagttttagaa

SEQ ID NO: 5091424 - DNA, 18 bp, Homo sapiens
aacatgctggtgaatatt

SEQ ID NO: 5091425 - DNA, 18 bp, Homo sapiens
aacatgctgtacatactt

SEQ ID NO: 5091426 - DNA, 19 bp, Homo sapiens
aaccagggggaagcaccag

SEQ ID NO: 5091427 - DNA, 16 bp, Homo sapiens
aaccaggggtaccagg

SEQ ID NO: 5091428 - DNA, 23 bp, Homo sapiens
aaccagggtgcatggcttgggga

SEQ ID NO: 5091429 - DNA, 19 bp, Homo sapiens
aaccaggtcagtctgtctc

SEQ ID NO: 5091430 - DNA, 21 bp, Homo sapiens
aaccaggtccaatgagctttc

SEQ ID NO: 5091431 - DNA, 14 bp, Homo sapiens
aaccaggttgcagt

SEQ ID NO: 5091432 - DNA, 17 bp, Homo sapiens
aaccagtaacgtgctgc

SEQ ID NO: 5091433 - DNA, 22 bp, Homo sapiens
aaccagtaacgtgctgctcaag

SEQ ID NO: 5091434 - DNA, 19 bp, Homo sapiens
aaccagtatacaagataag

SEQ ID NO: 5091435 - DNA, 17 bp, Homo sapiens
aaccagtatggaaggga

SEQ ID NO: 5091436 - DNA, 19 bp, Homo sapiens
aaccagtatggaagggagg

SEQ ID NO: 5091437 - DNA, 13 bp, Homo sapiens
aaccagtattgta

SEQ ID NO: 5091438 - DNA, 14 bp, Homo sapiens
aaccagtattgtac

SEQ ID NO: 5091439 - DNA, 15 bp, Homo sapiens
aaccagtattgtaca

SEQ ID NO: 5091440 - DNA, 22 bp, Homo sapiens
aaccagtattgtacaaagtatt

SEQ ID NO: 5091441 - DNA, 17 bp, Homo sapiens
aaccagtatttaagctt

SEQ ID NO: 5091442 - DNA, 21 bp, Homo sapiens
aaccagtatttttgctgcttc

SEQ ID NO: 5091443 - DNA, 22 bp, Homo sapiens
aaccagtatttttgctgcttct

SEQ ID NO: 5091444 - DNA, 18 bp, Homo sapiens
aaccagtccctctgagtg

SEQ ID NO: 5091445 - DNA, 13 bp, Homo sapiens
aaccagtcctgct

SEQ ID NO: 5091446 - DNA, 14 bp, Homo sapiens
aaccagtcctgctg

SEQ ID NO: 5091447 - DNA, 16 bp, Homo sapiens
aaccagtcctgctgcc

SEQ ID NO: 5091448 - DNA, 19 bp, Homo sapiens
aaccagtcctgctgcctgg

SEQ ID NO: 5091449 - DNA, 15 bp, Homo sapiens
aaccagtctgaagtt

SEQ ID NO: 5091450 - DNA, 20 bp, Homo sapiens
aaccagtctgtgtttacaga

SEQ ID NO: 5091451 - DNA, 17 bp, Homo sapiens
aaccagtcttctccctg

SEQ ID NO: 5091452 - DNA, 18 bp, Homo sapiens
aaccagtcttttgaaaga

SEQ ID NO: 5091453 - DNA, 13 bp, Homo sapiens
aaccagtgccaag

SEQ ID NO: 5091454 - DNA, 14 bp, Homo sapiens
aaccagtgccaagg

SEQ ID NO: 5091455 - DNA, 15 bp, Homo sapiens
aaccagtgccaagga

SEQ ID NO: 5091456 - DNA, 16 bp, Homo sapiens
aaccagtgccaaggac

SEQ ID NO: 5091457 - DNA, 23 bp, Homo sapiens
aaccagtggccggttgccactct

SEQ ID NO: 5091458 - DNA, 20 bp, Homo sapiens
aaccagtgtaactggctgct

SEQ ID NO: 5091459 - DNA, 22 bp, Homo sapiens
aaccagtgtaactggctgctcc

SEQ ID NO: 5091460 - DNA, 13 bp, Homo sapiens
aaccagtgtctga

SEQ ID NO: 5091461 - DNA, 17 bp, Homo sapiens
aaccagtgttgtggatt

SEQ ID NO: 5091462 - DNA, 14 bp, Homo sapiens
aaccagttatgtga

SEQ ID NO: 5091463 - DNA, 23 bp, Homo sapiens
aaccagttggctaggggagcagg

SEQ ID NO: 5091464 - DNA, 13 bp, Homo sapiens
aaccagtttagct

SEQ ID NO: 5091465 - DNA, 16 bp, Homo sapiens
aaccagtttattctgt

SEQ ID NO: 5091466 - DNA, 17 bp, Homo sapiens
aaccagttttgctgcta

SEQ ID NO: 5091467 - DNA, 19 bp, Homo sapiens
aaccataaaaccctataca

SEQ ID NO: 5091468 - DNA, 14 bp, Homo sapiens
aaccataaaagaag

SEQ ID NO: 5091469 - DNA, 14 bp, Homo sapiens
aaccataaatcaat

SEQ ID NO: 5091470 - DNA, 18 bp, Homo sapiens
aaccataacaacttcata

SEQ ID NO: 5091471 - DNA, 15 bp, Homo sapiens
aaccataatgtcttt

SEQ ID NO: 5091472 - DNA, 14 bp, Homo sapiens
aaccatagaactgt

SEQ ID NO: 5091473 - DNA, 15 bp, Homo sapiens
aaccatagttactgt

SEQ ID NO: 5091474 - DNA, 13 bp, Homo sapiens
aaccatatgatac

SEQ ID NO: 5091475 - DNA, 19 bp, Homo sapiens
aaccatatgattgaaaaga

SEQ ID NO: 5091476 - DNA, 20 bp, Homo sapiens
aaccatatgattgaaaagaa

SEQ ID NO: 5091477 - DNA, 16 bp, Homo sapiens
aaccatatggatatta

SEQ ID NO: 5091478 - DNA, 15 bp, Homo sapiens
aaccatcacagctgg

SEQ ID NO: 5091479 - DNA, 20 bp, Homo sapiens
aaccatcattgaaatctttt

SEQ ID NO: 5091480 - DNA, 23 bp, Homo sapiens
aaccatcattgaaatctttttgc

SEQ ID NO: 5091481 - DNA, 21 bp, Homo sapiens
aaccatccacttacatatatt

SEQ ID NO: 5091482 - DNA, 18 bp, Homo sapiens
aaccatccatccctagaa

SEQ ID NO: 5091483 - DNA, 16 bp, Homo sapiens
aaccatccccaactcc

SEQ ID NO: 5091484 - DNA, 22 bp, Homo sapiens
aaccatccctgatgtctgtctg

SEQ ID NO: 5091485 - DNA, 14 bp, Homo sapiens
aaccatcctctccc

SEQ ID NO: 5091486 - DNA, 14 bp, Homo sapiens
aaccatcctctgtt

SEQ ID NO: 5091487 - DNA, 14 bp, Homo sapiens
aaccatctccctgg

SEQ ID NO: 5091488 - DNA, 13 bp, Homo sapiens
aaccatctggcct

SEQ ID NO: 5091489 - DNA, 19 bp, Homo sapiens
aaccatctggtgcctttcc

SEQ ID NO: 5091490 - DNA, 20 bp, Homo sapiens
aaccatctgtccctgcctca

SEQ ID NO: 5091491 - DNA, 12 bp, Homo sapiens
aaccatcttctg

SEQ ID NO: 5091492 - DNA, 13 bp, Homo sapiens
aaccatctttaat

SEQ ID NO: 5091493 - DNA, 23 bp, Homo sapiens
aaccatctttaatcaatgtgaca

SEQ ID NO: 5091494 - DNA, 12 bp, Homo sapiens
aaccatgaaaag

SEQ ID NO: 5091495 - DNA, 19 bp, Homo sapiens
aaccatgaaaagttttcaa

SEQ ID NO: 5091496 - DNA, 17 bp, Homo sapiens
aaccatgaagacaggat

SEQ ID NO: 5091497 - DNA, 20 bp, Homo sapiens
aaccatgaagtctctaacaa

SEQ ID NO: 5091498 - DNA, 22 bp, Homo sapiens
aaccatgaatgaacccctggct

SEQ ID NO: 5091499 - DNA, 21 bp, Homo sapiens
aaccatgacaaacctagcttt

SEQ ID NO: 5091500 - DNA, 15 bp, Homo sapiens
aaccatgactgtgac

SEQ ID NO: 5091501 - DNA, 17 bp, Homo sapiens
aaccatgagaatttgca

SEQ ID NO: 5091502 - DNA, 22 bp, Homo sapiens
aaccatgagaccactgttatca

SEQ ID NO: 5091503 - DNA, 14 bp, Homo sapiens
aaccatgagcacta

SEQ ID NO: 5091504 - DNA, 19 bp, Homo sapiens
aaccatgcaaattgtgaaa

SEQ ID NO: 5091505 - DNA, 20 bp, Homo sapiens
aaccatgcaaattgtgaaat

SEQ ID NO: 5091506 - DNA, 18 bp, Homo sapiens
aaccatgcagcttcatca

SEQ ID NO: 5091507 - DNA, 17 bp, Homo sapiens
aaccatggacctgcact

SEQ ID NO: 5091508 - DNA, 23 bp, Homo sapiens
aaccatggacctgcacttggcct

SEQ ID NO: 5091509 - DNA, 16 bp, Homo sapiens
aaccatggctgaagga

SEQ ID NO: 5091510 - DNA, 17 bp, Homo sapiens
aaccatgggataaatgc

SEQ ID NO: 5091511 - DNA, 16 bp, Homo sapiens
aaccatgggctcaggg

SEQ ID NO: 5091512 - DNA, 17 bp, Homo sapiens
aaccatgggctcagggc

SEQ ID NO: 5091513 - DNA, 19 bp, Homo sapiens
aaccatgggctcagggcca

SEQ ID NO: 5091514 - DNA, 20 bp, Homo sapiens
aaccatgtaaagaacataaa

SEQ ID NO: 5091515 - DNA, 17 bp, Homo sapiens
aaccatgtagaaaattt

SEQ ID NO: 5091516 - DNA, 19 bp, Homo sapiens
aaccatgtgactaaaaatg

SEQ ID NO: 5091517 - DNA, 13 bp, Homo sapiens
aaccatgttttgg

SEQ ID NO: 5091518 - DNA, 21 bp, Homo sapiens
aaccttttaaaaaaataatat

SEQ ID NO: 5091519 - DNA, 13 bp, Homo sapiens
aaccttttactgg

SEQ ID NO: 5091520 - DNA, 12 bp, Homo sapiens
aacctttttaaa

SEQ ID NO: 5091521 - DNA, 17 bp, Homo sapiens
aacctttttcttgatct

SEQ ID NO: 5091522 - DNA, 22 bp, Homo sapiens
aacctttttcttgatcttaaag

SEQ ID NO: 5091523 - DNA, 21 bp, Homo sapiens
aaccttttttaagatttttct

SEQ ID NO: 5091524 - DNA, 14 bp, Homo sapiens
aacctttttttgat

SEQ ID NO: 5091525 - DNA, 18 bp, Homo sapiens
aacctttttttttgaaac

SEQ ID NO: 5091526 - DNA, 20 bp, Homo sapiens
aacctttttttttgaaacag

SEQ ID NO: 5091527 - DNA, 12 bp, Homo sapiens
aacgaaaagcac

SEQ ID NO: 5091528 - DNA, 14 bp, Homo sapiens
aacgaaaatcattg

SEQ ID NO: 5091529 - DNA, 14 bp, Homo sapiens
aacgaaacacttca

SEQ ID NO: 5091530 - DNA, 16 bp, Homo sapiens
aacgaacatggcatgt

SEQ ID NO: 5091531 - DNA, 17 bp, Homo sapiens
aacgaacccactgtgct

SEQ ID NO: 5091532 - DNA, 14 bp, Homo sapiens
aacgaacgttttaa

SEQ ID NO: 5091533 - DNA, 13 bp, Homo sapiens
aacgaagaaaaaa

SEQ ID NO: 5091534 - DNA, 16 bp, Homo sapiens
aacgaagagttccctt

SEQ ID NO: 5091535 - DNA, 13 bp, Homo sapiens
aacgaataaaggt

SEQ ID NO: 5091536 - DNA, 17 bp, Homo sapiens
aacgaatgtttcaaatc

SEQ ID NO: 5091537 - DNA, 16 bp, Homo sapiens
aacgacccactctgct

SEQ ID NO: 5091538 - DNA, 17 bp, Homo sapiens
aacgaccgtcttttgaa

SEQ ID NO: 5091539 - DNA, 16 bp, Homo sapiens
aacgactcaaaatgac

SEQ ID NO: 5091540 - DNA, 19 bp, Homo sapiens
aacgactccgagaacaaca

SEQ ID NO: 5091541 - DNA, 18 bp, Homo sapiens
aacgactgggcactgcca

SEQ ID NO: 5091542 - DNA, 17 bp, Homo sapiens
aacgagaagacaaactc

SEQ ID NO: 5091543 - DNA, 14 bp, Homo sapiens
aacgagaagtgctt

SEQ ID NO: 5091544 - DNA, 16 bp, Homo sapiens
aacgagactttccatt

SEQ ID NO: 5091545 - DNA, 21 bp, Homo sapiens
aacgagactttccattacaag

SEQ ID NO: 5091546 - DNA, 23 bp, Homo sapiens
aacgagaggggaagagtgtactg

SEQ ID NO: 5091547 - DNA, 15 bp, Homo sapiens
aacgagcctggaagc

SEQ ID NO: 5091548 - DNA, 19 bp, Homo sapiens
aacgagggcaacagggagc

SEQ ID NO: 5091549 - DNA, 13 bp, Homo sapiens
aacgagttaatga

SEQ ID NO: 5091550 - DNA, 22 bp, Homo sapiens
aacgatagcctagctttctaaa

SEQ ID NO: 5091551 - DNA, 13 bp, Homo sapiens
aacgatatatgta

SEQ ID NO: 5091552 - DNA, 17 bp, Homo sapiens
aacgatatatgtaaata

SEQ ID NO: 5091553 - DNA, 19 bp, Homo sapiens
aacgatatatgtaaatata

SEQ ID NO: 5091554 - DNA, 15 bp, Homo sapiens
aacgatccttcaaag

SEQ ID NO: 5091555 - DNA, 17 bp, Homo sapiens
aacgatgaatttcttct

SEQ ID NO: 5091556 - DNA, 17 bp, Homo sapiens
aacgatgatgcttgtaa

SEQ ID NO: 5091557 - DNA, 16 bp, Homo sapiens
aacgatgtgtctgtat

SEQ ID NO: 5091558 - DNA, 15 bp, Homo sapiens
aacgattcacagcct

SEQ ID NO: 5091559 - DNA, 14 bp, Homo sapiens
aacgatttttaaaa

SEQ ID NO: 5091560 - DNA, 18 bp, Homo sapiens
aacgatttttaaaatgta

SEQ ID NO: 5091561 - DNA, 21 bp, Homo sapiens
aacgcaaacctctccttcctc

SEQ ID NO: 5091562 - DNA, 20 bp, Homo sapiens
aacgcaaagggctgaaagcc

SEQ ID NO: 5091563 - DNA, 16 bp, Homo sapiens
aacgcaattaaaaata

SEQ ID NO: 5091564 - DNA, 14 bp, Homo sapiens
aacgcaccaatcag

SEQ ID NO: 5091565 - DNA, 19 bp, Homo sapiens
aacgcaccaatcagcactc

SEQ ID NO: 5091566 - DNA, 21 bp, Homo sapiens
aacgcacgcaacccttgctgc

SEQ ID NO: 5091567 - DNA, 22 bp, Homo sapiens
aacgcagattgggctggctctg

SEQ ID NO: 5091568 - DNA, 22 bp, Homo sapiens
aacgcagccctagagcctgcct

SEQ ID NO: 5091569 - DNA, 23 bp, Homo sapiens
aacgcagccctagagcctgcctg

SEQ ID NO: 5091570 - DNA, 12 bp, Homo sapiens
aacgcagccctg

SEQ ID NO: 5091571 - DNA, 11 bp, Homo sapiens
aacgcagcctc

SEQ ID NO: 5091572 - DNA, 24 bp, Homo sapiens
aacgcaggagaatcactgcagccc

SEQ ID NO: 5091573 - DNA, 13 bp, Homo sapiens
aacgcaggagaga

SEQ ID NO: 5091574 - DNA, 16 bp, Homo sapiens
aacgcagttgattcct

SEQ ID NO: 5091575 - DNA, 22 bp, Homo sapiens
aacgcatctagttcccctgttt

SEQ ID NO: 5091576 - DNA, 22 bp, Homo sapiens
aacgcatggagtgtgtattgtt

SEQ ID NO: 5091577 - DNA, 18 bp, Homo sapiens
aacgcattaagaggttta

SEQ ID NO: 5091578 - DNA, 14 bp, Homo sapiens
aacgcattttgggt

SEQ ID NO: 5091579 - DNA, 13 bp, Homo sapiens
aacgccagtctcc

SEQ ID NO: 5091580 - DNA, 17 bp, Homo sapiens
aacgcccacttccctgg

SEQ ID NO: 5091581 - DNA, 18 bp, Homo sapiens
aacgccccgggcaaaggg

SEQ ID NO: 5091582 - DNA, 20 bp, Homo sapiens
aacgccccgggcaaagggtc

SEQ ID NO: 5091583 - DNA, 23 bp, Homo sapiens
aacgcccctccaaacctccagcc

SEQ ID NO: 5091584 - DNA, 14 bp, Homo sapiens
aacgcccctgtggc

SEQ ID NO: 5091585 - DNA, 16 bp, Homo sapiens
aacgcccctgtggcca

SEQ ID NO: 5091586 - DNA, 17 bp, Homo sapiens
aacgcccctgtggccaa

SEQ ID NO: 5091587 - DNA, 14 bp, Homo sapiens
aacgccctggtaag

SEQ ID NO: 5091588 - DNA, 19 bp, Homo sapiens
aacgccctggtaaggctgg

SEQ ID NO: 5091589 - DNA, 12 bp, Homo sapiens
aacgccctgtgt

SEQ ID NO: 5091590 - DNA, 22 bp, Homo sapiens
aacgccgccttggccttgcagc

SEQ ID NO: 5091591 - DNA, 17 bp, Homo sapiens
aacgcctcctgtcccca

SEQ ID NO: 5091592 - DNA, 13 bp, Homo sapiens
aacgcctgagccc

SEQ ID NO: 5091593 - DNA, 17 bp, Homo sapiens
aacgcctgagcccaggg

SEQ ID NO: 5091594 - DNA, 15 bp, Homo sapiens
aacgcctgccttctg

SEQ ID NO: 5091595 - DNA, 21 bp, Homo sapiens
aacgcctgcttgtccctgccc

SEQ ID NO: 5091596 - DNA, 16 bp, Homo sapiens
aacgcgtctgcctggg

SEQ ID NO: 5091597 - DNA, 13 bp, Homo sapiens
aacgcgttgaaat

SEQ ID NO: 5091598 - DNA, 14 bp, Homo sapiens
aacgcgttgaaatt

SEQ ID NO: 5091599 - DNA, 21 bp, Homo sapiens
aacgctaaagagcccttgcct

SEQ ID NO: 5091600 - DNA, 18 bp, Homo sapiens
aacgctaaaggtgtaaga

SEQ ID NO: 5091601 - DNA, 16 bp, Homo sapiens
aacgctatctgggaag

SEQ ID NO: 5091602 - DNA, 20 bp, Homo sapiens
aacgctcttagctttctcag

SEQ ID NO: 5091603 - DNA, 22 bp, Homo sapiens
aacgctgaagcggtcagactgg

SEQ ID NO: 5091604 - DNA, 11 bp, Homo sapiens
aacgctgcctg

SEQ ID NO: 5091605 - DNA, 13 bp, Homo sapiens
aacgctgcctgcc

SEQ ID NO: 5091606 - DNA, 14 bp, Homo sapiens
aacgctgcctgccc

SEQ ID NO: 5091607 - DNA, 15 bp, Homo sapiens
aacgctgcctgccca

SEQ ID NO: 5091608 - DNA, 19 bp, Homo sapiens
aacgctgctccatgcacag

SEQ ID NO: 5091609 - DNA, 16 bp, Homo sapiens
aacgctgtcaaaagtt

SEQ ID NO: 5091610 - DNA, 21 bp, Homo sapiens
aacgctgtgatgctgtgtgcc

SEQ ID NO: 5091611 - DNA, 21 bp, Homo sapiens
aacgcttaaaggtgtcttcct

SEQ ID NO: 5091612 - DNA, 19 bp, Homo sapiens
aacccccagcccacagagc

SEQ ID NO: 5091613 - DNA, 13 bp, Homo sapiens
aacccccagcctg

SEQ ID NO: 5091614 - DNA, 14 bp, Homo sapiens
aacccccagcctgc

SEQ ID NO: 5091615 - DNA, 13 bp, Homo sapiens
aacccccagctgg

SEQ ID NO: 5091616 - DNA, 23 bp, Homo sapiens
aacccccagtcctcactgtcctg

SEQ ID NO: 5091617 - DNA, 19 bp, Homo sapiens
aacccccagtgccacagag

SEQ ID NO: 5091618 - DNA, 13 bp, Homo sapiens
aacccccatcttt

SEQ ID NO: 5091619 - DNA, 12 bp, Homo sapiens
aaccccccactc

SEQ ID NO: 5091620 - DNA, 15 bp, Homo sapiens
aaccccccactccct

SEQ ID NO: 5091621 - DNA, 18 bp, Homo sapiens
aaccccccagcactgagg

SEQ ID NO: 5091622 - DNA, 13 bp, Homo sapiens
aaccccccaggcc

SEQ ID NO: 5091623 - DNA, 15 bp, Homo sapiens
aaccccccgactgtg

SEQ ID NO: 5091624 - DNA, 12 bp, Homo sapiens
aacccccctcct

SEQ ID NO: 5091625 - DNA, 19 bp, Homo sapiens
aacccccctcctgctcctc

SEQ ID NO: 5091626 - DNA, 22 bp, Homo sapiens
aacccccctcctgctcctccct

SEQ ID NO: 5091627 - DNA, 16 bp, Homo sapiens
aacccccgctccagat

SEQ ID NO: 5091628 - DNA, 18 bp, Homo sapiens
aaccccctccctgtccca

SEQ ID NO: 5091629 - DNA, 20 bp, Homo sapiens
aaccccctccctgtcccagg

SEQ ID NO: 5091630 - DNA, 12 bp, Homo sapiens
aaccccctgcaa

SEQ ID NO: 5091631 - DNA, 15 bp, Homo sapiens
aaccccctgcagccc

SEQ ID NO: 5091632 - DNA, 13 bp, Homo sapiens
aaccccctgccca

SEQ ID NO: 5091633 - DNA, 18 bp, Homo sapiens
aaccccctgtaaggttcc

SEQ ID NO: 5091634 - DNA, 16 bp, Homo sapiens
aaccccctttgtgctg

SEQ ID NO: 5091635 - DNA, 18 bp, Homo sapiens
aaccccgcggtgctctgg

SEQ ID NO: 5091636 - DNA, 14 bp, Homo sapiens
aaccccgtcaacaa

SEQ ID NO: 5091637 - DNA, 15 bp, Homo sapiens
aaccccgtcaacaaa

SEQ ID NO: 5091638 - DNA, 17 bp, Homo sapiens
aaccccgtcaacaaatc

SEQ ID NO: 5091639 - DNA, 22 bp, Homo sapiens
aaccccgtcgaggggctctcag

SEQ ID NO: 5091640 - DNA, 20 bp, Homo sapiens
aaccccgtgacaaaggtaga

SEQ ID NO: 5091641 - DNA, 19 bp, Homo sapiens
aacccctaagactgccttc

SEQ ID NO: 5091642 - DNA, 21 bp, Homo sapiens
aacccctaatcgccctgagct

SEQ ID NO: 5091643 - DNA, 21 bp, Homo sapiens
aacccctaggtcatttgtaga

SEQ ID NO: 5091644 - DNA, 12 bp, Homo sapiens
aacccctccccc

SEQ ID NO: 5091645 - DNA, 13 bp, Homo sapiens
aacccctccccca

SEQ ID NO: 5091646 - DNA, 13 bp, Homo sapiens
aacccctcctccc

SEQ ID NO: 5091647 - DNA, 15 bp, Homo sapiens
aacccctcctccctc

SEQ ID NO: 5091648 - DNA, 16 bp, Homo sapiens
aacccctcctccctca

SEQ ID NO: 5091649 - DNA, 15 bp, Homo sapiens
aacccctcctggcct

SEQ ID NO: 5091650 - DNA, 18 bp, Homo sapiens
aacccctccttccccaga

SEQ ID NO: 5091651 - DNA, 23 bp, Homo sapiens
aacccctccttccccagacccag

SEQ ID NO: 5091652 - DNA, 16 bp, Homo sapiens
aacccctcgcccagtc

SEQ ID NO: 5091653 - DNA, 23 bp, Homo sapiens
aacccctctcaggtaccttttct

SEQ ID NO: 5091654 - DNA, 21 bp, Homo sapiens
aacccctctcccttttcagat

SEQ ID NO: 5091655 - DNA, 21 bp, Homo sapiens
aacccctgatgtttgaagagt

SEQ ID NO: 5091656 - DNA, 13 bp, Homo sapiens
aacccctgcctgg

SEQ ID NO: 5091657 - DNA, 20 bp, Homo sapiens
aacccctggaccccagcctc

SEQ ID NO: 5091658 - DNA, 21 bp, Homo sapiens
aacccctgtacccagctcctt

SEQ ID NO: 5091659 - DNA, 12 bp, Homo sapiens
aacccctgtccc

SEQ ID NO: 5091660 - DNA, 12 bp, Homo sapiens
aaccccttccca

SEQ ID NO: 5091661 - DNA, 18 bp, Homo sapiens
aaccccttctctgtgacc

SEQ ID NO: 5091662 - DNA, 16 bp, Homo sapiens
aacccgacagagggaa

SEQ ID NO: 5091663 - DNA, 15 bp, Homo sapiens
aacccgactgtgaaa

SEQ ID NO: 5091664 - DNA, 15 bp, Homo sapiens
aacccgaggcccgca

SEQ ID NO: 5091665 - DNA, 23 bp, Homo sapiens
aacccgaggttggtttggggaga

SEQ ID NO: 5091666 - DNA, 13 bp, Homo sapiens
aacccgctgcttc

SEQ ID NO: 5091667 - DNA, 23 bp, Homo sapiens
aacccgggagcggaggttgcagt

SEQ ID NO: 5091668 - DNA, 16 bp, Homo sapiens
aacccgggaggcagag

SEQ ID NO: 5091669 - DNA, 15 bp, Homo sapiens
aacccgggggacaga

SEQ ID NO: 5091670 - DNA, 15 bp, Homo sapiens
aacccgtctggccca

SEQ ID NO: 5091671 - DNA, 18 bp, Homo sapiens
aacccgtgcccctgggat

SEQ ID NO: 5091672 - DNA, 13 bp, Homo sapiens
aacccgtggaggc

SEQ ID NO: 5091673 - DNA, 16 bp, Homo sapiens
aacccgtttcccggtt

SEQ ID NO: 5091674 - DNA, 20 bp, Homo sapiens
aaccctaaagcagtaaaata

SEQ ID NO: 5091675 - DNA, 16 bp, Homo sapiens
aaccctacactcggaa

SEQ ID NO: 5091676 - DNA, 19 bp, Homo sapiens
aaccctacagtatataagc

SEQ ID NO: 5091677 - DNA, 14 bp, Homo sapiens
aaccctagcaaaag

SEQ ID NO: 5091678 - DNA, 16 bp, Homo sapiens
aaccctagccttgctt

SEQ ID NO: 5091679 - DNA, 18 bp, Homo sapiens
aaccctagccttgcttgt

SEQ ID NO: 5091680 - DNA, 14 bp, Homo sapiens
aaccctagctgtgt

SEQ ID NO: 5091681 - DNA, 16 bp, Homo sapiens
aaccctatctcctgac

SEQ ID NO: 5091682 - DNA, 19 bp, Homo sapiens
aaccctatctcctgacaga

SEQ ID NO: 5091683 - DNA, 20 bp, Homo sapiens
aaccctattcattagcatta

SEQ ID NO: 5091684 - DNA, 23 bp, Homo sapiens
aaccctcattgctgtcttgcccc

SEQ ID NO: 5091685 - DNA, 13 bp, Homo sapiens
aaccctcccagaa

SEQ ID NO: 5091686 - DNA, 21 bp, Homo sapiens
aaccctcccagaaacatctct

SEQ ID NO: 5091687 - DNA, 15 bp, Homo sapiens
aaccctccctcagcc

SEQ ID NO: 5091688 - DNA, 19 bp, Homo sapiens
aaccctccctcagcccctc

SEQ ID NO: 5091689 - DNA, 15 bp, Homo sapiens
aaccctccgttcctc

SEQ ID NO: 5091690 - DNA, 11 bp, Homo sapiens
aaccctcctgg

SEQ ID NO: 5091691 - DNA, 20 bp, Homo sapiens
aaccctcctgggaaggccac

SEQ ID NO: 5091692 - DNA, 19 bp, Homo sapiens
aaccctcctgggcccaagt

SEQ ID NO: 5091693 - DNA, 12 bp, Homo sapiens
aaccctccttgg

SEQ ID NO: 5091694 - DNA, 20 bp, Homo sapiens
aaccctccttggtgcctctg

SEQ ID NO: 5091695 - DNA, 22 bp, Homo sapiens
aaccctcgatgttcatggaatt

SEQ ID NO: 5091696 - DNA, 18 bp, Homo sapiens
aaccctcgccctgtccct

SEQ ID NO: 5091697 - DNA, 20 bp, Homo sapiens
aaccctcgccctgtccctcc

SEQ ID NO: 5091698 - DNA, 15 bp, Homo sapiens
aaccctcggagcccc

SEQ ID NO: 5091699 - DNA, 15 bp, Homo sapiens
aaccctcgtttctga

SEQ ID NO: 5091700 - DNA, 13 bp, Homo sapiens
aaccctctcttcc

SEQ ID NO: 5091701 - DNA, 16 bp, Homo sapiens
aaccctctcttcccta

SEQ ID NO: 5091702 - DNA, 16 bp, Homo sapiens
aaccctctgagttttt

SEQ ID NO: 5091703 - DNA, 18 bp, Homo sapiens
aaccctctgagtttttgt

SEQ ID NO: 5091704 - DNA, 14 bp, Homo sapiens
aaccctctggaagt

SEQ ID NO: 5091705 - DNA, 14 bp, Homo sapiens
aaccctctgtcacc

SEQ ID NO: 5091706 - DNA, 11 bp, Homo sapiens
aaccctctgtg

SEQ ID NO: 5091707 - DNA, 13 bp, Homo sapiens
aaccctctgtgaa

SEQ ID NO: 5091708 - DNA, 14 bp, Homo sapiens
aaccctctgtgaaa

SEQ ID NO: 5091709 - DNA, 16 bp, Homo sapiens
aaccctcttgccatcc

SEQ ID NO: 5091710 - DNA, 17 bp, Homo sapiens
aaccctcttgccatcct

SEQ ID NO: 5091711 - DNA, 21 bp, Homo sapiens
aaccctgacaaattttaatta

SEQ ID NO: 5091712 - DNA, 22 bp, Homo sapiens
aaccctgagcagggtccacagc

SEQ ID NO: 5091713 - DNA, 17 bp, Homo sapiens
aaccctgaggtatctgt

SEQ ID NO: 5091714 - DNA, 21 bp, Homo sapiens
aaccctgcaatcactttttgg

SEQ ID NO: 5091715 - DNA, 20 bp, Homo sapiens
aaccctgccccactcctgtc

SEQ ID NO: 5091716 - DNA, 14 bp, Homo sapiens
aaccctgcccctgc

SEQ ID NO: 5091717 - DNA, 17 bp, Homo sapiens
aaccctgccctgcacct

SEQ ID NO: 5091718 - DNA, 19 bp, Homo sapiens
aaccctgccctgccccacc

SEQ ID NO: 5091719 - DNA, 20 bp, Homo sapiens
aaccctgccctgctctgccc

SEQ ID NO: 5091720 - DNA, 15 bp, Homo sapiens
aaccctgccgtcacc

SEQ ID NO: 5091721 - DNA, 18 bp, Homo sapiens
aaccctgccgtcaccacc

SEQ ID NO: 5091722 - DNA, 21 bp, Homo sapiens
aaccctgccgtcaccaccacc

SEQ ID NO: 5091723 - DNA, 22 bp, Homo sapiens
aaccctgccgtcaccaccaccc

SEQ ID NO: 5091724 - DNA, 17 bp, Homo sapiens
aaccctgcgtggggaca

SEQ ID NO: 5091725 - DNA, 21 bp, Homo sapiens
aaccctgcttctgctgccctg

SEQ ID NO: 5091726 - DNA, 19 bp, Homo sapiens
aaccctggcacttaagggg

SEQ ID NO: 5091727 - DNA, 17 bp, Homo sapiens
aaccctggcctcacttg

SEQ ID NO: 5091728 - DNA, 19 bp, Homo sapiens
aaccctgggctattgctgc

SEQ ID NO: 5091729 - DNA, 18 bp, Homo sapiens
aaccctgggctccctgga

SEQ ID NO: 5091730 - DNA, 19 bp, Homo sapiens
aaccctgggctccctggag

SEQ ID NO: 5091731 - DNA, 12 bp, Homo sapiens
aaccctgggctg

SEQ ID NO: 5091732 - DNA, 17 bp, Homo sapiens
aaccctgggctgtccag

SEQ ID NO: 5091733 - DNA, 19 bp, Homo sapiens
aaccctggggaaggagcca

SEQ ID NO: 5091734 - DNA, 14 bp, Homo sapiens
aaccctggtgacca

SEQ ID NO: 5091735 - DNA, 23 bp, Homo sapiens
aaccctggtgctttccttcatct

SEQ ID NO: 5091736 - DNA, 22 bp, Homo sapiens
aaccctgtcttgtcctcctgtt

SEQ ID NO: 5091737 - DNA, 21 bp, Homo sapiens
aaccctgtgggggcggctgtg

SEQ ID NO: 5091738 - DNA, 22 bp, Homo sapiens
aaccctgttgagtatttgctgt

SEQ ID NO: 5091739 - DNA, 23 bp, Homo sapiens
aaccctgttgagtatttgctgtt

SEQ ID NO: 5091740 - DNA, 13 bp, Homo sapiens
aaccctgtttcct

SEQ ID NO: 5091741 - DNA, 16 bp, Homo sapiens
aaccctgttttatact

SEQ ID NO: 5091742 - DNA, 22 bp, Homo sapiens
aacccttaaacagttgcacagc

SEQ ID NO: 5091743 - DNA, 17 bp, Homo sapiens
aacccttacagtgaaga

SEQ ID NO: 5091744 - DNA, 21 bp, Homo sapiens
aacccttaccccttagcctcc

SEQ ID NO: 5091745 - DNA, 22 bp, Homo sapiens
aacccttagcttttagcctggc

SEQ ID NO: 5091746 - DNA, 23 bp, Homo sapiens
aacccttaggacagggtccctgc

SEQ ID NO: 5091747 - DNA, 19 bp, Homo sapiens
aacccttcaacgtttcttc

SEQ ID NO: 5091748 - DNA, 22 bp, Homo sapiens
aacccttcaacgtttcttcact

SEQ ID NO: 5091749 - DNA, 17 bp, Homo sapiens
aacccttcaactcctgg

SEQ ID NO: 5091750 - DNA, 19 bp, Homo sapiens
aacccttcaactcctggct

SEQ ID NO: 5091751 - DNA, 21 bp, Homo sapiens
aacccttcagtgctacatttt

SEQ ID NO: 5091752 - DNA, 19 bp, Homo sapiens
aacccttcatcttcctgtg

SEQ ID NO: 5091753 - DNA, 11 bp, Homo sapiens
aacccttcctg

SEQ ID NO: 5091754 - DNA, 12 bp, Homo sapiens
aacccttcctgc

SEQ ID NO: 5091755 - DNA, 17 bp, Homo sapiens
aacccttctgctttcta

SEQ ID NO: 5091756 - DNA, 16 bp, Homo sapiens
aacccttcttcatgtt

SEQ ID NO: 5091757 - DNA, 21 bp, Homo sapiens
aacccttgaatttctagacag

SEQ ID NO: 5091758 - DNA, 15 bp, Homo sapiens
aacccttgactgtta

SEQ ID NO: 5091759 - DNA, 20 bp, Homo sapiens
aacccttgctttcctgggcc

SEQ ID NO: 5091760 - DNA, 14 bp, Homo sapiens
aacccttgggccag

SEQ ID NO: 5091761 - DNA, 15 bp, Homo sapiens
aacccttgggccaga

SEQ ID NO: 5091762 - DNA, 21 bp, Homo sapiens
aacccttgtcagtgacagtat

SEQ ID NO: 5091763 - DNA, 18 bp, Homo sapiens
aaccctttaaatgtaaaa

SEQ ID NO: 5091764 - DNA, 16 bp, Homo sapiens
aaccctttaatgaact

SEQ ID NO: 5091765 - DNA, 23 bp, Homo sapiens
aaccctttggattatgcccatga

SEQ ID NO: 5091766 - DNA, 12 bp, Homo sapiens
aaccctttgtat

SEQ ID NO: 5091767 - DNA, 21 bp, Homo sapiens
aacccttttcatcctggctgg

SEQ ID NO: 5091768 - DNA, 16 bp, Homo sapiens
aaccgaacatgaccaa

SEQ ID NO: 5091769 - DNA, 13 bp, Homo sapiens
aaccgaataaatg

SEQ ID NO: 5091770 - DNA, 21 bp, Homo sapiens
aaccgagagaatgctgacctg

SEQ ID NO: 5091771 - DNA, 19 bp, Homo sapiens
aaccgagccagcagctgaa

SEQ ID NO: 5091772 - DNA, 13 bp, Homo sapiens
aaccgaggccctc

SEQ ID NO: 5091773 - DNA, 21 bp, Homo sapiens
aaccgagggggctgctcccac

SEQ ID NO: 5091774 - DNA, 17 bp, Homo sapiens
aaccgagtagaaaatgt

SEQ ID NO: 5091775 - DNA, 17 bp, Homo sapiens
aaccgatgctccagcca

SEQ ID NO: 5091776 - DNA, 18 bp, Homo sapiens
aaccgatgctttaccaaa

SEQ ID NO: 5091777 - DNA, 21 bp, Homo sapiens
aaccgcaggaagctgctccgt

SEQ ID NO: 5091778 - DNA, 17 bp, Homo sapiens
aaccgccagctctgttc

SEQ ID NO: 5091779 - DNA, 18 bp, Homo sapiens
aaccgccggccacactgg

SEQ ID NO: 5091780 - DNA, 15 bp, Homo sapiens
aaccgctacaagagg

SEQ ID NO: 5091781 - DNA, 16 bp, Homo sapiens
aaccgctcacctagag

SEQ ID NO: 5091782 - DNA, 19 bp, Homo sapiens
aaccgctcacctagagcca

SEQ ID NO: 5091783 - DNA, 15 bp, Homo sapiens
aaccggcaacctgta

SEQ ID NO: 5091784 - DNA, 18 bp, Homo sapiens
aaccgggagaaggcatga

SEQ ID NO: 5091785 - DNA, 23 bp, Homo sapiens
aaccggggagcccccgccccgcc

SEQ ID NO: 5091786 - DNA, 17 bp, Homo sapiens
aaccggtcccagcctgg

SEQ ID NO: 5091787 - DNA, 18 bp, Homo sapiens
aaccggtcccagcctggg

SEQ ID NO: 5091788 - DNA, 19 bp, Homo sapiens
aaccgtagactaggaagta

SEQ ID NO: 5091789 - DNA, 15 bp, Homo sapiens
aaccgtcaataggca

SEQ ID NO: 5091790 - DNA, 12 bp, Homo sapiens
aaccgtggggag

SEQ ID NO: 5091791 - DNA, 18 bp, Homo sapiens
aacgcttcgggaaaatat

SEQ ID NO: 5091792 - DNA, 19 bp, Homo sapiens
aacgcttgctcttaagtac

SEQ ID NO: 5091793 - DNA, 22 bp, Homo sapiens
aacgcttgtagaactcactctg

SEQ ID NO: 5091794 - DNA, 21 bp, Homo sapiens
aacggacgagataatgtgaac

SEQ ID NO: 5091795 - DNA, 16 bp, Homo sapiens
aacggaggaagcccac

SEQ ID NO: 5091796 - DNA, 22 bp, Homo sapiens
aacggaggcctgcgaccctggg

SEQ ID NO: 5091797 - DNA, 23 bp, Homo sapiens
aacggaggcctgcgaccctgggg

SEQ ID NO: 5091798 - DNA, 14 bp, Homo sapiens
aacggagggagtgg

SEQ ID NO: 5091799 - DNA, 12 bp, Homo sapiens
aacggagtcaaa

SEQ ID NO: 5091800 - DNA, 17 bp, Homo sapiens
aacggatgagttattat

SEQ ID NO: 5091801 - DNA, 21 bp, Homo sapiens
aacggatgctccgaggactgg

SEQ ID NO: 5091802 - DNA, 19 bp, Homo sapiens
aacggcaacgtagcctggg

SEQ ID NO: 5091803 - DNA, 11 bp, Homo sapiens
aacggcccagg

SEQ ID NO: 5091804 - DNA, 15 bp, Homo sapiens
aacggccccagcttc

SEQ ID NO: 5091805 - DNA, 17 bp, Homo sapiens
aacggccccagcttctc

SEQ ID NO: 5091806 - DNA, 20 bp, Homo sapiens
aacggccctgcaggagcagg

SEQ ID NO: 5091807 - DNA, 14 bp, Homo sapiens
aacggctccaggat

SEQ ID NO: 5091808 - DNA, 17 bp, Homo sapiens
aacgggaacatgccccc

SEQ ID NO: 5091809 - DNA, 13 bp, Homo sapiens
aacgggaggctgg

SEQ ID NO: 5091810 - DNA, 14 bp, Homo sapiens
aacgggaggctggg

SEQ ID NO: 5091811 - DNA, 13 bp, Homo sapiens
aacgggatacagg

SEQ ID NO: 5091812 - DNA, 17 bp, Homo sapiens
aacgggcagtctgctct

SEQ ID NO: 5091813 - DNA, 19 bp, Homo sapiens
aacgggcagtctgctctgc

SEQ ID NO: 5091814 - DNA, 21 bp, Homo sapiens
aacgggcagtctgctctgctg

SEQ ID NO: 5091815 - DNA, 16 bp, Homo sapiens
aacgggcatgggcctc

SEQ ID NO: 5091816 - DNA, 21 bp, Homo sapiens
aacgggcatgggcctctctgg

SEQ ID NO: 5091817 - DNA, 16 bp, Homo sapiens
aacgggccctcctccc

SEQ ID NO: 5091818 - DNA, 21 bp, Homo sapiens
aacgggcgtcaggggtgcaca

SEQ ID NO: 5091819 - DNA, 15 bp, Homo sapiens
aacgggctgccctgc

SEQ ID NO: 5091820 - DNA, 20 bp, Homo sapiens
aacggggggctcctgcccag

SEQ ID NO: 5091821 - DNA, 21 bp, Homo sapiens
aacggggggctcctgcccagg

SEQ ID NO: 5091822 - DNA, 19 bp, Homo sapiens
aacgggggggttctccccc

SEQ ID NO: 5091823 - DNA, 15 bp, Homo sapiens
aacggggtggggagg

SEQ ID NO: 5091824 - DNA, 17 bp, Homo sapiens
aacggggtggggagggt

SEQ ID NO: 5091825 - DNA, 20 bp, Homo sapiens
aacgggtctgtgggactggc

SEQ ID NO: 5091826 - DNA, 19 bp, Homo sapiens
aacgggttactaagatgaa

SEQ ID NO: 5091827 - DNA, 12 bp, Homo sapiens
aacgggttgtgt

SEQ ID NO: 5091828 - DNA, 17 bp, Homo sapiens
aacggtaaatttctgtg

SEQ ID NO: 5091829 - DNA, 20 bp, Homo sapiens
aacggtatcctccctgccca

SEQ ID NO: 5091830 - DNA, 23 bp, Homo sapiens
aacggtatcctccctgcccatcc

SEQ ID NO: 5091831 - DNA, 18 bp, Homo sapiens
aacggtcccccctcactc

SEQ ID NO: 5091832 - DNA, 14 bp, Homo sapiens
aacggtctggcagg

SEQ ID NO: 5091833 - DNA, 19 bp, Homo sapiens
aacggtctggcagggcagc

SEQ ID NO: 5091834 - DNA, 20 bp, Homo sapiens
aacggtctggcagggcagca

SEQ ID NO: 5091835 - DNA, 15 bp, Homo sapiens
aacggtctttatgaa

SEQ ID NO: 5091836 - DNA, 19 bp, Homo sapiens
aacggtctttatgaattat

SEQ ID NO: 5091837 - DNA, 18 bp, Homo sapiens
aacggtgcccatcctgcc

SEQ ID NO: 5091838 - DNA, 20 bp, Homo sapiens
aacggtgctttctgtgaaag

SEQ ID NO: 5091839 - DNA, 13 bp, Homo sapiens
aacggttaaaact

SEQ ID NO: 5091840 - DNA, 19 bp, Homo sapiens
aacggttcctggtgactcc

SEQ ID NO: 5091841 - DNA, 15 bp, Homo sapiens
aacgtaataaaccag

SEQ ID NO: 5091842 - DNA, 18 bp, Homo sapiens
aacgtaattgtacaagca

SEQ ID NO: 5091843 - DNA, 15 bp, Homo sapiens
aacgtatcaatacag

SEQ ID NO: 5091844 - DNA, 18 bp, Homo sapiens
aacgtatgcatgtgaaga

SEQ ID NO: 5091845 - DNA, 22 bp, Homo sapiens
aacgtattcagagttagatatt

SEQ ID NO: 5091846 - DNA, 12 bp, Homo sapiens
aacgtatttagc

SEQ ID NO: 5091847 - DNA, 19 bp, Homo sapiens
aacgtatttagccattacc

SEQ ID NO: 5091848 - DNA, 17 bp, Homo sapiens
aacgtatttctccagac

SEQ ID NO: 5091849 - DNA, 22 bp, Homo sapiens
aacgtattttgatgttttgtac

SEQ ID NO: 5091850 - DNA, 21 bp, Homo sapiens
aacgtcacccaaaagcacaaa

SEQ ID NO: 5091851 - DNA, 13 bp, Homo sapiens
aacgtcatctcag

SEQ ID NO: 5091852 - DNA, 14 bp, Homo sapiens
aacgtcatctcagg

SEQ ID NO: 5091853 - DNA, 18 bp, Homo sapiens
aacgtcattcagtactta

SEQ ID NO: 5091854 - DNA, 20 bp, Homo sapiens
aacgtccatctctctccctt

SEQ ID NO: 5091855 - DNA, 22 bp, Homo sapiens
aacgtcccacactttgaagcaa

SEQ ID NO: 5091856 - DNA, 11 bp, Homo sapiens
aacgtccccag

SEQ ID NO: 5091857 - DNA, 19 bp, Homo sapiens
aacgtcctctttagttttt

SEQ ID NO: 5091858 - DNA, 18 bp, Homo sapiens
aacgtctttttgtttgtt

SEQ ID NO: 5091859 - DNA, 23 bp, Homo sapiens
aacgtgagagaaagagagaagcc

SEQ ID NO: 5091860 - DNA, 16 bp, Homo sapiens
aacgtgatacatttgg

SEQ ID NO: 5091861 - DNA, 19 bp, Homo sapiens
aacgtgattgattcagtat

SEQ ID NO: 5091862 - DNA, 21 bp, Homo sapiens
aacgtgatttttaaattaaat

SEQ ID NO: 5091863 - DNA, 15 bp, Homo sapiens
aacgtgcaaagccaa

SEQ ID NO: 5091864 - DNA, 18 bp, Homo sapiens
aacgtgcaaagccaaggc

SEQ ID NO: 5091865 - DNA, 14 bp, Homo sapiens
aacgtgcattgtgc

SEQ ID NO: 5091866 - DNA, 23 bp, Homo sapiens
aacgtgcattgtgcttctttctt

SEQ ID NO: 5091867 - DNA, 14 bp, Homo sapiens
aacgtgccagcagc

SEQ ID NO: 5091868 - DNA, 16 bp, Homo sapiens
aacgtgccagcagccc

SEQ ID NO: 5091869 - DNA, 11 bp, Homo sapiens
aacgtgccccc

SEQ ID NO: 5091870 - DNA, 19 bp, Homo sapiens
aacgtgcgtgtctctgcca

SEQ ID NO: 5091871 - DNA, 13 bp, Homo sapiens
aacgtgctgctca

SEQ ID NO: 5091872 - DNA, 23 bp, Homo sapiens
aacgtgctgcttacactccaggt

SEQ ID NO: 5091873 - DNA, 23 bp, Homo sapiens
aacgtggattgtatttaagacat

SEQ ID NO: 5091874 - DNA, 13 bp, Homo sapiens
aacgtggcccaga

SEQ ID NO: 5091875 - DNA, 22 bp, Homo sapiens
aacgtggctccaccttgatggg

SEQ ID NO: 5091876 - DNA, 22 bp, Homo sapiens
aacgtggctgcttcaaggatcc

SEQ ID NO: 5091877 - DNA, 20 bp, Homo sapiens
aacgtgggcttaaagcagaa

SEQ ID NO: 5091878 - DNA, 18 bp, Homo sapiens
aacgtggggcagcacaga

SEQ ID NO: 5091879 - DNA, 23 bp, Homo sapiens
aacgtggtttgcctgaggctgta

SEQ ID NO: 5091880 - DNA, 17 bp, Homo sapiens
aacgtgtaaccagttat

SEQ ID NO: 5091881 - DNA, 18 bp, Homo sapiens
aacgtgtcacacttgtga

SEQ ID NO: 5091882 - DNA, 14 bp, Homo sapiens
aacgtgtcccgagc

SEQ ID NO: 5091883 - DNA, 19 bp, Homo sapiens
aacgtgtgctgtgtttgct

SEQ ID NO: 5091884 - DNA, 21 bp, Homo sapiens
aacgtgttaattataaacagc

SEQ ID NO: 5091885 - DNA, 22 bp, Homo sapiens
aacgtgttaattataaacagca

SEQ ID NO: 5091886 - DNA, 16 bp, Homo sapiens
aacgtgttcaatattt

SEQ ID NO: 5091887 - DNA, 16 bp, Homo sapiens
aacgttcatgttcatc

SEQ ID NO: 5091888 - DNA, 20 bp, Homo sapiens
aacgttcatgttcatctcag

SEQ ID NO: 5091889 - DNA, 12 bp, Homo sapiens
aacgttcccttt

SEQ ID NO: 5091890 - DNA, 20 bp, Homo sapiens
aacgttcgatttctacctca

SEQ ID NO: 5091891 - DNA, 21 bp, Homo sapiens
aacgttcgatttctacctcag

SEQ ID NO: 5091892 - DNA, 12 bp, Homo sapiens
aacgttgacccc

SEQ ID NO: 5091893 - DNA, 18 bp, Homo sapiens
aacgttgacccctttccc

SEQ ID NO: 5091894 - DNA, 23 bp, Homo sapiens
aacgttgacccctttcccccacc

SEQ ID NO: 5091895 - DNA, 16 bp, Homo sapiens
aacgttgctgtgggaa

SEQ ID NO: 5091896 - DNA, 21 bp, Homo sapiens
aacgttggtatgataatgata

SEQ ID NO: 5091897 - DNA, 20 bp, Homo sapiens
aacgtttaagccaaaacaat

SEQ ID NO: 5091898 - DNA, 18 bp, Homo sapiens
aacgtttcagtaataaaa

SEQ ID NO: 5091899 - DNA, 14 bp, Homo sapiens
aacgtttctcatta

SEQ ID NO: 5091900 - DNA, 18 bp, Homo sapiens
aacgtttctcattaaaat

SEQ ID NO: 5091901 - DNA, 20 bp, Homo sapiens
aacgtttggttcaaatgtgt

SEQ ID NO: 5091902 - DNA, 20 bp, Homo sapiens
aacgttttatgtgaatgtgg

SEQ ID NO: 5091903 - DNA, 17 bp, Homo sapiens
aacgttttctaattgct

SEQ ID NO: 5091904 - DNA, 18 bp, Homo sapiens
aacgttttctactttgaa

SEQ ID NO: 5091905 - DNA, 19 bp, Homo sapiens
aacgttttctactttgaaa

SEQ ID NO: 5091906 - DNA, 11 bp, Homo sapiens
aacgttttctt

SEQ ID NO: 5091907 - DNA, 14 bp, Homo sapiens
aacgttttcttctt

SEQ ID NO: 5091908 - DNA, 22 bp, Homo sapiens
aacgttttcttctttccctgga

SEQ ID NO: 5091909 - DNA, 20 bp, Homo sapiens
aacgttttttcttcttttaa

SEQ ID NO: 5091910 - DNA, 19 bp, Homo sapiens
aactaaaaaaaaaaaggcc

SEQ ID NO: 5091911 - DNA, 15 bp, Homo sapiens
aactaaaataatttt

SEQ ID NO: 5091912 - DNA, 15 bp, Homo sapiens
aactaaaatgttcta

SEQ ID NO: 5091913 - DNA, 12 bp, Homo sapiens
aactaaaattaa

SEQ ID NO: 5091914 - DNA, 22 bp, Homo sapiens
aactaaaattttctaagattaa

SEQ ID NO: 5091915 - DNA, 15 bp, Homo sapiens
aactaaactaaaata

SEQ ID NO: 5091916 - DNA, 16 bp, Homo sapiens
aactaaactacagaaa

SEQ ID NO: 5091917 - DNA, 19 bp, Homo sapiens
aactaaactagtttttcct

SEQ ID NO: 5091918 - DNA, 15 bp, Homo sapiens
aactaaactcattta

SEQ ID NO: 5091919 - DNA, 17 bp, Homo sapiens
aactaaactcatttata

SEQ ID NO: 5091920 - DNA, 12 bp, Homo sapiens
aactaaacttta

SEQ ID NO: 5091921 - DNA, 18 bp, Homo sapiens
aactaaagtatttaaaga

SEQ ID NO: 5091922 - DNA, 20 bp, Homo sapiens
aactaaagtgtgctttataa

SEQ ID NO: 5091923 - DNA, 19 bp, Homo sapiens
aactaaagttgtactttaa

SEQ ID NO: 5091924 - DNA, 19 bp, Homo sapiens
aactaaataaacagatgta

SEQ ID NO: 5091925 - DNA, 15 bp, Homo sapiens
aactaaataatgaat

SEQ ID NO: 5091926 - DNA, 20 bp, Homo sapiens
aactaaatagcatgtattgt

SEQ ID NO: 5091927 - DNA, 22 bp, Homo sapiens
aactaaatataaattttcagaa

SEQ ID NO: 5091928 - DNA, 15 bp, Homo sapiens
aactaaatatatgtc

SEQ ID NO: 5091929 - DNA, 22 bp, Homo sapiens
aactaaatgctcatacacagtt

SEQ ID NO: 5091930 - DNA, 12 bp, Homo sapiens
aactaaattact

SEQ ID NO: 5091931 - DNA, 14 bp, Homo sapiens
aactaaattactgt

SEQ ID NO: 5091932 - DNA, 13 bp, Homo sapiens
aactaaatttcac

SEQ ID NO: 5091933 - DNA, 14 bp, Homo sapiens
aactaaatttgata

SEQ ID NO: 5091934 - DNA, 20 bp, Homo sapiens
aactaaatttgatacttata

SEQ ID NO: 5091935 - DNA, 14 bp, Homo sapiens
aactaaattttaaa

SEQ ID NO: 5091936 - DNA, 18 bp, Homo sapiens
aactaaattttaaagcca

SEQ ID NO: 5091937 - DNA, 13 bp, Homo sapiens
aactaacaaccaa

SEQ ID NO: 5091938 - DNA, 12 bp, Homo sapiens
aactaacactat

SEQ ID NO: 5091939 - DNA, 15 bp, Homo sapiens
aactaaccagcattc

SEQ ID NO: 5091940 - DNA, 18 bp, Homo sapiens
aactaacctggtatttta

SEQ ID NO: 5091941 - DNA, 15 bp, Homo sapiens
aactaactgactctg

SEQ ID NO: 5091942 - DNA, 22 bp, Homo sapiens
aactaacttttttttttttaac

SEQ ID NO: 5091943 - DNA, 15 bp, Homo sapiens
aactaagaaacttaa

SEQ ID NO: 5091944 - DNA, 19 bp, Homo sapiens
aactaagaaacttttgtaa

SEQ ID NO: 5091945 - DNA, 23 bp, Homo sapiens
aactaagaaatatgcacaatagc

SEQ ID NO: 5091946 - DNA, 16 bp, Homo sapiens
aactaagaagtggtgt

SEQ ID NO: 5091947 - DNA, 14 bp, Homo sapiens
aactaagagaaact

SEQ ID NO: 5091948 - DNA, 23 bp, Homo sapiens
aactaagaggcccagccctcaga

SEQ ID NO: 5091949 - DNA, 14 bp, Homo sapiens
aactaagattcttt

SEQ ID NO: 5091950 - DNA, 17 bp, Homo sapiens
aactaagattcttttaa

SEQ ID NO: 5091951 - DNA, 19 bp, Homo sapiens
aactaagcacattatgttt

SEQ ID NO: 5091952 - DNA, 18 bp, Homo sapiens
aactaagcagtccctgag

SEQ ID NO: 5091953 - DNA, 22 bp, Homo sapiens
aactaagccaacttgatgtgaa

SEQ ID NO: 5091954 - DNA, 17 bp, Homo sapiens
aactaagcccccgctgt

SEQ ID NO: 5091955 - DNA, 19 bp, Homo sapiens
aactaagcccccgctgtaa

SEQ ID NO: 5091956 - DNA, 21 bp, Homo sapiens
aactaaggaaccctggaaact

SEQ ID NO: 5091957 - DNA, 16 bp, Homo sapiens
aactaaggacaaatta

SEQ ID NO: 5091958 - DNA, 18 bp, Homo sapiens
aactaaggacaaattagc

SEQ ID NO: 5091959 - DNA, 21 bp, Homo sapiens
aactaaggacaaattagcatg

SEQ ID NO: 5091960 - DNA, 22 bp, Homo sapiens
aactaaggcatttgattaaatt

SEQ ID NO: 5091961 - DNA, 22 bp, Homo sapiens
aactaagggggtagaagtagtt

SEQ ID NO: 5091962 - DNA, 15 bp, Homo sapiens
aactaaggtgaagaa

SEQ ID NO: 5091963 - DNA, 22 bp, Homo sapiens
aactaaggtgactcgagtgttt

SEQ ID NO: 5091964 - DNA, 15 bp, Homo sapiens
aactaaggtgctaaa

SEQ ID NO: 5091965 - DNA, 14 bp, Homo sapiens
aactaagttattgc

SEQ ID NO: 5091966 - DNA, 15 bp, Homo sapiens
aactaagttattgct

SEQ ID NO: 5091967 - DNA, 15 bp, Homo sapiens
aactaagttgtattt

SEQ ID NO: 5091968 - DNA, 16 bp, Homo sapiens
aactaagttgtatttt

SEQ ID NO: 5091969 - DNA, 16 bp, Homo sapiens
aaccgtgtccagcaca

SEQ ID NO: 5091970 - DNA, 23 bp, Homo sapiens
aaccgtgtgtccagcattgaaga

SEQ ID NO: 5091971 - DNA, 19 bp, Homo sapiens
aaccgtgtttgtctcttct

SEQ ID NO: 5091972 - DNA, 21 bp, Homo sapiens
aaccgtgtttgtctcttctgg

SEQ ID NO: 5091973 - DNA, 15 bp, Homo sapiens
aaccgttattataat

SEQ ID NO: 5091974 - DNA, 13 bp, Homo sapiens
aaccgtttacagt

SEQ ID NO: 5091975 - DNA, 17 bp, Homo sapiens
aaccgttttgaagctac

SEQ ID NO: 5091976 - DNA, 18 bp, Homo sapiens
aaccgttttgaagctact

SEQ ID NO: 5091977 - DNA, 16 bp, Homo sapiens
aaccgtttttcaagaa

SEQ ID NO: 5091978 - DNA, 20 bp, Homo sapiens
aaccgtttttcaagaaaact

SEQ ID NO: 5091979 - DNA, 14 bp, Homo sapiens
aacctaaaaatttt

SEQ ID NO: 5091980 - DNA, 18 bp, Homo sapiens
aacctaaaacaatctgta

SEQ ID NO: 5091981 - DNA, 21 bp, Homo sapiens
aacctaaaataattggttctt

SEQ ID NO: 5091982 - DNA, 22 bp, Homo sapiens
aacctaaggcaacatttccgaa

SEQ ID NO: 5091983 - DNA, 16 bp, Homo sapiens
aacctaatatcactta

SEQ ID NO: 5091984 - DNA, 20 bp, Homo sapiens
aacctaatcaccatgtaagc

SEQ ID NO: 5091985 - DNA, 15 bp, Homo sapiens
aacctaatgcactct

SEQ ID NO: 5091986 - DNA, 16 bp, Homo sapiens
aacctaatgcagaatt

SEQ ID NO: 5091987 - DNA, 16 bp, Homo sapiens
aacctaattgaaattt

SEQ ID NO: 5091988 - DNA, 20 bp, Homo sapiens
aacctaattgtggtagaaat

SEQ ID NO: 5091989 - DNA, 14 bp, Homo sapiens
aacctacaaaaaaa

SEQ ID NO: 5091990 - DNA, 23 bp, Homo sapiens
aacctacagagatgctaagagaa

SEQ ID NO: 5091991 - DNA, 19 bp, Homo sapiens
aacctacagtggagggaga

SEQ ID NO: 5091992 - DNA, 20 bp, Homo sapiens
aacctacagttttaactgtg

SEQ ID NO: 5091993 - DNA, 16 bp, Homo sapiens
aacctacattccaccc

SEQ ID NO: 5091994 - DNA, 20 bp, Homo sapiens
aacctaccaccccttcctgt

SEQ ID NO: 5091995 - DNA, 13 bp, Homo sapiens
aacctaccagcca

SEQ ID NO: 5091996 - DNA, 14 bp, Homo sapiens
aacctaccctggtc

SEQ ID NO: 5091997 - DNA, 22 bp, Homo sapiens
aacctacctcccacactcccaa

SEQ ID NO: 5091998 - DNA, 18 bp, Homo sapiens
aacctacctgtaactttt

SEQ ID NO: 5091999 - DNA, 19 bp, Homo sapiens
aacctaccttatagagcac

SEQ ID NO: 5092000 - DNA, 15 bp, Homo sapiens
aacctacgaccccag

SEQ ID NO: 5092001 - DNA, 16 bp, Homo sapiens
aacctacgcacatacc

SEQ ID NO: 5092002 - DNA, 20 bp, Homo sapiens
aacctactgaggagcaaagc

SEQ ID NO: 5092003 - DNA, 21 bp, Homo sapiens
aacctactgaggagcaaagca

SEQ ID NO: 5092004 - DNA, 14 bp, Homo sapiens
aacctactgtctaa

SEQ ID NO: 5092005 - DNA, 15 bp, Homo sapiens
aacctactgttcctt

SEQ ID NO: 5092006 - DNA, 17 bp, Homo sapiens
aacctactgttcctttc

SEQ ID NO: 5092007 - DNA, 21 bp, Homo sapiens
aacctactgttcctttcagat

SEQ ID NO: 5092008 - DNA, 20 bp, Homo sapiens
aacctacttgtaaacttgaa

SEQ ID NO: 5092009 - DNA, 22 bp, Homo sapiens
aacctacttgtaaacttgaaag

SEQ ID NO: 5092010 - DNA, 22 bp, Homo sapiens
aacctactttcatactgaagat

SEQ ID NO: 5092011 - DNA, 13 bp, Homo sapiens
aacctagaatgtc

SEQ ID NO: 5092012 - DNA, 16 bp, Homo sapiens
aacctagaatgtcaga

SEQ ID NO: 5092013 - DNA, 14 bp, Homo sapiens
aacctagagaagat

SEQ ID NO: 5092014 - DNA, 15 bp, Homo sapiens
aacctagatgtttaa

SEQ ID NO: 5092015 - DNA, 23 bp, Homo sapiens
aacctagatgtttaacaaatcta

SEQ ID NO: 5092016 - DNA, 15 bp, Homo sapiens
aacctagcacacctg

SEQ ID NO: 5092017 - DNA, 20 bp, Homo sapiens
aacctagcatcttacaaaaa

SEQ ID NO: 5092018 - DNA, 12 bp, Homo sapiens
aacctagcccct

SEQ ID NO: 5092019 - DNA, 17 bp, Homo sapiens
aacctagcttttaaaaa

SEQ ID NO: 5092020 - DNA, 19 bp, Homo sapiens
aacctagcttttaaaaaat

SEQ ID NO: 5092021 - DNA, 23 bp, Homo sapiens
aacctagcttttaaaaaatattt

SEQ ID NO: 5092022 - DNA, 13 bp, Homo sapiens
aacctaggaggat

SEQ ID NO: 5092023 - DNA, 13 bp, Homo sapiens
aacctaggagggc

SEQ ID NO: 5092024 - DNA, 22 bp, Homo sapiens
aacctaggagggctctgagcca

SEQ ID NO: 5092025 - DNA, 17 bp, Homo sapiens
aacctagtactgccccc

SEQ ID NO: 5092026 - DNA, 22 bp, Homo sapiens
aacctagttaaagaaaggaaaa

SEQ ID NO: 5092027 - DNA, 20 bp, Homo sapiens
aacctagtttgttactttaa

SEQ ID NO: 5092028 - DNA, 15 bp, Homo sapiens
aacctataagcatga

SEQ ID NO: 5092029 - DNA, 21 bp, Homo sapiens
aacctatctcagggagggaag

SEQ ID NO: 5092030 - DNA, 17 bp, Homo sapiens
aacctatctgtattggc

SEQ ID NO: 5092031 - DNA, 20 bp, Homo sapiens
aacctatctgtattggcagc

SEQ ID NO: 5092032 - DNA, 13 bp, Homo sapiens
aacctatctttaa

SEQ ID NO: 5092033 - DNA, 21 bp, Homo sapiens
aacctatgaagcaatggatat

SEQ ID NO: 5092034 - DNA, 18 bp, Homo sapiens
aacctatgataattattt

SEQ ID NO: 5092035 - DNA, 21 bp, Homo sapiens
aacctattgggacagcatgac

SEQ ID NO: 5092036 - DNA, 22 bp, Homo sapiens
aacctatttatcgcaacatgaa

SEQ ID NO: 5092037 - DNA, 11 bp, Homo sapiens
aacctattttc

SEQ ID NO: 5092038 - DNA, 21 bp, Homo sapiens
aacctattttgaaaaattcct

SEQ ID NO: 5092039 - DNA, 23 bp, Homo sapiens
aacctattttgaaaaattcctat

SEQ ID NO: 5092040 - DNA, 21 bp, Homo sapiens
aacctatttttttctcccttt

SEQ ID NO: 5092041 - DNA, 21 bp, Homo sapiens
aacctcaaactaggaggaaaa

SEQ ID NO: 5092042 - DNA, 15 bp, Homo sapiens
aacctcaaagtgact

SEQ ID NO: 5092043 - DNA, 14 bp, Homo sapiens
aacctcaaatatag

SEQ ID NO: 5092044 - DNA, 18 bp, Homo sapiens
aacctcaatttatgttaa

SEQ ID NO: 5092045 - DNA, 20 bp, Homo sapiens
aacctcacactactgtattt

SEQ ID NO: 5092046 - DNA, 13 bp, Homo sapiens
aacctcaccaaac

SEQ ID NO: 5092047 - DNA, 17 bp, Homo sapiens
aacctcaccaactccta

SEQ ID NO: 5092048 - DNA, 12 bp, Homo sapiens
aacctcaccatt

SEQ ID NO: 5092049 - DNA, 21 bp, Homo sapiens
aacctcaccccgaggccctgc

SEQ ID NO: 5092050 - DNA, 21 bp, Homo sapiens
aacctcacccgaggctgccca

SEQ ID NO: 5092051 - DNA, 16 bp, Homo sapiens
aacctcactcttgcca

SEQ ID NO: 5092052 - DNA, 17 bp, Homo sapiens
aacctcactcttgccaa

SEQ ID NO: 5092053 - DNA, 20 bp, Homo sapiens
aacctcactgccctccctcg

SEQ ID NO: 5092054 - DNA, 18 bp, Homo sapiens
aacctcagagtatcttta

SEQ ID NO: 5092055 - DNA, 18 bp, Homo sapiens
aacctcagattcttcatt

SEQ ID NO: 5092056 - DNA, 15 bp, Homo sapiens
aacctcagcaacctg

SEQ ID NO: 5092057 - DNA, 12 bp, Homo sapiens
aacctcagcctg

SEQ ID NO: 5092058 - DNA, 13 bp, Homo sapiens
aacctcagcctgg

SEQ ID NO: 5092059 - DNA, 14 bp, Homo sapiens
aacctcagcctggc

SEQ ID NO: 5092060 - DNA, 20 bp, Homo sapiens
aacctcagcctggccagaca

SEQ ID NO: 5092061 - DNA, 14 bp, Homo sapiens
aacctcagctctgg

SEQ ID NO: 5092062 - DNA, 21 bp, Homo sapiens
aacctcagctctgggagagga

SEQ ID NO: 5092063 - DNA, 15 bp, Homo sapiens
aacctcaggctccta

SEQ ID NO: 5092064 - DNA, 19 bp, Homo sapiens
aacctcagggctcccaggg

SEQ ID NO: 5092065 - DNA, 13 bp, Homo sapiens
aacctcagggctg

SEQ ID NO: 5092066 - DNA, 18 bp, Homo sapiens
aacctcagggctgtccca

SEQ ID NO: 5092067 - DNA, 23 bp, Homo sapiens
aacctcagggctgtcccagcccc

SEQ ID NO: 5092068 - DNA, 14 bp, Homo sapiens
aacctcagtaattt

SEQ ID NO: 5092069 - DNA, 19 bp, Homo sapiens
aacctcagtgtcatttatg

SEQ ID NO: 5092070 - DNA, 18 bp, Homo sapiens
aacctcagttggcctctg

SEQ ID NO: 5092071 - DNA, 22 bp, Homo sapiens
aacctcatagcaaccagaggaa

SEQ ID NO: 5092072 - DNA, 14 bp, Homo sapiens
aacctcatcctctc

SEQ ID NO: 5092073 - DNA, 16 bp, Homo sapiens
aacctcatcttcttca

SEQ ID NO: 5092074 - DNA, 20 bp, Homo sapiens
aacctcatggagtcatcttg

SEQ ID NO: 5092075 - DNA, 14 bp, Homo sapiens
aacctcattcccca

SEQ ID NO: 5092076 - DNA, 21 bp, Homo sapiens
aacctcattgacaagaactga

SEQ ID NO: 5092077 - DNA, 19 bp, Homo sapiens
aacctcattgctaccacag

SEQ ID NO: 5092078 - DNA, 16 bp, Homo sapiens
aacctcattgttctgt

SEQ ID NO: 5092079 - DNA, 16 bp, Homo sapiens
aacctcatttaccata

SEQ ID NO: 5092080 - DNA, 21 bp, Homo sapiens
aacctccacagtagcatttct

SEQ ID NO: 5092081 - DNA, 22 bp, Homo sapiens
aacctccacatcccatgttgaa

SEQ ID NO: 5092082 - DNA, 19 bp, Homo sapiens
aacctccacctcccgggtt

SEQ ID NO: 5092083 - DNA, 16 bp, Homo sapiens
aacctccacctccggg

SEQ ID NO: 5092084 - DNA, 13 bp, Homo sapiens
aacctccagactc

SEQ ID NO: 5092085 - DNA, 19 bp, Homo sapiens
aacctccagcctccctgtc

SEQ ID NO: 5092086 - DNA, 22 bp, Homo sapiens
aacctccattctattttagaat

SEQ ID NO: 5092087 - DNA, 17 bp, Homo sapiens
aacctcccagaggtcca

SEQ ID NO: 5092088 - DNA, 21 bp, Homo sapiens
aacctcccagaggtccagccc

SEQ ID NO: 5092089 - DNA, 24 bp, Homo sapiens
aacctcccagaggtccagcccatc

SEQ ID NO: 5092090 - DNA, 17 bp, Homo sapiens
aacctcccctggtcctg

SEQ ID NO: 5092091 - DNA, 19 bp, Homo sapiens
aacctccctcaacaaggta

SEQ ID NO: 5092092 - DNA, 21 bp, Homo sapiens
aacctccctcaacaaggtata

SEQ ID NO: 5092093 - DNA, 16 bp, Homo sapiens
aacctccctcctttcc

SEQ ID NO: 5092094 - DNA, 13 bp, Homo sapiens
aacctccctcttg

SEQ ID NO: 5092095 - DNA, 14 bp, Homo sapiens
aacctccctcttgt

SEQ ID NO: 5092096 - DNA, 23 bp, Homo sapiens
aacctccctcttgttttgtttgt

SEQ ID NO: 5092097 - DNA, 19 bp, Homo sapiens
aacctccctgggcctgtct

SEQ ID NO: 5092098 - DNA, 21 bp, Homo sapiens
aacctccctgggcctgtctca

SEQ ID NO: 5092099 - DNA, 22 bp, Homo sapiens
aacctcccttaagcagcaacag

SEQ ID NO: 5092100 - DNA, 19 bp, Homo sapiens
aacctccgcctcccgggtt

SEQ ID NO: 5092101 - DNA, 18 bp, Homo sapiens
aacctccgtgctgggctt

SEQ ID NO: 5092102 - DNA, 13 bp, Homo sapiens
aacctcctctgtg

SEQ ID NO: 5092103 - DNA, 14 bp, Homo sapiens
aacctcctctgtga

SEQ ID NO: 5092104 - DNA, 11 bp, Homo sapiens
aacctcctgct

SEQ ID NO: 5092105 - DNA, 13 bp, Homo sapiens
aacctcctgggtt

SEQ ID NO: 5092106 - DNA, 21 bp, Homo sapiens
aacctcctgttagctgttatt

SEQ ID NO: 5092107 - DNA, 18 bp, Homo sapiens
aacctcctttctcttctc

SEQ ID NO: 5092108 - DNA, 21 bp, Homo sapiens
aacctcgaggtttctcaaaga

SEQ ID NO: 5092109 - DNA, 17 bp, Homo sapiens
aacctcgagtactgtgg

SEQ ID NO: 5092110 - DNA, 14 bp, Homo sapiens
aacctcgctggact

SEQ ID NO: 5092111 - DNA, 14 bp, Homo sapiens
aacctcggggtggg

SEQ ID NO: 5092112 - DNA, 18 bp, Homo sapiens
aacctctaagtgctgctg

SEQ ID NO: 5092113 - DNA, 19 bp, Homo sapiens
aacctctaagtgctgctgt

SEQ ID NO: 5092114 - DNA, 17 bp, Homo sapiens
aacctctactgaaaaca

SEQ ID NO: 5092115 - DNA, 14 bp, Homo sapiens
aacctctatatgtt

SEQ ID NO: 5092116 - DNA, 13 bp, Homo sapiens
aacctctcagcac

SEQ ID NO: 5092117 - DNA, 21 bp, Homo sapiens
aacctctcctcatgttctgct

SEQ ID NO: 5092118 - DNA, 13 bp, Homo sapiens
aacctctccttcc

SEQ ID NO: 5092119 - DNA, 15 bp, Homo sapiens
aacctctccttcctc

SEQ ID NO: 5092120 - DNA, 16 bp, Homo sapiens
aacctctcgccatgat

SEQ ID NO: 5092121 - DNA, 15 bp, Homo sapiens
aacctctctaagcca

SEQ ID NO: 5092122 - DNA, 17 bp, Homo sapiens
aacctctctaagccaca

SEQ ID NO: 5092123 - DNA, 19 bp, Homo sapiens
aacctctctgaactgcaac

SEQ ID NO: 5092124 - DNA, 23 bp, Homo sapiens
aacctctctgatcttgtgctcag

SEQ ID NO: 5092125 - DNA, 20 bp, Homo sapiens
aacctctgatttattttgta

SEQ ID NO: 5092126 - DNA, 19 bp, Homo sapiens
aacctctgcctcccgggtt

SEQ ID NO: 5092127 - DNA, 16 bp, Homo sapiens
aacctctgcctcctgg

SEQ ID NO: 5092128 - DNA, 17 bp, Homo sapiens
aacctctgcctcctggg

SEQ ID NO: 5092129 - DNA, 20 bp, Homo sapiens
aacctctgcctcctgggttc

SEQ ID NO: 5092130 - DNA, 20 bp, Homo sapiens
aacctctgcttcccaggttc

SEQ ID NO: 5092131 - DNA, 15 bp, Homo sapiens
aacctctggcccttg

SEQ ID NO: 5092132 - DNA, 18 bp, Homo sapiens
aacctctggcccttggaa

SEQ ID NO: 5092133 - DNA, 23 bp, Homo sapiens
aacctctggcccttggaataaag

SEQ ID NO: 5092134 - DNA, 21 bp, Homo sapiens
aacctctgtattagtttttga

SEQ ID NO: 5092135 - DNA, 16 bp, Homo sapiens
aacctctgtctcatcc

SEQ ID NO: 5092136 - DNA, 23 bp, Homo sapiens
aacctctgtggtcacccatgcat

SEQ ID NO: 5092137 - DNA, 12 bp, Homo sapiens
aacctctgttca

SEQ ID NO: 5092138 - DNA, 15 bp, Homo sapiens
aacctctgttcagtg

SEQ ID NO: 5092139 - DNA, 19 bp, Homo sapiens
aacctctgttccccaccca

SEQ ID NO: 5092140 - DNA, 14 bp, Homo sapiens
aacctcttatcact

SEQ ID NO: 5092141 - DNA, 15 bp, Homo sapiens
aacctcttatcacta

SEQ ID NO: 5092142 - DNA, 19 bp, Homo sapiens
aacctcttatcactaagaa

SEQ ID NO: 5092143 - DNA, 19 bp, Homo sapiens
aacctcttcctaggccacg

SEQ ID NO: 5092144 - DNA, 12 bp, Homo sapiens
aacctcttcctc

SEQ ID NO: 5092145 - DNA, 16 bp, Homo sapiens
aacctcttcctcctgg

SEQ ID NO: 5092146 - DNA, 17 bp, Homo sapiens
aacctcttctggctcaa

SEQ ID NO: 5092147 - DNA, 17 bp, Homo sapiens
aactaagttgtatttta

SEQ ID NO: 5092148 - DNA, 20 bp, Homo sapiens
aactaagttttgtgtgtata

SEQ ID NO: 5092149 - DNA, 14 bp, Homo sapiens
aactaataaaagca

SEQ ID NO: 5092150 - DNA, 22 bp, Homo sapiens
aactaataaaatattttctgtg

SEQ ID NO: 5092151 - DNA, 22 bp, Homo sapiens
aactaatacgtgccagatataa

SEQ ID NO: 5092152 - DNA, 13 bp, Homo sapiens
aactaatcaagag

SEQ ID NO: 5092153 - DNA, 21 bp, Homo sapiens
aactaatcaagagtgagtgaa

SEQ ID NO: 5092154 - DNA, 22 bp, Homo sapiens
aactaatctattgggttcatta

SEQ ID NO: 5092155 - DNA, 14 bp, Homo sapiens
aactaatgaacaaa

SEQ ID NO: 5092156 - DNA, 18 bp, Homo sapiens
aactaatgaattgaaatt

SEQ ID NO: 5092157 - DNA, 18 bp, Homo sapiens
aactaatgacaagtgact

SEQ ID NO: 5092158 - DNA, 12 bp, Homo sapiens
aactaatgagtt

SEQ ID NO: 5092159 - DNA, 11 bp, Homo sapiens
aactaatgtaa

SEQ ID NO: 5092160 - DNA, 16 bp, Homo sapiens
aactaatgtaaatatt

SEQ ID NO: 5092161 - DNA, 12 bp, Homo sapiens
aactaatgtact

SEQ ID NO: 5092162 - DNA, 14 bp, Homo sapiens
aactaatgtactgt

SEQ ID NO: 5092163 - DNA, 22 bp, Homo sapiens
aactaatgtactgtacataaat

SEQ ID NO: 5092164 - DNA, 14 bp, Homo sapiens
aactaatgtttgaa

SEQ ID NO: 5092165 - DNA, 17 bp, Homo sapiens
aactaattataatgcaa

SEQ ID NO: 5092166 - DNA, 17 bp, Homo sapiens
aactaattgtatttagt

SEQ ID NO: 5092167 - DNA, 15 bp, Homo sapiens
aactaatttagtaat

SEQ ID NO: 5092168 - DNA, 11 bp, Homo sapiens
aactaatttct

SEQ ID NO: 5092169 - DNA, 20 bp, Homo sapiens
aactaatttggtttttactc

SEQ ID NO: 5092170 - DNA, 14 bp, Homo sapiens
aactaatttgtggt

SEQ ID NO: 5092171 - DNA, 22 bp, Homo sapiens
aactaatttgtggtaaagtagt

SEQ ID NO: 5092172 - DNA, 19 bp, Homo sapiens
aactaattttaaagtaaaa

SEQ ID NO: 5092173 - DNA, 19 bp, Homo sapiens
aactaattttgttgaaaat

SEQ ID NO: 5092174 - DNA, 23 bp, Homo sapiens
aactaatttttatttttgctgag

SEQ ID NO: 5092175 - DNA, 13 bp, Homo sapiens
aactaatttttgt

SEQ ID NO: 5092176 - DNA, 15 bp, Homo sapiens
aactacaaacaaaat

SEQ ID NO: 5092177 - DNA, 17 bp, Homo sapiens
aactacaaaggtttaaa

SEQ ID NO: 5092178 - DNA, 20 bp, Homo sapiens
aactacaaccaatggaatgt

SEQ ID NO: 5092179 - DNA, 12 bp, Homo sapiens
aactacagaaaa

SEQ ID NO: 5092180 - DNA, 19 bp, Homo sapiens
aactacagaaaaaccagag

SEQ ID NO: 5092181 - DNA, 18 bp, Homo sapiens
aactacagaatattaaat

SEQ ID NO: 5092182 - DNA, 21 bp, Homo sapiens
aactacagaatattaaatatt

SEQ ID NO: 5092183 - DNA, 16 bp, Homo sapiens
aactacagccaaattg

SEQ ID NO: 5092184 - DNA, 13 bp, Homo sapiens
aactacagtggct

SEQ ID NO: 5092185 - DNA, 17 bp, Homo sapiens
aactacataaaaataga

SEQ ID NO: 5092186 - DNA, 20 bp, Homo sapiens
aactacatacgcaaaaactt

SEQ ID NO: 5092187 - DNA, 17 bp, Homo sapiens
aactacatatttgtgcc

SEQ ID NO: 5092188 - DNA, 14 bp, Homo sapiens
aactacattaaaag

SEQ ID NO: 5092189 - DNA, 22 bp, Homo sapiens
aactacattaaaagctttagat

SEQ ID NO: 5092190 - DNA, 14 bp, Homo sapiens
aactacattttaac

SEQ ID NO: 5092191 - DNA, 15 bp, Homo sapiens
aactacattttaaca

SEQ ID NO: 5092192 - DNA, 13 bp, Homo sapiens
aactaccaaatta

SEQ ID NO: 5092193 - DNA, 22 bp, Homo sapiens
aactaccaccctcgctgccacc

SEQ ID NO: 5092194 - DNA, 13 bp, Homo sapiens
aactaccacctca

SEQ ID NO: 5092195 - DNA, 17 bp, Homo sapiens
aactaccacctgacatt

SEQ ID NO: 5092196 - DNA, 22 bp, Homo sapiens
aactaccactttttttaaccat

SEQ ID NO: 5092197 - DNA, 14 bp, Homo sapiens
aactaccaggaata

SEQ ID NO: 5092198 - DNA, 15 bp, Homo sapiens
aactaccaggtggca

SEQ ID NO: 5092199 - DNA, 19 bp, Homo sapiens
aactaccagtgggcatgta

SEQ ID NO: 5092200 - DNA, 22 bp, Homo sapiens
aactaccagtgggcatgtatta

SEQ ID NO: 5092201 - DNA, 16 bp, Homo sapiens
aactacccaaaacaag

SEQ ID NO: 5092202 - DNA, 21 bp, Homo sapiens
aactaccctacacctctgggc

SEQ ID NO: 5092203 - DNA, 17 bp, Homo sapiens
aactacccttaattact

SEQ ID NO: 5092204 - DNA, 18 bp, Homo sapiens
aactacccttaattactt

SEQ ID NO: 5092205 - DNA, 21 bp, Homo sapiens
aactacccttaattacttaaa

SEQ ID NO: 5092206 - DNA, 17 bp, Homo sapiens
aactacctaaaataaat

SEQ ID NO: 5092207 - DNA, 13 bp, Homo sapiens
aactacctatatt

SEQ ID NO: 5092208 - DNA, 15 bp, Homo sapiens
aactacctatcctta

SEQ ID NO: 5092209 - DNA, 12 bp, Homo sapiens
aactacctcctc

SEQ ID NO: 5092210 - DNA, 13 bp, Homo sapiens
aactacctctgga

SEQ ID NO: 5092211 - DNA, 15 bp, Homo sapiens
aactacctgtattta

SEQ ID NO: 5092212 - DNA, 23 bp, Homo sapiens
aactacctgtatttaaaaataga

SEQ ID NO: 5092213 - DNA, 16 bp, Homo sapiens
aactacggttgggaga

SEQ ID NO: 5092214 - DNA, 18 bp, Homo sapiens
aactactaagaataaata

SEQ ID NO: 5092215 - DNA, 21 bp, Homo sapiens
aactactaagaataaataaag

SEQ ID NO: 5092216 - DNA, 15 bp, Homo sapiens
aactactaatctcaa

SEQ ID NO: 5092217 - DNA, 18 bp, Homo sapiens
aactactaatctcaattt

SEQ ID NO: 5092218 - DNA, 20 bp, Homo sapiens
aactactaatctcaatttaa

SEQ ID NO: 5092219 - DNA, 20 bp, Homo sapiens
aactactactggtgatgcct

SEQ ID NO: 5092220 - DNA, 22 bp, Homo sapiens
aactactatccaacttatattt

SEQ ID NO: 5092221 - DNA, 13 bp, Homo sapiens
aactactctttga

SEQ ID NO: 5092222 - DNA, 14 bp, Homo sapiens
aactactctttgat

SEQ ID NO: 5092223 - DNA, 12 bp, Homo sapiens
aactactgaata

SEQ ID NO: 5092224 - DNA, 18 bp, Homo sapiens
aactactgaataaatcat

SEQ ID NO: 5092225 - DNA, 23 bp, Homo sapiens
aactactgaatgaagcagtattt

SEQ ID NO: 5092226 - DNA, 16 bp, Homo sapiens
aactactgcaaaaagt

SEQ ID NO: 5092227 - DNA, 17 bp, Homo sapiens
aactactgcctttagaa

SEQ ID NO: 5092228 - DNA, 19 bp, Homo sapiens
aactactgcctttagaaaa

SEQ ID NO: 5092229 - DNA, 16 bp, Homo sapiens
aactactgctaatgtt

SEQ ID NO: 5092230 - DNA, 23 bp, Homo sapiens
aactactgctattttttttaaat

SEQ ID NO: 5092231 - DNA, 17 bp, Homo sapiens
aactactgtagaactga

SEQ ID NO: 5092232 - DNA, 21 bp, Homo sapiens
aactactgtagaactgatttt

SEQ ID NO: 5092233 - DNA, 17 bp, Homo sapiens
aactactgtagaagaag

SEQ ID NO: 5092234 - DNA, 14 bp, Homo sapiens
aactactgtgttcc

SEQ ID NO: 5092235 - DNA, 15 bp, Homo sapiens
aactactgtgttcct

SEQ ID NO: 5092236 - DNA, 17 bp, Homo sapiens
aactactgtgttcctgg

SEQ ID NO: 5092237 - DNA, 15 bp, Homo sapiens
aactacttcattttc

SEQ ID NO: 5092238 - DNA, 14 bp, Homo sapiens
aactactttactaa

SEQ ID NO: 5092239 - DNA, 13 bp, Homo sapiens
aactactttataa

SEQ ID NO: 5092240 - DNA, 23 bp, Homo sapiens
aactactttgaaaacaattcagt

SEQ ID NO: 5092241 - DNA, 15 bp, Homo sapiens
aactacttttctaaa

SEQ ID NO: 5092242 - DNA, 16 bp, Homo sapiens
aactagaaaattctaa

SEQ ID NO: 5092243 - DNA, 21 bp, Homo sapiens
aactagaagaaagggcaagaa

SEQ ID NO: 5092244 - DNA, 21 bp, Homo sapiens
aactagaattgttgcatccct

SEQ ID NO: 5092245 - DNA, 16 bp, Homo sapiens
aactagaatttgatta

SEQ ID NO: 5092246 - DNA, 18 bp, Homo sapiens
aactagacattattttgt

SEQ ID NO: 5092247 - DNA, 17 bp, Homo sapiens
aactagagactctgtga

SEQ ID NO: 5092248 - DNA, 19 bp, Homo sapiens
aactagagactctgtgatc

SEQ ID NO: 5092249 - DNA, 21 bp, Homo sapiens
aactagagatgtgcaattgat

SEQ ID NO: 5092250 - DNA, 16 bp, Homo sapiens
aactagagcagccctg

SEQ ID NO: 5092251 - DNA, 20 bp, Homo sapiens
aactagaggtgagaaattta

SEQ ID NO: 5092252 - DNA, 21 bp, Homo sapiens
aactagaggtgagaaatttaa

SEQ ID NO: 5092253 - DNA, 22 bp, Homo sapiens
aactagaggtgttacagaggac

SEQ ID NO: 5092254 - DNA, 15 bp, Homo sapiens
aactagagtatgtgt

SEQ ID NO: 5092255 - DNA, 17 bp, Homo sapiens
aactagatactgttgat

SEQ ID NO: 5092256 - DNA, 20 bp, Homo sapiens
aactagatctcctatttttc

SEQ ID NO: 5092257 - DNA, 19 bp, Homo sapiens
aactagatctcctgtaatt

SEQ ID NO: 5092258 - DNA, 22 bp, Homo sapiens
aactagatctcctgtaattttg

SEQ ID NO: 5092259 - DNA, 17 bp, Homo sapiens
aactagatgacctcatt

SEQ ID NO: 5092260 - DNA, 18 bp, Homo sapiens
aactagatgacctcatta

SEQ ID NO: 5092261 - DNA, 20 bp, Homo sapiens
aactagattacattcagttg

SEQ ID NO: 5092262 - DNA, 15 bp, Homo sapiens
aactagatttgtcct

SEQ ID NO: 5092263 - DNA, 22 bp, Homo sapiens
aactagcaaaaggatgatttaa

SEQ ID NO: 5092264 - DNA, 18 bp, Homo sapiens
aactagcataagtggttt

SEQ ID NO: 5092265 - DNA, 22 bp, Homo sapiens
aactagcataagtggttttctt

SEQ ID NO: 5092266 - DNA, 14 bp, Homo sapiens
aactagccaaggct

SEQ ID NO: 5092267 - DNA, 18 bp, Homo sapiens
aactagccaccaactctt

SEQ ID NO: 5092268 - DNA, 13 bp, Homo sapiens
aactagcccctgg

SEQ ID NO: 5092269 - DNA, 16 bp, Homo sapiens
aactagcccctggggt

SEQ ID NO: 5092270 - DNA, 14 bp, Homo sapiens
aactagcctcatct

SEQ ID NO: 5092271 - DNA, 22 bp, Homo sapiens
aactagctgggactacaggtgc

SEQ ID NO: 5092272 - DNA, 22 bp, Homo sapiens
aactagcttacatgagaacaga

SEQ ID NO: 5092273 - DNA, 15 bp, Homo sapiens
aactagctttgctct

SEQ ID NO: 5092274 - DNA, 15 bp, Homo sapiens
aactaggaaaattgg

SEQ ID NO: 5092275 - DNA, 23 bp, Homo sapiens
aactaggaaggcacttctgcctg

SEQ ID NO: 5092276 - DNA, 15 bp, Homo sapiens
aactaggaagtggct

SEQ ID NO: 5092277 - DNA, 22 bp, Homo sapiens
aactaggagctttgactcagga

SEQ ID NO: 5092278 - DNA, 15 bp, Homo sapiens
aactaggaggaaaag

SEQ ID NO: 5092279 - DNA, 17 bp, Homo sapiens
aactaggcaaaaagaag

SEQ ID NO: 5092280 - DNA, 15 bp, Homo sapiens
aactaggcatttgta

SEQ ID NO: 5092281 - DNA, 15 bp, Homo sapiens
aactaggctccttca

SEQ ID NO: 5092282 - DNA, 17 bp, Homo sapiens
aactagggaagataata

SEQ ID NO: 5092283 - DNA, 17 bp, Homo sapiens
aactagggccaagccca

SEQ ID NO: 5092284 - DNA, 14 bp, Homo sapiens
aactaggtaactta

SEQ ID NO: 5092285 - DNA, 14 bp, Homo sapiens
aactaggtaatgtt

SEQ ID NO: 5092286 - DNA, 20 bp, Homo sapiens
aactaggtaatgttttgtat

SEQ ID NO: 5092287 - DNA, 21 bp, Homo sapiens
aactaggtaatgttttgtata

SEQ ID NO: 5092288 - DNA, 14 bp, Homo sapiens
aactaggtatttaa

SEQ ID NO: 5092289 - DNA, 14 bp, Homo sapiens
aactaggtgctggc

SEQ ID NO: 5092290 - DNA, 15 bp, Homo sapiens
aactaggtgctggca

SEQ ID NO: 5092291 - DNA, 17 bp, Homo sapiens
aactaggtgctggcatg

SEQ ID NO: 5092292 - DNA, 18 bp, Homo sapiens
aactaggtttttgcttct

SEQ ID NO: 5092293 - DNA, 11 bp, Homo sapiens
aactagtaata

SEQ ID NO: 5092294 - DNA, 17 bp, Homo sapiens
aactagtaataccaaag

SEQ ID NO: 5092295 - DNA, 23 bp, Homo sapiens
aactagtactcaaggtttaacct

SEQ ID NO: 5092296 - DNA, 21 bp, Homo sapiens
aactagtagaagaagctttgc

SEQ ID NO: 5092297 - DNA, 16 bp, Homo sapiens
aactagtatcatttta

SEQ ID NO: 5092298 - DNA, 19 bp, Homo sapiens
aactagtggggcttaatga

SEQ ID NO: 5092299 - DNA, 23 bp, Homo sapiens
aactagtggggtttcctggcact

SEQ ID NO: 5092300 - DNA, 18 bp, Homo sapiens
aactagtgtttctgcaga

SEQ ID NO: 5092301 - DNA, 21 bp, Homo sapiens
aactagttactaaacatgtat

SEQ ID NO: 5092302 - DNA, 14 bp, Homo sapiens
aactagttatttta

SEQ ID NO: 5092303 - DNA, 12 bp, Homo sapiens
aactagttctta

SEQ ID NO: 5092304 - DNA, 13 bp, Homo sapiens
aactagtttccag

SEQ ID NO: 5092305 - DNA, 14 bp, Homo sapiens
aactagttttgttt

SEQ ID NO: 5092306 - DNA, 18 bp, Homo sapiens
aactagtttttatagcta

SEQ ID NO: 5092307 - DNA, 20 bp, Homo sapiens
aactataaaactaggtgctg

SEQ ID NO: 5092308 - DNA, 16 bp, Homo sapiens
aactataaactactgt

SEQ ID NO: 5092309 - DNA, 19 bp, Homo sapiens
aactataaactactgtaat

SEQ ID NO: 5092310 - DNA, 14 bp, Homo sapiens
aactataaacttaa

SEQ ID NO: 5092311 - DNA, 12 bp, Homo sapiens
aactataaatac

SEQ ID NO: 5092312 - DNA, 17 bp, Homo sapiens
aactataacaatcactg

SEQ ID NO: 5092313 - DNA, 14 bp, Homo sapiens
aactataacattat

SEQ ID NO: 5092314 - DNA, 19 bp, Homo sapiens
aactataacattatataac

SEQ ID NO: 5092315 - DNA, 20 bp, Homo sapiens
aactataacattatataaca

SEQ ID NO: 5092316 - DNA, 20 bp, Homo sapiens
aactataagatacaataaaa

SEQ ID NO: 5092317 - DNA, 23 bp, Homo sapiens
aactataaggtgcctcagttttc

SEQ ID NO: 5092318 - DNA, 13 bp, Homo sapiens
aactatataaatg

SEQ ID NO: 5092319 - DNA, 18 bp, Homo sapiens
aactatataaatgacatt

SEQ ID NO: 5092320 - DNA, 21 bp, Homo sapiens
aactatataaatgacattatt

SEQ ID NO: 5092321 - DNA, 20 bp, Homo sapiens
aactatataagacattaaga

SEQ ID NO: 5092322 - DNA, 24 bp, Homo sapiens
aactatatataatcatcaagtaat

SEQ ID NO: 5092323 - DNA, 23 bp, Homo sapiens
aactatatgtacagctctcccct

SEQ ID NO: 5092324 - DNA, 21 bp, Homo sapiens
aactatattgcgagaaacaga

SEQ ID NO: 5092325 - DNA, 22 bp, Homo sapiens
aactatatttaataccaccaac

SEQ ID NO: 5092326 - DNA, 16 bp, Homo sapiens
aacctctttgtctaca

SEQ ID NO: 5092327 - DNA, 15 bp, Homo sapiens
aacctctttttcctc

SEQ ID NO: 5092328 - DNA, 11 bp, Homo sapiens
aacctgaaaaa

SEQ ID NO: 5092329 - DNA, 22 bp, Homo sapiens
aacctgaaaagatgttgtgtct

SEQ ID NO: 5092330 - DNA, 12 bp, Homo sapiens
aacctgaaatat

SEQ ID NO: 5092331 - DNA, 14 bp, Homo sapiens
aacctgaagatgtc

SEQ ID NO: 5092332 - DNA, 20 bp, Homo sapiens
aacctgaaggtcccctggca

SEQ ID NO: 5092333 - DNA, 20 bp, Homo sapiens
aacctgaattaaagtctaca

SEQ ID NO: 5092334 - DNA, 14 bp, Homo sapiens
aacctgaattattc

SEQ ID NO: 5092335 - DNA, 17 bp, Homo sapiens
aacctgaattattccaa

SEQ ID NO: 5092336 - DNA, 17 bp, Homo sapiens
aacctgagatggagctg

SEQ ID NO: 5092337 - DNA, 16 bp, Homo sapiens
aacctgagatggccct

SEQ ID NO: 5092338 - DNA, 21 bp, Homo sapiens
aacctgagatggccctctggt

SEQ ID NO: 5092339 - DNA, 21 bp, Homo sapiens
aacctgagatttattaaagaa

SEQ ID NO: 5092340 - DNA, 21 bp, Homo sapiens
aacctgagctattttcctctg

SEQ ID NO: 5092341 - DNA, 22 bp, Homo sapiens
aacctgagctattttcctctgg

SEQ ID NO: 5092342 - DNA, 22 bp, Homo sapiens
aacctgaggatgcaacaaatat

SEQ ID NO: 5092343 - DNA, 18 bp, Homo sapiens
aacctgaggccaaatatt

SEQ ID NO: 5092344 - DNA, 16 bp, Homo sapiens
aacctgatcacttttc

SEQ ID NO: 5092345 - DNA, 19 bp, Homo sapiens
aacctgatgaaaataaaga

SEQ ID NO: 5092346 - DNA, 21 bp, Homo sapiens
aacctgatgaaaataaagaat

SEQ ID NO: 5092347 - DNA, 23 bp, Homo sapiens
aacctgatgaaaataaagaatgg

SEQ ID NO: 5092348 - DNA, 15 bp, Homo sapiens
aacctgatgctgact

SEQ ID NO: 5092349 - DNA, 23 bp, Homo sapiens
aacctgatgctggggacacagca

SEQ ID NO: 5092350 - DNA, 18 bp, Homo sapiens
aacctgattgtaaacttc

SEQ ID NO: 5092351 - DNA, 15 bp, Homo sapiens
aacctgcaaggcaaa

SEQ ID NO: 5092352 - DNA, 19 bp, Homo sapiens
aacctgcaagggctcccca

SEQ ID NO: 5092353 - DNA, 22 bp, Homo sapiens
aacctgcaagggctccccactg

SEQ ID NO: 5092354 - DNA, 19 bp, Homo sapiens
aacctgcaagttgctctga

SEQ ID NO: 5092355 - DNA, 13 bp, Homo sapiens
aacctgcacacag

SEQ ID NO: 5092356 - DNA, 22 bp, Homo sapiens
aacctgcagttcctgagtacct

SEQ ID NO: 5092357 - DNA, 17 bp, Homo sapiens
aacctgcatttaagaac

SEQ ID NO: 5092358 - DNA, 18 bp, Homo sapiens
aacctgcatttaagaaca

SEQ ID NO: 5092359 - DNA, 16 bp, Homo sapiens
aacctgccaaggagca

SEQ ID NO: 5092360 - DNA, 15 bp, Homo sapiens
aacctgccacaatgt

SEQ ID NO: 5092361 - DNA, 16 bp, Homo sapiens
aacctgccacaatgtg

SEQ ID NO: 5092362 - DNA, 22 bp, Homo sapiens
aacctgccacaatgtgatatgt

SEQ ID NO: 5092363 - DNA, 15 bp, Homo sapiens
aacctgccagggaga

SEQ ID NO: 5092364 - DNA, 22 bp, Homo sapiens
aacctgcccctccccagccctt

SEQ ID NO: 5092365 - DNA, 21 bp, Homo sapiens
aacctgcctaaattaaattgg

SEQ ID NO: 5092366 - DNA, 18 bp, Homo sapiens
aacctgcctttgtatgtg

SEQ ID NO: 5092367 - DNA, 17 bp, Homo sapiens
aacctgcggaaggaggt

SEQ ID NO: 5092368 - DNA, 13 bp, Homo sapiens
aacctgctccctt

SEQ ID NO: 5092369 - DNA, 22 bp, Homo sapiens
aacctgctcccttcgctctgct

SEQ ID NO: 5092370 - DNA, 23 bp, Homo sapiens
aacctgctcccttcgctctgctg

SEQ ID NO: 5092371 - DNA, 11 bp, Homo sapiens
aacctgctctc

SEQ ID NO: 5092372 - DNA, 13 bp, Homo sapiens
aacctgctctcct

SEQ ID NO: 5092373 - DNA, 20 bp, Homo sapiens
aacctgctctcctcttgcca

SEQ ID NO: 5092374 - DNA, 19 bp, Homo sapiens
aacctgctggatgggactc

SEQ ID NO: 5092375 - DNA, 21 bp, Homo sapiens
aacctgctggatgggactcca

SEQ ID NO: 5092376 - DNA, 13 bp, Homo sapiens
aacctgcttcctg

SEQ ID NO: 5092377 - DNA, 13 bp, Homo sapiens
aacctgcttcctt

SEQ ID NO: 5092378 - DNA, 19 bp, Homo sapiens
aacctggaaaaattccaga

SEQ ID NO: 5092379 - DNA, 11 bp, Homo sapiens
aacctggaaag

SEQ ID NO: 5092380 - DNA, 16 bp, Homo sapiens
aacctggaaatgatgt

SEQ ID NO: 5092381 - DNA, 22 bp, Homo sapiens
aacctggaatctacaagccaaa

SEQ ID NO: 5092382 - DNA, 15 bp, Homo sapiens
aacctggacttcctg

SEQ ID NO: 5092383 - DNA, 16 bp, Homo sapiens
aacctggacttcctgt

SEQ ID NO: 5092384 - DNA, 14 bp, Homo sapiens
aacctggagatgat

SEQ ID NO: 5092385 - DNA, 17 bp, Homo sapiens
aacctggagatgatgat

SEQ ID NO: 5092386 - DNA, 19 bp, Homo sapiens
aacctggagatgatgatga

SEQ ID NO: 5092387 - DNA, 17 bp, Homo sapiens
aacctggagatggtgga

SEQ ID NO: 5092388 - DNA, 10 bp, Homo sapiens
aacctggagg

SEQ ID NO: 5092389 - DNA, 23 bp, Homo sapiens
aacctggaggctggaccaactgc

SEQ ID NO: 5092390 - DNA, 16 bp, Homo sapiens
aacctggatccagcac

SEQ ID NO: 5092391 - DNA, 17 bp, Homo sapiens
aacctggatccagcact

SEQ ID NO: 5092392 - DNA, 19 bp, Homo sapiens
aacctggattttttaaatc

SEQ ID NO: 5092393 - DNA, 16 bp, Homo sapiens
aacctggcaggccctg

SEQ ID NO: 5092394 - DNA, 19 bp, Homo sapiens
aacctggcataggactctt

SEQ ID NO: 5092395 - DNA, 15 bp, Homo sapiens
aacctggccactgtc

SEQ ID NO: 5092396 - DNA, 16 bp, Homo sapiens
aacctggccagaggca

SEQ ID NO: 5092397 - DNA, 12 bp, Homo sapiens
aacctggccttc

SEQ ID NO: 5092398 - DNA, 15 bp, Homo sapiens
aacctggctctggcc

SEQ ID NO: 5092399 - DNA, 11 bp, Homo sapiens
aacctggctgc

SEQ ID NO: 5092400 - DNA, 10 bp, Homo sapiens
aacctggctt

SEQ ID NO: 5092401 - DNA, 17 bp, Homo sapiens
aacctgggaaggccagc

SEQ ID NO: 5092402 - DNA, 20 bp, Homo sapiens
aacctgggaaggccagcctt

SEQ ID NO: 5092403 - DNA, 23 bp, Homo sapiens
aacctgggaaggccagccttgta

SEQ ID NO: 5092404 - DNA, 11 bp, Homo sapiens
aacctgggacc

SEQ ID NO: 5092405 - DNA, 21 bp, Homo sapiens
aacctgggaccaacctgacct

SEQ ID NO: 5092406 - DNA, 17 bp, Homo sapiens
aacctgggattcaggaa

SEQ ID NO: 5092407 - DNA, 17 bp, Homo sapiens
aacctgggctgtgctgc

SEQ ID NO: 5092408 - DNA, 21 bp, Homo sapiens
aacctggggtgaatacttatt

SEQ ID NO: 5092409 - DNA, 23 bp, Homo sapiens
aacctggggtgaatacttatttt

SEQ ID NO: 5092410 - DNA, 20 bp, Homo sapiens
aacctgggtatgttcctaag

SEQ ID NO: 5092411 - DNA, 18 bp, Homo sapiens
aacctgggtccaaataaa

SEQ ID NO: 5092412 - DNA, 22 bp, Homo sapiens
aacctgggtccaaataaaaact

SEQ ID NO: 5092413 - DNA, 20 bp, Homo sapiens
aacctgggttgcagacagga

SEQ ID NO: 5092414 - DNA, 21 bp, Homo sapiens
aacctggtgcatcgaaatgta

SEQ ID NO: 5092415 - DNA, 21 bp, Homo sapiens
aacctggtggcaccagatgca

SEQ ID NO: 5092416 - DNA, 16 bp, Homo sapiens
aacctgtaaattattt

SEQ ID NO: 5092417 - DNA, 17 bp, Homo sapiens
aacctgtaaattatttt

SEQ ID NO: 5092418 - DNA, 20 bp, Homo sapiens
aacctgtaagcccagcattt

SEQ ID NO: 5092419 - DNA, 18 bp, Homo sapiens
aacctgtagaagatgacc

SEQ ID NO: 5092420 - DNA, 22 bp, Homo sapiens
aacctgtagatgcagaaaaaga

SEQ ID NO: 5092421 - DNA, 17 bp, Homo sapiens
aacctgtccataaagta

SEQ ID NO: 5092422 - DNA, 21 bp, Homo sapiens
aacctgtccataaagtaattt

SEQ ID NO: 5092423 - DNA, 22 bp, Homo sapiens
aacctgtctccactgtgccttt

SEQ ID NO: 5092424 - DNA, 13 bp, Homo sapiens
aacctgtctcctc

SEQ ID NO: 5092425 - DNA, 16 bp, Homo sapiens
aacctgtcttttggga

SEQ ID NO: 5092426 - DNA, 13 bp, Homo sapiens
aacctgtgaggaa

SEQ ID NO: 5092427 - DNA, 14 bp, Homo sapiens
aacctgtgaggaag

SEQ ID NO: 5092428 - DNA, 15 bp, Homo sapiens
aacctgtgaggaaga

SEQ ID NO: 5092429 - DNA, 23 bp, Homo sapiens
aacctgtgcagtcccgtggaggg

SEQ ID NO: 5092430 - DNA, 14 bp, Homo sapiens
aacctgtgccaggc

SEQ ID NO: 5092431 - DNA, 14 bp, Homo sapiens
aacctgtgcctccc

SEQ ID NO: 5092432 - DNA, 22 bp, Homo sapiens
aacctgtggctcaggggagcaa

SEQ ID NO: 5092433 - DNA, 16 bp, Homo sapiens
aacctgtggtgtattt

SEQ ID NO: 5092434 - DNA, 12 bp, Homo sapiens
aacctgtgtctc

SEQ ID NO: 5092435 - DNA, 13 bp, Homo sapiens
aacctgtgtctta

SEQ ID NO: 5092436 - DNA, 17 bp, Homo sapiens
aacctgttacactgggc

SEQ ID NO: 5092437 - DNA, 21 bp, Homo sapiens
aacctgttacctactttgact

SEQ ID NO: 5092438 - DNA, 19 bp, Homo sapiens
aacctgttcaaaatgttaa

SEQ ID NO: 5092439 - DNA, 13 bp, Homo sapiens
aacctgttcctga

SEQ ID NO: 5092440 - DNA, 21 bp, Homo sapiens
aacctgttcctgactgttctc

SEQ ID NO: 5092441 - DNA, 23 bp, Homo sapiens
aacctgttcttagagtgtagctg

SEQ ID NO: 5092442 - DNA, 20 bp, Homo sapiens
aacctgttcttcctaccaaa

SEQ ID NO: 5092443 - DNA, 21 bp, Homo sapiens
aacctgttcttccttttttaa

SEQ ID NO: 5092444 - DNA, 22 bp, Homo sapiens
aacctgttttgttaatgctcta

SEQ ID NO: 5092445 - DNA, 12 bp, Homo sapiens
aaccttaaaaca

SEQ ID NO: 5092446 - DNA, 18 bp, Homo sapiens
aaccttaaaagtaataaa

SEQ ID NO: 5092447 - DNA, 21 bp, Homo sapiens
aaccttaaaagtaataaagag

SEQ ID NO: 5092448 - DNA, 17 bp, Homo sapiens
aaccttaaacacccctc

SEQ ID NO: 5092449 - DNA, 12 bp, Homo sapiens
aaccttaagtaa

SEQ ID NO: 5092450 - DNA, 12 bp, Homo sapiens
aaccttaatatt

SEQ ID NO: 5092451 - DNA, 13 bp, Homo sapiens
aaccttaatgtgg

SEQ ID NO: 5092452 - DNA, 22 bp, Homo sapiens
aaccttaattttacagcccttg

SEQ ID NO: 5092453 - DNA, 12 bp, Homo sapiens
aaccttaccaaa

SEQ ID NO: 5092454 - DNA, 19 bp, Homo sapiens
aaccttagggacaggtgga

SEQ ID NO: 5092455 - DNA, 17 bp, Homo sapiens
aaccttatatttacaat

SEQ ID NO: 5092456 - DNA, 21 bp, Homo sapiens
aaccttatatttacaataaat

SEQ ID NO: 5092457 - DNA, 22 bp, Homo sapiens
aaccttatcaaggattttcatg

SEQ ID NO: 5092458 - DNA, 18 bp, Homo sapiens
aaccttatcctgcattgt

SEQ ID NO: 5092459 - DNA, 19 bp, Homo sapiens
aaccttatcctgcattgtt

SEQ ID NO: 5092460 - DNA, 15 bp, Homo sapiens
aaccttattgtacct

SEQ ID NO: 5092461 - DNA, 18 bp, Homo sapiens
aaccttcaaagcttttgt

SEQ ID NO: 5092462 - DNA, 14 bp, Homo sapiens
aaccttcaacccag

SEQ ID NO: 5092463 - DNA, 19 bp, Homo sapiens
aaccttcacacacagactg

SEQ ID NO: 5092464 - DNA, 22 bp, Homo sapiens
aaccttcatgatgaattacttc

SEQ ID NO: 5092465 - DNA, 15 bp, Homo sapiens
aaccttcatgctttt

SEQ ID NO: 5092466 - DNA, 12 bp, Homo sapiens
aaccttccaaac

SEQ ID NO: 5092467 - DNA, 18 bp, Homo sapiens
aaccttccaacttcctgt

SEQ ID NO: 5092468 - DNA, 24 bp, Homo sapiens
aaccttccaagactgaagactgca

SEQ ID NO: 5092469 - DNA, 13 bp, Homo sapiens
aaccttccaccca

SEQ ID NO: 5092470 - DNA, 19 bp, Homo sapiens
aaccttcctgggaggacag

SEQ ID NO: 5092471 - DNA, 15 bp, Homo sapiens
aaccttcctgtctcc

SEQ ID NO: 5092472 - DNA, 19 bp, Homo sapiens
aaccttcctgtctcccagg

SEQ ID NO: 5092473 - DNA, 14 bp, Homo sapiens
aaccttccttccct

SEQ ID NO: 5092474 - DNA, 19 bp, Homo sapiens
aaccttccttcctgcttga

SEQ ID NO: 5092475 - DNA, 21 bp, Homo sapiens
aaccttctagaacctgggctg

SEQ ID NO: 5092476 - DNA, 18 bp, Homo sapiens
aaccttctgccctcctgc

SEQ ID NO: 5092477 - DNA, 15 bp, Homo sapiens
aaccttcttttcaat

SEQ ID NO: 5092478 - DNA, 20 bp, Homo sapiens
aaccttgaaaaaaaacagtg

SEQ ID NO: 5092479 - DNA, 18 bp, Homo sapiens
aaccttgaaaactttatg

SEQ ID NO: 5092480 - DNA, 21 bp, Homo sapiens
aaccttgaagtgactgttgta

SEQ ID NO: 5092481 - DNA, 13 bp, Homo sapiens
aaccttgaatgct

SEQ ID NO: 5092482 - DNA, 15 bp, Homo sapiens
aaccttgaatgctgc

SEQ ID NO: 5092483 - DNA, 17 bp, Homo sapiens
aaccttgaatgctgcca

SEQ ID NO: 5092484 - DNA, 19 bp, Homo sapiens
aaccttgaatgctgccagt

SEQ ID NO: 5092485 - DNA, 20 bp, Homo sapiens
aaccttgacttctgcccaaa

SEQ ID NO: 5092486 - DNA, 16 bp, Homo sapiens
aaccttgagacagctt

SEQ ID NO: 5092487 - DNA, 14 bp, Homo sapiens
aaccttgcaacggt

SEQ ID NO: 5092488 - DNA, 11 bp, Homo sapiens
aaccttgcagc

SEQ ID NO: 5092489 - DNA, 16 bp, Homo sapiens
aaccttgcctggtaca

SEQ ID NO: 5092490 - DNA, 14 bp, Homo sapiens
aaccttgctatcaa

SEQ ID NO: 5092491 - DNA, 21 bp, Homo sapiens
aaccttgctatcaagaaatgc

SEQ ID NO: 5092492 - DNA, 21 bp, Homo sapiens
aaccttgctctcctcatctcc

SEQ ID NO: 5092493 - DNA, 16 bp, Homo sapiens
aaccttgctgtcctga

SEQ ID NO: 5092494 - DNA, 20 bp, Homo sapiens
aaccttggaccactcctgtc

SEQ ID NO: 5092495 - DNA, 20 bp, Homo sapiens
aaccttggcataagacagag

SEQ ID NO: 5092496 - DNA, 17 bp, Homo sapiens
aaccttggcctgggccg

SEQ ID NO: 5092497 - DNA, 19 bp, Homo sapiens
aaccttggcttggccctgg

SEQ ID NO: 5092498 - DNA, 21 bp, Homo sapiens
aaccttgggttagacctacag

SEQ ID NO: 5092499 - DNA, 20 bp, Homo sapiens
aaccttggtgtagttgaact

SEQ ID NO: 5092500 - DNA, 21 bp, Homo sapiens
aaccttgtaaaaaaagcaaaa

SEQ ID NO: 5092501 - DNA, 22 bp, Homo sapiens
aaccttgtaaattccccttccc

SEQ ID NO: 5092502 - DNA, 23 bp, Homo sapiens
aaccttgtaaattccccttccca

SEQ ID NO: 5092503 - DNA, 16 bp, Homo sapiens
aaccttgtactttaca

SEQ ID NO: 5092504 - DNA, 13 bp, Homo sapiens
aactatattttct

SEQ ID NO: 5092505 - DNA, 16 bp, Homo sapiens
aactatattttcttta

SEQ ID NO: 5092506 - DNA, 17 bp, Homo sapiens
aactatattttgtcata

SEQ ID NO: 5092507 - DNA, 13 bp, Homo sapiens
aactatcaaaatt

SEQ ID NO: 5092508 - DNA, 22 bp, Homo sapiens
aactatcaatatttaagtttgt

SEQ ID NO: 5092509 - DNA, 13 bp, Homo sapiens
aactatcaggcag

SEQ ID NO: 5092510 - DNA, 19 bp, Homo sapiens
aactatccaattaaaatta

SEQ ID NO: 5092511 - DNA, 20 bp, Homo sapiens
aactatcccctgcgctttga

SEQ ID NO: 5092512 - DNA, 22 bp, Homo sapiens
aactatcccctgcgctttgaac

SEQ ID NO: 5092513 - DNA, 23 bp, Homo sapiens
aactatcccctgcgctttgaacg

SEQ ID NO: 5092514 - DNA, 19 bp, Homo sapiens
aactatccttctctttcaa

SEQ ID NO: 5092515 - DNA, 17 bp, Homo sapiens
aactatcggttcaagtt

SEQ ID NO: 5092516 - DNA, 20 bp, Homo sapiens
aactatctcatttccaagca

SEQ ID NO: 5092517 - DNA, 13 bp, Homo sapiens
aactatctgcatt

SEQ ID NO: 5092518 - DNA, 18 bp, Homo sapiens
aactatctgcattatcta

SEQ ID NO: 5092519 - DNA, 12 bp, Homo sapiens
aactatctgtat

SEQ ID NO: 5092520 - DNA, 13 bp, Homo sapiens
aactatcttcatc

SEQ ID NO: 5092521 - DNA, 13 bp, Homo sapiens
aactatcttgtgt

SEQ ID NO: 5092522 - DNA, 22 bp, Homo sapiens
aactatgactggagtaaaccat

SEQ ID NO: 5092523 - DNA, 23 bp, Homo sapiens
aactatgagcttgctcattaatt

SEQ ID NO: 5092524 - DNA, 16 bp, Homo sapiens
aactatgattattaac

SEQ ID NO: 5092525 - DNA, 21 bp, Homo sapiens
aactatgatttggaaaataaa

SEQ ID NO: 5092526 - DNA, 15 bp, Homo sapiens
aactatgcaagagaa

SEQ ID NO: 5092527 - DNA, 17 bp, Homo sapiens
aactatgcatggtgccc

SEQ ID NO: 5092528 - DNA, 17 bp, Homo sapiens
aactatgcctatgtagt

SEQ ID NO: 5092529 - DNA, 15 bp, Homo sapiens
aactatgctgaagag

SEQ ID NO: 5092530 - DNA, 12 bp, Homo sapiens
aactatggaaat

SEQ ID NO: 5092531 - DNA, 18 bp, Homo sapiens
aactatggatcagaatag

SEQ ID NO: 5092532 - DNA, 19 bp, Homo sapiens
aactatggtaaataactgt

SEQ ID NO: 5092533 - DNA, 13 bp, Homo sapiens
aactatgtaattt

SEQ ID NO: 5092534 - DNA, 12 bp, Homo sapiens
aactatgtacaa

SEQ ID NO: 5092535 - DNA, 15 bp, Homo sapiens
aactatgtacaatat

SEQ ID NO: 5092536 - DNA, 14 bp, Homo sapiens
aactatgtgctatc

SEQ ID NO: 5092537 - DNA, 12 bp, Homo sapiens
aactatgtgttc

SEQ ID NO: 5092538 - DNA, 23 bp, Homo sapiens
aactatgttcagaacttcatctg

SEQ ID NO: 5092539 - DNA, 18 bp, Homo sapiens
aactatgtttaaagtaat

SEQ ID NO: 5092540 - DNA, 12 bp, Homo sapiens
aactattaacct

SEQ ID NO: 5092541 - DNA, 21 bp, Homo sapiens
aactattaaggatgtagcttt

SEQ ID NO: 5092542 - DNA, 24 bp, Homo sapiens
aactattaaggatgtagcttttca

SEQ ID NO: 5092543 - DNA, 13 bp, Homo sapiens
aactattacagtg

SEQ ID NO: 5092544 - DNA, 16 bp, Homo sapiens
aactattacagtgttg

SEQ ID NO: 5092545 - DNA, 20 bp, Homo sapiens
aactattagagtatttccct

SEQ ID NO: 5092546 - DNA, 21 bp, Homo sapiens
aactattagagtatttccctt

SEQ ID NO: 5092547 - DNA, 23 bp, Homo sapiens
aactattaggaggaatgtgcttt

SEQ ID NO: 5092548 - DNA, 22 bp, Homo sapiens
aactattattaataaattttaa

SEQ ID NO: 5092549 - DNA, 12 bp, Homo sapiens
aactattcagtt

SEQ ID NO: 5092550 - DNA, 16 bp, Homo sapiens
aactattcagttgtgt

SEQ ID NO: 5092551 - DNA, 17 bp, Homo sapiens
aactattcagttgtgtt

SEQ ID NO: 5092552 - DNA, 21 bp, Homo sapiens
aactattcagttgtgtttgtt

SEQ ID NO: 5092553 - DNA, 14 bp, Homo sapiens
aactattcatgcta

SEQ ID NO: 5092554 - DNA, 16 bp, Homo sapiens
aactattccatgtttt

SEQ ID NO: 5092555 - DNA, 19 bp, Homo sapiens
aactattctgggggcccga

SEQ ID NO: 5092556 - DNA, 21 bp, Homo sapiens
aactattcttaataaaactca

SEQ ID NO: 5092557 - DNA, 14 bp, Homo sapiens
aactattgcccagg

SEQ ID NO: 5092558 - DNA, 19 bp, Homo sapiens
aactattgcctctggacgt

SEQ ID NO: 5092559 - DNA, 12 bp, Homo sapiens
aactatttaaaa

SEQ ID NO: 5092560 - DNA, 18 bp, Homo sapiens
aactatttaaaattggca

SEQ ID NO: 5092561 - DNA, 15 bp, Homo sapiens
aactatttaaagaaa

SEQ ID NO: 5092562 - DNA, 12 bp, Homo sapiens
aactatttactt

SEQ ID NO: 5092563 - DNA, 13 bp, Homo sapiens
aactatttagaga

SEQ ID NO: 5092564 - DNA, 22 bp, Homo sapiens
aactatttatatcacacaatat

SEQ ID NO: 5092565 - DNA, 13 bp, Homo sapiens
aactatttatctg

SEQ ID NO: 5092566 - DNA, 20 bp, Homo sapiens
aactatttatctgtgttttt

SEQ ID NO: 5092567 - DNA, 23 bp, Homo sapiens
aactatttatctgtgtttttgaa

SEQ ID NO: 5092568 - DNA, 16 bp, Homo sapiens
aactatttattgtgct

SEQ ID NO: 5092569 - DNA, 18 bp, Homo sapiens
aactatttcagaatattt

SEQ ID NO: 5092570 - DNA, 20 bp, Homo sapiens
aactatttcttatatatgtg

SEQ ID NO: 5092571 - DNA, 16 bp, Homo sapiens
aactatttgtataaaa

SEQ ID NO: 5092572 - DNA, 12 bp, Homo sapiens
aactattttaaa

SEQ ID NO: 5092573 - DNA, 16 bp, Homo sapiens
aactattttatgttca

SEQ ID NO: 5092574 - DNA, 20 bp, Homo sapiens
aactattttcagatgtgaac

SEQ ID NO: 5092575 - DNA, 19 bp, Homo sapiens
aactattttgagcattaga

SEQ ID NO: 5092576 - DNA, 22 bp, Homo sapiens
aactattttgttttaatctact

SEQ ID NO: 5092577 - DNA, 14 bp, Homo sapiens
aactatttttgtat

SEQ ID NO: 5092578 - DNA, 16 bp, Homo sapiens
aactatttttttagtt

SEQ ID NO: 5092579 - DNA, 15 bp, Homo sapiens
aactcaaaaggagaa

SEQ ID NO: 5092580 - DNA, 16 bp, Homo sapiens
aactcaaacacagaga

SEQ ID NO: 5092581 - DNA, 22 bp, Homo sapiens
aactcaaacttctggctccctc

SEQ ID NO: 5092582 - DNA, 23 bp, Homo sapiens
aactcaaagaatgtgtatggtat

SEQ ID NO: 5092583 - DNA, 19 bp, Homo sapiens
aactcaaagaggtaactga

SEQ ID NO: 5092584 - DNA, 20 bp, Homo sapiens
aactcaaagatgatggaaac

SEQ ID NO: 5092585 - DNA, 24 bp, Homo sapiens
aactcaaagcaagctcttctcctc

SEQ ID NO: 5092586 - DNA, 22 bp, Homo sapiens
aactcaaatggggccagatcca

SEQ ID NO: 5092587 - DNA, 21 bp, Homo sapiens
aactcaaatgtgagtgttttt

SEQ ID NO: 5092588 - DNA, 14 bp, Homo sapiens
aactcaacatttgt

SEQ ID NO: 5092589 - DNA, 16 bp, Homo sapiens
aactcaagacaatgca

SEQ ID NO: 5092590 - DNA, 12 bp, Homo sapiens
aactcaagctgc

SEQ ID NO: 5092591 - DNA, 13 bp, Homo sapiens
aactcaaggaaaa

SEQ ID NO: 5092592 - DNA, 21 bp, Homo sapiens
aactcaaggaaaagttctttc

SEQ ID NO: 5092593 - DNA, 21 bp, Homo sapiens
aactcaaggaggtggtgaatt

SEQ ID NO: 5092594 - DNA, 19 bp, Homo sapiens
aactcaagggttttccagg

SEQ ID NO: 5092595 - DNA, 14 bp, Homo sapiens
aactcaaggtggct

SEQ ID NO: 5092596 - DNA, 15 bp, Homo sapiens
aactcaatatatagt

SEQ ID NO: 5092597 - DNA, 17 bp, Homo sapiens
aactcaatatatagtta

SEQ ID NO: 5092598 - DNA, 12 bp, Homo sapiens
aactcaatattt

SEQ ID NO: 5092599 - DNA, 13 bp, Homo sapiens
aactcaatatttt

SEQ ID NO: 5092600 - DNA, 18 bp, Homo sapiens
aactcaatctaaattaaa

SEQ ID NO: 5092601 - DNA, 19 bp, Homo sapiens
aactcaatctaaattaaaa

SEQ ID NO: 5092602 - DNA, 13 bp, Homo sapiens
aactcaatgatag

SEQ ID NO: 5092603 - DNA, 18 bp, Homo sapiens
aactcaatgcatgatgac

SEQ ID NO: 5092604 - DNA, 19 bp, Homo sapiens
aactcaatgcatgatgact

SEQ ID NO: 5092605 - DNA, 14 bp, Homo sapiens
aactcacaaatgat

SEQ ID NO: 5092606 - DNA, 13 bp, Homo sapiens
aactcacacctcc

SEQ ID NO: 5092607 - DNA, 19 bp, Homo sapiens
aactcacacctccttttct

SEQ ID NO: 5092608 - DNA, 17 bp, Homo sapiens
aactcacagactgctgt

SEQ ID NO: 5092609 - DNA, 13 bp, Homo sapiens
aactcacagagct

SEQ ID NO: 5092610 - DNA, 23 bp, Homo sapiens
aactcacattggcaagtgtaaaa

SEQ ID NO: 5092611 - DNA, 21 bp, Homo sapiens
aactcaccatgtaaaagagtc

SEQ ID NO: 5092612 - DNA, 14 bp, Homo sapiens
aactcaccatttca

SEQ ID NO: 5092613 - DNA, 15 bp, Homo sapiens
aactcaccatttcat

SEQ ID NO: 5092614 - DNA, 16 bp, Homo sapiens
aactcaccatttcatc

SEQ ID NO: 5092615 - DNA, 22 bp, Homo sapiens
aactcacccccaaggggcagtc

SEQ ID NO: 5092616 - DNA, 17 bp, Homo sapiens
aactcaccgctcaccct

SEQ ID NO: 5092617 - DNA, 17 bp, Homo sapiens
aactcacctaatgttta

SEQ ID NO: 5092618 - DNA, 21 bp, Homo sapiens
aactcacctaatgtttatgag

SEQ ID NO: 5092619 - DNA, 22 bp, Homo sapiens
aactcacctgctggcccctcac

SEQ ID NO: 5092620 - DNA, 22 bp, Homo sapiens
aactcactaacagggagaagta

SEQ ID NO: 5092621 - DNA, 14 bp, Homo sapiens
aactcactcactgt

SEQ ID NO: 5092622 - DNA, 22 bp, Homo sapiens
aactcactcactgtttataaat

SEQ ID NO: 5092623 - DNA, 22 bp, Homo sapiens
aactcactcagtttatgctgtg

SEQ ID NO: 5092624 - DNA, 16 bp, Homo sapiens
aactcactccttttaa

SEQ ID NO: 5092625 - DNA, 12 bp, Homo sapiens
aactcactctgg

SEQ ID NO: 5092626 - DNA, 13 bp, Homo sapiens
aactcactctggg

SEQ ID NO: 5092627 - DNA, 17 bp, Homo sapiens
aactcactctgggctgt

SEQ ID NO: 5092628 - DNA, 20 bp, Homo sapiens
aactcactctttagatattt

SEQ ID NO: 5092629 - DNA, 23 bp, Homo sapiens
aactcactgcctaggaggctggc

SEQ ID NO: 5092630 - DNA, 14 bp, Homo sapiens
aactcactgctcaa

SEQ ID NO: 5092631 - DNA, 13 bp, Homo sapiens
aactcactgtgct

SEQ ID NO: 5092632 - DNA, 14 bp, Homo sapiens
aactcactgtgctc

SEQ ID NO: 5092633 - DNA, 22 bp, Homo sapiens
aactcacttttttacaactcca

SEQ ID NO: 5092634 - DNA, 21 bp, Homo sapiens
aactcagaaacatcagttact

SEQ ID NO: 5092635 - DNA, 23 bp, Homo sapiens
aactcagaactgtcggaggaaag

SEQ ID NO: 5092636 - DNA, 16 bp, Homo sapiens
aactcagaatataaca

SEQ ID NO: 5092637 - DNA, 16 bp, Homo sapiens
aactcagacattccaa

SEQ ID NO: 5092638 - DNA, 15 bp, Homo sapiens
aactcagagcccctc

SEQ ID NO: 5092639 - DNA, 22 bp, Homo sapiens
aactcagagcccctccctgcta

SEQ ID NO: 5092640 - DNA, 11 bp, Homo sapiens
aactcagatat

SEQ ID NO: 5092641 - DNA, 15 bp, Homo sapiens
aactcagatcactac

SEQ ID NO: 5092642 - DNA, 18 bp, Homo sapiens
aactcagatcactactgc

SEQ ID NO: 5092643 - DNA, 13 bp, Homo sapiens
aactcagatccag

SEQ ID NO: 5092644 - DNA, 17 bp, Homo sapiens
aactcagatctgtctga

SEQ ID NO: 5092645 - DNA, 18 bp, Homo sapiens
aactcagccaagcacagt

SEQ ID NO: 5092646 - DNA, 21 bp, Homo sapiens
aactcagccaagcacagtggt

SEQ ID NO: 5092647 - DNA, 17 bp, Homo sapiens
aactcagcctgggacag

SEQ ID NO: 5092648 - DNA, 15 bp, Homo sapiens
aactcaggactccag

SEQ ID NO: 5092649 - DNA, 20 bp, Homo sapiens
aactcaggactccagcccat

SEQ ID NO: 5092650 - DNA, 15 bp, Homo sapiens
aactcaggcaaagaa

SEQ ID NO: 5092651 - DNA, 13 bp, Homo sapiens
aactcaggcattt

SEQ ID NO: 5092652 - DNA, 16 bp, Homo sapiens
aactcagggacagagc

SEQ ID NO: 5092653 - DNA, 18 bp, Homo sapiens
aactcagggacagagcca

SEQ ID NO: 5092654 - DNA, 10 bp, Homo sapiens
aactcaggtt

SEQ ID NO: 5092655 - DNA, 12 bp, Homo sapiens
aactcagtctgt

SEQ ID NO: 5092656 - DNA, 23 bp, Homo sapiens
aactcatacactcgtatgatact

SEQ ID NO: 5092657 - DNA, 20 bp, Homo sapiens
aactcatacagtctctattt

SEQ ID NO: 5092658 - DNA, 22 bp, Homo sapiens
aactcatacagtctctatttga

SEQ ID NO: 5092659 - DNA, 15 bp, Homo sapiens
aactcatattttcat

SEQ ID NO: 5092660 - DNA, 18 bp, Homo sapiens
aactcatattttcatgct

SEQ ID NO: 5092661 - DNA, 16 bp, Homo sapiens
aactcatcacataaag

SEQ ID NO: 5092662 - DNA, 18 bp, Homo sapiens
aactcatcactgtggctg

SEQ ID NO: 5092663 - DNA, 22 bp, Homo sapiens
aactcatccctaatgctgcaga

SEQ ID NO: 5092664 - DNA, 24 bp, Homo sapiens
aactcatcctcttttaatggcatt

SEQ ID NO: 5092665 - DNA, 23 bp, Homo sapiens
aactcatcctgtgtggggaggca

SEQ ID NO: 5092666 - DNA, 21 bp, Homo sapiens
aactcatcgttctaaaatcaa

SEQ ID NO: 5092667 - DNA, 20 bp, Homo sapiens
aactcatctggagttctcaa

SEQ ID NO: 5092668 - DNA, 14 bp, Homo sapiens
aactcattagagat

SEQ ID NO: 5092669 - DNA, 15 bp, Homo sapiens
aactcattcatagga

SEQ ID NO: 5092670 - DNA, 21 bp, Homo sapiens
aactcattccagatcccaggc

SEQ ID NO: 5092671 - DNA, 22 bp, Homo sapiens
aactcattctcttcttgctata

SEQ ID NO: 5092672 - DNA, 22 bp, Homo sapiens
aactcattgctctgttaataat

SEQ ID NO: 5092673 - DNA, 17 bp, Homo sapiens
aactcatttgaatgctt

SEQ ID NO: 5092674 - DNA, 18 bp, Homo sapiens
aactccaaaatctggctt

SEQ ID NO: 5092675 - DNA, 20 bp, Homo sapiens
aactccacagggactgttct

SEQ ID NO: 5092676 - DNA, 15 bp, Homo sapiens
aactccaccttccca

SEQ ID NO: 5092677 - DNA, 21 bp, Homo sapiens
aactccagaaagtgacaagct

SEQ ID NO: 5092678 - DNA, 13 bp, Homo sapiens
aactccagcaact

SEQ ID NO: 5092679 - DNA, 14 bp, Homo sapiens
aactccagcgtcct

SEQ ID NO: 5092680 - DNA, 16 bp, Homo sapiens
aactccagcgtcctca

SEQ ID NO: 5092681 - DNA, 18 bp, Homo sapiens
aactccagcgtcctcagc

SEQ ID NO: 5092682 - DNA, 20 bp, Homo sapiens
aactccagcgtcctcagcac

SEQ ID NO: 5092683 - DNA, 21 bp, Homo sapiens
aaccttgtgcctggctcagag

SEQ ID NO: 5092684 - DNA, 17 bp, Homo sapiens
aaccttgttatttctca

SEQ ID NO: 5092685 - DNA, 17 bp, Homo sapiens
aaccttgttctattttt

SEQ ID NO: 5092686 - DNA, 23 bp, Homo sapiens
aaccttgttctatttttcaatca

SEQ ID NO: 5092687 - DNA, 18 bp, Homo sapiens
aaccttgtttattaaatt

SEQ ID NO: 5092688 - DNA, 15 bp, Homo sapiens
aaccttgtttgtttt

SEQ ID NO: 5092689 - DNA, 13 bp, Homo sapiens
aaccttgttttgg

SEQ ID NO: 5092690 - DNA, 22 bp, Homo sapiens
aacctttaaaaatgtataatga

SEQ ID NO: 5092691 - DNA, 14 bp, Homo sapiens
aacctttaaaattg

SEQ ID NO: 5092692 - DNA, 19 bp, Homo sapiens
aacctttaaaattgtcacc

SEQ ID NO: 5092693 - DNA, 20 bp, Homo sapiens
aacctttaaagtaaaggcct

SEQ ID NO: 5092694 - DNA, 14 bp, Homo sapiens
aacctttaatgaga

SEQ ID NO: 5092695 - DNA, 23 bp, Homo sapiens
aacctttacagttagcagggatg

SEQ ID NO: 5092696 - DNA, 15 bp, Homo sapiens
aacctttagctgtga

SEQ ID NO: 5092697 - DNA, 16 bp, Homo sapiens
aacctttagggcagct

SEQ ID NO: 5092698 - DNA, 14 bp, Homo sapiens
aacctttcaaattt

SEQ ID NO: 5092699 - DNA, 19 bp, Homo sapiens
aacctttcagctggcagag

SEQ ID NO: 5092700 - DNA, 18 bp, Homo sapiens
aacctttccccagacaca

SEQ ID NO: 5092701 - DNA, 15 bp, Homo sapiens
aacctttccctcacc

SEQ ID NO: 5092702 - DNA, 20 bp, Homo sapiens
aacctttccctcaccccctc

SEQ ID NO: 5092703 - DNA, 22 bp, Homo sapiens
aacctttccctcaccccctccc

SEQ ID NO: 5092704 - DNA, 22 bp, Homo sapiens
aacctttccgctgtcgccccag

SEQ ID NO: 5092705 - DNA, 23 bp, Homo sapiens
aacctttccgctgtcgccccagg

SEQ ID NO: 5092706 - DNA, 18 bp, Homo sapiens
aacctttctactttttct

SEQ ID NO: 5092707 - DNA, 16 bp, Homo sapiens
aacctttctataattt

SEQ ID NO: 5092708 - DNA, 19 bp, Homo sapiens
aacctttctgacatcagca

SEQ ID NO: 5092709 - DNA, 15 bp, Homo sapiens
aacctttctggcctg

SEQ ID NO: 5092710 - DNA, 16 bp, Homo sapiens
aacctttctggcctgt

SEQ ID NO: 5092711 - DNA, 14 bp, Homo sapiens
aacctttctgtagc

SEQ ID NO: 5092712 - DNA, 12 bp, Homo sapiens
aacctttctgtg

SEQ ID NO: 5092713 - DNA, 23 bp, Homo sapiens
aacctttctttctgaaatagtca

SEQ ID NO: 5092714 - DNA, 11 bp, Homo sapiens
aacctttgcta

SEQ ID NO: 5092715 - DNA, 15 bp, Homo sapiens
aacctttgctgtagt

SEQ ID NO: 5092716 - DNA, 19 bp, Homo sapiens
aacctttgcttaccttgtt

SEQ ID NO: 5092717 - DNA, 20 bp, Homo sapiens
aacctttgcttaccttgttt

SEQ ID NO: 5092718 - DNA, 16 bp, Homo sapiens
aacctttgtgccctat

SEQ ID NO: 5092719 - DNA, 13 bp, Homo sapiens
aacctttgtgtaa

SEQ ID NO: 5092720 - DNA, 22 bp, Homo sapiens
aaccttttcttgtatctggatt

SEQ ID NO: 5092721 - DNA, 16 bp, Homo sapiens
aaccttttgagtgcct

SEQ ID NO: 5092722 - DNA, 17 bp, Homo sapiens
aaccttttttaagattt

SEQ ID NO: 5092723 - DNA, 18 bp, Homo sapiens
aaccttttttaagatttt

SEQ ID NO: 5092724 - DNA, 15 bp, Homo sapiens
aacctttttttttga

SEQ ID NO: 5092725 - DNA, 19 bp, Homo sapiens
aacctttttttttgaaaca

SEQ ID NO: 5092726 - DNA, 14 bp, Homo sapiens
aacgaaaacctgac

SEQ ID NO: 5092727 - DNA, 15 bp, Homo sapiens
aacgaaaaggacaga

SEQ ID NO: 5092728 - DNA, 13 bp, Homo sapiens
aacgaaagctggg

SEQ ID NO: 5092729 - DNA, 16 bp, Homo sapiens
aacgaaatatcaaagt

SEQ ID NO: 5092730 - DNA, 18 bp, Homo sapiens
aacgaacccctagaaagg

SEQ ID NO: 5092731 - DNA, 15 bp, Homo sapiens
aacgaaccttggcct

SEQ ID NO: 5092732 - DNA, 12 bp, Homo sapiens
aacgaagaaaaa

SEQ ID NO: 5092733 - DNA, 23 bp, Homo sapiens
aacgaagagttcccttgaaactt

SEQ ID NO: 5092734 - DNA, 16 bp, Homo sapiens
aacgaagatccgagcg

SEQ ID NO: 5092735 - DNA, 12 bp, Homo sapiens
aacgaataaagg

SEQ ID NO: 5092736 - DNA, 23 bp, Homo sapiens
aacgacaaagccaaactctgcca

SEQ ID NO: 5092737 - DNA, 17 bp, Homo sapiens
aacgacaaatctgtctg

SEQ ID NO: 5092738 - DNA, 14 bp, Homo sapiens
aacgacaatagctt

SEQ ID NO: 5092739 - DNA, 13 bp, Homo sapiens
aacgaccaaactc

SEQ ID NO: 5092740 - DNA, 17 bp, Homo sapiens
aacgaccgacgcccctc

SEQ ID NO: 5092741 - DNA, 20 bp, Homo sapiens
aacgaccgtcttttgaaaac

SEQ ID NO: 5092742 - DNA, 14 bp, Homo sapiens
aacgactcaaaatg

SEQ ID NO: 5092743 - DNA, 17 bp, Homo sapiens
aacgactcaaaatgaca

SEQ ID NO: 5092744 - DNA, 19 bp, Homo sapiens
aacgactgtatattgctaa

SEQ ID NO: 5092745 - DNA, 13 bp, Homo sapiens
aacgagaagacaa

SEQ ID NO: 5092746 - DNA, 15 bp, Homo sapiens
aacgagcactggcca

SEQ ID NO: 5092747 - DNA, 16 bp, Homo sapiens
aacgagcactggccag

SEQ ID NO: 5092748 - DNA, 18 bp, Homo sapiens
aacgagcactggccagag

SEQ ID NO: 5092749 - DNA, 16 bp, Homo sapiens
aacgagcagcccaggg

SEQ ID NO: 5092750 - DNA, 17 bp, Homo sapiens
aacgagcagcccagggc

SEQ ID NO: 5092751 - DNA, 12 bp, Homo sapiens
aacgagggataa

SEQ ID NO: 5092752 - DNA, 22 bp, Homo sapiens
aacgagggctgatggaggaaaa

SEQ ID NO: 5092753 - DNA, 21 bp, Homo sapiens
aacgagggggtcagcccaaga

SEQ ID NO: 5092754 - DNA, 22 bp, Homo sapiens
aacgagttaatgatggcagagg

SEQ ID NO: 5092755 - DNA, 18 bp, Homo sapiens
aacgataaaattacaaaa

SEQ ID NO: 5092756 - DNA, 16 bp, Homo sapiens
aacgatatatgtaaat

SEQ ID NO: 5092757 - DNA, 20 bp, Homo sapiens
aacgatatatgtaaatatac

SEQ ID NO: 5092758 - DNA, 17 bp, Homo sapiens
aacgatcacaaatgact

SEQ ID NO: 5092759 - DNA, 22 bp, Homo sapiens
aacgatgatgcttgtaacaaga

SEQ ID NO: 5092760 - DNA, 20 bp, Homo sapiens
aacgatgtgcaatacatttt

SEQ ID NO: 5092761 - DNA, 21 bp, Homo sapiens
aacgattgacaccaaaatgaa

SEQ ID NO: 5092762 - DNA, 20 bp, Homo sapiens
aacgatttaattctcttgaa

SEQ ID NO: 5092763 - DNA, 18 bp, Homo sapiens
aacgatttaccaattaat

SEQ ID NO: 5092764 - DNA, 19 bp, Homo sapiens
aacgatttttaaaatgtac

SEQ ID NO: 5092765 - DNA, 16 bp, Homo sapiens
aacgcaaacctctcct

SEQ ID NO: 5092766 - DNA, 19 bp, Homo sapiens
aacgcaaacctctccttcc

SEQ ID NO: 5092767 - DNA, 21 bp, Homo sapiens
aacgcagaagagggggagggg

SEQ ID NO: 5092768 - DNA, 21 bp, Homo sapiens
aacgcagaggcggaaaccttg

SEQ ID NO: 5092769 - DNA, 22 bp, Homo sapiens
aacgcagaggcggaaaccttgc

SEQ ID NO: 5092770 - DNA, 18 bp, Homo sapiens
aacgcagatgatccatga

SEQ ID NO: 5092771 - DNA, 13 bp, Homo sapiens
aacgcagccctag

SEQ ID NO: 5092772 - DNA, 14 bp, Homo sapiens
aacgcaggagagag

SEQ ID NO: 5092773 - DNA, 16 bp, Homo sapiens
aacgcaggagagagag

SEQ ID NO: 5092774 - DNA, 19 bp, Homo sapiens
aacgcagttgtgtggccca

SEQ ID NO: 5092775 - DNA, 13 bp, Homo sapiens
aacgcatggagtg

SEQ ID NO: 5092776 - DNA, 20 bp, Homo sapiens
aacgcattttgggttgttta

SEQ ID NO: 5092777 - DNA, 20 bp, Homo sapiens
aacgccacaaaaatagagaa

SEQ ID NO: 5092778 - DNA, 23 bp, Homo sapiens
aacgccagtctcccaggccccct

SEQ ID NO: 5092779 - DNA, 22 bp, Homo sapiens
aacgccccagataccagcccct

SEQ ID NO: 5092780 - DNA, 15 bp, Homo sapiens
aacgcccctccaaac

SEQ ID NO: 5092781 - DNA, 20 bp, Homo sapiens
aacgcccctccaaacctcca

SEQ ID NO: 5092782 - DNA, 18 bp, Homo sapiens
aacgcccctgtggccaac

SEQ ID NO: 5092783 - DNA, 18 bp, Homo sapiens
aacgcctcccctgcccca

SEQ ID NO: 5092784 - DNA, 22 bp, Homo sapiens
aacgcctcttttccctctctag

SEQ ID NO: 5092785 - DNA, 12 bp, Homo sapiens
aacgcctgagcc

SEQ ID NO: 5092786 - DNA, 19 bp, Homo sapiens
aacgcctgagcccagggag

SEQ ID NO: 5092787 - DNA, 14 bp, Homo sapiens
aacgcgcagatgtg

SEQ ID NO: 5092788 - DNA, 21 bp, Homo sapiens
aacgcgcagatgtgcagcaga

SEQ ID NO: 5092789 - DNA, 23 bp, Homo sapiens
aacgcgcagatgtgcagcagatt

SEQ ID NO: 5092790 - DNA, 19 bp, Homo sapiens
aacgcgtctgcctgggccg

SEQ ID NO: 5092791 - DNA, 15 bp, Homo sapiens
aacgcgttgaaattg

SEQ ID NO: 5092792 - DNA, 22 bp, Homo sapiens
aacgctaaagagcccttgcctc

SEQ ID NO: 5092793 - DNA, 20 bp, Homo sapiens
aacgctccaaagtcataatt

SEQ ID NO: 5092794 - DNA, 14 bp, Homo sapiens
aacgctcctttgtg

SEQ ID NO: 5092795 - DNA, 19 bp, Homo sapiens
aacgctctaccctgcagct

SEQ ID NO: 5092796 - DNA, 12 bp, Homo sapiens
aacgctctcctc

SEQ ID NO: 5092797 - DNA, 21 bp, Homo sapiens
aacgctctcctcgagccctcc

SEQ ID NO: 5092798 - DNA, 19 bp, Homo sapiens
aacgctctctactctgctt

SEQ ID NO: 5092799 - DNA, 16 bp, Homo sapiens
aacgctgaagcggtca

SEQ ID NO: 5092800 - DNA, 15 bp, Homo sapiens
aacgctgatttaaag

SEQ ID NO: 5092801 - DNA, 15 bp, Homo sapiens
aacgctgcctgcccg

SEQ ID NO: 5092802 - DNA, 23 bp, Homo sapiens
aacgctgctccatgcacaggaaa

SEQ ID NO: 5092803 - DNA, 10 bp, Homo sapiens
aacgctgtga

SEQ ID NO: 5092804 - DNA, 17 bp, Homo sapiens
aacgcttaaaggaagtc

SEQ ID NO: 5092805 - DNA, 22 bp, Homo sapiens
aacgcttcgggaaaatattcat

SEQ ID NO: 5092806 - DNA, 14 bp, Homo sapiens
aacggaagaagaga

SEQ ID NO: 5092807 - DNA, 11 bp, Homo sapiens
aacggaagctg

SEQ ID NO: 5092808 - DNA, 14 bp, Homo sapiens
aacggaagggttgg

SEQ ID NO: 5092809 - DNA, 20 bp, Homo sapiens
aacggagccccaggcctctg

SEQ ID NO: 5092810 - DNA, 18 bp, Homo sapiens
aacggatcagaaatacag

SEQ ID NO: 5092811 - DNA, 16 bp, Homo sapiens
aacggatgatttctat

SEQ ID NO: 5092812 - DNA, 17 bp, Homo sapiens
aacggatgatttctatg

SEQ ID NO: 5092813 - DNA, 11 bp, Homo sapiens
aacggatgctc

SEQ ID NO: 5092814 - DNA, 15 bp, Homo sapiens
aacggattccaaaga

SEQ ID NO: 5092815 - DNA, 14 bp, Homo sapiens
aacggcccaggcca

SEQ ID NO: 5092816 - DNA, 16 bp, Homo sapiens
aacggcccaggccagg

SEQ ID NO: 5092817 - DNA, 17 bp, Homo sapiens
aacggcccatagccttg

SEQ ID NO: 5092818 - DNA, 20 bp, Homo sapiens
aacggcccatagccttgggg

SEQ ID NO: 5092819 - DNA, 14 bp, Homo sapiens
aacggctctccaga

SEQ ID NO: 5092820 - DNA, 23 bp, Homo sapiens
aacgggagtggccatctggaaat

SEQ ID NO: 5092821 - DNA, 11 bp, Homo sapiens
aacgggcagcc

SEQ ID NO: 5092822 - DNA, 23 bp, Homo sapiens
aacgggcatgggcctctctgggg

SEQ ID NO: 5092823 - DNA, 14 bp, Homo sapiens
aacgggcctccccg

SEQ ID NO: 5092824 - DNA, 17 bp, Homo sapiens
aacgggctgccctgcca

SEQ ID NO: 5092825 - DNA, 24 bp, Homo sapiens
aacggggcagtactcctccctggg

SEQ ID NO: 5092826 - DNA, 16 bp, Homo sapiens
aacggggctcttctca

SEQ ID NO: 5092827 - DNA, 18 bp, Homo sapiens
aacggggctcttctcatt

SEQ ID NO: 5092828 - DNA, 16 bp, Homo sapiens
aacggggggctcctgc

SEQ ID NO: 5092829 - DNA, 20 bp, Homo sapiens
aacgggggtgcggcaggagc

SEQ ID NO: 5092830 - DNA, 20 bp, Homo sapiens
aacggggtggacgagggagt

SEQ ID NO: 5092831 - DNA, 12 bp, Homo sapiens
aacggggtgggg

SEQ ID NO: 5092832 - DNA, 17 bp, Homo sapiens
aacgggtcgtaatgact

SEQ ID NO: 5092833 - DNA, 13 bp, Homo sapiens
aacgggtctgtgg

SEQ ID NO: 5092834 - DNA, 18 bp, Homo sapiens
aacggtatcctccctgcc

SEQ ID NO: 5092835 - DNA, 13 bp, Homo sapiens
aacggtctggcag

SEQ ID NO: 5092836 - DNA, 20 bp, Homo sapiens
aacggtgctaaaaatgaaaa

SEQ ID NO: 5092837 - DNA, 20 bp, Homo sapiens
aacggtgctgtgagggaggg

SEQ ID NO: 5092838 - DNA, 14 bp, Homo sapiens
aacggttaaaactg

SEQ ID NO: 5092839 - DNA, 21 bp, Homo sapiens
aacggttcctggtgactcctg

SEQ ID NO: 5092840 - DNA, 19 bp, Homo sapiens
aacgtaagcactgtttttc

SEQ ID NO: 5092841 - DNA, 16 bp, Homo sapiens
aacgtaatcaaatatg

SEQ ID NO: 5092842 - DNA, 21 bp, Homo sapiens
aacgtaatcaaatatgtggtc

SEQ ID NO: 5092843 - DNA, 15 bp, Homo sapiens
aacgtacccaaggtc

SEQ ID NO: 5092844 - DNA, 19 bp, Homo sapiens
aacgtacctcttaaaattc

SEQ ID NO: 5092845 - DNA, 22 bp, Homo sapiens
aacgtacttaactgtgtgaaga

SEQ ID NO: 5092846 - DNA, 17 bp, Homo sapiens
aacgtagcatgtggcat

SEQ ID NO: 5092847 - DNA, 21 bp, Homo sapiens
aacgtagtcggcacagcctgg

SEQ ID NO: 5092848 - DNA, 15 bp, Homo sapiens
aacgtataaaagcct

SEQ ID NO: 5092849 - DNA, 14 bp, Homo sapiens
aacgtatagtcaat

SEQ ID NO: 5092850 - DNA, 16 bp, Homo sapiens
aacgtatgtatttcat

SEQ ID NO: 5092851 - DNA, 19 bp, Homo sapiens
aacgtatgtgctcttataa

SEQ ID NO: 5092852 - DNA, 19 bp, Homo sapiens
aacgtattggacctgccca

SEQ ID NO: 5092853 - DNA, 13 bp, Homo sapiens
aacgtatttctcc

SEQ ID NO: 5092854 - DNA, 13 bp, Homo sapiens
aacgtattttaaa

SEQ ID NO: 5092855 - DNA, 12 bp, Homo sapiens
aacgtattttga

SEQ ID NO: 5092856 - DNA, 13 bp, Homo sapiens
aacgtattttgat

SEQ ID NO: 5092857 - DNA, 14 bp, Homo sapiens
aacgtattttgatg

SEQ ID NO: 5092858 - DNA, 15 bp, Homo sapiens
aacgtcacccaaaag

SEQ ID NO: 5092859 - DNA, 15 bp, Homo sapiens
aacgtccatctctct

SEQ ID NO: 5092860 - DNA, 16 bp, Homo sapiens
aacgtcccacactttg

SEQ ID NO: 5092861 - DNA, 17 bp, Homo sapiens
aacgtccttccacttca

SEQ ID NO: 5092862 - DNA, 20 bp, Homo sapiens
aactccagctgagtcctggg

SEQ ID NO: 5092863 - DNA, 21 bp, Homo sapiens
aactccagctgagtcctgggg

SEQ ID NO: 5092864 - DNA, 21 bp, Homo sapiens
aactccaggaaagagcagtca

SEQ ID NO: 5092865 - DNA, 19 bp, Homo sapiens
aactccaggatttataaag

SEQ ID NO: 5092866 - DNA, 13 bp, Homo sapiens
aactccaggctgg

SEQ ID NO: 5092867 - DNA, 18 bp, Homo sapiens
aactccaggctgggctga

SEQ ID NO: 5092868 - DNA, 10 bp, Homo sapiens
aactccaggg

SEQ ID NO: 5092869 - DNA, 16 bp, Homo sapiens
aactccagggtcccct

SEQ ID NO: 5092870 - DNA, 19 bp, Homo sapiens
aactccagggtcccctgcc

SEQ ID NO: 5092871 - DNA, 18 bp, Homo sapiens
aactccagtctcctgaca

SEQ ID NO: 5092872 - DNA, 17 bp, Homo sapiens
aactccatacagcctct

SEQ ID NO: 5092873 - DNA, 19 bp, Homo sapiens
aactccatctcaaaacaaa

SEQ ID NO: 5092874 - DNA, 14 bp, Homo sapiens
aactccatgaccag

SEQ ID NO: 5092875 - DNA, 19 bp, Homo sapiens
aactccatgaccaggccac

SEQ ID NO: 5092876 - DNA, 16 bp, Homo sapiens
aactccatgcaaacca

SEQ ID NO: 5092877 - DNA, 17 bp, Homo sapiens
aactccatggggttcga

SEQ ID NO: 5092878 - DNA, 13 bp, Homo sapiens
aactcccaagaac

SEQ ID NO: 5092879 - DNA, 16 bp, Homo sapiens
aactcccaccctaccc

SEQ ID NO: 5092880 - DNA, 22 bp, Homo sapiens
aactcccagcaacacaagctgg

SEQ ID NO: 5092881 - DNA, 13 bp, Homo sapiens
aactcccagccac

SEQ ID NO: 5092882 - DNA, 16 bp, Homo sapiens
aactcccagccaccac

SEQ ID NO: 5092883 - DNA, 12 bp, Homo sapiens
aactcccaggac

SEQ ID NO: 5092884 - DNA, 22 bp, Homo sapiens
aactcccatatcatataaaatt

SEQ ID NO: 5092885 - DNA, 21 bp, Homo sapiens
aactcccattaccatgtaatg

SEQ ID NO: 5092886 - DNA, 18 bp, Homo sapiens
aactcccccagaggtgga

SEQ ID NO: 5092887 - DNA, 22 bp, Homo sapiens
aactcccccattttacagattt

SEQ ID NO: 5092888 - DNA, 12 bp, Homo sapiens
aactccccttcc

SEQ ID NO: 5092889 - DNA, 15 bp, Homo sapiens
aactccccttccctg

SEQ ID NO: 5092890 - DNA, 22 bp, Homo sapiens
aactccccttccctggggagcc

SEQ ID NO: 5092891 - DNA, 23 bp, Homo sapiens
aactccccttccctggggagccc

SEQ ID NO: 5092892 - DNA, 15 bp, Homo sapiens
aactccctaggcctg

SEQ ID NO: 5092893 - DNA, 21 bp, Homo sapiens
aactccctgaacctcagtttc

SEQ ID NO: 5092894 - DNA, 19 bp, Homo sapiens
aactcccttgtgttccttc

SEQ ID NO: 5092895 - DNA, 14 bp, Homo sapiens
aactccctttttac

SEQ ID NO: 5092896 - DNA, 16 bp, Homo sapiens
aactccctttttacac

SEQ ID NO: 5092897 - DNA, 14 bp, Homo sapiens
aactccgcccccag

SEQ ID NO: 5092898 - DNA, 15 bp, Homo sapiens
aactccgcccccagc

SEQ ID NO: 5092899 - DNA, 19 bp, Homo sapiens
aactcctaaataaactagt

SEQ ID NO: 5092900 - DNA, 13 bp, Homo sapiens
aactcctaatttt

SEQ ID NO: 5092901 - DNA, 23 bp, Homo sapiens
aactcctaattttaaataatttc

SEQ ID NO: 5092902 - DNA, 13 bp, Homo sapiens
aactcctacctga

SEQ ID NO: 5092903 - DNA, 17 bp, Homo sapiens
aactcctacctgaaggc

SEQ ID NO: 5092904 - DNA, 15 bp, Homo sapiens
aactcctactgcttc

SEQ ID NO: 5092905 - DNA, 21 bp, Homo sapiens
aactcctcacacaccctgagg

SEQ ID NO: 5092906 - DNA, 11 bp, Homo sapiens
aactcctccca

SEQ ID NO: 5092907 - DNA, 12 bp, Homo sapiens
aactcctcccat

SEQ ID NO: 5092908 - DNA, 11 bp, Homo sapiens
aactcctcctt

SEQ ID NO: 5092909 - DNA, 17 bp, Homo sapiens
aactcctgaaattcaga

SEQ ID NO: 5092910 - DNA, 16 bp, Homo sapiens
aactcctgacagtctt

SEQ ID NO: 5092911 - DNA, 11 bp, Homo sapiens
aactcctgacc

SEQ ID NO: 5092912 - DNA, 18 bp, Homo sapiens
aactcctgacctcaggca

SEQ ID NO: 5092913 - DNA, 19 bp, Homo sapiens
aactcctgacgtcaagtga

SEQ ID NO: 5092914 - DNA, 18 bp, Homo sapiens
aactcctgagaaatgtta

SEQ ID NO: 5092915 - DNA, 10 bp, Homo sapiens
aactcctgcc

SEQ ID NO: 5092916 - DNA, 18 bp, Homo sapiens
aactcctgcccctgttct

SEQ ID NO: 5092917 - DNA, 14 bp, Homo sapiens
aactcctggcctca

SEQ ID NO: 5092918 - DNA, 19 bp, Homo sapiens
aactcctgtcttctttctc

SEQ ID NO: 5092919 - DNA, 12 bp, Homo sapiens
aactccttacag

SEQ ID NO: 5092920 - DNA, 17 bp, Homo sapiens
aactccttattttgtat

SEQ ID NO: 5092921 - DNA, 18 bp, Homo sapiens
aactccttccatccttga

SEQ ID NO: 5092922 - DNA, 19 bp, Homo sapiens
aactccttccatccttgac

SEQ ID NO: 5092923 - DNA, 13 bp, Homo sapiens
aactccttcctct

SEQ ID NO: 5092924 - DNA, 14 bp, Homo sapiens
aactccttcctggc

SEQ ID NO: 5092925 - DNA, 12 bp, Homo sapiens
aactccttggcc

SEQ ID NO: 5092926 - DNA, 17 bp, Homo sapiens
aactcctttcagccaca

SEQ ID NO: 5092927 - DNA, 18 bp, Homo sapiens
aactcctttcttatcttg

SEQ ID NO: 5092928 - DNA, 20 bp, Homo sapiens
aactccttttgctgtctttc

SEQ ID NO: 5092929 - DNA, 16 bp, Homo sapiens
aactcgaactgctttc

SEQ ID NO: 5092930 - DNA, 19 bp, Homo sapiens
aactcgaagcccttccagt

SEQ ID NO: 5092931 - DNA, 15 bp, Homo sapiens
aactcgaatctgtgt

SEQ ID NO: 5092932 - DNA, 16 bp, Homo sapiens
aactcgaatctgtgtg

SEQ ID NO: 5092933 - DNA, 22 bp, Homo sapiens
aactcgaggactgtatttgtga

SEQ ID NO: 5092934 - DNA, 23 bp, Homo sapiens
aactcgatgaatgtgttgatttg

SEQ ID NO: 5092935 - DNA, 20 bp, Homo sapiens
aactcgcgagtgtaactttc

SEQ ID NO: 5092936 - DNA, 22 bp, Homo sapiens
aactcgcttaggtagaaactat

SEQ ID NO: 5092937 - DNA, 22 bp, Homo sapiens
aactcgggattacagaaacacg

SEQ ID NO: 5092938 - DNA, 19 bp, Homo sapiens
aactcgggggcgcctggag

SEQ ID NO: 5092939 - DNA, 19 bp, Homo sapiens
aactcgggggtgctggggc

SEQ ID NO: 5092940 - DNA, 20 bp, Homo sapiens
aactcgggggtgctggggcc

SEQ ID NO: 5092941 - DNA, 23 bp, Homo sapiens
aactcggtgtccccaccatctgc

SEQ ID NO: 5092942 - DNA, 20 bp, Homo sapiens
aactcggtttggtagacttg

SEQ ID NO: 5092943 - DNA, 19 bp, Homo sapiens
aactcgtgttcactcagca

SEQ ID NO: 5092944 - DNA, 18 bp, Homo sapiens
aactcgttaaagcaaagc

SEQ ID NO: 5092945 - DNA, 19 bp, Homo sapiens
aactctaaaagatcctttt

SEQ ID NO: 5092946 - DNA, 13 bp, Homo sapiens
aactctaactgtg

SEQ ID NO: 5092947 - DNA, 16 bp, Homo sapiens
aactctaagtgtaaaa

SEQ ID NO: 5092948 - DNA, 13 bp, Homo sapiens
aactctaattcta

SEQ ID NO: 5092949 - DNA, 14 bp, Homo sapiens
aactctacccctgc

SEQ ID NO: 5092950 - DNA, 13 bp, Homo sapiens
aactctaccctga

SEQ ID NO: 5092951 - DNA, 23 bp, Homo sapiens
aactctaccctggtaggaaagca

SEQ ID NO: 5092952 - DNA, 14 bp, Homo sapiens
aactctagaaatgc

SEQ ID NO: 5092953 - DNA, 18 bp, Homo sapiens
aactctagactgcaagaa

SEQ ID NO: 5092954 - DNA, 18 bp, Homo sapiens
aactctagagagccttaa

SEQ ID NO: 5092955 - DNA, 19 bp, Homo sapiens
aactctagagagccttaac

SEQ ID NO: 5092956 - DNA, 11 bp, Homo sapiens
aactctagcct

SEQ ID NO: 5092957 - DNA, 19 bp, Homo sapiens
aactctagctgggggtggg

SEQ ID NO: 5092958 - DNA, 15 bp, Homo sapiens
aactctataaagaaa

SEQ ID NO: 5092959 - DNA, 17 bp, Homo sapiens
aactctataaagaaact

SEQ ID NO: 5092960 - DNA, 22 bp, Homo sapiens
aactctataaagaaacttttga

SEQ ID NO: 5092961 - DNA, 14 bp, Homo sapiens
aactctatactcaa

SEQ ID NO: 5092962 - DNA, 22 bp, Homo sapiens
aactctatattgttcagcatgc

SEQ ID NO: 5092963 - DNA, 19 bp, Homo sapiens
aactctatctgggcctggg

SEQ ID NO: 5092964 - DNA, 19 bp, Homo sapiens
aactctcaagctaagtaaa

SEQ ID NO: 5092965 - DNA, 22 bp, Homo sapiens
aactctcaccatgatgtgaaga

SEQ ID NO: 5092966 - DNA, 21 bp, Homo sapiens
aactctcagaaataaatcaca

SEQ ID NO: 5092967 - DNA, 11 bp, Homo sapiens
aactctccaaa

SEQ ID NO: 5092968 - DNA, 17 bp, Homo sapiens
aactctccagccattgt

SEQ ID NO: 5092969 - DNA, 15 bp, Homo sapiens
aactctccagtgcct

SEQ ID NO: 5092970 - DNA, 16 bp, Homo sapiens
aactctccctctggtc

SEQ ID NO: 5092971 - DNA, 18 bp, Homo sapiens
aactctcctccagagtca

SEQ ID NO: 5092972 - DNA, 16 bp, Homo sapiens
aactctcctctgctgc

SEQ ID NO: 5092973 - DNA, 17 bp, Homo sapiens
aactctcctctgctgct

SEQ ID NO: 5092974 - DNA, 23 bp, Homo sapiens
aactctcctctgctgctggctgg

SEQ ID NO: 5092975 - DNA, 13 bp, Homo sapiens
aactctcctcttt

SEQ ID NO: 5092976 - DNA, 21 bp, Homo sapiens
aactctcctgtggcctgctca

SEQ ID NO: 5092977 - DNA, 13 bp, Homo sapiens
aactctcctttga

SEQ ID NO: 5092978 - DNA, 22 bp, Homo sapiens
aactctcgggacctcgtttggg

SEQ ID NO: 5092979 - DNA, 22 bp, Homo sapiens
aactctctccaccctatatgta

SEQ ID NO: 5092980 - DNA, 13 bp, Homo sapiens
aactctctctgcc

SEQ ID NO: 5092981 - DNA, 15 bp, Homo sapiens
aactctctctgcccc

SEQ ID NO: 5092982 - DNA, 17 bp, Homo sapiens
aactctctctgccccca

SEQ ID NO: 5092983 - DNA, 10 bp, Homo sapiens
aactctctgc

SEQ ID NO: 5092984 - DNA, 20 bp, Homo sapiens
aactctctgtcttctctcca

SEQ ID NO: 5092985 - DNA, 22 bp, Homo sapiens
aactctctgtcttctctccact

SEQ ID NO: 5092986 - DNA, 15 bp, Homo sapiens
aactctcttcttcca

SEQ ID NO: 5092987 - DNA, 13 bp, Homo sapiens
aactctctttcct

SEQ ID NO: 5092988 - DNA, 16 bp, Homo sapiens
aactctctttccttga

SEQ ID NO: 5092989 - DNA, 11 bp, Homo sapiens
aactctgaagg

SEQ ID NO: 5092990 - DNA, 15 bp, Homo sapiens
aactctgaataagca

SEQ ID NO: 5092991 - DNA, 16 bp, Homo sapiens
aactctgaatttatct

SEQ ID NO: 5092992 - DNA, 19 bp, Homo sapiens
aactctgaatttatctttg

SEQ ID NO: 5092993 - DNA, 23 bp, Homo sapiens
aactctgaatttatctttgataa

SEQ ID NO: 5092994 - DNA, 22 bp, Homo sapiens
aactctgacaacagacttctga

SEQ ID NO: 5092995 - DNA, 23 bp, Homo sapiens
aactctgacaacagacttctgaa

SEQ ID NO: 5092996 - DNA, 21 bp, Homo sapiens
aactctgacaagggctgacct

SEQ ID NO: 5092997 - DNA, 23 bp, Homo sapiens
aactctgagagatttggggctaa

SEQ ID NO: 5092998 - DNA, 13 bp, Homo sapiens
aactctgatgtgg

SEQ ID NO: 5092999 - DNA, 15 bp, Homo sapiens
aactctgattttgat

SEQ ID NO: 5093000 - DNA, 10 bp, Homo sapiens
aactctgcaa

SEQ ID NO: 5093001 - DNA, 20 bp, Homo sapiens
aactctgcactccatggcca

SEQ ID NO: 5093002 - DNA, 22 bp, Homo sapiens
aactctgcactccatggccacc

SEQ ID NO: 5093003 - DNA, 13 bp, Homo sapiens
aactctgcaggaa

SEQ ID NO: 5093004 - DNA, 14 bp, Homo sapiens
aactctgcaggaaa

SEQ ID NO: 5093005 - DNA, 12 bp, Homo sapiens
aactctgcatag

SEQ ID NO: 5093006 - DNA, 15 bp, Homo sapiens
aactctgcatgtaga

SEQ ID NO: 5093007 - DNA, 12 bp, Homo sapiens
aactctgccagc

SEQ ID NO: 5093008 - DNA, 15 bp, Homo sapiens
aactctgcccaccct

SEQ ID NO: 5093009 - DNA, 22 bp, Homo sapiens
aactctgcctttatgatgctaa

SEQ ID NO: 5093010 - DNA, 13 bp, Homo sapiens
aactctgcggata

SEQ ID NO: 5093011 - DNA, 16 bp, Homo sapiens
aactctggacactcta

SEQ ID NO: 5093012 - DNA, 22 bp, Homo sapiens
aactctggacccctgggcctca

SEQ ID NO: 5093013 - DNA, 16 bp, Homo sapiens
aactctggattttgaa

SEQ ID NO: 5093014 - DNA, 23 bp, Homo sapiens
aactctggccttggttcctccag

SEQ ID NO: 5093015 - DNA, 12 bp, Homo sapiens
aactctggctca

SEQ ID NO: 5093016 - DNA, 17 bp, Homo sapiens
aactctggcttccaggt

SEQ ID NO: 5093017 - DNA, 22 bp, Homo sapiens
aactctgggctgctacccagaa

SEQ ID NO: 5093018 - DNA, 22 bp, Homo sapiens
aactctggtgataaaaataaag

SEQ ID NO: 5093019 - DNA, 18 bp, Homo sapiens
aactctggtgctcctgca

SEQ ID NO: 5093020 - DNA, 12 bp, Homo sapiens
aactctggtggc

SEQ ID NO: 5093021 - DNA, 18 bp, Homo sapiens
aactctgtaaaagtgtct

SEQ ID NO: 5093022 - DNA, 15 bp, Homo sapiens
aactctgtagcttaa

SEQ ID NO: 5093023 - DNA, 23 bp, Homo sapiens
aactctgtataatagagataagt

SEQ ID NO: 5093024 - DNA, 20 bp, Homo sapiens
aactctgtcttcacctgatt

SEQ ID NO: 5093025 - DNA, 17 bp, Homo sapiens
aactctgtgcaggtgct

SEQ ID NO: 5093026 - DNA, 21 bp, Homo sapiens
aactctgtgcaggtgctgcct

SEQ ID NO: 5093027 - DNA, 16 bp, Homo sapiens
aactctgtggcattat

SEQ ID NO: 5093028 - DNA, 17 bp, Homo sapiens
aactctgtgtcccagca

SEQ ID NO: 5093029 - DNA, 15 bp, Homo sapiens
aactctgtgtgagag

SEQ ID NO: 5093030 - DNA, 20 bp, Homo sapiens
aactctgtgttgtgaatgtc

SEQ ID NO: 5093031 - DNA, 23 bp, Homo sapiens
aactctgttacactttttggaag

SEQ ID NO: 5093032 - DNA, 19 bp, Homo sapiens
aactctgttcccccaccct

SEQ ID NO: 5093033 - DNA, 22 bp, Homo sapiens
aactctgttgcaagtgcaataa

SEQ ID NO: 5093034 - DNA, 13 bp, Homo sapiens
aactcttaaaaat

SEQ ID NO: 5093035 - DNA, 14 bp, Homo sapiens
aactcttaactgaa

SEQ ID NO: 5093036 - DNA, 16 bp, Homo sapiens
aactcttaactgaaga

SEQ ID NO: 5093037 - DNA, 17 bp, Homo sapiens
aactcttaatctgtgtg

SEQ ID NO: 5093038 - DNA, 19 bp, Homo sapiens
aactcttagaagtgttgta

SEQ ID NO: 5093039 - DNA, 18 bp, Homo sapiens
aactcttaggcacatcaa

SEQ ID NO: 5093040 - DNA, 21 bp, Homo sapiens
aactcttatttctttccttta

SEQ ID NO: 5093041 - DNA, 22 bp, Homo sapiens
aacgtccttccttgactgtcta

SEQ ID NO: 5093042 - DNA, 23 bp, Homo sapiens
aacgtccttccttgactgtctag

SEQ ID NO: 5093043 - DNA, 12 bp, Homo sapiens
aacgtctcccag

SEQ ID NO: 5093044 - DNA, 12 bp, Homo sapiens
aacgtcttaaat

SEQ ID NO: 5093045 - DNA, 14 bp, Homo sapiens
aacgtcttaaatat

SEQ ID NO: 5093046 - DNA, 15 bp, Homo sapiens
aacgtcttaaatatt

SEQ ID NO: 5093047 - DNA, 14 bp, Homo sapiens
aacgtctttttaag

SEQ ID NO: 5093048 - DNA, 15 bp, Homo sapiens
aacgtctttttaagc

SEQ ID NO: 5093049 - DNA, 21 bp, Homo sapiens
aacgtctttttaagcctttga

SEQ ID NO: 5093050 - DNA, 22 bp, Homo sapiens
aacgtctttttaagcctttgaa

SEQ ID NO: 5093051 - DNA, 15 bp, Homo sapiens
aacgtctttttgttt

SEQ ID NO: 5093052 - DNA, 19 bp, Homo sapiens
aacgtctttttgtttgttt

SEQ ID NO: 5093053 - DNA, 13 bp, Homo sapiens
aacgtgaaattct

SEQ ID NO: 5093054 - DNA, 17 bp, Homo sapiens
aacgtgaactaagattt

SEQ ID NO: 5093055 - DNA, 14 bp, Homo sapiens
aacgtgatacattt

SEQ ID NO: 5093056 - DNA, 17 bp, Homo sapiens
aacgtgatgttttgaat

SEQ ID NO: 5093057 - DNA, 18 bp, Homo sapiens
aacgtgattgattcagta

SEQ ID NO: 5093058 - DNA, 11 bp, Homo sapiens
aacgtgcaact

SEQ ID NO: 5093059 - DNA, 20 bp, Homo sapiens
aacgtgcaactgacactccc

SEQ ID NO: 5093060 - DNA, 11 bp, Homo sapiens
aacgtgcattg

SEQ ID NO: 5093061 - DNA, 13 bp, Homo sapiens
aacgtgccagcag

SEQ ID NO: 5093062 - DNA, 13 bp, Homo sapiens
aacgtgcccccag

SEQ ID NO: 5093063 - DNA, 14 bp, Homo sapiens
aacgtgcccccaga

SEQ ID NO: 5093064 - DNA, 16 bp, Homo sapiens
aacgtgcccccagagt

SEQ ID NO: 5093065 - DNA, 16 bp, Homo sapiens
aacgtgcttctttgta

SEQ ID NO: 5093066 - DNA, 20 bp, Homo sapiens
aacgtgcttctttgtaatga

SEQ ID NO: 5093067 - DNA, 15 bp, Homo sapiens
aacgtggacctgcct

SEQ ID NO: 5093068 - DNA, 14 bp, Homo sapiens
aacgtggattgtat

SEQ ID NO: 5093069 - DNA, 20 bp, Homo sapiens
aacgtggattgtatttaaga

SEQ ID NO: 5093070 - DNA, 22 bp, Homo sapiens
aacgtggattgtatttaagaca

SEQ ID NO: 5093071 - DNA, 15 bp, Homo sapiens
aacgtggctgcttca

SEQ ID NO: 5093072 - DNA, 19 bp, Homo sapiens
aacgtggctgcttcaagga

SEQ ID NO: 5093073 - DNA, 15 bp, Homo sapiens
aacgtggcttgtaga

SEQ ID NO: 5093074 - DNA, 17 bp, Homo sapiens
aacgtggcttgtagaat

SEQ ID NO: 5093075 - DNA, 20 bp, Homo sapiens
aacgtggcttgtagaatttt

SEQ ID NO: 5093076 - DNA, 21 bp, Homo sapiens
aacgtgggcttaaagcagaag

SEQ ID NO: 5093077 - DNA, 17 bp, Homo sapiens
aacgtggggcagcacag

SEQ ID NO: 5093078 - DNA, 18 bp, Homo sapiens
aacgtgggtatttcctgc

SEQ ID NO: 5093079 - DNA, 19 bp, Homo sapiens
aacgtgggtatttcctgct

SEQ ID NO: 5093080 - DNA, 23 bp, Homo sapiens
aacgtggttcagagactggcagc

SEQ ID NO: 5093081 - DNA, 14 bp, Homo sapiens
aacgtgtatgtttt

SEQ ID NO: 5093082 - DNA, 23 bp, Homo sapiens
aacgtgttaattataaacagcag

SEQ ID NO: 5093083 - DNA, 14 bp, Homo sapiens
aacgttaaaagtgt

SEQ ID NO: 5093084 - DNA, 17 bp, Homo sapiens
aacgttactcagggctc

SEQ ID NO: 5093085 - DNA, 20 bp, Homo sapiens
aacgttactcagggctcctc

SEQ ID NO: 5093086 - DNA, 21 bp, Homo sapiens
aacgttagaatagtggttaac

SEQ ID NO: 5093087 - DNA, 17 bp, Homo sapiens
aacgttagactgcaata

SEQ ID NO: 5093088 - DNA, 16 bp, Homo sapiens
aacgttcgatttctac

SEQ ID NO: 5093089 - DNA, 23 bp, Homo sapiens
aacgttctcagtcctttgttata

SEQ ID NO: 5093090 - DNA, 18 bp, Homo sapiens
aacgttgatgtaatgaaa

SEQ ID NO: 5093091 - DNA, 19 bp, Homo sapiens
aacgttgatgtaatgaaat

SEQ ID NO: 5093092 - DNA, 15 bp, Homo sapiens
aacgttgccacacca

SEQ ID NO: 5093093 - DNA, 14 bp, Homo sapiens
aacgttgctcccca

SEQ ID NO: 5093094 - DNA, 13 bp, Homo sapiens
aacgttgctgtgg

SEQ ID NO: 5093095 - DNA, 14 bp, Homo sapiens
aacgttgctgtggg

SEQ ID NO: 5093096 - DNA, 21 bp, Homo sapiens
aacgttggagtttgggctgga

SEQ ID NO: 5093097 - DNA, 16 bp, Homo sapiens
aacgtttaacattgat

SEQ ID NO: 5093098 - DNA, 13 bp, Homo sapiens
aacgttttattgt

SEQ ID NO: 5093099 - DNA, 15 bp, Homo sapiens
aacgttttattgtgt

SEQ ID NO: 5093100 - DNA, 13 bp, Homo sapiens
aacgttttctaat

SEQ ID NO: 5093101 - DNA, 19 bp, Homo sapiens
aacgttttcttaaatgttt

SEQ ID NO: 5093102 - DNA, 20 bp, Homo sapiens
aacgttttcttctttccctg

SEQ ID NO: 5093103 - DNA, 18 bp, Homo sapiens
aacgttttgtttgaaaaa

SEQ ID NO: 5093104 - DNA, 22 bp, Homo sapiens
aactaaaaagagactgtgccat

SEQ ID NO: 5093105 - DNA, 14 bp, Homo sapiens
aactaaaaataaat

SEQ ID NO: 5093106 - DNA, 16 bp, Homo sapiens
aactaaaaataaatta

SEQ ID NO: 5093107 - DNA, 17 bp, Homo sapiens
aactaaaaataaattaa

SEQ ID NO: 5093108 - DNA, 23 bp, Homo sapiens
aactaaaaatattcctccaaatc

SEQ ID NO: 5093109 - DNA, 17 bp, Homo sapiens
aactaaaacaaagccac

SEQ ID NO: 5093110 - DNA, 14 bp, Homo sapiens
aactaaaacattat

SEQ ID NO: 5093111 - DNA, 14 bp, Homo sapiens
aactaaaagacatt

SEQ ID NO: 5093112 - DNA, 16 bp, Homo sapiens
aactaaaataaattaa

SEQ ID NO: 5093113 - DNA, 12 bp, Homo sapiens
aactaaaatcat

SEQ ID NO: 5093114 - DNA, 17 bp, Homo sapiens
aactaaaatcattgtca

SEQ ID NO: 5093115 - DNA, 22 bp, Homo sapiens
aactaaaatcattgtcaaaatt

SEQ ID NO: 5093116 - DNA, 16 bp, Homo sapiens
aactaaacaaggcatt

SEQ ID NO: 5093117 - DNA, 21 bp, Homo sapiens
aactaaacagaaaactcccaa

SEQ ID NO: 5093118 - DNA, 18 bp, Homo sapiens
aactaaactcatttataa

SEQ ID NO: 5093119 - DNA, 18 bp, Homo sapiens
aactaaactcttaccata

SEQ ID NO: 5093120 - DNA, 13 bp, Homo sapiens
aactaaagaagag

SEQ ID NO: 5093121 - DNA, 21 bp, Homo sapiens
aactaaagaagaggagaaaaa

SEQ ID NO: 5093122 - DNA, 19 bp, Homo sapiens
aactaaagaagatctgtaa

SEQ ID NO: 5093123 - DNA, 13 bp, Homo sapiens
aactaaagcaata

SEQ ID NO: 5093124 - DNA, 19 bp, Homo sapiens
aactaaagcaatagaaaca

SEQ ID NO: 5093125 - DNA, 18 bp, Homo sapiens
aactaaagttgaaaatac

SEQ ID NO: 5093126 - DNA, 19 bp, Homo sapiens
aactaaagttgaaaataca

SEQ ID NO: 5093127 - DNA, 19 bp, Homo sapiens
aactaaataacacagatat

SEQ ID NO: 5093128 - DNA, 14 bp, Homo sapiens
aactaaataatgaa

SEQ ID NO: 5093129 - DNA, 23 bp, Homo sapiens
aactaaataatgaataaactgaa

SEQ ID NO: 5093130 - DNA, 20 bp, Homo sapiens
aactaaatagatttttagat

SEQ ID NO: 5093131 - DNA, 15 bp, Homo sapiens
aactaaatagcatgt

SEQ ID NO: 5093132 - DNA, 14 bp, Homo sapiens
aactaaatatatgt

SEQ ID NO: 5093133 - DNA, 21 bp, Homo sapiens
aactaaatgagacctaataat

SEQ ID NO: 5093134 - DNA, 13 bp, Homo sapiens
aactaaatgataa

SEQ ID NO: 5093135 - DNA, 14 bp, Homo sapiens
aactaaatgtagtt

SEQ ID NO: 5093136 - DNA, 14 bp, Homo sapiens
aactaaatgtgtac

SEQ ID NO: 5093137 - DNA, 14 bp, Homo sapiens
aactaaatgttcta

SEQ ID NO: 5093138 - DNA, 16 bp, Homo sapiens
aactaaattgtaaact

SEQ ID NO: 5093139 - DNA, 16 bp, Homo sapiens
aactaaatttgatact

SEQ ID NO: 5093140 - DNA, 21 bp, Homo sapiens
aactaaatttgatacttatat

SEQ ID NO: 5093141 - DNA, 18 bp, Homo sapiens
aactaaatttgtctttca

SEQ ID NO: 5093142 - DNA, 19 bp, Homo sapiens
aactaaatttgtctttcaa

SEQ ID NO: 5093143 - DNA, 14 bp, Homo sapiens
aactaacaatatga

SEQ ID NO: 5093144 - DNA, 23 bp, Homo sapiens
aactaacagctacaaacttttaa

SEQ ID NO: 5093145 - DNA, 11 bp, Homo sapiens
aactaacatgt

SEQ ID NO: 5093146 - DNA, 20 bp, Homo sapiens
aactaactgactctgttatt

SEQ ID NO: 5093147 - DNA, 14 bp, Homo sapiens
aactaactgccatg

SEQ ID NO: 5093148 - DNA, 15 bp, Homo sapiens
aactaactgccatgt

SEQ ID NO: 5093149 - DNA, 21 bp, Homo sapiens
aactaactgcttcatctcctt

SEQ ID NO: 5093150 - DNA, 18 bp, Homo sapiens
aactaagaaacttttgta

SEQ ID NO: 5093151 - DNA, 21 bp, Homo sapiens
aactaagagacagttctctgt

SEQ ID NO: 5093152 - DNA, 19 bp, Homo sapiens
aactaagaggcccagccct

SEQ ID NO: 5093153 - DNA, 15 bp, Homo sapiens
aactaagcaagtata

SEQ ID NO: 5093154 - DNA, 23 bp, Homo sapiens
aactaagcagtccctgagaccat

SEQ ID NO: 5093155 - DNA, 12 bp, Homo sapiens
aactaagccagg

SEQ ID NO: 5093156 - DNA, 20 bp, Homo sapiens
aactaagccaggcctggctg

SEQ ID NO: 5093157 - DNA, 17 bp, Homo sapiens
aactaagctctttgaga

SEQ ID NO: 5093158 - DNA, 17 bp, Homo sapiens
aactaaggacaaattag

SEQ ID NO: 5093159 - DNA, 14 bp, Homo sapiens
aactaaggacagga

SEQ ID NO: 5093160 - DNA, 20 bp, Homo sapiens
aactaaggtacggtgagact

SEQ ID NO: 5093161 - DNA, 16 bp, Homo sapiens
aactaaggtgaagaat

SEQ ID NO: 5093162 - DNA, 10 bp, Homo sapiens
aactaataaa

SEQ ID NO: 5093163 - DNA, 12 bp, Homo sapiens
aactaataaaat

SEQ ID NO: 5093164 - DNA, 13 bp, Homo sapiens
aactaataaaata

SEQ ID NO: 5093165 - DNA, 16 bp, Homo sapiens
aactaataaaataagt

SEQ ID NO: 5093166 - DNA, 19 bp, Homo sapiens
aactaataaaatattttct

SEQ ID NO: 5093167 - DNA, 21 bp, Homo sapiens
aactaataaaatattttctgt

SEQ ID NO: 5093168 - DNA, 23 bp, Homo sapiens
aactaataaaatattttctgtgt

SEQ ID NO: 5093169 - DNA, 22 bp, Homo sapiens
aactaatatgggcattgtagtt

SEQ ID NO: 5093170 - DNA, 22 bp, Homo sapiens
aactaatatggttttgttttca

SEQ ID NO: 5093171 - DNA, 23 bp, Homo sapiens
aactaatatttgtctgtgtgcta

SEQ ID NO: 5093172 - DNA, 23 bp, Homo sapiens
aactaatccttctggcagattca

SEQ ID NO: 5093173 - DNA, 21 bp, Homo sapiens
aactaatgaacaaatatgctt

SEQ ID NO: 5093174 - DNA, 13 bp, Homo sapiens
aactaatgagttt

SEQ ID NO: 5093175 - DNA, 22 bp, Homo sapiens
aactaatgataatcccaccacc

SEQ ID NO: 5093176 - DNA, 12 bp, Homo sapiens
aactaatgcctt

SEQ ID NO: 5093177 - DNA, 15 bp, Homo sapiens
aactaatgccttact

SEQ ID NO: 5093178 - DNA, 13 bp, Homo sapiens
aactaatgtaaat

SEQ ID NO: 5093179 - DNA, 18 bp, Homo sapiens
aactaatgtactgtacat

SEQ ID NO: 5093180 - DNA, 19 bp, Homo sapiens
aactaatgtactgtacata

SEQ ID NO: 5093181 - DNA, 21 bp, Homo sapiens
aactaatgtactgtacataaa

SEQ ID NO: 5093182 - DNA, 18 bp, Homo sapiens
aactaatgtttgaacaaa

SEQ ID NO: 5093183 - DNA, 20 bp, Homo sapiens
aactaattataatgcaaatt

SEQ ID NO: 5093184 - DNA, 13 bp, Homo sapiens
aactaattcattt

SEQ ID NO: 5093185 - DNA, 15 bp, Homo sapiens
aactaattctcacat

SEQ ID NO: 5093186 - DNA, 21 bp, Homo sapiens
aactaatttgctctgtggtaa

SEQ ID NO: 5093187 - DNA, 21 bp, Homo sapiens
aactaattttaaagtaaaagg

SEQ ID NO: 5093188 - DNA, 12 bp, Homo sapiens
aactaattttgt

SEQ ID NO: 5093189 - DNA, 14 bp, Homo sapiens
aactaattttgtac

SEQ ID NO: 5093190 - DNA, 15 bp, Homo sapiens
aactaatttttgtat

SEQ ID NO: 5093191 - DNA, 19 bp, Homo sapiens
aactacaaacaaaatttct

SEQ ID NO: 5093192 - DNA, 20 bp, Homo sapiens
aactacaaagctgaagaaaa

SEQ ID NO: 5093193 - DNA, 20 bp, Homo sapiens
aactacaaagctttgctaca

SEQ ID NO: 5093194 - DNA, 18 bp, Homo sapiens
aactacaaaggtttaaat

SEQ ID NO: 5093195 - DNA, 13 bp, Homo sapiens
aactacaaatcaa

SEQ ID NO: 5093196 - DNA, 23 bp, Homo sapiens
aactacacacccccaagccacag

SEQ ID NO: 5093197 - DNA, 16 bp, Homo sapiens
aactacactaataaat

SEQ ID NO: 5093198 - DNA, 17 bp, Homo sapiens
aactacagaatattaaa

SEQ ID NO: 5093199 - DNA, 15 bp, Homo sapiens
aactacagacaaaga

SEQ ID NO: 5093200 - DNA, 23 bp, Homo sapiens
aactacagagtctgacaggaaga

SEQ ID NO: 5093201 - DNA, 23 bp, Homo sapiens
aactacagtgattcatgtagaga

SEQ ID NO: 5093202 - DNA, 15 bp, Homo sapiens
aactacatctgcctc

SEQ ID NO: 5093203 - DNA, 15 bp, Homo sapiens
aactacatgaacaca

SEQ ID NO: 5093204 - DNA, 14 bp, Homo sapiens
aactacatgtaaaa

SEQ ID NO: 5093205 - DNA, 17 bp, Homo sapiens
aactacattaaaagctt

SEQ ID NO: 5093206 - DNA, 19 bp, Homo sapiens
aactacattaaaagcttta

SEQ ID NO: 5093207 - DNA, 12 bp, Homo sapiens
aactacatttta

SEQ ID NO: 5093208 - DNA, 13 bp, Homo sapiens
aactacattttaa

SEQ ID NO: 5093209 - DNA, 15 bp, Homo sapiens
aactacattttgcaa

SEQ ID NO: 5093210 - DNA, 16 bp, Homo sapiens
aactaccagtgggcat

SEQ ID NO: 5093211 - DNA, 18 bp, Homo sapiens
aactaccatgctttgttt

SEQ ID NO: 5093212 - DNA, 14 bp, Homo sapiens
aactaccccacaac

SEQ ID NO: 5093213 - DNA, 16 bp, Homo sapiens
aactacccccttttca

SEQ ID NO: 5093214 - DNA, 19 bp, Homo sapiens
aactacctcaaaacacttt

SEQ ID NO: 5093215 - DNA, 15 bp, Homo sapiens
aactacctgagctaa

SEQ ID NO: 5093216 - DNA, 15 bp, Homo sapiens
aactacgtgacctct

SEQ ID NO: 5093217 - DNA, 19 bp, Homo sapiens
aactactaatctcaattta

SEQ ID NO: 5093218 - DNA, 22 bp, Homo sapiens
aactactaatctcaatttaaga

SEQ ID NO: 5093219 - DNA, 20 bp, Homo sapiens
aactactacctgtaatgaca

SEQ ID NO: 5093220 - DNA, 15 bp, Homo sapiens
aactactattcaaaa

SEQ ID NO: 5093221 - DNA, 16 bp, Homo sapiens
aactcttcaaggtctg

SEQ ID NO: 5093222 - DNA, 18 bp, Homo sapiens
aactcttcacaaaatctg

SEQ ID NO: 5093223 - DNA, 17 bp, Homo sapiens
aactcttcactcttcaa

SEQ ID NO: 5093224 - DNA, 23 bp, Homo sapiens
aactcttcactcttcaaatgcct

SEQ ID NO: 5093225 - DNA, 11 bp, Homo sapiens
aactcttcagt

SEQ ID NO: 5093226 - DNA, 20 bp, Homo sapiens
aactcttcagttaattctta

SEQ ID NO: 5093227 - DNA, 23 bp, Homo sapiens
aactcttcagttaattcttagat

SEQ ID NO: 5093228 - DNA, 21 bp, Homo sapiens
aactcttcatcttaaactaca

SEQ ID NO: 5093229 - DNA, 16 bp, Homo sapiens
aactcttcctcccctc

SEQ ID NO: 5093230 - DNA, 18 bp, Homo sapiens
aactcttcctcccctctc

SEQ ID NO: 5093231 - DNA, 19 bp, Homo sapiens
aactcttcctcccctctca

SEQ ID NO: 5093232 - DNA, 15 bp, Homo sapiens
aactcttctactttc

SEQ ID NO: 5093233 - DNA, 14 bp, Homo sapiens
aactcttctggaaa

SEQ ID NO: 5093234 - DNA, 16 bp, Homo sapiens
aactcttctttgctgc

SEQ ID NO: 5093235 - DNA, 21 bp, Homo sapiens
aactcttctttgctgcattcc

SEQ ID NO: 5093236 - DNA, 19 bp, Homo sapiens
aactcttgctcactcccta

SEQ ID NO: 5093237 - DNA, 13 bp, Homo sapiens
aactcttgtattg

SEQ ID NO: 5093238 - DNA, 14 bp, Homo sapiens
aactcttgtttttt

SEQ ID NO: 5093239 - DNA, 13 bp, Homo sapiens
aactctttaactt

SEQ ID NO: 5093240 - DNA, 12 bp, Homo sapiens
aactctttcaaa

SEQ ID NO: 5093241 - DNA, 13 bp, Homo sapiens
aactctttcccca

SEQ ID NO: 5093242 - DNA, 13 bp, Homo sapiens
aactctttcggta

SEQ ID NO: 5093243 - DNA, 15 bp, Homo sapiens
aactctttgttattt

SEQ ID NO: 5093244 - DNA, 14 bp, Homo sapiens
aactcttttaacag

SEQ ID NO: 5093245 - DNA, 12 bp, Homo sapiens
aactgaaaagac

SEQ ID NO: 5093246 - DNA, 13 bp, Homo sapiens
aactgaaaagaga

SEQ ID NO: 5093247 - DNA, 20 bp, Homo sapiens
aactgaaaagagagcagaga

SEQ ID NO: 5093248 - DNA, 22 bp, Homo sapiens
aactgaaaagagagcagagaat

SEQ ID NO: 5093249 - DNA, 19 bp, Homo sapiens
aactgaaaatctaatatta

SEQ ID NO: 5093250 - DNA, 13 bp, Homo sapiens
aactgaaaatgta

SEQ ID NO: 5093251 - DNA, 15 bp, Homo sapiens
aactgaaaatgtaaa

SEQ ID NO: 5093252 - DNA, 17 bp, Homo sapiens
aactgaaaatgtaaatt

SEQ ID NO: 5093253 - DNA, 13 bp, Homo sapiens
aactgaaaattat

SEQ ID NO: 5093254 - DNA, 17 bp, Homo sapiens
aactgaaaattatttaa

SEQ ID NO: 5093255 - DNA, 20 bp, Homo sapiens
aactgaaagcacatgaataa

SEQ ID NO: 5093256 - DNA, 14 bp, Homo sapiens
aactgaaagtgttt

SEQ ID NO: 5093257 - DNA, 11 bp, Homo sapiens
aactgaaataa

SEQ ID NO: 5093258 - DNA, 22 bp, Homo sapiens
aactgaaataaacctgcactga

SEQ ID NO: 5093259 - DNA, 10 bp, Homo sapiens
aactgaaatc

SEQ ID NO: 5093260 - DNA, 22 bp, Homo sapiens
aactgaaatgagcatgcatttt

SEQ ID NO: 5093261 - DNA, 14 bp, Homo sapiens
aactgaaatgtgga

SEQ ID NO: 5093262 - DNA, 18 bp, Homo sapiens
aactgaaattaaaactat

SEQ ID NO: 5093263 - DNA, 16 bp, Homo sapiens
aactgaaattacatat

SEQ ID NO: 5093264 - DNA, 15 bp, Homo sapiens
aactgaacattccag

SEQ ID NO: 5093265 - DNA, 16 bp, Homo sapiens
aactgaaccacaaaaa

SEQ ID NO: 5093266 - DNA, 19 bp, Homo sapiens
aactgaactctgacaacag

SEQ ID NO: 5093267 - DNA, 14 bp, Homo sapiens
aactgaactgtaac

SEQ ID NO: 5093268 - DNA, 12 bp, Homo sapiens
aactgaactgtt

SEQ ID NO: 5093269 - DNA, 15 bp, Homo sapiens
aactgaactttgaag

SEQ ID NO: 5093270 - DNA, 16 bp, Homo sapiens
aactgaactttgaaga

SEQ ID NO: 5093271 - DNA, 20 bp, Homo sapiens
aactgaactttgaagacccg

SEQ ID NO: 5093272 - DNA, 14 bp, Homo sapiens
aactgaagaaggat

SEQ ID NO: 5093273 - DNA, 14 bp, Homo sapiens
aactgaagacaatt

SEQ ID NO: 5093274 - DNA, 17 bp, Homo sapiens
aactgaagacctccaca

SEQ ID NO: 5093275 - DNA, 13 bp, Homo sapiens
aactgaagagaca

SEQ ID NO: 5093276 - DNA, 17 bp, Homo sapiens
aactgaagcaaatacca

SEQ ID NO: 5093277 - DNA, 20 bp, Homo sapiens
aactgaagcaaataccaaag

SEQ ID NO: 5093278 - DNA, 22 bp, Homo sapiens
aactgaagcaaataccaaagca

SEQ ID NO: 5093279 - DNA, 18 bp, Homo sapiens
aactgaagcagcctctcc

SEQ ID NO: 5093280 - DNA, 14 bp, Homo sapiens
aactgaagcataaa

SEQ ID NO: 5093281 - DNA, 21 bp, Homo sapiens
aactgaagccacttggcccag

SEQ ID NO: 5093282 - DNA, 12 bp, Homo sapiens
aactgaagcttt

SEQ ID NO: 5093283 - DNA, 15 bp, Homo sapiens
aactgaaggagaagg

SEQ ID NO: 5093284 - DNA, 22 bp, Homo sapiens
aactgaaggagatcaatggttt

SEQ ID NO: 5093285 - DNA, 21 bp, Homo sapiens
aactgaaggctaaaaagcaac

SEQ ID NO: 5093286 - DNA, 19 bp, Homo sapiens
aactgaagggggcggccta

SEQ ID NO: 5093287 - DNA, 16 bp, Homo sapiens
aactgaaggtgcagtt

SEQ ID NO: 5093288 - DNA, 22 bp, Homo sapiens
aactgaaggttttttttttaag

SEQ ID NO: 5093289 - DNA, 15 bp, Homo sapiens
aactgaagtctgaaa

SEQ ID NO: 5093290 - DNA, 10 bp, Homo sapiens
aactgaataa

SEQ ID NO: 5093291 - DNA, 17 bp, Homo sapiens
aactgaataaaaaataa

SEQ ID NO: 5093292 - DNA, 19 bp, Homo sapiens
aactgaataaaaaataaat

SEQ ID NO: 5093293 - DNA, 12 bp, Homo sapiens
aactgaataaat

SEQ ID NO: 5093294 - DNA, 19 bp, Homo sapiens
aactgaataaattcagtat

SEQ ID NO: 5093295 - DNA, 18 bp, Homo sapiens
aactgaataccactctgt

SEQ ID NO: 5093296 - DNA, 18 bp, Homo sapiens
aactgaatagctgtcata

SEQ ID NO: 5093297 - DNA, 19 bp, Homo sapiens
aactgaatattttggaaac

SEQ ID NO: 5093298 - DNA, 15 bp, Homo sapiens
aactgaatgaatcca

SEQ ID NO: 5093299 - DNA, 22 bp, Homo sapiens
aactgaatgaatccattggaga

SEQ ID NO: 5093300 - DNA, 13 bp, Homo sapiens
aactgaattgtgt

SEQ ID NO: 5093301 - DNA, 14 bp, Homo sapiens
aactgaatttggag

SEQ ID NO: 5093302 - DNA, 16 bp, Homo sapiens
aactgaatttgtactt

SEQ ID NO: 5093303 - DNA, 17 bp, Homo sapiens
aactgaatttgttctta

SEQ ID NO: 5093304 - DNA, 20 bp, Homo sapiens
aactgacaaaggagccttga

SEQ ID NO: 5093305 - DNA, 12 bp, Homo sapiens
aactgacacagg

SEQ ID NO: 5093306 - DNA, 23 bp, Homo sapiens
aactgacacatgctgaacatcac

SEQ ID NO: 5093307 - DNA, 14 bp, Homo sapiens
aactgacatcagat

SEQ ID NO: 5093308 - DNA, 17 bp, Homo sapiens
aactgacatcagatttc

SEQ ID NO: 5093309 - DNA, 20 bp, Homo sapiens
aactgacatgattagcagaa

SEQ ID NO: 5093310 - DNA, 14 bp, Homo sapiens
aactgacgctggag

SEQ ID NO: 5093311 - DNA, 18 bp, Homo sapiens
aactgacgctggagatgc

SEQ ID NO: 5093312 - DNA, 15 bp, Homo sapiens
aactgactaaccatt

SEQ ID NO: 5093313 - DNA, 15 bp, Homo sapiens
aactgactatcataa

SEQ ID NO: 5093314 - DNA, 18 bp, Homo sapiens
aactgactatcataaaat

SEQ ID NO: 5093315 - DNA, 22 bp, Homo sapiens
aactgactattcttgatgtaaa

SEQ ID NO: 5093316 - DNA, 19 bp, Homo sapiens
aactgactgaaggaaaagc

SEQ ID NO: 5093317 - DNA, 14 bp, Homo sapiens
aactgacttaacaa

SEQ ID NO: 5093318 - DNA, 20 bp, Homo sapiens
aactgacttcatttgtgcca

SEQ ID NO: 5093319 - DNA, 15 bp, Homo sapiens
aactgacttctgcta

SEQ ID NO: 5093320 - DNA, 13 bp, Homo sapiens
aactgactttctc

SEQ ID NO: 5093321 - DNA, 14 bp, Homo sapiens
aactgactttctcc

SEQ ID NO: 5093322 - DNA, 19 bp, Homo sapiens
aactgactttttcccccca

SEQ ID NO: 5093323 - DNA, 20 bp, Homo sapiens
aactgagaagccaagcctgg

SEQ ID NO: 5093324 - DNA, 21 bp, Homo sapiens
aactgagaaggcaggcctccg

SEQ ID NO: 5093325 - DNA, 15 bp, Homo sapiens
aactgagacaggcag

SEQ ID NO: 5093326 - DNA, 17 bp, Homo sapiens
aactgagacaggcagtt

SEQ ID NO: 5093327 - DNA, 12 bp, Homo sapiens
aactgagaccaa

SEQ ID NO: 5093328 - DNA, 15 bp, Homo sapiens
aactgagaccaagtc

SEQ ID NO: 5093329 - DNA, 15 bp, Homo sapiens
aactgagagaaagat

SEQ ID NO: 5093330 - DNA, 15 bp, Homo sapiens
aactgagaggtgagg

SEQ ID NO: 5093331 - DNA, 23 bp, Homo sapiens
aactgagatattattttaaattt

SEQ ID NO: 5093332 - DNA, 21 bp, Homo sapiens
aactgagatcaaaaaaatata

SEQ ID NO: 5093333 - DNA, 20 bp, Homo sapiens
aactgagatgtgaacacatc

SEQ ID NO: 5093334 - DNA, 23 bp, Homo sapiens
aactgagatgtgaacacatcagc

SEQ ID NO: 5093335 - DNA, 20 bp, Homo sapiens
aactgagatgttaaaatagt

SEQ ID NO: 5093336 - DNA, 20 bp, Homo sapiens
aactgagccaaacacactgt

SEQ ID NO: 5093337 - DNA, 23 bp, Homo sapiens
aactgagccaaacacactgtaaa

SEQ ID NO: 5093338 - DNA, 13 bp, Homo sapiens
aactgagccccag

SEQ ID NO: 5093339 - DNA, 14 bp, Homo sapiens
aactgagccccagc

SEQ ID NO: 5093340 - DNA, 15 bp, Homo sapiens
aactgagccccagcg

SEQ ID NO: 5093341 - DNA, 10 bp, Homo sapiens
aactgagcct

SEQ ID NO: 5093342 - DNA, 13 bp, Homo sapiens
aactgagcctagc

SEQ ID NO: 5093343 - DNA, 13 bp, Homo sapiens
aactgagcgaccc

SEQ ID NO: 5093344 - DNA, 18 bp, Homo sapiens
aactgagctcctctgggc

SEQ ID NO: 5093345 - DNA, 22 bp, Homo sapiens
aactgagctcctctgggcagga

SEQ ID NO: 5093346 - DNA, 12 bp, Homo sapiens
aactgagctggg

SEQ ID NO: 5093347 - DNA, 13 bp, Homo sapiens
aactgagcttgga

SEQ ID NO: 5093348 - DNA, 12 bp, Homo sapiens
aactgaggaatt

SEQ ID NO: 5093349 - DNA, 16 bp, Homo sapiens
aactgaggaattttct

SEQ ID NO: 5093350 - DNA, 14 bp, Homo sapiens
aactgaggagtagc

SEQ ID NO: 5093351 - DNA, 11 bp, Homo sapiens
aactgaggccc

SEQ ID NO: 5093352 - DNA, 12 bp, Homo sapiens
aactgaggccct

SEQ ID NO: 5093353 - DNA, 16 bp, Homo sapiens
aactgagggcagagag

SEQ ID NO: 5093354 - DNA, 13 bp, Homo sapiens
aactgagggccag

SEQ ID NO: 5093355 - DNA, 19 bp, Homo sapiens
aactgagggctctgtttgt

SEQ ID NO: 5093356 - DNA, 13 bp, Homo sapiens
aactgagggctga

SEQ ID NO: 5093357 - DNA, 17 bp, Homo sapiens
aactgagggctgatctt

SEQ ID NO: 5093358 - DNA, 18 bp, Homo sapiens
aactgagtaaattggaaa

SEQ ID NO: 5093359 - DNA, 22 bp, Homo sapiens
aactgagtaaattggaaacatt

SEQ ID NO: 5093360 - DNA, 17 bp, Homo sapiens
aactgagtccatgaaaa

SEQ ID NO: 5093361 - DNA, 15 bp, Homo sapiens
aactgagtcctgttc

SEQ ID NO: 5093362 - DNA, 15 bp, Homo sapiens
aactgagtctgtgga

SEQ ID NO: 5093363 - DNA, 15 bp, Homo sapiens
aactgatagttactg

SEQ ID NO: 5093364 - DNA, 16 bp, Homo sapiens
aactgatagttactgt

SEQ ID NO: 5093365 - DNA, 17 bp, Homo sapiens
aactgatagttactgtt

SEQ ID NO: 5093366 - DNA, 22 bp, Homo sapiens
aactgatagttactgttgtgac

SEQ ID NO: 5093367 - DNA, 23 bp, Homo sapiens
aactgatatacttgagtgtgcaa

SEQ ID NO: 5093368 - DNA, 14 bp, Homo sapiens
aactgatcatgttt

SEQ ID NO: 5093369 - DNA, 19 bp, Homo sapiens
aactgatcatttgcagctg

SEQ ID NO: 5093370 - DNA, 17 bp, Homo sapiens
aactgatcctgctccag

SEQ ID NO: 5093371 - DNA, 18 bp, Homo sapiens
aactgatcctgctccagc

SEQ ID NO: 5093372 - DNA, 19 bp, Homo sapiens
aactgatcctgctccagca

SEQ ID NO: 5093373 - DNA, 22 bp, Homo sapiens
aactgatgagatacatttgatc

SEQ ID NO: 5093374 - DNA, 21 bp, Homo sapiens
aactgatgcgaaaacttgaat

SEQ ID NO: 5093375 - DNA, 13 bp, Homo sapiens
aactgatgtgaaa

SEQ ID NO: 5093376 - DNA, 18 bp, Homo sapiens
aactgatgttactagcct

SEQ ID NO: 5093377 - DNA, 13 bp, Homo sapiens
aactgattaaaaa

SEQ ID NO: 5093378 - DNA, 18 bp, Homo sapiens
aactgattaaaaatacct

SEQ ID NO: 5093379 - DNA, 21 bp, Homo sapiens
aactgattaaatatttgaaga

SEQ ID NO: 5093380 - DNA, 17 bp, Homo sapiens
aactgattagtattcag

SEQ ID NO: 5093381 - DNA, 19 bp, Homo sapiens
aactgattcacatctcatt

SEQ ID NO: 5093382 - DNA, 23 bp, Homo sapiens
aactgattgctcccaggatctcc

SEQ ID NO: 5093383 - DNA, 11 bp, Homo sapiens
aactgatttct

SEQ ID NO: 5093384 - DNA, 12 bp, Homo sapiens
aactgatttcta

SEQ ID NO: 5093385 - DNA, 13 bp, Homo sapiens
aactgatttctat

SEQ ID NO: 5093386 - DNA, 18 bp, Homo sapiens
aactgatttcttcagaat

SEQ ID NO: 5093387 - DNA, 16 bp, Homo sapiens
aactgattttgtatgt

SEQ ID NO: 5093388 - DNA, 17 bp, Homo sapiens
aactgatttttttttcc

SEQ ID NO: 5093389 - DNA, 21 bp, Homo sapiens
aactgatttttttttccttca

SEQ ID NO: 5093390 - DNA, 12 bp, Homo sapiens
aactgcaaaaaa

SEQ ID NO: 5093391 - DNA, 20 bp, Homo sapiens
aactgcaaaaaaagcctcca

SEQ ID NO: 5093392 - DNA, 14 bp, Homo sapiens
aactgcaaacagaa

SEQ ID NO: 5093393 - DNA, 14 bp, Homo sapiens
aactgcaaagaaag

SEQ ID NO: 5093394 - DNA, 13 bp, Homo sapiens
aactgcaaagctt

SEQ ID NO: 5093395 - DNA, 15 bp, Homo sapiens
aactgcaactccagc

SEQ ID NO: 5093396 - DNA, 17 bp, Homo sapiens
aactgcaagtcacaaag

SEQ ID NO: 5093397 - DNA, 23 bp, Homo sapiens
aactgcaagtcacaaaggaatgg

SEQ ID NO: 5093398 - DNA, 17 bp, Homo sapiens
aactgcaataacttctg

SEQ ID NO: 5093399 - DNA, 16 bp, Homo sapiens
aactgcaatagagact

SEQ ID NO: 5093400 - DNA, 18 bp, Homo sapiens
aactgcaatagagactgt

SEQ ID NO: 5093401 - DNA, 22 bp, Homo sapiens
aactgcaatagagactgtagat

SEQ ID NO: 5093402 - DNA, 23 bp, Homo sapiens
aactgcaatagagactgtagatt

SEQ ID NO: 5093403 - DNA, 17 bp, Homo sapiens
aactactcagggaatga

SEQ ID NO: 5093404 - DNA, 15 bp, Homo sapiens
aactactctttgatt

SEQ ID NO: 5093405 - DNA, 16 bp, Homo sapiens
aactactctttgattt

SEQ ID NO: 5093406 - DNA, 14 bp, Homo sapiens
aactactgaataaa

SEQ ID NO: 5093407 - DNA, 22 bp, Homo sapiens
aactactgaataaatcatgtgg

SEQ ID NO: 5093408 - DNA, 19 bp, Homo sapiens
aactactgaatgaagcagt

SEQ ID NO: 5093409 - DNA, 21 bp, Homo sapiens
aactactgaatgaagcagtat

SEQ ID NO: 5093410 - DNA, 19 bp, Homo sapiens
aactactgacgaaagagtc

SEQ ID NO: 5093411 - DNA, 14 bp, Homo sapiens
aactactgctattt

SEQ ID NO: 5093412 - DNA, 22 bp, Homo sapiens
aactactgctattttttttaaa

SEQ ID NO: 5093413 - DNA, 13 bp, Homo sapiens
aactactgtaatt

SEQ ID NO: 5093414 - DNA, 20 bp, Homo sapiens
aactactgtaattaagtgca

SEQ ID NO: 5093415 - DNA, 14 bp, Homo sapiens
aactactgtacatt

SEQ ID NO: 5093416 - DNA, 16 bp, Homo sapiens
aactactgtacatttt

SEQ ID NO: 5093417 - DNA, 12 bp, Homo sapiens
aactactgtact

SEQ ID NO: 5093418 - DNA, 15 bp, Homo sapiens
aactactgtactttg

SEQ ID NO: 5093419 - DNA, 17 bp, Homo sapiens
aactactgtgttatgca

SEQ ID NO: 5093420 - DNA, 14 bp, Homo sapiens
aactacttcatttt

SEQ ID NO: 5093421 - DNA, 20 bp, Homo sapiens
aactacttcattttctcaaa

SEQ ID NO: 5093422 - DNA, 22 bp, Homo sapiens
aactacttctcttgttaggtaa

SEQ ID NO: 5093423 - DNA, 17 bp, Homo sapiens
aactacttgcatttgat

SEQ ID NO: 5093424 - DNA, 20 bp, Homo sapiens
aactacttgcatttgatttt

SEQ ID NO: 5093425 - DNA, 19 bp, Homo sapiens
aactactttactaaattaa

SEQ ID NO: 5093426 - DNA, 17 bp, Homo sapiens
aactactttataactaa

SEQ ID NO: 5093427 - DNA, 19 bp, Homo sapiens
aactactttgctgctaata

SEQ ID NO: 5093428 - DNA, 16 bp, Homo sapiens
aactacttttctaaaa

SEQ ID NO: 5093429 - DNA, 18 bp, Homo sapiens
aactacttttctaaaatc

SEQ ID NO: 5093430 - DNA, 15 bp, Homo sapiens
aactactttttatac

SEQ ID NO: 5093431 - DNA, 16 bp, Homo sapiens
aactactttttatact

SEQ ID NO: 5093432 - DNA, 16 bp, Homo sapiens
aactagaaagaaggac

SEQ ID NO: 5093433 - DNA, 12 bp, Homo sapiens
aactagaagaaa

SEQ ID NO: 5093434 - DNA, 15 bp, Homo sapiens
aactagacaaaagtt

SEQ ID NO: 5093435 - DNA, 16 bp, Homo sapiens
aactagacaaaagttt

SEQ ID NO: 5093436 - DNA, 16 bp, Homo sapiens
aactagacattctgtc

SEQ ID NO: 5093437 - DNA, 21 bp, Homo sapiens
aactagactttcctttgcacc

SEQ ID NO: 5093438 - DNA, 21 bp, Homo sapiens
aactagagactctgtgatcta

SEQ ID NO: 5093439 - DNA, 20 bp, Homo sapiens
aactagagatgactgagtcc

SEQ ID NO: 5093440 - DNA, 12 bp, Homo sapiens
aactagagcacg

SEQ ID NO: 5093441 - DNA, 22 bp, Homo sapiens
aactagagcagccctggagtca

SEQ ID NO: 5093442 - DNA, 23 bp, Homo sapiens
aactagagcagccctggagtcat

SEQ ID NO: 5093443 - DNA, 18 bp, Homo sapiens
aactagaggttttatgat

SEQ ID NO: 5093444 - DNA, 20 bp, Homo sapiens
aactagaggttttatgatat

SEQ ID NO: 5093445 - DNA, 22 bp, Homo sapiens
aactagaggttttatgatattt

SEQ ID NO: 5093446 - DNA, 14 bp, Homo sapiens
aactagagtatgtg

SEQ ID NO: 5093447 - DNA, 19 bp, Homo sapiens
aactagagtatgtgtatgt

SEQ ID NO: 5093448 - DNA, 16 bp, Homo sapiens
aactagataacttaaa

SEQ ID NO: 5093449 - DNA, 19 bp, Homo sapiens
aactagataacttaaataa

SEQ ID NO: 5093450 - DNA, 17 bp, Homo sapiens
aactagatcaaggagcc

SEQ ID NO: 5093451 - DNA, 20 bp, Homo sapiens
aactagatcaaggagcccag

SEQ ID NO: 5093452 - DNA, 12 bp, Homo sapiens
aactagatctcc

SEQ ID NO: 5093453 - DNA, 16 bp, Homo sapiens
aactagatctcctgta

SEQ ID NO: 5093454 - DNA, 21 bp, Homo sapiens
aactagatctcctgtaatttt

SEQ ID NO: 5093455 - DNA, 14 bp, Homo sapiens
aactagatgacctc

SEQ ID NO: 5093456 - DNA, 14 bp, Homo sapiens
aactagatggtgct

SEQ ID NO: 5093457 - DNA, 17 bp, Homo sapiens
aactagatggtgctgag

SEQ ID NO: 5093458 - DNA, 20 bp, Homo sapiens
aactagcaatgcctgtgaaa

SEQ ID NO: 5093459 - DNA, 19 bp, Homo sapiens
aactagcatatctgccttt

SEQ ID NO: 5093460 - DNA, 16 bp, Homo sapiens
aactagcattcttaaa

SEQ ID NO: 5093461 - DNA, 21 bp, Homo sapiens
aactagccaaaccaggaccct

SEQ ID NO: 5093462 - DNA, 18 bp, Homo sapiens
aactagccagacaaaatt

SEQ ID NO: 5093463 - DNA, 22 bp, Homo sapiens
aactagccagacaaaatttgag

SEQ ID NO: 5093464 - DNA, 23 bp, Homo sapiens
aactagccagacaaaatttgaga

SEQ ID NO: 5093465 - DNA, 20 bp, Homo sapiens
aactagctctatgtttacaa

SEQ ID NO: 5093466 - DNA, 13 bp, Homo sapiens
aactagcttaagg

SEQ ID NO: 5093467 - DNA, 12 bp, Homo sapiens
aactaggaaaat

SEQ ID NO: 5093468 - DNA, 23 bp, Homo sapiens
aactaggagctttgactcaggag

SEQ ID NO: 5093469 - DNA, 16 bp, Homo sapiens
aactaggatatgtata

SEQ ID NO: 5093470 - DNA, 14 bp, Homo sapiens
aactaggatcagaa

SEQ ID NO: 5093471 - DNA, 16 bp, Homo sapiens
aactaggattataatg

SEQ ID NO: 5093472 - DNA, 22 bp, Homo sapiens
aactaggattataatgctgcct

SEQ ID NO: 5093473 - DNA, 17 bp, Homo sapiens
aactaggcatttgtaaa

SEQ ID NO: 5093474 - DNA, 16 bp, Homo sapiens
aactaggccatttgta

SEQ ID NO: 5093475 - DNA, 17 bp, Homo sapiens
aactaggccatttgtat

SEQ ID NO: 5093476 - DNA, 13 bp, Homo sapiens
aactaggctctta

SEQ ID NO: 5093477 - DNA, 12 bp, Homo sapiens
aactagggctag

SEQ ID NO: 5093478 - DNA, 22 bp, Homo sapiens
aactagggctagtcttccctta

SEQ ID NO: 5093479 - DNA, 17 bp, Homo sapiens
aactaggggaggagaga

SEQ ID NO: 5093480 - DNA, 18 bp, Homo sapiens
aactagggttttggcctg

SEQ ID NO: 5093481 - DNA, 19 bp, Homo sapiens
aactagggttttggcctgc

SEQ ID NO: 5093482 - DNA, 23 bp, Homo sapiens
aactaggtaatgttttgtatata

SEQ ID NO: 5093483 - DNA, 22 bp, Homo sapiens
aactaggtctgatattcaaatg

SEQ ID NO: 5093484 - DNA, 21 bp, Homo sapiens
aactaggtgcatatttataaa

SEQ ID NO: 5093485 - DNA, 21 bp, Homo sapiens
aactaggtgctgcagcccctg

SEQ ID NO: 5093486 - DNA, 13 bp, Homo sapiens
aactaggtttaaa

SEQ ID NO: 5093487 - DNA, 23 bp, Homo sapiens
aactagtaatgggccaattaaaa

SEQ ID NO: 5093488 - DNA, 17 bp, Homo sapiens
aactagtagttctcttg

SEQ ID NO: 5093489 - DNA, 14 bp, Homo sapiens
aactagtatctctg

SEQ ID NO: 5093490 - DNA, 15 bp, Homo sapiens
aactagtcctttact

SEQ ID NO: 5093491 - DNA, 22 bp, Homo sapiens
aactagtctacttcttaaaatt

SEQ ID NO: 5093492 - DNA, 21 bp, Homo sapiens
aactagtgtttctgcagaggc

SEQ ID NO: 5093493 - DNA, 22 bp, Homo sapiens
aactagtgtttctgcagaggca

SEQ ID NO: 5093494 - DNA, 17 bp, Homo sapiens
aactagttaaaagcctt

SEQ ID NO: 5093495 - DNA, 19 bp, Homo sapiens
aactagttaataagtggta

SEQ ID NO: 5093496 - DNA, 24 bp, Homo sapiens
aactagttcaaatgatgaagacca

SEQ ID NO: 5093497 - DNA, 22 bp, Homo sapiens
aactagttgtctgaattgagaa

SEQ ID NO: 5093498 - DNA, 16 bp, Homo sapiens
aactagtttccagtgg

SEQ ID NO: 5093499 - DNA, 15 bp, Homo sapiens
aactagttttgttta

SEQ ID NO: 5093500 - DNA, 23 bp, Homo sapiens
aactagtttttcctatcatgtta

SEQ ID NO: 5093501 - DNA, 14 bp, Homo sapiens
aactataaaaaaga

SEQ ID NO: 5093502 - DNA, 17 bp, Homo sapiens
aactataaactactgta

SEQ ID NO: 5093503 - DNA, 18 bp, Homo sapiens
aactataaactactgtaa

SEQ ID NO: 5093504 - DNA, 21 bp, Homo sapiens
aactataaacttaaagctact

SEQ ID NO: 5093505 - DNA, 23 bp, Homo sapiens
aactataaacttaagggcaagga

SEQ ID NO: 5093506 - DNA, 22 bp, Homo sapiens
aactataaagttttatttgaat

SEQ ID NO: 5093507 - DNA, 16 bp, Homo sapiens
aactataaatacaaat

SEQ ID NO: 5093508 - DNA, 17 bp, Homo sapiens
aactataaatacaaatc

SEQ ID NO: 5093509 - DNA, 16 bp, Homo sapiens
aactataaatatgtac

SEQ ID NO: 5093510 - DNA, 14 bp, Homo sapiens
aactataacaaaaa

SEQ ID NO: 5093511 - DNA, 21 bp, Homo sapiens
aactataacaaaaaaagaaaa

SEQ ID NO: 5093512 - DNA, 14 bp, Homo sapiens
aactataacattca

SEQ ID NO: 5093513 - DNA, 14 bp, Homo sapiens
aactatagtaactt

SEQ ID NO: 5093514 - DNA, 17 bp, Homo sapiens
aactatataagacatta

SEQ ID NO: 5093515 - DNA, 19 bp, Homo sapiens
aactatataagacattaag

SEQ ID NO: 5093516 - DNA, 15 bp, Homo sapiens
aactatatataatgt

SEQ ID NO: 5093517 - DNA, 19 bp, Homo sapiens
aactatatcagtagtgtac

SEQ ID NO: 5093518 - DNA, 22 bp, Homo sapiens
aactatatcagtagtgtacatt

SEQ ID NO: 5093519 - DNA, 18 bp, Homo sapiens
aactatatgtgaaacatt

SEQ ID NO: 5093520 - DNA, 14 bp, Homo sapiens
aactatatgtgaat

SEQ ID NO: 5093521 - DNA, 17 bp, Homo sapiens
aactatcaatatttaag

SEQ ID NO: 5093522 - DNA, 18 bp, Homo sapiens
aactatcaatatttaagt

SEQ ID NO: 5093523 - DNA, 19 bp, Homo sapiens
aactatcaatatttaagtt

SEQ ID NO: 5093524 - DNA, 16 bp, Homo sapiens
aactatcaattcttga

SEQ ID NO: 5093525 - DNA, 22 bp, Homo sapiens
aactatcaattcttgagaccca

SEQ ID NO: 5093526 - DNA, 14 bp, Homo sapiens
aactatcaggcaga

SEQ ID NO: 5093527 - DNA, 17 bp, Homo sapiens
aactatcaggcagaaga

SEQ ID NO: 5093528 - DNA, 14 bp, Homo sapiens
aactatcattttta

SEQ ID NO: 5093529 - DNA, 21 bp, Homo sapiens
aactatcccctgcgctttgaa

SEQ ID NO: 5093530 - DNA, 19 bp, Homo sapiens
aactatcctgattccaaat

SEQ ID NO: 5093531 - DNA, 21 bp, Homo sapiens
aactatcctgcgggttttaat

SEQ ID NO: 5093532 - DNA, 17 bp, Homo sapiens
aactatctcacttccag

SEQ ID NO: 5093533 - DNA, 18 bp, Homo sapiens
aactatctcacttccaga

SEQ ID NO: 5093534 - DNA, 20 bp, Homo sapiens
aactatctgaaagtaaagtt

SEQ ID NO: 5093535 - DNA, 14 bp, Homo sapiens
aactatctgcatta

SEQ ID NO: 5093536 - DNA, 16 bp, Homo sapiens
aactatctgcattatc

SEQ ID NO: 5093537 - DNA, 19 bp, Homo sapiens
aactatctggccatattta

SEQ ID NO: 5093538 - DNA, 15 bp, Homo sapiens
aactatctgtattta

SEQ ID NO: 5093539 - DNA, 14 bp, Homo sapiens
aactatcttctcta

SEQ ID NO: 5093540 - DNA, 18 bp, Homo sapiens
aactatcttctctatatt

SEQ ID NO: 5093541 - DNA, 23 bp, Homo sapiens
aactatcttctttggacttctga

SEQ ID NO: 5093542 - DNA, 15 bp, Homo sapiens
aactatgaaaccttt

SEQ ID NO: 5093543 - DNA, 13 bp, Homo sapiens
aactatgaaatcg

SEQ ID NO: 5093544 - DNA, 16 bp, Homo sapiens
aactatgaacactgtc

SEQ ID NO: 5093545 - DNA, 18 bp, Homo sapiens
aactatgacagatatatt

SEQ ID NO: 5093546 - DNA, 20 bp, Homo sapiens
aactatgacgtagcgagtta

SEQ ID NO: 5093547 - DNA, 18 bp, Homo sapiens
aactatgaggagcctctg

SEQ ID NO: 5093548 - DNA, 14 bp, Homo sapiens
aactatgataaatt

SEQ ID NO: 5093549 - DNA, 18 bp, Homo sapiens
aactatgatgtggagaaa

SEQ ID NO: 5093550 - DNA, 24 bp, Homo sapiens
aactatgcacctataaatactaaa

SEQ ID NO: 5093551 - DNA, 22 bp, Homo sapiens
aactatgcatggtgccccagga

SEQ ID NO: 5093552 - DNA, 23 bp, Homo sapiens
aactatgccgtgtagtttctggt

SEQ ID NO: 5093553 - DNA, 23 bp, Homo sapiens
aactatgcctatgtagtgtcttt

SEQ ID NO: 5093554 - DNA, 19 bp, Homo sapiens
aactatgcgtaaatcaact

SEQ ID NO: 5093555 - DNA, 21 bp, Homo sapiens
aactatggtgtgcttatgttt

SEQ ID NO: 5093556 - DNA, 22 bp, Homo sapiens
aactatggtgtgcttatgtttt

SEQ ID NO: 5093557 - DNA, 16 bp, Homo sapiens
aactatggttcccaat

SEQ ID NO: 5093558 - DNA, 13 bp, Homo sapiens
aactatgtacaat

SEQ ID NO: 5093559 - DNA, 19 bp, Homo sapiens
aactatgtacaatatttta

SEQ ID NO: 5093560 - DNA, 17 bp, Homo sapiens
aactatgtattaattta

SEQ ID NO: 5093561 - DNA, 20 bp, Homo sapiens
aactatgtgctatcacatgt

SEQ ID NO: 5093562 - DNA, 17 bp, Homo sapiens
aactatgtggctgaaaa

SEQ ID NO: 5093563 - DNA, 19 bp, Homo sapiens
aactatgtgtttttctcat

SEQ ID NO: 5093564 - DNA, 16 bp, Homo sapiens
aactatgttcctaaca

SEQ ID NO: 5093565 - DNA, 17 bp, Homo sapiens
aactatgttcctaacaa

SEQ ID NO: 5093566 - DNA, 20 bp, Homo sapiens
aactatgttcctaacaaaat

SEQ ID NO: 5093567 - DNA, 22 bp, Homo sapiens
aactatgttcctaacaaaatga

SEQ ID NO: 5093568 - DNA, 17 bp, Homo sapiens
aactatgtttaaagtaa

SEQ ID NO: 5093569 - DNA, 17 bp, Homo sapiens
aactattaaagtgccat

SEQ ID NO: 5093570 - DNA, 21 bp, Homo sapiens
aactattaaccttttttgtct

SEQ ID NO: 5093571 - DNA, 22 bp, Homo sapiens
aactattagagtatttcccttc

SEQ ID NO: 5093572 - DNA, 20 bp, Homo sapiens
aactattagtattattaaca

SEQ ID NO: 5093573 - DNA, 14 bp, Homo sapiens
aactattataaggc

SEQ ID NO: 5093574 - DNA, 15 bp, Homo sapiens
aactattatattgag

SEQ ID NO: 5093575 - DNA, 18 bp, Homo sapiens
aactattatgattattta

SEQ ID NO: 5093576 - DNA, 23 bp, Homo sapiens
aactattattaataaattttaac

SEQ ID NO: 5093577 - DNA, 20 bp, Homo sapiens
aactattcgaatgaaaagac

SEQ ID NO: 5093578 - DNA, 11 bp, Homo sapiens
aactattctgt

SEQ ID NO: 5093579 - DNA, 13 bp, Homo sapiens
aactgcaatgaaa

SEQ ID NO: 5093580 - DNA, 20 bp, Homo sapiens
aactgcaatgaaagtcaaat

SEQ ID NO: 5093581 - DNA, 21 bp, Homo sapiens
aactgcaatgaaagtcaaatt

SEQ ID NO: 5093582 - DNA, 15 bp, Homo sapiens
aactgcaatttccat

SEQ ID NO: 5093583 - DNA, 23 bp, Homo sapiens
aactgcacaataaaaccaagcct

SEQ ID NO: 5093584 - DNA, 15 bp, Homo sapiens
aactgcacaatgcat

SEQ ID NO: 5093585 - DNA, 21 bp, Homo sapiens
aactgcacagtgctgttggtg

SEQ ID NO: 5093586 - DNA, 13 bp, Homo sapiens
aactgcacatcta

SEQ ID NO: 5093587 - DNA, 17 bp, Homo sapiens
aactgcacatgatttca

SEQ ID NO: 5093588 - DNA, 19 bp, Homo sapiens
aactgcacatgatttcaca

SEQ ID NO: 5093589 - DNA, 21 bp, Homo sapiens
aactgcacctgggcagctcct

SEQ ID NO: 5093590 - DNA, 16 bp, Homo sapiens
aactgcagaaaaaata

SEQ ID NO: 5093591 - DNA, 14 bp, Homo sapiens
aactgcagaaagcc

SEQ ID NO: 5093592 - DNA, 17 bp, Homo sapiens
aactgcagacctgtcct

SEQ ID NO: 5093593 - DNA, 19 bp, Homo sapiens
aactgcagacctgtcctcc

SEQ ID NO: 5093594 - DNA, 16 bp, Homo sapiens
aactgcagatagccca

SEQ ID NO: 5093595 - DNA, 18 bp, Homo sapiens
aactgcagatagcccagg

SEQ ID NO: 5093596 - DNA, 20 bp, Homo sapiens
aactgcagcaatctttgaaa

SEQ ID NO: 5093597 - DNA, 22 bp, Homo sapiens
aactgcagcaatctttgaaaga

SEQ ID NO: 5093598 - DNA, 15 bp, Homo sapiens
aactgcagctctcca

SEQ ID NO: 5093599 - DNA, 24 bp, Homo sapiens
aactgcagctgggaagaggagcct

SEQ ID NO: 5093600 - DNA, 14 bp, Homo sapiens
aactgcagctgtga

SEQ ID NO: 5093601 - DNA, 10 bp, Homo sapiens
aactgcagga

SEQ ID NO: 5093602 - DNA, 13 bp, Homo sapiens
aactgcaggccct

SEQ ID NO: 5093603 - DNA, 20 bp, Homo sapiens
aactgcaggccctggcctcc

SEQ ID NO: 5093604 - DNA, 21 bp, Homo sapiens
aactgcaggccctggcctccc

SEQ ID NO: 5093605 - DNA, 23 bp, Homo sapiens
aactgcagggaaaattatttgca

SEQ ID NO: 5093606 - DNA, 16 bp, Homo sapiens
aactgcagtcactgca

SEQ ID NO: 5093607 - DNA, 19 bp, Homo sapiens
aactgcagtcatcaacaat

SEQ ID NO: 5093608 - DNA, 22 bp, Homo sapiens
aactgcatccaggcctgaggct

SEQ ID NO: 5093609 - DNA, 13 bp, Homo sapiens
aactgcatctgga

SEQ ID NO: 5093610 - DNA, 14 bp, Homo sapiens
aactgcatgtataa

SEQ ID NO: 5093611 - DNA, 14 bp, Homo sapiens
aactgcattagaaa

SEQ ID NO: 5093612 - DNA, 20 bp, Homo sapiens
aactgcattgagaactgcat

SEQ ID NO: 5093613 - DNA, 19 bp, Homo sapiens
aactgcattggttttccat

SEQ ID NO: 5093614 - DNA, 22 bp, Homo sapiens
aactgcattttaccagatgttt

SEQ ID NO: 5093615 - DNA, 20 bp, Homo sapiens
aactgcatttttaatcagtg

SEQ ID NO: 5093616 - DNA, 12 bp, Homo sapiens
aactgccaagaa

SEQ ID NO: 5093617 - DNA, 14 bp, Homo sapiens
aactgccaagggtg

SEQ ID NO: 5093618 - DNA, 17 bp, Homo sapiens
aactgccacaagcacaa

SEQ ID NO: 5093619 - DNA, 17 bp, Homo sapiens
aactgccagccttggag

SEQ ID NO: 5093620 - DNA, 20 bp, Homo sapiens
aactgccaggctgcctcctg

SEQ ID NO: 5093621 - DNA, 19 bp, Homo sapiens
aactgccataacataccac

SEQ ID NO: 5093622 - DNA, 22 bp, Homo sapiens
aactgccatgtaggctaagaaa

SEQ ID NO: 5093623 - DNA, 23 bp, Homo sapiens
aactgccattattttctgtcaga

SEQ ID NO: 5093624 - DNA, 16 bp, Homo sapiens
aactgccattggctat

SEQ ID NO: 5093625 - DNA, 16 bp, Homo sapiens
aactgcccagtttcca

SEQ ID NO: 5093626 - DNA, 18 bp, Homo sapiens
aactgcccattgtaactt

SEQ ID NO: 5093627 - DNA, 16 bp, Homo sapiens
aactgcccccaacttt

SEQ ID NO: 5093628 - DNA, 14 bp, Homo sapiens
aactgcccccactg

SEQ ID NO: 5093629 - DNA, 19 bp, Homo sapiens
aactgcccccctcctttcc

SEQ ID NO: 5093630 - DNA, 16 bp, Homo sapiens
aactgccccctctgcc

SEQ ID NO: 5093631 - DNA, 19 bp, Homo sapiens
aactgccccctctgccctg

SEQ ID NO: 5093632 - DNA, 14 bp, Homo sapiens
aactgccccgggtg

SEQ ID NO: 5093633 - DNA, 18 bp, Homo sapiens
aactgccctaagccccca

SEQ ID NO: 5093634 - DNA, 19 bp, Homo sapiens
aactgccctaagcccccag

SEQ ID NO: 5093635 - DNA, 13 bp, Homo sapiens
aactgcccttcca

SEQ ID NO: 5093636 - DNA, 19 bp, Homo sapiens
aactgccctttccctgcat

SEQ ID NO: 5093637 - DNA, 18 bp, Homo sapiens
aactgcccttttaaatgg

SEQ ID NO: 5093638 - DNA, 18 bp, Homo sapiens
aactgcctaaaatgttct

SEQ ID NO: 5093639 - DNA, 20 bp, Homo sapiens
aactgcctaccagtcgccct

SEQ ID NO: 5093640 - DNA, 20 bp, Homo sapiens
aactgcctattcacgccgta

SEQ ID NO: 5093641 - DNA, 17 bp, Homo sapiens
aactgcctccttgccag

SEQ ID NO: 5093642 - DNA, 15 bp, Homo sapiens
aactgcctctttcct

SEQ ID NO: 5093643 - DNA, 14 bp, Homo sapiens
aactgcctgggcca

SEQ ID NO: 5093644 - DNA, 19 bp, Homo sapiens
aactgcctggggggcaggg

SEQ ID NO: 5093645 - DNA, 14 bp, Homo sapiens
aactgcgaggacat

SEQ ID NO: 5093646 - DNA, 19 bp, Homo sapiens
aactgctaaattctatgtt

SEQ ID NO: 5093647 - DNA, 22 bp, Homo sapiens
aactgctaaattctatgttaaa

SEQ ID NO: 5093648 - DNA, 18 bp, Homo sapiens
aactgctacttgctctgc

SEQ ID NO: 5093649 - DNA, 16 bp, Homo sapiens
aactgctcagagcttt

SEQ ID NO: 5093650 - DNA, 16 bp, Homo sapiens
aactgctcagctctgg

SEQ ID NO: 5093651 - DNA, 21 bp, Homo sapiens
aactgctccaaatttaaccat

SEQ ID NO: 5093652 - DNA, 19 bp, Homo sapiens
aactgctccagcctctgcc

SEQ ID NO: 5093653 - DNA, 20 bp, Homo sapiens
aactgctccagcctctgccg

SEQ ID NO: 5093654 - DNA, 13 bp, Homo sapiens
aactgctcctcct

SEQ ID NO: 5093655 - DNA, 12 bp, Homo sapiens
aactgctctgcc

SEQ ID NO: 5093656 - DNA, 13 bp, Homo sapiens
aactgctctgccc

SEQ ID NO: 5093657 - DNA, 22 bp, Homo sapiens
aactgctcttgggcaatattct

SEQ ID NO: 5093658 - DNA, 23 bp, Homo sapiens
aactgctgaaaactagctcgtga

SEQ ID NO: 5093659 - DNA, 17 bp, Homo sapiens
aactgctgaattcacct

SEQ ID NO: 5093660 - DNA, 20 bp, Homo sapiens
aactgctgactgttttctct

SEQ ID NO: 5093661 - DNA, 18 bp, Homo sapiens
aactgctgatcaatgaaa

SEQ ID NO: 5093662 - DNA, 18 bp, Homo sapiens
aactgctgatgctcatgg

SEQ ID NO: 5093663 - DNA, 19 bp, Homo sapiens
aactgctgatgctcatggt

SEQ ID NO: 5093664 - DNA, 20 bp, Homo sapiens
aactgctgatgctcatggtc

SEQ ID NO: 5093665 - DNA, 17 bp, Homo sapiens
aactgctgcatactttg

SEQ ID NO: 5093666 - DNA, 14 bp, Homo sapiens
aactgctgccactg

SEQ ID NO: 5093667 - DNA, 23 bp, Homo sapiens
aactgctgcctgatttgttggga

SEQ ID NO: 5093668 - DNA, 11 bp, Homo sapiens
aactgctgctg

SEQ ID NO: 5093669 - DNA, 22 bp, Homo sapiens
aactgctgctgacccctgtgtg

SEQ ID NO: 5093670 - DNA, 20 bp, Homo sapiens
aactgctgcttaaaatgcaa

SEQ ID NO: 5093671 - DNA, 14 bp, Homo sapiens
aactgctgcttttt

SEQ ID NO: 5093672 - DNA, 13 bp, Homo sapiens
aactgctggggct

SEQ ID NO: 5093673 - DNA, 14 bp, Homo sapiens
aactgctggggctg

SEQ ID NO: 5093674 - DNA, 16 bp, Homo sapiens
aactgctggggctggt

SEQ ID NO: 5093675 - DNA, 14 bp, Homo sapiens
aactgctggtgatt

SEQ ID NO: 5093676 - DNA, 15 bp, Homo sapiens
aactgctgtaaaatt

SEQ ID NO: 5093677 - DNA, 20 bp, Homo sapiens
aactgctgttaattgattaa

SEQ ID NO: 5093678 - DNA, 20 bp, Homo sapiens
aactgctgttttatgtcata

SEQ ID NO: 5093679 - DNA, 20 bp, Homo sapiens
aactgcttcatctccttttg

SEQ ID NO: 5093680 - DNA, 19 bp, Homo sapiens
aactgcttcctttcttgat

SEQ ID NO: 5093681 - DNA, 21 bp, Homo sapiens
aactgcttctagaaactctgg

SEQ ID NO: 5093682 - DNA, 14 bp, Homo sapiens
aactgcttcttgga

SEQ ID NO: 5093683 - DNA, 17 bp, Homo sapiens
aactgcttcttggagct

SEQ ID NO: 5093684 - DNA, 14 bp, Homo sapiens
aactgcttgcattt

SEQ ID NO: 5093685 - DNA, 17 bp, Homo sapiens
aactgctttattttccc

SEQ ID NO: 5093686 - DNA, 22 bp, Homo sapiens
aactgctttatttttataaaac

SEQ ID NO: 5093687 - DNA, 18 bp, Homo sapiens
aactgctttctgttccaa

SEQ ID NO: 5093688 - DNA, 21 bp, Homo sapiens
aactgctttctttcgtttgtt

SEQ ID NO: 5093689 - DNA, 16 bp, Homo sapiens
aactgctttgtgcata

SEQ ID NO: 5093690 - DNA, 21 bp, Homo sapiens
aactgcttttcctcaagcaat

SEQ ID NO: 5093691 - DNA, 17 bp, Homo sapiens
aactgcttttcggaaca

SEQ ID NO: 5093692 - DNA, 22 bp, Homo sapiens
aactgcttttttttttccagca

SEQ ID NO: 5093693 - DNA, 19 bp, Homo sapiens
aactggaaaacagaacact

SEQ ID NO: 5093694 - DNA, 19 bp, Homo sapiens
aactggaaacaaaacagaa

SEQ ID NO: 5093695 - DNA, 18 bp, Homo sapiens
aactggaaatctggattt

SEQ ID NO: 5093696 - DNA, 13 bp, Homo sapiens
aactggaacattt

SEQ ID NO: 5093697 - DNA, 20 bp, Homo sapiens
aactggaaggctttattctt

SEQ ID NO: 5093698 - DNA, 13 bp, Homo sapiens
aactggaataata

SEQ ID NO: 5093699 - DNA, 15 bp, Homo sapiens
aactggaataatatt

SEQ ID NO: 5093700 - DNA, 17 bp, Homo sapiens
aactggaatagtttttt

SEQ ID NO: 5093701 - DNA, 10 bp, Homo sapiens
aactggacag

SEQ ID NO: 5093702 - DNA, 21 bp, Homo sapiens
aactggacatcacagcagaat

SEQ ID NO: 5093703 - DNA, 15 bp, Homo sapiens
aactggacatgaagg

SEQ ID NO: 5093704 - DNA, 18 bp, Homo sapiens
aactggacatgaaggaaa

SEQ ID NO: 5093705 - DNA, 14 bp, Homo sapiens
aactggaccctgtt

SEQ ID NO: 5093706 - DNA, 17 bp, Homo sapiens
aactggaccctgttgct

SEQ ID NO: 5093707 - DNA, 19 bp, Homo sapiens
aactggaccctgttgctaa

SEQ ID NO: 5093708 - DNA, 17 bp, Homo sapiens
aactggacgcccagctg

SEQ ID NO: 5093709 - DNA, 16 bp, Homo sapiens
aactggactcacattc

SEQ ID NO: 5093710 - DNA, 22 bp, Homo sapiens
aactggactcaggatgcccagg

SEQ ID NO: 5093711 - DNA, 16 bp, Homo sapiens
aactggagaaatgatt

SEQ ID NO: 5093712 - DNA, 18 bp, Homo sapiens
aactggagcaagaaggaa

SEQ ID NO: 5093713 - DNA, 17 bp, Homo sapiens
aactggagctgctaagc

SEQ ID NO: 5093714 - DNA, 15 bp, Homo sapiens
aactggagggtgggt

SEQ ID NO: 5093715 - DNA, 14 bp, Homo sapiens
aactggagtctgga

SEQ ID NO: 5093716 - DNA, 20 bp, Homo sapiens
aactggagtctggagtgggc

SEQ ID NO: 5093717 - DNA, 14 bp, Homo sapiens
aactggatgaacag

SEQ ID NO: 5093718 - DNA, 14 bp, Homo sapiens
aactggattatcta

SEQ ID NO: 5093719 - DNA, 22 bp, Homo sapiens
aactggcaaagcagaatgtgat

SEQ ID NO: 5093720 - DNA, 22 bp, Homo sapiens
aactggcaggcaggctcccagg

SEQ ID NO: 5093721 - DNA, 17 bp, Homo sapiens
aactggcagttttccat

SEQ ID NO: 5093722 - DNA, 17 bp, Homo sapiens
aactggcatctgctcta

SEQ ID NO: 5093723 - DNA, 17 bp, Homo sapiens
aactggcatgtcatttg

SEQ ID NO: 5093724 - DNA, 16 bp, Homo sapiens
aactggccaagctgag

SEQ ID NO: 5093725 - DNA, 13 bp, Homo sapiens
aactggccccagg

SEQ ID NO: 5093726 - DNA, 22 bp, Homo sapiens
aactggccccaggcggaggggc

SEQ ID NO: 5093727 - DNA, 23 bp, Homo sapiens
aactggccccaggcggaggggct

SEQ ID NO: 5093728 - DNA, 20 bp, Homo sapiens
aactggccccggatcagagc

SEQ ID NO: 5093729 - DNA, 15 bp, Homo sapiens
aactggcctaaattt

SEQ ID NO: 5093730 - DNA, 15 bp, Homo sapiens
aactggccttttgat

SEQ ID NO: 5093731 - DNA, 17 bp, Homo sapiens
aactggcgaagcctgag

SEQ ID NO: 5093732 - DNA, 20 bp, Homo sapiens
aactggcgatctcccagggc

SEQ ID NO: 5093733 - DNA, 14 bp, Homo sapiens
aactggctctgatt

SEQ ID NO: 5093734 - DNA, 23 bp, Homo sapiens
aactggctgaaaggttaattctc

SEQ ID NO: 5093735 - DNA, 11 bp, Homo sapiens
aactggctgca

SEQ ID NO: 5093736 - DNA, 15 bp, Homo sapiens
aactggctgctccct

SEQ ID NO: 5093737 - DNA, 18 bp, Homo sapiens
aactggctgctccctgct

SEQ ID NO: 5093738 - DNA, 19 bp, Homo sapiens
aactggctgctccctgctc

SEQ ID NO: 5093739 - DNA, 13 bp, Homo sapiens
aactggctggcca

SEQ ID NO: 5093740 - DNA, 17 bp, Homo sapiens
aactggctgggcccctg

SEQ ID NO: 5093741 - DNA, 18 bp, Homo sapiens
aactggctgggcccctgg

SEQ ID NO: 5093742 - DNA, 12 bp, Homo sapiens
aactggctgtgt

SEQ ID NO: 5093743 - DNA, 19 bp, Homo sapiens
aactggctgtttgatagca

SEQ ID NO: 5093744 - DNA, 22 bp, Homo sapiens
aactggcttgtacatttttaaa

SEQ ID NO: 5093745 - DNA, 18 bp, Homo sapiens
aactggctttttcccagc

SEQ ID NO: 5093746 - DNA, 18 bp, Homo sapiens
aactgggaacccctttcc

SEQ ID NO: 5093747 - DNA, 15 bp, Homo sapiens
aactgggaagaacaa

SEQ ID NO: 5093748 - DNA, 15 bp, Homo sapiens
aactgggacgtgtat

SEQ ID NO: 5093749 - DNA, 19 bp, Homo sapiens
aactgggataactgatttc

SEQ ID NO: 5093750 - DNA, 11 bp, Homo sapiens
aactgggctgg

SEQ ID NO: 5093751 - DNA, 15 bp, Homo sapiens
aactgggctgggcct

SEQ ID NO: 5093752 - DNA, 13 bp, Homo sapiens
aactggggaaaag

SEQ ID NO: 5093753 - DNA, 23 bp, Homo sapiens
aactggggagttataaaaataca

SEQ ID NO: 5093754 - DNA, 22 bp, Homo sapiens
aactgggggagggtgaagtgaa

SEQ ID NO: 5093755 - DNA, 15 bp, Homo sapiens
aactggggggccacc

SEQ ID NO: 5093756 - DNA, 17 bp, Homo sapiens
aactggggggccaccat

SEQ ID NO: 5093757 - DNA, 18 bp, Homo sapiens
aactggggtgatgtttta

SEQ ID NO: 5093758 - DNA, 12 bp, Homo sapiens
aactattctgtt

SEQ ID NO: 5093759 - DNA, 15 bp, Homo sapiens
aactattctgttcca

SEQ ID NO: 5093760 - DNA, 12 bp, Homo sapiens
aactattcttaa

SEQ ID NO: 5093761 - DNA, 15 bp, Homo sapiens
aactattcttcattt

SEQ ID NO: 5093762 - DNA, 21 bp, Homo sapiens
aactattgcatttatatgtac

SEQ ID NO: 5093763 - DNA, 20 bp, Homo sapiens
aactattgggtgaatatggt

SEQ ID NO: 5093764 - DNA, 21 bp, Homo sapiens
aactattgtgctcagagacac

SEQ ID NO: 5093765 - DNA, 22 bp, Homo sapiens
aactattgtgctcagagacact

SEQ ID NO: 5093766 - DNA, 20 bp, Homo sapiens
aactatttaaaataaagagg

SEQ ID NO: 5093767 - DNA, 12 bp, Homo sapiens
aactatttaaca

SEQ ID NO: 5093768 - DNA, 16 bp, Homo sapiens
aactatttaacttgag

SEQ ID NO: 5093769 - DNA, 14 bp, Homo sapiens
aactatttactttt

SEQ ID NO: 5093770 - DNA, 20 bp, Homo sapiens
aactatttagagaatgattt

SEQ ID NO: 5093771 - DNA, 17 bp, Homo sapiens
aactatttagtgttagt

SEQ ID NO: 5093772 - DNA, 21 bp, Homo sapiens
aactatttatatcacacaata

SEQ ID NO: 5093773 - DNA, 22 bp, Homo sapiens
aactatttattgtgctgggtcc

SEQ ID NO: 5093774 - DNA, 13 bp, Homo sapiens
aactatttcacat

SEQ ID NO: 5093775 - DNA, 16 bp, Homo sapiens
aactatttctacacag

SEQ ID NO: 5093776 - DNA, 17 bp, Homo sapiens
aactatttcttatatat

SEQ ID NO: 5093777 - DNA, 19 bp, Homo sapiens
aactatttctttcatcaga

SEQ ID NO: 5093778 - DNA, 18 bp, Homo sapiens
aactatttgtctttcagg

SEQ ID NO: 5093779 - DNA, 17 bp, Homo sapiens
aactattttcaaagact

SEQ ID NO: 5093780 - DNA, 16 bp, Homo sapiens
aactattttgttttaa

SEQ ID NO: 5093781 - DNA, 18 bp, Homo sapiens
aactattttgttttaatc

SEQ ID NO: 5093782 - DNA, 19 bp, Homo sapiens
aactattttgttttaatct

SEQ ID NO: 5093783 - DNA, 20 bp, Homo sapiens
aactattttgttttaatcta

SEQ ID NO: 5093784 - DNA, 13 bp, Homo sapiens
aactatttttaag

SEQ ID NO: 5093785 - DNA, 22 bp, Homo sapiens
aactatttttaaggtctaatca

SEQ ID NO: 5093786 - DNA, 14 bp, Homo sapiens
aactatttttgtaa

SEQ ID NO: 5093787 - DNA, 16 bp, Homo sapiens
aactatttttgtatag

SEQ ID NO: 5093788 - DNA, 20 bp, Homo sapiens
aactatttttgtgtttgaaa

SEQ ID NO: 5093789 - DNA, 23 bp, Homo sapiens
aactatttttttagttaatattt

SEQ ID NO: 5093790 - DNA, 16 bp, Homo sapiens
aactatttttttcaaa

SEQ ID NO: 5093791 - DNA, 17 bp, Homo sapiens
aactcaaaaccatctct

SEQ ID NO: 5093792 - DNA, 13 bp, Homo sapiens
aactcaaaagttg

SEQ ID NO: 5093793 - DNA, 15 bp, Homo sapiens
aactcaaaatatttg

SEQ ID NO: 5093794 - DNA, 22 bp, Homo sapiens
aactcaaactgaggaatttcac

SEQ ID NO: 5093795 - DNA, 23 bp, Homo sapiens
aactcaaacttctggctccctct

SEQ ID NO: 5093796 - DNA, 18 bp, Homo sapiens
aactcaaagacttcctct

SEQ ID NO: 5093797 - DNA, 21 bp, Homo sapiens
aactcaaagcaagctcttctc

SEQ ID NO: 5093798 - DNA, 14 bp, Homo sapiens
aactcaaaggactg

SEQ ID NO: 5093799 - DNA, 15 bp, Homo sapiens
aactcaacattactg

SEQ ID NO: 5093800 - DNA, 19 bp, Homo sapiens
aactcaaccaaatggtaca

SEQ ID NO: 5093801 - DNA, 12 bp, Homo sapiens
aactcaaccaga

SEQ ID NO: 5093802 - DNA, 23 bp, Homo sapiens
aactcaactgtctattgtcacat

SEQ ID NO: 5093803 - DNA, 20 bp, Homo sapiens
aactcaagaatttctaaact

SEQ ID NO: 5093804 - DNA, 13 bp, Homo sapiens
aactcaagacaat

SEQ ID NO: 5093805 - DNA, 16 bp, Homo sapiens
aactcaaggaaaagtt

SEQ ID NO: 5093806 - DNA, 20 bp, Homo sapiens
aactcaaggaaaagttcttt

SEQ ID NO: 5093807 - DNA, 23 bp, Homo sapiens
aactcaaggaaaagttctttcaa

SEQ ID NO: 5093808 - DNA, 23 bp, Homo sapiens
aactcaaggataccttcttattt

SEQ ID NO: 5093809 - DNA, 13 bp, Homo sapiens
aactcaatatata

SEQ ID NO: 5093810 - DNA, 18 bp, Homo sapiens
aactcaatatatagttag

SEQ ID NO: 5093811 - DNA, 23 bp, Homo sapiens
aactcaatatatagttagcttta

SEQ ID NO: 5093812 - DNA, 14 bp, Homo sapiens
aactcaatattttc

SEQ ID NO: 5093813 - DNA, 21 bp, Homo sapiens
aactcaatattttccatgaaa

SEQ ID NO: 5093814 - DNA, 16 bp, Homo sapiens
aactcaatgcatgatg

SEQ ID NO: 5093815 - DNA, 18 bp, Homo sapiens
aactcacacctccttttc

SEQ ID NO: 5093816 - DNA, 21 bp, Homo sapiens
aactcacagactgctgtctta

SEQ ID NO: 5093817 - DNA, 15 bp, Homo sapiens
aactcacagagcttt

SEQ ID NO: 5093818 - DNA, 14 bp, Homo sapiens
aactcacagcttct

SEQ ID NO: 5093819 - DNA, 15 bp, Homo sapiens
aactcacagcttctc

SEQ ID NO: 5093820 - DNA, 22 bp, Homo sapiens
aactcacagcttctccaagcat

SEQ ID NO: 5093821 - DNA, 20 bp, Homo sapiens
aactcaccagccccactgcc

SEQ ID NO: 5093822 - DNA, 17 bp, Homo sapiens
aactcaccaggttgctt

SEQ ID NO: 5093823 - DNA, 16 bp, Homo sapiens
aactcaccatgtaaaa

SEQ ID NO: 5093824 - DNA, 13 bp, Homo sapiens
aactcaccatttc

SEQ ID NO: 5093825 - DNA, 16 bp, Homo sapiens
aactcaccccagcccc

SEQ ID NO: 5093826 - DNA, 17 bp, Homo sapiens
aactcaccccagcccca

SEQ ID NO: 5093827 - DNA, 18 bp, Homo sapiens
aactcaccccagccccaa

SEQ ID NO: 5093828 - DNA, 14 bp, Homo sapiens
aactcacccttggc

SEQ ID NO: 5093829 - DNA, 17 bp, Homo sapiens
aactcacctctcaaggt

SEQ ID NO: 5093830 - DNA, 16 bp, Homo sapiens
aactcacctgctggcc

SEQ ID NO: 5093831 - DNA, 20 bp, Homo sapiens
aactcacctggcatcttaca

SEQ ID NO: 5093832 - DNA, 15 bp, Homo sapiens
aactcacctggggct

SEQ ID NO: 5093833 - DNA, 17 bp, Homo sapiens
aactcacgatgaaattg

SEQ ID NO: 5093834 - DNA, 22 bp, Homo sapiens
aactcacgatgaaattgaacct

SEQ ID NO: 5093835 - DNA, 17 bp, Homo sapiens
aactcactcttatgaaa

SEQ ID NO: 5093836 - DNA, 14 bp, Homo sapiens
aactcactgcctag

SEQ ID NO: 5093837 - DNA, 15 bp, Homo sapiens
aactcactggaatgt

SEQ ID NO: 5093838 - DNA, 14 bp, Homo sapiens
aactcactttcctc

SEQ ID NO: 5093839 - DNA, 13 bp, Homo sapiens
aactcagaagaga

SEQ ID NO: 5093840 - DNA, 17 bp, Homo sapiens
aactcagaaggctttgg

SEQ ID NO: 5093841 - DNA, 21 bp, Homo sapiens
aactcagaatatattcacttt

SEQ ID NO: 5093842 - DNA, 16 bp, Homo sapiens
aactcagaatgctcta

SEQ ID NO: 5093843 - DNA, 14 bp, Homo sapiens
aactcagaatgggg

SEQ ID NO: 5093844 - DNA, 18 bp, Homo sapiens
aactcagaattattttta

SEQ ID NO: 5093845 - DNA, 23 bp, Homo sapiens
aactcagagaaaaatgctcccca

SEQ ID NO: 5093846 - DNA, 21 bp, Homo sapiens
aactcagatcactactgcagt

SEQ ID NO: 5093847 - DNA, 22 bp, Homo sapiens
aactcagatccagggacagagg

SEQ ID NO: 5093848 - DNA, 19 bp, Homo sapiens
aactcagatctgatcaaga

SEQ ID NO: 5093849 - DNA, 16 bp, Homo sapiens
aactcagattgactaa

SEQ ID NO: 5093850 - DNA, 20 bp, Homo sapiens
aactcagattgactaaataa

SEQ ID NO: 5093851 - DNA, 21 bp, Homo sapiens
aactcagattgactaaataaa

SEQ ID NO: 5093852 - DNA, 16 bp, Homo sapiens
aactcagccaagcaca

SEQ ID NO: 5093853 - DNA, 20 bp, Homo sapiens
aactcagccaagcacagtgg

SEQ ID NO: 5093854 - DNA, 12 bp, Homo sapiens
aactcagcctgt

SEQ ID NO: 5093855 - DNA, 16 bp, Homo sapiens
aactcagcctgttcct

SEQ ID NO: 5093856 - DNA, 21 bp, Homo sapiens
aactcagcctgttccttcctg

SEQ ID NO: 5093857 - DNA, 23 bp, Homo sapiens
aactcagcctgttccttcctgca

SEQ ID NO: 5093858 - DNA, 13 bp, Homo sapiens
aactcagccttaa

SEQ ID NO: 5093859 - DNA, 20 bp, Homo sapiens
aactcagctattaagaaaat

SEQ ID NO: 5093860 - DNA, 21 bp, Homo sapiens
aactcagctattaagaaaatc

SEQ ID NO: 5093861 - DNA, 13 bp, Homo sapiens
aactcaggatgcc

SEQ ID NO: 5093862 - DNA, 12 bp, Homo sapiens
aactcaggcatt

SEQ ID NO: 5093863 - DNA, 14 bp, Homo sapiens
aactcagtatttta

SEQ ID NO: 5093864 - DNA, 20 bp, Homo sapiens
aactcagtcctgtactctgg

SEQ ID NO: 5093865 - DNA, 19 bp, Homo sapiens
aactcagtctcaaataata

SEQ ID NO: 5093866 - DNA, 20 bp, Homo sapiens
aactcagtctcaaataataa

SEQ ID NO: 5093867 - DNA, 22 bp, Homo sapiens
aactcagtgaaggcccatgaag

SEQ ID NO: 5093868 - DNA, 19 bp, Homo sapiens
aactcagttcaaaccattt

SEQ ID NO: 5093869 - DNA, 21 bp, Homo sapiens
aactcatacagtctctatttg

SEQ ID NO: 5093870 - DNA, 18 bp, Homo sapiens
aactcatacctttaaagg

SEQ ID NO: 5093871 - DNA, 23 bp, Homo sapiens
aactcatactgtgctggagccac

SEQ ID NO: 5093872 - DNA, 14 bp, Homo sapiens
aactcatattttga

SEQ ID NO: 5093873 - DNA, 19 bp, Homo sapiens
aactcatcacataaagaaa

SEQ ID NO: 5093874 - DNA, 16 bp, Homo sapiens
aactcatcataaaata

SEQ ID NO: 5093875 - DNA, 17 bp, Homo sapiens
aactcatcataaaataa

SEQ ID NO: 5093876 - DNA, 19 bp, Homo sapiens
aactcatccagaactgtct

SEQ ID NO: 5093877 - DNA, 21 bp, Homo sapiens
aactcatccctaatgctgcag

SEQ ID NO: 5093878 - DNA, 17 bp, Homo sapiens
aactcatcccttgttta

SEQ ID NO: 5093879 - DNA, 17 bp, Homo sapiens
aactcatcctcttttaa

SEQ ID NO: 5093880 - DNA, 19 bp, Homo sapiens
aactcatctgaaatgttac

SEQ ID NO: 5093881 - DNA, 22 bp, Homo sapiens
aactcatctttagagcaacagt

SEQ ID NO: 5093882 - DNA, 18 bp, Homo sapiens
aactcatgaacaaaatga

SEQ ID NO: 5093883 - DNA, 18 bp, Homo sapiens
aactcatgggtacccaga

SEQ ID NO: 5093884 - DNA, 14 bp, Homo sapiens
aactcattccagat

SEQ ID NO: 5093885 - DNA, 15 bp, Homo sapiens
aactcattccagatc

SEQ ID NO: 5093886 - DNA, 15 bp, Homo sapiens
aactcattcctgcct

SEQ ID NO: 5093887 - DNA, 19 bp, Homo sapiens
aactcattcctgcctgtct

SEQ ID NO: 5093888 - DNA, 22 bp, Homo sapiens
aactcattgcagcagataactt

SEQ ID NO: 5093889 - DNA, 22 bp, Homo sapiens
aactcatttcctatgtaactgc

SEQ ID NO: 5093890 - DNA, 12 bp, Homo sapiens
aactcatttcta

SEQ ID NO: 5093891 - DNA, 17 bp, Homo sapiens
aactcatttttgccata

SEQ ID NO: 5093892 - DNA, 18 bp, Homo sapiens
aactccaaacaattctga

SEQ ID NO: 5093893 - DNA, 16 bp, Homo sapiens
aactccaacatccact

SEQ ID NO: 5093894 - DNA, 23 bp, Homo sapiens
aactccaacctctcggccccatc

SEQ ID NO: 5093895 - DNA, 14 bp, Homo sapiens
aactccaagcagac

SEQ ID NO: 5093896 - DNA, 16 bp, Homo sapiens
aactccaagcagactc

SEQ ID NO: 5093897 - DNA, 13 bp, Homo sapiens
aactccaaggcaa

SEQ ID NO: 5093898 - DNA, 19 bp, Homo sapiens
aactccaaggcaaatgtcc

SEQ ID NO: 5093899 - DNA, 14 bp, Homo sapiens
aactccacatctgc

SEQ ID NO: 5093900 - DNA, 15 bp, Homo sapiens
aactccaccaaccca

SEQ ID NO: 5093901 - DNA, 23 bp, Homo sapiens
aactccaccaacccatcagaagg

SEQ ID NO: 5093902 - DNA, 19 bp, Homo sapiens
aactccaccgaccaactgc

SEQ ID NO: 5093903 - DNA, 21 bp, Homo sapiens
aactccaccgaccaactgccc

SEQ ID NO: 5093904 - DNA, 22 bp, Homo sapiens
aactccaccgaccaactgccct

SEQ ID NO: 5093905 - DNA, 23 bp, Homo sapiens
aactccaccgaccaactgcccta

SEQ ID NO: 5093906 - DNA, 13 bp, Homo sapiens
aactccactcagc

SEQ ID NO: 5093907 - DNA, 14 bp, Homo sapiens
aactccactcagca

SEQ ID NO: 5093908 - DNA, 14 bp, Homo sapiens
aactccagaaagtg

SEQ ID NO: 5093909 - DNA, 15 bp, Homo sapiens
aactccagacttggg

SEQ ID NO: 5093910 - DNA, 21 bp, Homo sapiens
aactccagccacccagccagg

SEQ ID NO: 5093911 - DNA, 22 bp, Homo sapiens
aactccagccacccagccagga

SEQ ID NO: 5093912 - DNA, 16 bp, Homo sapiens
aactccagctgagtcc

SEQ ID NO: 5093913 - DNA, 13 bp, Homo sapiens
aactccaggaaaa

SEQ ID NO: 5093914 - DNA, 19 bp, Homo sapiens
aactccaggacgaggagga

SEQ ID NO: 5093915 - DNA, 10 bp, Homo sapiens
aactccaggc

SEQ ID NO: 5093916 - DNA, 13 bp, Homo sapiens
aactccaggcatg

SEQ ID NO: 5093917 - DNA, 16 bp, Homo sapiens
aactccaggctggaag

SEQ ID NO: 5093918 - DNA, 15 bp, Homo sapiens
aactccaggctgggc

SEQ ID NO: 5093919 - DNA, 18 bp, Homo sapiens
aactccagggtcccctgc

SEQ ID NO: 5093920 - DNA, 19 bp, Homo sapiens
aactccagtactggagctt

SEQ ID NO: 5093921 - DNA, 18 bp, Homo sapiens
aactccataagtaagaaa

SEQ ID NO: 5093922 - DNA, 15 bp, Homo sapiens
aactccatacagcct

SEQ ID NO: 5093923 - DNA, 19 bp, Homo sapiens
aactccatacagcctctac

SEQ ID NO: 5093924 - DNA, 16 bp, Homo sapiens
aactccatatgtgttc

SEQ ID NO: 5093925 - DNA, 20 bp, Homo sapiens
aactccatcgccatcttctt

SEQ ID NO: 5093926 - DNA, 18 bp, Homo sapiens
aactccatctgacaaatt

SEQ ID NO: 5093927 - DNA, 17 bp, Homo sapiens
aactccatgaccaggcc

SEQ ID NO: 5093928 - DNA, 23 bp, Homo sapiens
aactccatgggattttatctgtg

SEQ ID NO: 5093929 - DNA, 10 bp, Homo sapiens
aactccattt

SEQ ID NO: 5093930 - DNA, 19 bp, Homo sapiens
aactcccatatctccttta

SEQ ID NO: 5093931 - DNA, 15 bp, Homo sapiens
aactcccattaccat

SEQ ID NO: 5093932 - DNA, 17 bp, Homo sapiens
aactcccccattttaca

SEQ ID NO: 5093933 - DNA, 17 bp, Homo sapiens
aactcccctgtttcaat

SEQ ID NO: 5093934 - DNA, 19 bp, Homo sapiens
aactcccctgtttcaatca

SEQ ID NO: 5093935 - DNA, 19 bp, Homo sapiens
aactccccttcctcactgc

SEQ ID NO: 5093936 - DNA, 20 bp, Homo sapiens
aactggggttcaagcccagg

SEQ ID NO: 5093937 - DNA, 21 bp, Homo sapiens
aactggggttcaagcccaggc

SEQ ID NO: 5093938 - DNA, 21 bp, Homo sapiens
aactgggtacccaaaacacat

SEQ ID NO: 5093939 - DNA, 17 bp, Homo sapiens
aactgggtcttcagctt

SEQ ID NO: 5093940 - DNA, 19 bp, Homo sapiens
aactgggttcaaaaagaaa

SEQ ID NO: 5093941 - DNA, 21 bp, Homo sapiens
aactgggttgagggatgctgg

SEQ ID NO: 5093942 - DNA, 15 bp, Homo sapiens
aactgggtttctcat

SEQ ID NO: 5093943 - DNA, 22 bp, Homo sapiens
aactgggttttcagcataaatg

SEQ ID NO: 5093944 - DNA, 15 bp, Homo sapiens
aactggtagaaaaac

SEQ ID NO: 5093945 - DNA, 20 bp, Homo sapiens
aactggtagttcattgtaaa

SEQ ID NO: 5093946 - DNA, 22 bp, Homo sapiens
aactggtccactcagggctgcc

SEQ ID NO: 5093947 - DNA, 17 bp, Homo sapiens
aactggtcttccttttt

SEQ ID NO: 5093948 - DNA, 16 bp, Homo sapiens
aactggtgatataaag

SEQ ID NO: 5093949 - DNA, 16 bp, Homo sapiens
aactggtgcatgacaa

SEQ ID NO: 5093950 - DNA, 14 bp, Homo sapiens
aactggttcaggct

SEQ ID NO: 5093951 - DNA, 20 bp, Homo sapiens
aactggttctgtgttgaaat

SEQ ID NO: 5093952 - DNA, 19 bp, Homo sapiens
aactggttgtagtgggaag

SEQ ID NO: 5093953 - DNA, 22 bp, Homo sapiens
aactggtttagcacaatttata

SEQ ID NO: 5093954 - DNA, 15 bp, Homo sapiens
aactggtttataata

SEQ ID NO: 5093955 - DNA, 20 bp, Homo sapiens
aactggtttgaaatttttga

SEQ ID NO: 5093956 - DNA, 15 bp, Homo sapiens
aactgtaaaagtgta

SEQ ID NO: 5093957 - DNA, 15 bp, Homo sapiens
aactgtaaaatactt

SEQ ID NO: 5093958 - DNA, 22 bp, Homo sapiens
aactgtaaacttggaatcaagg

SEQ ID NO: 5093959 - DNA, 14 bp, Homo sapiens
aactgtaaagatgt

SEQ ID NO: 5093960 - DNA, 14 bp, Homo sapiens
aactgtaaagcaaa

SEQ ID NO: 5093961 - DNA, 18 bp, Homo sapiens
aactgtaaagttcaattg

SEQ ID NO: 5093962 - DNA, 10 bp, Homo sapiens
aactgtaaat

SEQ ID NO: 5093963 - DNA, 13 bp, Homo sapiens
aactgtaaataaa

SEQ ID NO: 5093964 - DNA, 13 bp, Homo sapiens
aactgtaaataca

SEQ ID NO: 5093965 - DNA, 21 bp, Homo sapiens
aactgtaaatatgtttgtgcc

SEQ ID NO: 5093966 - DNA, 15 bp, Homo sapiens
aactgtaaatcactt

SEQ ID NO: 5093967 - DNA, 16 bp, Homo sapiens
aactgtaaatcacttg

SEQ ID NO: 5093968 - DNA, 20 bp, Homo sapiens
aactgtaaatcacttgtaaa

SEQ ID NO: 5093969 - DNA, 22 bp, Homo sapiens
aactgtaaatcacttgtaaata

SEQ ID NO: 5093970 - DNA, 23 bp, Homo sapiens
aactgtaaatcacttgtaaataa

SEQ ID NO: 5093971 - DNA, 17 bp, Homo sapiens
aactgtaaatcataatg

SEQ ID NO: 5093972 - DNA, 17 bp, Homo sapiens
aactgtaataacttcta

SEQ ID NO: 5093973 - DNA, 18 bp, Homo sapiens
aactgtaattatttgaat

SEQ ID NO: 5093974 - DNA, 16 bp, Homo sapiens
aactgtacaaatgaaa

SEQ ID NO: 5093975 - DNA, 10 bp, Homo sapiens
aactgtacag

SEQ ID NO: 5093976 - DNA, 18 bp, Homo sapiens
aactgtacagaatttcca

SEQ ID NO: 5093977 - DNA, 16 bp, Homo sapiens
aactgtacattgtgag

SEQ ID NO: 5093978 - DNA, 13 bp, Homo sapiens
aactgtacatttc

SEQ ID NO: 5093979 - DNA, 17 bp, Homo sapiens
aactgtactgttttctg

SEQ ID NO: 5093980 - DNA, 13 bp, Homo sapiens
aactgtactttga

SEQ ID NO: 5093981 - DNA, 20 bp, Homo sapiens
aactgtactttgattcacat

SEQ ID NO: 5093982 - DNA, 18 bp, Homo sapiens
aactgtacttttaaggca

SEQ ID NO: 5093983 - DNA, 14 bp, Homo sapiens
aactgtagaaatga

SEQ ID NO: 5093984 - DNA, 15 bp, Homo sapiens
aactgtagaaatgat

SEQ ID NO: 5093985 - DNA, 17 bp, Homo sapiens
aactgtagaaatgatga

SEQ ID NO: 5093986 - DNA, 16 bp, Homo sapiens
aactgtagccaccctg

SEQ ID NO: 5093987 - DNA, 14 bp, Homo sapiens
aactgtagtaattg

SEQ ID NO: 5093988 - DNA, 15 bp, Homo sapiens
aactgtagtaattgt

SEQ ID NO: 5093989 - DNA, 14 bp, Homo sapiens
aactgtatatattc

SEQ ID NO: 5093990 - DNA, 16 bp, Homo sapiens
aactgtatattattgc

SEQ ID NO: 5093991 - DNA, 18 bp, Homo sapiens
aactgtatcatctttgcc

SEQ ID NO: 5093992 - DNA, 15 bp, Homo sapiens
aactgtatgtacata

SEQ ID NO: 5093993 - DNA, 15 bp, Homo sapiens
aactgtattattgca

SEQ ID NO: 5093994 - DNA, 21 bp, Homo sapiens
aactgtattgaaaaaatattg

SEQ ID NO: 5093995 - DNA, 14 bp, Homo sapiens
aactgtatttcagt

SEQ ID NO: 5093996 - DNA, 15 bp, Homo sapiens
aactgtatttcagta

SEQ ID NO: 5093997 - DNA, 16 bp, Homo sapiens
aactgtatttcagtat

SEQ ID NO: 5093998 - DNA, 17 bp, Homo sapiens
aactgtatttcagtatt

SEQ ID NO: 5093999 - DNA, 22 bp, Homo sapiens
aactgtatttcagtattttcca

SEQ ID NO: 5094000 - DNA, 19 bp, Homo sapiens
aactgtatttttgaagact

SEQ ID NO: 5094001 - DNA, 21 bp, Homo sapiens
aactgtcaaagaatcaatcca

SEQ ID NO: 5094002 - DNA, 18 bp, Homo sapiens
aactgtcaaatatgttct

SEQ ID NO: 5094003 - DNA, 15 bp, Homo sapiens
aactgtcaccctgag

SEQ ID NO: 5094004 - DNA, 16 bp, Homo sapiens
aactgtcaccctgagg

SEQ ID NO: 5094005 - DNA, 19 bp, Homo sapiens
aactgtcagcccacagcag

SEQ ID NO: 5094006 - DNA, 17 bp, Homo sapiens
aactgtcagttcatcct

SEQ ID NO: 5094007 - DNA, 18 bp, Homo sapiens
aactgtcagttcatcctg

SEQ ID NO: 5094008 - DNA, 13 bp, Homo sapiens
aactgtcatgata

SEQ ID NO: 5094009 - DNA, 22 bp, Homo sapiens
aactgtccagtccagtgatgtg

SEQ ID NO: 5094010 - DNA, 20 bp, Homo sapiens
aactgtcccaaggagggggc

SEQ ID NO: 5094011 - DNA, 13 bp, Homo sapiens
aactgtcccagct

SEQ ID NO: 5094012 - DNA, 19 bp, Homo sapiens
aactgtcccatccccaggt

SEQ ID NO: 5094013 - DNA, 17 bp, Homo sapiens
aactgtcctctttcaga

SEQ ID NO: 5094014 - DNA, 19 bp, Homo sapiens
aactgtcctctttcagaaa

SEQ ID NO: 5094015 - DNA, 18 bp, Homo sapiens
aactgtcctgtcctgctc

SEQ ID NO: 5094016 - DNA, 15 bp, Homo sapiens
aactgtcgtgtcata

SEQ ID NO: 5094017 - DNA, 18 bp, Homo sapiens
aactgtctaatgacacgg

SEQ ID NO: 5094018 - DNA, 19 bp, Homo sapiens
aactgtctagcacttcctt

SEQ ID NO: 5094019 - DNA, 14 bp, Homo sapiens
aactgtctatttct

SEQ ID NO: 5094020 - DNA, 14 bp, Homo sapiens
aactgtctcaaaag

SEQ ID NO: 5094021 - DNA, 19 bp, Homo sapiens
aactgtctctcatgaacct

SEQ ID NO: 5094022 - DNA, 22 bp, Homo sapiens
aactgtctctcttctcagagtg

SEQ ID NO: 5094023 - DNA, 14 bp, Homo sapiens
aactgtcttagact

SEQ ID NO: 5094024 - DNA, 15 bp, Homo sapiens
aactgtcttcctcaa

SEQ ID NO: 5094025 - DNA, 16 bp, Homo sapiens
aactgtcttcctcaaa

SEQ ID NO: 5094026 - DNA, 12 bp, Homo sapiens
aactgtcttctg

SEQ ID NO: 5094027 - DNA, 23 bp, Homo sapiens
aactgtcttggctgtgagcaact

SEQ ID NO: 5094028 - DNA, 11 bp, Homo sapiens
aactgtcttgt

SEQ ID NO: 5094029 - DNA, 12 bp, Homo sapiens
aactgtcttgtt

SEQ ID NO: 5094030 - DNA, 16 bp, Homo sapiens
aactgtcttgtttcag

SEQ ID NO: 5094031 - DNA, 14 bp, Homo sapiens
aactgtgaaaaatc

SEQ ID NO: 5094032 - DNA, 22 bp, Homo sapiens
aactgtgaaataccacaagcct

SEQ ID NO: 5094033 - DNA, 13 bp, Homo sapiens
aactgtgaaatgt

SEQ ID NO: 5094034 - DNA, 19 bp, Homo sapiens
aactgtgaataataaatac

SEQ ID NO: 5094035 - DNA, 16 bp, Homo sapiens
aactgtgaatatgtgt

SEQ ID NO: 5094036 - DNA, 15 bp, Homo sapiens
aactgtgaatgcttc

SEQ ID NO: 5094037 - DNA, 20 bp, Homo sapiens
aactgtgaatgcttctgatt

SEQ ID NO: 5094038 - DNA, 22 bp, Homo sapiens
aactgtgaatgcttctgattta

SEQ ID NO: 5094039 - DNA, 15 bp, Homo sapiens
aactgtgactaggca

SEQ ID NO: 5094040 - DNA, 14 bp, Homo sapiens
aactgtgataaaaa

SEQ ID NO: 5094041 - DNA, 23 bp, Homo sapiens
aactgtgatgaagccgaccttag

SEQ ID NO: 5094042 - DNA, 20 bp, Homo sapiens
aactgtgattcttttaggac

SEQ ID NO: 5094043 - DNA, 23 bp, Homo sapiens
aactgtgcaaagcagagtgaaat

SEQ ID NO: 5094044 - DNA, 17 bp, Homo sapiens
aactgtgcaaagggctg

SEQ ID NO: 5094045 - DNA, 22 bp, Homo sapiens
aactgtgcaaagggctgccttg

SEQ ID NO: 5094046 - DNA, 15 bp, Homo sapiens
aactgtgccacaatg

SEQ ID NO: 5094047 - DNA, 16 bp, Homo sapiens
aactgtgccctgcctt

SEQ ID NO: 5094048 - DNA, 13 bp, Homo sapiens
aactgtgctcaga

SEQ ID NO: 5094049 - DNA, 16 bp, Homo sapiens
aactgtggaatataaa

SEQ ID NO: 5094050 - DNA, 18 bp, Homo sapiens
aactgtggaatataaata

SEQ ID NO: 5094051 - DNA, 16 bp, Homo sapiens
aactgtggaatttatt

SEQ ID NO: 5094052 - DNA, 20 bp, Homo sapiens
aactgtggaatttattggca

SEQ ID NO: 5094053 - DNA, 22 bp, Homo sapiens
aactgtggatacccttaccctt

SEQ ID NO: 5094054 - DNA, 14 bp, Homo sapiens
aactgtggccacct

SEQ ID NO: 5094055 - DNA, 11 bp, Homo sapiens
aactgtggccg

SEQ ID NO: 5094056 - DNA, 20 bp, Homo sapiens
aactgtggccgttatctgga

SEQ ID NO: 5094057 - DNA, 20 bp, Homo sapiens
aactgtgggattctgatttg

SEQ ID NO: 5094058 - DNA, 23 bp, Homo sapiens
aactgtggggcttacagaaatga

SEQ ID NO: 5094059 - DNA, 18 bp, Homo sapiens
aactgtggtagctccagc

SEQ ID NO: 5094060 - DNA, 15 bp, Homo sapiens
aactgtggtgccaca

SEQ ID NO: 5094061 - DNA, 12 bp, Homo sapiens
aactgtgtaaac

SEQ ID NO: 5094062 - DNA, 22 bp, Homo sapiens
aactgtgtaactgcccaaagca

SEQ ID NO: 5094063 - DNA, 17 bp, Homo sapiens
aactgtgtatcattaaa

SEQ ID NO: 5094064 - DNA, 21 bp, Homo sapiens
aactgtgtatcattaaaatat

SEQ ID NO: 5094065 - DNA, 13 bp, Homo sapiens
aactgtgtatgta

SEQ ID NO: 5094066 - DNA, 15 bp, Homo sapiens
aactgtgtatgtaca

SEQ ID NO: 5094067 - DNA, 17 bp, Homo sapiens
aactgtgtgaagaaatg

SEQ ID NO: 5094068 - DNA, 19 bp, Homo sapiens
aactgtgtgaccagcggaa

SEQ ID NO: 5094069 - DNA, 21 bp, Homo sapiens
aactgtgtgtaattgttcctt

SEQ ID NO: 5094070 - DNA, 12 bp, Homo sapiens
aactgtgtgtga

SEQ ID NO: 5094071 - DNA, 12 bp, Homo sapiens
aactgtgttgta

SEQ ID NO: 5094072 - DNA, 17 bp, Homo sapiens
aactgtgttgtattaac

SEQ ID NO: 5094073 - DNA, 20 bp, Homo sapiens
aactgtgttgtattaacaaa

SEQ ID NO: 5094074 - DNA, 18 bp, Homo sapiens
aactgtgtttcaaatgga

SEQ ID NO: 5094075 - DNA, 22 bp, Homo sapiens
aactgtgtttcaagttcaatcc

SEQ ID NO: 5094076 - DNA, 20 bp, Homo sapiens
aactgttaactatgacagat

SEQ ID NO: 5094077 - DNA, 21 bp, Homo sapiens
aactgttaagaaatctgtttt

SEQ ID NO: 5094078 - DNA, 15 bp, Homo sapiens
aactgttaagggaag

SEQ ID NO: 5094079 - DNA, 21 bp, Homo sapiens
aactgttaagggaagctgata

SEQ ID NO: 5094080 - DNA, 14 bp, Homo sapiens
aactgttacaactt

SEQ ID NO: 5094081 - DNA, 15 bp, Homo sapiens
aactgttacagtaat

SEQ ID NO: 5094082 - DNA, 17 bp, Homo sapiens
aactgttaccattggaa

SEQ ID NO: 5094083 - DNA, 23 bp, Homo sapiens
aactgttaccattggaaatttca

SEQ ID NO: 5094084 - DNA, 20 bp, Homo sapiens
aactgttacctaaagtattt

SEQ ID NO: 5094085 - DNA, 15 bp, Homo sapiens
aactgttagatgctg

SEQ ID NO: 5094086 - DNA, 21 bp, Homo sapiens
aactgttatcacttatatata

SEQ ID NO: 5094087 - DNA, 17 bp, Homo sapiens
aactgttatttataatc

SEQ ID NO: 5094088 - DNA, 18 bp, Homo sapiens
aactgttcccacctgctg

SEQ ID NO: 5094089 - DNA, 23 bp, Homo sapiens
aactgttcctcatgttgctgaat

SEQ ID NO: 5094090 - DNA, 14 bp, Homo sapiens
aactgttggaagtt

SEQ ID NO: 5094091 - DNA, 19 bp, Homo sapiens
aactgttggaatggatttt

SEQ ID NO: 5094092 - DNA, 22 bp, Homo sapiens
aactgttggagcccgaagctct

SEQ ID NO: 5094093 - DNA, 19 bp, Homo sapiens
aactgttggctgctcccca

SEQ ID NO: 5094094 - DNA, 18 bp, Homo sapiens
aactgttggttcatccag

SEQ ID NO: 5094095 - DNA, 18 bp, Homo sapiens
aactgttgtagaagacaa

SEQ ID NO: 5094096 - DNA, 15 bp, Homo sapiens
aactgttgtataaat

SEQ ID NO: 5094097 - DNA, 22 bp, Homo sapiens
aactgttgtgggcgctgcttcc

SEQ ID NO: 5094098 - DNA, 13 bp, Homo sapiens
aactgttgttgat

SEQ ID NO: 5094099 - DNA, 13 bp, Homo sapiens
aactgtttaacac

SEQ ID NO: 5094100 - DNA, 18 bp, Homo sapiens
aactgtttacatatctgt

SEQ ID NO: 5094101 - DNA, 19 bp, Homo sapiens
aactgtttactcacattgt

SEQ ID NO: 5094102 - DNA, 10 bp, Homo sapiens
aactgtttat

SEQ ID NO: 5094103 - DNA, 13 bp, Homo sapiens
aactgtttatatg

SEQ ID NO: 5094104 - DNA, 18 bp, Homo sapiens
aactgtttatatgtgttg

SEQ ID NO: 5094105 - DNA, 14 bp, Homo sapiens
aactgtttatggta

SEQ ID NO: 5094106 - DNA, 16 bp, Homo sapiens
aactgtttcaagccct

SEQ ID NO: 5094107 - DNA, 17 bp, Homo sapiens
aactgtttcaagccctc

SEQ ID NO: 5094108 - DNA, 22 bp, Homo sapiens
aactgtttcaagccctcctccc

SEQ ID NO: 5094109 - DNA, 15 bp, Homo sapiens
aactgtttccctgct

SEQ ID NO: 5094110 - DNA, 19 bp, Homo sapiens
aactgtttccctgctgaat

SEQ ID NO: 5094111 - DNA, 20 bp, Homo sapiens
aactgttttagaaattggta

SEQ ID NO: 5094112 - DNA, 13 bp, Homo sapiens
aactgttttcatg

SEQ ID NO: 5094113 - DNA, 20 bp, Homo sapiens
aacttaaaaagtctgcatta

SEQ ID NO: 5094114 - DNA, 18 bp, Homo sapiens
aacttaaaaatgtaaata

SEQ ID NO: 5094115 - DNA, 13 bp, Homo sapiens
aactcccggaggt

SEQ ID NO: 5094116 - DNA, 10 bp, Homo sapiens
aactccctcc

SEQ ID NO: 5094117 - DNA, 16 bp, Homo sapiens
aactccctccaccagc

SEQ ID NO: 5094118 - DNA, 19 bp, Homo sapiens
aactccctgaacctcagtt

SEQ ID NO: 5094119 - DNA, 20 bp, Homo sapiens
aactccctgaacctcagttt

SEQ ID NO: 5094120 - DNA, 19 bp, Homo sapiens
aactccctgccccccagcc

SEQ ID NO: 5094121 - DNA, 14 bp, Homo sapiens
aactcccttcaaaa

SEQ ID NO: 5094122 - DNA, 17 bp, Homo sapiens
aactcccttctgcttgt

SEQ ID NO: 5094123 - DNA, 16 bp, Homo sapiens
aactcccttgtgttcc

SEQ ID NO: 5094124 - DNA, 17 bp, Homo sapiens
aactcccttgtgttcct

SEQ ID NO: 5094125 - DNA, 22 bp, Homo sapiens
aactcccttgtgttccttctgt

SEQ ID NO: 5094126 - DNA, 17 bp, Homo sapiens
aactccgcccagcctct

SEQ ID NO: 5094127 - DNA, 19 bp, Homo sapiens
aactccgcccccagcctat

SEQ ID NO: 5094128 - DNA, 12 bp, Homo sapiens
aactccggattg

SEQ ID NO: 5094129 - DNA, 15 bp, Homo sapiens
aactcctaacctcgg

SEQ ID NO: 5094130 - DNA, 17 bp, Homo sapiens
aactcctaattttaaat

SEQ ID NO: 5094131 - DNA, 17 bp, Homo sapiens
aactcctactgcttcct

SEQ ID NO: 5094132 - DNA, 19 bp, Homo sapiens
aactcctagttctagaaaa

SEQ ID NO: 5094133 - DNA, 21 bp, Homo sapiens
aactcctataaagtgcctcgg

SEQ ID NO: 5094134 - DNA, 16 bp, Homo sapiens
aactcctcaacactca

SEQ ID NO: 5094135 - DNA, 16 bp, Homo sapiens
aactcctcattgtaaa

SEQ ID NO: 5094136 - DNA, 19 bp, Homo sapiens
aactcctccatccatgtgt

SEQ ID NO: 5094137 - DNA, 14 bp, Homo sapiens
aactcctcccaggg

SEQ ID NO: 5094138 - DNA, 20 bp, Homo sapiens
aactcctcccttttatcttc

SEQ ID NO: 5094139 - DNA, 12 bp, Homo sapiens
aactcctgacct

SEQ ID NO: 5094140 - DNA, 15 bp, Homo sapiens
aactcctgacctcag

SEQ ID NO: 5094141 - DNA, 17 bp, Homo sapiens
aactcctgacctcaggc

SEQ ID NO: 5094142 - DNA, 18 bp, Homo sapiens
aactcctgacctcaggtg

SEQ ID NO: 5094143 - DNA, 13 bp, Homo sapiens
aactcctgccagg

SEQ ID NO: 5094144 - DNA, 13 bp, Homo sapiens
aactcctgcctgt

SEQ ID NO: 5094145 - DNA, 16 bp, Homo sapiens
aactcctgcctgtgtt

SEQ ID NO: 5094146 - DNA, 13 bp, Homo sapiens
aactcctggcctt

SEQ ID NO: 5094147 - DNA, 15 bp, Homo sapiens
aactcctgggctcaa

SEQ ID NO: 5094148 - DNA, 18 bp, Homo sapiens
aactcctgtcttctttct

SEQ ID NO: 5094149 - DNA, 16 bp, Homo sapiens
aactcctgtcttgcta

SEQ ID NO: 5094150 - DNA, 21 bp, Homo sapiens
aactcctgtgaccacaacatg

SEQ ID NO: 5094151 - DNA, 11 bp, Homo sapiens
aactcctgtgt

SEQ ID NO: 5094152 - DNA, 13 bp, Homo sapiens
aactcctgtgtcg

SEQ ID NO: 5094153 - DNA, 22 bp, Homo sapiens
aactcctgtgtcggtcagaaca

SEQ ID NO: 5094154 - DNA, 13 bp, Homo sapiens
aactcctgttctt

SEQ ID NO: 5094155 - DNA, 21 bp, Homo sapiens
aactcctgtttctccttagtt

SEQ ID NO: 5094156 - DNA, 20 bp, Homo sapiens
aactccttccatccttgact

SEQ ID NO: 5094157 - DNA, 20 bp, Homo sapiens
aactccttcctggcctgaga

SEQ ID NO: 5094158 - DNA, 21 bp, Homo sapiens
aactcctttagcaggtggtcc

SEQ ID NO: 5094159 - DNA, 13 bp, Homo sapiens
aactcctttctta

SEQ ID NO: 5094160 - DNA, 15 bp, Homo sapiens
aactcgaacttgaag

SEQ ID NO: 5094161 - DNA, 14 bp, Homo sapiens
aactcgaggactgt

SEQ ID NO: 5094162 - DNA, 20 bp, Homo sapiens
aactcgaggactgtatttgt

SEQ ID NO: 5094163 - DNA, 13 bp, Homo sapiens
aactcgaggagct

SEQ ID NO: 5094164 - DNA, 13 bp, Homo sapiens
aactcgatgcact

SEQ ID NO: 5094165 - DNA, 16 bp, Homo sapiens
aactcgatgcactgac

SEQ ID NO: 5094166 - DNA, 17 bp, Homo sapiens
aactcgatgcactgacc

SEQ ID NO: 5094167 - DNA, 19 bp, Homo sapiens
aactcgcacctgtgctgga

SEQ ID NO: 5094168 - DNA, 18 bp, Homo sapiens
aactcgcttctctgtgac

SEQ ID NO: 5094169 - DNA, 14 bp, Homo sapiens
aactcgggagggaa

SEQ ID NO: 5094170 - DNA, 19 bp, Homo sapiens
aactcgggcactccctaag

SEQ ID NO: 5094171 - DNA, 16 bp, Homo sapiens
aactcggtgtccccac

SEQ ID NO: 5094172 - DNA, 22 bp, Homo sapiens
aactcggtttggtagacttgga

SEQ ID NO: 5094173 - DNA, 21 bp, Homo sapiens
aactcgtatagcatgcatctg

SEQ ID NO: 5094174 - DNA, 19 bp, Homo sapiens
aactcgtgtctggcacagc

SEQ ID NO: 5094175 - DNA, 15 bp, Homo sapiens
aactcgttttttaca

SEQ ID NO: 5094176 - DNA, 14 bp, Homo sapiens
aactctaaaagatc

SEQ ID NO: 5094177 - DNA, 14 bp, Homo sapiens
aactctaaccagtg

SEQ ID NO: 5094178 - DNA, 15 bp, Homo sapiens
aactctaaccagtgt

SEQ ID NO: 5094179 - DNA, 15 bp, Homo sapiens
aactctaaccctgtg

SEQ ID NO: 5094180 - DNA, 17 bp, Homo sapiens
aactctaagtgtttgct

SEQ ID NO: 5094181 - DNA, 16 bp, Homo sapiens
aactctaatattgctt

SEQ ID NO: 5094182 - DNA, 21 bp, Homo sapiens
aactctaattcccattttgca

SEQ ID NO: 5094183 - DNA, 19 bp, Homo sapiens
aactctacaccctctgccc

SEQ ID NO: 5094184 - DNA, 22 bp, Homo sapiens
aactctacaccctctgccccag

SEQ ID NO: 5094185 - DNA, 14 bp, Homo sapiens
aactctacatttaa

SEQ ID NO: 5094186 - DNA, 15 bp, Homo sapiens
aactctacccctgct

SEQ ID NO: 5094187 - DNA, 22 bp, Homo sapiens
aactctaccctggtaggaaagc

SEQ ID NO: 5094188 - DNA, 19 bp, Homo sapiens
aactctactcaacccattg

SEQ ID NO: 5094189 - DNA, 18 bp, Homo sapiens
aactctactgttgcaaag

SEQ ID NO: 5094190 - DNA, 16 bp, Homo sapiens
aactctagagagcctt

SEQ ID NO: 5094191 - DNA, 12 bp, Homo sapiens
aactctagctgg

SEQ ID NO: 5094192 - DNA, 17 bp, Homo sapiens
aactctagggatataaa

SEQ ID NO: 5094193 - DNA, 16 bp, Homo sapiens
aactctagtttgcaga

SEQ ID NO: 5094194 - DNA, 19 bp, Homo sapiens
aactctataaagaaacttt

SEQ ID NO: 5094195 - DNA, 23 bp, Homo sapiens
aactctatattgttcagcatgca

SEQ ID NO: 5094196 - DNA, 17 bp, Homo sapiens
aactctatcagcattgt

SEQ ID NO: 5094197 - DNA, 19 bp, Homo sapiens
aactctatctgaaatccca

SEQ ID NO: 5094198 - DNA, 21 bp, Homo sapiens
aactctatctgggcctgggct

SEQ ID NO: 5094199 - DNA, 23 bp, Homo sapiens
aactctatgggtatcaaacagct

SEQ ID NO: 5094200 - DNA, 14 bp, Homo sapiens
aactctattttgat

SEQ ID NO: 5094201 - DNA, 15 bp, Homo sapiens
aactctcaaaagtct

SEQ ID NO: 5094202 - DNA, 14 bp, Homo sapiens
aactctcagaaata

SEQ ID NO: 5094203 - DNA, 16 bp, Homo sapiens
aactctcagaaataaa

SEQ ID NO: 5094204 - DNA, 22 bp, Homo sapiens
aactctcagaaataaatcacag

SEQ ID NO: 5094205 - DNA, 13 bp, Homo sapiens
aactctcaggact

SEQ ID NO: 5094206 - DNA, 18 bp, Homo sapiens
aactctcattatttgtgt

SEQ ID NO: 5094207 - DNA, 13 bp, Homo sapiens
aactctccccagt

SEQ ID NO: 5094208 - DNA, 19 bp, Homo sapiens
aactctccccagtgcctgc

SEQ ID NO: 5094209 - DNA, 23 bp, Homo sapiens
aactctccccagtgcctgccact

SEQ ID NO: 5094210 - DNA, 19 bp, Homo sapiens
aactctcccctccccatct

SEQ ID NO: 5094211 - DNA, 15 bp, Homo sapiens
aactctcccctttct

SEQ ID NO: 5094212 - DNA, 15 bp, Homo sapiens
aactctcctccagag

SEQ ID NO: 5094213 - DNA, 21 bp, Homo sapiens
aactctcctctgctgctggct

SEQ ID NO: 5094214 - DNA, 21 bp, Homo sapiens
aactctcgagacttctctgtg

SEQ ID NO: 5094215 - DNA, 19 bp, Homo sapiens
aactctctagtgcaggaaa

SEQ ID NO: 5094216 - DNA, 12 bp, Homo sapiens
aactctctccac

SEQ ID NO: 5094217 - DNA, 14 bp, Homo sapiens
aactctctcccagg

SEQ ID NO: 5094218 - DNA, 15 bp, Homo sapiens
aactctctcccagga

SEQ ID NO: 5094219 - DNA, 12 bp, Homo sapiens
aactctctctgc

SEQ ID NO: 5094220 - DNA, 16 bp, Homo sapiens
aactctctctgccccc

SEQ ID NO: 5094221 - DNA, 12 bp, Homo sapiens
aactctctgaac

SEQ ID NO: 5094222 - DNA, 15 bp, Homo sapiens
aactctctgcctgta

SEQ ID NO: 5094223 - DNA, 10 bp, Homo sapiens
aactctctgt

SEQ ID NO: 5094224 - DNA, 21 bp, Homo sapiens
aactctcttattgcctcactt

SEQ ID NO: 5094225 - DNA, 18 bp, Homo sapiens
aactctcttcttccatta

SEQ ID NO: 5094226 - DNA, 14 bp, Homo sapiens
aactctctttcctt

SEQ ID NO: 5094227 - DNA, 16 bp, Homo sapiens
aactctgaactttgga

SEQ ID NO: 5094228 - DNA, 12 bp, Homo sapiens
aactctgaataa

SEQ ID NO: 5094229 - DNA, 18 bp, Homo sapiens
aactctgaataagcactt

SEQ ID NO: 5094230 - DNA, 19 bp, Homo sapiens
aactctgacaagggctgac

SEQ ID NO: 5094231 - DNA, 13 bp, Homo sapiens
aactctgagccca

SEQ ID NO: 5094232 - DNA, 18 bp, Homo sapiens
aactctgagtgcaaactt

SEQ ID NO: 5094233 - DNA, 20 bp, Homo sapiens
aactctgagtgcaaacttca

SEQ ID NO: 5094234 - DNA, 22 bp, Homo sapiens
aactctgagtgcaaacttcaga

SEQ ID NO: 5094235 - DNA, 21 bp, Homo sapiens
aactctgatgtaaatgaagta

SEQ ID NO: 5094236 - DNA, 22 bp, Homo sapiens
aactctgatgtaaatgaagtaa

SEQ ID NO: 5094237 - DNA, 14 bp, Homo sapiens
aactctgattttga

SEQ ID NO: 5094238 - DNA, 18 bp, Homo sapiens
aactctgattttgatatt

SEQ ID NO: 5094239 - DNA, 23 bp, Homo sapiens
aactctgcaactgaatacttgaa

SEQ ID NO: 5094240 - DNA, 21 bp, Homo sapiens
aactctgcactccatggccac

SEQ ID NO: 5094241 - DNA, 11 bp, Homo sapiens
aactctgcata

SEQ ID NO: 5094242 - DNA, 19 bp, Homo sapiens
aactctgcatagacaaagg

SEQ ID NO: 5094243 - DNA, 23 bp, Homo sapiens
aactctgccagaaaaaaataact

SEQ ID NO: 5094244 - DNA, 14 bp, Homo sapiens
aactctgccagcca

SEQ ID NO: 5094245 - DNA, 18 bp, Homo sapiens
aactctgccagccctgca

SEQ ID NO: 5094246 - DNA, 21 bp, Homo sapiens
aactctgcctttatgatgcta

SEQ ID NO: 5094247 - DNA, 21 bp, Homo sapiens
aactctgctgagggtccagaa

SEQ ID NO: 5094248 - DNA, 22 bp, Homo sapiens
aactctgctgtctaacctgtga

SEQ ID NO: 5094249 - DNA, 19 bp, Homo sapiens
aactctggacactctatat

SEQ ID NO: 5094250 - DNA, 16 bp, Homo sapiens
aactctggctcagcct

SEQ ID NO: 5094251 - DNA, 19 bp, Homo sapiens
aactctggctccttctcca

SEQ ID NO: 5094252 - DNA, 16 bp, Homo sapiens
aactctggcttccagg

SEQ ID NO: 5094253 - DNA, 20 bp, Homo sapiens
aactctggcttccaggtatc

SEQ ID NO: 5094254 - DNA, 15 bp, Homo sapiens
aactctggcttttgg

SEQ ID NO: 5094255 - DNA, 19 bp, Homo sapiens
aactctgggcacttttgaa

SEQ ID NO: 5094256 - DNA, 21 bp, Homo sapiens
aactctgggctgctacccaga

SEQ ID NO: 5094257 - DNA, 14 bp, Homo sapiens
aactctggggcttg

SEQ ID NO: 5094258 - DNA, 23 bp, Homo sapiens
aactctggtgataaaaataaagc

SEQ ID NO: 5094259 - DNA, 13 bp, Homo sapiens
aactctggtggca

SEQ ID NO: 5094260 - DNA, 21 bp, Homo sapiens
aactctgtaaaagtgtctgta

SEQ ID NO: 5094261 - DNA, 12 bp, Homo sapiens
aactctgtaaga

SEQ ID NO: 5094262 - DNA, 13 bp, Homo sapiens
aactctgtaattc

SEQ ID NO: 5094263 - DNA, 22 bp, Homo sapiens
aactctgtacgaggcttctcta

SEQ ID NO: 5094264 - DNA, 23 bp, Homo sapiens
aactctgtacgaggcttctctaa

SEQ ID NO: 5094265 - DNA, 16 bp, Homo sapiens
aactctgtataataga

SEQ ID NO: 5094266 - DNA, 18 bp, Homo sapiens
aactctgtataatagaga

SEQ ID NO: 5094267 - DNA, 16 bp, Homo sapiens
aactctgttacacttt

SEQ ID NO: 5094268 - DNA, 22 bp, Homo sapiens
aactctgttacactttttggaa

SEQ ID NO: 5094269 - DNA, 15 bp, Homo sapiens
aactctgttccccca

SEQ ID NO: 5094270 - DNA, 14 bp, Homo sapiens
aactcttaaagcaa

SEQ ID NO: 5094271 - DNA, 17 bp, Homo sapiens
aactcttaaatactttt

SEQ ID NO: 5094272 - DNA, 18 bp, Homo sapiens
aactcttaactgaagaaa

SEQ ID NO: 5094273 - DNA, 16 bp, Homo sapiens
aactcttaatctgtgt

SEQ ID NO: 5094274 - DNA, 17 bp, Homo sapiens
aactcttagaaatgaag

SEQ ID NO: 5094275 - DNA, 20 bp, Homo sapiens
aactcttagaagtgttgtaa

SEQ ID NO: 5094276 - DNA, 22 bp, Homo sapiens
aactcttataaatttctatttt

SEQ ID NO: 5094277 - DNA, 15 bp, Homo sapiens
aactcttatctcagt

SEQ ID NO: 5094278 - DNA, 11 bp, Homo sapiens
aactcttcaag

SEQ ID NO: 5094279 - DNA, 19 bp, Homo sapiens
aactcttcaccttggttta

SEQ ID NO: 5094280 - DNA, 15 bp, Homo sapiens
aactcttcactcttc

SEQ ID NO: 5094281 - DNA, 12 bp, Homo sapiens
aactcttcagaa

SEQ ID NO: 5094282 - DNA, 23 bp, Homo sapiens
aactcttcagaacacacagactt

SEQ ID NO: 5094283 - DNA, 13 bp, Homo sapiens
aactcttcatctt

SEQ ID NO: 5094284 - DNA, 13 bp, Homo sapiens
aactcttcatttt

SEQ ID NO: 5094285 - DNA, 11 bp, Homo sapiens
aactcttcctc

SEQ ID NO: 5094286 - DNA, 12 bp, Homo sapiens
aactcttcctcc

SEQ ID NO: 5094287 - DNA, 16 bp, Homo sapiens
aactcttctcattact

SEQ ID NO: 5094288 - DNA, 17 bp, Homo sapiens
aactcttctcattactt

SEQ ID NO: 5094289 - DNA, 21 bp, Homo sapiens
aactcttctggaaaccaaata

SEQ ID NO: 5094290 - DNA, 13 bp, Homo sapiens
aactcttgaaatt

SEQ ID NO: 5094291 - DNA, 20 bp, Homo sapiens
aactcttgaaattagtttac

SEQ ID NO: 5094292 - DNA, 21 bp, Homo sapiens
aactcttgacagctataatta

SEQ ID NO: 5094293 - DNA, 14 bp, Homo sapiens
aactcttgctcact

SEQ ID NO: 5094294 - DNA, 14 bp, Homo sapiens
aactcttggaagaa

SEQ ID NO: 5094295 - DNA, 17 bp, Homo sapiens
aactcttggccagagct

SEQ ID NO: 5094296 - DNA, 12 bp, Homo sapiens
aacttaaaacat

SEQ ID NO: 5094297 - DNA, 19 bp, Homo sapiens
aacttaaaactttgtagaa

SEQ ID NO: 5094298 - DNA, 11 bp, Homo sapiens
aacttaaaata

SEQ ID NO: 5094299 - DNA, 15 bp, Homo sapiens
aacttaaacaatttc

SEQ ID NO: 5094300 - DNA, 11 bp, Homo sapiens
aacttaaagat

SEQ ID NO: 5094301 - DNA, 17 bp, Homo sapiens
aacttaaagcaaaatag

SEQ ID NO: 5094302 - DNA, 19 bp, Homo sapiens
aacttaaagcaaaatagta

SEQ ID NO: 5094303 - DNA, 22 bp, Homo sapiens
aacttaaagcaaaatagtattg

SEQ ID NO: 5094304 - DNA, 15 bp, Homo sapiens
aacttaaataaatgt

SEQ ID NO: 5094305 - DNA, 15 bp, Homo sapiens
aacttaaatattgta

SEQ ID NO: 5094306 - DNA, 15 bp, Homo sapiens
aacttaaatatttga

SEQ ID NO: 5094307 - DNA, 17 bp, Homo sapiens
aacttaaatatttgaaa

SEQ ID NO: 5094308 - DNA, 15 bp, Homo sapiens
aacttaaatgccccc

SEQ ID NO: 5094309 - DNA, 15 bp, Homo sapiens
aacttaaatgttatt

SEQ ID NO: 5094310 - DNA, 19 bp, Homo sapiens
aacttaaattttagttctt

SEQ ID NO: 5094311 - DNA, 13 bp, Homo sapiens
aacttaacatgaa

SEQ ID NO: 5094312 - DNA, 15 bp, Homo sapiens
aacttaacatgggct

SEQ ID NO: 5094313 - DNA, 21 bp, Homo sapiens
aacttaacattctgtaaaatg

SEQ ID NO: 5094314 - DNA, 17 bp, Homo sapiens
aacttaacccagatttt

SEQ ID NO: 5094315 - DNA, 13 bp, Homo sapiens
aacttaactgaag

SEQ ID NO: 5094316 - DNA, 13 bp, Homo sapiens
aacttaagaattg

SEQ ID NO: 5094317 - DNA, 17 bp, Homo sapiens
aacttaagatgaataca

SEQ ID NO: 5094318 - DNA, 17 bp, Homo sapiens
aacttaagttaaacata

SEQ ID NO: 5094319 - DNA, 15 bp, Homo sapiens
aacttaagtttagaa

SEQ ID NO: 5094320 - DNA, 17 bp, Homo sapiens
aacttaagtttagaaat

SEQ ID NO: 5094321 - DNA, 12 bp, Homo sapiens
aacttaataaat

SEQ ID NO: 5094322 - DNA, 17 bp, Homo sapiens
aacttaataaatattgt

SEQ ID NO: 5094323 - DNA, 13 bp, Homo sapiens
aacttaatgaaaa

SEQ ID NO: 5094324 - DNA, 13 bp, Homo sapiens
aacttaatggcac

SEQ ID NO: 5094325 - DNA, 14 bp, Homo sapiens
aacttaatgtgctg

SEQ ID NO: 5094326 - DNA, 19 bp, Homo sapiens
aacttaattgctctatgcc

SEQ ID NO: 5094327 - DNA, 17 bp, Homo sapiens
aacttaatttaatattt

SEQ ID NO: 5094328 - DNA, 12 bp, Homo sapiens
aacttacacaca

SEQ ID NO: 5094329 - DNA, 16 bp, Homo sapiens
aacttacactgtttca

SEQ ID NO: 5094330 - DNA, 17 bp, Homo sapiens
aacttacagaaatgaat

SEQ ID NO: 5094331 - DNA, 22 bp, Homo sapiens
aacttacattgttcaattagaa

SEQ ID NO: 5094332 - DNA, 15 bp, Homo sapiens
aacttaccaattgat

SEQ ID NO: 5094333 - DNA, 15 bp, Homo sapiens
aacttacccagatgt

SEQ ID NO: 5094334 - DNA, 19 bp, Homo sapiens
aacttacctctgcttctga

SEQ ID NO: 5094335 - DNA, 20 bp, Homo sapiens
aacttacctctgcttctgac

SEQ ID NO: 5094336 - DNA, 13 bp, Homo sapiens
aacttactgtata

SEQ ID NO: 5094337 - DNA, 14 bp, Homo sapiens
aacttactgtatat

SEQ ID NO: 5094338 - DNA, 17 bp, Homo sapiens
aacttactgtatatgta

SEQ ID NO: 5094339 - DNA, 20 bp, Homo sapiens
aacttactgtcagagaatat

SEQ ID NO: 5094340 - DNA, 17 bp, Homo sapiens
aacttagaaaccaaatt

SEQ ID NO: 5094341 - DNA, 13 bp, Homo sapiens
aacttagaaatat

SEQ ID NO: 5094342 - DNA, 18 bp, Homo sapiens
aacttagaataaaattgt

SEQ ID NO: 5094343 - DNA, 19 bp, Homo sapiens
aacttagaataaaattgta

SEQ ID NO: 5094344 - DNA, 20 bp, Homo sapiens
aacttagaattgaggagttg

SEQ ID NO: 5094345 - DNA, 12 bp, Homo sapiens
aacttagaccca

SEQ ID NO: 5094346 - DNA, 16 bp, Homo sapiens
aacttagacccatgct

SEQ ID NO: 5094347 - DNA, 20 bp, Homo sapiens
aacttagactctagtattta

SEQ ID NO: 5094348 - DNA, 16 bp, Homo sapiens
aacttagaggaaaagg

SEQ ID NO: 5094349 - DNA, 16 bp, Homo sapiens
aacttagaggaaaatg

SEQ ID NO: 5094350 - DNA, 20 bp, Homo sapiens
aacttagatcatcagtcacc

SEQ ID NO: 5094351 - DNA, 13 bp, Homo sapiens
aacttagatgtta

SEQ ID NO: 5094352 - DNA, 22 bp, Homo sapiens
aacttagccatttttcaaagca

SEQ ID NO: 5094353 - DNA, 23 bp, Homo sapiens
aacttagcttgcacatgaatgca

SEQ ID NO: 5094354 - DNA, 23 bp, Homo sapiens
aacttagctttatttttcttttc

SEQ ID NO: 5094355 - DNA, 12 bp, Homo sapiens
aacttaggctac

SEQ ID NO: 5094356 - DNA, 20 bp, Homo sapiens
aacttagtgacaaaatagac

SEQ ID NO: 5094357 - DNA, 22 bp, Homo sapiens
aacttagtgcggacaagtttta

SEQ ID NO: 5094358 - DNA, 15 bp, Homo sapiens
aacttagtgtctcta

SEQ ID NO: 5094359 - DNA, 22 bp, Homo sapiens
aacttagtgtctctatttatga

SEQ ID NO: 5094360 - DNA, 23 bp, Homo sapiens
aacttagtgtctctatttatgag

SEQ ID NO: 5094361 - DNA, 18 bp, Homo sapiens
aacttagtgtttagcatt

SEQ ID NO: 5094362 - DNA, 16 bp, Homo sapiens
aacttagtttgtgaat

SEQ ID NO: 5094363 - DNA, 23 bp, Homo sapiens
aacttagtttgtgaattgatttt

SEQ ID NO: 5094364 - DNA, 13 bp, Homo sapiens
aacttagttttgt

SEQ ID NO: 5094365 - DNA, 15 bp, Homo sapiens
aacttataaatcata

SEQ ID NO: 5094366 - DNA, 19 bp, Homo sapiens
aacttataaatcatattga

SEQ ID NO: 5094367 - DNA, 22 bp, Homo sapiens
aacttatagttaatattttgtt

SEQ ID NO: 5094368 - DNA, 23 bp, Homo sapiens
aacttatattaaataaatgtgca

SEQ ID NO: 5094369 - DNA, 23 bp, Homo sapiens
aacttatattaatagtaatttgt

SEQ ID NO: 5094370 - DNA, 13 bp, Homo sapiens
aacttatattgaa

SEQ ID NO: 5094371 - DNA, 15 bp, Homo sapiens
aacttatattgtaag

SEQ ID NO: 5094372 - DNA, 19 bp, Homo sapiens
aacttatattgtaagaaat

SEQ ID NO: 5094373 - DNA, 20 bp, Homo sapiens
aacttatattgtaagaaata

SEQ ID NO: 5094374 - DNA, 14 bp, Homo sapiens
aacttatgaatgtt

SEQ ID NO: 5094375 - DNA, 22 bp, Homo sapiens
aacttatggactgttttgatag

SEQ ID NO: 5094376 - DNA, 15 bp, Homo sapiens
aacttatggccacag

SEQ ID NO: 5094377 - DNA, 14 bp, Homo sapiens
aacttatgtagata

SEQ ID NO: 5094378 - DNA, 17 bp, Homo sapiens
aacttatgtagatattt

SEQ ID NO: 5094379 - DNA, 19 bp, Homo sapiens
aacttatgtagatatttgg

SEQ ID NO: 5094380 - DNA, 20 bp, Homo sapiens
aacttatgtagatatttggc

SEQ ID NO: 5094381 - DNA, 14 bp, Homo sapiens
aacttatgtatgtg

SEQ ID NO: 5094382 - DNA, 14 bp, Homo sapiens
aacttattagaaac

SEQ ID NO: 5094383 - DNA, 23 bp, Homo sapiens
aacttattatcactttggggttc

SEQ ID NO: 5094384 - DNA, 13 bp, Homo sapiens
aacttattatttt

SEQ ID NO: 5094385 - DNA, 13 bp, Homo sapiens
aacttattccaag

SEQ ID NO: 5094386 - DNA, 23 bp, Homo sapiens
aacttattctgtagattctgtgg

SEQ ID NO: 5094387 - DNA, 16 bp, Homo sapiens
aacttattgctgattt

SEQ ID NO: 5094388 - DNA, 17 bp, Homo sapiens
aacttatttaaaaatat

SEQ ID NO: 5094389 - DNA, 18 bp, Homo sapiens
aacttatttatatgaagc

SEQ ID NO: 5094390 - DNA, 19 bp, Homo sapiens
aacttatttatatgaagca

SEQ ID NO: 5094391 - DNA, 23 bp, Homo sapiens
aacttatttcataattgcctaca

SEQ ID NO: 5094392 - DNA, 14 bp, Homo sapiens
aacttatttctgaa

SEQ ID NO: 5094393 - DNA, 19 bp, Homo sapiens
aacttatttgagtgattat

SEQ ID NO: 5094394 - DNA, 17 bp, Homo sapiens
aacttattttatttcca

SEQ ID NO: 5094395 - DNA, 18 bp, Homo sapiens
aacttatttttttctgat

SEQ ID NO: 5094396 - DNA, 20 bp, Homo sapiens
aacttatttttttctgattg

SEQ ID NO: 5094397 - DNA, 17 bp, Homo sapiens
aacttcaaaagcttttt

SEQ ID NO: 5094398 - DNA, 13 bp, Homo sapiens
aacttcaaagctg

SEQ ID NO: 5094399 - DNA, 19 bp, Homo sapiens
aacttcaaagctgaatatt

SEQ ID NO: 5094400 - DNA, 19 bp, Homo sapiens
aacttcaacatttacatgt

SEQ ID NO: 5094401 - DNA, 13 bp, Homo sapiens
aacttcaagaagt

SEQ ID NO: 5094402 - DNA, 20 bp, Homo sapiens
aacttcaagatgagcctggg

SEQ ID NO: 5094403 - DNA, 20 bp, Homo sapiens
aacttcaagggacaagtatt

SEQ ID NO: 5094404 - DNA, 16 bp, Homo sapiens
aacttcacaactaggc

SEQ ID NO: 5094405 - DNA, 14 bp, Homo sapiens
aacttcacatattg

SEQ ID NO: 5094406 - DNA, 16 bp, Homo sapiens
aacttcacattaaaaa

SEQ ID NO: 5094407 - DNA, 14 bp, Homo sapiens
aacttcaccacccc

SEQ ID NO: 5094408 - DNA, 22 bp, Homo sapiens
aacttcaccatattaccacaga

SEQ ID NO: 5094409 - DNA, 13 bp, Homo sapiens
aacttcaccttaa

SEQ ID NO: 5094410 - DNA, 21 bp, Homo sapiens
aacttcactccaaagagaaac

SEQ ID NO: 5094411 - DNA, 18 bp, Homo sapiens
aacttcagaaggcctcac

SEQ ID NO: 5094412 - DNA, 20 bp, Homo sapiens
aacttcagatacttgtgaac

SEQ ID NO: 5094413 - DNA, 14 bp, Homo sapiens
aacttcagatgttt

SEQ ID NO: 5094414 - DNA, 11 bp, Homo sapiens
aacttcagcaa

SEQ ID NO: 5094415 - DNA, 15 bp, Homo sapiens
aacttcagcaaccct

SEQ ID NO: 5094416 - DNA, 22 bp, Homo sapiens
aacttcagcaaccctacagtat

SEQ ID NO: 5094417 - DNA, 14 bp, Homo sapiens
aacttcagcagggg

SEQ ID NO: 5094418 - DNA, 23 bp, Homo sapiens
aacttcagcattgtaattatgta

SEQ ID NO: 5094419 - DNA, 21 bp, Homo sapiens
aacttcagcggtttatataag

SEQ ID NO: 5094420 - DNA, 12 bp, Homo sapiens
aacttcaggaaa

SEQ ID NO: 5094421 - DNA, 15 bp, Homo sapiens
aacttcataaatgtt

SEQ ID NO: 5094422 - DNA, 17 bp, Homo sapiens
aacttcatcccagctgc

SEQ ID NO: 5094423 - DNA, 18 bp, Homo sapiens
aacttcatcccagctgct

SEQ ID NO: 5094424 - DNA, 12 bp, Homo sapiens
aacttcatctgc

SEQ ID NO: 5094425 - DNA, 13 bp, Homo sapiens
aacttcatctgcc

SEQ ID NO: 5094426 - DNA, 15 bp, Homo sapiens
aacttcatctgccac

SEQ ID NO: 5094427 - DNA, 16 bp, Homo sapiens
aacttcatctgtctgt

SEQ ID NO: 5094428 - DNA, 16 bp, Homo sapiens
aacttcatgtaatttt

SEQ ID NO: 5094429 - DNA, 13 bp, Homo sapiens
aacttcatttgac

SEQ ID NO: 5094430 - DNA, 15 bp, Homo sapiens
aacttccaaagaaag

SEQ ID NO: 5094431 - DNA, 18 bp, Homo sapiens
aacttccaacaagcctca

SEQ ID NO: 5094432 - DNA, 14 bp, Homo sapiens
aacttccaactttt

SEQ ID NO: 5094433 - DNA, 16 bp, Homo sapiens
aacttccaaggccctg

SEQ ID NO: 5094434 - DNA, 15 bp, Homo sapiens
aacttccactttgta

SEQ ID NO: 5094435 - DNA, 22 bp, Homo sapiens
aacttccagaggacagctctgg

SEQ ID NO: 5094436 - DNA, 18 bp, Homo sapiens
aacttccagatcctggaa

SEQ ID NO: 5094437 - DNA, 15 bp, Homo sapiens
aacttccaggaaagt

SEQ ID NO: 5094438 - DNA, 15 bp, Homo sapiens
aacttccattctttc

SEQ ID NO: 5094439 - DNA, 17 bp, Homo sapiens
aacttccattctttctt

SEQ ID NO: 5094440 - DNA, 23 bp, Homo sapiens
aacttcccacacgattagcttta

SEQ ID NO: 5094441 - DNA, 18 bp, Homo sapiens
aacttcccatctggctca

SEQ ID NO: 5094442 - DNA, 13 bp, Homo sapiens
aacttcccctcta

SEQ ID NO: 5094443 - DNA, 23 bp, Homo sapiens
aacttcccgtcccatatcctgcc

SEQ ID NO: 5094444 - DNA, 13 bp, Homo sapiens
aacttccctcccc

SEQ ID NO: 5094445 - DNA, 14 bp, Homo sapiens
aacttccctccccc

SEQ ID NO: 5094446 - DNA, 17 bp, Homo sapiens
aacttccctgttcttta

SEQ ID NO: 5094447 - DNA, 14 bp, Homo sapiens
aacttccgcctcct

SEQ ID NO: 5094448 - DNA, 15 bp, Homo sapiens
aacttccgcctcctg

SEQ ID NO: 5094449 - DNA, 16 bp, Homo sapiens
aacttcctctgccatg

SEQ ID NO: 5094450 - DNA, 15 bp, Homo sapiens
aacttcctgcaggta

SEQ ID NO: 5094451 - DNA, 19 bp, Homo sapiens
aacttcctgctgcaccctg

SEQ ID NO: 5094452 - DNA, 18 bp, Homo sapiens
aacttcctgtgcctttcc

SEQ ID NO: 5094453 - DNA, 19 bp, Homo sapiens
aacttcctgtgcctttcct

SEQ ID NO: 5094454 - DNA, 17 bp, Homo sapiens
aacttcctgtggcctga

SEQ ID NO: 5094455 - DNA, 19 bp, Homo sapiens
aacttccttgcccctgctc

SEQ ID NO: 5094456 - DNA, 12 bp, Homo sapiens
aacttcctttat

SEQ ID NO: 5094457 - DNA, 20 bp, Homo sapiens
aacttcgaaagcatcattat

SEQ ID NO: 5094458 - DNA, 16 bp, Homo sapiens
aacttcgctagaaaaa

SEQ ID NO: 5094459 - DNA, 23 bp, Homo sapiens
aacttctaaaactgtactttgat

SEQ ID NO: 5094460 - DNA, 15 bp, Homo sapiens
aacttctaaacactt

SEQ ID NO: 5094461 - DNA, 17 bp, Homo sapiens
aacttctaaacacttca

SEQ ID NO: 5094462 - DNA, 16 bp, Homo sapiens
aacttctaatatattt

SEQ ID NO: 5094463 - DNA, 18 bp, Homo sapiens
aacttctatattttaata

SEQ ID NO: 5094464 - DNA, 13 bp, Homo sapiens
aacttctatcctt

SEQ ID NO: 5094465 - DNA, 16 bp, Homo sapiens
aacttctatgttggtt

SEQ ID NO: 5094466 - DNA, 22 bp, Homo sapiens
aacttctatgttggtttcagtg

SEQ ID NO: 5094467 - DNA, 16 bp, Homo sapiens
aacttctatgtttatc

SEQ ID NO: 5094468 - DNA, 16 bp, Homo sapiens
aacttctcatttatgt

SEQ ID NO: 5094469 - DNA, 13 bp, Homo sapiens
aacttctcccacc

SEQ ID NO: 5094470 - DNA, 16 bp, Homo sapiens
aacttctcccacccct

SEQ ID NO: 5094471 - DNA, 22 bp, Homo sapiens
aacttctcccctggtagaaaga

SEQ ID NO: 5094472 - DNA, 14 bp, Homo sapiens
aacttctctcagac

SEQ ID NO: 5094473 - DNA, 20 bp, Homo sapiens
aacttctgcaacaagcatgc

SEQ ID NO: 5094474 - DNA, 13 bp, Homo sapiens
aacttcttaaata

SEQ ID NO: 5094475 - DNA, 18 bp, Homo sapiens
aacttcttaaatatcttt

SEQ ID NO: 5094476 - DNA, 11 bp, Homo sapiens
aacttcttcag

SEQ ID NO: 5094477 - DNA, 13 bp, Homo sapiens
aactcttggcctc

SEQ ID NO: 5094478 - DNA, 17 bp, Homo sapiens
aactcttggcctctgct

SEQ ID NO: 5094479 - DNA, 14 bp, Homo sapiens
aactcttgtattgc

SEQ ID NO: 5094480 - DNA, 17 bp, Homo sapiens
aactcttgtgaattatt

SEQ ID NO: 5094481 - DNA, 11 bp, Homo sapiens
aactctttaac

SEQ ID NO: 5094482 - DNA, 13 bp, Homo sapiens
aactctttcaaaa

SEQ ID NO: 5094483 - DNA, 18 bp, Homo sapiens
aactctttcaaattatat

SEQ ID NO: 5094484 - DNA, 14 bp, Homo sapiens
aactctttgagaaa

SEQ ID NO: 5094485 - DNA, 11 bp, Homo sapiens
aactctttggc

SEQ ID NO: 5094486 - DNA, 15 bp, Homo sapiens
aactctttggctatt

SEQ ID NO: 5094487 - DNA, 21 bp, Homo sapiens
aactctttggctattgtcctt

SEQ ID NO: 5094488 - DNA, 11 bp, Homo sapiens
aactctttggt

SEQ ID NO: 5094489 - DNA, 19 bp, Homo sapiens
aactctttgttatttgaaa

SEQ ID NO: 5094490 - DNA, 17 bp, Homo sapiens
aactctttttgggctcc

SEQ ID NO: 5094491 - DNA, 16 bp, Homo sapiens
aactgaaaaatgtcag

SEQ ID NO: 5094492 - DNA, 18 bp, Homo sapiens
aactgaaaacataaaaag

SEQ ID NO: 5094493 - DNA, 14 bp, Homo sapiens
aactgaaaaccagt

SEQ ID NO: 5094494 - DNA, 21 bp, Homo sapiens
aactgaaaactcccatttacg

SEQ ID NO: 5094495 - DNA, 20 bp, Homo sapiens
aactgaaaagactcagtgtt

SEQ ID NO: 5094496 - DNA, 15 bp, Homo sapiens
aactgaaaagagagc

SEQ ID NO: 5094497 - DNA, 21 bp, Homo sapiens
aactgaaaagagagcagagaa

SEQ ID NO: 5094498 - DNA, 12 bp, Homo sapiens
aactgaaaatgt

SEQ ID NO: 5094499 - DNA, 12 bp, Homo sapiens
aactgaaaatta

SEQ ID NO: 5094500 - DNA, 22 bp, Homo sapiens
aactgaaacaaatgctcctcct

SEQ ID NO: 5094501 - DNA, 19 bp, Homo sapiens
aactgaaacttttctaaag

SEQ ID NO: 5094502 - DNA, 16 bp, Homo sapiens
aactgaaagtgtttta

SEQ ID NO: 5094503 - DNA, 21 bp, Homo sapiens
aactgaaagtgttttactctt

SEQ ID NO: 5094504 - DNA, 14 bp, Homo sapiens
aactgaaataaacc

SEQ ID NO: 5094505 - DNA, 21 bp, Homo sapiens
aactgaaataaacctgcactg

SEQ ID NO: 5094506 - DNA, 12 bp, Homo sapiens
aactgaaatcat

SEQ ID NO: 5094507 - DNA, 20 bp, Homo sapiens
aactgaaatcatacttctta

SEQ ID NO: 5094508 - DNA, 14 bp, Homo sapiens
aactgaaattacat

SEQ ID NO: 5094509 - DNA, 18 bp, Homo sapiens
aactgaaattagtgtttt

SEQ ID NO: 5094510 - DNA, 21 bp, Homo sapiens
aactgaaattagtgttttcat

SEQ ID NO: 5094511 - DNA, 21 bp, Homo sapiens
aactgaacaccattgaaggct

SEQ ID NO: 5094512 - DNA, 17 bp, Homo sapiens
aactgaaccaaattgca

SEQ ID NO: 5094513 - DNA, 18 bp, Homo sapiens
aactgaaccaaattgcac

SEQ ID NO: 5094514 - DNA, 14 bp, Homo sapiens
aactgaacgacaaa

SEQ ID NO: 5094515 - DNA, 15 bp, Homo sapiens
aactgaacgtcctgc

SEQ ID NO: 5094516 - DNA, 16 bp, Homo sapiens
aactgaactctgacaa

SEQ ID NO: 5094517 - DNA, 23 bp, Homo sapiens
aactgaactctgacaacagactt

SEQ ID NO: 5094518 - DNA, 13 bp, Homo sapiens
aactgaactgtaa

SEQ ID NO: 5094519 - DNA, 15 bp, Homo sapiens
aactgaactgtgaac

SEQ ID NO: 5094520 - DNA, 15 bp, Homo sapiens
aactgaacttcagag

SEQ ID NO: 5094521 - DNA, 18 bp, Homo sapiens
aactgaacttgaagctaa

SEQ ID NO: 5094522 - DNA, 17 bp, Homo sapiens
aactgaagaaagagaag

SEQ ID NO: 5094523 - DNA, 20 bp, Homo sapiens
aactgaagaaggatatattt

SEQ ID NO: 5094524 - DNA, 23 bp, Homo sapiens
aactgaagacaattatcaaccac

SEQ ID NO: 5094525 - DNA, 14 bp, Homo sapiens
aactgaagagacag

SEQ ID NO: 5094526 - DNA, 14 bp, Homo sapiens
aactgaagatattc

SEQ ID NO: 5094527 - DNA, 20 bp, Homo sapiens
aactgaagatccacaaaaga

SEQ ID NO: 5094528 - DNA, 20 bp, Homo sapiens
aactgaagcagcctctcccc

SEQ ID NO: 5094529 - DNA, 21 bp, Homo sapiens
aactgaagcagcctctcccca

SEQ ID NO: 5094530 - DNA, 11 bp, Homo sapiens
aactgaagcat

SEQ ID NO: 5094531 - DNA, 17 bp, Homo sapiens
aactgaagcataaacat

SEQ ID NO: 5094532 - DNA, 14 bp, Homo sapiens
aactgaagccactt

SEQ ID NO: 5094533 - DNA, 16 bp, Homo sapiens
aactgaagccacttgg

SEQ ID NO: 5094534 - DNA, 18 bp, Homo sapiens
aactgaagccttcttctg

SEQ ID NO: 5094535 - DNA, 14 bp, Homo sapiens
aactgaagctgctg

SEQ ID NO: 5094536 - DNA, 15 bp, Homo sapiens
aactgaagctgctgt

SEQ ID NO: 5094537 - DNA, 13 bp, Homo sapiens
aactgaaggaagg

SEQ ID NO: 5094538 - DNA, 14 bp, Homo sapiens
aactgaaggaaggc

SEQ ID NO: 5094539 - DNA, 13 bp, Homo sapiens
aactgaaggagaa

SEQ ID NO: 5094540 - DNA, 17 bp, Homo sapiens
aactgaaggggtgcacc

SEQ ID NO: 5094541 - DNA, 23 bp, Homo sapiens
aactgaaggggtgcacccacctg

SEQ ID NO: 5094542 - DNA, 14 bp, Homo sapiens
aactgaagtctgaa

SEQ ID NO: 5094543 - DNA, 16 bp, Homo sapiens
aactgaagtttcacat

SEQ ID NO: 5094544 - DNA, 18 bp, Homo sapiens
aactgaataaaaaataaa

SEQ ID NO: 5094545 - DNA, 17 bp, Homo sapiens
aactgaataccactctg

SEQ ID NO: 5094546 - DNA, 20 bp, Homo sapiens
aactgaatagcaagtggcat

SEQ ID NO: 5094547 - DNA, 16 bp, Homo sapiens
aactgaataggaaaat

SEQ ID NO: 5094548 - DNA, 23 bp, Homo sapiens
aactgaataggaaaatgtacata

SEQ ID NO: 5094549 - DNA, 12 bp, Homo sapiens
aactgaatataa

SEQ ID NO: 5094550 - DNA, 20 bp, Homo sapiens
aactgaatattttggaaact

SEQ ID NO: 5094551 - DNA, 23 bp, Homo sapiens
aactgaatattttggaaactgct

SEQ ID NO: 5094552 - DNA, 20 bp, Homo sapiens
aactgaatcaggaaactcaa

SEQ ID NO: 5094553 - DNA, 18 bp, Homo sapiens
aactgaatctatggcttt

SEQ ID NO: 5094554 - DNA, 23 bp, Homo sapiens
aactgaatgaatccattggagaa

SEQ ID NO: 5094555 - DNA, 12 bp, Homo sapiens
aactgaatgaga

SEQ ID NO: 5094556 - DNA, 16 bp, Homo sapiens
aactgaatgtttacat

SEQ ID NO: 5094557 - DNA, 20 bp, Homo sapiens
aactgaatgtttattccttg

SEQ ID NO: 5094558 - DNA, 13 bp, Homo sapiens
aactgaatttgga

SEQ ID NO: 5094559 - DNA, 14 bp, Homo sapiens
aactgaattttgtc

SEQ ID NO: 5094560 - DNA, 19 bp, Homo sapiens
aactgaattttttttaaaa

SEQ ID NO: 5094561 - DNA, 15 bp, Homo sapiens
aactgacaaagatgc

SEQ ID NO: 5094562 - DNA, 19 bp, Homo sapiens
aactgacaaaggagccttg

SEQ ID NO: 5094563 - DNA, 21 bp, Homo sapiens
aactgacaaaggagccttgat

SEQ ID NO: 5094564 - DNA, 18 bp, Homo sapiens
aactgacaaatcaagttt

SEQ ID NO: 5094565 - DNA, 19 bp, Homo sapiens
aactgacaaatcaagtttc

SEQ ID NO: 5094566 - DNA, 21 bp, Homo sapiens
aactgacaacctgtgcagtcc

SEQ ID NO: 5094567 - DNA, 16 bp, Homo sapiens
aactgacaatgaaggg

SEQ ID NO: 5094568 - DNA, 14 bp, Homo sapiens
aactgacaatttta

SEQ ID NO: 5094569 - DNA, 21 bp, Homo sapiens
aactgacaattttacctattc

SEQ ID NO: 5094570 - DNA, 14 bp, Homo sapiens
aactgacacaggaa

SEQ ID NO: 5094571 - DNA, 20 bp, Homo sapiens
aactgacactcccacccagt

SEQ ID NO: 5094572 - DNA, 20 bp, Homo sapiens
aactgacagatgcttttgct

SEQ ID NO: 5094573 - DNA, 21 bp, Homo sapiens
aactgacaggcagcctggaca

SEQ ID NO: 5094574 - DNA, 14 bp, Homo sapiens
aactgacagtatta

SEQ ID NO: 5094575 - DNA, 14 bp, Homo sapiens
aactgacataatgt

SEQ ID NO: 5094576 - DNA, 15 bp, Homo sapiens
aactgacatcagatt

SEQ ID NO: 5094577 - DNA, 23 bp, Homo sapiens
aactgacatgccctcccttctcc

SEQ ID NO: 5094578 - DNA, 22 bp, Homo sapiens
aactgaccctcccttcctgtcc

SEQ ID NO: 5094579 - DNA, 20 bp, Homo sapiens
aactgacgctggagatgcaa

SEQ ID NO: 5094580 - DNA, 15 bp, Homo sapiens
aactgactcttaaga

SEQ ID NO: 5094581 - DNA, 18 bp, Homo sapiens
aactgactcttaagaaga

SEQ ID NO: 5094582 - DNA, 19 bp, Homo sapiens
aactgactcttaagaagac

SEQ ID NO: 5094583 - DNA, 13 bp, Homo sapiens
aactgacttaaga

SEQ ID NO: 5094584 - DNA, 14 bp, Homo sapiens
aactgacttaatgc

SEQ ID NO: 5094585 - DNA, 18 bp, Homo sapiens
aactgactttttcccccc

SEQ ID NO: 5094586 - DNA, 17 bp, Homo sapiens
aactgagaaatgaatgc

SEQ ID NO: 5094587 - DNA, 17 bp, Homo sapiens
aactgagaagccaagcc

SEQ ID NO: 5094588 - DNA, 13 bp, Homo sapiens
aactgagagaaag

SEQ ID NO: 5094589 - DNA, 14 bp, Homo sapiens
aactgagagctgag

SEQ ID NO: 5094590 - DNA, 17 bp, Homo sapiens
aactgagagtaattcat

SEQ ID NO: 5094591 - DNA, 15 bp, Homo sapiens
aactgagatattatt

SEQ ID NO: 5094592 - DNA, 19 bp, Homo sapiens
aactgagatattattttaa

SEQ ID NO: 5094593 - DNA, 15 bp, Homo sapiens
aactgagatgttaaa

SEQ ID NO: 5094594 - DNA, 24 bp, Homo sapiens
aactgagccaaacacactgtaaat

SEQ ID NO: 5094595 - DNA, 10 bp, Homo sapiens
aactgagccg

SEQ ID NO: 5094596 - DNA, 17 bp, Homo sapiens
aactgagcctagctacc

SEQ ID NO: 5094597 - DNA, 17 bp, Homo sapiens
aactgagcttggaagct

SEQ ID NO: 5094598 - DNA, 20 bp, Homo sapiens
aactgaggaattttctttgt

SEQ ID NO: 5094599 - DNA, 23 bp, Homo sapiens
aactgaggagaagctgatccagt

SEQ ID NO: 5094600 - DNA, 19 bp, Homo sapiens
aactgaggagatgaccagg

SEQ ID NO: 5094601 - DNA, 22 bp, Homo sapiens
aactgaggagatgaccagggat

SEQ ID NO: 5094602 - DNA, 22 bp, Homo sapiens
aactgaggagtagctgagagga

SEQ ID NO: 5094603 - DNA, 12 bp, Homo sapiens
aactgaggcaga

SEQ ID NO: 5094604 - DNA, 14 bp, Homo sapiens
aactgaggcccaga

SEQ ID NO: 5094605 - DNA, 16 bp, Homo sapiens
aactgaggcccagaga

SEQ ID NO: 5094606 - DNA, 17 bp, Homo sapiens
aactgaggcccagagag

SEQ ID NO: 5094607 - DNA, 19 bp, Homo sapiens
aactgaggcttagagatag

SEQ ID NO: 5094608 - DNA, 16 bp, Homo sapiens
aactgagggctgatct

SEQ ID NO: 5094609 - DNA, 18 bp, Homo sapiens
aactgaggtatggccatg

SEQ ID NO: 5094610 - DNA, 20 bp, Homo sapiens
aactgaggtcactgggttct

SEQ ID NO: 5094611 - DNA, 18 bp, Homo sapiens
aactgaggtgttattttc

SEQ ID NO: 5094612 - DNA, 22 bp, Homo sapiens
aactgagtatgtgtaacaggat

SEQ ID NO: 5094613 - DNA, 21 bp, Homo sapiens
aactgagtcatcttgtgagtg

SEQ ID NO: 5094614 - DNA, 13 bp, Homo sapiens
aactgagtcctgt

SEQ ID NO: 5094615 - DNA, 18 bp, Homo sapiens
aactgatcaaaaataaac

SEQ ID NO: 5094616 - DNA, 19 bp, Homo sapiens
aactgatcaaaaataaact

SEQ ID NO: 5094617 - DNA, 21 bp, Homo sapiens
aactgatcaaaaataaactag

SEQ ID NO: 5094618 - DNA, 22 bp, Homo sapiens
aactgatcaaaaataaactagt

SEQ ID NO: 5094619 - DNA, 23 bp, Homo sapiens
aactgatcatgtttatgagaaac

SEQ ID NO: 5094620 - DNA, 20 bp, Homo sapiens
aactgatcatttgcagctgc

SEQ ID NO: 5094621 - DNA, 22 bp, Homo sapiens
aactgatcatttgcagctgctg

SEQ ID NO: 5094622 - DNA, 21 bp, Homo sapiens
aactgatcctgctccagcagc

SEQ ID NO: 5094623 - DNA, 13 bp, Homo sapiens
aactgatctattt

SEQ ID NO: 5094624 - DNA, 15 bp, Homo sapiens
aactgatctgttata

SEQ ID NO: 5094625 - DNA, 23 bp, Homo sapiens
aactgatcttttcctgccagaag

SEQ ID NO: 5094626 - DNA, 23 bp, Homo sapiens
aactgatgagtaaactgaggccc

SEQ ID NO: 5094627 - DNA, 16 bp, Homo sapiens
aactgatgatagactt

SEQ ID NO: 5094628 - DNA, 20 bp, Homo sapiens
aactgatgcgaaaacttgaa

SEQ ID NO: 5094629 - DNA, 22 bp, Homo sapiens
aactgatgcgacttgttttgct

SEQ ID NO: 5094630 - DNA, 15 bp, Homo sapiens
aactgatggaccggg

SEQ ID NO: 5094631 - DNA, 23 bp, Homo sapiens
aactgatggaccgggtgggcctg

SEQ ID NO: 5094632 - DNA, 15 bp, Homo sapiens
aactgatgtgaaact

SEQ ID NO: 5094633 - DNA, 16 bp, Homo sapiens
aactgattaaaaatac

SEQ ID NO: 5094634 - DNA, 18 bp, Homo sapiens
aactgattagtaagtctt

SEQ ID NO: 5094635 - DNA, 20 bp, Homo sapiens
aactgattagtattcaggca

SEQ ID NO: 5094636 - DNA, 19 bp, Homo sapiens
aactgattcttatgattac

SEQ ID NO: 5094637 - DNA, 19 bp, Homo sapiens
aactgattgctcccaggat

SEQ ID NO: 5094638 - DNA, 18 bp, Homo sapiens
aactgatttctatggctt

SEQ ID NO: 5094639 - DNA, 16 bp, Homo sapiens
aactgatttcttcaga

SEQ ID NO: 5094640 - DNA, 12 bp, Homo sapiens
aactgattttac

SEQ ID NO: 5094641 - DNA, 19 bp, Homo sapiens
aactgattttacaaattaa

SEQ ID NO: 5094642 - DNA, 14 bp, Homo sapiens
aactgattttgtat

SEQ ID NO: 5094643 - DNA, 16 bp, Homo sapiens
aactgattttttaaga

SEQ ID NO: 5094644 - DNA, 20 bp, Homo sapiens
aactgatttttttttccttc

SEQ ID NO: 5094645 - DNA, 19 bp, Homo sapiens
aactgcaaaaaaagcctcc

SEQ ID NO: 5094646 - DNA, 21 bp, Homo sapiens
aactgcaaaaaaagcctccaa

SEQ ID NO: 5094647 - DNA, 22 bp, Homo sapiens
aactgcaaaaaaagcctccaag

SEQ ID NO: 5094648 - DNA, 15 bp, Homo sapiens
aactgcaaagtgaag

SEQ ID NO: 5094649 - DNA, 18 bp, Homo sapiens
aactgcaaagtgaagttg

SEQ ID NO: 5094650 - DNA, 16 bp, Homo sapiens
aactgcaactccagcg

SEQ ID NO: 5094651 - DNA, 16 bp, Homo sapiens
aactgcaagtcacaaa

SEQ ID NO: 5094652 - DNA, 18 bp, Homo sapiens
aactgcaataacttctga

SEQ ID NO: 5094653 - DNA, 19 bp, Homo sapiens
aactgcaataacttctgac

SEQ ID NO: 5094654 - DNA, 23 bp, Homo sapiens
aactgcaataatatcaaaacaag

SEQ ID NO: 5094655 - DNA, 18 bp, Homo sapiens
aacttcttccactttttc

SEQ ID NO: 5094656 - DNA, 16 bp, Homo sapiens
aacttcttcctgctgg

SEQ ID NO: 5094657 - DNA, 15 bp, Homo sapiens
aacttcttctatatc

SEQ ID NO: 5094658 - DNA, 22 bp, Homo sapiens
aacttctttctatttgacttgt

SEQ ID NO: 5094659 - DNA, 12 bp, Homo sapiens
aacttctttgaa

SEQ ID NO: 5094660 - DNA, 13 bp, Homo sapiens
aacttctttgaag

SEQ ID NO: 5094661 - DNA, 17 bp, Homo sapiens
aacttctttgaagttat

SEQ ID NO: 5094662 - DNA, 18 bp, Homo sapiens
aacttcttttctcttcta

SEQ ID NO: 5094663 - DNA, 9 bp, Homo sapiens
aacttgaaa

SEQ ID NO: 5094664 - DNA, 10 bp, Homo sapiens
aacttgaaaa

SEQ ID NO: 5094665 - DNA, 13 bp, Homo sapiens
aacttgaaaaaaa

SEQ ID NO: 5094666 - DNA, 18 bp, Homo sapiens
aacttgaaaaaaaaaaac

SEQ ID NO: 5094667 - DNA, 16 bp, Homo sapiens
aacttgaaaagaaaac

SEQ ID NO: 5094668 - DNA, 20 bp, Homo sapiens
aacttgaaaagattgcaaag

SEQ ID NO: 5094669 - DNA, 14 bp, Homo sapiens
aacttgaaaatata

SEQ ID NO: 5094670 - DNA, 13 bp, Homo sapiens
aacttgaaatata

SEQ ID NO: 5094671 - DNA, 16 bp, Homo sapiens
aacttgaaatatataa

SEQ ID NO: 5094672 - DNA, 18 bp, Homo sapiens
aacttgaaatatataata

SEQ ID NO: 5094673 - DNA, 22 bp, Homo sapiens
aacttgaaatctaatatttcta

SEQ ID NO: 5094674 - DNA, 13 bp, Homo sapiens
aacttgaaatttg

SEQ ID NO: 5094675 - DNA, 14 bp, Homo sapiens
aacttgaactgatt

SEQ ID NO: 5094676 - DNA, 12 bp, Homo sapiens
aacttgaagaaa

SEQ ID NO: 5094677 - DNA, 13 bp, Homo sapiens
aacttgaagaaac

SEQ ID NO: 5094678 - DNA, 14 bp, Homo sapiens
aacttgaagcagtc

SEQ ID NO: 5094679 - DNA, 12 bp, Homo sapiens
aacttgaaggat

SEQ ID NO: 5094680 - DNA, 13 bp, Homo sapiens
aacttgaatctgt

SEQ ID NO: 5094681 - DNA, 15 bp, Homo sapiens
aacttgaccctgagc

SEQ ID NO: 5094682 - DNA, 19 bp, Homo sapiens
aacttgaccctgagcttaa

SEQ ID NO: 5094683 - DNA, 16 bp, Homo sapiens
aacttgagatctgtat

SEQ ID NO: 5094684 - DNA, 17 bp, Homo sapiens
aacttgagatctgtata

SEQ ID NO: 5094685 - DNA, 22 bp, Homo sapiens
aacttgagatctgtataaataa

SEQ ID NO: 5094686 - DNA, 21 bp, Homo sapiens
aacttgagattcaagacaaga

SEQ ID NO: 5094687 - DNA, 21 bp, Homo sapiens
aacttgagcctgtcaagaggc

SEQ ID NO: 5094688 - DNA, 22 bp, Homo sapiens
aacttgagctttaaaaatcatt

SEQ ID NO: 5094689 - DNA, 19 bp, Homo sapiens
aacttgagggtaataaact

SEQ ID NO: 5094690 - DNA, 23 bp, Homo sapiens
aacttgaggtggcctccttgctt

SEQ ID NO: 5094691 - DNA, 12 bp, Homo sapiens
aacttgatgttc

SEQ ID NO: 5094692 - DNA, 19 bp, Homo sapiens
aacttgatgttccacctgc

SEQ ID NO: 5094693 - DNA, 14 bp, Homo sapiens
aacttgattcttgt

SEQ ID NO: 5094694 - DNA, 14 bp, Homo sapiens
aacttgatttgcat

SEQ ID NO: 5094695 - DNA, 15 bp, Homo sapiens
aacttgatttgcatg

SEQ ID NO: 5094696 - DNA, 19 bp, Homo sapiens
aacttgcaaaatcagtttt

SEQ ID NO: 5094697 - DNA, 21 bp, Homo sapiens
aacttgcaatataacattcta

SEQ ID NO: 5094698 - DNA, 10 bp, Homo sapiens
aacttgcatc

SEQ ID NO: 5094699 - DNA, 22 bp, Homo sapiens
aacttgcatctaggctgggcgt

SEQ ID NO: 5094700 - DNA, 21 bp, Homo sapiens
aacttgccatccgcacagaaa

SEQ ID NO: 5094701 - DNA, 16 bp, Homo sapiens
aacttgccatttcttt

SEQ ID NO: 5094702 - DNA, 20 bp, Homo sapiens
aacttgccatttctttatat

SEQ ID NO: 5094703 - DNA, 16 bp, Homo sapiens
aacttgcctccatctt

SEQ ID NO: 5094704 - DNA, 13 bp, Homo sapiens
aacttgcctcttt

SEQ ID NO: 5094705 - DNA, 18 bp, Homo sapiens
aacttgcctcttttacct

SEQ ID NO: 5094706 - DNA, 23 bp, Homo sapiens
aacttgcctcttttacctgctgc

SEQ ID NO: 5094707 - DNA, 16 bp, Homo sapiens
aacttgcctgcctttc

SEQ ID NO: 5094708 - DNA, 22 bp, Homo sapiens
aacttgcctggggtctgagcat

SEQ ID NO: 5094709 - DNA, 13 bp, Homo sapiens
aacttgcctttca

SEQ ID NO: 5094710 - DNA, 19 bp, Homo sapiens
aacttgctacttatcattt

SEQ ID NO: 5094711 - DNA, 16 bp, Homo sapiens
aacttgctcctttcca

SEQ ID NO: 5094712 - DNA, 19 bp, Homo sapiens
aacttgctcctttccatca

SEQ ID NO: 5094713 - DNA, 20 bp, Homo sapiens
aacttgctcctttccatcag

SEQ ID NO: 5094714 - DNA, 12 bp, Homo sapiens
aacttgctctca

SEQ ID NO: 5094715 - DNA, 14 bp, Homo sapiens
aacttgctgaaaaa

SEQ ID NO: 5094716 - DNA, 16 bp, Homo sapiens
aacttgctgaaaaaca

SEQ ID NO: 5094717 - DNA, 20 bp, Homo sapiens
aacttgctgcagtatgaaaa

SEQ ID NO: 5094718 - DNA, 16 bp, Homo sapiens
aacttgctgctgcctt

SEQ ID NO: 5094719 - DNA, 19 bp, Homo sapiens
aacttgctgctgtgcctgc

SEQ ID NO: 5094720 - DNA, 23 bp, Homo sapiens
aacttgctgggtggttctctggg

SEQ ID NO: 5094721 - DNA, 15 bp, Homo sapiens
aacttgctgtgaaat

SEQ ID NO: 5094722 - DNA, 18 bp, Homo sapiens
aacttgcttaaatgtgaa

SEQ ID NO: 5094723 - DNA, 21 bp, Homo sapiens
aacttgcttaaatttcttatg

SEQ ID NO: 5094724 - DNA, 13 bp, Homo sapiens
aacttgcttctaa

SEQ ID NO: 5094725 - DNA, 17 bp, Homo sapiens
aacttgcttctaaatgc

SEQ ID NO: 5094726 - DNA, 16 bp, Homo sapiens
aacttgctttcttctt

SEQ ID NO: 5094727 - DNA, 16 bp, Homo sapiens
aacttggaaaaagaaa

SEQ ID NO: 5094728 - DNA, 22 bp, Homo sapiens
aacttggatcagatagcaggag

SEQ ID NO: 5094729 - DNA, 16 bp, Homo sapiens
aacttggatggacttg

SEQ ID NO: 5094730 - DNA, 13 bp, Homo sapiens
aacttggcacttt

SEQ ID NO: 5094731 - DNA, 21 bp, Homo sapiens
aacttggcactttttcgtgtg

SEQ ID NO: 5094732 - DNA, 15 bp, Homo sapiens
aacttggcatttcta

SEQ ID NO: 5094733 - DNA, 16 bp, Homo sapiens
aacttggcatttctat

SEQ ID NO: 5094734 - DNA, 21 bp, Homo sapiens
aacttggcatttctatacttt

SEQ ID NO: 5094735 - DNA, 11 bp, Homo sapiens
aacttggctca

SEQ ID NO: 5094736 - DNA, 20 bp, Homo sapiens
aacttggctttcctgtttct

SEQ ID NO: 5094737 - DNA, 16 bp, Homo sapiens
aacttgggcacatgct

SEQ ID NO: 5094738 - DNA, 16 bp, Homo sapiens
aacttgggctgtaaag

SEQ ID NO: 5094739 - DNA, 17 bp, Homo sapiens
aacttggtcagagccac

SEQ ID NO: 5094740 - DNA, 14 bp, Homo sapiens
aacttggttataca

SEQ ID NO: 5094741 - DNA, 16 bp, Homo sapiens
aacttggttctgcttc

SEQ ID NO: 5094742 - DNA, 21 bp, Homo sapiens
aacttggttttgctacataat

SEQ ID NO: 5094743 - DNA, 22 bp, Homo sapiens
aacttggttttgctacataatt

SEQ ID NO: 5094744 - DNA, 18 bp, Homo sapiens
aacttgtaatcttcccca

SEQ ID NO: 5094745 - DNA, 12 bp, Homo sapiens
aacttgtactta

SEQ ID NO: 5094746 - DNA, 16 bp, Homo sapiens
aacttgtagccagaat

SEQ ID NO: 5094747 - DNA, 18 bp, Homo sapiens
aacttgtagctgtaaaac

SEQ ID NO: 5094748 - DNA, 15 bp, Homo sapiens
aacttgtatattcca

SEQ ID NO: 5094749 - DNA, 17 bp, Homo sapiens
aacttgtatctgaagac

SEQ ID NO: 5094750 - DNA, 15 bp, Homo sapiens
aacttgtattatgtg

SEQ ID NO: 5094751 - DNA, 16 bp, Homo sapiens
aacttgtattatgtgt

SEQ ID NO: 5094752 - DNA, 14 bp, Homo sapiens
aacttgtatttcca

SEQ ID NO: 5094753 - DNA, 17 bp, Homo sapiens
aacttgtattttgtcac

SEQ ID NO: 5094754 - DNA, 20 bp, Homo sapiens
aacttgtcaaaaaacaaaaa

SEQ ID NO: 5094755 - DNA, 11 bp, Homo sapiens
aacttgtcact

SEQ ID NO: 5094756 - DNA, 14 bp, Homo sapiens
aacttgtctggctt

SEQ ID NO: 5094757 - DNA, 20 bp, Homo sapiens
aacttgtctggctttggcac

SEQ ID NO: 5094758 - DNA, 22 bp, Homo sapiens
aacttgtctttggaccctgagg

SEQ ID NO: 5094759 - DNA, 11 bp, Homo sapiens
aacttgtgaac

SEQ ID NO: 5094760 - DNA, 21 bp, Homo sapiens
aacttgtgaactccatcattc

SEQ ID NO: 5094761 - DNA, 13 bp, Homo sapiens
aacttgtgaatgc

SEQ ID NO: 5094762 - DNA, 17 bp, Homo sapiens
aacttgtgaatgcttct

SEQ ID NO: 5094763 - DNA, 16 bp, Homo sapiens
aacttgtgagcatcag

SEQ ID NO: 5094764 - DNA, 17 bp, Homo sapiens
aacttgtgagcatcaga

SEQ ID NO: 5094765 - DNA, 19 bp, Homo sapiens
aacttgtgagcatcagagg

SEQ ID NO: 5094766 - DNA, 12 bp, Homo sapiens
aacttgtgcctc

SEQ ID NO: 5094767 - DNA, 13 bp, Homo sapiens
aacttgtgcctcc

SEQ ID NO: 5094768 - DNA, 20 bp, Homo sapiens
aacttgtgctatagtgtata

SEQ ID NO: 5094769 - DNA, 17 bp, Homo sapiens
aacttgtgctgagaata

SEQ ID NO: 5094770 - DNA, 20 bp, Homo sapiens
aacttgtgtaaatacaattt

SEQ ID NO: 5094771 - DNA, 15 bp, Homo sapiens
aacttgtgttactaa

SEQ ID NO: 5094772 - DNA, 15 bp, Homo sapiens
aacttgttattgtga

SEQ ID NO: 5094773 - DNA, 20 bp, Homo sapiens
aacttgttattgtgaatgat

SEQ ID NO: 5094774 - DNA, 16 bp, Homo sapiens
aacttgttcacaggtt

SEQ ID NO: 5094775 - DNA, 21 bp, Homo sapiens
aacttgttcatttagataatt

SEQ ID NO: 5094776 - DNA, 19 bp, Homo sapiens
aacttgttcttccaaagca

SEQ ID NO: 5094777 - DNA, 15 bp, Homo sapiens
aacttgttgcagact

SEQ ID NO: 5094778 - DNA, 17 bp, Homo sapiens
aacttgttgtggctctt

SEQ ID NO: 5094779 - DNA, 16 bp, Homo sapiens
aacttgtttaataaag

SEQ ID NO: 5094780 - DNA, 15 bp, Homo sapiens
aacttgtttacaaca

SEQ ID NO: 5094781 - DNA, 18 bp, Homo sapiens
aacttgtttacaacattt

SEQ ID NO: 5094782 - DNA, 17 bp, Homo sapiens
aacttgtttgctgtgaa

SEQ ID NO: 5094783 - DNA, 22 bp, Homo sapiens
aacttgttttgacttgaataaa

SEQ ID NO: 5094784 - DNA, 15 bp, Homo sapiens
aactttaaaaaatat

SEQ ID NO: 5094785 - DNA, 21 bp, Homo sapiens
aactttaaaaattattatata

SEQ ID NO: 5094786 - DNA, 14 bp, Homo sapiens
aactttaaaactgt

SEQ ID NO: 5094787 - DNA, 19 bp, Homo sapiens
aactttaaaactgtattta

SEQ ID NO: 5094788 - DNA, 15 bp, Homo sapiens
aactttaaaaggcaa

SEQ ID NO: 5094789 - DNA, 16 bp, Homo sapiens
aactttaaaaggcaac

SEQ ID NO: 5094790 - DNA, 17 bp, Homo sapiens
aactttaaaaggcaact

SEQ ID NO: 5094791 - DNA, 15 bp, Homo sapiens
aactttaaacatcta

SEQ ID NO: 5094792 - DNA, 16 bp, Homo sapiens
aactttaagcagctct

SEQ ID NO: 5094793 - DNA, 18 bp, Homo sapiens
aactttaagcagctcttg

SEQ ID NO: 5094794 - DNA, 18 bp, Homo sapiens
aactttaagtttcaggat

SEQ ID NO: 5094795 - DNA, 11 bp, Homo sapiens
aactttaatac

SEQ ID NO: 5094796 - DNA, 16 bp, Homo sapiens
aactttaatatgtatt

SEQ ID NO: 5094797 - DNA, 12 bp, Homo sapiens
aactttaatcaa

SEQ ID NO: 5094798 - DNA, 19 bp, Homo sapiens
aactttaatgttttttgcc

SEQ ID NO: 5094799 - DNA, 20 bp, Homo sapiens
aactttaattctctttcaaa

SEQ ID NO: 5094800 - DNA, 12 bp, Homo sapiens
aactttacatat

SEQ ID NO: 5094801 - DNA, 14 bp, Homo sapiens
aactttaccaaatg

SEQ ID NO: 5094802 - DNA, 17 bp, Homo sapiens
aactttacctatggaag

SEQ ID NO: 5094803 - DNA, 20 bp, Homo sapiens
aactttactaagatgacatt

SEQ ID NO: 5094804 - DNA, 22 bp, Homo sapiens
aactttagaagtgcatttctga

SEQ ID NO: 5094805 - DNA, 16 bp, Homo sapiens
aactttagcatcagaa

SEQ ID NO: 5094806 - DNA, 17 bp, Homo sapiens
aactttagtattaaatc

SEQ ID NO: 5094807 - DNA, 20 bp, Homo sapiens
aactttagtttgcctgcagt

SEQ ID NO: 5094808 - DNA, 17 bp, Homo sapiens
aactttataacttaaat

SEQ ID NO: 5094809 - DNA, 13 bp, Homo sapiens
aactttatacatt

SEQ ID NO: 5094810 - DNA, 14 bp, Homo sapiens
aactttatcactta

SEQ ID NO: 5094811 - DNA, 22 bp, Homo sapiens
aactttatcagggaaactaaga

SEQ ID NO: 5094812 - DNA, 23 bp, Homo sapiens
aactttatcatggaatttaatgc

SEQ ID NO: 5094813 - DNA, 20 bp, Homo sapiens
aactttatgctaagtgaaat

SEQ ID NO: 5094814 - DNA, 21 bp, Homo sapiens
aactttatgctaagtgaaata

SEQ ID NO: 5094815 - DNA, 12 bp, Homo sapiens
aactttattctt

SEQ ID NO: 5094816 - DNA, 17 bp, Homo sapiens
aactttattgcatatag

SEQ ID NO: 5094817 - DNA, 21 bp, Homo sapiens
aactttattgcatatagattt

SEQ ID NO: 5094818 - DNA, 16 bp, Homo sapiens
aactttatttaaatgc

SEQ ID NO: 5094819 - DNA, 20 bp, Homo sapiens
aactttatttaaatgcatgt

SEQ ID NO: 5094820 - DNA, 14 bp, Homo sapiens
aactttatttgtaa

SEQ ID NO: 5094821 - DNA, 20 bp, Homo sapiens
aactttatttgtaaaccatt

SEQ ID NO: 5094822 - DNA, 23 bp, Homo sapiens
aactttattttgaatgtacctct

SEQ ID NO: 5094823 - DNA, 14 bp, Homo sapiens
aactttatttttct

SEQ ID NO: 5094824 - DNA, 16 bp, Homo sapiens
aactttcaagaacttg

SEQ ID NO: 5094825 - DNA, 16 bp, Homo sapiens
aactttcacttcttcc

SEQ ID NO: 5094826 - DNA, 14 bp, Homo sapiens
aactttcagaggca

SEQ ID NO: 5094827 - DNA, 20 bp, Homo sapiens
aactttcagcagtctaaatt

SEQ ID NO: 5094828 - DNA, 12 bp, Homo sapiens
aactttcatacc

SEQ ID NO: 5094829 - DNA, 18 bp, Homo sapiens
aactttcataccacttga

SEQ ID NO: 5094830 - DNA, 11 bp, Homo sapiens
aactttcattt

SEQ ID NO: 5094831 - DNA, 17 bp, Homo sapiens
aactttcatttttttcc

SEQ ID NO: 5094832 - DNA, 23 bp, Homo sapiens
aactttcccaggttctgtttatg

SEQ ID NO: 5094833 - DNA, 23 bp, Homo sapiens
aactttccccagatcaaattcta

SEQ ID NO: 5094834 - DNA, 14 bp, Homo sapiens
aactttccccccaa

SEQ ID NO: 5094835 - DNA, 12 bp, Homo sapiens
aactttcccttg

SEQ ID NO: 5094836 - DNA, 17 bp, Homo sapiens
aactgcaatagagactg

SEQ ID NO: 5094837 - DNA, 17 bp, Homo sapiens
aactgcacacacagctc

SEQ ID NO: 5094838 - DNA, 17 bp, Homo sapiens
aactgcacactcagtgg

SEQ ID NO: 5094839 - DNA, 18 bp, Homo sapiens
aactgcacactcagtggg

SEQ ID NO: 5094840 - DNA, 16 bp, Homo sapiens
aactgcacagtgctgt

SEQ ID NO: 5094841 - DNA, 18 bp, Homo sapiens
aactgcacagtgctgttg

SEQ ID NO: 5094842 - DNA, 17 bp, Homo sapiens
aactgcacatgaaagtt

SEQ ID NO: 5094843 - DNA, 19 bp, Homo sapiens
aactgcacatgaagaaata

SEQ ID NO: 5094844 - DNA, 21 bp, Homo sapiens
aactgcacatgaagaaatact

SEQ ID NO: 5094845 - DNA, 18 bp, Homo sapiens
aactgcacatgatttcac

SEQ ID NO: 5094846 - DNA, 22 bp, Homo sapiens
aactgcaccaccgaccaactcc

SEQ ID NO: 5094847 - DNA, 12 bp, Homo sapiens
aactgcactttt

SEQ ID NO: 5094848 - DNA, 17 bp, Homo sapiens
aactgcactttttttac

SEQ ID NO: 5094849 - DNA, 17 bp, Homo sapiens
aactgcaggaatgctga

SEQ ID NO: 5094850 - DNA, 18 bp, Homo sapiens
aactgcaggagcagtttg

SEQ ID NO: 5094851 - DNA, 19 bp, Homo sapiens
aactgcaggccctggcctc

SEQ ID NO: 5094852 - DNA, 22 bp, Homo sapiens
aactgcagtcatcaacaatgat

SEQ ID NO: 5094853 - DNA, 23 bp, Homo sapiens
aactgcagttcatccgcactgta

SEQ ID NO: 5094854 - DNA, 11 bp, Homo sapiens
aactgcagttt

SEQ ID NO: 5094855 - DNA, 16 bp, Homo sapiens
aactgcatacactttt

SEQ ID NO: 5094856 - DNA, 16 bp, Homo sapiens
aactgcatcaagactt

SEQ ID NO: 5094857 - DNA, 21 bp, Homo sapiens
aactgcatcccacgttctgtt

SEQ ID NO: 5094858 - DNA, 17 bp, Homo sapiens
aactgcatgcccagaga

SEQ ID NO: 5094859 - DNA, 18 bp, Homo sapiens
aactgcatgcccagagac

SEQ ID NO: 5094860 - DNA, 14 bp, Homo sapiens
aactgcatgctgct

SEQ ID NO: 5094861 - DNA, 21 bp, Homo sapiens
aactgcatggacctaacattc

SEQ ID NO: 5094862 - DNA, 18 bp, Homo sapiens
aactgcatgtataaatga

SEQ ID NO: 5094863 - DNA, 23 bp, Homo sapiens
aactgcattaccgcgttgtaaaa

SEQ ID NO: 5094864 - DNA, 19 bp, Homo sapiens
aactgcattagaaaccatg

SEQ ID NO: 5094865 - DNA, 16 bp, Homo sapiens
aactgcattatttgtt

SEQ ID NO: 5094866 - DNA, 18 bp, Homo sapiens
aactgcattctataataa

SEQ ID NO: 5094867 - DNA, 14 bp, Homo sapiens
aactgcatttttaa

SEQ ID NO: 5094868 - DNA, 19 bp, Homo sapiens
aactgccaaataaaatgtt

SEQ ID NO: 5094869 - DNA, 11 bp, Homo sapiens
aactgccacct

SEQ ID NO: 5094870 - DNA, 12 bp, Homo sapiens
aactgccacctt

SEQ ID NO: 5094871 - DNA, 17 bp, Homo sapiens
aactgccaggctgcctc

SEQ ID NO: 5094872 - DNA, 18 bp, Homo sapiens
aactgccaggctgcctcc

SEQ ID NO: 5094873 - DNA, 15 bp, Homo sapiens
aactgccatgtaggc

SEQ ID NO: 5094874 - DNA, 18 bp, Homo sapiens
aactgccattattttctg

SEQ ID NO: 5094875 - DNA, 22 bp, Homo sapiens
aactgccattattttctgtcag

SEQ ID NO: 5094876 - DNA, 12 bp, Homo sapiens
aactgcccagca

SEQ ID NO: 5094877 - DNA, 14 bp, Homo sapiens
aactgcccagcaac

SEQ ID NO: 5094878 - DNA, 16 bp, Homo sapiens
aactgcccagcccctt

SEQ ID NO: 5094879 - DNA, 13 bp, Homo sapiens
aactgccccaggg

SEQ ID NO: 5094880 - DNA, 13 bp, Homo sapiens
aactgcccccact

SEQ ID NO: 5094881 - DNA, 20 bp, Homo sapiens
aactgccccctctgccctgc

SEQ ID NO: 5094882 - DNA, 22 bp, Homo sapiens
aactgccctaagcccccagggc

SEQ ID NO: 5094883 - DNA, 10 bp, Homo sapiens
aactgccctt

SEQ ID NO: 5094884 - DNA, 18 bp, Homo sapiens
aactgcccttccaggtgg

SEQ ID NO: 5094885 - DNA, 17 bp, Homo sapiens
aactgcccttgctgccc

SEQ ID NO: 5094886 - DNA, 20 bp, Homo sapiens
aactgcccttttaaatggca

SEQ ID NO: 5094887 - DNA, 16 bp, Homo sapiens
aactgccgctggaggc

SEQ ID NO: 5094888 - DNA, 16 bp, Homo sapiens
aactgccgtaatttaa

SEQ ID NO: 5094889 - DNA, 17 bp, Homo sapiens
aactgcctaaggccctt

SEQ ID NO: 5094890 - DNA, 16 bp, Homo sapiens
aactgcctactccaaa

SEQ ID NO: 5094891 - DNA, 17 bp, Homo sapiens
aactgcctagaaacaac

SEQ ID NO: 5094892 - DNA, 21 bp, Homo sapiens
aactgcctccttgccagcccc

SEQ ID NO: 5094893 - DNA, 21 bp, Homo sapiens
aactgccttccccagggtgtc

SEQ ID NO: 5094894 - DNA, 18 bp, Homo sapiens
aactgcgaggacatcaaa

SEQ ID NO: 5094895 - DNA, 20 bp, Homo sapiens
aactgcgataactgagaaac

SEQ ID NO: 5094896 - DNA, 22 bp, Homo sapiens
aactgcgggaatactgtctctt

SEQ ID NO: 5094897 - DNA, 16 bp, Homo sapiens
aactgcgttaaaggct

SEQ ID NO: 5094898 - DNA, 15 bp, Homo sapiens
aactgctaaatactg

SEQ ID NO: 5094899 - DNA, 21 bp, Homo sapiens
aactgctaaatactgtacata

SEQ ID NO: 5094900 - DNA, 17 bp, Homo sapiens
aactgctacttgctctg

SEQ ID NO: 5094901 - DNA, 17 bp, Homo sapiens
aactgctcagctctggt

SEQ ID NO: 5094902 - DNA, 17 bp, Homo sapiens
aactgctccagcctctg

SEQ ID NO: 5094903 - DNA, 22 bp, Homo sapiens
aactgctccagcctctgccgct

SEQ ID NO: 5094904 - DNA, 24 bp, Homo sapiens
aactgctccagcctctgccgctgc

SEQ ID NO: 5094905 - DNA, 16 bp, Homo sapiens
aactgctctactttga

SEQ ID NO: 5094906 - DNA, 19 bp, Homo sapiens
aactgctctactttgagaa

SEQ ID NO: 5094907 - DNA, 17 bp, Homo sapiens
aactgctcttgaacatt

SEQ ID NO: 5094908 - DNA, 23 bp, Homo sapiens
aactgctcttgggcaatattctc

SEQ ID NO: 5094909 - DNA, 15 bp, Homo sapiens
aactgctgagccact

SEQ ID NO: 5094910 - DNA, 19 bp, Homo sapiens
aactgctgatcaatgaaat

SEQ ID NO: 5094911 - DNA, 13 bp, Homo sapiens
aactgctgccact

SEQ ID NO: 5094912 - DNA, 19 bp, Homo sapiens
aactgctggaaatctcaaa

SEQ ID NO: 5094913 - DNA, 16 bp, Homo sapiens
aactgctgtaaacaca

SEQ ID NO: 5094914 - DNA, 13 bp, Homo sapiens
aactgctgtcaat

SEQ ID NO: 5094915 - DNA, 19 bp, Homo sapiens
aactgctgttaaaattaat

SEQ ID NO: 5094916 - DNA, 21 bp, Homo sapiens
aactgctgttttatgtcatac

SEQ ID NO: 5094917 - DNA, 21 bp, Homo sapiens
aactgcttactcccaaaacag

SEQ ID NO: 5094918 - DNA, 22 bp, Homo sapiens
aactgcttcccttactttgctg

SEQ ID NO: 5094919 - DNA, 22 bp, Homo sapiens
aactgcttcctataattttgat

SEQ ID NO: 5094920 - DNA, 23 bp, Homo sapiens
aactgcttcctataattttgata

SEQ ID NO: 5094921 - DNA, 18 bp, Homo sapiens
aactgcttgcccagggtg

SEQ ID NO: 5094922 - DNA, 18 bp, Homo sapiens
aactgctttcaagtctga

SEQ ID NO: 5094923 - DNA, 12 bp, Homo sapiens
aactgctttgca

SEQ ID NO: 5094924 - DNA, 16 bp, Homo sapiens
aactgctttgggagat

SEQ ID NO: 5094925 - DNA, 23 bp, Homo sapiens
aactgctttgggagattatcagt

SEQ ID NO: 5094926 - DNA, 17 bp, Homo sapiens
aactgctttgtgcatat

SEQ ID NO: 5094927 - DNA, 22 bp, Homo sapiens
aactgcttttcctcaagcaata

SEQ ID NO: 5094928 - DNA, 17 bp, Homo sapiens
aactggaaaacagaaca

SEQ ID NO: 5094929 - DNA, 18 bp, Homo sapiens
aactggaaaatcttctag

SEQ ID NO: 5094930 - DNA, 16 bp, Homo sapiens
aactggaaacatctga

SEQ ID NO: 5094931 - DNA, 16 bp, Homo sapiens
aactggaaatctggat

SEQ ID NO: 5094932 - DNA, 15 bp, Homo sapiens
aactggaagcacagc

SEQ ID NO: 5094933 - DNA, 20 bp, Homo sapiens
aactggaagcacagcctcgg

SEQ ID NO: 5094934 - DNA, 13 bp, Homo sapiens
aactggaagcttt

SEQ ID NO: 5094935 - DNA, 14 bp, Homo sapiens
aactggaataagaa

SEQ ID NO: 5094936 - DNA, 16 bp, Homo sapiens
aactggaatcagctca

SEQ ID NO: 5094937 - DNA, 19 bp, Homo sapiens
aactggaatcagctcagga

SEQ ID NO: 5094938 - DNA, 14 bp, Homo sapiens
aactggaattaaaa

SEQ ID NO: 5094939 - DNA, 20 bp, Homo sapiens
aactggaattaaaaggatag

SEQ ID NO: 5094940 - DNA, 21 bp, Homo sapiens
aactggacacaataggtcttt

SEQ ID NO: 5094941 - DNA, 14 bp, Homo sapiens
aactggacagcctc

SEQ ID NO: 5094942 - DNA, 15 bp, Homo sapiens
aactggacagcctct

SEQ ID NO: 5094943 - DNA, 18 bp, Homo sapiens
aactggacatcacagcag

SEQ ID NO: 5094944 - DNA, 23 bp, Homo sapiens
aactggacatcacagcagaatga

SEQ ID NO: 5094945 - DNA, 16 bp, Homo sapiens
aactggacatgaagga

SEQ ID NO: 5094946 - DNA, 22 bp, Homo sapiens
aactggaccctgttgctaagcc

SEQ ID NO: 5094947 - DNA, 13 bp, Homo sapiens
aactggactcaca

SEQ ID NO: 5094948 - DNA, 17 bp, Homo sapiens
aactggactcacattcg

SEQ ID NO: 5094949 - DNA, 19 bp, Homo sapiens
aactggagaccagaaacct

SEQ ID NO: 5094950 - DNA, 12 bp, Homo sapiens
aactggagcccc

SEQ ID NO: 5094951 - DNA, 12 bp, Homo sapiens
aactggagctgc

SEQ ID NO: 5094952 - DNA, 16 bp, Homo sapiens
aactggagtctggagt

SEQ ID NO: 5094953 - DNA, 23 bp, Homo sapiens
aactggagttccttatccctctc

SEQ ID NO: 5094954 - DNA, 18 bp, Homo sapiens
aactggatactgtactga

SEQ ID NO: 5094955 - DNA, 22 bp, Homo sapiens
aactggatagaaaaatgctgtt

SEQ ID NO: 5094956 - DNA, 16 bp, Homo sapiens
aactggatatttcaat

SEQ ID NO: 5094957 - DNA, 21 bp, Homo sapiens
aactggatgcatcaagaacta

SEQ ID NO: 5094958 - DNA, 14 bp, Homo sapiens
aactggatggaaat

SEQ ID NO: 5094959 - DNA, 16 bp, Homo sapiens
aactggattaaactta

SEQ ID NO: 5094960 - DNA, 23 bp, Homo sapiens
aactggattttgaacgcttaagt

SEQ ID NO: 5094961 - DNA, 15 bp, Homo sapiens
aactggcaggagcct

SEQ ID NO: 5094962 - DNA, 14 bp, Homo sapiens
aactggcaggcagg

SEQ ID NO: 5094963 - DNA, 20 bp, Homo sapiens
aactggcatctgacacaaaa

SEQ ID NO: 5094964 - DNA, 15 bp, Homo sapiens
aactggcatgtcatt

SEQ ID NO: 5094965 - DNA, 21 bp, Homo sapiens
aactggccaagctgaggtgcc

SEQ ID NO: 5094966 - DNA, 14 bp, Homo sapiens
aactggccccaggc

SEQ ID NO: 5094967 - DNA, 22 bp, Homo sapiens
aactggccctatttagatgata

SEQ ID NO: 5094968 - DNA, 16 bp, Homo sapiens
aactggccctcttctt

SEQ ID NO: 5094969 - DNA, 21 bp, Homo sapiens
aactggccggtctgcaagtca

SEQ ID NO: 5094970 - DNA, 23 bp, Homo sapiens
aactggccggtctgcaagtcaga

SEQ ID NO: 5094971 - DNA, 18 bp, Homo sapiens
aactggcctaaatttctt

SEQ ID NO: 5094972 - DNA, 16 bp, Homo sapiens
aactggccttttgata

SEQ ID NO: 5094973 - DNA, 16 bp, Homo sapiens
aactggcgaagcctga

SEQ ID NO: 5094974 - DNA, 21 bp, Homo sapiens
aactggcgatctcccagggct

SEQ ID NO: 5094975 - DNA, 23 bp, Homo sapiens
aactggctcctttgcctctgcta

SEQ ID NO: 5094976 - DNA, 17 bp, Homo sapiens
aactggctgctccctgc

SEQ ID NO: 5094977 - DNA, 17 bp, Homo sapiens
aactggctggccagtct

SEQ ID NO: 5094978 - DNA, 14 bp, Homo sapiens
aactggctgggccc

SEQ ID NO: 5094979 - DNA, 16 bp, Homo sapiens
aactggcttcatttta

SEQ ID NO: 5094980 - DNA, 15 bp, Homo sapiens
aactggcttctgtgc

SEQ ID NO: 5094981 - DNA, 17 bp, Homo sapiens
aactggcttgtacattt

SEQ ID NO: 5094982 - DNA, 18 bp, Homo sapiens
aactggctttcctgctgg

SEQ ID NO: 5094983 - DNA, 13 bp, Homo sapiens
aactgggaaatga

SEQ ID NO: 5094984 - DNA, 17 bp, Homo sapiens
aactgggaaatgagatc

SEQ ID NO: 5094985 - DNA, 22 bp, Homo sapiens
aactgggaacccctttcccacc

SEQ ID NO: 5094986 - DNA, 12 bp, Homo sapiens
aactgggaagaa

SEQ ID NO: 5094987 - DNA, 16 bp, Homo sapiens
aactgggaagatgctg

SEQ ID NO: 5094988 - DNA, 13 bp, Homo sapiens
aactgggaccttt

SEQ ID NO: 5094989 - DNA, 21 bp, Homo sapiens
aactgggacgtgtatttccat

SEQ ID NO: 5094990 - DNA, 14 bp, Homo sapiens
aactgggataactg

SEQ ID NO: 5094991 - DNA, 23 bp, Homo sapiens
aactgggatgaaactaaagcaat

SEQ ID NO: 5094992 - DNA, 20 bp, Homo sapiens
aactgggatgaggtgactat

SEQ ID NO: 5094993 - DNA, 18 bp, Homo sapiens
aactgggattaagtgaga

SEQ ID NO: 5094994 - DNA, 16 bp, Homo sapiens
aactgggcatttcaat

SEQ ID NO: 5094995 - DNA, 12 bp, Homo sapiens
aactgggccagc

SEQ ID NO: 5094996 - DNA, 14 bp, Homo sapiens
aactgggctgaaca

SEQ ID NO: 5094997 - DNA, 19 bp, Homo sapiens
aactggggagttataaaaa

SEQ ID NO: 5094998 - DNA, 20 bp, Homo sapiens
aactggggagttataaaaat

SEQ ID NO: 5094999 - DNA, 19 bp, Homo sapiens
aactggggctttgccttgc

SEQ ID NO: 5095000 - DNA, 14 bp, Homo sapiens
aactggggggccac

SEQ ID NO: 5095001 - DNA, 16 bp, Homo sapiens
aactggggggccacca

SEQ ID NO: 5095002 - DNA, 18 bp, Homo sapiens
aactggggggccaccatg

SEQ ID NO: 5095003 - DNA, 22 bp, Homo sapiens
aactggggttcaagcccaggct

SEQ ID NO: 5095004 - DNA, 16 bp, Homo sapiens
aactggggttgagggc

SEQ ID NO: 5095005 - DNA, 18 bp, Homo sapiens
aactggggttgagggcca

SEQ ID NO: 5095006 - DNA, 23 bp, Homo sapiens
aactgggtaaatgcaaagttctg

SEQ ID NO: 5095007 - DNA, 18 bp, Homo sapiens
aactgggtaatgaaacaa

SEQ ID NO: 5095008 - DNA, 16 bp, Homo sapiens
aactgggtacttgtgg

SEQ ID NO: 5095009 - DNA, 21 bp, Homo sapiens
aactgggtacttgtggacaca

SEQ ID NO: 5095010 - DNA, 22 bp, Homo sapiens
aactgggtcatcatttgtcctg

SEQ ID NO: 5095011 - DNA, 15 bp, Homo sapiens
aactgggtgactgga

SEQ ID NO: 5095012 - DNA, 23 bp, Homo sapiens
aactgggttaaatattttgctaa

SEQ ID NO: 5095013 - DNA, 21 bp, Homo sapiens
aactgggttacagtgttttat

SEQ ID NO: 5095014 - DNA, 15 bp, Homo sapiens
aactttcctggatgt

SEQ ID NO: 5095015 - DNA, 18 bp, Homo sapiens
aactttcctggatgtctg

SEQ ID NO: 5095016 - DNA, 16 bp, Homo sapiens
aactttccttcctcat

SEQ ID NO: 5095017 - DNA, 18 bp, Homo sapiens
aactttcggagcctgcct

SEQ ID NO: 5095018 - DNA, 19 bp, Homo sapiens
aactttcggagcctgcctc

SEQ ID NO: 5095019 - DNA, 20 bp, Homo sapiens
aactttctataacctaaatg

SEQ ID NO: 5095020 - DNA, 15 bp, Homo sapiens
aactttctcagcata

SEQ ID NO: 5095021 - DNA, 18 bp, Homo sapiens
aactttctcagcatatat

SEQ ID NO: 5095022 - DNA, 19 bp, Homo sapiens
aactttctcagcatatata

SEQ ID NO: 5095023 - DNA, 23 bp, Homo sapiens
aactttctccatttaagacacat

SEQ ID NO: 5095024 - DNA, 16 bp, Homo sapiens
aactttctctgtgaaa

SEQ ID NO: 5095025 - DNA, 12 bp, Homo sapiens
aactttctcttt

SEQ ID NO: 5095026 - DNA, 16 bp, Homo sapiens
aactttctctttgcca

SEQ ID NO: 5095027 - DNA, 14 bp, Homo sapiens
aactttctgctttg

SEQ ID NO: 5095028 - DNA, 14 bp, Homo sapiens
aactttctggtccc

SEQ ID NO: 5095029 - DNA, 11 bp, Homo sapiens
aactttctgta

SEQ ID NO: 5095030 - DNA, 15 bp, Homo sapiens
aactttctgtaaact

SEQ ID NO: 5095031 - DNA, 21 bp, Homo sapiens
aactttcttaatatttttaca

SEQ ID NO: 5095032 - DNA, 12 bp, Homo sapiens
aactttcttcaa

SEQ ID NO: 5095033 - DNA, 11 bp, Homo sapiens
aactttgaaat

SEQ ID NO: 5095034 - DNA, 13 bp, Homo sapiens
aactttgaaatat

SEQ ID NO: 5095035 - DNA, 14 bp, Homo sapiens
aactttgaaatata

SEQ ID NO: 5095036 - DNA, 12 bp, Homo sapiens
aactttgaataa

SEQ ID NO: 5095037 - DNA, 17 bp, Homo sapiens
aactttgaataaagaat

SEQ ID NO: 5095038 - DNA, 13 bp, Homo sapiens
aactttgacctct

SEQ ID NO: 5095039 - DNA, 22 bp, Homo sapiens
aactttgaggataactttttaa

SEQ ID NO: 5095040 - DNA, 17 bp, Homo sapiens
aactttgagtacagata

SEQ ID NO: 5095041 - DNA, 23 bp, Homo sapiens
aactttgagtacagatactgtga

SEQ ID NO: 5095042 - DNA, 18 bp, Homo sapiens
aactttgcaaattattta

SEQ ID NO: 5095043 - DNA, 22 bp, Homo sapiens
aactttgcaaattatttattac

SEQ ID NO: 5095044 - DNA, 17 bp, Homo sapiens
aactttgcagcatacca

SEQ ID NO: 5095045 - DNA, 19 bp, Homo sapiens
aactttgcagcataccaat

SEQ ID NO: 5095046 - DNA, 22 bp, Homo sapiens
aactttgcatagcagctgctac

SEQ ID NO: 5095047 - DNA, 13 bp, Homo sapiens
aactttgcatgtt

SEQ ID NO: 5095048 - DNA, 22 bp, Homo sapiens
aactttgcatgttcttgttttg

SEQ ID NO: 5095049 - DNA, 23 bp, Homo sapiens
aactttgcatgttcttgttttgt

SEQ ID NO: 5095050 - DNA, 15 bp, Homo sapiens
aactttgccaaaaaa

SEQ ID NO: 5095051 - DNA, 15 bp, Homo sapiens
aactttgctgagcct

SEQ ID NO: 5095052 - DNA, 19 bp, Homo sapiens
aactttgcttgattaaaca

SEQ ID NO: 5095053 - DNA, 12 bp, Homo sapiens
aactttggaaaa

SEQ ID NO: 5095054 - DNA, 16 bp, Homo sapiens
aactttggaacaagat

SEQ ID NO: 5095055 - DNA, 19 bp, Homo sapiens
aactttggagaactcattt

SEQ ID NO: 5095056 - DNA, 15 bp, Homo sapiens
aactttggcctttgt

SEQ ID NO: 5095057 - DNA, 23 bp, Homo sapiens
aactttgtacagtggagaaatat

SEQ ID NO: 5095058 - DNA, 22 bp, Homo sapiens
aactttgtagaaagcaaacaaa

SEQ ID NO: 5095059 - DNA, 21 bp, Homo sapiens
aactttgtagacattttgaaa

SEQ ID NO: 5095060 - DNA, 22 bp, Homo sapiens
aactttgtagacattttgaaat

SEQ ID NO: 5095061 - DNA, 13 bp, Homo sapiens
aactttgtatagt

SEQ ID NO: 5095062 - DNA, 20 bp, Homo sapiens
aactttgtatagttatgtaa

SEQ ID NO: 5095063 - DNA, 20 bp, Homo sapiens
aactttgtcgtggttcttaa

SEQ ID NO: 5095064 - DNA, 19 bp, Homo sapiens
aactttgtggatgtcttcc

SEQ ID NO: 5095065 - DNA, 17 bp, Homo sapiens
aacttttaaaatttgtc

SEQ ID NO: 5095066 - DNA, 15 bp, Homo sapiens
aacttttaaagaaaa

SEQ ID NO: 5095067 - DNA, 13 bp, Homo sapiens
aacttttaatggt

SEQ ID NO: 5095068 - DNA, 15 bp, Homo sapiens
aacttttaattactg

SEQ ID NO: 5095069 - DNA, 14 bp, Homo sapiens
aacttttaatttaa

SEQ ID NO: 5095070 - DNA, 13 bp, Homo sapiens
aacttttacagaa

SEQ ID NO: 5095071 - DNA, 19 bp, Homo sapiens
aacttttacagaatgcatt

SEQ ID NO: 5095072 - DNA, 21 bp, Homo sapiens
aacttttacatttttctgatg

SEQ ID NO: 5095073 - DNA, 17 bp, Homo sapiens
aacttttagtaaagtca

SEQ ID NO: 5095074 - DNA, 19 bp, Homo sapiens
aacttttataaattaaata

SEQ ID NO: 5095075 - DNA, 13 bp, Homo sapiens
aacttttcaaaat

SEQ ID NO: 5095076 - DNA, 20 bp, Homo sapiens
aacttttcaaggcacattga

SEQ ID NO: 5095077 - DNA, 16 bp, Homo sapiens
aacttttcatttcaga

SEQ ID NO: 5095078 - DNA, 18 bp, Homo sapiens
aacttttcatttcagatt

SEQ ID NO: 5095079 - DNA, 21 bp, Homo sapiens
aacttttccaagcaaaatcta

SEQ ID NO: 5095080 - DNA, 15 bp, Homo sapiens
aacttttccctcact

SEQ ID NO: 5095081 - DNA, 19 bp, Homo sapiens
aacttttctaacagaaagc

SEQ ID NO: 5095082 - DNA, 19 bp, Homo sapiens
aacttttctaagaaaagca

SEQ ID NO: 5095083 - DNA, 18 bp, Homo sapiens
aacttttctattaaaagt

SEQ ID NO: 5095084 - DNA, 18 bp, Homo sapiens
aacttttcttaaggtttt

SEQ ID NO: 5095085 - DNA, 14 bp, Homo sapiens
aacttttgaaaaag

SEQ ID NO: 5095086 - DNA, 12 bp, Homo sapiens
aacttttgaaat

SEQ ID NO: 5095087 - DNA, 21 bp, Homo sapiens
aacttttgagaatgtttgaaa

SEQ ID NO: 5095088 - DNA, 15 bp, Homo sapiens
aacttttggaatcat

SEQ ID NO: 5095089 - DNA, 13 bp, Homo sapiens
aacttttgggagc

SEQ ID NO: 5095090 - DNA, 17 bp, Homo sapiens
aacttttgggatttgtt

SEQ ID NO: 5095091 - DNA, 11 bp, Homo sapiens
aacttttgtaa

SEQ ID NO: 5095092 - DNA, 15 bp, Homo sapiens
aacttttgtaaagaa

SEQ ID NO: 5095093 - DNA, 14 bp, Homo sapiens
aacttttgtaaata

SEQ ID NO: 5095094 - DNA, 14 bp, Homo sapiens
aacttttgtagtct

SEQ ID NO: 5095095 - DNA, 16 bp, Homo sapiens
aacttttgtagtctta

SEQ ID NO: 5095096 - DNA, 13 bp, Homo sapiens
aacttttgtgaat

SEQ ID NO: 5095097 - DNA, 19 bp, Homo sapiens
aacttttgtgaattaggct

SEQ ID NO: 5095098 - DNA, 20 bp, Homo sapiens
aacttttgtttagagccctc

SEQ ID NO: 5095099 - DNA, 23 bp, Homo sapiens
aacttttgtttttttttgtttgt

SEQ ID NO: 5095100 - DNA, 23 bp, Homo sapiens
aactttttaaaaaaataaaacag

SEQ ID NO: 5095101 - DNA, 16 bp, Homo sapiens
aactttttaataaagt

SEQ ID NO: 5095102 - DNA, 18 bp, Homo sapiens
aactttttacattacaga

SEQ ID NO: 5095103 - DNA, 14 bp, Homo sapiens
aactttttattgcc

SEQ ID NO: 5095104 - DNA, 23 bp, Homo sapiens
aactttttattgccttctcacca

SEQ ID NO: 5095105 - DNA, 16 bp, Homo sapiens
aactttttatttctaa

SEQ ID NO: 5095106 - DNA, 22 bp, Homo sapiens
aactttttccagcaaaatggaa

SEQ ID NO: 5095107 - DNA, 12 bp, Homo sapiens
aactttttcctc

SEQ ID NO: 5095108 - DNA, 20 bp, Homo sapiens
aactttttctaaattataaa

SEQ ID NO: 5095109 - DNA, 18 bp, Homo sapiens
aactttttctaagctgtt

SEQ ID NO: 5095110 - DNA, 18 bp, Homo sapiens
aactttttgaattctatg

SEQ ID NO: 5095111 - DNA, 15 bp, Homo sapiens
aactttttgttctgg

SEQ ID NO: 5095112 - DNA, 23 bp, Homo sapiens
aactttttgttctggtccttttt

SEQ ID NO: 5095113 - DNA, 19 bp, Homo sapiens
aacttttttaaataaactt

SEQ ID NO: 5095114 - DNA, 20 bp, Homo sapiens
aacttttttaaataaacttt

SEQ ID NO: 5095115 - DNA, 16 bp, Homo sapiens
aacttttttaaattaa

SEQ ID NO: 5095116 - DNA, 18 bp, Homo sapiens
aacttttttatatctttt

SEQ ID NO: 5095117 - DNA, 18 bp, Homo sapiens
aacttttttattttaaga

SEQ ID NO: 5095118 - DNA, 20 bp, Homo sapiens
aacttttttcattttgaaaa

SEQ ID NO: 5095119 - DNA, 14 bp, Homo sapiens
aacttttttccctt

SEQ ID NO: 5095120 - DNA, 15 bp, Homo sapiens
aacttttttcccttg

SEQ ID NO: 5095121 - DNA, 19 bp, Homo sapiens
aacttttttgagtcattga

SEQ ID NO: 5095122 - DNA, 18 bp, Homo sapiens
aacttttttggtgtgtgt

SEQ ID NO: 5095123 - DNA, 18 bp, Homo sapiens
aacttttttgtgtatgta

SEQ ID NO: 5095124 - DNA, 21 bp, Homo sapiens
aactttttttgagaaggaaat

SEQ ID NO: 5095125 - DNA, 20 bp, Homo sapiens
aacttttttttaagttacac

SEQ ID NO: 5095126 - DNA, 19 bp, Homo sapiens
aacttttttttctctcttt

SEQ ID NO: 5095127 - DNA, 18 bp, Homo sapiens
aacttttttttttcttta

SEQ ID NO: 5095128 - DNA, 21 bp, Homo sapiens
aacttttttttttttttggtt

SEQ ID NO: 5095129 - DNA, 18 bp, Homo sapiens
aagaaaaaaaaaaaagcc

SEQ ID NO: 5095130 - DNA, 20 bp, Homo sapiens
aagaaaaaaaaaagaagaag

SEQ ID NO: 5095131 - DNA, 17 bp, Homo sapiens
aagaaaaaaaaaatgat

SEQ ID NO: 5095132 - DNA, 19 bp, Homo sapiens
aagaaaaaaaaagaattac

SEQ ID NO: 5095133 - DNA, 16 bp, Homo sapiens
aagaaaaaaaaatact

SEQ ID NO: 5095134 - DNA, 18 bp, Homo sapiens
aagaaaaaaaaggcagta

SEQ ID NO: 5095135 - DNA, 16 bp, Homo sapiens
aagaaaaaaaatcaaa

SEQ ID NO: 5095136 - DNA, 16 bp, Homo sapiens
aagaaaaaaaatgtac

SEQ ID NO: 5095137 - DNA, 13 bp, Homo sapiens
aagaaaaaaacca

SEQ ID NO: 5095138 - DNA, 13 bp, Homo sapiens
aagaaaaaaagaa

SEQ ID NO: 5095139 - DNA, 12 bp, Homo sapiens
aagaaaaaaata

SEQ ID NO: 5095140 - DNA, 24 bp, Homo sapiens
aagaaaaaaataattttatgaact

SEQ ID NO: 5095141 - DNA, 15 bp, Homo sapiens
aagaaaaaaatacta

SEQ ID NO: 5095142 - DNA, 22 bp, Homo sapiens
aagaaaaaaatactatttaaga

SEQ ID NO: 5095143 - DNA, 18 bp, Homo sapiens
aagaaaaaaatagtttta

SEQ ID NO: 5095144 - DNA, 14 bp, Homo sapiens
aagaaaaaaatata

SEQ ID NO: 5095145 - DNA, 15 bp, Homo sapiens
aagaaaaaaatcttc

SEQ ID NO: 5095146 - DNA, 13 bp, Homo sapiens
aagaaaaaaatga

SEQ ID NO: 5095147 - DNA, 17 bp, Homo sapiens
aagaaaaaaatgtattt

SEQ ID NO: 5095148 - DNA, 20 bp, Homo sapiens
aagaaaaaaattgaaatgta

SEQ ID NO: 5095149 - DNA, 10 bp, Homo sapiens
aagaaaaaag

SEQ ID NO: 5095150 - DNA, 18 bp, Homo sapiens
aagaaaaaagaaaaatct

SEQ ID NO: 5095151 - DNA, 15 bp, Homo sapiens
aagaaaaaagaatgt

SEQ ID NO: 5095152 - DNA, 13 bp, Homo sapiens
aagaaaaaagctt

SEQ ID NO: 5095153 - DNA, 11 bp, Homo sapiens
aagaaaaaagt

SEQ ID NO: 5095154 - DNA, 21 bp, Homo sapiens
aagaaaaaagtccttcagttt

SEQ ID NO: 5095155 - DNA, 13 bp, Homo sapiens
aagaaaaaatcag

SEQ ID NO: 5095156 - DNA, 15 bp, Homo sapiens
aagaaaaaatggcaa

SEQ ID NO: 5095157 - DNA, 16 bp, Homo sapiens
aagaaaaaatggcaag

SEQ ID NO: 5095158 - DNA, 21 bp, Homo sapiens
aagaaaaaatggcaagagatc

SEQ ID NO: 5095159 - DNA, 13 bp, Homo sapiens
aagaaaaacatgt

SEQ ID NO: 5095160 - DNA, 14 bp, Homo sapiens
aagaaaaacatgtc

SEQ ID NO: 5095161 - DNA, 15 bp, Homo sapiens
aagaaaaacatgtca

SEQ ID NO: 5095162 - DNA, 16 bp, Homo sapiens
aagaaaaacatgtcat

SEQ ID NO: 5095163 - DNA, 19 bp, Homo sapiens
aagaaaaacatgtcatgta

SEQ ID NO: 5095164 - DNA, 9 bp, Homo sapiens
aagaaaaag

SEQ ID NO: 5095165 - DNA, 15 bp, Homo sapiens
aagaaaaagaagcaa

SEQ ID NO: 5095166 - DNA, 15 bp, Homo sapiens
aagaaaaagaagtac

SEQ ID NO: 5095167 - DNA, 11 bp, Homo sapiens
aagaaaaagga

SEQ ID NO: 5095168 - DNA, 20 bp, Homo sapiens
aagaaaaaggatgcacagag

SEQ ID NO: 5095169 - DNA, 22 bp, Homo sapiens
aagaaaaaggatgcacagagtt

SEQ ID NO: 5095170 - DNA, 18 bp, Homo sapiens
aagaaaaagtaaatcaaa

SEQ ID NO: 5095171 - DNA, 20 bp, Homo sapiens
aagaaaaagtacaatgaact

SEQ ID NO: 5095172 - DNA, 15 bp, Homo sapiens
aagaaaaagttgcag

SEQ ID NO: 5095173 - DNA, 9 bp, Homo sapiens
aagaaaaat

SEQ ID NO: 5095174 - DNA, 14 bp, Homo sapiens
aagaaaaataaaga

SEQ ID NO: 5095175 - DNA, 16 bp, Homo sapiens
aagaaaaataaagaaa

SEQ ID NO: 5095176 - DNA, 12 bp, Homo sapiens
aagaaaaataat

SEQ ID NO: 5095177 - DNA, 19 bp, Homo sapiens
aagaaaaatataaaaacaa

SEQ ID NO: 5095178 - DNA, 14 bp, Homo sapiens
aagaaaaatatgat

SEQ ID NO: 5095179 - DNA, 12 bp, Homo sapiens
aagaaaaatcaa

SEQ ID NO: 5095180 - DNA, 13 bp, Homo sapiens
aagaaaaatcatg

SEQ ID NO: 5095181 - DNA, 17 bp, Homo sapiens
aagaaaaatcatgtttg

SEQ ID NO: 5095182 - DNA, 14 bp, Homo sapiens
aagaaaaatctcat

SEQ ID NO: 5095183 - DNA, 23 bp, Homo sapiens
aagaaaaatctcattatttcaaa

SEQ ID NO: 5095184 - DNA, 22 bp, Homo sapiens
aagaaaaatgaaaacttttgta

SEQ ID NO: 5095185 - DNA, 12 bp, Homo sapiens
aagaaaaatgtg

SEQ ID NO: 5095186 - DNA, 16 bp, Homo sapiens
aagaaaaattaattag

SEQ ID NO: 5095187 - DNA, 12 bp, Homo sapiens
aagaaaaatttc

SEQ ID NO: 5095188 - DNA, 13 bp, Homo sapiens
aagaaaaatttct

SEQ ID NO: 5095189 - DNA, 11 bp, Homo sapiens
aagaaaacaaa

SEQ ID NO: 5095190 - DNA, 22 bp, Homo sapiens
aagaaaacaaaaccaaaagtta

SEQ ID NO: 5095191 - DNA, 15 bp, Homo sapiens
aagaaaacaagtata

SEQ ID NO: 5095192 - DNA, 13 bp, Homo sapiens
aagaaaacacaac

SEQ ID NO: 5095193 - DNA, 16 bp, Homo sapiens
aagaaaacacacaaaa

SEQ ID NO: 5095194 - DNA, 11 bp, Homo sapiens
aagaaaacact

SEQ ID NO: 5095195 - DNA, 13 bp, Homo sapiens
aagaaaacactgt

SEQ ID NO: 5095196 - DNA, 13 bp, Homo sapiens
aagaaaacatata

SEQ ID NO: 5095197 - DNA, 18 bp, Homo sapiens
aagaaaacatatatttta

SEQ ID NO: 5095198 - DNA, 18 bp, Homo sapiens
aagaaaacatctattctc

SEQ ID NO: 5095199 - DNA, 13 bp, Homo sapiens
aagaaaacatctt

SEQ ID NO: 5095200 - DNA, 14 bp, Homo sapiens
aagaaaacatgtaa

SEQ ID NO: 5095201 - DNA, 12 bp, Homo sapiens
aagaaaacattt

SEQ ID NO: 5095202 - DNA, 17 bp, Homo sapiens
aagaaaacatttaacat

SEQ ID NO: 5095203 - DNA, 15 bp, Homo sapiens
aagaaaaccaaaata

SEQ ID NO: 5095204 - DNA, 19 bp, Homo sapiens
aagaaaacccaaagctcta

SEQ ID NO: 5095205 - DNA, 14 bp, Homo sapiens
aagaaaacccaccc

SEQ ID NO: 5095206 - DNA, 13 bp, Homo sapiens
aagaaaacccgag

SEQ ID NO: 5095207 - DNA, 15 bp, Homo sapiens
aagaaaacccgaggg

SEQ ID NO: 5095208 - DNA, 18 bp, Homo sapiens
aagaaaaccctaagtgtg

SEQ ID NO: 5095209 - DNA, 16 bp, Homo sapiens
aagaaaacctcatgga

SEQ ID NO: 5095210 - DNA, 14 bp, Homo sapiens
aagaaaacctgtat

SEQ ID NO: 5095211 - DNA, 21 bp, Homo sapiens
aagaaaacctgtatttttgtt

SEQ ID NO: 5095212 - DNA, 21 bp, Homo sapiens
aagaaaacctgtttttaacat

SEQ ID NO: 5095213 - DNA, 22 bp, Homo sapiens
aagaaaacggaaatgtgtggtc

SEQ ID NO: 5095214 - DNA, 14 bp, Homo sapiens
aagaaaacttccaa

SEQ ID NO: 5095215 - DNA, 13 bp, Homo sapiens
aagaaaagaaaaa

SEQ ID NO: 5095216 - DNA, 20 bp, Homo sapiens
aagaaaagaatccctgttca

SEQ ID NO: 5095217 - DNA, 14 bp, Homo sapiens
aagaaaagaccctg

SEQ ID NO: 5095218 - DNA, 18 bp, Homo sapiens
aagaaaagacttgtaata

SEQ ID NO: 5095219 - DNA, 15 bp, Homo sapiens
aagaaaagagaagaa

SEQ ID NO: 5095220 - DNA, 20 bp, Homo sapiens
aagaaaagatatgtattcta

SEQ ID NO: 5095221 - DNA, 16 bp, Homo sapiens
aagaaaagattcttct

SEQ ID NO: 5095222 - DNA, 13 bp, Homo sapiens
aagaaaagcactt

SEQ ID NO: 5095223 - DNA, 14 bp, Homo sapiens
aagaaaagcacttt

SEQ ID NO: 5095224 - DNA, 16 bp, Homo sapiens
aagaaaagcacttttg

SEQ ID NO: 5095225 - DNA, 14 bp, Homo sapiens
aagaaaagccaagc

SEQ ID NO: 5095226 - DNA, 14 bp, Homo sapiens
aagaaaagccgaaa

SEQ ID NO: 5095227 - DNA, 16 bp, Homo sapiens
aagaaaagcctcagct

SEQ ID NO: 5095228 - DNA, 19 bp, Homo sapiens
aagaaaagcgcgttgtgta

SEQ ID NO: 5095229 - DNA, 13 bp, Homo sapiens
aagaaaaggacaa

SEQ ID NO: 5095230 - DNA, 19 bp, Homo sapiens
aagaaaaggatttaagcaa

SEQ ID NO: 5095231 - DNA, 13 bp, Homo sapiens
aagaaaaggcatg

SEQ ID NO: 5095232 - DNA, 17 bp, Homo sapiens
aagaaaaggggagagaa

SEQ ID NO: 5095233 - DNA, 19 bp, Homo sapiens
aagaaaagggtcaaacatc

SEQ ID NO: 5095234 - DNA, 19 bp, Homo sapiens
aagaaaagtgaatgctcaa

SEQ ID NO: 5095235 - DNA, 15 bp, Homo sapiens
aagaaaagtgcatat

SEQ ID NO: 5095236 - DNA, 15 bp, Homo sapiens
aagaaaagttttgta

SEQ ID NO: 5095237 - DNA, 16 bp, Homo sapiens
aagaaaagttttgtaa

SEQ ID NO: 5095238 - DNA, 21 bp, Homo sapiens
aagaaaataaaaaaaagaaaa

SEQ ID NO: 5095239 - DNA, 15 bp, Homo sapiens
aagaaaataaaatta

SEQ ID NO: 5095240 - DNA, 15 bp, Homo sapiens
aagaaaataaattac

SEQ ID NO: 5095241 - DNA, 20 bp, Homo sapiens
aagaaaataagagctcagga

SEQ ID NO: 5095242 - DNA, 16 bp, Homo sapiens
aagaaaatacaataaa

SEQ ID NO: 5095243 - DNA, 18 bp, Homo sapiens
aagaaaatacaataaact

SEQ ID NO: 5095244 - DNA, 16 bp, Homo sapiens
aagaaaataccaagga

SEQ ID NO: 5095245 - DNA, 22 bp, Homo sapiens
aagaaaatagagatgagctttc

SEQ ID NO: 5095246 - DNA, 17 bp, Homo sapiens
aagaaaatatacatttg

SEQ ID NO: 5095247 - DNA, 20 bp, Homo sapiens
aagaaaatatacatttgttg

SEQ ID NO: 5095248 - DNA, 15 bp, Homo sapiens
aagaaaatattctaa

SEQ ID NO: 5095249 - DNA, 19 bp, Homo sapiens
aagaaaatatttttaaatg

SEQ ID NO: 5095250 - DNA, 12 bp, Homo sapiens
aagaaaatcagt

SEQ ID NO: 5095251 - DNA, 17 bp, Homo sapiens
aagaaaatcatattgct

SEQ ID NO: 5095252 - DNA, 14 bp, Homo sapiens
aagaaaatctttgt

SEQ ID NO: 5095253 - DNA, 12 bp, Homo sapiens
aagaaaatgcct

SEQ ID NO: 5095254 - DNA, 22 bp, Homo sapiens
aagaaaatggaaagaaggaaaa

SEQ ID NO: 5095255 - DNA, 13 bp, Homo sapiens
aagaaaatggaat

SEQ ID NO: 5095256 - DNA, 19 bp, Homo sapiens
aagaaaatggaattactcc

SEQ ID NO: 5095257 - DNA, 14 bp, Homo sapiens
aagaaaatggatga

SEQ ID NO: 5095258 - DNA, 22 bp, Homo sapiens
aagaaaatgtaaaggtttttgt

SEQ ID NO: 5095259 - DNA, 14 bp, Homo sapiens
aagaaaatgtcttt

SEQ ID NO: 5095260 - DNA, 17 bp, Homo sapiens
aagaaaatgtgtaacag

SEQ ID NO: 5095261 - DNA, 14 bp, Homo sapiens
aagaaaatgttacg

SEQ ID NO: 5095262 - DNA, 15 bp, Homo sapiens
aagaaaattatattc

SEQ ID NO: 5095263 - DNA, 16 bp, Homo sapiens
aagaaaattctctcaa

SEQ ID NO: 5095264 - DNA, 14 bp, Homo sapiens
aagaaaattgagtt

SEQ ID NO: 5095265 - DNA, 16 bp, Homo sapiens
aagaaaattgcatgaa

SEQ ID NO: 5095266 - DNA, 19 bp, Homo sapiens
aagaaaattgcatgaaact

SEQ ID NO: 5095267 - DNA, 13 bp, Homo sapiens
aagaaaattgcca

SEQ ID NO: 5095268 - DNA, 13 bp, Homo sapiens
aagaaaattggta

SEQ ID NO: 5095269 - DNA, 16 bp, Homo sapiens
aagaaaatttaaaaat

SEQ ID NO: 5095270 - DNA, 21 bp, Homo sapiens
aagaaaatttaaaaattaaag

SEQ ID NO: 5095271 - DNA, 14 bp, Homo sapiens
aagaaaatttaatt

SEQ ID NO: 5095272 - DNA, 17 bp, Homo sapiens
aagaaaatttaattatt

SEQ ID NO: 5095273 - DNA, 23 bp, Homo sapiens
aagaaaatttgccaatctttcct

SEQ ID NO: 5095274 - DNA, 11 bp, Homo sapiens
aagaaaatttt

SEQ ID NO: 5095275 - DNA, 12 bp, Homo sapiens
aagaaaattttg

SEQ ID NO: 5095276 - DNA, 15 bp, Homo sapiens
aagaaacaaaatata

SEQ ID NO: 5095277 - DNA, 15 bp, Homo sapiens
aagaaacaaagcaaa

SEQ ID NO: 5095278 - DNA, 15 bp, Homo sapiens
aagaaacaagctgtg

SEQ ID NO: 5095279 - DNA, 16 bp, Homo sapiens
aagaaacaagctgtgc

SEQ ID NO: 5095280 - DNA, 20 bp, Homo sapiens
aagaaacaagctgtgcaggc

SEQ ID NO: 5095281 - DNA, 21 bp, Homo sapiens
aagaaacacatcaaataaact

SEQ ID NO: 5095282 - DNA, 16 bp, Homo sapiens
aagaaacaccacttaa

SEQ ID NO: 5095283 - DNA, 14 bp, Homo sapiens
aagaaacactaaat

SEQ ID NO: 5095284 - DNA, 22 bp, Homo sapiens
aagaaacactcaacaataaaga

SEQ ID NO: 5095285 - DNA, 12 bp, Homo sapiens
aagaaacactga

SEQ ID NO: 5095286 - DNA, 11 bp, Homo sapiens
aagaaacagaa

SEQ ID NO: 5095287 - DNA, 19 bp, Homo sapiens
aagaaacagatctcctggc

SEQ ID NO: 5095288 - DNA, 22 bp, Homo sapiens
aagaaacaggggatcaaagttc

SEQ ID NO: 5095289 - DNA, 17 bp, Homo sapiens
aagaaacagtttaacag

SEQ ID NO: 5095290 - DNA, 19 bp, Homo sapiens
aagaaacatcattctacat

SEQ ID NO: 5095291 - DNA, 15 bp, Homo sapiens
aagaaacatttatct

SEQ ID NO: 5095292 - DNA, 21 bp, Homo sapiens
aagaaaccaagtgcgctttgc

SEQ ID NO: 5095293 - DNA, 16 bp, Homo sapiens
aagaaaccatgacaaa

SEQ ID NO: 5095294 - DNA, 17 bp, Homo sapiens
aagaaaccttttaaaaa

SEQ ID NO: 5095295 - DNA, 23 bp, Homo sapiens
aagaaactactaatctcaattta

SEQ ID NO: 5095296 - DNA, 16 bp, Homo sapiens
aagaaactcaccccca

SEQ ID NO: 5095297 - DNA, 15 bp, Homo sapiens
aagaaactgatttta

SEQ ID NO: 5095298 - DNA, 20 bp, Homo sapiens
aagaaactggtccatgtaaa

SEQ ID NO: 5095299 - DNA, 18 bp, Homo sapiens
aagaaacttggctggaat

SEQ ID NO: 5095300 - DNA, 19 bp, Homo sapiens
aagaaacttggctggaatt

SEQ ID NO: 5095301 - DNA, 19 bp, Homo sapiens
aagaaacttgtaaatatct

SEQ ID NO: 5095302 - DNA, 17 bp, Homo sapiens
aagaaacttgtccttcc

SEQ ID NO: 5095303 - DNA, 15 bp, Homo sapiens
aagaaacttttgtaa

SEQ ID NO: 5095304 - DNA, 23 bp, Homo sapiens
aagaaacttttttattttttaaa

SEQ ID NO: 5095305 - DNA, 12 bp, Homo sapiens
aagaaagaaagg

SEQ ID NO: 5095306 - DNA, 14 bp, Homo sapiens
aagaaagaaaggaa

SEQ ID NO: 5095307 - DNA, 12 bp, Homo sapiens
aagaaagaaata

SEQ ID NO: 5095308 - DNA, 15 bp, Homo sapiens
aagaaagaaggaagt

SEQ ID NO: 5095309 - DNA, 21 bp, Homo sapiens
aagaaagaatgcaagagtgga

SEQ ID NO: 5095310 - DNA, 22 bp, Homo sapiens
aagaaagaatgttactgcctta

SEQ ID NO: 5095311 - DNA, 23 bp, Homo sapiens
aagaaagaattcctgcagcagtt

SEQ ID NO: 5095312 - DNA, 14 bp, Homo sapiens
aagaaagacatctt

SEQ ID NO: 5095313 - DNA, 22 bp, Homo sapiens
aagaaagactctattctcaaag

SEQ ID NO: 5095314 - DNA, 9 bp, Homo sapiens
aagaaagag

SEQ ID NO: 5095315 - DNA, 17 bp, Homo sapiens
aagaaagagaaggagcc

SEQ ID NO: 5095316 - DNA, 15 bp, Homo sapiens
aagaaagagagaaaa

SEQ ID NO: 5095317 - DNA, 17 bp, Homo sapiens
aagaaagaggaaaagaa

SEQ ID NO: 5095318 - DNA, 11 bp, Homo sapiens
aagaaagaggg

SEQ ID NO: 5095319 - DNA, 22 bp, Homo sapiens
aagaaagagggtcccagggctg

SEQ ID NO: 5095320 - DNA, 21 bp, Homo sapiens
aagaaagagttgtcctgatgt

SEQ ID NO: 5095321 - DNA, 17 bp, Homo sapiens
aagaaagatatctatga

SEQ ID NO: 5095322 - DNA, 12 bp, Homo sapiens
aagaaagatttg

SEQ ID NO: 5095323 - DNA, 17 bp, Homo sapiens
aagaaagatttgttact

SEQ ID NO: 5095324 - DNA, 16 bp, Homo sapiens
aagaaagcaaaagcaa

SEQ ID NO: 5095325 - DNA, 16 bp, Homo sapiens
aagaaagcatagacat

SEQ ID NO: 5095326 - DNA, 15 bp, Homo sapiens
aagaaagccagacaa

SEQ ID NO: 5095327 - DNA, 19 bp, Homo sapiens
aagaaagccagacaacttc

SEQ ID NO: 5095328 - DNA, 22 bp, Homo sapiens
aagaaagccctaaaatactatt

SEQ ID NO: 5095329 - DNA, 19 bp, Homo sapiens
aagaaagcccttaggaaga

SEQ ID NO: 5095330 - DNA, 15 bp, Homo sapiens
aagaaagctaatact

SEQ ID NO: 5095331 - DNA, 21 bp, Homo sapiens
aagaaagctatatatgaataa

SEQ ID NO: 5095332 - DNA, 17 bp, Homo sapiens
aagaaagctggtaaact

SEQ ID NO: 5095333 - DNA, 15 bp, Homo sapiens
aagaaagctgtgaaa

SEQ ID NO: 5095334 - DNA, 15 bp, Homo sapiens
aagaaagctgtggct

SEQ ID NO: 5095335 - DNA, 22 bp, Homo sapiens
aagaaagcttcaaactgcatga

SEQ ID NO: 5095336 - DNA, 13 bp, Homo sapiens
aagaaagcttcct

SEQ ID NO: 5095337 - DNA, 12 bp, Homo sapiens
aagaaagctttt

SEQ ID NO: 5095338 - DNA, 16 bp, Homo sapiens
aagaaaggaaaccttt

SEQ ID NO: 5095339 - DNA, 17 bp, Homo sapiens
aagaaaggaaagaagga

SEQ ID NO: 5095340 - DNA, 15 bp, Homo sapiens
aagaaaggaacattt

SEQ ID NO: 5095341 - DNA, 14 bp, Homo sapiens
aagaaaggaagcaa

SEQ ID NO: 5095342 - DNA, 20 bp, Homo sapiens
aagaaaggaagcattgtaaa

SEQ ID NO: 5095343 - DNA, 12 bp, Homo sapiens
aagaaaggaagt

SEQ ID NO: 5095344 - DNA, 20 bp, Homo sapiens
aagaaagggaaactggctga

SEQ ID NO: 5095345 - DNA, 15 bp, Homo sapiens
aagaaagggcaagaa

SEQ ID NO: 5095346 - DNA, 16 bp, Homo sapiens
aagaaagggtgttttt

SEQ ID NO: 5095347 - DNA, 17 bp, Homo sapiens
aagaaagggttctgtaa

SEQ ID NO: 5095348 - DNA, 13 bp, Homo sapiens
aagaaagtccacc

SEQ ID NO: 5095349 - DNA, 22 bp, Homo sapiens
aagaaagtctatctaatgacat

SEQ ID NO: 5095350 - DNA, 15 bp, Homo sapiens
aagaaagtctatgct

SEQ ID NO: 5095351 - DNA, 22 bp, Homo sapiens
aagaaagtgagcagtgttagct

SEQ ID NO: 5095352 - DNA, 23 bp, Homo sapiens
aagaaagtgggaggtcaggaaac

SEQ ID NO: 5095353 - DNA, 13 bp, Homo sapiens
aagaaagtgttca

SEQ ID NO: 5095354 - DNA, 22 bp, Homo sapiens
aagaaagtgttcaaattaaaaa

SEQ ID NO: 5095355 - DNA, 23 bp, Homo sapiens
aagaaataaaaggaagccaaaga

SEQ ID NO: 5095356 - DNA, 17 bp, Homo sapiens
aagaaataaaccaaagg

SEQ ID NO: 5095357 - DNA, 15 bp, Homo sapiens
aagaaataaatcaga

SEQ ID NO: 5095358 - DNA, 22 bp, Homo sapiens
aagaaataaatctatatttttg

SEQ ID NO: 5095359 - DNA, 13 bp, Homo sapiens
aagaaataaccac

SEQ ID NO: 5095360 - DNA, 13 bp, Homo sapiens
aagaaataagaat

SEQ ID NO: 5095361 - DNA, 15 bp, Homo sapiens
aagaaataataatat

SEQ ID NO: 5095362 - DNA, 12 bp, Homo sapiens
aagaaatacagt

SEQ ID NO: 5095363 - DNA, 13 bp, Homo sapiens
aagaaatagcaga

SEQ ID NO: 5095364 - DNA, 17 bp, Homo sapiens
aagaaatagcagagcct

SEQ ID NO: 5095365 - DNA, 15 bp, Homo sapiens
aagaaatagttctgt

SEQ ID NO: 5095366 - DNA, 22 bp, Homo sapiens
aagaaatatacagtttgacttt

SEQ ID NO: 5095367 - DNA, 12 bp, Homo sapiens
aagaaatatctg

SEQ ID NO: 5095368 - DNA, 23 bp, Homo sapiens
aagaaatatctgagctctttgca

SEQ ID NO: 5095369 - DNA, 17 bp, Homo sapiens
aagaaatatctgtgaaa

SEQ ID NO: 5095370 - DNA, 13 bp, Homo sapiens
aagaaatatgtga

SEQ ID NO: 5095371 - DNA, 18 bp, Homo sapiens
aagaaatatgtgagattt

SEQ ID NO: 5095372 - DNA, 20 bp, Homo sapiens
aagaaatattccaaatgtct

SEQ ID NO: 5095373 - DNA, 14 bp, Homo sapiens
aagaaatcacagaa

SEQ ID NO: 5095374 - DNA, 23 bp, Homo sapiens
aagaaatcatgtccatacacttt

SEQ ID NO: 5095375 - DNA, 16 bp, Homo sapiens
aagaaatccaaatttc

SEQ ID NO: 5095376 - DNA, 19 bp, Homo sapiens
aagaaatcgccttatgaga

SEQ ID NO: 5095377 - DNA, 14 bp, Homo sapiens
aagaaatctataga

SEQ ID NO: 5095378 - DNA, 23 bp, Homo sapiens
aactgggttctttggaagcagcc

SEQ ID NO: 5095379 - DNA, 21 bp, Homo sapiens
aactgggtttctcattaaagt

SEQ ID NO: 5095380 - DNA, 13 bp, Homo sapiens
aactgggttttca

SEQ ID NO: 5095381 - DNA, 20 bp, Homo sapiens
aactggtaaaaagatccagg

SEQ ID NO: 5095382 - DNA, 22 bp, Homo sapiens
aactggtaagcgatttgaaaca

SEQ ID NO: 5095383 - DNA, 15 bp, Homo sapiens
aactggtatatattt

SEQ ID NO: 5095384 - DNA, 18 bp, Homo sapiens
aactggtatgaataattg

SEQ ID NO: 5095385 - DNA, 22 bp, Homo sapiens
aactggtattctgttctggagg

SEQ ID NO: 5095386 - DNA, 22 bp, Homo sapiens
aactggtattttatctttgatt

SEQ ID NO: 5095387 - DNA, 13 bp, Homo sapiens
aactggtccaggc

SEQ ID NO: 5095388 - DNA, 16 bp, Homo sapiens
aactggtccaggccag

SEQ ID NO: 5095389 - DNA, 19 bp, Homo sapiens
aactggtcttcctttttgg

SEQ ID NO: 5095390 - DNA, 15 bp, Homo sapiens
aactggtgatataaa

SEQ ID NO: 5095391 - DNA, 18 bp, Homo sapiens
aactggtgatataaagaa

SEQ ID NO: 5095392 - DNA, 18 bp, Homo sapiens
aactggtgcactttgtaa

SEQ ID NO: 5095393 - DNA, 23 bp, Homo sapiens
aactggttaaaaaacaaatgttc

SEQ ID NO: 5095394 - DNA, 22 bp, Homo sapiens
aactggttaaacattaatattt

SEQ ID NO: 5095395 - DNA, 13 bp, Homo sapiens
aactggttagtgt

SEQ ID NO: 5095396 - DNA, 19 bp, Homo sapiens
aactggttcaagagacact

SEQ ID NO: 5095397 - DNA, 22 bp, Homo sapiens
aactggttcaagagacactgct

SEQ ID NO: 5095398 - DNA, 15 bp, Homo sapiens
aactggttcaggctc

SEQ ID NO: 5095399 - DNA, 19 bp, Homo sapiens
aactggttctacaaatttt

SEQ ID NO: 5095400 - DNA, 21 bp, Homo sapiens
aactggtttgttgcagccaaa

SEQ ID NO: 5095401 - DNA, 22 bp, Homo sapiens
aactgtaaactctatcagcatt

SEQ ID NO: 5095402 - DNA, 15 bp, Homo sapiens
aactgtaaagatgaa

SEQ ID NO: 5095403 - DNA, 20 bp, Homo sapiens
aactgtaaataaaatgtgta

SEQ ID NO: 5095404 - DNA, 14 bp, Homo sapiens
aactgtaaatacaa

SEQ ID NO: 5095405 - DNA, 23 bp, Homo sapiens
aactgtaaatacaaaataaaatt

SEQ ID NO: 5095406 - DNA, 11 bp, Homo sapiens
aactgtaaatc

SEQ ID NO: 5095407 - DNA, 13 bp, Homo sapiens
aactgtaaatcac

SEQ ID NO: 5095408 - DNA, 21 bp, Homo sapiens
aactgtaaatcacttgtaaat

SEQ ID NO: 5095409 - DNA, 15 bp, Homo sapiens
aactgtaaatcataa

SEQ ID NO: 5095410 - DNA, 15 bp, Homo sapiens
aactgtaattatttg

SEQ ID NO: 5095411 - DNA, 20 bp, Homo sapiens
aactgtaattatttgaatga

SEQ ID NO: 5095412 - DNA, 18 bp, Homo sapiens
aactgtacagtgtctttt

SEQ ID NO: 5095413 - DNA, 14 bp, Homo sapiens
aactgtacatttaa

SEQ ID NO: 5095414 - DNA, 18 bp, Homo sapiens
aactgtacatttaaaatt

SEQ ID NO: 5095415 - DNA, 16 bp, Homo sapiens
aactgtaccatgtgct

SEQ ID NO: 5095416 - DNA, 17 bp, Homo sapiens
aactgtaccttttgcga

SEQ ID NO: 5095417 - DNA, 18 bp, Homo sapiens
aactgtaccttttgcgat

SEQ ID NO: 5095418 - DNA, 23 bp, Homo sapiens
aactgtactagtctgtgtgggac

SEQ ID NO: 5095419 - DNA, 15 bp, Homo sapiens
aactgtactgtctgt

SEQ ID NO: 5095420 - DNA, 13 bp, Homo sapiens
aactgtactgtgt

SEQ ID NO: 5095421 - DNA, 14 bp, Homo sapiens
aactgtactgtgtt

SEQ ID NO: 5095422 - DNA, 15 bp, Homo sapiens
aactgtactttgatt

SEQ ID NO: 5095423 - DNA, 18 bp, Homo sapiens
aactgtactttgattcac

SEQ ID NO: 5095424 - DNA, 19 bp, Homo sapiens
aactgtactttgattcaca

SEQ ID NO: 5095425 - DNA, 16 bp, Homo sapiens
aactgtagaaatgatg

SEQ ID NO: 5095426 - DNA, 23 bp, Homo sapiens
aactgtagcaagaactgcacggt

SEQ ID NO: 5095427 - DNA, 17 bp, Homo sapiens
aactgtagcgaccccag

SEQ ID NO: 5095428 - DNA, 18 bp, Homo sapiens
aactgtagcgaccccaga

SEQ ID NO: 5095429 - DNA, 21 bp, Homo sapiens
aactgtagcgaccccagactg

SEQ ID NO: 5095430 - DNA, 23 bp, Homo sapiens
aactgtagctcaagtttaaaagc

SEQ ID NO: 5095431 - DNA, 23 bp, Homo sapiens
aactgtagtgtagtcaggtgctc

SEQ ID NO: 5095432 - DNA, 15 bp, Homo sapiens
aactgtatattattg

SEQ ID NO: 5095433 - DNA, 20 bp, Homo sapiens
aactgtatattattgctata

SEQ ID NO: 5095434 - DNA, 14 bp, Homo sapiens
aactgtatatttgt

SEQ ID NO: 5095435 - DNA, 17 bp, Homo sapiens
aactgtatcaaatctgt

SEQ ID NO: 5095436 - DNA, 20 bp, Homo sapiens
aactgtatcaaatctgtata

SEQ ID NO: 5095437 - DNA, 18 bp, Homo sapiens
aactgtatgtcttataag

SEQ ID NO: 5095438 - DNA, 14 bp, Homo sapiens
aactgtatgtgtct

SEQ ID NO: 5095439 - DNA, 14 bp, Homo sapiens
aactgtattaaaga

SEQ ID NO: 5095440 - DNA, 22 bp, Homo sapiens
aactgtattctagtggctgttc

SEQ ID NO: 5095441 - DNA, 17 bp, Homo sapiens
aactgtattgaaaaaat

SEQ ID NO: 5095442 - DNA, 10 bp, Homo sapiens
aactgtattt

SEQ ID NO: 5095443 - DNA, 17 bp, Homo sapiens
aactgtatttacttgtt

SEQ ID NO: 5095444 - DNA, 20 bp, Homo sapiens
aactgtatttgaaataagaa

SEQ ID NO: 5095445 - DNA, 21 bp, Homo sapiens
aactgtatttttgaagactat

SEQ ID NO: 5095446 - DNA, 22 bp, Homo sapiens
aactgtcagaataaagaacatt

SEQ ID NO: 5095447 - DNA, 14 bp, Homo sapiens
aactgtcagttcat

SEQ ID NO: 5095448 - DNA, 23 bp, Homo sapiens
aactgtcatagggattgtccctg

SEQ ID NO: 5095449 - DNA, 18 bp, Homo sapiens
aactgtcatctagcccct

SEQ ID NO: 5095450 - DNA, 22 bp, Homo sapiens
aactgtcatgatacgcttaagg

SEQ ID NO: 5095451 - DNA, 14 bp, Homo sapiens
aactgtcccagcta

SEQ ID NO: 5095452 - DNA, 17 bp, Homo sapiens
aactgtcccagctacca

SEQ ID NO: 5095453 - DNA, 13 bp, Homo sapiens
aactgtccctccc

SEQ ID NO: 5095454 - DNA, 14 bp, Homo sapiens
aactgtccctccct

SEQ ID NO: 5095455 - DNA, 19 bp, Homo sapiens
aactgtccctcccttgctg

SEQ ID NO: 5095456 - DNA, 21 bp, Homo sapiens
aactgtccgtaagcagtatat

SEQ ID NO: 5095457 - DNA, 20 bp, Homo sapiens
aactgtcctctttcagaaaa

SEQ ID NO: 5095458 - DNA, 13 bp, Homo sapiens
aactgtcctgtcc

SEQ ID NO: 5095459 - DNA, 16 bp, Homo sapiens
aactgtcctgtcctgc

SEQ ID NO: 5095460 - DNA, 21 bp, Homo sapiens
aactgtcgtgcaaacccagtg

SEQ ID NO: 5095461 - DNA, 20 bp, Homo sapiens
aactgtctattgtcacatga

SEQ ID NO: 5095462 - DNA, 19 bp, Homo sapiens
aactgtctatttctgctga

SEQ ID NO: 5095463 - DNA, 23 bp, Homo sapiens
aactgtctcgatgcaatgaacac

SEQ ID NO: 5095464 - DNA, 20 bp, Homo sapiens
aactgtctgaatattctaga

SEQ ID NO: 5095465 - DNA, 20 bp, Homo sapiens
aactgtcttgtttcagtgag

SEQ ID NO: 5095466 - DNA, 19 bp, Homo sapiens
aactgtctttaaaagagag

SEQ ID NO: 5095467 - DNA, 11 bp, Homo sapiens
aactgtctttc

SEQ ID NO: 5095468 - DNA, 14 bp, Homo sapiens
aactgtctttcatt

SEQ ID NO: 5095469 - DNA, 16 bp, Homo sapiens
aactgtgaaaatagtg

SEQ ID NO: 5095470 - DNA, 19 bp, Homo sapiens
aactgtgaaataccacaag

SEQ ID NO: 5095471 - DNA, 13 bp, Homo sapiens
aactgtgaacaat

SEQ ID NO: 5095472 - DNA, 17 bp, Homo sapiens
aactgtgaacaatcaga

SEQ ID NO: 5095473 - DNA, 11 bp, Homo sapiens
aactgtgaata

SEQ ID NO: 5095474 - DNA, 20 bp, Homo sapiens
aactgtgaataataaataca

SEQ ID NO: 5095475 - DNA, 21 bp, Homo sapiens
aactgtgaatacttgaactct

SEQ ID NO: 5095476 - DNA, 22 bp, Homo sapiens
aactgtgaattcattctggagg

SEQ ID NO: 5095477 - DNA, 11 bp, Homo sapiens
aactgtgacag

SEQ ID NO: 5095478 - DNA, 14 bp, Homo sapiens
aactgtgacaggaa

SEQ ID NO: 5095479 - DNA, 13 bp, Homo sapiens
aactgtgacattc

SEQ ID NO: 5095480 - DNA, 13 bp, Homo sapiens
aactgtgataaaa

SEQ ID NO: 5095481 - DNA, 23 bp, Homo sapiens
aactgtgataatccccacaggca

SEQ ID NO: 5095482 - DNA, 19 bp, Homo sapiens
aactgtgatggggtgggca

SEQ ID NO: 5095483 - DNA, 13 bp, Homo sapiens
aactgtgattttt

SEQ ID NO: 5095484 - DNA, 18 bp, Homo sapiens
aactgtgcaaagggctgc

SEQ ID NO: 5095485 - DNA, 12 bp, Homo sapiens
aactgtgcagca

SEQ ID NO: 5095486 - DNA, 13 bp, Homo sapiens
aactgtgcagtga

SEQ ID NO: 5095487 - DNA, 17 bp, Homo sapiens
aactgtgcgttaaataa

SEQ ID NO: 5095488 - DNA, 18 bp, Homo sapiens
aactgtgcgttaaataag

SEQ ID NO: 5095489 - DNA, 12 bp, Homo sapiens
aactgtgctctc

SEQ ID NO: 5095490 - DNA, 18 bp, Homo sapiens
aactgtgcttctctatga

SEQ ID NO: 5095491 - DNA, 13 bp, Homo sapiens
aactgtgcttgtt

SEQ ID NO: 5095492 - DNA, 16 bp, Homo sapiens
aactgtggataaattt

SEQ ID NO: 5095493 - DNA, 14 bp, Homo sapiens
aactgtggatattg

SEQ ID NO: 5095494 - DNA, 16 bp, Homo sapiens
aactgtggtagctcca

SEQ ID NO: 5095495 - DNA, 17 bp, Homo sapiens
aactgtggtagctccag

SEQ ID NO: 5095496 - DNA, 19 bp, Homo sapiens
aactgtggtagctccagcg

SEQ ID NO: 5095497 - DNA, 21 bp, Homo sapiens
aactgtgtacataactgaaaa

SEQ ID NO: 5095498 - DNA, 14 bp, Homo sapiens
aactgtgtactgtt

SEQ ID NO: 5095499 - DNA, 13 bp, Homo sapiens
aactgtgtagcat

SEQ ID NO: 5095500 - DNA, 14 bp, Homo sapiens
aactgtgtatcatt

SEQ ID NO: 5095501 - DNA, 15 bp, Homo sapiens
aactgtgtatcatta

SEQ ID NO: 5095502 - DNA, 19 bp, Homo sapiens
aactgtgtatcattaaaat

SEQ ID NO: 5095503 - DNA, 13 bp, Homo sapiens
aactgtgtattta

SEQ ID NO: 5095504 - DNA, 18 bp, Homo sapiens
aactgtgtctctgaattc

SEQ ID NO: 5095505 - DNA, 14 bp, Homo sapiens
aactgtgtgaacgc

SEQ ID NO: 5095506 - DNA, 11 bp, Homo sapiens
aactgtgtgac

SEQ ID NO: 5095507 - DNA, 15 bp, Homo sapiens
aactgtgtgattaaa

SEQ ID NO: 5095508 - DNA, 14 bp, Homo sapiens
aactgtgtgtaatt

SEQ ID NO: 5095509 - DNA, 17 bp, Homo sapiens
aactgtgttcattagaa

SEQ ID NO: 5095510 - DNA, 20 bp, Homo sapiens
aactgtgtttccatcctttg

SEQ ID NO: 5095511 - DNA, 23 bp, Homo sapiens
aactgtgttttagtgtaaaattg

SEQ ID NO: 5095512 - DNA, 19 bp, Homo sapiens
aactgttaacccagtgttc

SEQ ID NO: 5095513 - DNA, 18 bp, Homo sapiens
aactgttagcactgttga

SEQ ID NO: 5095514 - DNA, 16 bp, Homo sapiens
aactgttatttataat

SEQ ID NO: 5095515 - DNA, 22 bp, Homo sapiens
aactgttcaagtgtccccagac

SEQ ID NO: 5095516 - DNA, 19 bp, Homo sapiens
aactgttctctttaaaata

SEQ ID NO: 5095517 - DNA, 21 bp, Homo sapiens
aactgttcttcattagatgtt

SEQ ID NO: 5095518 - DNA, 23 bp, Homo sapiens
aactgttctttgcagtgaagatg

SEQ ID NO: 5095519 - DNA, 21 bp, Homo sapiens
aactgttcttttgcaataata

SEQ ID NO: 5095520 - DNA, 16 bp, Homo sapiens
aactgttcttttgcat

SEQ ID NO: 5095521 - DNA, 18 bp, Homo sapiens
aactgttcttttgcattt

SEQ ID NO: 5095522 - DNA, 13 bp, Homo sapiens
aactgttgacata

SEQ ID NO: 5095523 - DNA, 22 bp, Homo sapiens
aactgttgaggttcctcttgga

SEQ ID NO: 5095524 - DNA, 17 bp, Homo sapiens
aactgttgcacttttga

SEQ ID NO: 5095525 - DNA, 18 bp, Homo sapiens
aactgttgcacttttgaa

SEQ ID NO: 5095526 - DNA, 15 bp, Homo sapiens
aactgttgccagaga

SEQ ID NO: 5095527 - DNA, 20 bp, Homo sapiens
aactgttgctcgaagactgt

SEQ ID NO: 5095528 - DNA, 18 bp, Homo sapiens
aactgttggattcagaaa

SEQ ID NO: 5095529 - DNA, 15 bp, Homo sapiens
aactgttggctgctc

SEQ ID NO: 5095530 - DNA, 19 bp, Homo sapiens
aactgttgtagaagacaaa

SEQ ID NO: 5095531 - DNA, 16 bp, Homo sapiens
aactgttgttactgga

SEQ ID NO: 5095532 - DNA, 22 bp, Homo sapiens
aactgtttagggccctgatttg

SEQ ID NO: 5095533 - DNA, 12 bp, Homo sapiens
aactgtttatat

SEQ ID NO: 5095534 - DNA, 16 bp, Homo sapiens
aactgtttatataaag

SEQ ID NO: 5095535 - DNA, 19 bp, Homo sapiens
aactgtttatggtattttc

SEQ ID NO: 5095536 - DNA, 16 bp, Homo sapiens
aactgtttccctgctg

SEQ ID NO: 5095537 - DNA, 17 bp, Homo sapiens
aactgtttccctgctga

SEQ ID NO: 5095538 - DNA, 19 bp, Homo sapiens
aactgtttgacttctcaag

SEQ ID NO: 5095539 - DNA, 23 bp, Homo sapiens
aactgtttggtcgagtctttgtg

SEQ ID NO: 5095540 - DNA, 15 bp, Homo sapiens
aactgttttgggtag

SEQ ID NO: 5095541 - DNA, 21 bp, Homo sapiens
aactgttttgggtagctgcca

SEQ ID NO: 5095542 - DNA, 17 bp, Homo sapiens
aactgtttttgaacctg

SEQ ID NO: 5095543 - DNA, 14 bp, Homo sapiens
aactgtttttgaag

SEQ ID NO: 5095544 - DNA, 15 bp, Homo sapiens
aactgtttttgaaga

SEQ ID NO: 5095545 - DNA, 13 bp, Homo sapiens
aactgttttttaa

SEQ ID NO: 5095546 - DNA, 13 bp, Homo sapiens
aacttaaaaatgt

SEQ ID NO: 5095547 - DNA, 21 bp, Homo sapiens
aacttaaaaatgtaaatattc

SEQ ID NO: 5095548 - DNA, 18 bp, Homo sapiens
aacttaaaaattaatatg

SEQ ID NO: 5095549 - DNA, 15 bp, Homo sapiens
aacttaaaacatatg

SEQ ID NO: 5095550 - DNA, 13 bp, Homo sapiens
aacttaaaacttt

SEQ ID NO: 5095551 - DNA, 16 bp, Homo sapiens
aacttaaaactttgta

SEQ ID NO: 5095552 - DNA, 11 bp, Homo sapiens
aacttaaaaga

SEQ ID NO: 5095553 - DNA, 13 bp, Homo sapiens
aacttaaaagaac

SEQ ID NO: 5095554 - DNA, 23 bp, Homo sapiens
aacttaaaagaacataggaattt

SEQ ID NO: 5095555 - DNA, 16 bp, Homo sapiens
aacttaaaataaaatt

SEQ ID NO: 5095556 - DNA, 13 bp, Homo sapiens
aacttaaacaaaa

SEQ ID NO: 5095557 - DNA, 16 bp, Homo sapiens
aagaaatcttgtctta

SEQ ID NO: 5095558 - DNA, 15 bp, Homo sapiens
aagaaatctttccag

SEQ ID NO: 5095559 - DNA, 14 bp, Homo sapiens
aagaaatgaaattt

SEQ ID NO: 5095560 - DNA, 18 bp, Homo sapiens
aagaaatgaaattttacc

SEQ ID NO: 5095561 - DNA, 18 bp, Homo sapiens
aagaaatgaacaaaagat

SEQ ID NO: 5095562 - DNA, 12 bp, Homo sapiens
aagaaatgaaga

SEQ ID NO: 5095563 - DNA, 13 bp, Homo sapiens
aagaaatgaagag

SEQ ID NO: 5095564 - DNA, 13 bp, Homo sapiens
aagaaatgagaaa

SEQ ID NO: 5095565 - DNA, 23 bp, Homo sapiens
aagaaatgagaaattgtgccaaa

SEQ ID NO: 5095566 - DNA, 13 bp, Homo sapiens
aagaaatgatgtt

SEQ ID NO: 5095567 - DNA, 23 bp, Homo sapiens
aagaaatgatgttggagaaggga

SEQ ID NO: 5095568 - DNA, 23 bp, Homo sapiens
aagaaatgattcaaattgctgct

SEQ ID NO: 5095569 - DNA, 13 bp, Homo sapiens
aagaaatgctaat

SEQ ID NO: 5095570 - DNA, 18 bp, Homo sapiens
aagaaatggattctattt

SEQ ID NO: 5095571 - DNA, 11 bp, Homo sapiens
aagaaatggcg

SEQ ID NO: 5095572 - DNA, 18 bp, Homo sapiens
aagaaatggcgtctgctc

SEQ ID NO: 5095573 - DNA, 21 bp, Homo sapiens
aagaaatggcgtctgctctgg

SEQ ID NO: 5095574 - DNA, 18 bp, Homo sapiens
aagaaatggctatgaaca

SEQ ID NO: 5095575 - DNA, 20 bp, Homo sapiens
aagaaatggctatgaacaga

SEQ ID NO: 5095576 - DNA, 17 bp, Homo sapiens
aagaaatgggcctcagc

SEQ ID NO: 5095577 - DNA, 19 bp, Homo sapiens
aagaaatgggcctcagccc

SEQ ID NO: 5095578 - DNA, 19 bp, Homo sapiens
aagaaatgggcctgcctgc

SEQ ID NO: 5095579 - DNA, 22 bp, Homo sapiens
aagaaatgggcctgcctgcctc

SEQ ID NO: 5095580 - DNA, 24 bp, Homo sapiens
aagaaatgggcctgcctgcctcca

SEQ ID NO: 5095581 - DNA, 14 bp, Homo sapiens
aagaaatggtatgt

SEQ ID NO: 5095582 - DNA, 13 bp, Homo sapiens
aagaaatggtgaa

SEQ ID NO: 5095583 - DNA, 17 bp, Homo sapiens
aagaaatgtcagatgcg

SEQ ID NO: 5095584 - DNA, 16 bp, Homo sapiens
aagaaatgtctctgct

SEQ ID NO: 5095585 - DNA, 13 bp, Homo sapiens
aagaaatgtctta

SEQ ID NO: 5095586 - DNA, 16 bp, Homo sapiens
aagaaattaaggaaca

SEQ ID NO: 5095587 - DNA, 12 bp, Homo sapiens
aagaaattaata

SEQ ID NO: 5095588 - DNA, 20 bp, Homo sapiens
aagaaattaggggttaaagc

SEQ ID NO: 5095589 - DNA, 15 bp, Homo sapiens
aagaaattataaaga

SEQ ID NO: 5095590 - DNA, 14 bp, Homo sapiens
aagaaattatcttt

SEQ ID NO: 5095591 - DNA, 15 bp, Homo sapiens
aagaaattcaggtac

SEQ ID NO: 5095592 - DNA, 20 bp, Homo sapiens
aagaaattcaggtacagaaa

SEQ ID NO: 5095593 - DNA, 17 bp, Homo sapiens
aagaaattcgcatgttt

SEQ ID NO: 5095594 - DNA, 13 bp, Homo sapiens
aagaaattgcaat

SEQ ID NO: 5095595 - DNA, 18 bp, Homo sapiens
aagaaatttattacttgt

SEQ ID NO: 5095596 - DNA, 15 bp, Homo sapiens
aagaaatttcacata

SEQ ID NO: 5095597 - DNA, 15 bp, Homo sapiens
aagaaatttgcagtt

SEQ ID NO: 5095598 - DNA, 16 bp, Homo sapiens
aagaaatttggtaccc

SEQ ID NO: 5095599 - DNA, 20 bp, Homo sapiens
aagaacaaaaaaatctgcag

SEQ ID NO: 5095600 - DNA, 21 bp, Homo sapiens
aagaacaaaaaaatctgcaga

SEQ ID NO: 5095601 - DNA, 17 bp, Homo sapiens
aagaacaaaaccccaga

SEQ ID NO: 5095602 - DNA, 14 bp, Homo sapiens
aagaacaaacaaaa

SEQ ID NO: 5095603 - DNA, 12 bp, Homo sapiens
aagaacaaagct

SEQ ID NO: 5095604 - DNA, 14 bp, Homo sapiens
aagaacaacggcaa

SEQ ID NO: 5095605 - DNA, 13 bp, Homo sapiens
aagaacaagagac

SEQ ID NO: 5095606 - DNA, 14 bp, Homo sapiens
aagaacaagtttag

SEQ ID NO: 5095607 - DNA, 20 bp, Homo sapiens
aagaacaagttttggcagcc

SEQ ID NO: 5095608 - DNA, 21 bp, Homo sapiens
aagaacacaaagcggggggag

SEQ ID NO: 5095609 - DNA, 16 bp, Homo sapiens
aagaacaccctctaaa

SEQ ID NO: 5095610 - DNA, 22 bp, Homo sapiens
aagaacactgcagtgttatttt

SEQ ID NO: 5095611 - DNA, 22 bp, Homo sapiens
aagaacactggacctttgggtt

SEQ ID NO: 5095612 - DNA, 14 bp, Homo sapiens
aagaacagaaaaca

SEQ ID NO: 5095613 - DNA, 18 bp, Homo sapiens
aagaacagaattgctcct

SEQ ID NO: 5095614 - DNA, 16 bp, Homo sapiens
aagaacagctcatctt

SEQ ID NO: 5095615 - DNA, 17 bp, Homo sapiens
aagaacaggacatagca

SEQ ID NO: 5095616 - DNA, 22 bp, Homo sapiens
aagaacaggcttggcaaagaag

SEQ ID NO: 5095617 - DNA, 15 bp, Homo sapiens
aagaacagtacattt

SEQ ID NO: 5095618 - DNA, 12 bp, Homo sapiens
aagaacagtact

SEQ ID NO: 5095619 - DNA, 12 bp, Homo sapiens
aagaacataaac

SEQ ID NO: 5095620 - DNA, 13 bp, Homo sapiens
aagaacataggaa

SEQ ID NO: 5095621 - DNA, 20 bp, Homo sapiens
aagaacatcataaaattttt

SEQ ID NO: 5095622 - DNA, 15 bp, Homo sapiens
aagaacatctgcact

SEQ ID NO: 5095623 - DNA, 14 bp, Homo sapiens
aagaacatgatttt

SEQ ID NO: 5095624 - DNA, 20 bp, Homo sapiens
aagaacatgcagtttgaaat

SEQ ID NO: 5095625 - DNA, 22 bp, Homo sapiens
aagaacatgcagtttgaaattc

SEQ ID NO: 5095626 - DNA, 21 bp, Homo sapiens
aagaacatgctatccaatctc

SEQ ID NO: 5095627 - DNA, 23 bp, Homo sapiens
aagaacattattcatctctcctc

SEQ ID NO: 5095628 - DNA, 12 bp, Homo sapiens
aagaaccaaaaa

SEQ ID NO: 5095629 - DNA, 22 bp, Homo sapiens
aagaaccaaaagttttcctgag

SEQ ID NO: 5095630 - DNA, 12 bp, Homo sapiens
aagaaccaaata

SEQ ID NO: 5095631 - DNA, 15 bp, Homo sapiens
aagaaccactgtcta

SEQ ID NO: 5095632 - DNA, 21 bp, Homo sapiens
aagaaccagcccagcctgccc

SEQ ID NO: 5095633 - DNA, 20 bp, Homo sapiens
aagaaccagtccccccaccc

SEQ ID NO: 5095634 - DNA, 15 bp, Homo sapiens
aagaaccatgcagga

SEQ ID NO: 5095635 - DNA, 16 bp, Homo sapiens
aagaaccatgcaggaa

SEQ ID NO: 5095636 - DNA, 17 bp, Homo sapiens
aagaaccatgcaggaag

SEQ ID NO: 5095637 - DNA, 21 bp, Homo sapiens
aagaaccatgcaggaaggaaa

SEQ ID NO: 5095638 - DNA, 22 bp, Homo sapiens
aagaaccatgcaggaaggaaaa

SEQ ID NO: 5095639 - DNA, 15 bp, Homo sapiens
aagaaccatttgcaa

SEQ ID NO: 5095640 - DNA, 18 bp, Homo sapiens
aagaacccagggtggaga

SEQ ID NO: 5095641 - DNA, 17 bp, Homo sapiens
aagaaccccagacctct

SEQ ID NO: 5095642 - DNA, 13 bp, Homo sapiens
aagaaccccaggc

SEQ ID NO: 5095643 - DNA, 16 bp, Homo sapiens
aagaacccccctcccc

SEQ ID NO: 5095644 - DNA, 14 bp, Homo sapiens
aagaaccctctgtc

SEQ ID NO: 5095645 - DNA, 17 bp, Homo sapiens
aagaaccctctgtccca

SEQ ID NO: 5095646 - DNA, 22 bp, Homo sapiens
aagaacctacagactccatctc

SEQ ID NO: 5095647 - DNA, 19 bp, Homo sapiens
aagaaccttaatgacaaca

SEQ ID NO: 5095648 - DNA, 14 bp, Homo sapiens
aagaacgaggttta

SEQ ID NO: 5095649 - DNA, 21 bp, Homo sapiens
aagaacgaggtttatattttc

SEQ ID NO: 5095650 - DNA, 24 bp, Homo sapiens
aagaactaattcgtacataataag

SEQ ID NO: 5095651 - DNA, 20 bp, Homo sapiens
aagaactacaaacaaaattt

SEQ ID NO: 5095652 - DNA, 21 bp, Homo sapiens
aagaactagaggttttatgat

SEQ ID NO: 5095653 - DNA, 19 bp, Homo sapiens
aagaactataaacttaaag

SEQ ID NO: 5095654 - DNA, 23 bp, Homo sapiens
aagaactatatgtgaatcctctt

SEQ ID NO: 5095655 - DNA, 16 bp, Homo sapiens
aagaactcatcactgt

SEQ ID NO: 5095656 - DNA, 20 bp, Homo sapiens
aagaactcatcactgtggct

SEQ ID NO: 5095657 - DNA, 16 bp, Homo sapiens
aagaactccaccccca

SEQ ID NO: 5095658 - DNA, 21 bp, Homo sapiens
aagaactcccttctcccctca

SEQ ID NO: 5095659 - DNA, 12 bp, Homo sapiens
aagaactcctcc

SEQ ID NO: 5095660 - DNA, 13 bp, Homo sapiens
aagaactccttat

SEQ ID NO: 5095661 - DNA, 17 bp, Homo sapiens
aagaactccttattttg

SEQ ID NO: 5095662 - DNA, 20 bp, Homo sapiens
aagaactccttattttgtat

SEQ ID NO: 5095663 - DNA, 18 bp, Homo sapiens
aagaactctgcacagcaa

SEQ ID NO: 5095664 - DNA, 14 bp, Homo sapiens
aagaactctgggca

SEQ ID NO: 5095665 - DNA, 15 bp, Homo sapiens
aagaactctttttcc

SEQ ID NO: 5095666 - DNA, 18 bp, Homo sapiens
aagaactctttttcctct

SEQ ID NO: 5095667 - DNA, 12 bp, Homo sapiens
aagaactgaaat

SEQ ID NO: 5095668 - DNA, 13 bp, Homo sapiens
aagaactgcactt

SEQ ID NO: 5095669 - DNA, 14 bp, Homo sapiens
aagaactgcacttt

SEQ ID NO: 5095670 - DNA, 21 bp, Homo sapiens
aagaactgcagatagcccagg

SEQ ID NO: 5095671 - DNA, 13 bp, Homo sapiens
aagaactgcatgg

SEQ ID NO: 5095672 - DNA, 13 bp, Homo sapiens
aagaactgcatgt

SEQ ID NO: 5095673 - DNA, 13 bp, Homo sapiens
aagaactgcccca

SEQ ID NO: 5095674 - DNA, 21 bp, Homo sapiens
aagaactgcttcatgtgaaca

SEQ ID NO: 5095675 - DNA, 15 bp, Homo sapiens
aagaactgcttgcat

SEQ ID NO: 5095676 - DNA, 12 bp, Homo sapiens
aagaactgcttt

SEQ ID NO: 5095677 - DNA, 13 bp, Homo sapiens
aagaactggaaac

SEQ ID NO: 5095678 - DNA, 14 bp, Homo sapiens
aagaactgtgtctg

SEQ ID NO: 5095679 - DNA, 20 bp, Homo sapiens
aagaactgtgtttcaagttc

SEQ ID NO: 5095680 - DNA, 17 bp, Homo sapiens
aagaactgttggttatt

SEQ ID NO: 5095681 - DNA, 20 bp, Homo sapiens
aagaacttactgattatttt

SEQ ID NO: 5095682 - DNA, 21 bp, Homo sapiens
aagaacttctcgtagatgctg

SEQ ID NO: 5095683 - DNA, 13 bp, Homo sapiens
aagaacttgttta

SEQ ID NO: 5095684 - DNA, 14 bp, Homo sapiens
aagaacttgtttaa

SEQ ID NO: 5095685 - DNA, 18 bp, Homo sapiens
aagaacttgtttaataaa

SEQ ID NO: 5095686 - DNA, 21 bp, Homo sapiens
aagaactttaaagctcaggag

SEQ ID NO: 5095687 - DNA, 17 bp, Homo sapiens
aagaactttaaattgtg

SEQ ID NO: 5095688 - DNA, 18 bp, Homo sapiens
aagaactttgagctactg

SEQ ID NO: 5095689 - DNA, 13 bp, Homo sapiens
aagaagaaaagag

SEQ ID NO: 5095690 - DNA, 11 bp, Homo sapiens
aagaagaaact

SEQ ID NO: 5095691 - DNA, 18 bp, Homo sapiens
aagaagaaacttgtaaat

SEQ ID NO: 5095692 - DNA, 23 bp, Homo sapiens
aagaagaaacttgtaaatatctt

SEQ ID NO: 5095693 - DNA, 16 bp, Homo sapiens
aagaagaaagcaaaag

SEQ ID NO: 5095694 - DNA, 14 bp, Homo sapiens
aagaagaaaggact

SEQ ID NO: 5095695 - DNA, 15 bp, Homo sapiens
aagaagaacagctgt

SEQ ID NO: 5095696 - DNA, 23 bp, Homo sapiens
aagaagaacagctgttcctgtgt

SEQ ID NO: 5095697 - DNA, 18 bp, Homo sapiens
aagaagaaccagcccagc

SEQ ID NO: 5095698 - DNA, 23 bp, Homo sapiens
aagaagaaccaggcatggaaaga

SEQ ID NO: 5095699 - DNA, 15 bp, Homo sapiens
aagaagaacttgcat

SEQ ID NO: 5095700 - DNA, 9 bp, Homo sapiens
aagaagaag

SEQ ID NO: 5095701 - DNA, 15 bp, Homo sapiens
aagaagaagaagaag

SEQ ID NO: 5095702 - DNA, 13 bp, Homo sapiens
aagaagaagaagg

SEQ ID NO: 5095703 - DNA, 15 bp, Homo sapiens
aagaagaaggagagc

SEQ ID NO: 5095704 - DNA, 14 bp, Homo sapiens
aagaagaaggccag

SEQ ID NO: 5095705 - DNA, 12 bp, Homo sapiens
aagaagaatata

SEQ ID NO: 5095706 - DNA, 13 bp, Homo sapiens
aagaagacatgtt

SEQ ID NO: 5095707 - DNA, 17 bp, Homo sapiens
aagaagacatgttttag

SEQ ID NO: 5095708 - DNA, 14 bp, Homo sapiens
aagaagacattttg

SEQ ID NO: 5095709 - DNA, 16 bp, Homo sapiens
aagaagacattttgtt

SEQ ID NO: 5095710 - DNA, 19 bp, Homo sapiens
aagaagaccagtcacagcc

SEQ ID NO: 5095711 - DNA, 22 bp, Homo sapiens
aagaagaccagtcacagccatt

SEQ ID NO: 5095712 - DNA, 20 bp, Homo sapiens
aagaagaccctttgttgaaa

SEQ ID NO: 5095713 - DNA, 13 bp, Homo sapiens
aagaagacttttt

SEQ ID NO: 5095714 - DNA, 18 bp, Homo sapiens
aagaagagaagctgctga

SEQ ID NO: 5095715 - DNA, 15 bp, Homo sapiens
aagaagagagaactt

SEQ ID NO: 5095716 - DNA, 16 bp, Homo sapiens
aagaagagaggcatag

SEQ ID NO: 5095717 - DNA, 23 bp, Homo sapiens
aagaagagcgagagatcaaagat

SEQ ID NO: 5095718 - DNA, 20 bp, Homo sapiens
aagaagagctatcaggagaa

SEQ ID NO: 5095719 - DNA, 20 bp, Homo sapiens
aagaagaggagaaaaagaag

SEQ ID NO: 5095720 - DNA, 14 bp, Homo sapiens
aagaagaggagcct

SEQ ID NO: 5095721 - DNA, 18 bp, Homo sapiens
aagaagaggagcctcaga

SEQ ID NO: 5095722 - DNA, 13 bp, Homo sapiens
aagaagaggagga

SEQ ID NO: 5095723 - DNA, 12 bp, Homo sapiens
aagaagagtaaa

SEQ ID NO: 5095724 - DNA, 14 bp, Homo sapiens
aagaagagtttaca

SEQ ID NO: 5095725 - DNA, 18 bp, Homo sapiens
aagaagatagctctctga

SEQ ID NO: 5095726 - DNA, 20 bp, Homo sapiens
aagaagatagctctctgact

SEQ ID NO: 5095727 - DNA, 17 bp, Homo sapiens
aagaagatcacgctccc

SEQ ID NO: 5095728 - DNA, 19 bp, Homo sapiens
aagaagatcctaaaacaaa

SEQ ID NO: 5095729 - DNA, 14 bp, Homo sapiens
aagaagatgaatgg

SEQ ID NO: 5095730 - DNA, 14 bp, Homo sapiens
aagaagatgagcct

SEQ ID NO: 5095731 - DNA, 12 bp, Homo sapiens
aagaagatgctc

SEQ ID NO: 5095732 - DNA, 17 bp, Homo sapiens
aagaagatgttgaagaa

SEQ ID NO: 5095733 - DNA, 16 bp, Homo sapiens
aagaagattcccaccc

SEQ ID NO: 5095734 - DNA, 21 bp, Homo sapiens
aagaagcaaagttcaacttat

SEQ ID NO: 5095735 - DNA, 21 bp, Homo sapiens
aagaagcaacctcagtaattt

SEQ ID NO: 5095736 - DNA, 16 bp, Homo sapiens
aagaagcaaggaacca

SEQ ID NO: 5095737 - DNA, 16 bp, Homo sapiens
aagaagcaatctcctt

SEQ ID NO: 5095738 - DNA, 13 bp, Homo sapiens
aacttaaagcaaa

SEQ ID NO: 5095739 - DNA, 18 bp, Homo sapiens
aacttaaagcaaaatagt

SEQ ID NO: 5095740 - DNA, 15 bp, Homo sapiens
aacttaaagtgaatt

SEQ ID NO: 5095741 - DNA, 19 bp, Homo sapiens
aacttaaataaatgtcatt

SEQ ID NO: 5095742 - DNA, 13 bp, Homo sapiens
aacttaaataata

SEQ ID NO: 5095743 - DNA, 19 bp, Homo sapiens
aacttaaatattgctctat

SEQ ID NO: 5095744 - DNA, 14 bp, Homo sapiens
aacttaaatattgt

SEQ ID NO: 5095745 - DNA, 21 bp, Homo sapiens
aacttaaatattgtaatatga

SEQ ID NO: 5095746 - DNA, 18 bp, Homo sapiens
aacttaaatgaacacagc

SEQ ID NO: 5095747 - DNA, 14 bp, Homo sapiens
aacttaaattatgt

SEQ ID NO: 5095748 - DNA, 19 bp, Homo sapiens
aacttaaattttaatttat

SEQ ID NO: 5095749 - DNA, 22 bp, Homo sapiens
aacttaacaattaattttctat

SEQ ID NO: 5095750 - DNA, 14 bp, Homo sapiens
aacttaacatattt

SEQ ID NO: 5095751 - DNA, 15 bp, Homo sapiens
aacttaacatgctgt

SEQ ID NO: 5095752 - DNA, 16 bp, Homo sapiens
aacttaacattgcatc

SEQ ID NO: 5095753 - DNA, 22 bp, Homo sapiens
aacttaaccgcatcagaagcct

SEQ ID NO: 5095754 - DNA, 16 bp, Homo sapiens
aacttaactgaagaaa

SEQ ID NO: 5095755 - DNA, 15 bp, Homo sapiens
aacttaagaaacact

SEQ ID NO: 5095756 - DNA, 11 bp, Homo sapiens
aacttaagaat

SEQ ID NO: 5095757 - DNA, 21 bp, Homo sapiens
aacttaagcaaaggggacagc

SEQ ID NO: 5095758 - DNA, 17 bp, Homo sapiens
aacttaaggcatttgtt

SEQ ID NO: 5095759 - DNA, 20 bp, Homo sapiens
aacttaagggcaaggagttt

SEQ ID NO: 5095760 - DNA, 23 bp, Homo sapiens
aacttaaggtatatttagttgca

SEQ ID NO: 5095761 - DNA, 21 bp, Homo sapiens
aacttaagttggtcctttaca

SEQ ID NO: 5095762 - DNA, 13 bp, Homo sapiens
aacttaagtttag

SEQ ID NO: 5095763 - DNA, 16 bp, Homo sapiens
aacttaagtttagaaa

SEQ ID NO: 5095764 - DNA, 18 bp, Homo sapiens
aacttaagtttagaaatt

SEQ ID NO: 5095765 - DNA, 15 bp, Homo sapiens
aacttaataatcaag

SEQ ID NO: 5095766 - DNA, 17 bp, Homo sapiens
aacttaataatcaagag

SEQ ID NO: 5095767 - DNA, 20 bp, Homo sapiens
aacttaataatcaagagcct

SEQ ID NO: 5095768 - DNA, 15 bp, Homo sapiens
aacttaatctaaatg

SEQ ID NO: 5095769 - DNA, 16 bp, Homo sapiens
aacttaatctaaatgg

SEQ ID NO: 5095770 - DNA, 18 bp, Homo sapiens
aacttaatctaaatggaa

SEQ ID NO: 5095771 - DNA, 21 bp, Homo sapiens
aacttaatgtctttgagcctt

SEQ ID NO: 5095772 - DNA, 12 bp, Homo sapiens
aacttacaaaaa

SEQ ID NO: 5095773 - DNA, 18 bp, Homo sapiens
aacttacaaaaacacttc

SEQ ID NO: 5095774 - DNA, 15 bp, Homo sapiens
aacttacaaactggt

SEQ ID NO: 5095775 - DNA, 23 bp, Homo sapiens
aacttacaaagggtctatcttgt

SEQ ID NO: 5095776 - DNA, 19 bp, Homo sapiens
aacttacaagactgtaaat

SEQ ID NO: 5095777 - DNA, 20 bp, Homo sapiens
aacttacaagactgtaaatt

SEQ ID NO: 5095778 - DNA, 18 bp, Homo sapiens
aacttacacttggagccc

SEQ ID NO: 5095779 - DNA, 19 bp, Homo sapiens
aacttacattgttcaatta

SEQ ID NO: 5095780 - DNA, 20 bp, Homo sapiens
aacttacattgttcaattag

SEQ ID NO: 5095781 - DNA, 12 bp, Homo sapiens
aacttacatttg

SEQ ID NO: 5095782 - DNA, 14 bp, Homo sapiens
aacttacatttgta

SEQ ID NO: 5095783 - DNA, 16 bp, Homo sapiens
aacttacatttgtact

SEQ ID NO: 5095784 - DNA, 18 bp, Homo sapiens
aacttaccaattgatgtt

SEQ ID NO: 5095785 - DNA, 14 bp, Homo sapiens
aacttacccagatg

SEQ ID NO: 5095786 - DNA, 23 bp, Homo sapiens
aacttacctaagtgacatttgta

SEQ ID NO: 5095787 - DNA, 17 bp, Homo sapiens
aacttacctctgcttct

SEQ ID NO: 5095788 - DNA, 15 bp, Homo sapiens
aacttactagcttta

SEQ ID NO: 5095789 - DNA, 12 bp, Homo sapiens
aacttactgtat

SEQ ID NO: 5095790 - DNA, 14 bp, Homo sapiens
aacttactgtccac

SEQ ID NO: 5095791 - DNA, 14 bp, Homo sapiens
aacttactgtgtaa

SEQ ID NO: 5095792 - DNA, 13 bp, Homo sapiens
aacttacttttgt

SEQ ID NO: 5095793 - DNA, 14 bp, Homo sapiens
aacttagaaaccaa

SEQ ID NO: 5095794 - DNA, 16 bp, Homo sapiens
aacttagaaaccaaat

SEQ ID NO: 5095795 - DNA, 15 bp, Homo sapiens
aacttagaataaaat

SEQ ID NO: 5095796 - DNA, 17 bp, Homo sapiens
aacttagaataaaattg

SEQ ID NO: 5095797 - DNA, 14 bp, Homo sapiens
aacttagaggaaaa

SEQ ID NO: 5095798 - DNA, 15 bp, Homo sapiens
aacttagaggaaaat

SEQ ID NO: 5095799 - DNA, 20 bp, Homo sapiens
aacttagatgttaaatgtta

SEQ ID NO: 5095800 - DNA, 23 bp, Homo sapiens
aacttagcattttctgcatctcc

SEQ ID NO: 5095801 - DNA, 15 bp, Homo sapiens
aacttagccagagtt

SEQ ID NO: 5095802 - DNA, 19 bp, Homo sapiens
aacttagctcaggtgcctt

SEQ ID NO: 5095803 - DNA, 22 bp, Homo sapiens
aacttagcttttgatgtctcca

SEQ ID NO: 5095804 - DNA, 16 bp, Homo sapiens
aacttaggtggcaagc

SEQ ID NO: 5095805 - DNA, 19 bp, Homo sapiens
aacttagtgtaatatacca

SEQ ID NO: 5095806 - DNA, 18 bp, Homo sapiens
aacttagtgtctctattt

SEQ ID NO: 5095807 - DNA, 16 bp, Homo sapiens
aacttagtgtttagca

SEQ ID NO: 5095808 - DNA, 21 bp, Homo sapiens
aacttagtgtttagcattaaa

SEQ ID NO: 5095809 - DNA, 15 bp, Homo sapiens
aacttagtttgtgaa

SEQ ID NO: 5095810 - DNA, 18 bp, Homo sapiens
aacttagttttgttccaa

SEQ ID NO: 5095811 - DNA, 12 bp, Homo sapiens
aacttagttttt

SEQ ID NO: 5095812 - DNA, 14 bp, Homo sapiens
aacttataattaca

SEQ ID NO: 5095813 - DNA, 22 bp, Homo sapiens
aacttataattacaatgcacaa

SEQ ID NO: 5095814 - DNA, 20 bp, Homo sapiens
aacttatatactatttccct

SEQ ID NO: 5095815 - DNA, 23 bp, Homo sapiens
aacttatatcatcagcatacctt

SEQ ID NO: 5095816 - DNA, 19 bp, Homo sapiens
aacttatattgaagacaat

SEQ ID NO: 5095817 - DNA, 15 bp, Homo sapiens
aacttatccatcttt

SEQ ID NO: 5095818 - DNA, 17 bp, Homo sapiens
aacttatctccagccaa

SEQ ID NO: 5095819 - DNA, 12 bp, Homo sapiens
aacttatgaatg

SEQ ID NO: 5095820 - DNA, 20 bp, Homo sapiens
aacttatggactgttttgat

SEQ ID NO: 5095821 - DNA, 19 bp, Homo sapiens
aacttatggggccaaaata

SEQ ID NO: 5095822 - DNA, 21 bp, Homo sapiens
aacttatgtagatatttggct

SEQ ID NO: 5095823 - DNA, 14 bp, Homo sapiens
aacttatgtctctt

SEQ ID NO: 5095824 - DNA, 21 bp, Homo sapiens
aacttattaaatggaaactga

SEQ ID NO: 5095825 - DNA, 14 bp, Homo sapiens
aacttattaaattt

SEQ ID NO: 5095826 - DNA, 19 bp, Homo sapiens
aacttattaacaactgtga

SEQ ID NO: 5095827 - DNA, 15 bp, Homo sapiens
aacttattagaaacc

SEQ ID NO: 5095828 - DNA, 20 bp, Homo sapiens
aacttattccaagtgcattt

SEQ ID NO: 5095829 - DNA, 13 bp, Homo sapiens
aacttattctgta

SEQ ID NO: 5095830 - DNA, 17 bp, Homo sapiens
aacttattctttgagta

SEQ ID NO: 5095831 - DNA, 23 bp, Homo sapiens
aacttattgcctagcctataaat

SEQ ID NO: 5095832 - DNA, 19 bp, Homo sapiens
aacttattgcctgggcagt

SEQ ID NO: 5095833 - DNA, 14 bp, Homo sapiens
aacttattgctaga

SEQ ID NO: 5095834 - DNA, 22 bp, Homo sapiens
aacttattgctgattttaatgg

SEQ ID NO: 5095835 - DNA, 23 bp, Homo sapiens
aacttattgtattcctcatgtca

SEQ ID NO: 5095836 - DNA, 11 bp, Homo sapiens
aacttattgtt

SEQ ID NO: 5095837 - DNA, 18 bp, Homo sapiens
aacttatttaaaaatatt

SEQ ID NO: 5095838 - DNA, 19 bp, Homo sapiens
aacttatttaaaaatattt

SEQ ID NO: 5095839 - DNA, 13 bp, Homo sapiens
aacttatttagag

SEQ ID NO: 5095840 - DNA, 14 bp, Homo sapiens
aacttatttatatg

SEQ ID NO: 5095841 - DNA, 16 bp, Homo sapiens
aacttatttcataatt

SEQ ID NO: 5095842 - DNA, 21 bp, Homo sapiens
aacttatttctgaaaaagaga

SEQ ID NO: 5095843 - DNA, 22 bp, Homo sapiens
aacttatttctgaaaaagagaa

SEQ ID NO: 5095844 - DNA, 13 bp, Homo sapiens
aacttattttgat

SEQ ID NO: 5095845 - DNA, 14 bp, Homo sapiens
aacttattttgatt

SEQ ID NO: 5095846 - DNA, 13 bp, Homo sapiens
aacttattttgct

SEQ ID NO: 5095847 - DNA, 17 bp, Homo sapiens
aacttattttgctttaa

SEQ ID NO: 5095848 - DNA, 14 bp, Homo sapiens
aacttatttttcac

SEQ ID NO: 5095849 - DNA, 16 bp, Homo sapiens
aacttatttttttctg

SEQ ID NO: 5095850 - DNA, 17 bp, Homo sapiens
aacttatttttttctga

SEQ ID NO: 5095851 - DNA, 22 bp, Homo sapiens
aacttatttttttctgattgta

SEQ ID NO: 5095852 - DNA, 17 bp, Homo sapiens
aacttcaaaaactaaaa

SEQ ID NO: 5095853 - DNA, 20 bp, Homo sapiens
aacttcaaaaactaaaatca

SEQ ID NO: 5095854 - DNA, 21 bp, Homo sapiens
aacttcaaaaactaaaatcat

SEQ ID NO: 5095855 - DNA, 13 bp, Homo sapiens
aacttcaaatttt

SEQ ID NO: 5095856 - DNA, 14 bp, Homo sapiens
aacttcaacattta

SEQ ID NO: 5095857 - DNA, 15 bp, Homo sapiens
aacttcaaggaaaat

SEQ ID NO: 5095858 - DNA, 16 bp, Homo sapiens
aacttcacatttatgt

SEQ ID NO: 5095859 - DNA, 15 bp, Homo sapiens
aacttcaccttaaaa

SEQ ID NO: 5095860 - DNA, 16 bp, Homo sapiens
aacttcactccaaaga

SEQ ID NO: 5095861 - DNA, 20 bp, Homo sapiens
aacttcactccaaagagaaa

SEQ ID NO: 5095862 - DNA, 18 bp, Homo sapiens
aacttcagaaacccggct

SEQ ID NO: 5095863 - DNA, 16 bp, Homo sapiens
aacttcagagaagtca

SEQ ID NO: 5095864 - DNA, 13 bp, Homo sapiens
aacttcagagtga

SEQ ID NO: 5095865 - DNA, 14 bp, Homo sapiens
aacttcagagttct

SEQ ID NO: 5095866 - DNA, 15 bp, Homo sapiens
aacttcagatgtttc

SEQ ID NO: 5095867 - DNA, 17 bp, Homo sapiens
aacttcagatgtttcca

SEQ ID NO: 5095868 - DNA, 13 bp, Homo sapiens
aacttcagcacca

SEQ ID NO: 5095869 - DNA, 18 bp, Homo sapiens
aacttcagcagtacctat

SEQ ID NO: 5095870 - DNA, 16 bp, Homo sapiens
aacttcagcattgtaa

SEQ ID NO: 5095871 - DNA, 19 bp, Homo sapiens
aacttcagcattgtaatta

SEQ ID NO: 5095872 - DNA, 21 bp, Homo sapiens
aacttcaggataataaagtgt

SEQ ID NO: 5095873 - DNA, 18 bp, Homo sapiens
aacttcagtactcaaatt

SEQ ID NO: 5095874 - DNA, 15 bp, Homo sapiens
aacttcagtcctggg

SEQ ID NO: 5095875 - DNA, 21 bp, Homo sapiens
aacttcagttttactgcattt

SEQ ID NO: 5095876 - DNA, 22 bp, Homo sapiens
aacttcagttttactgcatttt

SEQ ID NO: 5095877 - DNA, 14 bp, Homo sapiens
aacttcatcccagc

SEQ ID NO: 5095878 - DNA, 18 bp, Homo sapiens
aacttcatgctgtctgtg

SEQ ID NO: 5095879 - DNA, 13 bp, Homo sapiens
aacttcatgcttg

SEQ ID NO: 5095880 - DNA, 14 bp, Homo sapiens
aacttcatgcttga

SEQ ID NO: 5095881 - DNA, 12 bp, Homo sapiens
aacttcatggat

SEQ ID NO: 5095882 - DNA, 15 bp, Homo sapiens
aacttcatggatcag

SEQ ID NO: 5095883 - DNA, 14 bp, Homo sapiens
aacttcatgtaatt

SEQ ID NO: 5095884 - DNA, 22 bp, Homo sapiens
aacttcattagggtaatatcat

SEQ ID NO: 5095885 - DNA, 22 bp, Homo sapiens
aacttcattgtttggacctgca

SEQ ID NO: 5095886 - DNA, 22 bp, Homo sapiens
aacttcatttgacacaaagctt

SEQ ID NO: 5095887 - DNA, 12 bp, Homo sapiens
aacttcattttt

SEQ ID NO: 5095888 - DNA, 14 bp, Homo sapiens
aacttccaaagctt

SEQ ID NO: 5095889 - DNA, 23 bp, Homo sapiens
aacttccaaataaataattttca

SEQ ID NO: 5095890 - DNA, 13 bp, Homo sapiens
aacttccaattta

SEQ ID NO: 5095891 - DNA, 15 bp, Homo sapiens
aacttccacaagagt

SEQ ID NO: 5095892 - DNA, 19 bp, Homo sapiens
aacttccactttgtataaa

SEQ ID NO: 5095893 - DNA, 14 bp, Homo sapiens
aacttccaggaaag

SEQ ID NO: 5095894 - DNA, 22 bp, Homo sapiens
aacttccaggaaagtgtgaaga

SEQ ID NO: 5095895 - DNA, 19 bp, Homo sapiens
aacttccaggtgttactgt

SEQ ID NO: 5095896 - DNA, 23 bp, Homo sapiens
aacttccaggttccatccaccac

SEQ ID NO: 5095897 - DNA, 21 bp, Homo sapiens
aacttccattctttcttcctc

SEQ ID NO: 5095898 - DNA, 16 bp, Homo sapiens
aacttcccaacttccc

SEQ ID NO: 5095899 - DNA, 15 bp, Homo sapiens
aacttcccattaaaa

SEQ ID NO: 5095900 - DNA, 16 bp, Homo sapiens
aacttcccattaaaaa

SEQ ID NO: 5095901 - DNA, 17 bp, Homo sapiens
aacttccccatcttcta

SEQ ID NO: 5095902 - DNA, 18 bp, Homo sapiens
aacttccccatcttctaa

SEQ ID NO: 5095903 - DNA, 22 bp, Homo sapiens
aacttcccgtcccatatcctgc

SEQ ID NO: 5095904 - DNA, 15 bp, Homo sapiens
aacttccctgttctt

SEQ ID NO: 5095905 - DNA, 22 bp, Homo sapiens
aacttcctcccttacagagcat

SEQ ID NO: 5095906 - DNA, 11 bp, Homo sapiens
aacttcctgct

SEQ ID NO: 5095907 - DNA, 13 bp, Homo sapiens
aacttcctgtgga

SEQ ID NO: 5095908 - DNA, 17 bp, Homo sapiens
aacttcctgtggatgca

SEQ ID NO: 5095909 - DNA, 13 bp, Homo sapiens
aacttcctgtggc

SEQ ID NO: 5095910 - DNA, 19 bp, Homo sapiens
aacttccttcacatctccc

SEQ ID NO: 5095911 - DNA, 20 bp, Homo sapiens
aacttcctttgactttctgt

SEQ ID NO: 5095912 - DNA, 18 bp, Homo sapiens
aacttcctttgagaattg

SEQ ID NO: 5095913 - DNA, 15 bp, Homo sapiens
aacttcgaatatatc

SEQ ID NO: 5095914 - DNA, 20 bp, Homo sapiens
aacttcgaccctttctctga

SEQ ID NO: 5095915 - DNA, 21 bp, Homo sapiens
aacttcgctgtcccccaacac

SEQ ID NO: 5095916 - DNA, 16 bp, Homo sapiens
aacttctaaaactgta

SEQ ID NO: 5095917 - DNA, 14 bp, Homo sapiens
aacttctaaacact

SEQ ID NO: 5095918 - DNA, 22 bp, Homo sapiens
aagaagcaattatttaaagaaa

SEQ ID NO: 5095919 - DNA, 12 bp, Homo sapiens
aagaagcaggct

SEQ ID NO: 5095920 - DNA, 19 bp, Homo sapiens
aagaagcaggctacactga

SEQ ID NO: 5095921 - DNA, 19 bp, Homo sapiens
aagaagcccggctcctggt

SEQ ID NO: 5095922 - DNA, 11 bp, Homo sapiens
aagaagccctc

SEQ ID NO: 5095923 - DNA, 16 bp, Homo sapiens
aagaagccctgcagag

SEQ ID NO: 5095924 - DNA, 15 bp, Homo sapiens
aagaagccctgctgg

SEQ ID NO: 5095925 - DNA, 17 bp, Homo sapiens
aagaagccgggaacaga

SEQ ID NO: 5095926 - DNA, 17 bp, Homo sapiens
aagaagcctgcaggaga

SEQ ID NO: 5095927 - DNA, 22 bp, Homo sapiens
aagaagcctgtaacactcctct

SEQ ID NO: 5095928 - DNA, 16 bp, Homo sapiens
aagaagccttaatttg

SEQ ID NO: 5095929 - DNA, 18 bp, Homo sapiens
aagaagccttaatttgca

SEQ ID NO: 5095930 - DNA, 20 bp, Homo sapiens
aagaagccttaatttgcaca

SEQ ID NO: 5095931 - DNA, 22 bp, Homo sapiens
aagaagccttaatttgcacagt

SEQ ID NO: 5095932 - DNA, 16 bp, Homo sapiens
aagaagcgaacaaaaa

SEQ ID NO: 5095933 - DNA, 16 bp, Homo sapiens
aagaagctcccagatg

SEQ ID NO: 5095934 - DNA, 22 bp, Homo sapiens
aagaagctcccagatgctgggg

SEQ ID NO: 5095935 - DNA, 14 bp, Homo sapiens
aagaagctctctcc

SEQ ID NO: 5095936 - DNA, 13 bp, Homo sapiens
aagaagctgagga

SEQ ID NO: 5095937 - DNA, 22 bp, Homo sapiens
aagaagctgaggaagctgttgg

SEQ ID NO: 5095938 - DNA, 18 bp, Homo sapiens
aagaagctgggagggagg

SEQ ID NO: 5095939 - DNA, 17 bp, Homo sapiens
aagaagctgtcagaagt

SEQ ID NO: 5095940 - DNA, 18 bp, Homo sapiens
aagaagctgttgtacatt

SEQ ID NO: 5095941 - DNA, 12 bp, Homo sapiens
aagaagctttat

SEQ ID NO: 5095942 - DNA, 15 bp, Homo sapiens
aagaaggaaaaattt

SEQ ID NO: 5095943 - DNA, 17 bp, Homo sapiens
aagaaggaaaaatttga

SEQ ID NO: 5095944 - DNA, 13 bp, Homo sapiens
aagaaggaaagaa

SEQ ID NO: 5095945 - DNA, 22 bp, Homo sapiens
aagaaggaaagaaccgaagagc

SEQ ID NO: 5095946 - DNA, 20 bp, Homo sapiens
aagaaggaaatgaatttctc

SEQ ID NO: 5095947 - DNA, 16 bp, Homo sapiens
aagaaggaagacttta

SEQ ID NO: 5095948 - DNA, 13 bp, Homo sapiens
aagaaggaagctg

SEQ ID NO: 5095949 - DNA, 14 bp, Homo sapiens
aagaaggaagctgt

SEQ ID NO: 5095950 - DNA, 17 bp, Homo sapiens
aagaaggaagctgtgtt

SEQ ID NO: 5095951 - DNA, 18 bp, Homo sapiens
aagaaggaaggcctgagc

SEQ ID NO: 5095952 - DNA, 18 bp, Homo sapiens
aagaaggaccctttttgg

SEQ ID NO: 5095953 - DNA, 21 bp, Homo sapiens
aagaaggagaccttttcacaa

SEQ ID NO: 5095954 - DNA, 11 bp, Homo sapiens
aagaaggaggt

SEQ ID NO: 5095955 - DNA, 17 bp, Homo sapiens
aagaaggatgatgtctt

SEQ ID NO: 5095956 - DNA, 14 bp, Homo sapiens
aagaaggcaaaaat

SEQ ID NO: 5095957 - DNA, 16 bp, Homo sapiens
aagaaggcaaaaatgt

SEQ ID NO: 5095958 - DNA, 13 bp, Homo sapiens
aagaaggcaaggc

SEQ ID NO: 5095959 - DNA, 21 bp, Homo sapiens
aagaaggcacaggtgtaaata

SEQ ID NO: 5095960 - DNA, 23 bp, Homo sapiens
aagaaggcatcgtcatgcacagt

SEQ ID NO: 5095961 - DNA, 14 bp, Homo sapiens
aagaaggccagaga

SEQ ID NO: 5095962 - DNA, 15 bp, Homo sapiens
aagaaggccagagag

SEQ ID NO: 5095963 - DNA, 17 bp, Homo sapiens
aagaaggcccgggagga

SEQ ID NO: 5095964 - DNA, 13 bp, Homo sapiens
aagaaggctagga

SEQ ID NO: 5095965 - DNA, 19 bp, Homo sapiens
aagaagggaaattcacact

SEQ ID NO: 5095966 - DNA, 21 bp, Homo sapiens
aagaagggaaattcacactgt

SEQ ID NO: 5095967 - DNA, 21 bp, Homo sapiens
aagaagggaagccttttgcaa

SEQ ID NO: 5095968 - DNA, 22 bp, Homo sapiens
aagaagggaagccttttgcaaa

SEQ ID NO: 5095969 - DNA, 16 bp, Homo sapiens
aagaagggactgagag

SEQ ID NO: 5095970 - DNA, 20 bp, Homo sapiens
aagaagggctgcatgatgtt

SEQ ID NO: 5095971 - DNA, 21 bp, Homo sapiens
aagaagggctgcatgatgttt

SEQ ID NO: 5095972 - DNA, 21 bp, Homo sapiens
aagaaggggacaatggcagaa

SEQ ID NO: 5095973 - DNA, 23 bp, Homo sapiens
aagaagggggagtgaaacagaga

SEQ ID NO: 5095974 - DNA, 17 bp, Homo sapiens
aagaagggggccctgct

SEQ ID NO: 5095975 - DNA, 18 bp, Homo sapiens
aagaagggggccctgcta

SEQ ID NO: 5095976 - DNA, 17 bp, Homo sapiens
aagaagggtccttccct

SEQ ID NO: 5095977 - DNA, 17 bp, Homo sapiens
aagaaggtatttttcca

SEQ ID NO: 5095978 - DNA, 18 bp, Homo sapiens
aagaaggtggacctttta

SEQ ID NO: 5095979 - DNA, 22 bp, Homo sapiens
aagaaggtggaccttttaaagt

SEQ ID NO: 5095980 - DNA, 21 bp, Homo sapiens
aagaaggttaccaagaagcct

SEQ ID NO: 5095981 - DNA, 22 bp, Homo sapiens
aagaagtaaaagcaaaaaagaa

SEQ ID NO: 5095982 - DNA, 14 bp, Homo sapiens
aagaagtaaaagct

SEQ ID NO: 5095983 - DNA, 13 bp, Homo sapiens
aagaagtaaattt

SEQ ID NO: 5095984 - DNA, 14 bp, Homo sapiens
aagaagtaaatttg

SEQ ID NO: 5095985 - DNA, 17 bp, Homo sapiens
aagaagtaaatttgtcc

SEQ ID NO: 5095986 - DNA, 20 bp, Homo sapiens
aagaagtacaataagcagag

SEQ ID NO: 5095987 - DNA, 18 bp, Homo sapiens
aagaagtagcaagatctt

SEQ ID NO: 5095988 - DNA, 15 bp, Homo sapiens
aagaagtattaaaaa

SEQ ID NO: 5095989 - DNA, 20 bp, Homo sapiens
aagaagtatttttttaattt

SEQ ID NO: 5095990 - DNA, 22 bp, Homo sapiens
aagaagtcagagaaaacacttt

SEQ ID NO: 5095991 - DNA, 17 bp, Homo sapiens
aagaagtccatgtgata

SEQ ID NO: 5095992 - DNA, 14 bp, Homo sapiens
aagaagtccccagg

SEQ ID NO: 5095993 - DNA, 22 bp, Homo sapiens
aagaagtctgatggtgagcagt

SEQ ID NO: 5095994 - DNA, 14 bp, Homo sapiens
aagaagtctggcca

SEQ ID NO: 5095995 - DNA, 17 bp, Homo sapiens
aagaagtctggccattt

SEQ ID NO: 5095996 - DNA, 12 bp, Homo sapiens
aagaagtcttga

SEQ ID NO: 5095997 - DNA, 14 bp, Homo sapiens
aagaagtgaacact

SEQ ID NO: 5095998 - DNA, 16 bp, Homo sapiens
aagaagtgagtgtttc

SEQ ID NO: 5095999 - DNA, 22 bp, Homo sapiens
aagaagtgcttgggggtttttg

SEQ ID NO: 5096000 - DNA, 15 bp, Homo sapiens
aagaagtggagacag

SEQ ID NO: 5096001 - DNA, 19 bp, Homo sapiens
aagaagtggagacagtcct

SEQ ID NO: 5096002 - DNA, 12 bp, Homo sapiens
aagaagtggcat

SEQ ID NO: 5096003 - DNA, 20 bp, Homo sapiens
aagaagtggctgccacaccc

SEQ ID NO: 5096004 - DNA, 18 bp, Homo sapiens
aagaagtggggcagcagc

SEQ ID NO: 5096005 - DNA, 22 bp, Homo sapiens
aagaagttaaaaaacagctgca

SEQ ID NO: 5096006 - DNA, 14 bp, Homo sapiens
aagaagttaattct

SEQ ID NO: 5096007 - DNA, 13 bp, Homo sapiens
aagaagttacttt

SEQ ID NO: 5096008 - DNA, 15 bp, Homo sapiens
aagaagttactttgt

SEQ ID NO: 5096009 - DNA, 20 bp, Homo sapiens
aagaagttcaccagccctga

SEQ ID NO: 5096010 - DNA, 23 bp, Homo sapiens
aagaagttgctaagtgtgcttag

SEQ ID NO: 5096011 - DNA, 14 bp, Homo sapiens
aagaagtttaagga

SEQ ID NO: 5096012 - DNA, 22 bp, Homo sapiens
aagaagtttctggagcaagaga

SEQ ID NO: 5096013 - DNA, 20 bp, Homo sapiens
aagaagtttttctttgtgtt

SEQ ID NO: 5096014 - DNA, 16 bp, Homo sapiens
aagaataaaaaagaag

SEQ ID NO: 5096015 - DNA, 15 bp, Homo sapiens
aagaataaaaacttt

SEQ ID NO: 5096016 - DNA, 18 bp, Homo sapiens
aagaataaaaacttttga

SEQ ID NO: 5096017 - DNA, 20 bp, Homo sapiens
aagaataaaaattgacttct

SEQ ID NO: 5096018 - DNA, 12 bp, Homo sapiens
aagaataaaatg

SEQ ID NO: 5096019 - DNA, 21 bp, Homo sapiens
aagaataaaatgttgaaaagt

SEQ ID NO: 5096020 - DNA, 21 bp, Homo sapiens
aagaataaataaagaagaaaa

SEQ ID NO: 5096021 - DNA, 12 bp, Homo sapiens
aagaataataaa

SEQ ID NO: 5096022 - DNA, 22 bp, Homo sapiens
aagaataatcacgctttcctga

SEQ ID NO: 5096023 - DNA, 23 bp, Homo sapiens
aagaataatgccttgtatggtgt

SEQ ID NO: 5096024 - DNA, 22 bp, Homo sapiens
aagaataattcaattttaaaga

SEQ ID NO: 5096025 - DNA, 23 bp, Homo sapiens
aagaataattgaacaataaagtt

SEQ ID NO: 5096026 - DNA, 13 bp, Homo sapiens
aagaataatttat

SEQ ID NO: 5096027 - DNA, 14 bp, Homo sapiens
aagaataattttaa

SEQ ID NO: 5096028 - DNA, 22 bp, Homo sapiens
aagaatacaaacatatttgtta

SEQ ID NO: 5096029 - DNA, 17 bp, Homo sapiens
aagaatacccaggaaga

SEQ ID NO: 5096030 - DNA, 12 bp, Homo sapiens
aagaatacttct

SEQ ID NO: 5096031 - DNA, 12 bp, Homo sapiens
aagaatacttga

SEQ ID NO: 5096032 - DNA, 16 bp, Homo sapiens
aagaatacttgaactt

SEQ ID NO: 5096033 - DNA, 11 bp, Homo sapiens
aagaatagaac

SEQ ID NO: 5096034 - DNA, 15 bp, Homo sapiens
aagaatagcatctgt

SEQ ID NO: 5096035 - DNA, 16 bp, Homo sapiens
aagaatagcatctgta

SEQ ID NO: 5096036 - DNA, 18 bp, Homo sapiens
aagaatagcattgtaaaa

SEQ ID NO: 5096037 - DNA, 17 bp, Homo sapiens
aagaatagctttaatga

SEQ ID NO: 5096038 - DNA, 21 bp, Homo sapiens
aagaataggacttgtttttgt

SEQ ID NO: 5096039 - DNA, 19 bp, Homo sapiens
aagaataggtcattttcta

SEQ ID NO: 5096040 - DNA, 16 bp, Homo sapiens
aagaatagttgtcaga

SEQ ID NO: 5096041 - DNA, 20 bp, Homo sapiens
aagaatagttgtcagaatat

SEQ ID NO: 5096042 - DNA, 22 bp, Homo sapiens
aagaatagttgtcagaatatgt

SEQ ID NO: 5096043 - DNA, 13 bp, Homo sapiens
aagaatataaata

SEQ ID NO: 5096044 - DNA, 12 bp, Homo sapiens
aagaatatatat

SEQ ID NO: 5096045 - DNA, 14 bp, Homo sapiens
aagaatatgacttt

SEQ ID NO: 5096046 - DNA, 21 bp, Homo sapiens
aagaatatgtttccttgttta

SEQ ID NO: 5096047 - DNA, 16 bp, Homo sapiens
aagaatattcaaatgt

SEQ ID NO: 5096048 - DNA, 16 bp, Homo sapiens
aagaatattcagagaa

SEQ ID NO: 5096049 - DNA, 17 bp, Homo sapiens
aagaatattcagagaat

SEQ ID NO: 5096050 - DNA, 14 bp, Homo sapiens
aagaatattgcaaa

SEQ ID NO: 5096051 - DNA, 18 bp, Homo sapiens
aagaatattgtattgtta

SEQ ID NO: 5096052 - DNA, 14 bp, Homo sapiens
aagaatatttaaga

SEQ ID NO: 5096053 - DNA, 16 bp, Homo sapiens
aagaatatttaagaaa

SEQ ID NO: 5096054 - DNA, 20 bp, Homo sapiens
aagaatatttaagaaaagca

SEQ ID NO: 5096055 - DNA, 21 bp, Homo sapiens
aagaatatttaagaaaagcac

SEQ ID NO: 5096056 - DNA, 11 bp, Homo sapiens
aagaatatttg

SEQ ID NO: 5096057 - DNA, 13 bp, Homo sapiens
aagaatattttaa

SEQ ID NO: 5096058 - DNA, 14 bp, Homo sapiens
aagaatatttttag

SEQ ID NO: 5096059 - DNA, 21 bp, Homo sapiens
aagaatatttttagactattt

SEQ ID NO: 5096060 - DNA, 16 bp, Homo sapiens
aagaatcactgcactt

SEQ ID NO: 5096061 - DNA, 12 bp, Homo sapiens
aagaatcatgga

SEQ ID NO: 5096062 - DNA, 22 bp, Homo sapiens
aagaatcattatttattaaatt

SEQ ID NO: 5096063 - DNA, 16 bp, Homo sapiens
aagaatcattttgtgt

SEQ ID NO: 5096064 - DNA, 16 bp, Homo sapiens
aagaatccaagacaaa

SEQ ID NO: 5096065 - DNA, 16 bp, Homo sapiens
aagaatccaatactgc

SEQ ID NO: 5096066 - DNA, 18 bp, Homo sapiens
aagaatccctagacttta

SEQ ID NO: 5096067 - DNA, 15 bp, Homo sapiens
aagaatccctgttca

SEQ ID NO: 5096068 - DNA, 21 bp, Homo sapiens
aagaatccctgttcattgtaa

SEQ ID NO: 5096069 - DNA, 13 bp, Homo sapiens
aagaatccttttg

SEQ ID NO: 5096070 - DNA, 17 bp, Homo sapiens
aagaatcggcagtattt

SEQ ID NO: 5096071 - DNA, 21 bp, Homo sapiens
aagaatcggcagtattttctg

SEQ ID NO: 5096072 - DNA, 12 bp, Homo sapiens
aagaatctactt

SEQ ID NO: 5096073 - DNA, 13 bp, Homo sapiens
aagaatctactta

SEQ ID NO: 5096074 - DNA, 16 bp, Homo sapiens
aagaatctagaagatg

SEQ ID NO: 5096075 - DNA, 17 bp, Homo sapiens
aagaatctagaagatgt

SEQ ID NO: 5096076 - DNA, 21 bp, Homo sapiens
aagaatctagaagatgtgtaa

SEQ ID NO: 5096077 - DNA, 17 bp, Homo sapiens
aagaatctatctgctta

SEQ ID NO: 5096078 - DNA, 18 bp, Homo sapiens
aagaatctattagatttt

SEQ ID NO: 5096079 - DNA, 20 bp, Homo sapiens
aagaatctcatctcagtgaa

SEQ ID NO: 5096080 - DNA, 13 bp, Homo sapiens
aagaatctctcct

SEQ ID NO: 5096081 - DNA, 18 bp, Homo sapiens
aagaatcttaatgcttgt

SEQ ID NO: 5096082 - DNA, 16 bp, Homo sapiens
aagaatcttcctggca

SEQ ID NO: 5096083 - DNA, 13 bp, Homo sapiens
aagaatctttctt

SEQ ID NO: 5096084 - DNA, 15 bp, Homo sapiens
aagaatgaaaaatat

SEQ ID NO: 5096085 - DNA, 15 bp, Homo sapiens
aagaatgaaaacaat

SEQ ID NO: 5096086 - DNA, 17 bp, Homo sapiens
aagaatgaaagctgttc

SEQ ID NO: 5096087 - DNA, 14 bp, Homo sapiens
aagaatgaaatact

SEQ ID NO: 5096088 - DNA, 18 bp, Homo sapiens
aagaatgaaatgaatgat

SEQ ID NO: 5096089 - DNA, 13 bp, Homo sapiens
aagaatgaacaca

SEQ ID NO: 5096090 - DNA, 22 bp, Homo sapiens
aagaatgaaggtttttgtaaag

SEQ ID NO: 5096091 - DNA, 23 bp, Homo sapiens
aagaatgaaggtttttgtaaaga

SEQ ID NO: 5096092 - DNA, 19 bp, Homo sapiens
aagaatgacgatgccttca

SEQ ID NO: 5096093 - DNA, 16 bp, Homo sapiens
aagaatgactatataa

SEQ ID NO: 5096094 - DNA, 14 bp, Homo sapiens
aagaatgagaaaga

SEQ ID NO: 5096095 - DNA, 15 bp, Homo sapiens
aagaatgagaaagaa

SEQ ID NO: 5096096 - DNA, 23 bp, Homo sapiens
aagaatgagaaagaaaaggaatg

SEQ ID NO: 5096097 - DNA, 12 bp, Homo sapiens
aagaatgagtga

SEQ ID NO: 5096098 - DNA, 16 bp, Homo sapiens
aacttctaattgccat

SEQ ID NO: 5096099 - DNA, 17 bp, Homo sapiens
aacttctaattgccatg

SEQ ID NO: 5096100 - DNA, 14 bp, Homo sapiens
aacttctactgagc

SEQ ID NO: 5096101 - DNA, 19 bp, Homo sapiens
aacttctagcatatagact

SEQ ID NO: 5096102 - DNA, 21 bp, Homo sapiens
aacttctagcatatagactat

SEQ ID NO: 5096103 - DNA, 14 bp, Homo sapiens
aacttctcccaccc

SEQ ID NO: 5096104 - DNA, 17 bp, Homo sapiens
aacttctcccacccctt

SEQ ID NO: 5096105 - DNA, 16 bp, Homo sapiens
aacttctcccttctcc

SEQ ID NO: 5096106 - DNA, 18 bp, Homo sapiens
aacttctcctgaatgcat

SEQ ID NO: 5096107 - DNA, 19 bp, Homo sapiens
aacttctcgtagatgctgc

SEQ ID NO: 5096108 - DNA, 18 bp, Homo sapiens
aacttctcttctgagcct

SEQ ID NO: 5096109 - DNA, 18 bp, Homo sapiens
aacttctcttgaaaagtt

SEQ ID NO: 5096110 - DNA, 15 bp, Homo sapiens
aacttctgaaagagc

SEQ ID NO: 5096111 - DNA, 18 bp, Homo sapiens
aacttctgaactttggaa

SEQ ID NO: 5096112 - DNA, 19 bp, Homo sapiens
aacttctgcaacaagcatg

SEQ ID NO: 5096113 - DNA, 13 bp, Homo sapiens
aacttctgcctgt

SEQ ID NO: 5096114 - DNA, 11 bp, Homo sapiens
aacttctgctc

SEQ ID NO: 5096115 - DNA, 17 bp, Homo sapiens
aacttctgggcctctct

SEQ ID NO: 5096116 - DNA, 13 bp, Homo sapiens
aacttctgtttta

SEQ ID NO: 5096117 - DNA, 15 bp, Homo sapiens
aacttcttaaatatc

SEQ ID NO: 5096118 - DNA, 19 bp, Homo sapiens
aacttcttatggaattgat

SEQ ID NO: 5096119 - DNA, 14 bp, Homo sapiens
aacttcttctatat

SEQ ID NO: 5096120 - DNA, 21 bp, Homo sapiens
aacttcttctccatccctcta

SEQ ID NO: 5096121 - DNA, 13 bp, Homo sapiens
aacttcttgaaaa

SEQ ID NO: 5096122 - DNA, 19 bp, Homo sapiens
aacttcttgcttctttcta

SEQ ID NO: 5096123 - DNA, 16 bp, Homo sapiens
aacttcttgtcagaca

SEQ ID NO: 5096124 - DNA, 20 bp, Homo sapiens
aacttcttgtcagacataaa

SEQ ID NO: 5096125 - DNA, 21 bp, Homo sapiens
aacttcttgtcagacataaag

SEQ ID NO: 5096126 - DNA, 13 bp, Homo sapiens
aacttctttcact

SEQ ID NO: 5096127 - DNA, 21 bp, Homo sapiens
aacttctttttaatcttaaga

SEQ ID NO: 5096128 - DNA, 15 bp, Homo sapiens
aacttgaaaaatact

SEQ ID NO: 5096129 - DNA, 21 bp, Homo sapiens
aacttgaaaagattgcaaagg

SEQ ID NO: 5096130 - DNA, 22 bp, Homo sapiens
aacttgaaaagattgcaaaggg

SEQ ID NO: 5096131 - DNA, 23 bp, Homo sapiens
aacttgaaaagtttattgcttgt

SEQ ID NO: 5096132 - DNA, 15 bp, Homo sapiens
aacttgaaaatagta

SEQ ID NO: 5096133 - DNA, 12 bp, Homo sapiens
aacttgaaatat

SEQ ID NO: 5096134 - DNA, 14 bp, Homo sapiens
aacttgaaatatat

SEQ ID NO: 5096135 - DNA, 12 bp, Homo sapiens
aacttgaaattt

SEQ ID NO: 5096136 - DNA, 19 bp, Homo sapiens
aacttgaaatttgaatttt

SEQ ID NO: 5096137 - DNA, 12 bp, Homo sapiens
aacttgaacaaa

SEQ ID NO: 5096138 - DNA, 16 bp, Homo sapiens
aacttgaacaaagtct

SEQ ID NO: 5096139 - DNA, 12 bp, Homo sapiens
aacttgaactcc

SEQ ID NO: 5096140 - DNA, 18 bp, Homo sapiens
aacttgaagcctgctcct

SEQ ID NO: 5096141 - DNA, 16 bp, Homo sapiens
aacttgaagctttgta

SEQ ID NO: 5096142 - DNA, 16 bp, Homo sapiens
aacttgaatctgttac

SEQ ID NO: 5096143 - DNA, 16 bp, Homo sapiens
aacttgaatgtgtcag

SEQ ID NO: 5096144 - DNA, 17 bp, Homo sapiens
aacttgacaccactaag

SEQ ID NO: 5096145 - DNA, 23 bp, Homo sapiens
aacttgacatgtagcttcttctg

SEQ ID NO: 5096146 - DNA, 18 bp, Homo sapiens
aacttgagaactttattt

SEQ ID NO: 5096147 - DNA, 18 bp, Homo sapiens
aacttgagatctgtataa

SEQ ID NO: 5096148 - DNA, 19 bp, Homo sapiens
aacttgagatctgtataaa

SEQ ID NO: 5096149 - DNA, 20 bp, Homo sapiens
aacttgagatctgtataaat

SEQ ID NO: 5096150 - DNA, 20 bp, Homo sapiens
aacttgagatgtatgaaggc

SEQ ID NO: 5096151 - DNA, 12 bp, Homo sapiens
aacttgagccca

SEQ ID NO: 5096152 - DNA, 23 bp, Homo sapiens
aacttgagcctgtgaccttggga

SEQ ID NO: 5096153 - DNA, 12 bp, Homo sapiens
aacttgaggaca

SEQ ID NO: 5096154 - DNA, 13 bp, Homo sapiens
aacttgaggacac

SEQ ID NO: 5096155 - DNA, 15 bp, Homo sapiens
aacttgaggacacat

SEQ ID NO: 5096156 - DNA, 16 bp, Homo sapiens
aacttgaggacacatg

SEQ ID NO: 5096157 - DNA, 17 bp, Homo sapiens
aacttgaggacacatgt

SEQ ID NO: 5096158 - DNA, 18 bp, Homo sapiens
aacttgaggacacatgtc

SEQ ID NO: 5096159 - DNA, 19 bp, Homo sapiens
aacttgaggacacatgtcc

SEQ ID NO: 5096160 - DNA, 23 bp, Homo sapiens
aacttgagggacgactttcttta

SEQ ID NO: 5096161 - DNA, 20 bp, Homo sapiens
aacttgagggcccagagcag

SEQ ID NO: 5096162 - DNA, 22 bp, Homo sapiens
aacttgagggcccagagcagga

SEQ ID NO: 5096163 - DNA, 16 bp, Homo sapiens
aacttgagtataagat

SEQ ID NO: 5096164 - DNA, 22 bp, Homo sapiens
aacttgagtataagataaaata

SEQ ID NO: 5096165 - DNA, 19 bp, Homo sapiens
aacttgagtggctgtctta

SEQ ID NO: 5096166 - DNA, 12 bp, Homo sapiens
aacttgatatag

SEQ ID NO: 5096167 - DNA, 20 bp, Homo sapiens
aacttgatatatttcattct

SEQ ID NO: 5096168 - DNA, 17 bp, Homo sapiens
aacttgatccatttcta

SEQ ID NO: 5096169 - DNA, 19 bp, Homo sapiens
aacttgatccatttctaat

SEQ ID NO: 5096170 - DNA, 15 bp, Homo sapiens
aacttgatgcatgtg

SEQ ID NO: 5096171 - DNA, 13 bp, Homo sapiens
aacttgatgttcc

SEQ ID NO: 5096172 - DNA, 20 bp, Homo sapiens
aacttgatgttcctgggatg

SEQ ID NO: 5096173 - DNA, 19 bp, Homo sapiens
aacttgattaactcctcct

SEQ ID NO: 5096174 - DNA, 23 bp, Homo sapiens
aacttgattcttgtgattgactt

SEQ ID NO: 5096175 - DNA, 18 bp, Homo sapiens
aacttgcacatttgaatt

SEQ ID NO: 5096176 - DNA, 20 bp, Homo sapiens
aacttgcacatttgaattca

SEQ ID NO: 5096177 - DNA, 22 bp, Homo sapiens
aacttgcagtatatcacagagc

SEQ ID NO: 5096178 - DNA, 23 bp, Homo sapiens
aacttgcatattgttggcacaga

SEQ ID NO: 5096179 - DNA, 14 bp, Homo sapiens
aacttgcatcactt

SEQ ID NO: 5096180 - DNA, 22 bp, Homo sapiens
aacttgcattctggcataattt

SEQ ID NO: 5096181 - DNA, 23 bp, Homo sapiens
aacttgccaaaatgttggctgcg

SEQ ID NO: 5096182 - DNA, 15 bp, Homo sapiens
aacttgccatttctt

SEQ ID NO: 5096183 - DNA, 18 bp, Homo sapiens
aacttgccatttctttat

SEQ ID NO: 5096184 - DNA, 19 bp, Homo sapiens
aacttgccatttctttata

SEQ ID NO: 5096185 - DNA, 14 bp, Homo sapiens
aacttgcctccatc

SEQ ID NO: 5096186 - DNA, 21 bp, Homo sapiens
aacttgcctccatctttttct

SEQ ID NO: 5096187 - DNA, 23 bp, Homo sapiens
aacttgcctccatctttttcttg

SEQ ID NO: 5096188 - DNA, 11 bp, Homo sapiens
aacttgccttt

SEQ ID NO: 5096189 - DNA, 14 bp, Homo sapiens
aacttgcctttttt

SEQ ID NO: 5096190 - DNA, 20 bp, Homo sapiens
aacttgctacttatcatttt

SEQ ID NO: 5096191 - DNA, 14 bp, Homo sapiens
aacttgctcctttc

SEQ ID NO: 5096192 - DNA, 14 bp, Homo sapiens
aacttgctcttttt

SEQ ID NO: 5096193 - DNA, 16 bp, Homo sapiens
aacttgctgaatttca

SEQ ID NO: 5096194 - DNA, 20 bp, Homo sapiens
aacttgctgaatttcaggca

SEQ ID NO: 5096195 - DNA, 22 bp, Homo sapiens
aacttgctgcagtatgaaaata

SEQ ID NO: 5096196 - DNA, 14 bp, Homo sapiens
aacttgcttaaatg

SEQ ID NO: 5096197 - DNA, 17 bp, Homo sapiens
aacttgcttaaatgtga

SEQ ID NO: 5096198 - DNA, 19 bp, Homo sapiens
aacttgcttaaatgtgaat

SEQ ID NO: 5096199 - DNA, 20 bp, Homo sapiens
aacttgcttaaatgtgaatt

SEQ ID NO: 5096200 - DNA, 21 bp, Homo sapiens
aacttgcttaaatgtgaatta

SEQ ID NO: 5096201 - DNA, 14 bp, Homo sapiens
aacttgcttaaatt

SEQ ID NO: 5096202 - DNA, 18 bp, Homo sapiens
aacttgcttatcaacttc

SEQ ID NO: 5096203 - DNA, 15 bp, Homo sapiens
aacttgctttcttct

SEQ ID NO: 5096204 - DNA, 21 bp, Homo sapiens
aacttggaaatcagtagaaag

SEQ ID NO: 5096205 - DNA, 19 bp, Homo sapiens
aacttggaaatgacacaga

SEQ ID NO: 5096206 - DNA, 20 bp, Homo sapiens
aacttggaagggggagacag

SEQ ID NO: 5096207 - DNA, 22 bp, Homo sapiens
aacttggacatttatgtacaaa

SEQ ID NO: 5096208 - DNA, 17 bp, Homo sapiens
aacttggacccttggaa

SEQ ID NO: 5096209 - DNA, 20 bp, Homo sapiens
aacttggagagggggccgga

SEQ ID NO: 5096210 - DNA, 12 bp, Homo sapiens
aacttggagccg

SEQ ID NO: 5096211 - DNA, 13 bp, Homo sapiens
aacttggagtttc

SEQ ID NO: 5096212 - DNA, 15 bp, Homo sapiens
aacttggatattcaa

SEQ ID NO: 5096213 - DNA, 16 bp, Homo sapiens
aacttggatgagtttt

SEQ ID NO: 5096214 - DNA, 12 bp, Homo sapiens
aacttggcactt

SEQ ID NO: 5096215 - DNA, 16 bp, Homo sapiens
aacttggcactttttc

SEQ ID NO: 5096216 - DNA, 18 bp, Homo sapiens
aacttggcagctttttct

SEQ ID NO: 5096217 - DNA, 22 bp, Homo sapiens
aacttggcagctttttctgtgg

SEQ ID NO: 5096218 - DNA, 14 bp, Homo sapiens
aacttggcatttct

SEQ ID NO: 5096219 - DNA, 23 bp, Homo sapiens
aacttggccctcttgcgggcctg

SEQ ID NO: 5096220 - DNA, 17 bp, Homo sapiens
aacttggcgctgcccct

SEQ ID NO: 5096221 - DNA, 22 bp, Homo sapiens
aacttggctcgaatctctgtgc

SEQ ID NO: 5096222 - DNA, 23 bp, Homo sapiens
aacttggctcgaatctctgtgcc

SEQ ID NO: 5096223 - DNA, 22 bp, Homo sapiens
aacttggctctcaataaacttt

SEQ ID NO: 5096224 - DNA, 15 bp, Homo sapiens
aacttggctggaatt

SEQ ID NO: 5096225 - DNA, 23 bp, Homo sapiens
aacttggctgtatgtcaaattgt

SEQ ID NO: 5096226 - DNA, 11 bp, Homo sapiens
aacttgggagt

SEQ ID NO: 5096227 - DNA, 15 bp, Homo sapiens
aacttggggaagggg

SEQ ID NO: 5096228 - DNA, 23 bp, Homo sapiens
aacttggggaaggggcctgggct

SEQ ID NO: 5096229 - DNA, 15 bp, Homo sapiens
aacttggggaggcaa

SEQ ID NO: 5096230 - DNA, 22 bp, Homo sapiens
aacttgggttcttctcagcggg

SEQ ID NO: 5096231 - DNA, 16 bp, Homo sapiens
aacttggtcagagcca

SEQ ID NO: 5096232 - DNA, 20 bp, Homo sapiens
aacttggtcagagccactct

SEQ ID NO: 5096233 - DNA, 23 bp, Homo sapiens
aacttggtcagagccactctatg

SEQ ID NO: 5096234 - DNA, 17 bp, Homo sapiens
aacttggtgcttattga

SEQ ID NO: 5096235 - DNA, 16 bp, Homo sapiens
aacttggttcccagaa

SEQ ID NO: 5096236 - DNA, 23 bp, Homo sapiens
aacttggttcccatttgctcctt

SEQ ID NO: 5096237 - DNA, 16 bp, Homo sapiens
aacttggttttgctac

SEQ ID NO: 5096238 - DNA, 13 bp, Homo sapiens
aacttgtaaaaag

SEQ ID NO: 5096239 - DNA, 15 bp, Homo sapiens
aacttgtaaatacac

SEQ ID NO: 5096240 - DNA, 18 bp, Homo sapiens
aacttgtaaatgctgtca

SEQ ID NO: 5096241 - DNA, 20 bp, Homo sapiens
aacttgtacttacactgaaa

SEQ ID NO: 5096242 - DNA, 14 bp, Homo sapiens
aacttgtagcagct

SEQ ID NO: 5096243 - DNA, 14 bp, Homo sapiens
aacttgtagctgta

SEQ ID NO: 5096244 - DNA, 16 bp, Homo sapiens
aacttgtagctgtaaa

SEQ ID NO: 5096245 - DNA, 23 bp, Homo sapiens
aacttgtagctgtaaaacgctgt

SEQ ID NO: 5096246 - DNA, 14 bp, Homo sapiens
aacttgtatactta

SEQ ID NO: 5096247 - DNA, 14 bp, Homo sapiens
aacttgtatattcc

SEQ ID NO: 5096248 - DNA, 18 bp, Homo sapiens
aacttgtattggaagtat

SEQ ID NO: 5096249 - DNA, 13 bp, Homo sapiens
aacttgtcacttg

SEQ ID NO: 5096250 - DNA, 22 bp, Homo sapiens
aacttgtcagaatttctttgtc

SEQ ID NO: 5096251 - DNA, 15 bp, Homo sapiens
aacttgtcaggcatg

SEQ ID NO: 5096252 - DNA, 19 bp, Homo sapiens
aacttgtcctagcacagat

SEQ ID NO: 5096253 - DNA, 19 bp, Homo sapiens
aacttgtctaaataagttt

SEQ ID NO: 5096254 - DNA, 13 bp, Homo sapiens
aacttgtctggct

SEQ ID NO: 5096255 - DNA, 12 bp, Homo sapiens
aacttgtcttaa

SEQ ID NO: 5096256 - DNA, 16 bp, Homo sapiens
aacttgtgaagacaat

SEQ ID NO: 5096257 - DNA, 18 bp, Homo sapiens
aacttgtgagcatcagag

SEQ ID NO: 5096258 - DNA, 16 bp, Homo sapiens
aacttgtgccctccct

SEQ ID NO: 5096259 - DNA, 18 bp, Homo sapiens
aacttgtgggatggtggg

SEQ ID NO: 5096260 - DNA, 20 bp, Homo sapiens
aacttgtgtactgataaaat

SEQ ID NO: 5096261 - DNA, 18 bp, Homo sapiens
aacttgtgttcaatctgt

SEQ ID NO: 5096262 - DNA, 13 bp, Homo sapiens
aacttgtgttcta

SEQ ID NO: 5096263 - DNA, 14 bp, Homo sapiens
aacttgttcattta

SEQ ID NO: 5096264 - DNA, 22 bp, Homo sapiens
aacttgttgctgattttgacct

SEQ ID NO: 5096265 - DNA, 13 bp, Homo sapiens
aacttgtttgtaa

SEQ ID NO: 5096266 - DNA, 13 bp, Homo sapiens
aacttgttttctg

SEQ ID NO: 5096267 - DNA, 14 bp, Homo sapiens
aacttgtttttatt

SEQ ID NO: 5096268 - DNA, 20 bp, Homo sapiens
aacttgtttttattgcattt

SEQ ID NO: 5096269 - DNA, 21 bp, Homo sapiens
aacttgtttttattgcatttg

SEQ ID NO: 5096270 - DNA, 13 bp, Homo sapiens
aactttaaaactg

SEQ ID NO: 5096271 - DNA, 21 bp, Homo sapiens
aactttaaacctgtagaatca

SEQ ID NO: 5096272 - DNA, 17 bp, Homo sapiens
aactttaaagataagtc

SEQ ID NO: 5096273 - DNA, 22 bp, Homo sapiens
aactttaaccacagtgaaagtt

SEQ ID NO: 5096274 - DNA, 18 bp, Homo sapiens
aactttaacttccacttt

SEQ ID NO: 5096275 - DNA, 13 bp, Homo sapiens
aactttaacttct

SEQ ID NO: 5096276 - DNA, 20 bp, Homo sapiens
aactttaacttctgttttac

SEQ ID NO: 5096277 - DNA, 20 bp, Homo sapiens
aagaatgagtgaagtattgc

SEQ ID NO: 5096278 - DNA, 15 bp, Homo sapiens
aagaatgatgccttt

SEQ ID NO: 5096279 - DNA, 16 bp, Homo sapiens
aagaatgattatgaat

SEQ ID NO: 5096280 - DNA, 15 bp, Homo sapiens
aagaatgcagagatg

SEQ ID NO: 5096281 - DNA, 16 bp, Homo sapiens
aagaatgcagtacaga

SEQ ID NO: 5096282 - DNA, 18 bp, Homo sapiens
aagaatgcagtacagaat

SEQ ID NO: 5096283 - DNA, 20 bp, Homo sapiens
aagaatgcatgctttccata

SEQ ID NO: 5096284 - DNA, 9 bp, Homo sapiens
aagaatgct

SEQ ID NO: 5096285 - DNA, 22 bp, Homo sapiens
aagaatgctgcaacttttttat

SEQ ID NO: 5096286 - DNA, 19 bp, Homo sapiens
aagaatgctggttttccta

SEQ ID NO: 5096287 - DNA, 19 bp, Homo sapiens
aagaatgctgttctgattt

SEQ ID NO: 5096288 - DNA, 13 bp, Homo sapiens
aagaatggaaaag

SEQ ID NO: 5096289 - DNA, 15 bp, Homo sapiens
aagaatggaaaagag

SEQ ID NO: 5096290 - DNA, 17 bp, Homo sapiens
aagaatggcagaaaagt

SEQ ID NO: 5096291 - DNA, 15 bp, Homo sapiens
aagaatggctttcaa

SEQ ID NO: 5096292 - DNA, 17 bp, Homo sapiens
aagaatgggctgcagaa

SEQ ID NO: 5096293 - DNA, 15 bp, Homo sapiens
aagaatggtctcagt

SEQ ID NO: 5096294 - DNA, 16 bp, Homo sapiens
aagaatggtctcagtg

SEQ ID NO: 5096295 - DNA, 13 bp, Homo sapiens
aagaatgtaaagc

SEQ ID NO: 5096296 - DNA, 16 bp, Homo sapiens
aagaatgtacgtccag

SEQ ID NO: 5096297 - DNA, 19 bp, Homo sapiens
aagaatgtagccctctcca

SEQ ID NO: 5096298 - DNA, 14 bp, Homo sapiens
aagaatgtatatca

SEQ ID NO: 5096299 - DNA, 15 bp, Homo sapiens
aagaatgtcagaaaa

SEQ ID NO: 5096300 - DNA, 23 bp, Homo sapiens
aagaatgtcagaaaaacaataag

SEQ ID NO: 5096301 - DNA, 21 bp, Homo sapiens
aagaatgtcaggaatttaaga

SEQ ID NO: 5096302 - DNA, 23 bp, Homo sapiens
aagaatgtccaatggtaggaatt

SEQ ID NO: 5096303 - DNA, 17 bp, Homo sapiens
aagaatgtccttattct

SEQ ID NO: 5096304 - DNA, 17 bp, Homo sapiens
aagaatgtcgattaaaa

SEQ ID NO: 5096305 - DNA, 18 bp, Homo sapiens
aagaatgtcgattaaaat

SEQ ID NO: 5096306 - DNA, 13 bp, Homo sapiens
aagaatgtctatt

SEQ ID NO: 5096307 - DNA, 17 bp, Homo sapiens
aagaatgtctatttcca

SEQ ID NO: 5096308 - DNA, 16 bp, Homo sapiens
aagaatgtctccattg

SEQ ID NO: 5096309 - DNA, 12 bp, Homo sapiens
aagaatgttaag

SEQ ID NO: 5096310 - DNA, 18 bp, Homo sapiens
aagaatgttaagacttga

SEQ ID NO: 5096311 - DNA, 17 bp, Homo sapiens
aagaatgttactgcctt

SEQ ID NO: 5096312 - DNA, 18 bp, Homo sapiens
aagaatgttactgcctta

SEQ ID NO: 5096313 - DNA, 11 bp, Homo sapiens
aagaatgttag

SEQ ID NO: 5096314 - DNA, 15 bp, Homo sapiens
aagaatgttagagta

SEQ ID NO: 5096315 - DNA, 17 bp, Homo sapiens
aagaatgttggtttact

SEQ ID NO: 5096316 - DNA, 19 bp, Homo sapiens
aagaatgtttaatagaaaa

SEQ ID NO: 5096317 - DNA, 15 bp, Homo sapiens
aagaatgtttatagc

SEQ ID NO: 5096318 - DNA, 20 bp, Homo sapiens
aagaatgttttggcaagagc

SEQ ID NO: 5096319 - DNA, 15 bp, Homo sapiens
aagaattaaaaactt

SEQ ID NO: 5096320 - DNA, 18 bp, Homo sapiens
aagaattaaaactgagtc

SEQ ID NO: 5096321 - DNA, 18 bp, Homo sapiens
aagaattaaattgattat

SEQ ID NO: 5096322 - DNA, 14 bp, Homo sapiens
aagaattaatgaca

SEQ ID NO: 5096323 - DNA, 11 bp, Homo sapiens
aagaattacag

SEQ ID NO: 5096324 - DNA, 22 bp, Homo sapiens
aagaattagaagtctttcagtg

SEQ ID NO: 5096325 - DNA, 19 bp, Homo sapiens
aagaattatgtaatatatt

SEQ ID NO: 5096326 - DNA, 18 bp, Homo sapiens
aagaattattcagtgaat

SEQ ID NO: 5096327 - DNA, 23 bp, Homo sapiens
aagaattatttgccttctgaaat

SEQ ID NO: 5096328 - DNA, 17 bp, Homo sapiens
aagaattattttaacaa

SEQ ID NO: 5096329 - DNA, 16 bp, Homo sapiens
aagaattattttgatg

SEQ ID NO: 5096330 - DNA, 15 bp, Homo sapiens
aagaattatttttgt

SEQ ID NO: 5096331 - DNA, 19 bp, Homo sapiens
aagaattcaaactggggcc

SEQ ID NO: 5096332 - DNA, 13 bp, Homo sapiens
aagaattcaaatt

SEQ ID NO: 5096333 - DNA, 19 bp, Homo sapiens
aagaattcaaatttgtaat

SEQ ID NO: 5096334 - DNA, 18 bp, Homo sapiens
aagaattcaaattttatc

SEQ ID NO: 5096335 - DNA, 22 bp, Homo sapiens
aagaattcatgatgctagttct

SEQ ID NO: 5096336 - DNA, 14 bp, Homo sapiens
aagaattccaaagc

SEQ ID NO: 5096337 - DNA, 17 bp, Homo sapiens
aagaattccatctatat

SEQ ID NO: 5096338 - DNA, 19 bp, Homo sapiens
aagaattcctgaagccaga

SEQ ID NO: 5096339 - DNA, 20 bp, Homo sapiens
aagaattcctgaagccagat

SEQ ID NO: 5096340 - DNA, 16 bp, Homo sapiens
aagaattcctgcagca

SEQ ID NO: 5096341 - DNA, 19 bp, Homo sapiens
aagaattctattttgctgg

SEQ ID NO: 5096342 - DNA, 19 bp, Homo sapiens
aagaattctccaaaacaat

SEQ ID NO: 5096343 - DNA, 22 bp, Homo sapiens
aagaattctggtcctgttttct

SEQ ID NO: 5096344 - DNA, 13 bp, Homo sapiens
aagaattctgtga

SEQ ID NO: 5096345 - DNA, 23 bp, Homo sapiens
aagaattctgtgagaaaaaattt

SEQ ID NO: 5096346 - DNA, 19 bp, Homo sapiens
aagaattgaaaagtttttg

SEQ ID NO: 5096347 - DNA, 16 bp, Homo sapiens
aagaattgaacccagg

SEQ ID NO: 5096348 - DNA, 19 bp, Homo sapiens
aagaattgaacccaggagg

SEQ ID NO: 5096349 - DNA, 20 bp, Homo sapiens
aagaattgaacccaggaggt

SEQ ID NO: 5096350 - DNA, 16 bp, Homo sapiens
aagaattgaagcagga

SEQ ID NO: 5096351 - DNA, 17 bp, Homo sapiens
aagaattgagtaatggt

SEQ ID NO: 5096352 - DNA, 20 bp, Homo sapiens
aagaattgccagtcttttgt

SEQ ID NO: 5096353 - DNA, 15 bp, Homo sapiens
aagaattggaagtta

SEQ ID NO: 5096354 - DNA, 16 bp, Homo sapiens
aagaattgtctctggg

SEQ ID NO: 5096355 - DNA, 14 bp, Homo sapiens
aagaattgtcttgc

SEQ ID NO: 5096356 - DNA, 23 bp, Homo sapiens
aagaattgtggtttatatattta

SEQ ID NO: 5096357 - DNA, 16 bp, Homo sapiens
aagaatttaatggact

SEQ ID NO: 5096358 - DNA, 18 bp, Homo sapiens
aagaatttaccagaaata

SEQ ID NO: 5096359 - DNA, 23 bp, Homo sapiens
aagaatttagaggataaataata

SEQ ID NO: 5096360 - DNA, 15 bp, Homo sapiens
aagaatttagatctt

SEQ ID NO: 5096361 - DNA, 16 bp, Homo sapiens
aagaatttagatctta

SEQ ID NO: 5096362 - DNA, 15 bp, Homo sapiens
aagaatttagggaga

SEQ ID NO: 5096363 - DNA, 15 bp, Homo sapiens
aagaatttatctctt

SEQ ID NO: 5096364 - DNA, 16 bp, Homo sapiens
aagaatttcaatatca

SEQ ID NO: 5096365 - DNA, 14 bp, Homo sapiens
aagaatttcataga

SEQ ID NO: 5096366 - DNA, 19 bp, Homo sapiens
aagaatttctggaagaaag

SEQ ID NO: 5096367 - DNA, 20 bp, Homo sapiens
aagaatttctggaagaaagg

SEQ ID NO: 5096368 - DNA, 23 bp, Homo sapiens
aagaatttcttggtaagaagccg

SEQ ID NO: 5096369 - DNA, 17 bp, Homo sapiens
aagaatttgaagacttc

SEQ ID NO: 5096370 - DNA, 13 bp, Homo sapiens
aagaatttgcata

SEQ ID NO: 5096371 - DNA, 11 bp, Homo sapiens
aagaatttgtt

SEQ ID NO: 5096372 - DNA, 13 bp, Homo sapiens
aagaattttaaaa

SEQ ID NO: 5096373 - DNA, 18 bp, Homo sapiens
aagaattttaaaaatgaa

SEQ ID NO: 5096374 - DNA, 19 bp, Homo sapiens
aagaattttaaaaatgaat

SEQ ID NO: 5096375 - DNA, 22 bp, Homo sapiens
aagaattttcctgagacaaatt

SEQ ID NO: 5096376 - DNA, 11 bp, Homo sapiens
aagaatttttg

SEQ ID NO: 5096377 - DNA, 16 bp, Homo sapiens
aagaatttttgtttgg

SEQ ID NO: 5096378 - DNA, 14 bp, Homo sapiens
aagaattttttatt

SEQ ID NO: 5096379 - DNA, 13 bp, Homo sapiens
aagaatttttttg

SEQ ID NO: 5096380 - DNA, 15 bp, Homo sapiens
aagaatttttttgtc

SEQ ID NO: 5096381 - DNA, 20 bp, Homo sapiens
aagacaaaaagctacttatt

SEQ ID NO: 5096382 - DNA, 23 bp, Homo sapiens
aagacaaaaagctacttattgta

SEQ ID NO: 5096383 - DNA, 16 bp, Homo sapiens
aagacaaaaatactct

SEQ ID NO: 5096384 - DNA, 22 bp, Homo sapiens
aagacaaaaatactctaattct

SEQ ID NO: 5096385 - DNA, 14 bp, Homo sapiens
aagacaaaaatcaa

SEQ ID NO: 5096386 - DNA, 22 bp, Homo sapiens
aagacaaaaatcaaagaacaga

SEQ ID NO: 5096387 - DNA, 15 bp, Homo sapiens
aagacaaaacgagtc

SEQ ID NO: 5096388 - DNA, 21 bp, Homo sapiens
aagacaaaacgagtctttcat

SEQ ID NO: 5096389 - DNA, 14 bp, Homo sapiens
aagacaaaagaaac

SEQ ID NO: 5096390 - DNA, 15 bp, Homo sapiens
aagacaaaagaaact

SEQ ID NO: 5096391 - DNA, 14 bp, Homo sapiens
aagacaaaagtctg

SEQ ID NO: 5096392 - DNA, 16 bp, Homo sapiens
aagacaaaataaatgt

SEQ ID NO: 5096393 - DNA, 23 bp, Homo sapiens
aagacaaaattgtaagccagagt

SEQ ID NO: 5096394 - DNA, 13 bp, Homo sapiens
aagacaaacactg

SEQ ID NO: 5096395 - DNA, 15 bp, Homo sapiens
aagacaaacactgcc

SEQ ID NO: 5096396 - DNA, 13 bp, Homo sapiens
aagacaaactaaa

SEQ ID NO: 5096397 - DNA, 14 bp, Homo sapiens
aagacaaactgcat

SEQ ID NO: 5096398 - DNA, 18 bp, Homo sapiens
aagacaaagtctaaggaa

SEQ ID NO: 5096399 - DNA, 13 bp, Homo sapiens
aagacaaataaat

SEQ ID NO: 5096400 - DNA, 19 bp, Homo sapiens
aagacaaatatttctttct

SEQ ID NO: 5096401 - DNA, 22 bp, Homo sapiens
aagacaaatcaacagaagcatt

SEQ ID NO: 5096402 - DNA, 20 bp, Homo sapiens
aagacaaatgcagtgtattt

SEQ ID NO: 5096403 - DNA, 18 bp, Homo sapiens
aagacaaattctgtttct

SEQ ID NO: 5096404 - DNA, 14 bp, Homo sapiens
aagacaacaaaaga

SEQ ID NO: 5096405 - DNA, 15 bp, Homo sapiens
aagacaacagaaaga

SEQ ID NO: 5096406 - DNA, 14 bp, Homo sapiens
aagacaacattgta

SEQ ID NO: 5096407 - DNA, 22 bp, Homo sapiens
aagacaagaaaagaggaaaaaa

SEQ ID NO: 5096408 - DNA, 13 bp, Homo sapiens
aagacaagaatat

SEQ ID NO: 5096409 - DNA, 21 bp, Homo sapiens
aagacaagagatctacacatg

SEQ ID NO: 5096410 - DNA, 22 bp, Homo sapiens
aagacaagagatctacacatgt

SEQ ID NO: 5096411 - DNA, 15 bp, Homo sapiens
aagacaagagctgtt

SEQ ID NO: 5096412 - DNA, 18 bp, Homo sapiens
aagacaagctcctccctt

SEQ ID NO: 5096413 - DNA, 21 bp, Homo sapiens
aagacaaggaaaaaataacaa

SEQ ID NO: 5096414 - DNA, 16 bp, Homo sapiens
aagacaagtacataaa

SEQ ID NO: 5096415 - DNA, 18 bp, Homo sapiens
aagacaagtatgaatatt

SEQ ID NO: 5096416 - DNA, 18 bp, Homo sapiens
aagacaataattacattg

SEQ ID NO: 5096417 - DNA, 19 bp, Homo sapiens
aagacaataattacattgg

SEQ ID NO: 5096418 - DNA, 23 bp, Homo sapiens
aagacaataattctacatgttgt

SEQ ID NO: 5096419 - DNA, 13 bp, Homo sapiens
aagacaatataat

SEQ ID NO: 5096420 - DNA, 23 bp, Homo sapiens
aagacaatggcttactccaggag

SEQ ID NO: 5096421 - DNA, 19 bp, Homo sapiens
aagacaatgtgaaaagaaa

SEQ ID NO: 5096422 - DNA, 15 bp, Homo sapiens
aagacaattctttat

SEQ ID NO: 5096423 - DNA, 16 bp, Homo sapiens
aagacaatttgataca

SEQ ID NO: 5096424 - DNA, 17 bp, Homo sapiens
aagacaatttgatacat

SEQ ID NO: 5096425 - DNA, 14 bp, Homo sapiens
aagacacacctctg

SEQ ID NO: 5096426 - DNA, 23 bp, Homo sapiens
aagacacactccccacttcactt

SEQ ID NO: 5096427 - DNA, 22 bp, Homo sapiens
aagacacatcttattgaataaa

SEQ ID NO: 5096428 - DNA, 18 bp, Homo sapiens
aagacacatgtggagaag

SEQ ID NO: 5096429 - DNA, 14 bp, Homo sapiens
aagacacattccta

SEQ ID NO: 5096430 - DNA, 11 bp, Homo sapiens
aagacacattg

SEQ ID NO: 5096431 - DNA, 21 bp, Homo sapiens
aagacacattttttaggaaat

SEQ ID NO: 5096432 - DNA, 13 bp, Homo sapiens
aagacaccagagc

SEQ ID NO: 5096433 - DNA, 15 bp, Homo sapiens
aagacaccagagcag

SEQ ID NO: 5096434 - DNA, 16 bp, Homo sapiens
aagacaccagagcaga

SEQ ID NO: 5096435 - DNA, 20 bp, Homo sapiens
aagacaccagagcagatgca

SEQ ID NO: 5096436 - DNA, 23 bp, Homo sapiens
aagacaccagagcagatgcagag

SEQ ID NO: 5096437 - DNA, 17 bp, Homo sapiens
aagacaccttcccagct

SEQ ID NO: 5096438 - DNA, 20 bp, Homo sapiens
aagacacgcccgactctctc

SEQ ID NO: 5096439 - DNA, 13 bp, Homo sapiens
aagacacgtgttt

SEQ ID NO: 5096440 - DNA, 14 bp, Homo sapiens
aagacacgtgtttt

SEQ ID NO: 5096441 - DNA, 15 bp, Homo sapiens
aagacactaattcct

SEQ ID NO: 5096442 - DNA, 20 bp, Homo sapiens
aagacactagtagagcaaag

SEQ ID NO: 5096443 - DNA, 19 bp, Homo sapiens
aagacactggtgtatctca

SEQ ID NO: 5096444 - DNA, 24 bp, Homo sapiens
aagacactgtcaatgaggttatga

SEQ ID NO: 5096445 - DNA, 13 bp, Homo sapiens
aagacacttcaga

SEQ ID NO: 5096446 - DNA, 16 bp, Homo sapiens
aagacagaaaagtgcc

SEQ ID NO: 5096447 - DNA, 16 bp, Homo sapiens
aagacagaagtttgca

SEQ ID NO: 5096448 - DNA, 18 bp, Homo sapiens
aagacagaagtttgcact

SEQ ID NO: 5096449 - DNA, 13 bp, Homo sapiens
aagacagaatggt

SEQ ID NO: 5096450 - DNA, 15 bp, Homo sapiens
aagacagaatggtgg

SEQ ID NO: 5096451 - DNA, 17 bp, Homo sapiens
aagacagagaaacagac

SEQ ID NO: 5096452 - DNA, 21 bp, Homo sapiens
aagacagagatggcagagcca

SEQ ID NO: 5096453 - DNA, 23 bp, Homo sapiens
aagacagagcagatcagtctttg

SEQ ID NO: 5096454 - DNA, 14 bp, Homo sapiens
aagacagagcaggc

SEQ ID NO: 5096455 - DNA, 21 bp, Homo sapiens
aagacagagcaggctttgtga

SEQ ID NO: 5096456 - DNA, 14 bp, Homo sapiens
aagacagagcctcc

SEQ ID NO: 5096457 - DNA, 19 bp, Homo sapiens
aactttaacttttaatgtg

SEQ ID NO: 5096458 - DNA, 14 bp, Homo sapiens
aactttaatacagc

SEQ ID NO: 5096459 - DNA, 12 bp, Homo sapiens
aactttaatatg

SEQ ID NO: 5096460 - DNA, 14 bp, Homo sapiens
aactttaatatgta

SEQ ID NO: 5096461 - DNA, 16 bp, Homo sapiens
aactttaatcaagttg

SEQ ID NO: 5096462 - DNA, 21 bp, Homo sapiens
aactttaattctctttcaaag

SEQ ID NO: 5096463 - DNA, 18 bp, Homo sapiens
aactttaccataaagcct

SEQ ID NO: 5096464 - DNA, 12 bp, Homo sapiens
aactttaccatg

SEQ ID NO: 5096465 - DNA, 13 bp, Homo sapiens
aactttacctttt

SEQ ID NO: 5096466 - DNA, 22 bp, Homo sapiens
aactttaccttttttatacata

SEQ ID NO: 5096467 - DNA, 15 bp, Homo sapiens
aactttactctgtgt

SEQ ID NO: 5096468 - DNA, 18 bp, Homo sapiens
aactttactctgtgttta

SEQ ID NO: 5096469 - DNA, 11 bp, Homo sapiens
aactttactgt

SEQ ID NO: 5096470 - DNA, 14 bp, Homo sapiens
aactttagaaataa

SEQ ID NO: 5096471 - DNA, 15 bp, Homo sapiens
aactttagaaataaa

SEQ ID NO: 5096472 - DNA, 16 bp, Homo sapiens
aactttagaaataaga

SEQ ID NO: 5096473 - DNA, 21 bp, Homo sapiens
aactttagaagtgcatttctg

SEQ ID NO: 5096474 - DNA, 13 bp, Homo sapiens
aactttagaattc

SEQ ID NO: 5096475 - DNA, 19 bp, Homo sapiens
aactttagggggtgggagg

SEQ ID NO: 5096476 - DNA, 21 bp, Homo sapiens
aactttagggggtgggagggg

SEQ ID NO: 5096477 - DNA, 21 bp, Homo sapiens
aactttagtttgcctgcagtt

SEQ ID NO: 5096478 - DNA, 23 bp, Homo sapiens
aactttagtttgcctgcagtttc

SEQ ID NO: 5096479 - DNA, 15 bp, Homo sapiens
aactttataaagata

SEQ ID NO: 5096480 - DNA, 15 bp, Homo sapiens
aactttataaatcca

SEQ ID NO: 5096481 - DNA, 18 bp, Homo sapiens
aactttatacattagtaa

SEQ ID NO: 5096482 - DNA, 21 bp, Homo sapiens
aactttatacattagtaaatg

SEQ ID NO: 5096483 - DNA, 14 bp, Homo sapiens
aactttatgtactg

SEQ ID NO: 5096484 - DNA, 14 bp, Homo sapiens
aactttatgtgtaa

SEQ ID NO: 5096485 - DNA, 19 bp, Homo sapiens
aactttattaaaagaatga

SEQ ID NO: 5096486 - DNA, 14 bp, Homo sapiens
aactttattaaata

SEQ ID NO: 5096487 - DNA, 21 bp, Homo sapiens
aactttattaaatacaaaact

SEQ ID NO: 5096488 - DNA, 23 bp, Homo sapiens
aactttattcttgaaagaagaat

SEQ ID NO: 5096489 - DNA, 20 bp, Homo sapiens
aactttattctttgttcttt

SEQ ID NO: 5096490 - DNA, 15 bp, Homo sapiens
aactttatttaaatg

SEQ ID NO: 5096491 - DNA, 18 bp, Homo sapiens
aactttatttaaatgcat

SEQ ID NO: 5096492 - DNA, 14 bp, Homo sapiens
aactttattttgaa

SEQ ID NO: 5096493 - DNA, 22 bp, Homo sapiens
aactttattttgaatgtacctc

SEQ ID NO: 5096494 - DNA, 17 bp, Homo sapiens
aactttcaaaagcaaac

SEQ ID NO: 5096495 - DNA, 17 bp, Homo sapiens
aactttcaatatcttta

SEQ ID NO: 5096496 - DNA, 15 bp, Homo sapiens
aactttcaattgtca

SEQ ID NO: 5096497 - DNA, 17 bp, Homo sapiens
aactttcacctcagatt

SEQ ID NO: 5096498 - DNA, 21 bp, Homo sapiens
aactttcacctcagattttct

SEQ ID NO: 5096499 - DNA, 16 bp, Homo sapiens
aactttcactttgaaa

SEQ ID NO: 5096500 - DNA, 14 bp, Homo sapiens
aactttcagtggct

SEQ ID NO: 5096501 - DNA, 12 bp, Homo sapiens
aactttccaaat

SEQ ID NO: 5096502 - DNA, 20 bp, Homo sapiens
aactttccactgacaacgaa

SEQ ID NO: 5096503 - DNA, 14 bp, Homo sapiens
aactttccagtctt

SEQ ID NO: 5096504 - DNA, 20 bp, Homo sapiens
aactttccagtcttagctga

SEQ ID NO: 5096505 - DNA, 10 bp, Homo sapiens
aactttccat

SEQ ID NO: 5096506 - DNA, 14 bp, Homo sapiens
aactttccatgaca

SEQ ID NO: 5096507 - DNA, 19 bp, Homo sapiens
aactttccatgacagtagc

SEQ ID NO: 5096508 - DNA, 20 bp, Homo sapiens
aactttccatgacagtagca

SEQ ID NO: 5096509 - DNA, 12 bp, Homo sapiens
aactttcctcaa

SEQ ID NO: 5096510 - DNA, 14 bp, Homo sapiens
aactttcctcgcct

SEQ ID NO: 5096511 - DNA, 19 bp, Homo sapiens
aactttcctcttcctgcct

SEQ ID NO: 5096512 - DNA, 19 bp, Homo sapiens
aactttcctggatgtctga

SEQ ID NO: 5096513 - DNA, 22 bp, Homo sapiens
aactttcgaccgactttcccca

SEQ ID NO: 5096514 - DNA, 16 bp, Homo sapiens
aactttcgttgttatt

SEQ ID NO: 5096515 - DNA, 18 bp, Homo sapiens
aactttctcactgctgtc

SEQ ID NO: 5096516 - DNA, 16 bp, Homo sapiens
aactttctcataagca

SEQ ID NO: 5096517 - DNA, 12 bp, Homo sapiens
aactttctccct

SEQ ID NO: 5096518 - DNA, 13 bp, Homo sapiens
aactttctccctc

SEQ ID NO: 5096519 - DNA, 18 bp, Homo sapiens
aactttctcttcatactt

SEQ ID NO: 5096520 - DNA, 15 bp, Homo sapiens
aactttcttatccta

SEQ ID NO: 5096521 - DNA, 16 bp, Homo sapiens
aactttgaaaaagata

SEQ ID NO: 5096522 - DNA, 11 bp, Homo sapiens
aactttgaaag

SEQ ID NO: 5096523 - DNA, 13 bp, Homo sapiens
aactttgaaagtt

SEQ ID NO: 5096524 - DNA, 14 bp, Homo sapiens
aactttgaagccat

SEQ ID NO: 5096525 - DNA, 14 bp, Homo sapiens
aactttgaataaag

SEQ ID NO: 5096526 - DNA, 19 bp, Homo sapiens
aactttgacctctgcagca

SEQ ID NO: 5096527 - DNA, 16 bp, Homo sapiens
aactttgagatctaaa

SEQ ID NO: 5096528 - DNA, 21 bp, Homo sapiens
aactttgaggaggaagcagaa

SEQ ID NO: 5096529 - DNA, 21 bp, Homo sapiens
aactttgcatgttcttgtttt

SEQ ID NO: 5096530 - DNA, 21 bp, Homo sapiens
aactttgccaaaaaaaaaaga

SEQ ID NO: 5096531 - DNA, 18 bp, Homo sapiens
aactttgccagtctttaa

SEQ ID NO: 5096532 - DNA, 21 bp, Homo sapiens
aactttggaaaacataaaaat

SEQ ID NO: 5096533 - DNA, 19 bp, Homo sapiens
aactttggaaccagactct

SEQ ID NO: 5096534 - DNA, 24 bp, Homo sapiens
aactttggaaccagactcttgcct

SEQ ID NO: 5096535 - DNA, 21 bp, Homo sapiens
aactttggaagttttacttga

SEQ ID NO: 5096536 - DNA, 23 bp, Homo sapiens
aactttggaagttttacttgatt

SEQ ID NO: 5096537 - DNA, 22 bp, Homo sapiens
aactttggagagtgagctacag

SEQ ID NO: 5096538 - DNA, 21 bp, Homo sapiens
aactttggcaacatcttggct

SEQ ID NO: 5096539 - DNA, 12 bp, Homo sapiens
aactttgggaaa

SEQ ID NO: 5096540 - DNA, 16 bp, Homo sapiens
aactttgggaaaacat

SEQ ID NO: 5096541 - DNA, 23 bp, Homo sapiens
aactttgggaaaaggtgtaaaac

SEQ ID NO: 5096542 - DNA, 14 bp, Homo sapiens
aactttgtaaaaat

SEQ ID NO: 5096543 - DNA, 15 bp, Homo sapiens
aactttgtagaaagc

SEQ ID NO: 5096544 - DNA, 18 bp, Homo sapiens
aactttgtagaaagcaaa

SEQ ID NO: 5096545 - DNA, 15 bp, Homo sapiens
aactttgtatagtta

SEQ ID NO: 5096546 - DNA, 22 bp, Homo sapiens
aactttgtatagttatgtaaat

SEQ ID NO: 5096547 - DNA, 14 bp, Homo sapiens
aacttttaaagaaa

SEQ ID NO: 5096548 - DNA, 15 bp, Homo sapiens
aacttttaaagaatt

SEQ ID NO: 5096549 - DNA, 15 bp, Homo sapiens
aacttttaagatttc

SEQ ID NO: 5096550 - DNA, 17 bp, Homo sapiens
aacttttaatgccttcc

SEQ ID NO: 5096551 - DNA, 22 bp, Homo sapiens
aacttttaattaaatgctcatc

SEQ ID NO: 5096552 - DNA, 13 bp, Homo sapiens
aacttttaattta

SEQ ID NO: 5096553 - DNA, 15 bp, Homo sapiens
aacttttacagaatg

SEQ ID NO: 5096554 - DNA, 16 bp, Homo sapiens
aacttttacagaatgc

SEQ ID NO: 5096555 - DNA, 19 bp, Homo sapiens
aacttttataaactttacc

SEQ ID NO: 5096556 - DNA, 16 bp, Homo sapiens
aacttttataaattaa

SEQ ID NO: 5096557 - DNA, 18 bp, Homo sapiens
aacttttataaattaaat

SEQ ID NO: 5096558 - DNA, 19 bp, Homo sapiens
aacttttatgcgcaaatac

SEQ ID NO: 5096559 - DNA, 22 bp, Homo sapiens
aacttttattacggtgatcctt

SEQ ID NO: 5096560 - DNA, 11 bp, Homo sapiens
aacttttcaaa

SEQ ID NO: 5096561 - DNA, 17 bp, Homo sapiens
aacttttcaaaataaag

SEQ ID NO: 5096562 - DNA, 19 bp, Homo sapiens
aacttttcaaaataaagct

SEQ ID NO: 5096563 - DNA, 17 bp, Homo sapiens
aacttttcaatgtgatt

SEQ ID NO: 5096564 - DNA, 20 bp, Homo sapiens
aacttttcaatgtgattctt

SEQ ID NO: 5096565 - DNA, 19 bp, Homo sapiens
aacttttcattccctgtag

SEQ ID NO: 5096566 - DNA, 12 bp, Homo sapiens
aacttttcattt

SEQ ID NO: 5096567 - DNA, 13 bp, Homo sapiens
aacttttcatttc

SEQ ID NO: 5096568 - DNA, 17 bp, Homo sapiens
aacttttcatttcagat

SEQ ID NO: 5096569 - DNA, 20 bp, Homo sapiens
aacttttcatttcagatttt

SEQ ID NO: 5096570 - DNA, 21 bp, Homo sapiens
aacttttcatttcagatttta

SEQ ID NO: 5096571 - DNA, 20 bp, Homo sapiens
aacttttccaagcaaaatct

SEQ ID NO: 5096572 - DNA, 14 bp, Homo sapiens
aacttttctaaagt

SEQ ID NO: 5096573 - DNA, 12 bp, Homo sapiens
aacttttctacc

SEQ ID NO: 5096574 - DNA, 13 bp, Homo sapiens
aacttttctcttt

SEQ ID NO: 5096575 - DNA, 15 bp, Homo sapiens
aacttttctgcattt

SEQ ID NO: 5096576 - DNA, 12 bp, Homo sapiens
aacttttgaaaa

SEQ ID NO: 5096577 - DNA, 17 bp, Homo sapiens
aacttttgaaaaagtgt

SEQ ID NO: 5096578 - DNA, 13 bp, Homo sapiens
aacttttgaaaga

SEQ ID NO: 5096579 - DNA, 17 bp, Homo sapiens
aacttttgaaagatgta

SEQ ID NO: 5096580 - DNA, 21 bp, Homo sapiens
aacttttggctaacagaaatt

SEQ ID NO: 5096581 - DNA, 18 bp, Homo sapiens
aacttttgtaaagaaatt

SEQ ID NO: 5096582 - DNA, 17 bp, Homo sapiens
aacttttgtaaattatt

SEQ ID NO: 5096583 - DNA, 19 bp, Homo sapiens
aacttttgtaatttgaatt

SEQ ID NO: 5096584 - DNA, 18 bp, Homo sapiens
aacttttgtactgaattt

SEQ ID NO: 5096585 - DNA, 19 bp, Homo sapiens
aacttttgtactgaatttt

SEQ ID NO: 5096586 - DNA, 11 bp, Homo sapiens
aacttttgtag

SEQ ID NO: 5096587 - DNA, 15 bp, Homo sapiens
aacttttgtagtctt

SEQ ID NO: 5096588 - DNA, 20 bp, Homo sapiens
aacttttgtagtcttatgaa

SEQ ID NO: 5096589 - DNA, 23 bp, Homo sapiens
aacttttgttaggaaaaaattga

SEQ ID NO: 5096590 - DNA, 20 bp, Homo sapiens
aacttttgtttaaagcatta

SEQ ID NO: 5096591 - DNA, 13 bp, Homo sapiens
aacttttgttttc

SEQ ID NO: 5096592 - DNA, 22 bp, Homo sapiens
aactttttaacaaatgttttca

SEQ ID NO: 5096593 - DNA, 11 bp, Homo sapiens
aactttttaca

SEQ ID NO: 5096594 - DNA, 12 bp, Homo sapiens
aactttttacat

SEQ ID NO: 5096595 - DNA, 13 bp, Homo sapiens
aactttttacatt

SEQ ID NO: 5096596 - DNA, 22 bp, Homo sapiens
aactttttacattacagaatat

SEQ ID NO: 5096597 - DNA, 22 bp, Homo sapiens
aactttttaccaagtacaaaaa

SEQ ID NO: 5096598 - DNA, 20 bp, Homo sapiens
aactttttatgtaatacttt

SEQ ID NO: 5096599 - DNA, 23 bp, Homo sapiens
aactttttatttctaaatgagac

SEQ ID NO: 5096600 - DNA, 16 bp, Homo sapiens
aactttttcaatggtt

SEQ ID NO: 5096601 - DNA, 14 bp, Homo sapiens
aactttttccagca

SEQ ID NO: 5096602 - DNA, 15 bp, Homo sapiens
aactttttccagcaa

SEQ ID NO: 5096603 - DNA, 19 bp, Homo sapiens
aactttttccagcaaaatg

SEQ ID NO: 5096604 - DNA, 18 bp, Homo sapiens
aactttttctaaattata

SEQ ID NO: 5096605 - DNA, 13 bp, Homo sapiens
aactttttgttca

SEQ ID NO: 5096606 - DNA, 21 bp, Homo sapiens
aacttttttaaataaactttt

SEQ ID NO: 5096607 - DNA, 18 bp, Homo sapiens
aacttttttaaattaaga

SEQ ID NO: 5096608 - DNA, 23 bp, Homo sapiens
aacttttttatttaaaaaactaa

SEQ ID NO: 5096609 - DNA, 22 bp, Homo sapiens
aacttttttattttaagaggaa

SEQ ID NO: 5096610 - DNA, 13 bp, Homo sapiens
aacttttttccac

SEQ ID NO: 5096611 - DNA, 12 bp, Homo sapiens
aacttttttccc

SEQ ID NO: 5096612 - DNA, 14 bp, Homo sapiens
aacttttttcttta

SEQ ID NO: 5096613 - DNA, 18 bp, Homo sapiens
aacttttttctttgaaat

SEQ ID NO: 5096614 - DNA, 18 bp, Homo sapiens
aacttttttgaggccttt

SEQ ID NO: 5096615 - DNA, 21 bp, Homo sapiens
aacttttttgtggcaattagt

SEQ ID NO: 5096616 - DNA, 19 bp, Homo sapiens
aacttttttgtgtatgtac

SEQ ID NO: 5096617 - DNA, 22 bp, Homo sapiens
aactttttttaggggatttttt

SEQ ID NO: 5096618 - DNA, 15 bp, Homo sapiens
aactttttttcaatg

SEQ ID NO: 5096619 - DNA, 18 bp, Homo sapiens
aactttttttgagaagga

SEQ ID NO: 5096620 - DNA, 14 bp, Homo sapiens
aacttttttttaag

SEQ ID NO: 5096621 - DNA, 19 bp, Homo sapiens
aacttttttttagtatttg

SEQ ID NO: 5096622 - DNA, 18 bp, Homo sapiens
aacttttttttctttttt

SEQ ID NO: 5096623 - DNA, 17 bp, Homo sapiens
aacttttttttgagaat

SEQ ID NO: 5096624 - DNA, 23 bp, Homo sapiens
aacttttttttttctttataaga

SEQ ID NO: 5096625 - DNA, 20 bp, Homo sapiens
aagaaaaaaaaaaagaaaga

SEQ ID NO: 5096626 - DNA, 17 bp, Homo sapiens
aagaaaaaaaaaagaag

SEQ ID NO: 5096627 - DNA, 22 bp, Homo sapiens
aagaaaaaaaaaagaagaagaa

SEQ ID NO: 5096628 - DNA, 16 bp, Homo sapiens
aagaaaaaaaaaatga

SEQ ID NO: 5096629 - DNA, 20 bp, Homo sapiens
aagaaaaaaaaaatgattgt

SEQ ID NO: 5096630 - DNA, 15 bp, Homo sapiens
aagaaaaaaaaagaa

SEQ ID NO: 5096631 - DNA, 16 bp, Homo sapiens
aagaaaaaaaaagaaa

SEQ ID NO: 5096632 - DNA, 18 bp, Homo sapiens
aagaaaaaaaaagaaaaa

SEQ ID NO: 5096633 - DNA, 18 bp, Homo sapiens
aagaaaaaaaaatgccat

SEQ ID NO: 5096634 - DNA, 16 bp, Homo sapiens
aagaaaaaaaataaca

SEQ ID NO: 5096635 - DNA, 18 bp, Homo sapiens
aagaaaaaaaataacaca

SEQ ID NO: 5096636 - DNA, 15 bp, Homo sapiens
aagaaaaaaaatgta

SEQ ID NO: 5096637 - DNA, 20 bp, Homo sapiens
aagacagagcctccacttag

SEQ ID NO: 5096638 - DNA, 14 bp, Homo sapiens
aagacagaggggag

SEQ ID NO: 5096639 - DNA, 15 bp, Homo sapiens
aagacagagtcttgc

SEQ ID NO: 5096640 - DNA, 17 bp, Homo sapiens
aagacagagtgaatttc

SEQ ID NO: 5096641 - DNA, 19 bp, Homo sapiens
aagacagatgagcaggagc

SEQ ID NO: 5096642 - DNA, 16 bp, Homo sapiens
aagacagatgccccag

SEQ ID NO: 5096643 - DNA, 22 bp, Homo sapiens
aagacagatgccccagagctgt

SEQ ID NO: 5096644 - DNA, 23 bp, Homo sapiens
aagacagcaaaaaaagcaacttt

SEQ ID NO: 5096645 - DNA, 19 bp, Homo sapiens
aagacagcagcagcctgca

SEQ ID NO: 5096646 - DNA, 16 bp, Homo sapiens
aagacagccatacttc

SEQ ID NO: 5096647 - DNA, 21 bp, Homo sapiens
aagacagcgataagctttcaa

SEQ ID NO: 5096648 - DNA, 14 bp, Homo sapiens
aagacaggagacaa

SEQ ID NO: 5096649 - DNA, 21 bp, Homo sapiens
aagacaggcacaaaatgtgac

SEQ ID NO: 5096650 - DNA, 20 bp, Homo sapiens
aagacagggctcatttttgc

SEQ ID NO: 5096651 - DNA, 22 bp, Homo sapiens
aagacagggctcatttttgcac

SEQ ID NO: 5096652 - DNA, 23 bp, Homo sapiens
aagacagggctcatttttgcact

SEQ ID NO: 5096653 - DNA, 19 bp, Homo sapiens
aagacaggtctagactttc

SEQ ID NO: 5096654 - DNA, 22 bp, Homo sapiens
aagacaggttacgaagacaaag

SEQ ID NO: 5096655 - DNA, 18 bp, Homo sapiens
aagacagtatttattggt

SEQ ID NO: 5096656 - DNA, 23 bp, Homo sapiens
aagacagtgaaagaaaataacaa

SEQ ID NO: 5096657 - DNA, 19 bp, Homo sapiens
aagacagtgcccatgaatg

SEQ ID NO: 5096658 - DNA, 17 bp, Homo sapiens
aagacagtggcactaaa

SEQ ID NO: 5096659 - DNA, 18 bp, Homo sapiens
aagacagtggcactaaaa

SEQ ID NO: 5096660 - DNA, 23 bp, Homo sapiens
aagacagtggcactaaaatgttt

SEQ ID NO: 5096661 - DNA, 15 bp, Homo sapiens
aagacagtggcagca

SEQ ID NO: 5096662 - DNA, 23 bp, Homo sapiens
aagacagtgtacaaaactgtaaa

SEQ ID NO: 5096663 - DNA, 18 bp, Homo sapiens
aagacagtgtatgtagaa

SEQ ID NO: 5096664 - DNA, 20 bp, Homo sapiens
aagacagtgtatgtagaagc

SEQ ID NO: 5096665 - DNA, 21 bp, Homo sapiens
aagacagtgtggggataaaga

SEQ ID NO: 5096666 - DNA, 14 bp, Homo sapiens
aagacagtgtgtgt

SEQ ID NO: 5096667 - DNA, 21 bp, Homo sapiens
aagacagtttcttgcaagctc

SEQ ID NO: 5096668 - DNA, 13 bp, Homo sapiens
aagacataaaaca

SEQ ID NO: 5096669 - DNA, 15 bp, Homo sapiens
aagacataaaacaga

SEQ ID NO: 5096670 - DNA, 14 bp, Homo sapiens
aagacataaacaaa

SEQ ID NO: 5096671 - DNA, 17 bp, Homo sapiens
aagacataaacaaagac

SEQ ID NO: 5096672 - DNA, 22 bp, Homo sapiens
aagacataacgtttttccttta

SEQ ID NO: 5096673 - DNA, 13 bp, Homo sapiens
aagacataatcat

SEQ ID NO: 5096674 - DNA, 23 bp, Homo sapiens
aagacatactgcttgattttaat

SEQ ID NO: 5096675 - DNA, 18 bp, Homo sapiens
aagacatagcatccaagt

SEQ ID NO: 5096676 - DNA, 21 bp, Homo sapiens
aagacatatattatatataga

SEQ ID NO: 5096677 - DNA, 22 bp, Homo sapiens
aagacatatattatatatagaa

SEQ ID NO: 5096678 - DNA, 16 bp, Homo sapiens
aagacatatctctaat

SEQ ID NO: 5096679 - DNA, 21 bp, Homo sapiens
aagacatcaagatacacttgt

SEQ ID NO: 5096680 - DNA, 12 bp, Homo sapiens
aagacatcaatg

SEQ ID NO: 5096681 - DNA, 13 bp, Homo sapiens
aagacatcaatga

SEQ ID NO: 5096682 - DNA, 21 bp, Homo sapiens
aagacatcacatccctctcct

SEQ ID NO: 5096683 - DNA, 16 bp, Homo sapiens
aagacatcagtctcca

SEQ ID NO: 5096684 - DNA, 21 bp, Homo sapiens
aagacatccataaagaagcaa

SEQ ID NO: 5096685 - DNA, 15 bp, Homo sapiens
aagacatctgaggaa

SEQ ID NO: 5096686 - DNA, 13 bp, Homo sapiens
aagacatctgcct

SEQ ID NO: 5096687 - DNA, 20 bp, Homo sapiens
aagacatctgcctgtaatta

SEQ ID NO: 5096688 - DNA, 12 bp, Homo sapiens
aagacatgaagc

SEQ ID NO: 5096689 - DNA, 14 bp, Homo sapiens
aagacatgatttcc

SEQ ID NO: 5096690 - DNA, 16 bp, Homo sapiens
aagacatgatttcctt

SEQ ID NO: 5096691 - DNA, 20 bp, Homo sapiens
aagacatgatttccttgaat

SEQ ID NO: 5096692 - DNA, 19 bp, Homo sapiens
aagacatgcactatgagga

SEQ ID NO: 5096693 - DNA, 14 bp, Homo sapiens
aagacatgcagcct

SEQ ID NO: 5096694 - DNA, 22 bp, Homo sapiens
aagacatggaagattagaggtt

SEQ ID NO: 5096695 - DNA, 23 bp, Homo sapiens
aagacatggaagattagaggttt

SEQ ID NO: 5096696 - DNA, 20 bp, Homo sapiens
aagacatggaaggttagagg

SEQ ID NO: 5096697 - DNA, 19 bp, Homo sapiens
aagacatggagactcctgc

SEQ ID NO: 5096698 - DNA, 23 bp, Homo sapiens
aagacatgggctatcagggagga

SEQ ID NO: 5096699 - DNA, 17 bp, Homo sapiens
aagacatgtctgttcta

SEQ ID NO: 5096700 - DNA, 19 bp, Homo sapiens
aagacatgtctgttctaca

SEQ ID NO: 5096701 - DNA, 19 bp, Homo sapiens
aagacatgtgaggaggaaa

SEQ ID NO: 5096702 - DNA, 20 bp, Homo sapiens
aagacatgtgaggaggaaaa

SEQ ID NO: 5096703 - DNA, 21 bp, Homo sapiens
aagacatgtgaggaggaaaag

SEQ ID NO: 5096704 - DNA, 18 bp, Homo sapiens
aagacatgttgtaaatta

SEQ ID NO: 5096705 - DNA, 14 bp, Homo sapiens
aagacatgttttag

SEQ ID NO: 5096706 - DNA, 15 bp, Homo sapiens
aagacattaaatcta

SEQ ID NO: 5096707 - DNA, 18 bp, Homo sapiens
aagacattaaatctatga

SEQ ID NO: 5096708 - DNA, 22 bp, Homo sapiens
aagacattaagagaacaaagag

SEQ ID NO: 5096709 - DNA, 21 bp, Homo sapiens
aagacattagtaacataataa

SEQ ID NO: 5096710 - DNA, 19 bp, Homo sapiens
aagacattagtttgaggta

SEQ ID NO: 5096711 - DNA, 21 bp, Homo sapiens
aagacattcaaaacgtgatgt

SEQ ID NO: 5096712 - DNA, 20 bp, Homo sapiens
aagacattcaccaacaacag

SEQ ID NO: 5096713 - DNA, 15 bp, Homo sapiens
aagacattcttagtt

SEQ ID NO: 5096714 - DNA, 21 bp, Homo sapiens
aagacattcttagttaatctt

SEQ ID NO: 5096715 - DNA, 18 bp, Homo sapiens
aagacattcttatatttc

SEQ ID NO: 5096716 - DNA, 22 bp, Homo sapiens
aagacattcttatatttcatat

SEQ ID NO: 5096717 - DNA, 16 bp, Homo sapiens
aagacattgacagcaa

SEQ ID NO: 5096718 - DNA, 23 bp, Homo sapiens
aagacatttaaaatagttttcta

SEQ ID NO: 5096719 - DNA, 14 bp, Homo sapiens
aagacatttccttt

SEQ ID NO: 5096720 - DNA, 11 bp, Homo sapiens
aagacatttct

SEQ ID NO: 5096721 - DNA, 13 bp, Homo sapiens
aagacatttgctg

SEQ ID NO: 5096722 - DNA, 14 bp, Homo sapiens
aagacatttgctga

SEQ ID NO: 5096723 - DNA, 12 bp, Homo sapiens
aagacatttgta

SEQ ID NO: 5096724 - DNA, 18 bp, Homo sapiens
aagacatttgtatattgt

SEQ ID NO: 5096725 - DNA, 11 bp, Homo sapiens
aagacattttc

SEQ ID NO: 5096726 - DNA, 20 bp, Homo sapiens
aagacattttcatgcttcca

SEQ ID NO: 5096727 - DNA, 19 bp, Homo sapiens
aagacattttgtttttact

SEQ ID NO: 5096728 - DNA, 15 bp, Homo sapiens
aagacattttttaaa

SEQ ID NO: 5096729 - DNA, 17 bp, Homo sapiens
aagacattttttgctat

SEQ ID NO: 5096730 - DNA, 13 bp, Homo sapiens
aagaccaaaatga

SEQ ID NO: 5096731 - DNA, 22 bp, Homo sapiens
aagaccaagcttagtcctggga

SEQ ID NO: 5096732 - DNA, 23 bp, Homo sapiens
aagaccaagcttagtcctgggag

SEQ ID NO: 5096733 - DNA, 20 bp, Homo sapiens
aagaccaatgtgaagacact

SEQ ID NO: 5096734 - DNA, 15 bp, Homo sapiens
aagaccaccttccct

SEQ ID NO: 5096735 - DNA, 14 bp, Homo sapiens
aagaccagaaattc

SEQ ID NO: 5096736 - DNA, 12 bp, Homo sapiens
aagaccagacta

SEQ ID NO: 5096737 - DNA, 13 bp, Homo sapiens
aagaccagcctgg

SEQ ID NO: 5096738 - DNA, 14 bp, Homo sapiens
aagaccagcctggc

SEQ ID NO: 5096739 - DNA, 20 bp, Homo sapiens
aagaccagcctggccaacat

SEQ ID NO: 5096740 - DNA, 21 bp, Homo sapiens
aagaccagggcttttcccagg

SEQ ID NO: 5096741 - DNA, 17 bp, Homo sapiens
aagaccagtcacagcca

SEQ ID NO: 5096742 - DNA, 20 bp, Homo sapiens
aagaccagtcacagccattt

SEQ ID NO: 5096743 - DNA, 23 bp, Homo sapiens
aagaccagtcacagccatttcaa

SEQ ID NO: 5096744 - DNA, 12 bp, Homo sapiens
aagaccatctct

SEQ ID NO: 5096745 - DNA, 16 bp, Homo sapiens
aagaccatgcattcag

SEQ ID NO: 5096746 - DNA, 16 bp, Homo sapiens
aagaccatttgtagtg

SEQ ID NO: 5096747 - DNA, 18 bp, Homo sapiens
aagacccaaaacagcttt

SEQ ID NO: 5096748 - DNA, 13 bp, Homo sapiens
aagacccaaaagg

SEQ ID NO: 5096749 - DNA, 19 bp, Homo sapiens
aagacccaacacatgggac

SEQ ID NO: 5096750 - DNA, 16 bp, Homo sapiens
aagaccccaagaggaa

SEQ ID NO: 5096751 - DNA, 16 bp, Homo sapiens
aagaccccacccaagc

SEQ ID NO: 5096752 - DNA, 11 bp, Homo sapiens
aagaccccact

SEQ ID NO: 5096753 - DNA, 13 bp, Homo sapiens
aagaccccatctc

SEQ ID NO: 5096754 - DNA, 23 bp, Homo sapiens
aagaccccatggtccatcccctg

SEQ ID NO: 5096755 - DNA, 15 bp, Homo sapiens
aagacccctaaccct

SEQ ID NO: 5096756 - DNA, 12 bp, Homo sapiens
aagacccctgcc

SEQ ID NO: 5096757 - DNA, 14 bp, Homo sapiens
aagacccctgtctt

SEQ ID NO: 5096758 - DNA, 23 bp, Homo sapiens
aagaccccttaccactgctctga

SEQ ID NO: 5096759 - DNA, 14 bp, Homo sapiens
aagacccggccagg

SEQ ID NO: 5096760 - DNA, 17 bp, Homo sapiens
aagaccctaggtgctca

SEQ ID NO: 5096761 - DNA, 17 bp, Homo sapiens
aagaccctctcaaacta

SEQ ID NO: 5096762 - DNA, 13 bp, Homo sapiens
aagaccctgaatc

SEQ ID NO: 5096763 - DNA, 13 bp, Homo sapiens
aagaccctgagac

SEQ ID NO: 5096764 - DNA, 14 bp, Homo sapiens
aagaccctggcttt

SEQ ID NO: 5096765 - DNA, 12 bp, Homo sapiens
aagaccctgtgt

SEQ ID NO: 5096766 - DNA, 13 bp, Homo sapiens
aagacccttctcg

SEQ ID NO: 5096767 - DNA, 16 bp, Homo sapiens
aagaccctttcagaat

SEQ ID NO: 5096768 - DNA, 17 bp, Homo sapiens
aagacccttttgggttt

SEQ ID NO: 5096769 - DNA, 20 bp, Homo sapiens
aagacccttttgggtttctg

SEQ ID NO: 5096770 - DNA, 16 bp, Homo sapiens
aagaccgaattttatt

SEQ ID NO: 5096771 - DNA, 19 bp, Homo sapiens
aagaccgccccagggctat

SEQ ID NO: 5096772 - DNA, 22 bp, Homo sapiens
aagacctaaccagggccagaag

SEQ ID NO: 5096773 - DNA, 16 bp, Homo sapiens
aagacctaaggcagac

SEQ ID NO: 5096774 - DNA, 20 bp, Homo sapiens
aagacctaaggcagacagga

SEQ ID NO: 5096775 - DNA, 22 bp, Homo sapiens
aagacctactgttctaaagctc

SEQ ID NO: 5096776 - DNA, 15 bp, Homo sapiens
aagacctcagggcac

SEQ ID NO: 5096777 - DNA, 19 bp, Homo sapiens
aagacctcatctgtggagc

SEQ ID NO: 5096778 - DNA, 22 bp, Homo sapiens
aagacctcatctgtggagctgc

SEQ ID NO: 5096779 - DNA, 15 bp, Homo sapiens
aagacctcttccctc

SEQ ID NO: 5096780 - DNA, 17 bp, Homo sapiens
aagacctcttccctctg

SEQ ID NO: 5096781 - DNA, 20 bp, Homo sapiens
aagacctgaaagagaggact

SEQ ID NO: 5096782 - DNA, 14 bp, Homo sapiens
aagacctgaatccc

SEQ ID NO: 5096783 - DNA, 19 bp, Homo sapiens
aagacctggggttgtcagc

SEQ ID NO: 5096784 - DNA, 14 bp, Homo sapiens
aagacctgtgaggg

SEQ ID NO: 5096785 - DNA, 17 bp, Homo sapiens
aagacctgttgctagaa

SEQ ID NO: 5096786 - DNA, 20 bp, Homo sapiens
aagaccttctagtgagcctg

SEQ ID NO: 5096787 - DNA, 21 bp, Homo sapiens
aagaccttctagtgagcctgg

SEQ ID NO: 5096788 - DNA, 21 bp, Homo sapiens
aagaccttctccaaatgagat

SEQ ID NO: 5096789 - DNA, 18 bp, Homo sapiens
aagaccttctccctagcc

SEQ ID NO: 5096790 - DNA, 21 bp, Homo sapiens
aagacctttggagcaaagctg

SEQ ID NO: 5096791 - DNA, 21 bp, Homo sapiens
aagacgaggccctcgggccca

SEQ ID NO: 5096792 - DNA, 13 bp, Homo sapiens
aagacgaggggca

SEQ ID NO: 5096793 - DNA, 14 bp, Homo sapiens
aagacgaggggcag

SEQ ID NO: 5096794 - DNA, 22 bp, Homo sapiens
aagacgcactttggcttataat

SEQ ID NO: 5096795 - DNA, 14 bp, Homo sapiens
aagacgccctctat

SEQ ID NO: 5096796 - DNA, 15 bp, Homo sapiens
aagacgcctgagctc

SEQ ID NO: 5096797 - DNA, 23 bp, Homo sapiens
aagacgccttcatctgggacaaa

SEQ ID NO: 5096798 - DNA, 17 bp, Homo sapiens
aagacgcctttctcctc

SEQ ID NO: 5096799 - DNA, 22 bp, Homo sapiens
aagacgctgtgctgccctgccc

SEQ ID NO: 5096800 - DNA, 23 bp, Homo sapiens
aagacgctgtgctgccctgccca

SEQ ID NO: 5096801 - DNA, 23 bp, Homo sapiens
aagacggaatgaccagaaaattt

SEQ ID NO: 5096802 - DNA, 12 bp, Homo sapiens
aagacggaggag

SEQ ID NO: 5096803 - DNA, 22 bp, Homo sapiens
aagacggaggaggggaaggggc

SEQ ID NO: 5096804 - DNA, 21 bp, Homo sapiens
aagacggcacggtcttccctc

SEQ ID NO: 5096805 - DNA, 18 bp, Homo sapiens
aagacgggaggggaggca

SEQ ID NO: 5096806 - DNA, 19 bp, Homo sapiens
aagacggttaaatactgtg

SEQ ID NO: 5096807 - DNA, 22 bp, Homo sapiens
aagacgtaaagaattttcatcc

SEQ ID NO: 5096808 - DNA, 15 bp, Homo sapiens
aagacgtatgtaaca

SEQ ID NO: 5096809 - DNA, 18 bp, Homo sapiens
aagacgtcccttttttct

SEQ ID NO: 5096810 - DNA, 22 bp, Homo sapiens
aagacgtcctggaatgaagcat

SEQ ID NO: 5096811 - DNA, 22 bp, Homo sapiens
aagacgtctccccttctctgcc

SEQ ID NO: 5096812 - DNA, 20 bp, Homo sapiens
aagacgtctctttttggtaa

SEQ ID NO: 5096813 - DNA, 18 bp, Homo sapiens
aagacgtgaatgtctcag

SEQ ID NO: 5096814 - DNA, 15 bp, Homo sapiens
aagaaaaaaaccaaa

SEQ ID NO: 5096815 - DNA, 16 bp, Homo sapiens
aagaaaaaaagaaaaa

SEQ ID NO: 5096816 - DNA, 14 bp, Homo sapiens
aagaaaaaaagcaa

SEQ ID NO: 5096817 - DNA, 18 bp, Homo sapiens
aagaaaaaaagcacaaag

SEQ ID NO: 5096818 - DNA, 19 bp, Homo sapiens
aagaaaaaaagcacaaagt

SEQ ID NO: 5096819 - DNA, 13 bp, Homo sapiens
aagaaaaaaagct

SEQ ID NO: 5096820 - DNA, 14 bp, Homo sapiens
aagaaaaaaataat

SEQ ID NO: 5096821 - DNA, 20 bp, Homo sapiens
aagaaaaaaataattttatg

SEQ ID NO: 5096822 - DNA, 14 bp, Homo sapiens
aagaaaaaaatact

SEQ ID NO: 5096823 - DNA, 13 bp, Homo sapiens
aagaaaaaaatat

SEQ ID NO: 5096824 - DNA, 21 bp, Homo sapiens
aagaaaaaaatatattttatg

SEQ ID NO: 5096825 - DNA, 14 bp, Homo sapiens
aagaaaaaaatgta

SEQ ID NO: 5096826 - DNA, 15 bp, Homo sapiens
aagaaaaaaatgtat

SEQ ID NO: 5096827 - DNA, 16 bp, Homo sapiens
aagaaaaaaatgtatt

SEQ ID NO: 5096828 - DNA, 21 bp, Homo sapiens
aagaaaaaaatgtattttatg

SEQ ID NO: 5096829 - DNA, 17 bp, Homo sapiens
aagaaaaaaattgaaat

SEQ ID NO: 5096830 - DNA, 21 bp, Homo sapiens
aagaaaaaaattgaaatgtaa

SEQ ID NO: 5096831 - DNA, 13 bp, Homo sapiens
aagaaaaaacaac

SEQ ID NO: 5096832 - DNA, 16 bp, Homo sapiens
aagaaaaaagcttata

SEQ ID NO: 5096833 - DNA, 12 bp, Homo sapiens
aagaaaaaagtc

SEQ ID NO: 5096834 - DNA, 20 bp, Homo sapiens
aagaaaaaagtgcaacttga

SEQ ID NO: 5096835 - DNA, 19 bp, Homo sapiens
aagaaaaaatattttccct

SEQ ID NO: 5096836 - DNA, 12 bp, Homo sapiens
aagaaaaacaaa

SEQ ID NO: 5096837 - DNA, 20 bp, Homo sapiens
aagaaaaacaaactcgtttt

SEQ ID NO: 5096838 - DNA, 14 bp, Homo sapiens
aagaaaaacaaagt

SEQ ID NO: 5096839 - DNA, 13 bp, Homo sapiens
aagaaaaacaagt

SEQ ID NO: 5096840 - DNA, 17 bp, Homo sapiens
aagaaaaaccacagata

SEQ ID NO: 5096841 - DNA, 14 bp, Homo sapiens
aagaaaaactgttt

SEQ ID NO: 5096842 - DNA, 16 bp, Homo sapiens
aagaaaaagataagaa

SEQ ID NO: 5096843 - DNA, 12 bp, Homo sapiens
aagaaaaagcaa

SEQ ID NO: 5096844 - DNA, 13 bp, Homo sapiens
aagaaaaagcaaa

SEQ ID NO: 5096845 - DNA, 18 bp, Homo sapiens
aagaaaaaggacaaataa

SEQ ID NO: 5096846 - DNA, 17 bp, Homo sapiens
aagaaaaaggatgcaca

SEQ ID NO: 5096847 - DNA, 16 bp, Homo sapiens
aagaaaaaggctggct

SEQ ID NO: 5096848 - DNA, 20 bp, Homo sapiens
aagaaaaagtcatccaatct

SEQ ID NO: 5096849 - DNA, 19 bp, Homo sapiens
aagaaaaataaaatttcct

SEQ ID NO: 5096850 - DNA, 15 bp, Homo sapiens
aagaaaaataaagaa

SEQ ID NO: 5096851 - DNA, 23 bp, Homo sapiens
aagaaaaataccatgtctctaag

SEQ ID NO: 5096852 - DNA, 18 bp, Homo sapiens
aagaaaaatataaaaaca

SEQ ID NO: 5096853 - DNA, 16 bp, Homo sapiens
aagaaaaatcagtttt

SEQ ID NO: 5096854 - DNA, 18 bp, Homo sapiens
aagaaaaatcagtttttg

SEQ ID NO: 5096855 - DNA, 22 bp, Homo sapiens
aagaaaaatcatgtttgctctc

SEQ ID NO: 5096856 - DNA, 13 bp, Homo sapiens
aagaaaaatctca

SEQ ID NO: 5096857 - DNA, 14 bp, Homo sapiens
aagaaaaatgaaaa

SEQ ID NO: 5096858 - DNA, 18 bp, Homo sapiens
aagaaaaatgagcctggc

SEQ ID NO: 5096859 - DNA, 21 bp, Homo sapiens
aagaaaaattcacaagctaac

SEQ ID NO: 5096860 - DNA, 15 bp, Homo sapiens
aagaaaaatttctgg

SEQ ID NO: 5096861 - DNA, 12 bp, Homo sapiens
aagaaaacaaaa

SEQ ID NO: 5096862 - DNA, 12 bp, Homo sapiens
aagaaaacaaac

SEQ ID NO: 5096863 - DNA, 14 bp, Homo sapiens
aagaaaacaaccaa

SEQ ID NO: 5096864 - DNA, 14 bp, Homo sapiens
aagaaaacaacttc

SEQ ID NO: 5096865 - DNA, 18 bp, Homo sapiens
aagaaaacacacaaaaga

SEQ ID NO: 5096866 - DNA, 21 bp, Homo sapiens
aagaaaacacacaaaagatta

SEQ ID NO: 5096867 - DNA, 23 bp, Homo sapiens
aagaaaacacacaaaagattatg

SEQ ID NO: 5096868 - DNA, 12 bp, Homo sapiens
aagaaaacagta

SEQ ID NO: 5096869 - DNA, 12 bp, Homo sapiens
aagaaaacattc

SEQ ID NO: 5096870 - DNA, 17 bp, Homo sapiens
aagaaaacattccagat

SEQ ID NO: 5096871 - DNA, 21 bp, Homo sapiens
aagaaaacatttaacataatg

SEQ ID NO: 5096872 - DNA, 13 bp, Homo sapiens
aagaaaacatttt

SEQ ID NO: 5096873 - DNA, 17 bp, Homo sapiens
aagaaaaccaaaataaa

SEQ ID NO: 5096874 - DNA, 18 bp, Homo sapiens
aagaaaaccaaaataaaa

SEQ ID NO: 5096875 - DNA, 13 bp, Homo sapiens
aagaaaaccaaac

SEQ ID NO: 5096876 - DNA, 17 bp, Homo sapiens
aagaaaaccctaagtgt

SEQ ID NO: 5096877 - DNA, 22 bp, Homo sapiens
aagaaaaccctaagtgtggatg

SEQ ID NO: 5096878 - DNA, 18 bp, Homo sapiens
aagaaaactacatgtaaa

SEQ ID NO: 5096879 - DNA, 19 bp, Homo sapiens
aagaaaactacatgtaaaa

SEQ ID NO: 5096880 - DNA, 20 bp, Homo sapiens
aagaaaactacatgtaaaat

SEQ ID NO: 5096881 - DNA, 14 bp, Homo sapiens
aagaaaacttttgt

SEQ ID NO: 5096882 - DNA, 13 bp, Homo sapiens
aagaaaagacaaa

SEQ ID NO: 5096883 - DNA, 23 bp, Homo sapiens
aagaaaagacattgaaagctcta

SEQ ID NO: 5096884 - DNA, 15 bp, Homo sapiens
aagaaaagacatttt

SEQ ID NO: 5096885 - DNA, 13 bp, Homo sapiens
aagaaaagacctt

SEQ ID NO: 5096886 - DNA, 16 bp, Homo sapiens
aagaaaagagaagaag

SEQ ID NO: 5096887 - DNA, 16 bp, Homo sapiens
aagaaaagagctttct

SEQ ID NO: 5096888 - DNA, 11 bp, Homo sapiens
aagaaaagatg

SEQ ID NO: 5096889 - DNA, 13 bp, Homo sapiens
aagaaaagatgaa

SEQ ID NO: 5096890 - DNA, 23 bp, Homo sapiens
aagaaaagatgcactttgcttta

SEQ ID NO: 5096891 - DNA, 12 bp, Homo sapiens
aagaaaagcact

SEQ ID NO: 5096892 - DNA, 17 bp, Homo sapiens
aagaaaagcacttttgt

SEQ ID NO: 5096893 - DNA, 22 bp, Homo sapiens
aagaaaagcagacgcagcagct

SEQ ID NO: 5096894 - DNA, 18 bp, Homo sapiens
aagaaaagcattttcagt

SEQ ID NO: 5096895 - DNA, 20 bp, Homo sapiens
aagaaaagccgaaagggtta

SEQ ID NO: 5096896 - DNA, 17 bp, Homo sapiens
aagaaaagcctgaacta

SEQ ID NO: 5096897 - DNA, 18 bp, Homo sapiens
aagaaaaggaaatgaaca

SEQ ID NO: 5096898 - DNA, 19 bp, Homo sapiens
aagaaaaggaaatgaacat

SEQ ID NO: 5096899 - DNA, 18 bp, Homo sapiens
aagaaaaggaatgcaaga

SEQ ID NO: 5096900 - DNA, 15 bp, Homo sapiens
aagaaaaggacaaat

SEQ ID NO: 5096901 - DNA, 13 bp, Homo sapiens
aagaaaaggattt

SEQ ID NO: 5096902 - DNA, 13 bp, Homo sapiens
aagaaaaggcaaa

SEQ ID NO: 5096903 - DNA, 20 bp, Homo sapiens
aagaaaaggcaaaagactgg

SEQ ID NO: 5096904 - DNA, 22 bp, Homo sapiens
aagaaaaggttcttactgcttg

SEQ ID NO: 5096905 - DNA, 16 bp, Homo sapiens
aagaaaagtaatgaag

SEQ ID NO: 5096906 - DNA, 22 bp, Homo sapiens
aagaaaagtaggtttacattca

SEQ ID NO: 5096907 - DNA, 13 bp, Homo sapiens
aagaaaagtattt

SEQ ID NO: 5096908 - DNA, 21 bp, Homo sapiens
aagaaaagtattttgaagttt

SEQ ID NO: 5096909 - DNA, 23 bp, Homo sapiens
aagaaaagtattttgaagtttac

SEQ ID NO: 5096910 - DNA, 20 bp, Homo sapiens
aagaaaagtgcatatttatc

SEQ ID NO: 5096911 - DNA, 22 bp, Homo sapiens
aagaaaagtgcatatttatcca

SEQ ID NO: 5096912 - DNA, 12 bp, Homo sapiens
aagaaaagtgtg

SEQ ID NO: 5096913 - DNA, 22 bp, Homo sapiens
aagaaaagttcttaaaacacta

SEQ ID NO: 5096914 - DNA, 22 bp, Homo sapiens
aagaaaagttgggctttcacaa

SEQ ID NO: 5096915 - DNA, 18 bp, Homo sapiens
aagaaaagtttataaaag

SEQ ID NO: 5096916 - DNA, 13 bp, Homo sapiens
aagaaaataaaaa

SEQ ID NO: 5096917 - DNA, 23 bp, Homo sapiens
aagaaaataaaaaaaagaaaaaa

SEQ ID NO: 5096918 - DNA, 22 bp, Homo sapiens
aagaaaataaaattaagaatgt

SEQ ID NO: 5096919 - DNA, 15 bp, Homo sapiens
aagaaaatagtggtg

SEQ ID NO: 5096920 - DNA, 21 bp, Homo sapiens
aagaaaatagtggtgtgattt

SEQ ID NO: 5096921 - DNA, 11 bp, Homo sapiens
aagaaaatatc

SEQ ID NO: 5096922 - DNA, 13 bp, Homo sapiens
aagaaaatatcac

SEQ ID NO: 5096923 - DNA, 11 bp, Homo sapiens
aagaaaatatt

SEQ ID NO: 5096924 - DNA, 13 bp, Homo sapiens
aagaaaatattta

SEQ ID NO: 5096925 - DNA, 20 bp, Homo sapiens
aagaaaatattttgtctaaa

SEQ ID NO: 5096926 - DNA, 14 bp, Homo sapiens
aagaaaatcaatga

SEQ ID NO: 5096927 - DNA, 15 bp, Homo sapiens
aagaaaatctttata

SEQ ID NO: 5096928 - DNA, 12 bp, Homo sapiens
aagaaaatgaag

SEQ ID NO: 5096929 - DNA, 22 bp, Homo sapiens
aagaaaatgaatttgactggtt

SEQ ID NO: 5096930 - DNA, 16 bp, Homo sapiens
aagaaaatgactttat

SEQ ID NO: 5096931 - DNA, 18 bp, Homo sapiens
aagaaaatgactttattt

SEQ ID NO: 5096932 - DNA, 19 bp, Homo sapiens
aagaaaatggaaagaagga

SEQ ID NO: 5096933 - DNA, 20 bp, Homo sapiens
aagaaaatggaaagaaggaa

SEQ ID NO: 5096934 - DNA, 21 bp, Homo sapiens
aagaaaatggaaagaaggaaa

SEQ ID NO: 5096935 - DNA, 18 bp, Homo sapiens
aagaaaatggctaataaa

SEQ ID NO: 5096936 - DNA, 12 bp, Homo sapiens
aagaaaatgtct

SEQ ID NO: 5096937 - DNA, 12 bp, Homo sapiens
aagaaaatgtgt

SEQ ID NO: 5096938 - DNA, 13 bp, Homo sapiens
aagaaaatgtgta

SEQ ID NO: 5096939 - DNA, 15 bp, Homo sapiens
aagaaaatgtgtctg

SEQ ID NO: 5096940 - DNA, 22 bp, Homo sapiens
aagaaaatgttacggcatcaca

SEQ ID NO: 5096941 - DNA, 12 bp, Homo sapiens
aagaaaattata

SEQ ID NO: 5096942 - DNA, 15 bp, Homo sapiens
aagaaaattcctata

SEQ ID NO: 5096943 - DNA, 12 bp, Homo sapiens
aagaaaattctc

SEQ ID NO: 5096944 - DNA, 12 bp, Homo sapiens
aagaaaattgcc

SEQ ID NO: 5096945 - DNA, 15 bp, Homo sapiens
aagaaaattgccaaa

SEQ ID NO: 5096946 - DNA, 16 bp, Homo sapiens
aagaaaattgccaaaa

SEQ ID NO: 5096947 - DNA, 12 bp, Homo sapiens
aagaaaatttac

SEQ ID NO: 5096948 - DNA, 15 bp, Homo sapiens
aagaaaattttgcag

SEQ ID NO: 5096949 - DNA, 19 bp, Homo sapiens
aagaaaatttttgtagtag

SEQ ID NO: 5096950 - DNA, 22 bp, Homo sapiens
aagaaaatttttgtagtagcgt

SEQ ID NO: 5096951 - DNA, 12 bp, Homo sapiens
aagaaacaaaaa

SEQ ID NO: 5096952 - DNA, 14 bp, Homo sapiens
aagaaacaaagatg

SEQ ID NO: 5096953 - DNA, 15 bp, Homo sapiens
aagaaacaaagatgt

SEQ ID NO: 5096954 - DNA, 19 bp, Homo sapiens
aagaaacaactctttgaga

SEQ ID NO: 5096955 - DNA, 16 bp, Homo sapiens
aagaaacaaggttttc

SEQ ID NO: 5096956 - DNA, 21 bp, Homo sapiens
aagaaacacagcatgcattta

SEQ ID NO: 5096957 - DNA, 20 bp, Homo sapiens
aagaaacaccacttaatctt

SEQ ID NO: 5096958 - DNA, 16 bp, Homo sapiens
aagaaacaccagtgtt

SEQ ID NO: 5096959 - DNA, 12 bp, Homo sapiens
aagaaacacttt

SEQ ID NO: 5096960 - DNA, 19 bp, Homo sapiens
aagaaacaggccagataag

SEQ ID NO: 5096961 - DNA, 14 bp, Homo sapiens
aagaaacaggggat

SEQ ID NO: 5096962 - DNA, 20 bp, Homo sapiens
aagaaacaggggatcaaagt

SEQ ID NO: 5096963 - DNA, 16 bp, Homo sapiens
aagaaacagtttaaca

SEQ ID NO: 5096964 - DNA, 12 bp, Homo sapiens
aagaaacattta

SEQ ID NO: 5096965 - DNA, 13 bp, Homo sapiens
aagaaacatttta

SEQ ID NO: 5096966 - DNA, 17 bp, Homo sapiens
aagaaacccttgctgct

SEQ ID NO: 5096967 - DNA, 19 bp, Homo sapiens
aagaaaccttgctctcctc

SEQ ID NO: 5096968 - DNA, 24 bp, Homo sapiens
aagaaactaaaaatatagcaaatg

SEQ ID NO: 5096969 - DNA, 20 bp, Homo sapiens
aagaaactatgaagatctga

SEQ ID NO: 5096970 - DNA, 18 bp, Homo sapiens
aagaaactcacgatgaaa

SEQ ID NO: 5096971 - DNA, 13 bp, Homo sapiens
aagaaactgaata

SEQ ID NO: 5096972 - DNA, 16 bp, Homo sapiens
aagaaactgaggaatt

SEQ ID NO: 5096973 - DNA, 19 bp, Homo sapiens
aagaaactgaggaattttc

SEQ ID NO: 5096974 - DNA, 21 bp, Homo sapiens
aagaaactgaggaattttctt

SEQ ID NO: 5096975 - DNA, 21 bp, Homo sapiens
aagaaactgattttagctcat

SEQ ID NO: 5096976 - DNA, 18 bp, Homo sapiens
aagaaactggtccatgta

SEQ ID NO: 5096977 - DNA, 22 bp, Homo sapiens
aagaaacttaccaattgatgtt

SEQ ID NO: 5096978 - DNA, 16 bp, Homo sapiens
aagaaacttggctgga

SEQ ID NO: 5096979 - DNA, 17 bp, Homo sapiens
aagaaacttggctggaa

SEQ ID NO: 5096980 - DNA, 11 bp, Homo sapiens
aagaaactttc

SEQ ID NO: 5096981 - DNA, 15 bp, Homo sapiens
aagaaacttttctga

SEQ ID NO: 5096982 - DNA, 16 bp, Homo sapiens
aagaaacttttgaaaa

SEQ ID NO: 5096983 - DNA, 17 bp, Homo sapiens
aagaaacttttgtaaag

SEQ ID NO: 5096984 - DNA, 14 bp, Homo sapiens
aagaaactttttta

SEQ ID NO: 5096985 - DNA, 13 bp, Homo sapiens
aagaaagaaaaaa

SEQ ID NO: 5096986 - DNA, 11 bp, Homo sapiens
aagaaagaaag

SEQ ID NO: 5096987 - DNA, 12 bp, Homo sapiens
aagaaagaaatg

SEQ ID NO: 5096988 - DNA, 15 bp, Homo sapiens
aagaaagaaatggct

SEQ ID NO: 5096989 - DNA, 16 bp, Homo sapiens
aagaaagaacggaaga

SEQ ID NO: 5096990 - DNA, 13 bp, Homo sapiens
aagaaagaaggaa

SEQ ID NO: 5096991 - DNA, 14 bp, Homo sapiens
aagaaagaaggaag

SEQ ID NO: 5096992 - DNA, 19 bp, Homo sapiens
aagaaagaattgcagtaaa

SEQ ID NO: 5096993 - DNA, 20 bp, Homo sapiens
aagaaagactatctaaatgt

SEQ ID NO: 5096994 - DNA, 13 bp, Homo sapiens
aagaaagactcta

SEQ ID NO: 5096995 - DNA, 16 bp, Homo sapiens
aagaaagagagaaaat

SEQ ID NO: 5096996 - DNA, 12 bp, Homo sapiens
aagaaagaggaa

SEQ ID NO: 5096997 - DNA, 20 bp, Homo sapiens
aagacgtgatgccaggacca

SEQ ID NO: 5096998 - DNA, 18 bp, Homo sapiens
aagacgtggactcctctt

SEQ ID NO: 5096999 - DNA, 20 bp, Homo sapiens
aagacgtggtctagaccagg

SEQ ID NO: 5097000 - DNA, 15 bp, Homo sapiens
aagacgtgtttgtgt

SEQ ID NO: 5097001 - DNA, 17 bp, Homo sapiens
aagacgttttataagca

SEQ ID NO: 5097002 - DNA, 18 bp, Homo sapiens
aagacgttttataagcat

SEQ ID NO: 5097003 - DNA, 12 bp, Homo sapiens
aagactaaaagt

SEQ ID NO: 5097004 - DNA, 21 bp, Homo sapiens
aagactaacaaaggcagctgt

SEQ ID NO: 5097005 - DNA, 22 bp, Homo sapiens
aagactaacaaaggcagctgtg

SEQ ID NO: 5097006 - DNA, 23 bp, Homo sapiens
aagactaagggggtgaccatgca

SEQ ID NO: 5097007 - DNA, 20 bp, Homo sapiens
aagactaatgctttctgtgg

SEQ ID NO: 5097008 - DNA, 19 bp, Homo sapiens
aagactaatttaaaaaata

SEQ ID NO: 5097009 - DNA, 13 bp, Homo sapiens
aagactacctggg

SEQ ID NO: 5097010 - DNA, 23 bp, Homo sapiens
aagactagactactcaatattaa

SEQ ID NO: 5097011 - DNA, 22 bp, Homo sapiens
aagactagaggccagggcagca

SEQ ID NO: 5097012 - DNA, 20 bp, Homo sapiens
aagactagccagccaggaag

SEQ ID NO: 5097013 - DNA, 13 bp, Homo sapiens
aagactagcccct

SEQ ID NO: 5097014 - DNA, 14 bp, Homo sapiens
aagactatatatat

SEQ ID NO: 5097015 - DNA, 21 bp, Homo sapiens
aagactatatatataaatgta

SEQ ID NO: 5097016 - DNA, 16 bp, Homo sapiens
aagactatctaaatgt

SEQ ID NO: 5097017 - DNA, 17 bp, Homo sapiens
aagactatctacaaaaa

SEQ ID NO: 5097018 - DNA, 16 bp, Homo sapiens
aagactattaagagca

SEQ ID NO: 5097019 - DNA, 17 bp, Homo sapiens
aagactattaagagcaa

SEQ ID NO: 5097020 - DNA, 14 bp, Homo sapiens
aagactcaaatttt

SEQ ID NO: 5097021 - DNA, 13 bp, Homo sapiens
aagactcaatcat

SEQ ID NO: 5097022 - DNA, 12 bp, Homo sapiens
aagactcagggg

SEQ ID NO: 5097023 - DNA, 13 bp, Homo sapiens
aagactcagggga

SEQ ID NO: 5097024 - DNA, 14 bp, Homo sapiens
aagactcagtgttc

SEQ ID NO: 5097025 - DNA, 17 bp, Homo sapiens
aagactcattcttctgt

SEQ ID NO: 5097026 - DNA, 17 bp, Homo sapiens
aagactcattgctggag

SEQ ID NO: 5097027 - DNA, 14 bp, Homo sapiens
aagactccagaaat

SEQ ID NO: 5097028 - DNA, 22 bp, Homo sapiens
aagactcccgccccgggctggc

SEQ ID NO: 5097029 - DNA, 18 bp, Homo sapiens
aagactccctgatcccag

SEQ ID NO: 5097030 - DNA, 13 bp, Homo sapiens
aagactcctcctg

SEQ ID NO: 5097031 - DNA, 18 bp, Homo sapiens
aagactcctcctgggggc

SEQ ID NO: 5097032 - DNA, 17 bp, Homo sapiens
aagactcctctgggcct

SEQ ID NO: 5097033 - DNA, 11 bp, Homo sapiens
aagactcctgc

SEQ ID NO: 5097034 - DNA, 15 bp, Homo sapiens
aagactcctttcctg

SEQ ID NO: 5097035 - DNA, 18 bp, Homo sapiens
aagactcggcttttaatg

SEQ ID NO: 5097036 - DNA, 13 bp, Homo sapiens
aagactctagagt

SEQ ID NO: 5097037 - DNA, 18 bp, Homo sapiens
aagactctccactgacct

SEQ ID NO: 5097038 - DNA, 14 bp, Homo sapiens
aagactctgagcca

SEQ ID NO: 5097039 - DNA, 21 bp, Homo sapiens
aagactctgccttaatttttg

SEQ ID NO: 5097040 - DNA, 22 bp, Homo sapiens
aagactctgccttaatttttga

SEQ ID NO: 5097041 - DNA, 13 bp, Homo sapiens
aagactctggagc

SEQ ID NO: 5097042 - DNA, 22 bp, Homo sapiens
aagactctgtctcaataaataa

SEQ ID NO: 5097043 - DNA, 13 bp, Homo sapiens
aagactgaaagaa

SEQ ID NO: 5097044 - DNA, 18 bp, Homo sapiens
aagactgaaatggcttct

SEQ ID NO: 5097045 - DNA, 15 bp, Homo sapiens
aagactgaagatggc

SEQ ID NO: 5097046 - DNA, 15 bp, Homo sapiens
aagactgaatgtttt

SEQ ID NO: 5097047 - DNA, 17 bp, Homo sapiens
aagactgataattttac

SEQ ID NO: 5097048 - DNA, 20 bp, Homo sapiens
aagactgataattttacaat

SEQ ID NO: 5097049 - DNA, 16 bp, Homo sapiens
aagactgcacatcaaa

SEQ ID NO: 5097050 - DNA, 22 bp, Homo sapiens
aagactgcagaacccccaggtg

SEQ ID NO: 5097051 - DNA, 15 bp, Homo sapiens
aagactgcagctgct

SEQ ID NO: 5097052 - DNA, 12 bp, Homo sapiens
aagactgcctcc

SEQ ID NO: 5097053 - DNA, 12 bp, Homo sapiens
aagactgccttc

SEQ ID NO: 5097054 - DNA, 17 bp, Homo sapiens
aagactgctaaatgcac

SEQ ID NO: 5097055 - DNA, 15 bp, Homo sapiens
aagactgctcccggc

SEQ ID NO: 5097056 - DNA, 20 bp, Homo sapiens
aagactgctgtggccaggag

SEQ ID NO: 5097057 - DNA, 22 bp, Homo sapiens
aagactggaagctaatttgcat

SEQ ID NO: 5097058 - DNA, 21 bp, Homo sapiens
aagactggaaggtggggacag

SEQ ID NO: 5097059 - DNA, 14 bp, Homo sapiens
aagactggatttgc

SEQ ID NO: 5097060 - DNA, 19 bp, Homo sapiens
aagactggatttgcagaag

SEQ ID NO: 5097061 - DNA, 13 bp, Homo sapiens
aagactggcccag

SEQ ID NO: 5097062 - DNA, 22 bp, Homo sapiens
aagactggcccagtgccagcaa

SEQ ID NO: 5097063 - DNA, 22 bp, Homo sapiens
aagactggcttttattaatgca

SEQ ID NO: 5097064 - DNA, 13 bp, Homo sapiens
aagactgggcccc

SEQ ID NO: 5097065 - DNA, 16 bp, Homo sapiens
aagactggtattctct

SEQ ID NO: 5097066 - DNA, 17 bp, Homo sapiens
aagactggtttgtttgc

SEQ ID NO: 5097067 - DNA, 18 bp, Homo sapiens
aagactggtttgtttgct

SEQ ID NO: 5097068 - DNA, 16 bp, Homo sapiens
aagactggttttctgc

SEQ ID NO: 5097069 - DNA, 20 bp, Homo sapiens
aagactggttttctgccaat

SEQ ID NO: 5097070 - DNA, 21 bp, Homo sapiens
aagactgtaaattccaaagat

SEQ ID NO: 5097071 - DNA, 22 bp, Homo sapiens
aagactgtaaattccaaagatc

SEQ ID NO: 5097072 - DNA, 23 bp, Homo sapiens
aagactgtaaattccaaagatct

SEQ ID NO: 5097073 - DNA, 13 bp, Homo sapiens
aagactgtaatga

SEQ ID NO: 5097074 - DNA, 16 bp, Homo sapiens
aagactgtacaaagta

SEQ ID NO: 5097075 - DNA, 11 bp, Homo sapiens
aagactgtact

SEQ ID NO: 5097076 - DNA, 19 bp, Homo sapiens
aagactgtcaaatgaactt

SEQ ID NO: 5097077 - DNA, 20 bp, Homo sapiens
aagactgtcaaatgaacttt

SEQ ID NO: 5097078 - DNA, 17 bp, Homo sapiens
aagactgtgcagaagac

SEQ ID NO: 5097079 - DNA, 22 bp, Homo sapiens
aagactgtgcggcacaggaaac

SEQ ID NO: 5097080 - DNA, 23 bp, Homo sapiens
aagactgtgcggcacaggaaaca

SEQ ID NO: 5097081 - DNA, 17 bp, Homo sapiens
aagactgtgctgagaag

SEQ ID NO: 5097082 - DNA, 18 bp, Homo sapiens
aagactgtggctgctagc

SEQ ID NO: 5097083 - DNA, 20 bp, Homo sapiens
aagactgtgggtggggaggc

SEQ ID NO: 5097084 - DNA, 22 bp, Homo sapiens
aagactgttgtgatcttgcatt

SEQ ID NO: 5097085 - DNA, 23 bp, Homo sapiens
aagactgttgtgatcttgcattc

SEQ ID NO: 5097086 - DNA, 20 bp, Homo sapiens
aagactgtttttaagtaact

SEQ ID NO: 5097087 - DNA, 24 bp, Homo sapiens
aagacttaaagggcccaatgaatt

SEQ ID NO: 5097088 - DNA, 13 bp, Homo sapiens
aagacttaagatt

SEQ ID NO: 5097089 - DNA, 13 bp, Homo sapiens
aagacttaatatg

SEQ ID NO: 5097090 - DNA, 18 bp, Homo sapiens
aagacttaatctttgctg

SEQ ID NO: 5097091 - DNA, 17 bp, Homo sapiens
aagacttacctgaataa

SEQ ID NO: 5097092 - DNA, 20 bp, Homo sapiens
aagacttagatctgagccct

SEQ ID NO: 5097093 - DNA, 21 bp, Homo sapiens
aagacttcaaaatattgagca

SEQ ID NO: 5097094 - DNA, 19 bp, Homo sapiens
aagacttcaatattaaatg

SEQ ID NO: 5097095 - DNA, 15 bp, Homo sapiens
aagacttcagattcc

SEQ ID NO: 5097096 - DNA, 22 bp, Homo sapiens
aagacttcagtatgttgtcaaa

SEQ ID NO: 5097097 - DNA, 19 bp, Homo sapiens
aagacttcatttaacactg

SEQ ID NO: 5097098 - DNA, 19 bp, Homo sapiens
aagacttccaccctggaga

SEQ ID NO: 5097099 - DNA, 23 bp, Homo sapiens
aagacttccagctttctctttgt

SEQ ID NO: 5097100 - DNA, 23 bp, Homo sapiens
aagacttccccaagcctggcagg

SEQ ID NO: 5097101 - DNA, 13 bp, Homo sapiens
aagacttcctctc

SEQ ID NO: 5097102 - DNA, 18 bp, Homo sapiens
aagacttctggtgctgct

SEQ ID NO: 5097103 - DNA, 20 bp, Homo sapiens
aagacttctggtgctgctgg

SEQ ID NO: 5097104 - DNA, 21 bp, Homo sapiens
aagacttctggtgctgctggg

SEQ ID NO: 5097105 - DNA, 13 bp, Homo sapiens
aagacttgagaag

SEQ ID NO: 5097106 - DNA, 13 bp, Homo sapiens
aagacttgagaca

SEQ ID NO: 5097107 - DNA, 22 bp, Homo sapiens
aagacttgagacaatgttttct

SEQ ID NO: 5097108 - DNA, 20 bp, Homo sapiens
aagacttgcatttaaatgtg

SEQ ID NO: 5097109 - DNA, 23 bp, Homo sapiens
aagacttggttggtagggtggga

SEQ ID NO: 5097110 - DNA, 14 bp, Homo sapiens
aagacttgtgctta

SEQ ID NO: 5097111 - DNA, 17 bp, Homo sapiens
aagacttgtttctttct

SEQ ID NO: 5097112 - DNA, 18 bp, Homo sapiens
aagactttaaaagatgaa

SEQ ID NO: 5097113 - DNA, 21 bp, Homo sapiens
aagactttccccatactctgt

SEQ ID NO: 5097114 - DNA, 17 bp, Homo sapiens
aagactttgatccatgt

SEQ ID NO: 5097115 - DNA, 21 bp, Homo sapiens
aagacttttatgtgagatttc

SEQ ID NO: 5097116 - DNA, 21 bp, Homo sapiens
aagacttttccaaccctcatc

SEQ ID NO: 5097117 - DNA, 9 bp, Homo sapiens
aagagaaaa

SEQ ID NO: 5097118 - DNA, 18 bp, Homo sapiens
aagagaaaaaaaaacaca

SEQ ID NO: 5097119 - DNA, 12 bp, Homo sapiens
aagagaaaaaag

SEQ ID NO: 5097120 - DNA, 20 bp, Homo sapiens
aagagaaaaaccaatgattc

SEQ ID NO: 5097121 - DNA, 11 bp, Homo sapiens
aagagaaaaag

SEQ ID NO: 5097122 - DNA, 18 bp, Homo sapiens
aagagaaaaagaaatgca

SEQ ID NO: 5097123 - DNA, 16 bp, Homo sapiens
aagagaaaaagccctc

SEQ ID NO: 5097124 - DNA, 17 bp, Homo sapiens
aagagaaaaagccctct

SEQ ID NO: 5097125 - DNA, 16 bp, Homo sapiens
aagagaaaacctagta

SEQ ID NO: 5097126 - DNA, 13 bp, Homo sapiens
aagagaaaagaaa

SEQ ID NO: 5097127 - DNA, 20 bp, Homo sapiens
aagagaaaagacagggtggg

SEQ ID NO: 5097128 - DNA, 12 bp, Homo sapiens
aagagaaaagat

SEQ ID NO: 5097129 - DNA, 20 bp, Homo sapiens
aagagaaaagggaaaaaaga

SEQ ID NO: 5097130 - DNA, 12 bp, Homo sapiens
aagagaaaatat

SEQ ID NO: 5097131 - DNA, 16 bp, Homo sapiens
aagagaaaatattact

SEQ ID NO: 5097132 - DNA, 18 bp, Homo sapiens
aagagaaaatgctttctc

SEQ ID NO: 5097133 - DNA, 18 bp, Homo sapiens
aagagaaaattgaattta

SEQ ID NO: 5097134 - DNA, 16 bp, Homo sapiens
aagagaaaattgcact

SEQ ID NO: 5097135 - DNA, 21 bp, Homo sapiens
aagagaaacagggtgttgtca

SEQ ID NO: 5097136 - DNA, 15 bp, Homo sapiens
aagagaaacctgcca

SEQ ID NO: 5097137 - DNA, 22 bp, Homo sapiens
aagagaaacctgccaaggagca

SEQ ID NO: 5097138 - DNA, 15 bp, Homo sapiens
aagagaaactgtgta

SEQ ID NO: 5097139 - DNA, 11 bp, Homo sapiens
aagagaaactt

SEQ ID NO: 5097140 - DNA, 19 bp, Homo sapiens
aagagaaacttaaatgaac

SEQ ID NO: 5097141 - DNA, 20 bp, Homo sapiens
aagagaaactttatacatta

SEQ ID NO: 5097142 - DNA, 18 bp, Homo sapiens
aagagaaactttgtgcta

SEQ ID NO: 5097143 - DNA, 20 bp, Homo sapiens
aagagaaactttgtgctaca

SEQ ID NO: 5097144 - DNA, 17 bp, Homo sapiens
aagagaaaggcctgcac

SEQ ID NO: 5097145 - DNA, 18 bp, Homo sapiens
aagagaaagtgatttcta

SEQ ID NO: 5097146 - DNA, 14 bp, Homo sapiens
aagagaaatacagc

SEQ ID NO: 5097147 - DNA, 17 bp, Homo sapiens
aagagaaatacagctgg

SEQ ID NO: 5097148 - DNA, 21 bp, Homo sapiens
aagagaaatatatttgtcact

SEQ ID NO: 5097149 - DNA, 22 bp, Homo sapiens
aagagaaatatatttgtcactt

SEQ ID NO: 5097150 - DNA, 18 bp, Homo sapiens
aagagaaatcagaaaaat

SEQ ID NO: 5097151 - DNA, 22 bp, Homo sapiens
aagagaaatcagaaaaattaat

SEQ ID NO: 5097152 - DNA, 14 bp, Homo sapiens
aagagaaatctcat

SEQ ID NO: 5097153 - DNA, 20 bp, Homo sapiens
aagagaaatgaaatattttt

SEQ ID NO: 5097154 - DNA, 16 bp, Homo sapiens
aagagaacaagaggtg

SEQ ID NO: 5097155 - DNA, 14 bp, Homo sapiens
aagagaacatttta

SEQ ID NO: 5097156 - DNA, 21 bp, Homo sapiens
aagagaaccgagcaaagatca

SEQ ID NO: 5097157 - DNA, 11 bp, Homo sapiens
aagagaactcg

SEQ ID NO: 5097158 - DNA, 13 bp, Homo sapiens
aagagaacttttt

SEQ ID NO: 5097159 - DNA, 14 bp, Homo sapiens
aagagaagaagaaa

SEQ ID NO: 5097160 - DNA, 17 bp, Homo sapiens
aagagaagaagaaaaaa

SEQ ID NO: 5097161 - DNA, 13 bp, Homo sapiens
aagagaagagaaa

SEQ ID NO: 5097162 - DNA, 20 bp, Homo sapiens
aagagaagagggcccagccc

SEQ ID NO: 5097163 - DNA, 22 bp, Homo sapiens
aagagaagagggcccagcccag

SEQ ID NO: 5097164 - DNA, 20 bp, Homo sapiens
aagagaagatgcctgttaat

SEQ ID NO: 5097165 - DNA, 21 bp, Homo sapiens
aagagaagcaaacaatggtgt

SEQ ID NO: 5097166 - DNA, 17 bp, Homo sapiens
aagagaagcaaagtggg

SEQ ID NO: 5097167 - DNA, 12 bp, Homo sapiens
aagagaagctga

SEQ ID NO: 5097168 - DNA, 15 bp, Homo sapiens
aagagaagctgctga

SEQ ID NO: 5097169 - DNA, 15 bp, Homo sapiens
aagagaaggaagcca

SEQ ID NO: 5097170 - DNA, 13 bp, Homo sapiens
aagagaaggagca

SEQ ID NO: 5097171 - DNA, 14 bp, Homo sapiens
aagagaaggcacac

SEQ ID NO: 5097172 - DNA, 14 bp, Homo sapiens
aagagaagggaagc

SEQ ID NO: 5097173 - DNA, 22 bp, Homo sapiens
aagagaaggggacttctcttcc

SEQ ID NO: 5097174 - DNA, 17 bp, Homo sapiens
aagagaagtcacaacaa

SEQ ID NO: 5097175 - DNA, 18 bp, Homo sapiens
aagagaagtctcattcgc

SEQ ID NO: 5097176 - DNA, 17 bp, Homo sapiens
aagaaagaggagtgctt

SEQ ID NO: 5097177 - DNA, 23 bp, Homo sapiens
aagaaagaggtgaccccagggca

SEQ ID NO: 5097178 - DNA, 14 bp, Homo sapiens
aagaaagatactta

SEQ ID NO: 5097179 - DNA, 14 bp, Homo sapiens
aagaaagatgtttg

SEQ ID NO: 5097180 - DNA, 17 bp, Homo sapiens
aagaaagattgtaaact

SEQ ID NO: 5097181 - DNA, 22 bp, Homo sapiens
aagaaagattgtaaactaaagt

SEQ ID NO: 5097182 - DNA, 23 bp, Homo sapiens
aagaaagatttgttactgtattt

SEQ ID NO: 5097183 - DNA, 22 bp, Homo sapiens
aagaaagattttatacccttga

SEQ ID NO: 5097184 - DNA, 19 bp, Homo sapiens
aagaaagattttatgtgct

SEQ ID NO: 5097185 - DNA, 20 bp, Homo sapiens
aagaaagcaaaaaataaaat

SEQ ID NO: 5097186 - DNA, 12 bp, Homo sapiens
aagaaagcaact

SEQ ID NO: 5097187 - DNA, 14 bp, Homo sapiens
aagaaagcaacttt

SEQ ID NO: 5097188 - DNA, 20 bp, Homo sapiens
aagaaagcacctgtttttac

SEQ ID NO: 5097189 - DNA, 19 bp, Homo sapiens
aagaaagccaccttgttac

SEQ ID NO: 5097190 - DNA, 18 bp, Homo sapiens
aagaaagccagacaactt

SEQ ID NO: 5097191 - DNA, 19 bp, Homo sapiens
aagaaagccagtcttaaca

SEQ ID NO: 5097192 - DNA, 18 bp, Homo sapiens
aagaaagccctgtgcttt

SEQ ID NO: 5097193 - DNA, 13 bp, Homo sapiens
aagaaagctgctt

SEQ ID NO: 5097194 - DNA, 13 bp, Homo sapiens
aagaaagctgtgg

SEQ ID NO: 5097195 - DNA, 15 bp, Homo sapiens
aagaaagcttccttc

SEQ ID NO: 5097196 - DNA, 14 bp, Homo sapiens
aagaaagcttcttg

SEQ ID NO: 5097197 - DNA, 17 bp, Homo sapiens
aagaaagcttcttgtga

SEQ ID NO: 5097198 - DNA, 15 bp, Homo sapiens
aagaaaggaaagaag

SEQ ID NO: 5097199 - DNA, 20 bp, Homo sapiens
aagaaaggcaaccaataaaa

SEQ ID NO: 5097200 - DNA, 15 bp, Homo sapiens
aagaaaggctgctgt

SEQ ID NO: 5097201 - DNA, 18 bp, Homo sapiens
aagaaaggctgtggaagg

SEQ ID NO: 5097202 - DNA, 20 bp, Homo sapiens
aagaaaggctgttaaataca

SEQ ID NO: 5097203 - DNA, 14 bp, Homo sapiens
aagaaagggaaagc

SEQ ID NO: 5097204 - DNA, 18 bp, Homo sapiens
aagaaagggacccacctg

SEQ ID NO: 5097205 - DNA, 20 bp, Homo sapiens
aagaaagggacccacctgct

SEQ ID NO: 5097206 - DNA, 22 bp, Homo sapiens
aagaaagggagaaggattcttt

SEQ ID NO: 5097207 - DNA, 19 bp, Homo sapiens
aagaaaggggacccaagaa

SEQ ID NO: 5097208 - DNA, 21 bp, Homo sapiens
aagaaaggggcaggagctcag

SEQ ID NO: 5097209 - DNA, 23 bp, Homo sapiens
aagaaaggtgccatgtctttact

SEQ ID NO: 5097210 - DNA, 16 bp, Homo sapiens
aagaaagtaaaaagaa

SEQ ID NO: 5097211 - DNA, 14 bp, Homo sapiens
aagaaagtaaaacc

SEQ ID NO: 5097212 - DNA, 15 bp, Homo sapiens
aagaaagtaaaacca

SEQ ID NO: 5097213 - DNA, 19 bp, Homo sapiens
aagaaagtaatttaatttg

SEQ ID NO: 5097214 - DNA, 14 bp, Homo sapiens
aagaaagtacccag

SEQ ID NO: 5097215 - DNA, 16 bp, Homo sapiens
aagaaagtcagccata

SEQ ID NO: 5097216 - DNA, 23 bp, Homo sapiens
aagaaagtctatctaatgacatg

SEQ ID NO: 5097217 - DNA, 20 bp, Homo sapiens
aagaaagtgaaaaaaacaac

SEQ ID NO: 5097218 - DNA, 17 bp, Homo sapiens
aagaaagtgcagaatca

SEQ ID NO: 5097219 - DNA, 17 bp, Homo sapiens
aagaaagtgggaggtca

SEQ ID NO: 5097220 - DNA, 13 bp, Homo sapiens
aagaaagtggtct

SEQ ID NO: 5097221 - DNA, 20 bp, Homo sapiens
aagaaagtgttttattttca

SEQ ID NO: 5097222 - DNA, 19 bp, Homo sapiens
aagaaagttaggttataag

SEQ ID NO: 5097223 - DNA, 20 bp, Homo sapiens
aagaaagttgcacggctgct

SEQ ID NO: 5097224 - DNA, 22 bp, Homo sapiens
aagaaagttgcacggctgctga

SEQ ID NO: 5097225 - DNA, 13 bp, Homo sapiens
aagaaagtttccc

SEQ ID NO: 5097226 - DNA, 15 bp, Homo sapiens
aagaaagtttcccca

SEQ ID NO: 5097227 - DNA, 18 bp, Homo sapiens
aagaaataaatctatatt

SEQ ID NO: 5097228 - DNA, 12 bp, Homo sapiens
aagaaataagta

SEQ ID NO: 5097229 - DNA, 14 bp, Homo sapiens
aagaaataatagaa

SEQ ID NO: 5097230 - DNA, 12 bp, Homo sapiens
aagaaataattt

SEQ ID NO: 5097231 - DNA, 11 bp, Homo sapiens
aagaaatactc

SEQ ID NO: 5097232 - DNA, 14 bp, Homo sapiens
aagaaatactcctg

SEQ ID NO: 5097233 - DNA, 15 bp, Homo sapiens
aagaaatactgtaca

SEQ ID NO: 5097234 - DNA, 20 bp, Homo sapiens
aagaaatagaacaaggctga

SEQ ID NO: 5097235 - DNA, 23 bp, Homo sapiens
aagaaatagaataggcaaacttt

SEQ ID NO: 5097236 - DNA, 17 bp, Homo sapiens
aagaaatagagccaact

SEQ ID NO: 5097237 - DNA, 13 bp, Homo sapiens
aagaaatatacct

SEQ ID NO: 5097238 - DNA, 15 bp, Homo sapiens
aagaaatatattatt

SEQ ID NO: 5097239 - DNA, 19 bp, Homo sapiens
aagaaatatctgtgaaata

SEQ ID NO: 5097240 - DNA, 21 bp, Homo sapiens
aagaaatatgaaattccagca

SEQ ID NO: 5097241 - DNA, 15 bp, Homo sapiens
aagaaatatgtgaga

SEQ ID NO: 5097242 - DNA, 19 bp, Homo sapiens
aagaaatatgtgagatttt

SEQ ID NO: 5097243 - DNA, 20 bp, Homo sapiens
aagaaatatgtgagattttt

SEQ ID NO: 5097244 - DNA, 15 bp, Homo sapiens
aagaaatatttacct

SEQ ID NO: 5097245 - DNA, 17 bp, Homo sapiens
aagaaatatttacctaa

SEQ ID NO: 5097246 - DNA, 23 bp, Homo sapiens
aagaaatatttggatgttaaatt

SEQ ID NO: 5097247 - DNA, 18 bp, Homo sapiens
aagaaatcacagaatcat

SEQ ID NO: 5097248 - DNA, 20 bp, Homo sapiens
aagaaatcacttaaatacct

SEQ ID NO: 5097249 - DNA, 15 bp, Homo sapiens
aagaaatcatgttat

SEQ ID NO: 5097250 - DNA, 22 bp, Homo sapiens
aagaaatccaatcctagccctc

SEQ ID NO: 5097251 - DNA, 13 bp, Homo sapiens
aagaaatccctgt

SEQ ID NO: 5097252 - DNA, 20 bp, Homo sapiens
aagaaatcgccttatgagaa

SEQ ID NO: 5097253 - DNA, 13 bp, Homo sapiens
aagaaatctattt

SEQ ID NO: 5097254 - DNA, 18 bp, Homo sapiens
aagaaatctcttccataa

SEQ ID NO: 5097255 - DNA, 16 bp, Homo sapiens
aagaaatctttctgga

SEQ ID NO: 5097256 - DNA, 17 bp, Homo sapiens
aagaaatctttctggaa

SEQ ID NO: 5097257 - DNA, 16 bp, Homo sapiens
aagaaatgaaatttta

SEQ ID NO: 5097258 - DNA, 12 bp, Homo sapiens
aagaaatgaaca

SEQ ID NO: 5097259 - DNA, 14 bp, Homo sapiens
aagaaatgacactt

SEQ ID NO: 5097260 - DNA, 15 bp, Homo sapiens
aagaaatgactaatt

SEQ ID NO: 5097261 - DNA, 16 bp, Homo sapiens
aagaaatgactaatta

SEQ ID NO: 5097262 - DNA, 12 bp, Homo sapiens
aagaaatgatgt

SEQ ID NO: 5097263 - DNA, 19 bp, Homo sapiens
aagaaatgcacaatgtctt

SEQ ID NO: 5097264 - DNA, 20 bp, Homo sapiens
aagaaatgcatatgtcacta

SEQ ID NO: 5097265 - DNA, 16 bp, Homo sapiens
aagaaatgctaatgta

SEQ ID NO: 5097266 - DNA, 19 bp, Homo sapiens
aagaaatgctaatgtaatc

SEQ ID NO: 5097267 - DNA, 22 bp, Homo sapiens
aagaaatggcgtctgctctggt

SEQ ID NO: 5097268 - DNA, 18 bp, Homo sapiens
aagaaatggtatgtagag

SEQ ID NO: 5097269 - DNA, 12 bp, Homo sapiens
aagaaatgtacc

SEQ ID NO: 5097270 - DNA, 16 bp, Homo sapiens
aagaaatgtagttgat

SEQ ID NO: 5097271 - DNA, 18 bp, Homo sapiens
aagaaatgtattcctgaa

SEQ ID NO: 5097272 - DNA, 23 bp, Homo sapiens
aagaaatgttataaagtagaact

SEQ ID NO: 5097273 - DNA, 22 bp, Homo sapiens
aagaaattaacacccaaaagaa

SEQ ID NO: 5097274 - DNA, 21 bp, Homo sapiens
aagaaattagggctctaattt

SEQ ID NO: 5097275 - DNA, 15 bp, Homo sapiens
aagaaattatcttta

SEQ ID NO: 5097276 - DNA, 18 bp, Homo sapiens
aagaaattatctttagtt

SEQ ID NO: 5097277 - DNA, 13 bp, Homo sapiens
aagaaattatgtg

SEQ ID NO: 5097278 - DNA, 22 bp, Homo sapiens
aagaaattatgtgccagattta

SEQ ID NO: 5097279 - DNA, 17 bp, Homo sapiens
aagaaattcaagaagta

SEQ ID NO: 5097280 - DNA, 14 bp, Homo sapiens
aagaaattcagaac

SEQ ID NO: 5097281 - DNA, 12 bp, Homo sapiens
aagaaattcagg

SEQ ID NO: 5097282 - DNA, 19 bp, Homo sapiens
aagaaattcattaaagaaa

SEQ ID NO: 5097283 - DNA, 22 bp, Homo sapiens
aagaaattccatacttctctca

SEQ ID NO: 5097284 - DNA, 23 bp, Homo sapiens
aagaaattccatacttctctcag

SEQ ID NO: 5097285 - DNA, 14 bp, Homo sapiens
aagaaattcctgta

SEQ ID NO: 5097286 - DNA, 21 bp, Homo sapiens
aagaaattcttttcaaaagct

SEQ ID NO: 5097287 - DNA, 16 bp, Homo sapiens
aagaaattgcaataac

SEQ ID NO: 5097288 - DNA, 17 bp, Homo sapiens
aagaaattgtttttaac

SEQ ID NO: 5097289 - DNA, 20 bp, Homo sapiens
aagaaatttcaacagttatt

SEQ ID NO: 5097290 - DNA, 14 bp, Homo sapiens
aagaaatttcaggt

SEQ ID NO: 5097291 - DNA, 13 bp, Homo sapiens
aagaaatttgtgg

SEQ ID NO: 5097292 - DNA, 21 bp, Homo sapiens
aagaaattttagatattatca

SEQ ID NO: 5097293 - DNA, 12 bp, Homo sapiens
aagaacaaacac

SEQ ID NO: 5097294 - DNA, 19 bp, Homo sapiens
aagaacaacaacaacaata

SEQ ID NO: 5097295 - DNA, 12 bp, Homo sapiens
aagaacaacact

SEQ ID NO: 5097296 - DNA, 22 bp, Homo sapiens
aagaacaactttagcatcagaa

SEQ ID NO: 5097297 - DNA, 14 bp, Homo sapiens
aagaacaagaattt

SEQ ID NO: 5097298 - DNA, 19 bp, Homo sapiens
aagaacaagctcatctatt

SEQ ID NO: 5097299 - DNA, 22 bp, Homo sapiens
aagaacaagttttggcagccat

SEQ ID NO: 5097300 - DNA, 14 bp, Homo sapiens
aagaacaataatga

SEQ ID NO: 5097301 - DNA, 16 bp, Homo sapiens
aagaacacagcatgtg

SEQ ID NO: 5097302 - DNA, 19 bp, Homo sapiens
aagaacacagcatgtgcca

SEQ ID NO: 5097303 - DNA, 18 bp, Homo sapiens
aagaacacattttaaata

SEQ ID NO: 5097304 - DNA, 14 bp, Homo sapiens
aagaacacgaaata

SEQ ID NO: 5097305 - DNA, 16 bp, Homo sapiens
aagaacagaaaacaag

SEQ ID NO: 5097306 - DNA, 12 bp, Homo sapiens
aagaacagaaca

SEQ ID NO: 5097307 - DNA, 12 bp, Homo sapiens
aagaacagcccc

SEQ ID NO: 5097308 - DNA, 12 bp, Homo sapiens
aagaacagtaca

SEQ ID NO: 5097309 - DNA, 12 bp, Homo sapiens
aagaacataaag

SEQ ID NO: 5097310 - DNA, 18 bp, Homo sapiens
aagaacatccaaggagaa

SEQ ID NO: 5097311 - DNA, 23 bp, Homo sapiens
aagaacatccctgtcttaactgg

SEQ ID NO: 5097312 - DNA, 12 bp, Homo sapiens
aagaacatgaat

SEQ ID NO: 5097313 - DNA, 18 bp, Homo sapiens
aagaacatggacttgtat

SEQ ID NO: 5097314 - DNA, 19 bp, Homo sapiens
aagaacatggacttgtata

SEQ ID NO: 5097315 - DNA, 22 bp, Homo sapiens
aagaacatggacttgtatattt

SEQ ID NO: 5097316 - DNA, 11 bp, Homo sapiens
aagaacatgtg

SEQ ID NO: 5097317 - DNA, 13 bp, Homo sapiens
aagaacatttaaa

SEQ ID NO: 5097318 - DNA, 21 bp, Homo sapiens
aagaacatttgaatcttggga

SEQ ID NO: 5097319 - DNA, 16 bp, Homo sapiens
aagaaccaaagaagaa

SEQ ID NO: 5097320 - DNA, 21 bp, Homo sapiens
aagaaccactccttcatgttt

SEQ ID NO: 5097321 - DNA, 22 bp, Homo sapiens
aagaaccactccttcatgtttg

SEQ ID NO: 5097322 - DNA, 20 bp, Homo sapiens
aagaaccagcccagcctgcc

SEQ ID NO: 5097323 - DNA, 21 bp, Homo sapiens
aagaaccaggaggcctgggag

SEQ ID NO: 5097324 - DNA, 14 bp, Homo sapiens
aagaaccatctttg

SEQ ID NO: 5097325 - DNA, 14 bp, Homo sapiens
aagaaccatgcagg

SEQ ID NO: 5097326 - DNA, 22 bp, Homo sapiens
aagaacccatggaaaaatgcca

SEQ ID NO: 5097327 - DNA, 14 bp, Homo sapiens
aagaacccccctcc

SEQ ID NO: 5097328 - DNA, 21 bp, Homo sapiens
aagaacccccctccccaagga

SEQ ID NO: 5097329 - DNA, 17 bp, Homo sapiens
aagaacccctctgcttt

SEQ ID NO: 5097330 - DNA, 16 bp, Homo sapiens
aagaaccctatttaaa

SEQ ID NO: 5097331 - DNA, 20 bp, Homo sapiens
aagaaccctctgtcccaccc

SEQ ID NO: 5097332 - DNA, 21 bp, Homo sapiens
aagaaccgacccaccccgcgc

SEQ ID NO: 5097333 - DNA, 15 bp, Homo sapiens
aagaaccgcattttg

SEQ ID NO: 5097334 - DNA, 18 bp, Homo sapiens
aagaaccggacaaataag

SEQ ID NO: 5097335 - DNA, 18 bp, Homo sapiens
aagaacctatatcttaca

SEQ ID NO: 5097336 - DNA, 14 bp, Homo sapiens
aagaacctggaact

SEQ ID NO: 5097337 - DNA, 13 bp, Homo sapiens
aagaacgaacaca

SEQ ID NO: 5097338 - DNA, 18 bp, Homo sapiens
aagaacgaacacaagaaa

SEQ ID NO: 5097339 - DNA, 23 bp, Homo sapiens
aagaacgcggtgtgtaacactgt

SEQ ID NO: 5097340 - DNA, 16 bp, Homo sapiens
aagaacgtactttctg

SEQ ID NO: 5097341 - DNA, 14 bp, Homo sapiens
aagaacgtgcttgt

SEQ ID NO: 5097342 - DNA, 21 bp, Homo sapiens
aagaacgttttttcctcagtg

SEQ ID NO: 5097343 - DNA, 21 bp, Homo sapiens
aagaactacaaacaaaatttc

SEQ ID NO: 5097344 - DNA, 20 bp, Homo sapiens
aagaactataaacttaaagc

SEQ ID NO: 5097345 - DNA, 16 bp, Homo sapiens
aagaactatcttcatc

SEQ ID NO: 5097346 - DNA, 19 bp, Homo sapiens
aagaactcatcactgtggc

SEQ ID NO: 5097347 - DNA, 16 bp, Homo sapiens
aagaactccttatttt

SEQ ID NO: 5097348 - DNA, 16 bp, Homo sapiens
aagaactctaaccagt

SEQ ID NO: 5097349 - DNA, 19 bp, Homo sapiens
aagaactctaaccagtgta

SEQ ID NO: 5097350 - DNA, 11 bp, Homo sapiens
aagaactgaaa

SEQ ID NO: 5097351 - DNA, 21 bp, Homo sapiens
aagaactgaatccatatttca

SEQ ID NO: 5097352 - DNA, 11 bp, Homo sapiens
aagaactgcac

SEQ ID NO: 5097353 - DNA, 11 bp, Homo sapiens
aagaactgcag

SEQ ID NO: 5097354 - DNA, 22 bp, Homo sapiens
aagaactgcaggccctggcctc

SEQ ID NO: 5097355 - DNA, 23 bp, Homo sapiens
aagaactgcaggccctggcctcc

SEQ ID NO: 5097356 - DNA, 21 bp, Homo sapiens
aagagaagttattttctacag

SEQ ID NO: 5097357 - DNA, 22 bp, Homo sapiens
aagagaagtttaacaagtattt

SEQ ID NO: 5097358 - DNA, 20 bp, Homo sapiens
aagagaatacaggaaaatcc

SEQ ID NO: 5097359 - DNA, 20 bp, Homo sapiens
aagagaatcaacagatgata

SEQ ID NO: 5097360 - DNA, 13 bp, Homo sapiens
aagagaatgaact

SEQ ID NO: 5097361 - DNA, 15 bp, Homo sapiens
aagagaatgaactgt

SEQ ID NO: 5097362 - DNA, 20 bp, Homo sapiens
aagagaatgaactgtggaat

SEQ ID NO: 5097363 - DNA, 11 bp, Homo sapiens
aagagaatgag

SEQ ID NO: 5097364 - DNA, 16 bp, Homo sapiens
aagagaatgagtcctt

SEQ ID NO: 5097365 - DNA, 22 bp, Homo sapiens
aagagaatgcccttctccttat

SEQ ID NO: 5097366 - DNA, 10 bp, Homo sapiens
aagagaatgt

SEQ ID NO: 5097367 - DNA, 13 bp, Homo sapiens
aagagaatgttga

SEQ ID NO: 5097368 - DNA, 21 bp, Homo sapiens
aagagaattacttatattcat

SEQ ID NO: 5097369 - DNA, 11 bp, Homo sapiens
aagagaattct

SEQ ID NO: 5097370 - DNA, 14 bp, Homo sapiens
aagagaattctatt

SEQ ID NO: 5097371 - DNA, 17 bp, Homo sapiens
aagagaattgtatgtaa

SEQ ID NO: 5097372 - DNA, 14 bp, Homo sapiens
aagagaatttcaag

SEQ ID NO: 5097373 - DNA, 15 bp, Homo sapiens
aagagaatttcaagg

SEQ ID NO: 5097374 - DNA, 19 bp, Homo sapiens
aagagacaaacacctccca

SEQ ID NO: 5097375 - DNA, 13 bp, Homo sapiens
aagagacaaagat

SEQ ID NO: 5097376 - DNA, 15 bp, Homo sapiens
aagagacaaagattt

SEQ ID NO: 5097377 - DNA, 13 bp, Homo sapiens
aagagacactcca

SEQ ID NO: 5097378 - DNA, 14 bp, Homo sapiens
aagagacagaatga

SEQ ID NO: 5097379 - DNA, 16 bp, Homo sapiens
aagagacagaatgtat

SEQ ID NO: 5097380 - DNA, 22 bp, Homo sapiens
aagagacagagacaagtaattt

SEQ ID NO: 5097381 - DNA, 17 bp, Homo sapiens
aagagacagttatttat

SEQ ID NO: 5097382 - DNA, 19 bp, Homo sapiens
aagagacatgagaaaggga

SEQ ID NO: 5097383 - DNA, 20 bp, Homo sapiens
aagagacatgagaaagggag

SEQ ID NO: 5097384 - DNA, 14 bp, Homo sapiens
aagagacatttcaa

SEQ ID NO: 5097385 - DNA, 18 bp, Homo sapiens
aagagacatttcaaaact

SEQ ID NO: 5097386 - DNA, 18 bp, Homo sapiens
aagagaccacttccttaa

SEQ ID NO: 5097387 - DNA, 17 bp, Homo sapiens
aagagacctacctcagg

SEQ ID NO: 5097388 - DNA, 21 bp, Homo sapiens
aagagacctacctcaggttgc

SEQ ID NO: 5097389 - DNA, 21 bp, Homo sapiens
aagagactaatagagacacag

SEQ ID NO: 5097390 - DNA, 12 bp, Homo sapiens
aagagactcagc

SEQ ID NO: 5097391 - DNA, 15 bp, Homo sapiens
aagagactctggcct

SEQ ID NO: 5097392 - DNA, 18 bp, Homo sapiens
aagagactctttattttt

SEQ ID NO: 5097393 - DNA, 16 bp, Homo sapiens
aagagactgcttgaca

SEQ ID NO: 5097394 - DNA, 18 bp, Homo sapiens
aagagactggagcatctg

SEQ ID NO: 5097395 - DNA, 14 bp, Homo sapiens
aagagactgggcct

SEQ ID NO: 5097396 - DNA, 19 bp, Homo sapiens
aagagactgtgccatggtg

SEQ ID NO: 5097397 - DNA, 16 bp, Homo sapiens
aagagactgtggggag

SEQ ID NO: 5097398 - DNA, 22 bp, Homo sapiens
aagagactgtggggagggtcat

SEQ ID NO: 5097399 - DNA, 18 bp, Homo sapiens
aagagacttaagaaagct

SEQ ID NO: 5097400 - DNA, 19 bp, Homo sapiens
aagagactttattgcctat

SEQ ID NO: 5097401 - DNA, 13 bp, Homo sapiens
aagagactttgtc

SEQ ID NO: 5097402 - DNA, 12 bp, Homo sapiens
aagagagaaaat

SEQ ID NO: 5097403 - DNA, 23 bp, Homo sapiens
aagagagaaaataaaaagttaaa

SEQ ID NO: 5097404 - DNA, 21 bp, Homo sapiens
aagagagaaagaagtaggcat

SEQ ID NO: 5097405 - DNA, 11 bp, Homo sapiens
aagagagaaat

SEQ ID NO: 5097406 - DNA, 23 bp, Homo sapiens
aagagagaaccaagcttgtcttt

SEQ ID NO: 5097407 - DNA, 23 bp, Homo sapiens
aagagagaacctaactgtatctt

SEQ ID NO: 5097408 - DNA, 19 bp, Homo sapiens
aagagagaagagtccagga

SEQ ID NO: 5097409 - DNA, 20 bp, Homo sapiens
aagagagaagagtccaggaa

SEQ ID NO: 5097410 - DNA, 14 bp, Homo sapiens
aagagagaagccag

SEQ ID NO: 5097411 - DNA, 20 bp, Homo sapiens
aagagagaagccagccacag

SEQ ID NO: 5097412 - DNA, 16 bp, Homo sapiens
aagagagaattctgtt

SEQ ID NO: 5097413 - DNA, 17 bp, Homo sapiens
aagagagaattctgttc

SEQ ID NO: 5097414 - DNA, 13 bp, Homo sapiens
aagagagacaaaa

SEQ ID NO: 5097415 - DNA, 19 bp, Homo sapiens
aagagagagagagaaaaaa

SEQ ID NO: 5097416 - DNA, 19 bp, Homo sapiens
aagagagagagagagagaa

SEQ ID NO: 5097417 - DNA, 20 bp, Homo sapiens
aagagagatatatctgaaaa

SEQ ID NO: 5097418 - DNA, 18 bp, Homo sapiens
aagagagcagcgcccagg

SEQ ID NO: 5097419 - DNA, 16 bp, Homo sapiens
aagagagctctaacca

SEQ ID NO: 5097420 - DNA, 13 bp, Homo sapiens
aagagaggaagga

SEQ ID NO: 5097421 - DNA, 17 bp, Homo sapiens
aagagaggaaggacccc

SEQ ID NO: 5097422 - DNA, 19 bp, Homo sapiens
aagagaggaaggacccctc

SEQ ID NO: 5097423 - DNA, 18 bp, Homo sapiens
aagagaggagaggagaga

SEQ ID NO: 5097424 - DNA, 17 bp, Homo sapiens
aagagaggagttcaatg

SEQ ID NO: 5097425 - DNA, 20 bp, Homo sapiens
aagagaggatgtgcaagcga

SEQ ID NO: 5097426 - DNA, 17 bp, Homo sapiens
aagagaggcacctgctg

SEQ ID NO: 5097427 - DNA, 18 bp, Homo sapiens
aagagaggcacctgctgg

SEQ ID NO: 5097428 - DNA, 21 bp, Homo sapiens
aagagagggccatgcaattca

SEQ ID NO: 5097429 - DNA, 18 bp, Homo sapiens
aagagaggggaagaattt

SEQ ID NO: 5097430 - DNA, 20 bp, Homo sapiens
aagagagtaaacagacagct

SEQ ID NO: 5097431 - DNA, 23 bp, Homo sapiens
aagagagttctggatgtctggct

SEQ ID NO: 5097432 - DNA, 14 bp, Homo sapiens
aagagagtttgcca

SEQ ID NO: 5097433 - DNA, 17 bp, Homo sapiens
aagagataaacgaccaa

SEQ ID NO: 5097434 - DNA, 16 bp, Homo sapiens
aagagataactgtaaa

SEQ ID NO: 5097435 - DNA, 14 bp, Homo sapiens
aagagataattctt

SEQ ID NO: 5097436 - DNA, 14 bp, Homo sapiens
aagagatacattcc

SEQ ID NO: 5097437 - DNA, 19 bp, Homo sapiens
aagagatacttacatttcc

SEQ ID NO: 5097438 - DNA, 20 bp, Homo sapiens
aagagatacttacatttcca

SEQ ID NO: 5097439 - DNA, 16 bp, Homo sapiens
aagagatagcagagga

SEQ ID NO: 5097440 - DNA, 14 bp, Homo sapiens
aagagatagcttct

SEQ ID NO: 5097441 - DNA, 18 bp, Homo sapiens
aagagatagcttctcttc

SEQ ID NO: 5097442 - DNA, 15 bp, Homo sapiens
aagagatagttctaa

SEQ ID NO: 5097443 - DNA, 18 bp, Homo sapiens
aagagatcacccactcct

SEQ ID NO: 5097444 - DNA, 22 bp, Homo sapiens
aagagatcaggaagagaaggag

SEQ ID NO: 5097445 - DNA, 17 bp, Homo sapiens
aagagatccaaagactc

SEQ ID NO: 5097446 - DNA, 15 bp, Homo sapiens
aagagatcccaggag

SEQ ID NO: 5097447 - DNA, 18 bp, Homo sapiens
aagagatcgagaccatcc

SEQ ID NO: 5097448 - DNA, 17 bp, Homo sapiens
aagagatctacacatgt

SEQ ID NO: 5097449 - DNA, 19 bp, Homo sapiens
aagagatctacacatgttg

SEQ ID NO: 5097450 - DNA, 16 bp, Homo sapiens
aagagatctgggcatt

SEQ ID NO: 5097451 - DNA, 15 bp, Homo sapiens
aagagatctgtgtgg

SEQ ID NO: 5097452 - DNA, 20 bp, Homo sapiens
aagagatctgtgtggctcct

SEQ ID NO: 5097453 - DNA, 12 bp, Homo sapiens
aagagatgcact

SEQ ID NO: 5097454 - DNA, 16 bp, Homo sapiens
aagagatggaaaaaaa

SEQ ID NO: 5097455 - DNA, 15 bp, Homo sapiens
aagagatgggacaag

SEQ ID NO: 5097456 - DNA, 14 bp, Homo sapiens
aagagatgtggcaa

SEQ ID NO: 5097457 - DNA, 21 bp, Homo sapiens
aagagatgtggcaaagtgctg

SEQ ID NO: 5097458 - DNA, 15 bp, Homo sapiens
aagagattcctgagc

SEQ ID NO: 5097459 - DNA, 19 bp, Homo sapiens
aagagattgtgcgttcaaa

SEQ ID NO: 5097460 - DNA, 21 bp, Homo sapiens
aagagatttaaactctgaatt

SEQ ID NO: 5097461 - DNA, 14 bp, Homo sapiens
aagagatttaatta

SEQ ID NO: 5097462 - DNA, 15 bp, Homo sapiens
aagagatttatcttt

SEQ ID NO: 5097463 - DNA, 18 bp, Homo sapiens
aagagatttcaacatatc

SEQ ID NO: 5097464 - DNA, 13 bp, Homo sapiens
aagagatttcaag

SEQ ID NO: 5097465 - DNA, 21 bp, Homo sapiens
aagagatttcccttcatttaa

SEQ ID NO: 5097466 - DNA, 19 bp, Homo sapiens
aagagattttatgtttaaa

SEQ ID NO: 5097467 - DNA, 23 bp, Homo sapiens
aagagattttatgtttaaaatgg

SEQ ID NO: 5097468 - DNA, 17 bp, Homo sapiens
aagagcaaaaagtgtaa

SEQ ID NO: 5097469 - DNA, 14 bp, Homo sapiens
aagagcaaaaatat

SEQ ID NO: 5097470 - DNA, 15 bp, Homo sapiens
aagagcaaaagaatg

SEQ ID NO: 5097471 - DNA, 13 bp, Homo sapiens
aagagcaaacttt

SEQ ID NO: 5097472 - DNA, 21 bp, Homo sapiens
aagagcaaagtcatgtcagaa

SEQ ID NO: 5097473 - DNA, 23 bp, Homo sapiens
aagagcaaggtttcgtggcagca

SEQ ID NO: 5097474 - DNA, 14 bp, Homo sapiens
aagagcaattctgg

SEQ ID NO: 5097475 - DNA, 10 bp, Homo sapiens
aagagcacaa

SEQ ID NO: 5097476 - DNA, 21 bp, Homo sapiens
aagagcacaaacatttttcaa

SEQ ID NO: 5097477 - DNA, 21 bp, Homo sapiens
aagagcacacagagaagggaa

SEQ ID NO: 5097478 - DNA, 13 bp, Homo sapiens
aagagcacactgc

SEQ ID NO: 5097479 - DNA, 14 bp, Homo sapiens
aagagcacagccct

SEQ ID NO: 5097480 - DNA, 15 bp, Homo sapiens
aagagcacagccctc

SEQ ID NO: 5097481 - DNA, 16 bp, Homo sapiens
aagagcacgttttcca

SEQ ID NO: 5097482 - DNA, 16 bp, Homo sapiens
aagagcacttaagaga

SEQ ID NO: 5097483 - DNA, 21 bp, Homo sapiens
aagagcacttgagctgtctga

SEQ ID NO: 5097484 - DNA, 18 bp, Homo sapiens
aagagcagagtctgggcc

SEQ ID NO: 5097485 - DNA, 22 bp, Homo sapiens
aagagcagagtctgggcctctg

SEQ ID NO: 5097486 - DNA, 22 bp, Homo sapiens
aagagcagcacctcctcagcct

SEQ ID NO: 5097487 - DNA, 17 bp, Homo sapiens
aagagcagcatttttaa

SEQ ID NO: 5097488 - DNA, 11 bp, Homo sapiens
aagagcagcct

SEQ ID NO: 5097489 - DNA, 21 bp, Homo sapiens
aagagcagcttcggtgtgcag

SEQ ID NO: 5097490 - DNA, 22 bp, Homo sapiens
aagagcagcttcggtgtgcaga

SEQ ID NO: 5097491 - DNA, 22 bp, Homo sapiens
aagagcaggactccaggcccaa

SEQ ID NO: 5097492 - DNA, 12 bp, Homo sapiens
aagagcaggtga

SEQ ID NO: 5097493 - DNA, 20 bp, Homo sapiens
aagagcagtcagagtccagt

SEQ ID NO: 5097494 - DNA, 15 bp, Homo sapiens
aagagcatcatgcct

SEQ ID NO: 5097495 - DNA, 17 bp, Homo sapiens
aagagcatgatttgaaa

SEQ ID NO: 5097496 - DNA, 23 bp, Homo sapiens
aagagcatttggtacacacttga

SEQ ID NO: 5097497 - DNA, 14 bp, Homo sapiens
aagagccaatggag

SEQ ID NO: 5097498 - DNA, 11 bp, Homo sapiens
aagagccacag

SEQ ID NO: 5097499 - DNA, 15 bp, Homo sapiens
aagagccacctgcaa

SEQ ID NO: 5097500 - DNA, 18 bp, Homo sapiens
aagagccacctgcaagat

SEQ ID NO: 5097501 - DNA, 19 bp, Homo sapiens
aagagccatctgaagccac

SEQ ID NO: 5097502 - DNA, 15 bp, Homo sapiens
aagagccatgtccaa

SEQ ID NO: 5097503 - DNA, 21 bp, Homo sapiens
aagagcccaaaagagggcaca

SEQ ID NO: 5097504 - DNA, 16 bp, Homo sapiens
aagagcccaggcctcc

SEQ ID NO: 5097505 - DNA, 12 bp, Homo sapiens
aagagccccact

SEQ ID NO: 5097506 - DNA, 16 bp, Homo sapiens
aagagccccactctca

SEQ ID NO: 5097507 - DNA, 23 bp, Homo sapiens
aagagcccgtgccacccccagcc

SEQ ID NO: 5097508 - DNA, 18 bp, Homo sapiens
aagagccctaagtttgta

SEQ ID NO: 5097509 - DNA, 20 bp, Homo sapiens
aagagccctgagcccagaaa

SEQ ID NO: 5097510 - DNA, 23 bp, Homo sapiens
aagagccctggctctgcccctca

SEQ ID NO: 5097511 - DNA, 19 bp, Homo sapiens
aagagccctgtggccgcca

SEQ ID NO: 5097512 - DNA, 14 bp, Homo sapiens
aagagcccttgcct

SEQ ID NO: 5097513 - DNA, 18 bp, Homo sapiens
aagagcccttgcctcccc

SEQ ID NO: 5097514 - DNA, 22 bp, Homo sapiens
aagagccgacaatgccctgctg

SEQ ID NO: 5097515 - DNA, 15 bp, Homo sapiens
aagagccggtggtgc

SEQ ID NO: 5097516 - DNA, 19 bp, Homo sapiens
aagagcctgaagctggcct

SEQ ID NO: 5097517 - DNA, 18 bp, Homo sapiens
aagagcctgagactggaa

SEQ ID NO: 5097518 - DNA, 14 bp, Homo sapiens
aagagcctgatttt

SEQ ID NO: 5097519 - DNA, 13 bp, Homo sapiens
aagagcctggaga

SEQ ID NO: 5097520 - DNA, 14 bp, Homo sapiens
aagagccttaaaac

SEQ ID NO: 5097521 - DNA, 16 bp, Homo sapiens
aagagccttcacatga

SEQ ID NO: 5097522 - DNA, 21 bp, Homo sapiens
aagagccttggtgtccacctg

SEQ ID NO: 5097523 - DNA, 14 bp, Homo sapiens
aagagcctttccaa

SEQ ID NO: 5097524 - DNA, 23 bp, Homo sapiens
aagagcgagagatcaaagatgaa

SEQ ID NO: 5097525 - DNA, 16 bp, Homo sapiens
aagagctacataattt

SEQ ID NO: 5097526 - DNA, 18 bp, Homo sapiens
aagagctacgtatttaat

SEQ ID NO: 5097527 - DNA, 16 bp, Homo sapiens
aagagctagaaaaata

SEQ ID NO: 5097528 - DNA, 20 bp, Homo sapiens
aagagctagaaaaataaaat

SEQ ID NO: 5097529 - DNA, 16 bp, Homo sapiens
aagagctagcgctgcc

SEQ ID NO: 5097530 - DNA, 13 bp, Homo sapiens
aagagctaggcag

SEQ ID NO: 5097531 - DNA, 16 bp, Homo sapiens
aagagctaggcagggt

SEQ ID NO: 5097532 - DNA, 22 bp, Homo sapiens
aagagctagtctatcagcatct

SEQ ID NO: 5097533 - DNA, 20 bp, Homo sapiens
aagagctattgccaaccagt

SEQ ID NO: 5097534 - DNA, 18 bp, Homo sapiens
aagagctattttagaaag

SEQ ID NO: 5097535 - DNA, 11 bp, Homo sapiens
aagaactgcat

SEQ ID NO: 5097536 - DNA, 23 bp, Homo sapiens
aagaactgccccatctcctccca

SEQ ID NO: 5097537 - DNA, 22 bp, Homo sapiens
aagaactgtcatgtaaacatac

SEQ ID NO: 5097538 - DNA, 16 bp, Homo sapiens
aagaactgtgaaattt

SEQ ID NO: 5097539 - DNA, 22 bp, Homo sapiens
aagaactgtgaaatttacaaat

SEQ ID NO: 5097540 - DNA, 21 bp, Homo sapiens
aagaactgtttactgcttgat

SEQ ID NO: 5097541 - DNA, 15 bp, Homo sapiens
aagaacttactgatt

SEQ ID NO: 5097542 - DNA, 13 bp, Homo sapiens
aagaacttcattt

SEQ ID NO: 5097543 - DNA, 19 bp, Homo sapiens
aagaacttccccatacaaa

SEQ ID NO: 5097544 - DNA, 23 bp, Homo sapiens
aagaacttgatatatttcattct

SEQ ID NO: 5097545 - DNA, 15 bp, Homo sapiens
aagaacttgcatgga

SEQ ID NO: 5097546 - DNA, 13 bp, Homo sapiens
aagaacttgctgc

SEQ ID NO: 5097547 - DNA, 12 bp, Homo sapiens
aagaacttgttt

SEQ ID NO: 5097548 - DNA, 19 bp, Homo sapiens
aagaacttgtttacaacat

SEQ ID NO: 5097549 - DNA, 22 bp, Homo sapiens
aagaactttaaagctcaggagg

SEQ ID NO: 5097550 - DNA, 24 bp, Homo sapiens
aagaactttaaagctcaggagggt

SEQ ID NO: 5097551 - DNA, 18 bp, Homo sapiens
aagaactttttcttttcc

SEQ ID NO: 5097552 - DNA, 12 bp, Homo sapiens
aagaagaaaaaa

SEQ ID NO: 5097553 - DNA, 14 bp, Homo sapiens
aagaagaaaaaaac

SEQ ID NO: 5097554 - DNA, 12 bp, Homo sapiens
aagaagaaaaga

SEQ ID NO: 5097555 - DNA, 14 bp, Homo sapiens
aagaagaaaagaga

SEQ ID NO: 5097556 - DNA, 15 bp, Homo sapiens
aagaagaaaagagaa

SEQ ID NO: 5097557 - DNA, 16 bp, Homo sapiens
aagaagaaagatttaa

SEQ ID NO: 5097558 - DNA, 12 bp, Homo sapiens
aagaagaaagca

SEQ ID NO: 5097559 - DNA, 12 bp, Homo sapiens
aagaagaaagct

SEQ ID NO: 5097560 - DNA, 20 bp, Homo sapiens
aagaagaaagtctatgctta

SEQ ID NO: 5097561 - DNA, 15 bp, Homo sapiens
aagaagaaagtgttc

SEQ ID NO: 5097562 - DNA, 23 bp, Homo sapiens
aagaagaaataaataatctacat

SEQ ID NO: 5097563 - DNA, 18 bp, Homo sapiens
aagaagaaatagttctgt

SEQ ID NO: 5097564 - DNA, 19 bp, Homo sapiens
aagaagaaatatgaaattc

SEQ ID NO: 5097565 - DNA, 23 bp, Homo sapiens
aagaagaaccagcccagcctgcc

SEQ ID NO: 5097566 - DNA, 12 bp, Homo sapiens
aagaagaaggag

SEQ ID NO: 5097567 - DNA, 17 bp, Homo sapiens
aagaagaaggccagaga

SEQ ID NO: 5097568 - DNA, 13 bp, Homo sapiens
aagaagaagggca

SEQ ID NO: 5097569 - DNA, 13 bp, Homo sapiens
aagaagaagttca

SEQ ID NO: 5097570 - DNA, 19 bp, Homo sapiens
aagaagacaaactttgcat

SEQ ID NO: 5097571 - DNA, 16 bp, Homo sapiens
aagaagacatgaacca

SEQ ID NO: 5097572 - DNA, 19 bp, Homo sapiens
aagaagaccagactgtgga

SEQ ID NO: 5097573 - DNA, 22 bp, Homo sapiens
aagaagaccctttgttgaaaaa

SEQ ID NO: 5097574 - DNA, 21 bp, Homo sapiens
aagaagacctgagaatgtatc

SEQ ID NO: 5097575 - DNA, 22 bp, Homo sapiens
aagaagacggattatctagaga

SEQ ID NO: 5097576 - DNA, 13 bp, Homo sapiens
aagaagagaaaga

SEQ ID NO: 5097577 - DNA, 19 bp, Homo sapiens
aagaagagaagctgctgac

SEQ ID NO: 5097578 - DNA, 14 bp, Homo sapiens
aagaagagacagga

SEQ ID NO: 5097579 - DNA, 22 bp, Homo sapiens
aagaagagagaagacccttctc

SEQ ID NO: 5097580 - DNA, 12 bp, Homo sapiens
aagaagagatgc

SEQ ID NO: 5097581 - DNA, 14 bp, Homo sapiens
aagaagagccacag

SEQ ID NO: 5097582 - DNA, 22 bp, Homo sapiens
aagaagagcgagagatcaaaga

SEQ ID NO: 5097583 - DNA, 11 bp, Homo sapiens
aagaagaggaa

SEQ ID NO: 5097584 - DNA, 20 bp, Homo sapiens
aagaagaggaagaaattcag

SEQ ID NO: 5097585 - DNA, 13 bp, Homo sapiens
aagaagaggaagt

SEQ ID NO: 5097586 - DNA, 21 bp, Homo sapiens
aagaagaggagaaaaagaaga

SEQ ID NO: 5097587 - DNA, 21 bp, Homo sapiens
aagaagaggagcctcagaaga

SEQ ID NO: 5097588 - DNA, 14 bp, Homo sapiens
aagaagaggaggaa

SEQ ID NO: 5097589 - DNA, 19 bp, Homo sapiens
aagaagaggttcatttttc

SEQ ID NO: 5097590 - DNA, 19 bp, Homo sapiens
aagaagagtaacacttgaa

SEQ ID NO: 5097591 - DNA, 15 bp, Homo sapiens
aagaagagtttacag

SEQ ID NO: 5097592 - DNA, 15 bp, Homo sapiens
aagaagagtttgcaa

SEQ ID NO: 5097593 - DNA, 20 bp, Homo sapiens
aagaagatagtgagatttaa

SEQ ID NO: 5097594 - DNA, 22 bp, Homo sapiens
aagaagatcacgctccccgcct

SEQ ID NO: 5097595 - DNA, 15 bp, Homo sapiens
aagaagatgaatggc

SEQ ID NO: 5097596 - DNA, 18 bp, Homo sapiens
aagaagatgaatggcgtc

SEQ ID NO: 5097597 - DNA, 17 bp, Homo sapiens
aagaagatgacttccca

SEQ ID NO: 5097598 - DNA, 12 bp, Homo sapiens
aagaagatgagc

SEQ ID NO: 5097599 - DNA, 22 bp, Homo sapiens
aagaagatgctccagcaacaca

SEQ ID NO: 5097600 - DNA, 18 bp, Homo sapiens
aagaagatggatgtaatt

SEQ ID NO: 5097601 - DNA, 13 bp, Homo sapiens
aagaagattctaa

SEQ ID NO: 5097602 - DNA, 20 bp, Homo sapiens
aagaagcaaagttcaactta

SEQ ID NO: 5097603 - DNA, 13 bp, Homo sapiens
aagaagcagagag

SEQ ID NO: 5097604 - DNA, 19 bp, Homo sapiens
aagaagcccagtggtgagg

SEQ ID NO: 5097605 - DNA, 23 bp, Homo sapiens
aagaagcccagtggtgaggaaag

SEQ ID NO: 5097606 - DNA, 16 bp, Homo sapiens
aagaagccctgttctc

SEQ ID NO: 5097607 - DNA, 21 bp, Homo sapiens
aagaagctactattttggaaa

SEQ ID NO: 5097608 - DNA, 18 bp, Homo sapiens
aagaagctcgccccacct

SEQ ID NO: 5097609 - DNA, 21 bp, Homo sapiens
aagaagctcgccccacctcca

SEQ ID NO: 5097610 - DNA, 12 bp, Homo sapiens
aagaagctctcc

SEQ ID NO: 5097611 - DNA, 16 bp, Homo sapiens
aagaagctgaggaagc

SEQ ID NO: 5097612 - DNA, 20 bp, Homo sapiens
aagaagctgcttctgcccac

SEQ ID NO: 5097613 - DNA, 14 bp, Homo sapiens
aagaagctgggagg

SEQ ID NO: 5097614 - DNA, 15 bp, Homo sapiens
aagaagctgggaggg

SEQ ID NO: 5097615 - DNA, 19 bp, Homo sapiens
aagaagctgtcagaagttt

SEQ ID NO: 5097616 - DNA, 17 bp, Homo sapiens
aagaagctgtgaatatt

SEQ ID NO: 5097617 - DNA, 16 bp, Homo sapiens
aagaagctgttgtaca

SEQ ID NO: 5097618 - DNA, 16 bp, Homo sapiens
aagaagcttaggcagg

SEQ ID NO: 5097619 - DNA, 18 bp, Homo sapiens
aagaagcttccacaaaat

SEQ ID NO: 5097620 - DNA, 18 bp, Homo sapiens
aagaagcttctaataaat

SEQ ID NO: 5097621 - DNA, 13 bp, Homo sapiens
aagaaggaaaaaa

SEQ ID NO: 5097622 - DNA, 14 bp, Homo sapiens
aagaaggaaaaatt

SEQ ID NO: 5097623 - DNA, 19 bp, Homo sapiens
aagaaggaaaaattccagg

SEQ ID NO: 5097624 - DNA, 18 bp, Homo sapiens
aagaaggaaagatggtta

SEQ ID NO: 5097625 - DNA, 15 bp, Homo sapiens
aagaaggactgaaga

SEQ ID NO: 5097626 - DNA, 16 bp, Homo sapiens
aagaaggagagcaaga

SEQ ID NO: 5097627 - DNA, 12 bp, Homo sapiens
aagaaggagctg

SEQ ID NO: 5097628 - DNA, 14 bp, Homo sapiens
aagaaggatgatgt

SEQ ID NO: 5097629 - DNA, 15 bp, Homo sapiens
aagaaggcaaaaata

SEQ ID NO: 5097630 - DNA, 19 bp, Homo sapiens
aagaaggcaacttgaagaa

SEQ ID NO: 5097631 - DNA, 14 bp, Homo sapiens
aagaaggcaatatt

SEQ ID NO: 5097632 - DNA, 20 bp, Homo sapiens
aagaaggcaattttagtgta

SEQ ID NO: 5097633 - DNA, 20 bp, Homo sapiens
aagaaggcacaggtgtaaat

SEQ ID NO: 5097634 - DNA, 23 bp, Homo sapiens
aagaaggcacaggtgtaaatata

SEQ ID NO: 5097635 - DNA, 22 bp, Homo sapiens
aagaaggcagggaatgcctgga

SEQ ID NO: 5097636 - DNA, 13 bp, Homo sapiens
aagaaggccagag

SEQ ID NO: 5097637 - DNA, 16 bp, Homo sapiens
aagaaggccagagagg

SEQ ID NO: 5097638 - DNA, 14 bp, Homo sapiens
aagaagggaaattc

SEQ ID NO: 5097639 - DNA, 17 bp, Homo sapiens
aagaagggaaattcaca

SEQ ID NO: 5097640 - DNA, 15 bp, Homo sapiens
aagaagggaagcttt

SEQ ID NO: 5097641 - DNA, 19 bp, Homo sapiens
aagaagggaagctttgttt

SEQ ID NO: 5097642 - DNA, 17 bp, Homo sapiens
aagaagggactgagaga

SEQ ID NO: 5097643 - DNA, 14 bp, Homo sapiens
aagaagggagaaga

SEQ ID NO: 5097644 - DNA, 17 bp, Homo sapiens
aagaagggagaagaaag

SEQ ID NO: 5097645 - DNA, 22 bp, Homo sapiens
aagaagggccaccctgagcaga

SEQ ID NO: 5097646 - DNA, 11 bp, Homo sapiens
aagaagggctg

SEQ ID NO: 5097647 - DNA, 13 bp, Homo sapiens
aagaaggggccat

SEQ ID NO: 5097648 - DNA, 18 bp, Homo sapiens
aagaaggggccatcacag

SEQ ID NO: 5097649 - DNA, 23 bp, Homo sapiens
aagaaggggctcgagtgcccctg

SEQ ID NO: 5097650 - DNA, 22 bp, Homo sapiens
aagaagggggagtgaaacagag

SEQ ID NO: 5097651 - DNA, 14 bp, Homo sapiens
aagaagggggtggg

SEQ ID NO: 5097652 - DNA, 18 bp, Homo sapiens
aagaaggggtagggattt

SEQ ID NO: 5097653 - DNA, 21 bp, Homo sapiens
aagaagggtccttccctctcc

SEQ ID NO: 5097654 - DNA, 24 bp, Homo sapiens
aagaagggtccttccctctcccca

SEQ ID NO: 5097655 - DNA, 14 bp, Homo sapiens
aagaaggtgaatag

SEQ ID NO: 5097656 - DNA, 23 bp, Homo sapiens
aagaaggtgatttttttattatt

SEQ ID NO: 5097657 - DNA, 20 bp, Homo sapiens
aagaaggtggaccttttaaa

SEQ ID NO: 5097658 - DNA, 18 bp, Homo sapiens
aagaaggtttgtgttttt

SEQ ID NO: 5097659 - DNA, 20 bp, Homo sapiens
aagaagtatttttagaataa

SEQ ID NO: 5097660 - DNA, 21 bp, Homo sapiens
aagaagtatttttttaatttc

SEQ ID NO: 5097661 - DNA, 13 bp, Homo sapiens
aagaagtcaaatg

SEQ ID NO: 5097662 - DNA, 17 bp, Homo sapiens
aagaagtcaaatgaatg

SEQ ID NO: 5097663 - DNA, 21 bp, Homo sapiens
aagaagtcataaacagcattt

SEQ ID NO: 5097664 - DNA, 22 bp, Homo sapiens
aagaagtgaccaaggaggagtt

SEQ ID NO: 5097665 - DNA, 21 bp, Homo sapiens
aagaagtgagtgtttctatga

SEQ ID NO: 5097666 - DNA, 14 bp, Homo sapiens
aagaagtggagaca

SEQ ID NO: 5097667 - DNA, 13 bp, Homo sapiens
aagaagtgggagc

SEQ ID NO: 5097668 - DNA, 13 bp, Homo sapiens
aagaagtgggagt

SEQ ID NO: 5097669 - DNA, 19 bp, Homo sapiens
aagaagtgggagtgggaga

SEQ ID NO: 5097670 - DNA, 16 bp, Homo sapiens
aagaagtggtactagt

SEQ ID NO: 5097671 - DNA, 19 bp, Homo sapiens
aagaagtgtgtcaccctta

SEQ ID NO: 5097672 - DNA, 13 bp, Homo sapiens
aagaagttaattc

SEQ ID NO: 5097673 - DNA, 20 bp, Homo sapiens
aagaagttaattcttaaaac

SEQ ID NO: 5097674 - DNA, 21 bp, Homo sapiens
aagaagttaattcttaaaact

SEQ ID NO: 5097675 - DNA, 14 bp, Homo sapiens
aagaagttactttg

SEQ ID NO: 5097676 - DNA, 16 bp, Homo sapiens
aagaagttactttgta

SEQ ID NO: 5097677 - DNA, 19 bp, Homo sapiens
aagaagttactttgtaatt

SEQ ID NO: 5097678 - DNA, 15 bp, Homo sapiens
aagaagttacttttt

SEQ ID NO: 5097679 - DNA, 16 bp, Homo sapiens
aagaagttattttctt

SEQ ID NO: 5097680 - DNA, 17 bp, Homo sapiens
aagaagttcaccagccc

SEQ ID NO: 5097681 - DNA, 17 bp, Homo sapiens
aagaagttcatgtccaa

SEQ ID NO: 5097682 - DNA, 16 bp, Homo sapiens
aagaagttcttaaata

SEQ ID NO: 5097683 - DNA, 17 bp, Homo sapiens
aagaagtttaaggaata

SEQ ID NO: 5097684 - DNA, 12 bp, Homo sapiens
aagaagtttatt

SEQ ID NO: 5097685 - DNA, 19 bp, Homo sapiens
aagaagtttattctcattt

SEQ ID NO: 5097686 - DNA, 15 bp, Homo sapiens
aagaagtttcatcat

SEQ ID NO: 5097687 - DNA, 12 bp, Homo sapiens
aagaagtttggg

SEQ ID NO: 5097688 - DNA, 13 bp, Homo sapiens
aagaagttttaaa

SEQ ID NO: 5097689 - DNA, 19 bp, Homo sapiens
aagaagtttttctttgtgt

SEQ ID NO: 5097690 - DNA, 14 bp, Homo sapiens
aagaataaaaactt

SEQ ID NO: 5097691 - DNA, 20 bp, Homo sapiens
aagaataaaaacttttgagg

SEQ ID NO: 5097692 - DNA, 14 bp, Homo sapiens
aagaataaaatact

SEQ ID NO: 5097693 - DNA, 16 bp, Homo sapiens
aagaataaatgaatct

SEQ ID NO: 5097694 - DNA, 13 bp, Homo sapiens
aagaataaattct

SEQ ID NO: 5097695 - DNA, 17 bp, Homo sapiens
aagaataactaatacaa

SEQ ID NO: 5097696 - DNA, 18 bp, Homo sapiens
aagaataataaaatactt

SEQ ID NO: 5097697 - DNA, 20 bp, Homo sapiens
aagaataataaaatactttt

SEQ ID NO: 5097698 - DNA, 21 bp, Homo sapiens
aagaataatatgctgccaaat

SEQ ID NO: 5097699 - DNA, 16 bp, Homo sapiens
aagaataatcacgctt

SEQ ID NO: 5097700 - DNA, 23 bp, Homo sapiens
aagaataatcacgctttcctgaa

SEQ ID NO: 5097701 - DNA, 18 bp, Homo sapiens
aagaataatttatagtaa

SEQ ID NO: 5097702 - DNA, 20 bp, Homo sapiens
aagaataatttatagtaatg

SEQ ID NO: 5097703 - DNA, 13 bp, Homo sapiens
aagaataatttta

SEQ ID NO: 5097704 - DNA, 16 bp, Homo sapiens
aagaataattttggaa

SEQ ID NO: 5097705 - DNA, 17 bp, Homo sapiens
aagaatacagaaaatgc

SEQ ID NO: 5097706 - DNA, 18 bp, Homo sapiens
aagaatacagaaaatgct

SEQ ID NO: 5097707 - DNA, 15 bp, Homo sapiens
aagaatacatcagaa

SEQ ID NO: 5097708 - DNA, 18 bp, Homo sapiens
aagaatacatcagaaaat

SEQ ID NO: 5097709 - DNA, 23 bp, Homo sapiens
aagaatacatcagaaaataaaat

SEQ ID NO: 5097710 - DNA, 16 bp, Homo sapiens
aagaatacttctcatt

SEQ ID NO: 5097711 - DNA, 22 bp, Homo sapiens
aagaatacttctcattttttaa

SEQ ID NO: 5097712 - DNA, 15 bp, Homo sapiens
aagaatacttgaact

SEQ ID NO: 5097713 - DNA, 15 bp, Homo sapiens
aagaatagaaacaag

SEQ ID NO: 5097714 - DNA, 17 bp, Homo sapiens
aagaataggacttgttt

SEQ ID NO: 5097715 - DNA, 23 bp, Homo sapiens
aagagctattttagaaagctaaa

SEQ ID NO: 5097716 - DNA, 12 bp, Homo sapiens
aagagctcaagg

SEQ ID NO: 5097717 - DNA, 17 bp, Homo sapiens
aagagctcagacatttt

SEQ ID NO: 5097718 - DNA, 13 bp, Homo sapiens
aagagctcaggat

SEQ ID NO: 5097719 - DNA, 19 bp, Homo sapiens
aagagctcaggcttttcca

SEQ ID NO: 5097720 - DNA, 23 bp, Homo sapiens
aagagctcccctccacagctgca

SEQ ID NO: 5097721 - DNA, 11 bp, Homo sapiens
aagagctcttg

SEQ ID NO: 5097722 - DNA, 13 bp, Homo sapiens
aagagctcttggc

SEQ ID NO: 5097723 - DNA, 23 bp, Homo sapiens
aagagctctttgtctcaccagct

SEQ ID NO: 5097724 - DNA, 14 bp, Homo sapiens
aagagctgagacct

SEQ ID NO: 5097725 - DNA, 18 bp, Homo sapiens
aagagctgaggcaattct

SEQ ID NO: 5097726 - DNA, 22 bp, Homo sapiens
aagagctgatgtgagtgtgtgt

SEQ ID NO: 5097727 - DNA, 23 bp, Homo sapiens
aagagctgatgtgagtgtgtgtg

SEQ ID NO: 5097728 - DNA, 21 bp, Homo sapiens
aagagctgcctggatgagaaa

SEQ ID NO: 5097729 - DNA, 11 bp, Homo sapiens
aagagctgctg

SEQ ID NO: 5097730 - DNA, 20 bp, Homo sapiens
aagagctgggatcccacagc

SEQ ID NO: 5097731 - DNA, 22 bp, Homo sapiens
aagagctgggatcccacagccc

SEQ ID NO: 5097732 - DNA, 22 bp, Homo sapiens
aagagctgggtaccaggccacc

SEQ ID NO: 5097733 - DNA, 12 bp, Homo sapiens
aagagctgtggc

SEQ ID NO: 5097734 - DNA, 22 bp, Homo sapiens
aagagctgttatgctgtttcct

SEQ ID NO: 5097735 - DNA, 23 bp, Homo sapiens
aagagctgttatgctgtttccta

SEQ ID NO: 5097736 - DNA, 22 bp, Homo sapiens
aagagctgttctttttgactga

SEQ ID NO: 5097737 - DNA, 22 bp, Homo sapiens
aagagctgttttggatgaatgc

SEQ ID NO: 5097738 - DNA, 21 bp, Homo sapiens
aagagcttattacttatttgt

SEQ ID NO: 5097739 - DNA, 12 bp, Homo sapiens
aagagcttccag

SEQ ID NO: 5097740 - DNA, 22 bp, Homo sapiens
aagagcttccagaaatgccaca

SEQ ID NO: 5097741 - DNA, 18 bp, Homo sapiens
aagagcttgcacagccaa

SEQ ID NO: 5097742 - DNA, 14 bp, Homo sapiens
aagagcttgctcca

SEQ ID NO: 5097743 - DNA, 22 bp, Homo sapiens
aagagcttgctccagattctga

SEQ ID NO: 5097744 - DNA, 13 bp, Homo sapiens
aagagcttgcttt

SEQ ID NO: 5097745 - DNA, 21 bp, Homo sapiens
aagagctttttcactctaaaa

SEQ ID NO: 5097746 - DNA, 10 bp, Homo sapiens
aagaggaaaa

SEQ ID NO: 5097747 - DNA, 12 bp, Homo sapiens
aagaggaaaaaa

SEQ ID NO: 5097748 - DNA, 13 bp, Homo sapiens
aagaggaaaagaa

SEQ ID NO: 5097749 - DNA, 16 bp, Homo sapiens
aagaggaaaagaaatc

SEQ ID NO: 5097750 - DNA, 13 bp, Homo sapiens
aagaggaaaatga

SEQ ID NO: 5097751 - DNA, 21 bp, Homo sapiens
aagaggaaaatgaataataca

SEQ ID NO: 5097752 - DNA, 15 bp, Homo sapiens
aagaggaaagaatga

SEQ ID NO: 5097753 - DNA, 22 bp, Homo sapiens
aagaggaaaggcgcccccgccc

SEQ ID NO: 5097754 - DNA, 19 bp, Homo sapiens
aagaggaactagactttcc

SEQ ID NO: 5097755 - DNA, 15 bp, Homo sapiens
aagaggaactgggcc

SEQ ID NO: 5097756 - DNA, 19 bp, Homo sapiens
aagaggaagaagaagaaag

SEQ ID NO: 5097757 - DNA, 13 bp, Homo sapiens
aagaggaagcctt

SEQ ID NO: 5097758 - DNA, 20 bp, Homo sapiens
aagaggaaggggtgctgtga

SEQ ID NO: 5097759 - DNA, 20 bp, Homo sapiens
aagaggaagttaaaatttga

SEQ ID NO: 5097760 - DNA, 17 bp, Homo sapiens
aagaggaagttagagat

SEQ ID NO: 5097761 - DNA, 16 bp, Homo sapiens
aagaggacacaatggc

SEQ ID NO: 5097762 - DNA, 21 bp, Homo sapiens
aagaggacacaatggcacctc

SEQ ID NO: 5097763 - DNA, 15 bp, Homo sapiens
aagaggaccagagga

SEQ ID NO: 5097764 - DNA, 20 bp, Homo sapiens
aagaggactcgcttgtaaat

SEQ ID NO: 5097765 - DNA, 14 bp, Homo sapiens
aagaggactgtgtg

SEQ ID NO: 5097766 - DNA, 15 bp, Homo sapiens
aagaggactgtgtga

SEQ ID NO: 5097767 - DNA, 17 bp, Homo sapiens
aagaggagaaaaagaag

SEQ ID NO: 5097768 - DNA, 22 bp, Homo sapiens
aagaggagaaaaagaagaaaag

SEQ ID NO: 5097769 - DNA, 19 bp, Homo sapiens
aagaggagaaaagctcaag

SEQ ID NO: 5097770 - DNA, 18 bp, Homo sapiens
aagaggagaaggaaaaca

SEQ ID NO: 5097771 - DNA, 14 bp, Homo sapiens
aagaggagaccctg

SEQ ID NO: 5097772 - DNA, 18 bp, Homo sapiens
aagaggagaggaaaacta

SEQ ID NO: 5097773 - DNA, 20 bp, Homo sapiens
aagaggagattggccagtga

SEQ ID NO: 5097774 - DNA, 21 bp, Homo sapiens
aagaggagcacttccaaaatt

SEQ ID NO: 5097775 - DNA, 12 bp, Homo sapiens
aagaggagcaga

SEQ ID NO: 5097776 - DNA, 13 bp, Homo sapiens
aagaggaggaaga

SEQ ID NO: 5097777 - DNA, 23 bp, Homo sapiens
aagaggaggacccctgccttcct

SEQ ID NO: 5097778 - DNA, 14 bp, Homo sapiens
aagaggaggccgcc

SEQ ID NO: 5097779 - DNA, 17 bp, Homo sapiens
aagaggaggggaagagg

SEQ ID NO: 5097780 - DNA, 20 bp, Homo sapiens
aagaggaggggaagaggcct

SEQ ID NO: 5097781 - DNA, 20 bp, Homo sapiens
aagaggagtttcgaggtaga

SEQ ID NO: 5097782 - DNA, 16 bp, Homo sapiens
aagaggatcggaggct

SEQ ID NO: 5097783 - DNA, 17 bp, Homo sapiens
aagaggatgaaggaagg

SEQ ID NO: 5097784 - DNA, 17 bp, Homo sapiens
aagaggatgatttcaga

SEQ ID NO: 5097785 - DNA, 21 bp, Homo sapiens
aagaggatgatttcagaagga

SEQ ID NO: 5097786 - DNA, 22 bp, Homo sapiens
aagaggatgctgggctctgttc

SEQ ID NO: 5097787 - DNA, 14 bp, Homo sapiens
aagaggatgctgtg

SEQ ID NO: 5097788 - DNA, 14 bp, Homo sapiens
aagaggatgtggtt

SEQ ID NO: 5097789 - DNA, 16 bp, Homo sapiens
aagaggattgtaaaat

SEQ ID NO: 5097790 - DNA, 17 bp, Homo sapiens
aagaggattgtaaaatg

SEQ ID NO: 5097791 - DNA, 14 bp, Homo sapiens
aagaggcaaagaat

SEQ ID NO: 5097792 - DNA, 19 bp, Homo sapiens
aagaggcaagctgaaattt

SEQ ID NO: 5097793 - DNA, 18 bp, Homo sapiens
aagaggcaccaggaagcc

SEQ ID NO: 5097794 - DNA, 18 bp, Homo sapiens
aagaggcacctgtcccag

SEQ ID NO: 5097795 - DNA, 19 bp, Homo sapiens
aagaggcagggacctaaag

SEQ ID NO: 5097796 - DNA, 19 bp, Homo sapiens
aagaggcagttgcccagcc

SEQ ID NO: 5097797 - DNA, 22 bp, Homo sapiens
aagaggcagttgcccagcctct

SEQ ID NO: 5097798 - DNA, 22 bp, Homo sapiens
aagaggcatagagggagaggaa

SEQ ID NO: 5097799 - DNA, 16 bp, Homo sapiens
aagaggccagtacttt

SEQ ID NO: 5097800 - DNA, 19 bp, Homo sapiens
aagaggccatttaagtatc

SEQ ID NO: 5097801 - DNA, 11 bp, Homo sapiens
aagaggcccac

SEQ ID NO: 5097802 - DNA, 22 bp, Homo sapiens
aagaggcccactagagggccca

SEQ ID NO: 5097803 - DNA, 21 bp, Homo sapiens
aagaggccttcccatggccat

SEQ ID NO: 5097804 - DNA, 16 bp, Homo sapiens
aagaggcgacttcctc

SEQ ID NO: 5097805 - DNA, 15 bp, Homo sapiens
aagaggcgggccagc

SEQ ID NO: 5097806 - DNA, 21 bp, Homo sapiens
aagaggcgggccagccaggcg

SEQ ID NO: 5097807 - DNA, 22 bp, Homo sapiens
aagaggcgttgctttcactctc

SEQ ID NO: 5097808 - DNA, 15 bp, Homo sapiens
aagaggctccctcct

SEQ ID NO: 5097809 - DNA, 17 bp, Homo sapiens
aagaggctccctcctgt

SEQ ID NO: 5097810 - DNA, 18 bp, Homo sapiens
aagaggctgaaagaggcc

SEQ ID NO: 5097811 - DNA, 14 bp, Homo sapiens
aagaggctgaggca

SEQ ID NO: 5097812 - DNA, 21 bp, Homo sapiens
aagaggctgataattccagtg

SEQ ID NO: 5097813 - DNA, 13 bp, Homo sapiens
aagaggctggttc

SEQ ID NO: 5097814 - DNA, 15 bp, Homo sapiens
aagaggctgtgtggc

SEQ ID NO: 5097815 - DNA, 21 bp, Homo sapiens
aagaggctgtgtggccaacca

SEQ ID NO: 5097816 - DNA, 23 bp, Homo sapiens
aagaggctgtgtggccaaccagg

SEQ ID NO: 5097817 - DNA, 15 bp, Homo sapiens
aagaggcttccaagc

SEQ ID NO: 5097818 - DNA, 20 bp, Homo sapiens
aagaggcttccaagcattac

SEQ ID NO: 5097819 - DNA, 16 bp, Homo sapiens
aagaggcttctcctgt

SEQ ID NO: 5097820 - DNA, 17 bp, Homo sapiens
aagaggcttctcctgtt

SEQ ID NO: 5097821 - DNA, 23 bp, Homo sapiens
aagagggaagaaagagaaggagc

SEQ ID NO: 5097822 - DNA, 19 bp, Homo sapiens
aagagggaaggtgaccgcc

SEQ ID NO: 5097823 - DNA, 11 bp, Homo sapiens
aagagggacag

SEQ ID NO: 5097824 - DNA, 19 bp, Homo sapiens
aagagggacataagataaa

SEQ ID NO: 5097825 - DNA, 16 bp, Homo sapiens
aagagggacgcctggg

SEQ ID NO: 5097826 - DNA, 16 bp, Homo sapiens
aagagggactccaagc

SEQ ID NO: 5097827 - DNA, 12 bp, Homo sapiens
aagagggagaag

SEQ ID NO: 5097828 - DNA, 18 bp, Homo sapiens
aagagggagaagcatgaa

SEQ ID NO: 5097829 - DNA, 15 bp, Homo sapiens
aagagggaggcttcc

SEQ ID NO: 5097830 - DNA, 21 bp, Homo sapiens
aagagggaggcttcctgactg

SEQ ID NO: 5097831 - DNA, 14 bp, Homo sapiens
aagagggagggaaa

SEQ ID NO: 5097832 - DNA, 22 bp, Homo sapiens
aagagggagggagggctccaga

SEQ ID NO: 5097833 - DNA, 23 bp, Homo sapiens
aagagggagggagggctccagac

SEQ ID NO: 5097834 - DNA, 20 bp, Homo sapiens
aagagggaggggacagaggc

SEQ ID NO: 5097835 - DNA, 19 bp, Homo sapiens
aagagggcaaagctgattt

SEQ ID NO: 5097836 - DNA, 17 bp, Homo sapiens
aagagggcccaaagaat

SEQ ID NO: 5097837 - DNA, 17 bp, Homo sapiens
aagagggcccagcccag

SEQ ID NO: 5097838 - DNA, 14 bp, Homo sapiens
aagagggcctgtgg

SEQ ID NO: 5097839 - DNA, 19 bp, Homo sapiens
aagagggcctgtgggagcc

SEQ ID NO: 5097840 - DNA, 16 bp, Homo sapiens
aagaggggcagccctt

SEQ ID NO: 5097841 - DNA, 16 bp, Homo sapiens
aagaggggcgggctca

SEQ ID NO: 5097842 - DNA, 20 bp, Homo sapiens
aagaggggcgggctcagagc

SEQ ID NO: 5097843 - DNA, 21 bp, Homo sapiens
aagaggggcgggctcagagct

SEQ ID NO: 5097844 - DNA, 23 bp, Homo sapiens
aagagggggctctgcccacctgg

SEQ ID NO: 5097845 - DNA, 13 bp, Homo sapiens
aagagggggctgg

SEQ ID NO: 5097846 - DNA, 17 bp, Homo sapiens
aagaggggtataggaca

SEQ ID NO: 5097847 - DNA, 15 bp, Homo sapiens
aagagggtaacaata

SEQ ID NO: 5097848 - DNA, 20 bp, Homo sapiens
aagagggtcccagggctgca

SEQ ID NO: 5097849 - DNA, 20 bp, Homo sapiens
aagagggtctctttgttcaa

SEQ ID NO: 5097850 - DNA, 17 bp, Homo sapiens
aagagggtgaaaggcag

SEQ ID NO: 5097851 - DNA, 19 bp, Homo sapiens
aagagggtgagggccttct

SEQ ID NO: 5097852 - DNA, 20 bp, Homo sapiens
aagagggtgagggccttctt

SEQ ID NO: 5097853 - DNA, 17 bp, Homo sapiens
aagagggtgggtgggta

SEQ ID NO: 5097854 - DNA, 17 bp, Homo sapiens
aagagggtttattttca

SEQ ID NO: 5097855 - DNA, 17 bp, Homo sapiens
aagaggtacagggtttt

SEQ ID NO: 5097856 - DNA, 18 bp, Homo sapiens
aagaggtaccaaaaaaga

SEQ ID NO: 5097857 - DNA, 22 bp, Homo sapiens
aagaggtccttggttgggtcaa

SEQ ID NO: 5097858 - DNA, 14 bp, Homo sapiens
aagaggtctcccca

SEQ ID NO: 5097859 - DNA, 16 bp, Homo sapiens
aagaggtgaccccagg

SEQ ID NO: 5097860 - DNA, 17 bp, Homo sapiens
aagaggtgctgctttgc

SEQ ID NO: 5097861 - DNA, 16 bp, Homo sapiens
aagaggtgggagggcc

SEQ ID NO: 5097862 - DNA, 15 bp, Homo sapiens
aagaggtggggacca

SEQ ID NO: 5097863 - DNA, 16 bp, Homo sapiens
aagaggtgtgcaagag

SEQ ID NO: 5097864 - DNA, 22 bp, Homo sapiens
aagaggtgtgggtgtctgtttg

SEQ ID NO: 5097865 - DNA, 15 bp, Homo sapiens
aagaggtgttatttg

SEQ ID NO: 5097866 - DNA, 22 bp, Homo sapiens
aagaggttctcagcaagtgtac

SEQ ID NO: 5097867 - DNA, 21 bp, Homo sapiens
aagaggttgcagtgagctgag

SEQ ID NO: 5097868 - DNA, 18 bp, Homo sapiens
aagaggttttaaagcttc

SEQ ID NO: 5097869 - DNA, 17 bp, Homo sapiens
aagagtaaaggaaatga

SEQ ID NO: 5097870 - DNA, 18 bp, Homo sapiens
aagagtaaaggaaatgat

SEQ ID NO: 5097871 - DNA, 14 bp, Homo sapiens
aagagtaaatattg

SEQ ID NO: 5097872 - DNA, 21 bp, Homo sapiens
aagagtaacactgaggcgctc

SEQ ID NO: 5097873 - DNA, 19 bp, Homo sapiens
aagagtaacacttgaaaag

SEQ ID NO: 5097874 - DNA, 23 bp, Homo sapiens
aagagtaacacttgaaaagtgtg

SEQ ID NO: 5097875 - DNA, 20 bp, Homo sapiens
aagagtaacagtcatcattt

SEQ ID NO: 5097876 - DNA, 18 bp, Homo sapiens
aagagtaagggtaaaaaa

SEQ ID NO: 5097877 - DNA, 15 bp, Homo sapiens
aagagtaatggtatt

SEQ ID NO: 5097878 - DNA, 14 bp, Homo sapiens
aagagtaatttcat

SEQ ID NO: 5097879 - DNA, 17 bp, Homo sapiens
aagagtacactcagcca

SEQ ID NO: 5097880 - DNA, 21 bp, Homo sapiens
aagagtacaggtcttctttaa

SEQ ID NO: 5097881 - DNA, 12 bp, Homo sapiens
aagagtaggaag

SEQ ID NO: 5097882 - DNA, 14 bp, Homo sapiens
aagagtaggaagac

SEQ ID NO: 5097883 - DNA, 19 bp, Homo sapiens
aagagtaggaagactttgg

SEQ ID NO: 5097884 - DNA, 16 bp, Homo sapiens
aagagtagttaaaagt

SEQ ID NO: 5097885 - DNA, 22 bp, Homo sapiens
aagagtagttgatgttgcattt

SEQ ID NO: 5097886 - DNA, 14 bp, Homo sapiens
aagagtatactttg

SEQ ID NO: 5097887 - DNA, 15 bp, Homo sapiens
aagagtatccttcct

SEQ ID NO: 5097888 - DNA, 13 bp, Homo sapiens
aagagtattaatg

SEQ ID NO: 5097889 - DNA, 14 bp, Homo sapiens
aagagtattccatt

SEQ ID NO: 5097890 - DNA, 22 bp, Homo sapiens
aagagtattttaagaagacata

SEQ ID NO: 5097891 - DNA, 15 bp, Homo sapiens
aagagtatttttaac

SEQ ID NO: 5097892 - DNA, 17 bp, Homo sapiens
aagagtcaaagtagtta

SEQ ID NO: 5097893 - DNA, 20 bp, Homo sapiens
aagaatagggagacaatcta

SEQ ID NO: 5097894 - DNA, 23 bp, Homo sapiens
aagaatagggagacaatctaaaa

SEQ ID NO: 5097895 - DNA, 22 bp, Homo sapiens
aagaatagggcccatgggaggg

SEQ ID NO: 5097896 - DNA, 14 bp, Homo sapiens
aagaataggtcatt

SEQ ID NO: 5097897 - DNA, 13 bp, Homo sapiens
aagaatagtgcct

SEQ ID NO: 5097898 - DNA, 19 bp, Homo sapiens
aagaatagttctaaaattg

SEQ ID NO: 5097899 - DNA, 14 bp, Homo sapiens
aagaatataaatat

SEQ ID NO: 5097900 - DNA, 16 bp, Homo sapiens
aagaatataatgggaa

SEQ ID NO: 5097901 - DNA, 12 bp, Homo sapiens
aagaatatagtt

SEQ ID NO: 5097902 - DNA, 20 bp, Homo sapiens
aagaatatattatataaaga

SEQ ID NO: 5097903 - DNA, 17 bp, Homo sapiens
aagaatatcaaataata

SEQ ID NO: 5097904 - DNA, 21 bp, Homo sapiens
aagaatatcctttaaaattta

SEQ ID NO: 5097905 - DNA, 16 bp, Homo sapiens
aagaatatctggcaaa

SEQ ID NO: 5097906 - DNA, 20 bp, Homo sapiens
aagaatatctgtaatggtac

SEQ ID NO: 5097907 - DNA, 13 bp, Homo sapiens
aagaatatgttca

SEQ ID NO: 5097908 - DNA, 21 bp, Homo sapiens
aagaatattcagagaatatca

SEQ ID NO: 5097909 - DNA, 16 bp, Homo sapiens
aagaatattctatgaa

SEQ ID NO: 5097910 - DNA, 17 bp, Homo sapiens
aagaatattgcaaaata

SEQ ID NO: 5097911 - DNA, 19 bp, Homo sapiens
aagaatattgcaaaataca

SEQ ID NO: 5097912 - DNA, 11 bp, Homo sapiens
aagaatattgt

SEQ ID NO: 5097913 - DNA, 12 bp, Homo sapiens
aagaatattgta

SEQ ID NO: 5097914 - DNA, 13 bp, Homo sapiens
aagaatattgtat

SEQ ID NO: 5097915 - DNA, 12 bp, Homo sapiens
aagaatattgtt

SEQ ID NO: 5097916 - DNA, 14 bp, Homo sapiens
aagaatatttagaa

SEQ ID NO: 5097917 - DNA, 17 bp, Homo sapiens
aagaatattttgatgca

SEQ ID NO: 5097918 - DNA, 21 bp, Homo sapiens
aagaatcacaataattttcta

SEQ ID NO: 5097919 - DNA, 21 bp, Homo sapiens
aagaatcacctaattaatttc

SEQ ID NO: 5097920 - DNA, 12 bp, Homo sapiens
aagaatcagaga

SEQ ID NO: 5097921 - DNA, 14 bp, Homo sapiens
aagaatcagagtag

SEQ ID NO: 5097922 - DNA, 22 bp, Homo sapiens
aagaatcagagtagaaataaaa

SEQ ID NO: 5097923 - DNA, 22 bp, Homo sapiens
aagaatcaggagagggatacaa

SEQ ID NO: 5097924 - DNA, 14 bp, Homo sapiens
aagaatcagtagga

SEQ ID NO: 5097925 - DNA, 16 bp, Homo sapiens
aagaatcatagtgcca

SEQ ID NO: 5097926 - DNA, 22 bp, Homo sapiens
aagaatcattgtaaacattagt

SEQ ID NO: 5097927 - DNA, 23 bp, Homo sapiens
aagaatcattgtaaacattagtt

SEQ ID NO: 5097928 - DNA, 22 bp, Homo sapiens
aagaatcattgtgcttaataat

SEQ ID NO: 5097929 - DNA, 19 bp, Homo sapiens
aagaatccacatttctaaa

SEQ ID NO: 5097930 - DNA, 13 bp, Homo sapiens
aagaatcccaccc

SEQ ID NO: 5097931 - DNA, 17 bp, Homo sapiens
aagaatccttatctata

SEQ ID NO: 5097932 - DNA, 21 bp, Homo sapiens
aagaatccttatctataaaag

SEQ ID NO: 5097933 - DNA, 21 bp, Homo sapiens
aagaatccttttgtagaatga

SEQ ID NO: 5097934 - DNA, 23 bp, Homo sapiens
aagaatcgatgggggatgcttca

SEQ ID NO: 5097935 - DNA, 13 bp, Homo sapiens
aagaatcggcagt

SEQ ID NO: 5097936 - DNA, 13 bp, Homo sapiens
aagaatctagaag

SEQ ID NO: 5097937 - DNA, 14 bp, Homo sapiens
aagaatctagaaga

SEQ ID NO: 5097938 - DNA, 20 bp, Homo sapiens
aagaatctagataggtgctt

SEQ ID NO: 5097939 - DNA, 19 bp, Homo sapiens
aagaatctatctgcttatg

SEQ ID NO: 5097940 - DNA, 16 bp, Homo sapiens
aagaatctattagatt

SEQ ID NO: 5097941 - DNA, 13 bp, Homo sapiens
aagaatctgcccc

SEQ ID NO: 5097942 - DNA, 20 bp, Homo sapiens
aagaatcttggtttgccttc

SEQ ID NO: 5097943 - DNA, 22 bp, Homo sapiens
aagaatgaaaaatataatgttg

SEQ ID NO: 5097944 - DNA, 14 bp, Homo sapiens
aagaatgaaaacaa

SEQ ID NO: 5097945 - DNA, 17 bp, Homo sapiens
aagaatgaaatgaatga

SEQ ID NO: 5097946 - DNA, 15 bp, Homo sapiens
aagaatgaacacaat

SEQ ID NO: 5097947 - DNA, 14 bp, Homo sapiens
aagaatgagaaaca

SEQ ID NO: 5097948 - DNA, 21 bp, Homo sapiens
aagaatgagaaggagtcagaa

SEQ ID NO: 5097949 - DNA, 13 bp, Homo sapiens
aagaatgagcatt

SEQ ID NO: 5097950 - DNA, 14 bp, Homo sapiens
aagaatgagtttct

SEQ ID NO: 5097951 - DNA, 19 bp, Homo sapiens
aagaatgatctgattgacc

SEQ ID NO: 5097952 - DNA, 18 bp, Homo sapiens
aagaatgattatgaatta

SEQ ID NO: 5097953 - DNA, 12 bp, Homo sapiens
aagaatgcaaaa

SEQ ID NO: 5097954 - DNA, 23 bp, Homo sapiens
aagaatgcagattcctgggcctg

SEQ ID NO: 5097955 - DNA, 22 bp, Homo sapiens
aagaatgccatttctcacgccc

SEQ ID NO: 5097956 - DNA, 12 bp, Homo sapiens
aagaatgctgaa

SEQ ID NO: 5097957 - DNA, 16 bp, Homo sapiens
aagaatgctgaaacca

SEQ ID NO: 5097958 - DNA, 17 bp, Homo sapiens
aagaatgctgcaacttt

SEQ ID NO: 5097959 - DNA, 17 bp, Homo sapiens
aagaatgcttaatcaga

SEQ ID NO: 5097960 - DNA, 20 bp, Homo sapiens
aagaatggcagaaaagttta

SEQ ID NO: 5097961 - DNA, 18 bp, Homo sapiens
aagaatgggcagttacat

SEQ ID NO: 5097962 - DNA, 21 bp, Homo sapiens
aagaatgggcagttacatgca

SEQ ID NO: 5097963 - DNA, 20 bp, Homo sapiens
aagaatggggatcacagaga

SEQ ID NO: 5097964 - DNA, 19 bp, Homo sapiens
aagaatggtccgtgctaag

SEQ ID NO: 5097965 - DNA, 15 bp, Homo sapiens
aagaatggtgtgtgc

SEQ ID NO: 5097966 - DNA, 12 bp, Homo sapiens
aagaatgtaaag

SEQ ID NO: 5097967 - DNA, 16 bp, Homo sapiens
aagaatgtacagaaaa

SEQ ID NO: 5097968 - DNA, 12 bp, Homo sapiens
aagaatgtacat

SEQ ID NO: 5097969 - DNA, 15 bp, Homo sapiens
aagaatgtacattac

SEQ ID NO: 5097970 - DNA, 22 bp, Homo sapiens
aagaatgtcaggaatttaagaa

SEQ ID NO: 5097971 - DNA, 20 bp, Homo sapiens
aagaatgtccttattcttgt

SEQ ID NO: 5097972 - DNA, 14 bp, Homo sapiens
aagaatgtctgtac

SEQ ID NO: 5097973 - DNA, 18 bp, Homo sapiens
aagaatgtgctagagtta

SEQ ID NO: 5097974 - DNA, 14 bp, Homo sapiens
aagaatgtgtttca

SEQ ID NO: 5097975 - DNA, 16 bp, Homo sapiens
aagaatgttagagcac

SEQ ID NO: 5097976 - DNA, 16 bp, Homo sapiens
aagaatgttagagtaa

SEQ ID NO: 5097977 - DNA, 21 bp, Homo sapiens
aagaatgttagagtaatgaaa

SEQ ID NO: 5097978 - DNA, 19 bp, Homo sapiens
aagaatgttggtttacttt

SEQ ID NO: 5097979 - DNA, 21 bp, Homo sapiens
aagaatgttggtttactttca

SEQ ID NO: 5097980 - DNA, 21 bp, Homo sapiens
aagaatgtttaatagaaaatt

SEQ ID NO: 5097981 - DNA, 21 bp, Homo sapiens
aagaatgtttcagttatagag

SEQ ID NO: 5097982 - DNA, 13 bp, Homo sapiens
aagaatgttttgg

SEQ ID NO: 5097983 - DNA, 14 bp, Homo sapiens
aagaattaaaaact

SEQ ID NO: 5097984 - DNA, 13 bp, Homo sapiens
aagaattaaaact

SEQ ID NO: 5097985 - DNA, 14 bp, Homo sapiens
aagaattaaaactg

SEQ ID NO: 5097986 - DNA, 16 bp, Homo sapiens
aagaattaaaactgag

SEQ ID NO: 5097987 - DNA, 19 bp, Homo sapiens
aagaattaagatacaaatt

SEQ ID NO: 5097988 - DNA, 18 bp, Homo sapiens
aagaattacaatttcttt

SEQ ID NO: 5097989 - DNA, 22 bp, Homo sapiens
aagaattaccaagagaagggga

SEQ ID NO: 5097990 - DNA, 13 bp, Homo sapiens
aagaattactttg

SEQ ID NO: 5097991 - DNA, 19 bp, Homo sapiens
aagaattagaagtctttca

SEQ ID NO: 5097992 - DNA, 20 bp, Homo sapiens
aagaattagaagtctttcag

SEQ ID NO: 5097993 - DNA, 15 bp, Homo sapiens
aagaattagacatct

SEQ ID NO: 5097994 - DNA, 17 bp, Homo sapiens
aagaattaggtttcttt

SEQ ID NO: 5097995 - DNA, 21 bp, Homo sapiens
aagaattatgtaatatattgt

SEQ ID NO: 5097996 - DNA, 22 bp, Homo sapiens
aagaattatgtaatatattgta

SEQ ID NO: 5097997 - DNA, 23 bp, Homo sapiens
aagaattatgtaatatattgtac

SEQ ID NO: 5097998 - DNA, 20 bp, Homo sapiens
aagaattattcagtgaattt

SEQ ID NO: 5097999 - DNA, 23 bp, Homo sapiens
aagaattattcagtgaatttgtc

SEQ ID NO: 5098000 - DNA, 22 bp, Homo sapiens
aagaattatttttgtgtttcta

SEQ ID NO: 5098001 - DNA, 21 bp, Homo sapiens
aagaattcaaattttatctgc

SEQ ID NO: 5098002 - DNA, 15 bp, Homo sapiens
aagaattcacacctt

SEQ ID NO: 5098003 - DNA, 14 bp, Homo sapiens
aagaattcagattg

SEQ ID NO: 5098004 - DNA, 20 bp, Homo sapiens
aagaattcagtagcatttta

SEQ ID NO: 5098005 - DNA, 16 bp, Homo sapiens
aagaattcatgatgct

SEQ ID NO: 5098006 - DNA, 13 bp, Homo sapiens
aagaattccaaag

SEQ ID NO: 5098007 - DNA, 13 bp, Homo sapiens
aagaattcctgaa

SEQ ID NO: 5098008 - DNA, 14 bp, Homo sapiens
aagaattctatttt

SEQ ID NO: 5098009 - DNA, 18 bp, Homo sapiens
aagaattctattttgctg

SEQ ID NO: 5098010 - DNA, 20 bp, Homo sapiens
aagaattctccaaaacaatt

SEQ ID NO: 5098011 - DNA, 19 bp, Homo sapiens
aagaattctggtgtttaca

SEQ ID NO: 5098012 - DNA, 17 bp, Homo sapiens
aagaattcttatgctta

SEQ ID NO: 5098013 - DNA, 15 bp, Homo sapiens
aagaattgaaaagtt

SEQ ID NO: 5098014 - DNA, 20 bp, Homo sapiens
aagaattgaaaagtttttgt

SEQ ID NO: 5098015 - DNA, 14 bp, Homo sapiens
aagaattgaagata

SEQ ID NO: 5098016 - DNA, 21 bp, Homo sapiens
aagaattgaccatctgctttt

SEQ ID NO: 5098017 - DNA, 15 bp, Homo sapiens
aagaattgaccttga

SEQ ID NO: 5098018 - DNA, 20 bp, Homo sapiens
aagaattgaccttgaccatt

SEQ ID NO: 5098019 - DNA, 16 bp, Homo sapiens
aagaattgagcagttc

SEQ ID NO: 5098020 - DNA, 16 bp, Homo sapiens
aagaattgagtaatgg

SEQ ID NO: 5098021 - DNA, 15 bp, Homo sapiens
aagaattgccaatct

SEQ ID NO: 5098022 - DNA, 17 bp, Homo sapiens
aagaattgccaatcttg

SEQ ID NO: 5098023 - DNA, 18 bp, Homo sapiens
aagaattgccaatcttgt

SEQ ID NO: 5098024 - DNA, 14 bp, Homo sapiens
aagaattgtccatg

SEQ ID NO: 5098025 - DNA, 15 bp, Homo sapiens
aagaattgtcttgca

SEQ ID NO: 5098026 - DNA, 20 bp, Homo sapiens
aagaattgtctttctgtctc

SEQ ID NO: 5098027 - DNA, 12 bp, Homo sapiens
aagaattgttgg

SEQ ID NO: 5098028 - DNA, 21 bp, Homo sapiens
aagaattgttgggggtttttt

SEQ ID NO: 5098029 - DNA, 20 bp, Homo sapiens
aagaattgtttttgaattta

SEQ ID NO: 5098030 - DNA, 13 bp, Homo sapiens
aagaatttaaaga

SEQ ID NO: 5098031 - DNA, 14 bp, Homo sapiens
aagaatttaaagaa

SEQ ID NO: 5098032 - DNA, 22 bp, Homo sapiens
aagaatttaatggactgtgaat

SEQ ID NO: 5098033 - DNA, 19 bp, Homo sapiens
aagaatttaccagaaatat

SEQ ID NO: 5098034 - DNA, 17 bp, Homo sapiens
aagaatttagatcttat

SEQ ID NO: 5098035 - DNA, 19 bp, Homo sapiens
aagaatttagatcttatat

SEQ ID NO: 5098036 - DNA, 14 bp, Homo sapiens
aagaatttcacaag

SEQ ID NO: 5098037 - DNA, 20 bp, Homo sapiens
aagaatttctgctaaatatc

SEQ ID NO: 5098038 - DNA, 19 bp, Homo sapiens
aagaatttctttataaaat

SEQ ID NO: 5098039 - DNA, 20 bp, Homo sapiens
aagaatttgaaagtttcctt

SEQ ID NO: 5098040 - DNA, 20 bp, Homo sapiens
aagaatttgaagacttcaaa

SEQ ID NO: 5098041 - DNA, 12 bp, Homo sapiens
aagaatttgcat

SEQ ID NO: 5098042 - DNA, 20 bp, Homo sapiens
aagaatttggggcaggaaat

SEQ ID NO: 5098043 - DNA, 16 bp, Homo sapiens
aagaattttaaaaatg

SEQ ID NO: 5098044 - DNA, 19 bp, Homo sapiens
aagaattttatttttctgt

SEQ ID NO: 5098045 - DNA, 22 bp, Homo sapiens
aagaattttcagaccccagcgg

SEQ ID NO: 5098046 - DNA, 21 bp, Homo sapiens
aagaattttgttttacttttt

SEQ ID NO: 5098047 - DNA, 17 bp, Homo sapiens
aagaatttttgtttgga

SEQ ID NO: 5098048 - DNA, 16 bp, Homo sapiens
aagaattttttatttt

SEQ ID NO: 5098049 - DNA, 20 bp, Homo sapiens
aagaattttttattttttgg

SEQ ID NO: 5098050 - DNA, 21 bp, Homo sapiens
aagaattttttctcattctgt

SEQ ID NO: 5098051 - DNA, 23 bp, Homo sapiens
aagaattttttttttaagatatg

SEQ ID NO: 5098052 - DNA, 16 bp, Homo sapiens
aagacaaaaagctact

SEQ ID NO: 5098053 - DNA, 14 bp, Homo sapiens
aagacaaaaatact

SEQ ID NO: 5098054 - DNA, 15 bp, Homo sapiens
aagacaaaaatactc

SEQ ID NO: 5098055 - DNA, 21 bp, Homo sapiens
aagacaaaaatactctaattc

SEQ ID NO: 5098056 - DNA, 13 bp, Homo sapiens
aagacaaaaatca

SEQ ID NO: 5098057 - DNA, 18 bp, Homo sapiens
aagacaaaaatcaaagaa

SEQ ID NO: 5098058 - DNA, 16 bp, Homo sapiens
aagacaaaagtctgtc

SEQ ID NO: 5098059 - DNA, 22 bp, Homo sapiens
aagacaaaagtctgtctttcct

SEQ ID NO: 5098060 - DNA, 21 bp, Homo sapiens
aagacaaaattgtaagccaga

SEQ ID NO: 5098061 - DNA, 16 bp, Homo sapiens
aagacaaaatttaatt

SEQ ID NO: 5098062 - DNA, 18 bp, Homo sapiens
aagacaaaatttaattgt

SEQ ID NO: 5098063 - DNA, 22 bp, Homo sapiens
aagacaaaatttaattgtgtaa

SEQ ID NO: 5098064 - DNA, 20 bp, Homo sapiens
aagacaaacaccttatttgt

SEQ ID NO: 5098065 - DNA, 23 bp, Homo sapiens
aagacaaacactgccatattgtg

SEQ ID NO: 5098066 - DNA, 20 bp, Homo sapiens
aagacaaaccactgtacata

SEQ ID NO: 5098067 - DNA, 16 bp, Homo sapiens
aagacaaactaaactt

SEQ ID NO: 5098068 - DNA, 17 bp, Homo sapiens
aagacaaactaaacttt

SEQ ID NO: 5098069 - DNA, 17 bp, Homo sapiens
aagacaaagaaggaaaa

SEQ ID NO: 5098070 - DNA, 13 bp, Homo sapiens
aagacaaatacac

SEQ ID NO: 5098071 - DNA, 19 bp, Homo sapiens
aagagtcacaatttgcaaa

SEQ ID NO: 5098072 - DNA, 18 bp, Homo sapiens
aagagtcagacatttctt

SEQ ID NO: 5098073 - DNA, 14 bp, Homo sapiens
aagagtcagccctt

SEQ ID NO: 5098074 - DNA, 17 bp, Homo sapiens
aagagtccggatttcta

SEQ ID NO: 5098075 - DNA, 19 bp, Homo sapiens
aagagtccggatttctaac

SEQ ID NO: 5098076 - DNA, 21 bp, Homo sapiens
aagagtcctgaggcagaacct

SEQ ID NO: 5098077 - DNA, 22 bp, Homo sapiens
aagagtcgagtgatatggcttg

SEQ ID NO: 5098078 - DNA, 15 bp, Homo sapiens
aagagtctccttctc

SEQ ID NO: 5098079 - DNA, 18 bp, Homo sapiens
aagagtctccttctcttc

SEQ ID NO: 5098080 - DNA, 15 bp, Homo sapiens
aagagtctctccagc

SEQ ID NO: 5098081 - DNA, 13 bp, Homo sapiens
aagagtctctggc

SEQ ID NO: 5098082 - DNA, 16 bp, Homo sapiens
aagagtctctggctca

SEQ ID NO: 5098083 - DNA, 18 bp, Homo sapiens
aagagtctctggctcagc

SEQ ID NO: 5098084 - DNA, 17 bp, Homo sapiens
aagagtctggggaccag

SEQ ID NO: 5098085 - DNA, 20 bp, Homo sapiens
aagagtgaaatattgtaaat

SEQ ID NO: 5098086 - DNA, 22 bp, Homo sapiens
aagagtgacagtggattgcatt

SEQ ID NO: 5098087 - DNA, 18 bp, Homo sapiens
aagagtgactagtacaaa

SEQ ID NO: 5098088 - DNA, 22 bp, Homo sapiens
aagagtgacttattttgtctta

SEQ ID NO: 5098089 - DNA, 14 bp, Homo sapiens
aagagtgatgcctg

SEQ ID NO: 5098090 - DNA, 21 bp, Homo sapiens
aagagtgattgcagctttatg

SEQ ID NO: 5098091 - DNA, 22 bp, Homo sapiens
aagagtgccctgctttgcaaac

SEQ ID NO: 5098092 - DNA, 11 bp, Homo sapiens
aagagtgctga

SEQ ID NO: 5098093 - DNA, 22 bp, Homo sapiens
aagagtggcagctataggaaat

SEQ ID NO: 5098094 - DNA, 17 bp, Homo sapiens
aagagtggccccacctg

SEQ ID NO: 5098095 - DNA, 15 bp, Homo sapiens
aagagtgggctttgt

SEQ ID NO: 5098096 - DNA, 24 bp, Homo sapiens
aagagtggggggaggaagcagagg

SEQ ID NO: 5098097 - DNA, 15 bp, Homo sapiens
aagagtgtaaaatat

SEQ ID NO: 5098098 - DNA, 12 bp, Homo sapiens
aagagtgtagaa

SEQ ID NO: 5098099 - DNA, 14 bp, Homo sapiens
aagagtgtagaagc

SEQ ID NO: 5098100 - DNA, 18 bp, Homo sapiens
aagagtgtagaagcattc

SEQ ID NO: 5098101 - DNA, 22 bp, Homo sapiens
aagagtgtagaagcattccttc

SEQ ID NO: 5098102 - DNA, 19 bp, Homo sapiens
aagagtgtagatcagagca

SEQ ID NO: 5098103 - DNA, 16 bp, Homo sapiens
aagagtgtctatggag

SEQ ID NO: 5098104 - DNA, 14 bp, Homo sapiens
aagagtgtgaaatc

SEQ ID NO: 5098105 - DNA, 21 bp, Homo sapiens
aagagtgtggagtcattctca

SEQ ID NO: 5098106 - DNA, 22 bp, Homo sapiens
aagagtgtggagtcattctcat

SEQ ID NO: 5098107 - DNA, 20 bp, Homo sapiens
aagagtgtgttataaaataa

SEQ ID NO: 5098108 - DNA, 19 bp, Homo sapiens
aagagttacaataaagttt

SEQ ID NO: 5098109 - DNA, 20 bp, Homo sapiens
aagagttacaataaagttta

SEQ ID NO: 5098110 - DNA, 22 bp, Homo sapiens
aagagttatatgacttcttgtt

SEQ ID NO: 5098111 - DNA, 14 bp, Homo sapiens
aagagttcaagaaa

SEQ ID NO: 5098112 - DNA, 23 bp, Homo sapiens
aagagttctagatttttaagaga

SEQ ID NO: 5098113 - DNA, 20 bp, Homo sapiens
aagagttctatggagacttt

SEQ ID NO: 5098114 - DNA, 22 bp, Homo sapiens
aagagttctccttgtacttgaa

SEQ ID NO: 5098115 - DNA, 23 bp, Homo sapiens
aagagttcttaaggattgtgata

SEQ ID NO: 5098116 - DNA, 18 bp, Homo sapiens
aagagttcttgcccttca

SEQ ID NO: 5098117 - DNA, 22 bp, Homo sapiens
aagagttctttaggtgcctcct

SEQ ID NO: 5098118 - DNA, 21 bp, Homo sapiens
aagagttgccccgtctctgtt

SEQ ID NO: 5098119 - DNA, 20 bp, Homo sapiens
aagagttgctttgccagagc

SEQ ID NO: 5098120 - DNA, 18 bp, Homo sapiens
aagagttgtcctgatgtt

SEQ ID NO: 5098121 - DNA, 18 bp, Homo sapiens
aagagttgtgttgttctt

SEQ ID NO: 5098122 - DNA, 19 bp, Homo sapiens
aagagtttaaagagaaaag

SEQ ID NO: 5098123 - DNA, 22 bp, Homo sapiens
aagagtttaactttgggcccag

SEQ ID NO: 5098124 - DNA, 20 bp, Homo sapiens
aagagtttacaagaaataaa

SEQ ID NO: 5098125 - DNA, 19 bp, Homo sapiens
aagagtttcagtttgttgg

SEQ ID NO: 5098126 - DNA, 21 bp, Homo sapiens
aagagtttcagtttgttggaa

SEQ ID NO: 5098127 - DNA, 20 bp, Homo sapiens
aagagtttgatgaggccctc

SEQ ID NO: 5098128 - DNA, 18 bp, Homo sapiens
aagagtttgtaaatgact

SEQ ID NO: 5098129 - DNA, 19 bp, Homo sapiens
aagagtttgtaaatgactt

SEQ ID NO: 5098130 - DNA, 14 bp, Homo sapiens
aagagtttgtgact

SEQ ID NO: 5098131 - DNA, 15 bp, Homo sapiens
aagagtttgttctgt

SEQ ID NO: 5098132 - DNA, 17 bp, Homo sapiens
aagagttttctttagta

SEQ ID NO: 5098133 - DNA, 14 bp, Homo sapiens
aagagttttgggag

SEQ ID NO: 5098134 - DNA, 21 bp, Homo sapiens
aagagtttttttctgtttata

SEQ ID NO: 5098135 - DNA, 18 bp, Homo sapiens
aagataaaaaaacagctt

SEQ ID NO: 5098136 - DNA, 15 bp, Homo sapiens
aagataaaaatcagt

SEQ ID NO: 5098137 - DNA, 18 bp, Homo sapiens
aagataaaataaaatttt

SEQ ID NO: 5098138 - DNA, 18 bp, Homo sapiens
aagataaaatatcctcag

SEQ ID NO: 5098139 - DNA, 14 bp, Homo sapiens
aagataaaatgatg

SEQ ID NO: 5098140 - DNA, 18 bp, Homo sapiens
aagataaaatgatgttat

SEQ ID NO: 5098141 - DNA, 11 bp, Homo sapiens
aagataaagag

SEQ ID NO: 5098142 - DNA, 12 bp, Homo sapiens
aagataaagatg

SEQ ID NO: 5098143 - DNA, 14 bp, Homo sapiens
aagataaagatgat

SEQ ID NO: 5098144 - DNA, 17 bp, Homo sapiens
aagataaagccagaagc

SEQ ID NO: 5098145 - DNA, 20 bp, Homo sapiens
aagataaatccaactctgac

SEQ ID NO: 5098146 - DNA, 11 bp, Homo sapiens
aagataaatga

SEQ ID NO: 5098147 - DNA, 14 bp, Homo sapiens
aagataaatgagct

SEQ ID NO: 5098148 - DNA, 17 bp, Homo sapiens
aagataacattttcaat

SEQ ID NO: 5098149 - DNA, 17 bp, Homo sapiens
aagataacgcaggagag

SEQ ID NO: 5098150 - DNA, 18 bp, Homo sapiens
aagataacttactgtata

SEQ ID NO: 5098151 - DNA, 23 bp, Homo sapiens
aagataagacttgtttctttctg

SEQ ID NO: 5098152 - DNA, 13 bp, Homo sapiens
aagataagatttc

SEQ ID NO: 5098153 - DNA, 19 bp, Homo sapiens
aagataaggtctgaataat

SEQ ID NO: 5098154 - DNA, 16 bp, Homo sapiens
aagataagtctacatt

SEQ ID NO: 5098155 - DNA, 14 bp, Homo sapiens
aagataagtgcagt

SEQ ID NO: 5098156 - DNA, 17 bp, Homo sapiens
aagataagttggaaaca

SEQ ID NO: 5098157 - DNA, 19 bp, Homo sapiens
aagataagttggaaacact

SEQ ID NO: 5098158 - DNA, 22 bp, Homo sapiens
aagataagttggaaacactaaa

SEQ ID NO: 5098159 - DNA, 17 bp, Homo sapiens
aagataatcattgctta

SEQ ID NO: 5098160 - DNA, 15 bp, Homo sapiens
aagataatctcagtg

SEQ ID NO: 5098161 - DNA, 23 bp, Homo sapiens
aagataatctcagtgctttcctc

SEQ ID NO: 5098162 - DNA, 15 bp, Homo sapiens
aagataatctccaaa

SEQ ID NO: 5098163 - DNA, 21 bp, Homo sapiens
aagataatcttagctgccaag

SEQ ID NO: 5098164 - DNA, 17 bp, Homo sapiens
aagataatgcatatttt

SEQ ID NO: 5098165 - DNA, 20 bp, Homo sapiens
aagataatggataatcttcg

SEQ ID NO: 5098166 - DNA, 12 bp, Homo sapiens
aagataatgttc

SEQ ID NO: 5098167 - DNA, 17 bp, Homo sapiens
aagataattgctattta

SEQ ID NO: 5098168 - DNA, 14 bp, Homo sapiens
aagataattttatg

SEQ ID NO: 5098169 - DNA, 12 bp, Homo sapiens
aagatacaaata

SEQ ID NO: 5098170 - DNA, 15 bp, Homo sapiens
aagatacaaatggtg

SEQ ID NO: 5098171 - DNA, 20 bp, Homo sapiens
aagatacaaatggtggagga

SEQ ID NO: 5098172 - DNA, 20 bp, Homo sapiens
aagatacaagtttcagacag

SEQ ID NO: 5098173 - DNA, 15 bp, Homo sapiens
aagatacaataaaac

SEQ ID NO: 5098174 - DNA, 15 bp, Homo sapiens
aagatacactcctgc

SEQ ID NO: 5098175 - DNA, 16 bp, Homo sapiens
aagatacactcctgct

SEQ ID NO: 5098176 - DNA, 19 bp, Homo sapiens
aagatacactcctgctgtg

SEQ ID NO: 5098177 - DNA, 21 bp, Homo sapiens
aagatacactgacttggtgca

SEQ ID NO: 5098178 - DNA, 19 bp, Homo sapiens
aagatacacttgtaaataa

SEQ ID NO: 5098179 - DNA, 20 bp, Homo sapiens
aagatacagaactctttcaa

SEQ ID NO: 5098180 - DNA, 18 bp, Homo sapiens
aagatacagacattcaat

SEQ ID NO: 5098181 - DNA, 22 bp, Homo sapiens
aagatacagcctgcaagtggta

SEQ ID NO: 5098182 - DNA, 13 bp, Homo sapiens
aagatacatgcta

SEQ ID NO: 5098183 - DNA, 21 bp, Homo sapiens
aagatacatgttgtatttatg

SEQ ID NO: 5098184 - DNA, 14 bp, Homo sapiens
aagatacatttgta

SEQ ID NO: 5098185 - DNA, 15 bp, Homo sapiens
aagataccaaataga

SEQ ID NO: 5098186 - DNA, 15 bp, Homo sapiens
aagataccatcagca

SEQ ID NO: 5098187 - DNA, 21 bp, Homo sapiens
aagatacctttttttttcttt

SEQ ID NO: 5098188 - DNA, 13 bp, Homo sapiens
aagatactgaaat

SEQ ID NO: 5098189 - DNA, 10 bp, Homo sapiens
aagatactgc

SEQ ID NO: 5098190 - DNA, 20 bp, Homo sapiens
aagatactgtatatgtcaaa

SEQ ID NO: 5098191 - DNA, 14 bp, Homo sapiens
aagatacttaagtg

SEQ ID NO: 5098192 - DNA, 17 bp, Homo sapiens
aagatagaaagctggac

SEQ ID NO: 5098193 - DNA, 14 bp, Homo sapiens
aagatagaacaggc

SEQ ID NO: 5098194 - DNA, 12 bp, Homo sapiens
aagatagaagaa

SEQ ID NO: 5098195 - DNA, 14 bp, Homo sapiens
aagatagaagaaaa

SEQ ID NO: 5098196 - DNA, 13 bp, Homo sapiens
aagatagacaggt

SEQ ID NO: 5098197 - DNA, 17 bp, Homo sapiens
aagatagacttattctt

SEQ ID NO: 5098198 - DNA, 22 bp, Homo sapiens
aagatagagattcccctggacc

SEQ ID NO: 5098199 - DNA, 17 bp, Homo sapiens
aagatagagtaaaaaga

SEQ ID NO: 5098200 - DNA, 19 bp, Homo sapiens
aagatagagtaaaaagaaa

SEQ ID NO: 5098201 - DNA, 20 bp, Homo sapiens
aagatagcagaagagtagat

SEQ ID NO: 5098202 - DNA, 12 bp, Homo sapiens
aagatagctcct

SEQ ID NO: 5098203 - DNA, 22 bp, Homo sapiens
aagataggacgtatttataata

SEQ ID NO: 5098204 - DNA, 23 bp, Homo sapiens
aagataggacgtatttataatag

SEQ ID NO: 5098205 - DNA, 18 bp, Homo sapiens
aagataggagttctctga

SEQ ID NO: 5098206 - DNA, 16 bp, Homo sapiens
aagataggctctgcac

SEQ ID NO: 5098207 - DNA, 17 bp, Homo sapiens
aagataggctctgcaca

SEQ ID NO: 5098208 - DNA, 15 bp, Homo sapiens
aagatagggaacact

SEQ ID NO: 5098209 - DNA, 22 bp, Homo sapiens
aagataggttctgctttctgat

SEQ ID NO: 5098210 - DNA, 19 bp, Homo sapiens
aagatagttacatttatgt

SEQ ID NO: 5098211 - DNA, 22 bp, Homo sapiens
aagatagttacatttatgtgct

SEQ ID NO: 5098212 - DNA, 17 bp, Homo sapiens
aagatataagtgctgta

SEQ ID NO: 5098213 - DNA, 15 bp, Homo sapiens
aagatatacttgttt

SEQ ID NO: 5098214 - DNA, 21 bp, Homo sapiens
aagatatacttgtttttgtaa

SEQ ID NO: 5098215 - DNA, 12 bp, Homo sapiens
aagatatataga

SEQ ID NO: 5098216 - DNA, 12 bp, Homo sapiens
aagatatatatt

SEQ ID NO: 5098217 - DNA, 14 bp, Homo sapiens
aagatatatattca

SEQ ID NO: 5098218 - DNA, 12 bp, Homo sapiens
aagatatatgtg

SEQ ID NO: 5098219 - DNA, 19 bp, Homo sapiens
aagatatatgtgtatacat

SEQ ID NO: 5098220 - DNA, 15 bp, Homo sapiens
aagatatattaaaaa

SEQ ID NO: 5098221 - DNA, 14 bp, Homo sapiens
aagatatattttga

SEQ ID NO: 5098222 - DNA, 20 bp, Homo sapiens
aagatatcagagctcttaat

SEQ ID NO: 5098223 - DNA, 15 bp, Homo sapiens
aagatatccatcttt

SEQ ID NO: 5098224 - DNA, 16 bp, Homo sapiens
aagatatcttttcttt

SEQ ID NO: 5098225 - DNA, 18 bp, Homo sapiens
aagatatgaagaactatt

SEQ ID NO: 5098226 - DNA, 21 bp, Homo sapiens
aagatatgccactaacttcta

SEQ ID NO: 5098227 - DNA, 19 bp, Homo sapiens
aagatatgggacatttttg

SEQ ID NO: 5098228 - DNA, 13 bp, Homo sapiens
aagatattattca

SEQ ID NO: 5098229 - DNA, 13 bp, Homo sapiens
aagatattattta

SEQ ID NO: 5098230 - DNA, 13 bp, Homo sapiens
aagatattcaggt

SEQ ID NO: 5098231 - DNA, 13 bp, Homo sapiens
aagatattcctga

SEQ ID NO: 5098232 - DNA, 18 bp, Homo sapiens
aagatattcctttttaac

SEQ ID NO: 5098233 - DNA, 22 bp, Homo sapiens
aagatattgatcaaatatagaa

SEQ ID NO: 5098234 - DNA, 15 bp, Homo sapiens
aagatattgtacata

SEQ ID NO: 5098235 - DNA, 22 bp, Homo sapiens
aagatattgtatctcctttaat

SEQ ID NO: 5098236 - DNA, 20 bp, Homo sapiens
aagatattgtattatcatat

SEQ ID NO: 5098237 - DNA, 15 bp, Homo sapiens
aagatattgttcaaa

SEQ ID NO: 5098238 - DNA, 19 bp, Homo sapiens
aagatattgttgttttcca

SEQ ID NO: 5098239 - DNA, 13 bp, Homo sapiens
aagatatttatat

SEQ ID NO: 5098240 - DNA, 17 bp, Homo sapiens
aagatatttctttaaat

SEQ ID NO: 5098241 - DNA, 19 bp, Homo sapiens
aagatatttgcagtttttc

SEQ ID NO: 5098242 - DNA, 12 bp, Homo sapiens
aagatattttat

SEQ ID NO: 5098243 - DNA, 20 bp, Homo sapiens
aagatattttgctttgtgat

SEQ ID NO: 5098244 - DNA, 17 bp, Homo sapiens
aagatatttttatcttt

SEQ ID NO: 5098245 - DNA, 19 bp, Homo sapiens
aagatatttttatctttat

SEQ ID NO: 5098246 - DNA, 17 bp, Homo sapiens
aagatatttttcatgat

SEQ ID NO: 5098247 - DNA, 23 bp, Homo sapiens
aagatcaaaaaggcttataaaac

SEQ ID NO: 5098248 - DNA, 20 bp, Homo sapiens
aagatcaaaaggttaataaa

SEQ ID NO: 5098249 - DNA, 15 bp, Homo sapiens
aagacaaatacacat

SEQ ID NO: 5098250 - DNA, 13 bp, Homo sapiens
aagacaaatgaca

SEQ ID NO: 5098251 - DNA, 18 bp, Homo sapiens
aagacaaatgcagtgtat

SEQ ID NO: 5098252 - DNA, 13 bp, Homo sapiens
aagacaaatggga

SEQ ID NO: 5098253 - DNA, 13 bp, Homo sapiens
aagacaaatgtgc

SEQ ID NO: 5098254 - DNA, 20 bp, Homo sapiens
aagacaaatgtgctctatgt

SEQ ID NO: 5098255 - DNA, 16 bp, Homo sapiens
aagacaacaaaagaaa

SEQ ID NO: 5098256 - DNA, 21 bp, Homo sapiens
aagacaacattaaaacaatat

SEQ ID NO: 5098257 - DNA, 22 bp, Homo sapiens
aagacaagaactcccctttttt

SEQ ID NO: 5098258 - DNA, 20 bp, Homo sapiens
aagacaagaatatgttcaca

SEQ ID NO: 5098259 - DNA, 22 bp, Homo sapiens
aagacaagagctgttatgctgt

SEQ ID NO: 5098260 - DNA, 17 bp, Homo sapiens
aagacaagctgtataaa

SEQ ID NO: 5098261 - DNA, 17 bp, Homo sapiens
aagacaagtatgaatat

SEQ ID NO: 5098262 - DNA, 23 bp, Homo sapiens
aagacaagtatgaatattactct

SEQ ID NO: 5098263 - DNA, 22 bp, Homo sapiens
aagacaagtgattttcattgta

SEQ ID NO: 5098264 - DNA, 12 bp, Homo sapiens
aagacaagtgct

SEQ ID NO: 5098265 - DNA, 15 bp, Homo sapiens
aagacaatactccct

SEQ ID NO: 5098266 - DNA, 22 bp, Homo sapiens
aagacaatagcacttaaattcc

SEQ ID NO: 5098267 - DNA, 22 bp, Homo sapiens
aagacaatatgaacaaactatg

SEQ ID NO: 5098268 - DNA, 13 bp, Homo sapiens
aagacaatcacgc

SEQ ID NO: 5098269 - DNA, 20 bp, Homo sapiens
aagacaatcacgctgggaat

SEQ ID NO: 5098270 - DNA, 16 bp, Homo sapiens
aagacaatcactgaaa

SEQ ID NO: 5098271 - DNA, 15 bp, Homo sapiens
aagacaatcactgcc

SEQ ID NO: 5098272 - DNA, 23 bp, Homo sapiens
aagacaatgatattgacactgtc

SEQ ID NO: 5098273 - DNA, 16 bp, Homo sapiens
aagacaatgattattt

SEQ ID NO: 5098274 - DNA, 20 bp, Homo sapiens
aagacaatgtgaaaagaaaa

SEQ ID NO: 5098275 - DNA, 19 bp, Homo sapiens
aagacaatttgatacataa

SEQ ID NO: 5098276 - DNA, 21 bp, Homo sapiens
aagacaattttttttcaaatg

SEQ ID NO: 5098277 - DNA, 12 bp, Homo sapiens
aagacacacagc

SEQ ID NO: 5098278 - DNA, 22 bp, Homo sapiens
aagacacacctctggatccctg

SEQ ID NO: 5098279 - DNA, 15 bp, Homo sapiens
aagacacagaaccaa

SEQ ID NO: 5098280 - DNA, 20 bp, Homo sapiens
aagacacagaatagtttaca

SEQ ID NO: 5098281 - DNA, 21 bp, Homo sapiens
aagacacagaatagtttacac

SEQ ID NO: 5098282 - DNA, 16 bp, Homo sapiens
aagacacagcctcccc

SEQ ID NO: 5098283 - DNA, 14 bp, Homo sapiens
aagacacaggaaga

SEQ ID NO: 5098284 - DNA, 18 bp, Homo sapiens
aagacaccgttcattcag

SEQ ID NO: 5098285 - DNA, 14 bp, Homo sapiens
aagacacctggttg

SEQ ID NO: 5098286 - DNA, 19 bp, Homo sapiens
aagacacgtgcaacagact

SEQ ID NO: 5098287 - DNA, 16 bp, Homo sapiens
aagacactaattcctt

SEQ ID NO: 5098288 - DNA, 17 bp, Homo sapiens
aagacactaattcctta

SEQ ID NO: 5098289 - DNA, 13 bp, Homo sapiens
aagacactacaga

SEQ ID NO: 5098290 - DNA, 19 bp, Homo sapiens
aagacactagtagagcaaa

SEQ ID NO: 5098291 - DNA, 17 bp, Homo sapiens
aagacactcaaatatga

SEQ ID NO: 5098292 - DNA, 22 bp, Homo sapiens
aagacactgaaatatacacaca

SEQ ID NO: 5098293 - DNA, 11 bp, Homo sapiens
aagacactgca

SEQ ID NO: 5098294 - DNA, 19 bp, Homo sapiens
aagacactgcagaaaccct

SEQ ID NO: 5098295 - DNA, 13 bp, Homo sapiens
aagacactgcctg

SEQ ID NO: 5098296 - DNA, 15 bp, Homo sapiens
aagacactgcctggg

SEQ ID NO: 5098297 - DNA, 16 bp, Homo sapiens
aagacactgcctgggc

SEQ ID NO: 5098298 - DNA, 12 bp, Homo sapiens
aagacactgtga

SEQ ID NO: 5098299 - DNA, 13 bp, Homo sapiens
aagacactgtgca

SEQ ID NO: 5098300 - DNA, 21 bp, Homo sapiens
aagacactgtgcaggcccagg

SEQ ID NO: 5098301 - DNA, 22 bp, Homo sapiens
aagacactgtgcaggcccaggc

SEQ ID NO: 5098302 - DNA, 14 bp, Homo sapiens
aagacacttcagat

SEQ ID NO: 5098303 - DNA, 18 bp, Homo sapiens
aagacacttgctgagtga

SEQ ID NO: 5098304 - DNA, 21 bp, Homo sapiens
aagacacttgctgagtgaagg

SEQ ID NO: 5098305 - DNA, 11 bp, Homo sapiens
aagacagaaaa

SEQ ID NO: 5098306 - DNA, 13 bp, Homo sapiens
aagacagaaaagt

SEQ ID NO: 5098307 - DNA, 20 bp, Homo sapiens
aagacagaaccacagggcta

SEQ ID NO: 5098308 - DNA, 22 bp, Homo sapiens
aagacagaaggccttgaagaat

SEQ ID NO: 5098309 - DNA, 12 bp, Homo sapiens
aagacagaatgt

SEQ ID NO: 5098310 - DNA, 16 bp, Homo sapiens
aagacagaatgtcacc

SEQ ID NO: 5098311 - DNA, 17 bp, Homo sapiens
aagacagaatgtcacca

SEQ ID NO: 5098312 - DNA, 18 bp, Homo sapiens
aagacagaatgtcaccag

SEQ ID NO: 5098313 - DNA, 20 bp, Homo sapiens
aagacagacccagtgagtga

SEQ ID NO: 5098314 - DNA, 22 bp, Homo sapiens
aagacagacgcctgcttttgca

SEQ ID NO: 5098315 - DNA, 21 bp, Homo sapiens
aagacagagacgcaggaatgg

SEQ ID NO: 5098316 - DNA, 20 bp, Homo sapiens
aagacagagatggcagagcc

SEQ ID NO: 5098317 - DNA, 19 bp, Homo sapiens
aagacagagcaaagcgccc

SEQ ID NO: 5098318 - DNA, 16 bp, Homo sapiens
aagacagagcaggctt

SEQ ID NO: 5098319 - DNA, 19 bp, Homo sapiens
aagacagagcaggctttgt

SEQ ID NO: 5098320 - DNA, 15 bp, Homo sapiens
aagacagagctggga

SEQ ID NO: 5098321 - DNA, 15 bp, Homo sapiens
aagacagaggcagag

SEQ ID NO: 5098322 - DNA, 15 bp, Homo sapiens
aagacagatggacac

SEQ ID NO: 5098323 - DNA, 13 bp, Homo sapiens
aagacagattgtg

SEQ ID NO: 5098324 - DNA, 17 bp, Homo sapiens
aagacagattttcggaa

SEQ ID NO: 5098325 - DNA, 19 bp, Homo sapiens
aagacagcagagccatctg

SEQ ID NO: 5098326 - DNA, 16 bp, Homo sapiens
aagacagcatttaaag

SEQ ID NO: 5098327 - DNA, 20 bp, Homo sapiens
aagacagcatttaaagttgt

SEQ ID NO: 5098328 - DNA, 17 bp, Homo sapiens
aagacagccatacttcc

SEQ ID NO: 5098329 - DNA, 21 bp, Homo sapiens
aagacagcccgatcctcccct

SEQ ID NO: 5098330 - DNA, 14 bp, Homo sapiens
aagacagcctaatg

SEQ ID NO: 5098331 - DNA, 12 bp, Homo sapiens
aagacagccttc

SEQ ID NO: 5098332 - DNA, 20 bp, Homo sapiens
aagacaggaaagttcagagt

SEQ ID NO: 5098333 - DNA, 23 bp, Homo sapiens
aagacaggacagtgcttcagcct

SEQ ID NO: 5098334 - DNA, 20 bp, Homo sapiens
aagacaggcacaaaatgtga

SEQ ID NO: 5098335 - DNA, 15 bp, Homo sapiens
aagacagtatgagaa

SEQ ID NO: 5098336 - DNA, 14 bp, Homo sapiens
aagacagtggcccc

SEQ ID NO: 5098337 - DNA, 14 bp, Homo sapiens
aagacagtggttct

SEQ ID NO: 5098338 - DNA, 17 bp, Homo sapiens
aagacagtgtacaaaac

SEQ ID NO: 5098339 - DNA, 14 bp, Homo sapiens
aagacataaaacag

SEQ ID NO: 5098340 - DNA, 16 bp, Homo sapiens
aagacataaaacagaa

SEQ ID NO: 5098341 - DNA, 17 bp, Homo sapiens
aagacataaaactttaa

SEQ ID NO: 5098342 - DNA, 23 bp, Homo sapiens
aagacataaaactttaaaaggca

SEQ ID NO: 5098343 - DNA, 16 bp, Homo sapiens
aagacataaacaaaga

SEQ ID NO: 5098344 - DNA, 19 bp, Homo sapiens
aagacataaacaaagacat

SEQ ID NO: 5098345 - DNA, 18 bp, Homo sapiens
aagacataacgtttttcc

SEQ ID NO: 5098346 - DNA, 20 bp, Homo sapiens
aagacataacgtttttcctt

SEQ ID NO: 5098347 - DNA, 14 bp, Homo sapiens
aagacataatgcac

SEQ ID NO: 5098348 - DNA, 20 bp, Homo sapiens
aagacataatttaaaataaa

SEQ ID NO: 5098349 - DNA, 22 bp, Homo sapiens
aagacatagccgattctctgcc

SEQ ID NO: 5098350 - DNA, 12 bp, Homo sapiens
aagacatatatt

SEQ ID NO: 5098351 - DNA, 14 bp, Homo sapiens
aagacatatattat

SEQ ID NO: 5098352 - DNA, 15 bp, Homo sapiens
aagacatatctctaa

SEQ ID NO: 5098353 - DNA, 13 bp, Homo sapiens
aagacatcaagat

SEQ ID NO: 5098354 - DNA, 16 bp, Homo sapiens
aagacatcaatgaaac

SEQ ID NO: 5098355 - DNA, 22 bp, Homo sapiens
aagacatcatgtatcgcatatt

SEQ ID NO: 5098356 - DNA, 14 bp, Homo sapiens
aagacatctgagga

SEQ ID NO: 5098357 - DNA, 16 bp, Homo sapiens
aagacatctgaggaaa

SEQ ID NO: 5098358 - DNA, 19 bp, Homo sapiens
aagacatctgcctgtaatt

SEQ ID NO: 5098359 - DNA, 15 bp, Homo sapiens
aagacatgaatatga

SEQ ID NO: 5098360 - DNA, 18 bp, Homo sapiens
aagacatgaatgcacact

SEQ ID NO: 5098361 - DNA, 15 bp, Homo sapiens
aagacatgatttcct

SEQ ID NO: 5098362 - DNA, 21 bp, Homo sapiens
aagacatgatttccttgaatg

SEQ ID NO: 5098363 - DNA, 14 bp, Homo sapiens
aagacatggaagat

SEQ ID NO: 5098364 - DNA, 23 bp, Homo sapiens
aagacatggaaggttagaggttt

SEQ ID NO: 5098365 - DNA, 18 bp, Homo sapiens
aagacatggagactcctg

SEQ ID NO: 5098366 - DNA, 14 bp, Homo sapiens
aagacattagagaa

SEQ ID NO: 5098367 - DNA, 19 bp, Homo sapiens
aagacattagagaaaacct

SEQ ID NO: 5098368 - DNA, 14 bp, Homo sapiens
aagacattcaccaa

SEQ ID NO: 5098369 - DNA, 13 bp, Homo sapiens
aagacattctggt

SEQ ID NO: 5098370 - DNA, 15 bp, Homo sapiens
aagacattgacagca

SEQ ID NO: 5098371 - DNA, 17 bp, Homo sapiens
aagacattgacagcaat

SEQ ID NO: 5098372 - DNA, 18 bp, Homo sapiens
aagacattgacagcaatt

SEQ ID NO: 5098373 - DNA, 21 bp, Homo sapiens
aagacattgacagcaattcat

SEQ ID NO: 5098374 - DNA, 23 bp, Homo sapiens
aagacattgggtctattccagct

SEQ ID NO: 5098375 - DNA, 17 bp, Homo sapiens
aagacattgtttttaaa

SEQ ID NO: 5098376 - DNA, 16 bp, Homo sapiens
aagacatttcaaataa

SEQ ID NO: 5098377 - DNA, 13 bp, Homo sapiens
aagacatttcatc

SEQ ID NO: 5098378 - DNA, 15 bp, Homo sapiens
aagacatttcctttt

SEQ ID NO: 5098379 - DNA, 22 bp, Homo sapiens
aagacatttctgctctcagctc

SEQ ID NO: 5098380 - DNA, 21 bp, Homo sapiens
aagacatttcttttcttttta

SEQ ID NO: 5098381 - DNA, 23 bp, Homo sapiens
aagacatttcttttctttttaca

SEQ ID NO: 5098382 - DNA, 18 bp, Homo sapiens
aagacatttgctgaactc

SEQ ID NO: 5098383 - DNA, 11 bp, Homo sapiens
aagacatttgt

SEQ ID NO: 5098384 - DNA, 16 bp, Homo sapiens
aagacatttgtatatt

SEQ ID NO: 5098385 - DNA, 18 bp, Homo sapiens
aagacattttaagtttgt

SEQ ID NO: 5098386 - DNA, 19 bp, Homo sapiens
aagacattttaagtttgta

SEQ ID NO: 5098387 - DNA, 13 bp, Homo sapiens
aagacattttcat

SEQ ID NO: 5098388 - DNA, 14 bp, Homo sapiens
aagacattttctct

SEQ ID NO: 5098389 - DNA, 13 bp, Homo sapiens
aagacattttgtt

SEQ ID NO: 5098390 - DNA, 13 bp, Homo sapiens
aagacatttttat

SEQ ID NO: 5098391 - DNA, 23 bp, Homo sapiens
aagacatttttcattcatgaata

SEQ ID NO: 5098392 - DNA, 18 bp, Homo sapiens
aagaccaaaatgacaatg

SEQ ID NO: 5098393 - DNA, 13 bp, Homo sapiens
aagaccaaacttc

SEQ ID NO: 5098394 - DNA, 11 bp, Homo sapiens
aagaccaaaga

SEQ ID NO: 5098395 - DNA, 13 bp, Homo sapiens
aagaccaaagact

SEQ ID NO: 5098396 - DNA, 14 bp, Homo sapiens
aagaccaaagactt

SEQ ID NO: 5098397 - DNA, 23 bp, Homo sapiens
aagaccaaatgatagaactgtac

SEQ ID NO: 5098398 - DNA, 14 bp, Homo sapiens
aagaccaaattttg

SEQ ID NO: 5098399 - DNA, 23 bp, Homo sapiens
aagaccaaggcctcggcagaact

SEQ ID NO: 5098400 - DNA, 20 bp, Homo sapiens
aagaccaagtcctcaaagca

SEQ ID NO: 5098401 - DNA, 23 bp, Homo sapiens
aagaccaataggtgcaaaaataa

SEQ ID NO: 5098402 - DNA, 20 bp, Homo sapiens
aagaccaatcaaatatatta

SEQ ID NO: 5098403 - DNA, 14 bp, Homo sapiens
aagaccaatttatg

SEQ ID NO: 5098404 - DNA, 22 bp, Homo sapiens
aagaccaccagggtcccaggaa

SEQ ID NO: 5098405 - DNA, 12 bp, Homo sapiens
aagaccacctcc

SEQ ID NO: 5098406 - DNA, 13 bp, Homo sapiens
aagaccacctcca

SEQ ID NO: 5098407 - DNA, 22 bp, Homo sapiens
aagaccagaattcccttgaatt

SEQ ID NO: 5098408 - DNA, 12 bp, Homo sapiens
aagaccagcctg

SEQ ID NO: 5098409 - DNA, 14 bp, Homo sapiens
aagaccagcctgga

SEQ ID NO: 5098410 - DNA, 20 bp, Homo sapiens
aagaccagcctggccatcat

SEQ ID NO: 5098411 - DNA, 22 bp, Homo sapiens
aagaccagtcacagccatttca

SEQ ID NO: 5098412 - DNA, 12 bp, Homo sapiens
aagaccagtcca

SEQ ID NO: 5098413 - DNA, 16 bp, Homo sapiens
aagaccatccctgaag

SEQ ID NO: 5098414 - DNA, 20 bp, Homo sapiens
aagaccatgcctaggaacat

SEQ ID NO: 5098415 - DNA, 14 bp, Homo sapiens
aagaccattctgtg

SEQ ID NO: 5098416 - DNA, 17 bp, Homo sapiens
aagaccattctgtgacc

SEQ ID NO: 5098417 - DNA, 14 bp, Homo sapiens
aagacccaaaacag

SEQ ID NO: 5098418 - DNA, 19 bp, Homo sapiens
aagacccaaaacagctttg

SEQ ID NO: 5098419 - DNA, 20 bp, Homo sapiens
aagacccagtgtaaagaata

SEQ ID NO: 5098420 - DNA, 13 bp, Homo sapiens
aagaccccaccca

SEQ ID NO: 5098421 - DNA, 22 bp, Homo sapiens
aagaccccacccaagcttggca

SEQ ID NO: 5098422 - DNA, 23 bp, Homo sapiens
aagaccccactggagtctctctc

SEQ ID NO: 5098423 - DNA, 14 bp, Homo sapiens
aagaccccagcttc

SEQ ID NO: 5098424 - DNA, 14 bp, Homo sapiens
aagaccccatctct

SEQ ID NO: 5098425 - DNA, 23 bp, Homo sapiens
aagaccccgcaggatccctcctg

SEQ ID NO: 5098426 - DNA, 13 bp, Homo sapiens
aagacccctgccc

SEQ ID NO: 5098427 - DNA, 21 bp, Homo sapiens
aagacccggttattcgcccac

SEQ ID NO: 5098428 - DNA, 23 bp, Homo sapiens
aagacccggttattcgcccaccc

SEQ ID NO: 5098429 - DNA, 15 bp, Homo sapiens
aagatcaaaataaaa

SEQ ID NO: 5098430 - DNA, 22 bp, Homo sapiens
aagatcaaaataaaaagtgaca

SEQ ID NO: 5098431 - DNA, 16 bp, Homo sapiens
aagatcaaatgaaaag

SEQ ID NO: 5098432 - DNA, 12 bp, Homo sapiens
aagatcaataaa

SEQ ID NO: 5098433 - DNA, 17 bp, Homo sapiens
aagatcaattccctctc

SEQ ID NO: 5098434 - DNA, 14 bp, Homo sapiens
aagatcaatttctc

SEQ ID NO: 5098435 - DNA, 15 bp, Homo sapiens
aagatcaatttctcc

SEQ ID NO: 5098436 - DNA, 16 bp, Homo sapiens
aagatcacaaatagtg

SEQ ID NO: 5098437 - DNA, 21 bp, Homo sapiens
aagatcacacatcaagactat

SEQ ID NO: 5098438 - DNA, 14 bp, Homo sapiens
aagatcaccttgta

SEQ ID NO: 5098439 - DNA, 12 bp, Homo sapiens
aagatcactgta

SEQ ID NO: 5098440 - DNA, 12 bp, Homo sapiens
aagatcactgtt

SEQ ID NO: 5098441 - DNA, 15 bp, Homo sapiens
aagatcactttctca

SEQ ID NO: 5098442 - DNA, 15 bp, Homo sapiens
aagatcactttgctc

SEQ ID NO: 5098443 - DNA, 18 bp, Homo sapiens
aagatcagagctgcagcc

SEQ ID NO: 5098444 - DNA, 21 bp, Homo sapiens
aagatcattatcttcatgttt

SEQ ID NO: 5098445 - DNA, 21 bp, Homo sapiens
aagatccaaatgctgtgcaaa

SEQ ID NO: 5098446 - DNA, 23 bp, Homo sapiens
aagatccaaatgctgtgcaaaca

SEQ ID NO: 5098447 - DNA, 13 bp, Homo sapiens
aagatccaccccc

SEQ ID NO: 5098448 - DNA, 16 bp, Homo sapiens
aagatccatttgcctt

SEQ ID NO: 5098449 - DNA, 17 bp, Homo sapiens
aagatccatttgccttt

SEQ ID NO: 5098450 - DNA, 16 bp, Homo sapiens
aagatcccaacatggt

SEQ ID NO: 5098451 - DNA, 19 bp, Homo sapiens
aagatcccaacatggtcct

SEQ ID NO: 5098452 - DNA, 14 bp, Homo sapiens
aagatcccatttga

SEQ ID NO: 5098453 - DNA, 14 bp, Homo sapiens
aagatcctaaactc

SEQ ID NO: 5098454 - DNA, 17 bp, Homo sapiens
aagatcctaaactctct

SEQ ID NO: 5098455 - DNA, 22 bp, Homo sapiens
aagatcctagatcctaagggtc

SEQ ID NO: 5098456 - DNA, 21 bp, Homo sapiens
aagatcctagggcacttctag

SEQ ID NO: 5098457 - DNA, 20 bp, Homo sapiens
aagatcctagtgaccaaatt

SEQ ID NO: 5098458 - DNA, 18 bp, Homo sapiens
aagatcctcttgccacat

SEQ ID NO: 5098459 - DNA, 11 bp, Homo sapiens
aagatcctgtg

SEQ ID NO: 5098460 - DNA, 12 bp, Homo sapiens
aagatccttcat

SEQ ID NO: 5098461 - DNA, 14 bp, Homo sapiens
aagatcgctgtgct

SEQ ID NO: 5098462 - DNA, 15 bp, Homo sapiens
aagatcggaacagct

SEQ ID NO: 5098463 - DNA, 18 bp, Homo sapiens
aagatcggttaacaaata

SEQ ID NO: 5098464 - DNA, 19 bp, Homo sapiens
aagatcggttaacaaataa

SEQ ID NO: 5098465 - DNA, 20 bp, Homo sapiens
aagatcgtgaacataactga

SEQ ID NO: 5098466 - DNA, 17 bp, Homo sapiens
aagatcgttctctgcct

SEQ ID NO: 5098467 - DNA, 15 bp, Homo sapiens
aagatctaaactttt

SEQ ID NO: 5098468 - DNA, 12 bp, Homo sapiens
aagatctaaatc

SEQ ID NO: 5098469 - DNA, 20 bp, Homo sapiens
aagatctaccccagggagaa

SEQ ID NO: 5098470 - DNA, 16 bp, Homo sapiens
aagatctataaagcga

SEQ ID NO: 5098471 - DNA, 19 bp, Homo sapiens
aagatctcagataaagtga

SEQ ID NO: 5098472 - DNA, 18 bp, Homo sapiens
aagatctcagtggttaag

SEQ ID NO: 5098473 - DNA, 20 bp, Homo sapiens
aagatctccagttgtatcct

SEQ ID NO: 5098474 - DNA, 15 bp, Homo sapiens
aagatctctttctaa

SEQ ID NO: 5098475 - DNA, 19 bp, Homo sapiens
aagatctctttctaaagac

SEQ ID NO: 5098476 - DNA, 13 bp, Homo sapiens
aagatctgaaagt

SEQ ID NO: 5098477 - DNA, 12 bp, Homo sapiens
aagatctgactg

SEQ ID NO: 5098478 - DNA, 18 bp, Homo sapiens
aagatctgactgccaaat

SEQ ID NO: 5098479 - DNA, 13 bp, Homo sapiens
aagatctgctcct

SEQ ID NO: 5098480 - DNA, 18 bp, Homo sapiens
aagatctgcttccctggg

SEQ ID NO: 5098481 - DNA, 20 bp, Homo sapiens
aagatctgtcctcagccttg

SEQ ID NO: 5098482 - DNA, 19 bp, Homo sapiens
aagatctgtgcagccccgc

SEQ ID NO: 5098483 - DNA, 22 bp, Homo sapiens
aagatctgttttgaaggcaaaa

SEQ ID NO: 5098484 - DNA, 17 bp, Homo sapiens
aagatcttggcttaatt

SEQ ID NO: 5098485 - DNA, 19 bp, Homo sapiens
aagatcttggcttaattta

SEQ ID NO: 5098486 - DNA, 24 bp, Homo sapiens
aagatcttgtctccactaaatgag

SEQ ID NO: 5098487 - DNA, 13 bp, Homo sapiens
aagatctttcagg

SEQ ID NO: 5098488 - DNA, 23 bp, Homo sapiens
aagatctttcgttggttgtttct

SEQ ID NO: 5098489 - DNA, 13 bp, Homo sapiens
aagatctttctta

SEQ ID NO: 5098490 - DNA, 14 bp, Homo sapiens
aagatctttcttaa

SEQ ID NO: 5098491 - DNA, 11 bp, Homo sapiens
aagatctttta

SEQ ID NO: 5098492 - DNA, 20 bp, Homo sapiens
aagatcttttagaagtgaga

SEQ ID NO: 5098493 - DNA, 15 bp, Homo sapiens
aagatcttttatttt

SEQ ID NO: 5098494 - DNA, 18 bp, Homo sapiens
aagatcttttattttgcc

SEQ ID NO: 5098495 - DNA, 16 bp, Homo sapiens
aagatctttttttaag

SEQ ID NO: 5098496 - DNA, 17 bp, Homo sapiens
aagatctttttttaagt

SEQ ID NO: 5098497 - DNA, 22 bp, Homo sapiens
aagatctttttttaagtgttct

SEQ ID NO: 5098498 - DNA, 15 bp, Homo sapiens
aagatgaaaaagaat

SEQ ID NO: 5098499 - DNA, 23 bp, Homo sapiens
aagatgaaaaatggtcccttctt

SEQ ID NO: 5098500 - DNA, 17 bp, Homo sapiens
aagatgaaaatggaagt

SEQ ID NO: 5098501 - DNA, 12 bp, Homo sapiens
aagatgaaataa

SEQ ID NO: 5098502 - DNA, 16 bp, Homo sapiens
aagatgaaatgcactg

SEQ ID NO: 5098503 - DNA, 12 bp, Homo sapiens
aagatgaaattg

SEQ ID NO: 5098504 - DNA, 17 bp, Homo sapiens
aagatgaacagactgac

SEQ ID NO: 5098505 - DNA, 14 bp, Homo sapiens
aagatgaactctga

SEQ ID NO: 5098506 - DNA, 14 bp, Homo sapiens
aagatgaactttgt

SEQ ID NO: 5098507 - DNA, 15 bp, Homo sapiens
aagatgaactttgtc

SEQ ID NO: 5098508 - DNA, 14 bp, Homo sapiens
aagatgaagagaag

SEQ ID NO: 5098509 - DNA, 14 bp, Homo sapiens
aagatgaagaggat

SEQ ID NO: 5098510 - DNA, 18 bp, Homo sapiens
aagatgaaggtctgtttt

SEQ ID NO: 5098511 - DNA, 18 bp, Homo sapiens
aagatgaatccaaatgtg

SEQ ID NO: 5098512 - DNA, 22 bp, Homo sapiens
aagatgaatccaaatgtgaaag

SEQ ID NO: 5098513 - DNA, 22 bp, Homo sapiens
aagatgaatggtctggcaatat

SEQ ID NO: 5098514 - DNA, 12 bp, Homo sapiens
aagatgaatttg

SEQ ID NO: 5098515 - DNA, 21 bp, Homo sapiens
aagatgaattttatcagccat

SEQ ID NO: 5098516 - DNA, 13 bp, Homo sapiens
aagatgacacaag

SEQ ID NO: 5098517 - DNA, 14 bp, Homo sapiens
aagatgacagctct

SEQ ID NO: 5098518 - DNA, 15 bp, Homo sapiens
aagatgacattgcta

SEQ ID NO: 5098519 - DNA, 21 bp, Homo sapiens
aagatgacattgctaagatgc

SEQ ID NO: 5098520 - DNA, 22 bp, Homo sapiens
aagatgacattgctaagatgct

SEQ ID NO: 5098521 - DNA, 16 bp, Homo sapiens
aagatgacctcgttcc

SEQ ID NO: 5098522 - DNA, 13 bp, Homo sapiens
aagatgactgagg

SEQ ID NO: 5098523 - DNA, 15 bp, Homo sapiens
aagatgactgagggt

SEQ ID NO: 5098524 - DNA, 20 bp, Homo sapiens
aagatgagaacagataaaga

SEQ ID NO: 5098525 - DNA, 18 bp, Homo sapiens
aagatgagagaactggag

SEQ ID NO: 5098526 - DNA, 18 bp, Homo sapiens
aagatgagatttgccagc

SEQ ID NO: 5098527 - DNA, 12 bp, Homo sapiens
aagatgagcctg

SEQ ID NO: 5098528 - DNA, 21 bp, Homo sapiens
aagatgagctctgaacaaaca

SEQ ID NO: 5098529 - DNA, 18 bp, Homo sapiens
aagatgagctgcagcccc

SEQ ID NO: 5098530 - DNA, 14 bp, Homo sapiens
aagatgagctgtgc

SEQ ID NO: 5098531 - DNA, 16 bp, Homo sapiens
aagatgaggaaataat

SEQ ID NO: 5098532 - DNA, 22 bp, Homo sapiens
aagatgagggtgtcggctgtga

SEQ ID NO: 5098533 - DNA, 13 bp, Homo sapiens
aagatgaggttct

SEQ ID NO: 5098534 - DNA, 12 bp, Homo sapiens
aagatgagttgg

SEQ ID NO: 5098535 - DNA, 13 bp, Homo sapiens
aagatgatcattt

SEQ ID NO: 5098536 - DNA, 14 bp, Homo sapiens
aagatgatcatttg

SEQ ID NO: 5098537 - DNA, 18 bp, Homo sapiens
aagatgatctactcagaa

SEQ ID NO: 5098538 - DNA, 15 bp, Homo sapiens
aagatgatgctcagt

SEQ ID NO: 5098539 - DNA, 17 bp, Homo sapiens
aagatgatgctcagttt

SEQ ID NO: 5098540 - DNA, 14 bp, Homo sapiens
aagatgattgttct

SEQ ID NO: 5098541 - DNA, 22 bp, Homo sapiens
aagatgatttaagtatacagga

SEQ ID NO: 5098542 - DNA, 18 bp, Homo sapiens
aagatgattttgcttttc

SEQ ID NO: 5098543 - DNA, 21 bp, Homo sapiens
aagatgatttttaagtacaaa

SEQ ID NO: 5098544 - DNA, 16 bp, Homo sapiens
aagatgcactttgctt

SEQ ID NO: 5098545 - DNA, 18 bp, Homo sapiens
aagatgcactttgcttta

SEQ ID NO: 5098546 - DNA, 14 bp, Homo sapiens
aagatgcagaagca

SEQ ID NO: 5098547 - DNA, 16 bp, Homo sapiens
aagatgcagaagcaat

SEQ ID NO: 5098548 - DNA, 22 bp, Homo sapiens
aagatgcagagtaagtattatg

SEQ ID NO: 5098549 - DNA, 17 bp, Homo sapiens
aagatgcaggttttcta

SEQ ID NO: 5098550 - DNA, 15 bp, Homo sapiens
aagatgcattgtagt

SEQ ID NO: 5098551 - DNA, 22 bp, Homo sapiens
aagatgcattgtagtttaacca

SEQ ID NO: 5098552 - DNA, 23 bp, Homo sapiens
aagatgcattttaaatgtctata

SEQ ID NO: 5098553 - DNA, 16 bp, Homo sapiens
aagatgcccctgctcc

SEQ ID NO: 5098554 - DNA, 17 bp, Homo sapiens
aagatgcccctgctccc

SEQ ID NO: 5098555 - DNA, 19 bp, Homo sapiens
aagatgcctcttctacctc

SEQ ID NO: 5098556 - DNA, 19 bp, Homo sapiens
aagatgcgtttgcctcctg

SEQ ID NO: 5098557 - DNA, 21 bp, Homo sapiens
aagatgcgtttgcctcctgga

SEQ ID NO: 5098558 - DNA, 22 bp, Homo sapiens
aagatgctcaggtacagagaag

SEQ ID NO: 5098559 - DNA, 21 bp, Homo sapiens
aagatgctcatctgagccagc

SEQ ID NO: 5098560 - DNA, 15 bp, Homo sapiens
aagatgctcttctgt

SEQ ID NO: 5098561 - DNA, 21 bp, Homo sapiens
aagatgctgaaacaggagaga

SEQ ID NO: 5098562 - DNA, 20 bp, Homo sapiens
aagatgctgctgagcacatc

SEQ ID NO: 5098563 - DNA, 23 bp, Homo sapiens
aagatgctgctgagcacatctct

SEQ ID NO: 5098564 - DNA, 14 bp, Homo sapiens
aagatgctggcccc

SEQ ID NO: 5098565 - DNA, 15 bp, Homo sapiens
aagatgctggcccca

SEQ ID NO: 5098566 - DNA, 16 bp, Homo sapiens
aagatgctgggttggt

SEQ ID NO: 5098567 - DNA, 13 bp, Homo sapiens
aagatgctgtaaa

SEQ ID NO: 5098568 - DNA, 14 bp, Homo sapiens
aagatgctgtaaat

SEQ ID NO: 5098569 - DNA, 18 bp, Homo sapiens
aagatgctgtaaataggt

SEQ ID NO: 5098570 - DNA, 21 bp, Homo sapiens
aagatgctgtaaataggttca

SEQ ID NO: 5098571 - DNA, 12 bp, Homo sapiens
aagatgctttta

SEQ ID NO: 5098572 - DNA, 15 bp, Homo sapiens
aagatggaaaggatt

SEQ ID NO: 5098573 - DNA, 15 bp, Homo sapiens
aagatggaaattctg

SEQ ID NO: 5098574 - DNA, 22 bp, Homo sapiens
aagatggaaattctgaaaactg

SEQ ID NO: 5098575 - DNA, 20 bp, Homo sapiens
aagatggaatttatcaaacc

SEQ ID NO: 5098576 - DNA, 19 bp, Homo sapiens
aagatggacacgagccaca

SEQ ID NO: 5098577 - DNA, 21 bp, Homo sapiens
aagatggacacgagccacaag

SEQ ID NO: 5098578 - DNA, 18 bp, Homo sapiens
aagatggagacaccctct

SEQ ID NO: 5098579 - DNA, 14 bp, Homo sapiens
aagatggagaggaa

SEQ ID NO: 5098580 - DNA, 16 bp, Homo sapiens
aagatggagaggaaga

SEQ ID NO: 5098581 - DNA, 18 bp, Homo sapiens
aagatggagaggaagaaa

SEQ ID NO: 5098582 - DNA, 15 bp, Homo sapiens
aagatggagaggcat

SEQ ID NO: 5098583 - DNA, 20 bp, Homo sapiens
aagatggagggggctggggt

SEQ ID NO: 5098584 - DNA, 23 bp, Homo sapiens
aagatggagttgtattttgacaa

SEQ ID NO: 5098585 - DNA, 16 bp, Homo sapiens
aagatggagtttctaa

SEQ ID NO: 5098586 - DNA, 17 bp, Homo sapiens
aagatggagtttctaag

SEQ ID NO: 5098587 - DNA, 18 bp, Homo sapiens
aagatggataaactgagc

SEQ ID NO: 5098588 - DNA, 15 bp, Homo sapiens
aagatggatgtgctt

SEQ ID NO: 5098589 - DNA, 18 bp, Homo sapiens
aagatggattaaactcag

SEQ ID NO: 5098590 - DNA, 21 bp, Homo sapiens
aagatggattctcagatattt

SEQ ID NO: 5098591 - DNA, 21 bp, Homo sapiens
aagatggattggtgtaaaagg

SEQ ID NO: 5098592 - DNA, 16 bp, Homo sapiens
aagatggcactgtcca

SEQ ID NO: 5098593 - DNA, 21 bp, Homo sapiens
aagatggcactgtccagggcc

SEQ ID NO: 5098594 - DNA, 21 bp, Homo sapiens
aagatggcccagctccccaag

SEQ ID NO: 5098595 - DNA, 22 bp, Homo sapiens
aagatggcctaggatcttcact

SEQ ID NO: 5098596 - DNA, 19 bp, Homo sapiens
aagatggcgaccaccaaag

SEQ ID NO: 5098597 - DNA, 17 bp, Homo sapiens
aagatggctcagagggg

SEQ ID NO: 5098598 - DNA, 21 bp, Homo sapiens
aagatggctcagagggggact

SEQ ID NO: 5098599 - DNA, 14 bp, Homo sapiens
aagatggctgctgc

SEQ ID NO: 5098600 - DNA, 22 bp, Homo sapiens
aagatggctggaaggagccagc

SEQ ID NO: 5098601 - DNA, 16 bp, Homo sapiens
aagatggctgtgcctc

SEQ ID NO: 5098602 - DNA, 21 bp, Homo sapiens
aagatggctgtggcatttcca

SEQ ID NO: 5098603 - DNA, 19 bp, Homo sapiens
aagatggcttatgtcatca

SEQ ID NO: 5098604 - DNA, 23 bp, Homo sapiens
aagatggcttccgtgagacacaa

SEQ ID NO: 5098605 - DNA, 12 bp, Homo sapiens
aagatgggacag

SEQ ID NO: 5098606 - DNA, 13 bp, Homo sapiens
aagatgggacagc

SEQ ID NO: 5098607 - DNA, 11 bp, Homo sapiens
aagatgggagg

SEQ ID NO: 5098608 - DNA, 14 bp, Homo sapiens
aagatgggaggaga

SEQ ID NO: 5098609 - DNA, 13 bp, Homo sapiens
aagaccctccccg

SEQ ID NO: 5098610 - DNA, 14 bp, Homo sapiens
aagaccctgagact

SEQ ID NO: 5098611 - DNA, 18 bp, Homo sapiens
aagaccggaagctcctgg

SEQ ID NO: 5098612 - DNA, 19 bp, Homo sapiens
aagaccggaagctcctggt

SEQ ID NO: 5098613 - DNA, 22 bp, Homo sapiens
aagaccgtgtcccaaggagctg

SEQ ID NO: 5098614 - DNA, 22 bp, Homo sapiens
aagacctaccagggacaagcag

SEQ ID NO: 5098615 - DNA, 18 bp, Homo sapiens
aagacctactgttctaaa

SEQ ID NO: 5098616 - DNA, 15 bp, Homo sapiens
aagacctagctatgt

SEQ ID NO: 5098617 - DNA, 17 bp, Homo sapiens
aagacctcacctagaaa

SEQ ID NO: 5098618 - DNA, 18 bp, Homo sapiens
aagacctcatctgcctgc

SEQ ID NO: 5098619 - DNA, 19 bp, Homo sapiens
aagacctcatctgcctgca

SEQ ID NO: 5098620 - DNA, 16 bp, Homo sapiens
aagacctcatctgtgg

SEQ ID NO: 5098621 - DNA, 20 bp, Homo sapiens
aagacctcatctgtggagct

SEQ ID NO: 5098622 - DNA, 18 bp, Homo sapiens
aagacctccctgtgagag

SEQ ID NO: 5098623 - DNA, 21 bp, Homo sapiens
aagacctcgtctttgcttgtc

SEQ ID NO: 5098624 - DNA, 19 bp, Homo sapiens
aagacctcttccctctggg

SEQ ID NO: 5098625 - DNA, 12 bp, Homo sapiens
aagacctgaaag

SEQ ID NO: 5098626 - DNA, 15 bp, Homo sapiens
aagacctgagaatgt

SEQ ID NO: 5098627 - DNA, 17 bp, Homo sapiens
aagacctggcagctctg

SEQ ID NO: 5098628 - DNA, 16 bp, Homo sapiens
aagacctggcctttca

SEQ ID NO: 5098629 - DNA, 16 bp, Homo sapiens
aagacctgtgagggga

SEQ ID NO: 5098630 - DNA, 17 bp, Homo sapiens
aagacctgtgaggggaa

SEQ ID NO: 5098631 - DNA, 22 bp, Homo sapiens
aagaccttctagtgagcctggg

SEQ ID NO: 5098632 - DNA, 20 bp, Homo sapiens
aagaccttctccccattctg

SEQ ID NO: 5098633 - DNA, 14 bp, Homo sapiens
aagaccttctgaag

SEQ ID NO: 5098634 - DNA, 19 bp, Homo sapiens
aagaccttctgaagatctc

SEQ ID NO: 5098635 - DNA, 18 bp, Homo sapiens
aagaccttggcctctcct

SEQ ID NO: 5098636 - DNA, 13 bp, Homo sapiens
aagacctttcaaa

SEQ ID NO: 5098637 - DNA, 18 bp, Homo sapiens
aagacctttttctgcact

SEQ ID NO: 5098638 - DNA, 20 bp, Homo sapiens
aagacctttttctgcactat

SEQ ID NO: 5098639 - DNA, 16 bp, Homo sapiens
aagacgaagtgtaaac

SEQ ID NO: 5098640 - DNA, 19 bp, Homo sapiens
aagacgaggggcagggaag

SEQ ID NO: 5098641 - DNA, 20 bp, Homo sapiens
aagacgaggggcagggaagg

SEQ ID NO: 5098642 - DNA, 15 bp, Homo sapiens
aagacgatgtttatg

SEQ ID NO: 5098643 - DNA, 18 bp, Homo sapiens
aagacgcaaggtgtgctc

SEQ ID NO: 5098644 - DNA, 21 bp, Homo sapiens
aagacgcccattcggactgct

SEQ ID NO: 5098645 - DNA, 13 bp, Homo sapiens
aagacgccctctc

SEQ ID NO: 5098646 - DNA, 13 bp, Homo sapiens
aagacgctgtgct

SEQ ID NO: 5098647 - DNA, 15 bp, Homo sapiens
aagacgctgtgctgc

SEQ ID NO: 5098648 - DNA, 15 bp, Homo sapiens
aagacggaaaacaat

SEQ ID NO: 5098649 - DNA, 16 bp, Homo sapiens
aagacggatccacagt

SEQ ID NO: 5098650 - DNA, 19 bp, Homo sapiens
aagacggattctaaggact

SEQ ID NO: 5098651 - DNA, 19 bp, Homo sapiens
aagacggcacggtcttccc

SEQ ID NO: 5098652 - DNA, 14 bp, Homo sapiens
aagacgggagggga

SEQ ID NO: 5098653 - DNA, 15 bp, Homo sapiens
aagacgggaggggag

SEQ ID NO: 5098654 - DNA, 19 bp, Homo sapiens
aagacgggaggggaggcat

SEQ ID NO: 5098655 - DNA, 20 bp, Homo sapiens
aagacgtggactcctcttgg

SEQ ID NO: 5098656 - DNA, 17 bp, Homo sapiens
aagacgtggctctgggt

SEQ ID NO: 5098657 - DNA, 15 bp, Homo sapiens
aagacgtggtctaga

SEQ ID NO: 5098658 - DNA, 15 bp, Homo sapiens
aagacgttttataag

SEQ ID NO: 5098659 - DNA, 21 bp, Homo sapiens
aagacgtttttgtgctgtggg

SEQ ID NO: 5098660 - DNA, 22 bp, Homo sapiens
aagacgtttttgtgctgtgggc

SEQ ID NO: 5098661 - DNA, 19 bp, Homo sapiens
aagactaacaaaggcagct

SEQ ID NO: 5098662 - DNA, 20 bp, Homo sapiens
aagactaacaaaggcagctg

SEQ ID NO: 5098663 - DNA, 12 bp, Homo sapiens
aagactaacctt

SEQ ID NO: 5098664 - DNA, 15 bp, Homo sapiens
aagactaacctttgt

SEQ ID NO: 5098665 - DNA, 16 bp, Homo sapiens
aagactaatttaaaaa

SEQ ID NO: 5098666 - DNA, 17 bp, Homo sapiens
aagactactaaggcctt

SEQ ID NO: 5098667 - DNA, 21 bp, Homo sapiens
aagactagaaaattagactgt

SEQ ID NO: 5098668 - DNA, 21 bp, Homo sapiens
aagactagactactcaatatt

SEQ ID NO: 5098669 - DNA, 14 bp, Homo sapiens
aagactatgttctc

SEQ ID NO: 5098670 - DNA, 13 bp, Homo sapiens
aagactattcaaa

SEQ ID NO: 5098671 - DNA, 15 bp, Homo sapiens
aagactatttaccag

SEQ ID NO: 5098672 - DNA, 16 bp, Homo sapiens
aagactcaaatgttct

SEQ ID NO: 5098673 - DNA, 18 bp, Homo sapiens
aagactcaaatgttctaa

SEQ ID NO: 5098674 - DNA, 20 bp, Homo sapiens
aagactcagatgatgccagc

SEQ ID NO: 5098675 - DNA, 13 bp, Homo sapiens
aagactcaggagt

SEQ ID NO: 5098676 - DNA, 15 bp, Homo sapiens
aagactcaggagtct

SEQ ID NO: 5098677 - DNA, 21 bp, Homo sapiens
aagactcaggagtctgccact

SEQ ID NO: 5098678 - DNA, 23 bp, Homo sapiens
aagactcagtatgctttccctga

SEQ ID NO: 5098679 - DNA, 12 bp, Homo sapiens
aagactcatccg

SEQ ID NO: 5098680 - DNA, 14 bp, Homo sapiens
aagactccaaagaa

SEQ ID NO: 5098681 - DNA, 13 bp, Homo sapiens
aagactccagaaa

SEQ ID NO: 5098682 - DNA, 12 bp, Homo sapiens
aagactccagta

SEQ ID NO: 5098683 - DNA, 21 bp, Homo sapiens
aagactcccgccccgggctgg

SEQ ID NO: 5098684 - DNA, 22 bp, Homo sapiens
aagactccctgatcccagacct

SEQ ID NO: 5098685 - DNA, 20 bp, Homo sapiens
aagactccgtctcaaaaaaa

SEQ ID NO: 5098686 - DNA, 14 bp, Homo sapiens
aagactcctagctg

SEQ ID NO: 5098687 - DNA, 18 bp, Homo sapiens
aagactcctctgggcctg

SEQ ID NO: 5098688 - DNA, 23 bp, Homo sapiens
aagactcctctgggcctggggtg

SEQ ID NO: 5098689 - DNA, 17 bp, Homo sapiens
aagactcctgggcttca

SEQ ID NO: 5098690 - DNA, 14 bp, Homo sapiens
aagactccttgtgg

SEQ ID NO: 5098691 - DNA, 21 bp, Homo sapiens
aagactcggcttttaatgtac

SEQ ID NO: 5098692 - DNA, 15 bp, Homo sapiens
aagactctagagtcc

SEQ ID NO: 5098693 - DNA, 19 bp, Homo sapiens
aagactctagagtccaagg

SEQ ID NO: 5098694 - DNA, 21 bp, Homo sapiens
aagactctagagtccaaggtt

SEQ ID NO: 5098695 - DNA, 16 bp, Homo sapiens
aagactctccactgac

SEQ ID NO: 5098696 - DNA, 17 bp, Homo sapiens
aagactctccactgacc

SEQ ID NO: 5098697 - DNA, 21 bp, Homo sapiens
aagactctccactgacctggt

SEQ ID NO: 5098698 - DNA, 17 bp, Homo sapiens
aagactctgtctcaaaa

SEQ ID NO: 5098699 - DNA, 19 bp, Homo sapiens
aagactcttacctacaaaa

SEQ ID NO: 5098700 - DNA, 23 bp, Homo sapiens
aagactctttgggtccattcaga

SEQ ID NO: 5098701 - DNA, 15 bp, Homo sapiens
aagactgaacatgtt

SEQ ID NO: 5098702 - DNA, 19 bp, Homo sapiens
aagactgaacatgtttaca

SEQ ID NO: 5098703 - DNA, 13 bp, Homo sapiens
aagactgaatgtt

SEQ ID NO: 5098704 - DNA, 20 bp, Homo sapiens
aagactgaatgttttattta

SEQ ID NO: 5098705 - DNA, 23 bp, Homo sapiens
aagactgactgggcgtggtggct

SEQ ID NO: 5098706 - DNA, 19 bp, Homo sapiens
aagactgagccagattggc

SEQ ID NO: 5098707 - DNA, 21 bp, Homo sapiens
aagactgagtacgttgtgcat

SEQ ID NO: 5098708 - DNA, 23 bp, Homo sapiens
aagactgagtacgttgtgcattt

SEQ ID NO: 5098709 - DNA, 19 bp, Homo sapiens
aagactgattttaaaactt

SEQ ID NO: 5098710 - DNA, 14 bp, Homo sapiens
aagactgcagctgc

SEQ ID NO: 5098711 - DNA, 17 bp, Homo sapiens
aagactgcagctgctga

SEQ ID NO: 5098712 - DNA, 12 bp, Homo sapiens
aagactgccacg

SEQ ID NO: 5098713 - DNA, 20 bp, Homo sapiens
aagactgccacgtgccttag

SEQ ID NO: 5098714 - DNA, 13 bp, Homo sapiens
aagactgcctccc

SEQ ID NO: 5098715 - DNA, 15 bp, Homo sapiens
aagactgctgcagtc

SEQ ID NO: 5098716 - DNA, 23 bp, Homo sapiens
aagactgctggttgacatcagac

SEQ ID NO: 5098717 - DNA, 19 bp, Homo sapiens
aagactgctgtggccagga

SEQ ID NO: 5098718 - DNA, 22 bp, Homo sapiens
aagactgctgtggccaggaggt

SEQ ID NO: 5098719 - DNA, 13 bp, Homo sapiens
aagactggaagca

SEQ ID NO: 5098720 - DNA, 23 bp, Homo sapiens
aagactggaagctaatttgcatt

SEQ ID NO: 5098721 - DNA, 18 bp, Homo sapiens
aagactggagaaatgctt

SEQ ID NO: 5098722 - DNA, 20 bp, Homo sapiens
aagactggcccagtgccagc

SEQ ID NO: 5098723 - DNA, 23 bp, Homo sapiens
aagactggcttttattaatgcac

SEQ ID NO: 5098724 - DNA, 17 bp, Homo sapiens
aagactgggccccacat

SEQ ID NO: 5098725 - DNA, 23 bp, Homo sapiens
aagactgggccccacatggctta

SEQ ID NO: 5098726 - DNA, 15 bp, Homo sapiens
aagactggttttctg

SEQ ID NO: 5098727 - DNA, 17 bp, Homo sapiens
aagactggttttctgcc

SEQ ID NO: 5098728 - DNA, 17 bp, Homo sapiens
aagactgtacaaagtag

SEQ ID NO: 5098729 - DNA, 13 bp, Homo sapiens
aagactgtactgg

SEQ ID NO: 5098730 - DNA, 16 bp, Homo sapiens
aagactgtagatatgt

SEQ ID NO: 5098731 - DNA, 12 bp, Homo sapiens
aagactgtattt

SEQ ID NO: 5098732 - DNA, 21 bp, Homo sapiens
aagactgtattttcaggaagg

SEQ ID NO: 5098733 - DNA, 19 bp, Homo sapiens
aagactgtcttaatttgca

SEQ ID NO: 5098734 - DNA, 14 bp, Homo sapiens
aagactgtgcagaa

SEQ ID NO: 5098735 - DNA, 16 bp, Homo sapiens
aagactgttgctcaaa

SEQ ID NO: 5098736 - DNA, 17 bp, Homo sapiens
aagacttaaaagagctc

SEQ ID NO: 5098737 - DNA, 15 bp, Homo sapiens
aagacttaagattaa

SEQ ID NO: 5098738 - DNA, 14 bp, Homo sapiens
aagacttaatatgt

SEQ ID NO: 5098739 - DNA, 17 bp, Homo sapiens
aagacttaatcatatca

SEQ ID NO: 5098740 - DNA, 14 bp, Homo sapiens
aagacttactctaa

SEQ ID NO: 5098741 - DNA, 16 bp, Homo sapiens
aagacttactctaaga

SEQ ID NO: 5098742 - DNA, 16 bp, Homo sapiens
aagacttagttatttc

SEQ ID NO: 5098743 - DNA, 12 bp, Homo sapiens
aagacttcaaaa

SEQ ID NO: 5098744 - DNA, 13 bp, Homo sapiens
aagacttcaaatg

SEQ ID NO: 5098745 - DNA, 22 bp, Homo sapiens
aagacttcaaatgttattcaat

SEQ ID NO: 5098746 - DNA, 20 bp, Homo sapiens
aagacttcaatattaaatga

SEQ ID NO: 5098747 - DNA, 16 bp, Homo sapiens
aagacttcactgcagc

SEQ ID NO: 5098748 - DNA, 21 bp, Homo sapiens
aagacttcactgcagcctttc

SEQ ID NO: 5098749 - DNA, 14 bp, Homo sapiens
aagacttcagattc

SEQ ID NO: 5098750 - DNA, 14 bp, Homo sapiens
aagacttcagattt

SEQ ID NO: 5098751 - DNA, 19 bp, Homo sapiens
aagacttcagatttcaaat

SEQ ID NO: 5098752 - DNA, 20 bp, Homo sapiens
aagacttcagtcctggtctg

SEQ ID NO: 5098753 - DNA, 22 bp, Homo sapiens
aagacttcctctctacccccca

SEQ ID NO: 5098754 - DNA, 20 bp, Homo sapiens
aagacttcggggaagataca

SEQ ID NO: 5098755 - DNA, 15 bp, Homo sapiens
aagacttctagcaga

SEQ ID NO: 5098756 - DNA, 20 bp, Homo sapiens
aagacttctctttgcctcaa

SEQ ID NO: 5098757 - DNA, 20 bp, Homo sapiens
aagacttgagaaatttgaaa

SEQ ID NO: 5098758 - DNA, 14 bp, Homo sapiens
aagacttgatgaat

SEQ ID NO: 5098759 - DNA, 19 bp, Homo sapiens
aagacttgatgaataaaca

SEQ ID NO: 5098760 - DNA, 17 bp, Homo sapiens
aagacttggcccaggaa

SEQ ID NO: 5098761 - DNA, 19 bp, Homo sapiens
aagacttgtaatattttta

SEQ ID NO: 5098762 - DNA, 22 bp, Homo sapiens
aagacttgttagccaacttcaa

SEQ ID NO: 5098763 - DNA, 16 bp, Homo sapiens
aagacttgtttctgat

SEQ ID NO: 5098764 - DNA, 17 bp, Homo sapiens
aagactttgatccttgg

SEQ ID NO: 5098765 - DNA, 21 bp, Homo sapiens
aagactttgatccttggaaac

SEQ ID NO: 5098766 - DNA, 23 bp, Homo sapiens
aagactttgatgtgtttttgtat

SEQ ID NO: 5098767 - DNA, 16 bp, Homo sapiens
aagactttggaaagag

SEQ ID NO: 5098768 - DNA, 19 bp, Homo sapiens
aagactttgggataggaaa

SEQ ID NO: 5098769 - DNA, 20 bp, Homo sapiens
aagactttgggataggaaaa

SEQ ID NO: 5098770 - DNA, 13 bp, Homo sapiens
aagactttggtta

SEQ ID NO: 5098771 - DNA, 17 bp, Homo sapiens
aagactttggttatttt

SEQ ID NO: 5098772 - DNA, 23 bp, Homo sapiens
aagactttggttattttactttt

SEQ ID NO: 5098773 - DNA, 15 bp, Homo sapiens
aagacttttattaat

SEQ ID NO: 5098774 - DNA, 17 bp, Homo sapiens
aagacttttccaaccct

SEQ ID NO: 5098775 - DNA, 19 bp, Homo sapiens
aagacttttctttcagcca

SEQ ID NO: 5098776 - DNA, 17 bp, Homo sapiens
aagagaaaaaccaatga

SEQ ID NO: 5098777 - DNA, 19 bp, Homo sapiens
aagagaaaaaccaatgatt

SEQ ID NO: 5098778 - DNA, 14 bp, Homo sapiens
aagagaaaaagaag

SEQ ID NO: 5098779 - DNA, 16 bp, Homo sapiens
aagagaaaagaaaaaa

SEQ ID NO: 5098780 - DNA, 15 bp, Homo sapiens
aagagaaaagagaga

SEQ ID NO: 5098781 - DNA, 22 bp, Homo sapiens
aagagaaaagggaaaaaagaaa

SEQ ID NO: 5098782 - DNA, 14 bp, Homo sapiens
aagagaaaatatat

SEQ ID NO: 5098783 - DNA, 18 bp, Homo sapiens
aagagaaaatatatattt

SEQ ID NO: 5098784 - DNA, 22 bp, Homo sapiens
aagagaaaatgctttctcatgc

SEQ ID NO: 5098785 - DNA, 18 bp, Homo sapiens
aagagaaacactaatggc

SEQ ID NO: 5098786 - DNA, 21 bp, Homo sapiens
aagagaaaccgggagaaggca

SEQ ID NO: 5098787 - DNA, 19 bp, Homo sapiens
aagatgggcacatgaggag

SEQ ID NO: 5098788 - DNA, 22 bp, Homo sapiens
aagatgggcatcttttgtatta

SEQ ID NO: 5098789 - DNA, 20 bp, Homo sapiens
aagatggggaccagcagccc

SEQ ID NO: 5098790 - DNA, 17 bp, Homo sapiens
aagatggggagctctgg

SEQ ID NO: 5098791 - DNA, 17 bp, Homo sapiens
aagatgggggcaagaag

SEQ ID NO: 5098792 - DNA, 23 bp, Homo sapiens
aagatgggggcagggctgtgctt

SEQ ID NO: 5098793 - DNA, 22 bp, Homo sapiens
aagatgggggctggagggggca

SEQ ID NO: 5098794 - DNA, 15 bp, Homo sapiens
aagatgggtggttga

SEQ ID NO: 5098795 - DNA, 14 bp, Homo sapiens
aagatggtagcaga

SEQ ID NO: 5098796 - DNA, 16 bp, Homo sapiens
aagatggtatatttgg

SEQ ID NO: 5098797 - DNA, 21 bp, Homo sapiens
aagatggtccatttgttcctg

SEQ ID NO: 5098798 - DNA, 22 bp, Homo sapiens
aagatggtccatttgttcctgc

SEQ ID NO: 5098799 - DNA, 21 bp, Homo sapiens
aagatggtccgtgcccaggcc

SEQ ID NO: 5098800 - DNA, 17 bp, Homo sapiens
aagatggtcgtgtgtgt

SEQ ID NO: 5098801 - DNA, 17 bp, Homo sapiens
aagatggttaaacattt

SEQ ID NO: 5098802 - DNA, 13 bp, Homo sapiens
aagatggttcaaa

SEQ ID NO: 5098803 - DNA, 16 bp, Homo sapiens
aagatggttcaaagat

SEQ ID NO: 5098804 - DNA, 21 bp, Homo sapiens
aagatggttcaaagatacaag

SEQ ID NO: 5098805 - DNA, 24 bp, Homo sapiens
aagatggttcaaagatacaagaaa

SEQ ID NO: 5098806 - DNA, 15 bp, Homo sapiens
aagatggttgaccaa

SEQ ID NO: 5098807 - DNA, 22 bp, Homo sapiens
aagatggtttatgcatgtatat

SEQ ID NO: 5098808 - DNA, 13 bp, Homo sapiens
aagatggttttca

SEQ ID NO: 5098809 - DNA, 15 bp, Homo sapiens
aagatgtaagaagct

SEQ ID NO: 5098810 - DNA, 15 bp, Homo sapiens
aagatgtaaggaatt

SEQ ID NO: 5098811 - DNA, 21 bp, Homo sapiens
aagatgtaaggaattgaagat

SEQ ID NO: 5098812 - DNA, 14 bp, Homo sapiens
aagatgtacattta

SEQ ID NO: 5098813 - DNA, 20 bp, Homo sapiens
aagatgtacatttaataata

SEQ ID NO: 5098814 - DNA, 13 bp, Homo sapiens
aagatgtagagga

SEQ ID NO: 5098815 - DNA, 19 bp, Homo sapiens
aagatgtagatttatttca

SEQ ID NO: 5098816 - DNA, 18 bp, Homo sapiens
aagatgtagcaaaccctg

SEQ ID NO: 5098817 - DNA, 13 bp, Homo sapiens
aagatgtatgctt

SEQ ID NO: 5098818 - DNA, 18 bp, Homo sapiens
aagatgtatggatttcca

SEQ ID NO: 5098819 - DNA, 17 bp, Homo sapiens
aagatgtattcagagcc

SEQ ID NO: 5098820 - DNA, 18 bp, Homo sapiens
aagatgtcaaatatctca

SEQ ID NO: 5098821 - DNA, 15 bp, Homo sapiens
aagatgtcccacagg

SEQ ID NO: 5098822 - DNA, 20 bp, Homo sapiens
aagatgtcccacagggacca

SEQ ID NO: 5098823 - DNA, 21 bp, Homo sapiens
aagatgtcccacagggaccac

SEQ ID NO: 5098824 - DNA, 13 bp, Homo sapiens
aagatgtccccca

SEQ ID NO: 5098825 - DNA, 16 bp, Homo sapiens
aagatgtctcctcaag

SEQ ID NO: 5098826 - DNA, 20 bp, Homo sapiens
aagatgtctcctcaagcctg

SEQ ID NO: 5098827 - DNA, 11 bp, Homo sapiens
aagatgtctgt

SEQ ID NO: 5098828 - DNA, 12 bp, Homo sapiens
aagatgtctgtt

SEQ ID NO: 5098829 - DNA, 16 bp, Homo sapiens
aagatgtctgtttgct

SEQ ID NO: 5098830 - DNA, 11 bp, Homo sapiens
aagatgtgaaa

SEQ ID NO: 5098831 - DNA, 14 bp, Homo sapiens
aagatgtgaaaact

SEQ ID NO: 5098832 - DNA, 14 bp, Homo sapiens
aagatgtgaaaatt

SEQ ID NO: 5098833 - DNA, 11 bp, Homo sapiens
aagatgtgaat

SEQ ID NO: 5098834 - DNA, 15 bp, Homo sapiens
aagatgtgaattatt

SEQ ID NO: 5098835 - DNA, 18 bp, Homo sapiens
aagatgtgaattattgac

SEQ ID NO: 5098836 - DNA, 14 bp, Homo sapiens
aagatgtgacatgt

SEQ ID NO: 5098837 - DNA, 18 bp, Homo sapiens
aagatgtgacatgtttta

SEQ ID NO: 5098838 - DNA, 17 bp, Homo sapiens
aagatgtgatattctaa

SEQ ID NO: 5098839 - DNA, 18 bp, Homo sapiens
aagatgtgcaaaatcact

SEQ ID NO: 5098840 - DNA, 18 bp, Homo sapiens
aagatgtgcagcatttca

SEQ ID NO: 5098841 - DNA, 20 bp, Homo sapiens
aagatgtgcagcatttcact

SEQ ID NO: 5098842 - DNA, 21 bp, Homo sapiens
aagatgtgcagcatttcactt

SEQ ID NO: 5098843 - DNA, 17 bp, Homo sapiens
aagatgtgtaaacaggt

SEQ ID NO: 5098844 - DNA, 18 bp, Homo sapiens
aagatgtgttcttatttt

SEQ ID NO: 5098845 - DNA, 14 bp, Homo sapiens
aagatgttaaaatc

SEQ ID NO: 5098846 - DNA, 15 bp, Homo sapiens
aagatgttaacagta

SEQ ID NO: 5098847 - DNA, 18 bp, Homo sapiens
aagatgttaacagtattt

SEQ ID NO: 5098848 - DNA, 22 bp, Homo sapiens
aagatgttaacagtattttaag

SEQ ID NO: 5098849 - DNA, 21 bp, Homo sapiens
aagatgttaatctcccagccc

SEQ ID NO: 5098850 - DNA, 19 bp, Homo sapiens
aagatgttaattacttttg

SEQ ID NO: 5098851 - DNA, 16 bp, Homo sapiens
aagatgttatattaaa

SEQ ID NO: 5098852 - DNA, 20 bp, Homo sapiens
aagatgttatattaaagaaa

SEQ ID NO: 5098853 - DNA, 23 bp, Homo sapiens
aagatgttatattaaagaaaaac

SEQ ID NO: 5098854 - DNA, 18 bp, Homo sapiens
aagatgttatatttttct

SEQ ID NO: 5098855 - DNA, 16 bp, Homo sapiens
aagatgttatggtgtt

SEQ ID NO: 5098856 - DNA, 20 bp, Homo sapiens
aagatgttatggtgtttaga

SEQ ID NO: 5098857 - DNA, 15 bp, Homo sapiens
aagatgttctggata

SEQ ID NO: 5098858 - DNA, 16 bp, Homo sapiens
aagatgttgattttta

SEQ ID NO: 5098859 - DNA, 21 bp, Homo sapiens
aagatgttgatttttactgtg

SEQ ID NO: 5098860 - DNA, 13 bp, Homo sapiens
aagatgttgtcat

SEQ ID NO: 5098861 - DNA, 12 bp, Homo sapiens
aagatgttgttt

SEQ ID NO: 5098862 - DNA, 18 bp, Homo sapiens
aagatgtttatctgacac

SEQ ID NO: 5098863 - DNA, 12 bp, Homo sapiens
aagatgtttctt

SEQ ID NO: 5098864 - DNA, 19 bp, Homo sapiens
aagatgttttgtataaaat

SEQ ID NO: 5098865 - DNA, 20 bp, Homo sapiens
aagattaaaaccacagaaca

SEQ ID NO: 5098866 - DNA, 16 bp, Homo sapiens
aagattaaaattagtg

SEQ ID NO: 5098867 - DNA, 18 bp, Homo sapiens
aagattaaaggaaggaaa

SEQ ID NO: 5098868 - DNA, 20 bp, Homo sapiens
aagattaaatatatctttgt

SEQ ID NO: 5098869 - DNA, 18 bp, Homo sapiens
aagattaaatgtgtcatt

SEQ ID NO: 5098870 - DNA, 20 bp, Homo sapiens
aagattaaattatatctgag

SEQ ID NO: 5098871 - DNA, 21 bp, Homo sapiens
aagattaacactcatttccaa

SEQ ID NO: 5098872 - DNA, 23 bp, Homo sapiens
aagattaatctaccttgcagtgt

SEQ ID NO: 5098873 - DNA, 15 bp, Homo sapiens
aagattacaaaagca

SEQ ID NO: 5098874 - DNA, 18 bp, Homo sapiens
aagattacaaaagcaatt

SEQ ID NO: 5098875 - DNA, 20 bp, Homo sapiens
aagattactagggttttgcc

SEQ ID NO: 5098876 - DNA, 18 bp, Homo sapiens
aagattacttagaggaaa

SEQ ID NO: 5098877 - DNA, 13 bp, Homo sapiens
aagattagaagct

SEQ ID NO: 5098878 - DNA, 14 bp, Homo sapiens
aagattagaggttt

SEQ ID NO: 5098879 - DNA, 14 bp, Homo sapiens
aagattatagattc

SEQ ID NO: 5098880 - DNA, 16 bp, Homo sapiens
aagattatagattcta

SEQ ID NO: 5098881 - DNA, 22 bp, Homo sapiens
aagattatagctcccaaaagaa

SEQ ID NO: 5098882 - DNA, 23 bp, Homo sapiens
aagattatagctcccaaaagaat

SEQ ID NO: 5098883 - DNA, 20 bp, Homo sapiens
aagattatatatcataaagt

SEQ ID NO: 5098884 - DNA, 18 bp, Homo sapiens
aagattattttttatgag

SEQ ID NO: 5098885 - DNA, 20 bp, Homo sapiens
aagattcaatgcccctgaat

SEQ ID NO: 5098886 - DNA, 13 bp, Homo sapiens
aagattcaattta

SEQ ID NO: 5098887 - DNA, 21 bp, Homo sapiens
aagattcacacatgcctatat

SEQ ID NO: 5098888 - DNA, 13 bp, Homo sapiens
aagattcagctag

SEQ ID NO: 5098889 - DNA, 15 bp, Homo sapiens
aagattcaggtatgt

SEQ ID NO: 5098890 - DNA, 12 bp, Homo sapiens
aagattcagttt

SEQ ID NO: 5098891 - DNA, 21 bp, Homo sapiens
aagattcagttttcccacttt

SEQ ID NO: 5098892 - DNA, 19 bp, Homo sapiens
aagattcatttttaatcat

SEQ ID NO: 5098893 - DNA, 17 bp, Homo sapiens
aagattccaaaaagcac

SEQ ID NO: 5098894 - DNA, 20 bp, Homo sapiens
aagattccattttatacaag

SEQ ID NO: 5098895 - DNA, 15 bp, Homo sapiens
aagattcccaggagt

SEQ ID NO: 5098896 - DNA, 16 bp, Homo sapiens
aagattcccaggagtt

SEQ ID NO: 5098897 - DNA, 19 bp, Homo sapiens
aagattcccaggagttctg

SEQ ID NO: 5098898 - DNA, 21 bp, Homo sapiens
aagattccggatcctaagcat

SEQ ID NO: 5098899 - DNA, 18 bp, Homo sapiens
aagattcctgaatgtaat

SEQ ID NO: 5098900 - DNA, 13 bp, Homo sapiens
aagattctaaagg

SEQ ID NO: 5098901 - DNA, 23 bp, Homo sapiens
aagattctactcttgtcattttt

SEQ ID NO: 5098902 - DNA, 12 bp, Homo sapiens
aagattctagat

SEQ ID NO: 5098903 - DNA, 13 bp, Homo sapiens
aagattctagatc

SEQ ID NO: 5098904 - DNA, 14 bp, Homo sapiens
aagattctagatga

SEQ ID NO: 5098905 - DNA, 20 bp, Homo sapiens
aagattctatagttctagac

SEQ ID NO: 5098906 - DNA, 11 bp, Homo sapiens
aagattctatg

SEQ ID NO: 5098907 - DNA, 19 bp, Homo sapiens
aagattctatgttaatatt

SEQ ID NO: 5098908 - DNA, 23 bp, Homo sapiens
aagattctatgttaatattttat

SEQ ID NO: 5098909 - DNA, 16 bp, Homo sapiens
aagattctatttaatt

SEQ ID NO: 5098910 - DNA, 17 bp, Homo sapiens
aagattctctgcccagc

SEQ ID NO: 5098911 - DNA, 15 bp, Homo sapiens
aagattctgaaacca

SEQ ID NO: 5098912 - DNA, 14 bp, Homo sapiens
aagattctgtgggc

SEQ ID NO: 5098913 - DNA, 23 bp, Homo sapiens
aagattctgtgtcagagcccagc

SEQ ID NO: 5098914 - DNA, 20 bp, Homo sapiens
aagattcttccattaaattg

SEQ ID NO: 5098915 - DNA, 23 bp, Homo sapiens
aagattcttcttaaaagtttcta

SEQ ID NO: 5098916 - DNA, 20 bp, Homo sapiens
aagattctttaaactactga

SEQ ID NO: 5098917 - DNA, 14 bp, Homo sapiens
aagattcttttaaa

SEQ ID NO: 5098918 - DNA, 21 bp, Homo sapiens
aagattgaaaaggaagatcag

SEQ ID NO: 5098919 - DNA, 15 bp, Homo sapiens
aagattgaaattcca

SEQ ID NO: 5098920 - DNA, 14 bp, Homo sapiens
aagattgagaagcc

SEQ ID NO: 5098921 - DNA, 14 bp, Homo sapiens
aagattgagaagtt

SEQ ID NO: 5098922 - DNA, 14 bp, Homo sapiens
aagattgcaaaggg

SEQ ID NO: 5098923 - DNA, 13 bp, Homo sapiens
aagattgcaaagt

SEQ ID NO: 5098924 - DNA, 13 bp, Homo sapiens
aagattgcctctt

SEQ ID NO: 5098925 - DNA, 16 bp, Homo sapiens
aagattgcttaaaata

SEQ ID NO: 5098926 - DNA, 12 bp, Homo sapiens
aagattgcttta

SEQ ID NO: 5098927 - DNA, 20 bp, Homo sapiens
aagattggtgtttttttcta

SEQ ID NO: 5098928 - DNA, 21 bp, Homo sapiens
aagattggtgtttttttctat

SEQ ID NO: 5098929 - DNA, 22 bp, Homo sapiens
aagattgtaaactaaagtgtgc

SEQ ID NO: 5098930 - DNA, 12 bp, Homo sapiens
aagattgtaatt

SEQ ID NO: 5098931 - DNA, 21 bp, Homo sapiens
aagattgtaattaaaatgata

SEQ ID NO: 5098932 - DNA, 13 bp, Homo sapiens
aagattgtacata

SEQ ID NO: 5098933 - DNA, 13 bp, Homo sapiens
aagattgtgaagg

SEQ ID NO: 5098934 - DNA, 12 bp, Homo sapiens
aagattgtgtct

SEQ ID NO: 5098935 - DNA, 15 bp, Homo sapiens
aagattgttcctgct

SEQ ID NO: 5098936 - DNA, 19 bp, Homo sapiens
aagattgtttatctagatg

SEQ ID NO: 5098937 - DNA, 13 bp, Homo sapiens
aagattgttttat

SEQ ID NO: 5098938 - DNA, 19 bp, Homo sapiens
aagatttaaaattaaattt

SEQ ID NO: 5098939 - DNA, 21 bp, Homo sapiens
aagatttaagcacaaacttta

SEQ ID NO: 5098940 - DNA, 17 bp, Homo sapiens
aagatttaagtaatttt

SEQ ID NO: 5098941 - DNA, 16 bp, Homo sapiens
aagatttaatgttaca

SEQ ID NO: 5098942 - DNA, 22 bp, Homo sapiens
aagatttagttgagttattcca

SEQ ID NO: 5098943 - DNA, 14 bp, Homo sapiens
aagatttatcaaat

SEQ ID NO: 5098944 - DNA, 21 bp, Homo sapiens
aagatttatctgcaaggattt

SEQ ID NO: 5098945 - DNA, 14 bp, Homo sapiens
aagatttattttgt

SEQ ID NO: 5098946 - DNA, 21 bp, Homo sapiens
aagatttatttttaatatgtt

SEQ ID NO: 5098947 - DNA, 17 bp, Homo sapiens
aagatttccaagtgcca

SEQ ID NO: 5098948 - DNA, 18 bp, Homo sapiens
aagatttccatttgtcaa

SEQ ID NO: 5098949 - DNA, 19 bp, Homo sapiens
aagatttccctaaaaattc

SEQ ID NO: 5098950 - DNA, 16 bp, Homo sapiens
aagatttccttgtgca

SEQ ID NO: 5098951 - DNA, 23 bp, Homo sapiens
aagatttcctttggcaatatcat

SEQ ID NO: 5098952 - DNA, 18 bp, Homo sapiens
aagatttctaaataaaag

SEQ ID NO: 5098953 - DNA, 13 bp, Homo sapiens
aagatttcttgag

SEQ ID NO: 5098954 - DNA, 21 bp, Homo sapiens
aagatttcttttcattattct

SEQ ID NO: 5098955 - DNA, 15 bp, Homo sapiens
aagatttgaaaacaa

SEQ ID NO: 5098956 - DNA, 20 bp, Homo sapiens
aagatttgaaaacaaacttc

SEQ ID NO: 5098957 - DNA, 16 bp, Homo sapiens
aagatttgatgtatgt

SEQ ID NO: 5098958 - DNA, 23 bp, Homo sapiens
aagatttgatgtatgtaatacat

SEQ ID NO: 5098959 - DNA, 15 bp, Homo sapiens
aagatttgcccattt

SEQ ID NO: 5098960 - DNA, 16 bp, Homo sapiens
aagatttgctttaatt

SEQ ID NO: 5098961 - DNA, 14 bp, Homo sapiens
aagatttggaaaat

SEQ ID NO: 5098962 - DNA, 17 bp, Homo sapiens
aagatttggaagctctt

SEQ ID NO: 5098963 - DNA, 18 bp, Homo sapiens
aagatttggtttttgtct

SEQ ID NO: 5098964 - DNA, 21 bp, Homo sapiens
aagatttgtacatattatcat

SEQ ID NO: 5098965 - DNA, 21 bp, Homo sapiens
aagatttgtactacagttctt

SEQ ID NO: 5098966 - DNA, 23 bp, Homo sapiens
aagagaaaccttgcaaactctat

SEQ ID NO: 5098967 - DNA, 16 bp, Homo sapiens
aagagaaactgtgtat

SEQ ID NO: 5098968 - DNA, 13 bp, Homo sapiens
aagagaaacttcc

SEQ ID NO: 5098969 - DNA, 12 bp, Homo sapiens
aagagaaacttt

SEQ ID NO: 5098970 - DNA, 19 bp, Homo sapiens
aagagaaaggcctgcacac

SEQ ID NO: 5098971 - DNA, 18 bp, Homo sapiens
aagagaaagtacaaccac

SEQ ID NO: 5098972 - DNA, 11 bp, Homo sapiens
aagagaaatac

SEQ ID NO: 5098973 - DNA, 19 bp, Homo sapiens
aagagaaatacagctggct

SEQ ID NO: 5098974 - DNA, 17 bp, Homo sapiens
aagagaaatgaggaaga

SEQ ID NO: 5098975 - DNA, 18 bp, Homo sapiens
aagagaaatgaggaagaa

SEQ ID NO: 5098976 - DNA, 12 bp, Homo sapiens
aagagaaatttt

SEQ ID NO: 5098977 - DNA, 19 bp, Homo sapiens
aagagaacaaagagtgaaa

SEQ ID NO: 5098978 - DNA, 21 bp, Homo sapiens
aagagaacattttactgttgt

SEQ ID NO: 5098979 - DNA, 16 bp, Homo sapiens
aagagaaccgagcaaa

SEQ ID NO: 5098980 - DNA, 12 bp, Homo sapiens
aagagaactaaa

SEQ ID NO: 5098981 - DNA, 20 bp, Homo sapiens
aagagaactactaaggaaaa

SEQ ID NO: 5098982 - DNA, 20 bp, Homo sapiens
aagagaactcgcgctcagta

SEQ ID NO: 5098983 - DNA, 21 bp, Homo sapiens
aagagaactgatgacactgag

SEQ ID NO: 5098984 - DNA, 15 bp, Homo sapiens
aagagaagaaagaag

SEQ ID NO: 5098985 - DNA, 13 bp, Homo sapiens
aagagaagaaatg

SEQ ID NO: 5098986 - DNA, 14 bp, Homo sapiens
aagagaagaaatgt

SEQ ID NO: 5098987 - DNA, 16 bp, Homo sapiens
aagagaagaagaaaaa

SEQ ID NO: 5098988 - DNA, 14 bp, Homo sapiens
aagagaagacaaaa

SEQ ID NO: 5098989 - DNA, 21 bp, Homo sapiens
aagagaagacctagctatgtt

SEQ ID NO: 5098990 - DNA, 16 bp, Homo sapiens
aagagaagacgaaata

SEQ ID NO: 5098991 - DNA, 21 bp, Homo sapiens
aagagaagagggcccagccca

SEQ ID NO: 5098992 - DNA, 20 bp, Homo sapiens
aagagaagcaaacaatggtg

SEQ ID NO: 5098993 - DNA, 11 bp, Homo sapiens
aagagaagctg

SEQ ID NO: 5098994 - DNA, 18 bp, Homo sapiens
aagagaagctgctgacca

SEQ ID NO: 5098995 - DNA, 20 bp, Homo sapiens
aagagaaggcctggtcagca

SEQ ID NO: 5098996 - DNA, 18 bp, Homo sapiens
aagagaagggcagggctg

SEQ ID NO: 5098997 - DNA, 15 bp, Homo sapiens
aagagaagtttaaca

SEQ ID NO: 5098998 - DNA, 20 bp, Homo sapiens
aagagaatattttaagtatt

SEQ ID NO: 5098999 - DNA, 16 bp, Homo sapiens
aagagaatctgatcaa

SEQ ID NO: 5099000 - DNA, 19 bp, Homo sapiens
aagagaatctgatcaattt

SEQ ID NO: 5099001 - DNA, 19 bp, Homo sapiens
aagagaatgccattctctt

SEQ ID NO: 5099002 - DNA, 23 bp, Homo sapiens
aagagaatgcccttctccttatt

SEQ ID NO: 5099003 - DNA, 22 bp, Homo sapiens
aagagaatgttatagtgaatta

SEQ ID NO: 5099004 - DNA, 11 bp, Homo sapiens
aagagaattca

SEQ ID NO: 5099005 - DNA, 13 bp, Homo sapiens
aagagaattcagt

SEQ ID NO: 5099006 - DNA, 17 bp, Homo sapiens
aagagaattcagtattt

SEQ ID NO: 5099007 - DNA, 21 bp, Homo sapiens
aagagaattctaagattgtac

SEQ ID NO: 5099008 - DNA, 21 bp, Homo sapiens
aagagacaaacacctcccagg

SEQ ID NO: 5099009 - DNA, 15 bp, Homo sapiens
aagagacaaatagta

SEQ ID NO: 5099010 - DNA, 19 bp, Homo sapiens
aagagacactcagaccaga

SEQ ID NO: 5099011 - DNA, 18 bp, Homo sapiens
aagagacagaatgtatct

SEQ ID NO: 5099012 - DNA, 18 bp, Homo sapiens
aagagacagagtgctgag

SEQ ID NO: 5099013 - DNA, 14 bp, Homo sapiens
aagagacaggcagg

SEQ ID NO: 5099014 - DNA, 14 bp, Homo sapiens
aagagacagggaga

SEQ ID NO: 5099015 - DNA, 21 bp, Homo sapiens
aagagacagtcaccccaggac

SEQ ID NO: 5099016 - DNA, 22 bp, Homo sapiens
aagagacagtcaccccaggact

SEQ ID NO: 5099017 - DNA, 17 bp, Homo sapiens
aagagacagttctctgt

SEQ ID NO: 5099018 - DNA, 15 bp, Homo sapiens
aagagacatccaaat

SEQ ID NO: 5099019 - DNA, 17 bp, Homo sapiens
aagagacatgagaaagg

SEQ ID NO: 5099020 - DNA, 16 bp, Homo sapiens
aagagacatggaagag

SEQ ID NO: 5099021 - DNA, 18 bp, Homo sapiens
aagagacatggaagagag

SEQ ID NO: 5099022 - DNA, 17 bp, Homo sapiens
aagagaccacttcctta

SEQ ID NO: 5099023 - DNA, 20 bp, Homo sapiens
aagagaccacttccttaaca

SEQ ID NO: 5099024 - DNA, 13 bp, Homo sapiens
aagagacctgaac

SEQ ID NO: 5099025 - DNA, 14 bp, Homo sapiens
aagagaccttggct

SEQ ID NO: 5099026 - DNA, 15 bp, Homo sapiens
aagagactcagcctg

SEQ ID NO: 5099027 - DNA, 17 bp, Homo sapiens
aagagactcagcctgca

SEQ ID NO: 5099028 - DNA, 19 bp, Homo sapiens
aagagactcagcctgcagt

SEQ ID NO: 5099029 - DNA, 23 bp, Homo sapiens
aagagactccaagattcaaagag

SEQ ID NO: 5099030 - DNA, 20 bp, Homo sapiens
aagagactctcttagggaaa

SEQ ID NO: 5099031 - DNA, 18 bp, Homo sapiens
aagagactgcgttctgca

SEQ ID NO: 5099032 - DNA, 14 bp, Homo sapiens
aagagactgtgcca

SEQ ID NO: 5099033 - DNA, 15 bp, Homo sapiens
aagagactgtgccat

SEQ ID NO: 5099034 - DNA, 15 bp, Homo sapiens
aagagactgtgggga

SEQ ID NO: 5099035 - DNA, 18 bp, Homo sapiens
aagagactgtggggaggg

SEQ ID NO: 5099036 - DNA, 20 bp, Homo sapiens
aagagacttctgcttttcaa

SEQ ID NO: 5099037 - DNA, 19 bp, Homo sapiens
aagagactttgtcacttat

SEQ ID NO: 5099038 - DNA, 16 bp, Homo sapiens
aagagagaaaaacaaa

SEQ ID NO: 5099039 - DNA, 18 bp, Homo sapiens
aagagagaaaacttattt

SEQ ID NO: 5099040 - DNA, 15 bp, Homo sapiens
aagagagaaaataaa

SEQ ID NO: 5099041 - DNA, 17 bp, Homo sapiens
aagagagaaaataaaaa

SEQ ID NO: 5099042 - DNA, 18 bp, Homo sapiens
aagagagaaaataaaaag

SEQ ID NO: 5099043 - DNA, 19 bp, Homo sapiens
aagagagaaaataaaaagt

SEQ ID NO: 5099044 - DNA, 20 bp, Homo sapiens
aagagagaaaataaaaagtt

SEQ ID NO: 5099045 - DNA, 21 bp, Homo sapiens
aagagagaaaataaaaagtta

SEQ ID NO: 5099046 - DNA, 14 bp, Homo sapiens
aagagagaaagaag

SEQ ID NO: 5099047 - DNA, 20 bp, Homo sapiens
aagagagaaagcatattgac

SEQ ID NO: 5099048 - DNA, 13 bp, Homo sapiens
aagagagaaatct

SEQ ID NO: 5099049 - DNA, 15 bp, Homo sapiens
aagagagaagccagc

SEQ ID NO: 5099050 - DNA, 12 bp, Homo sapiens
aagagagaatgt

SEQ ID NO: 5099051 - DNA, 22 bp, Homo sapiens
aagagagaatttgctttatctg

SEQ ID NO: 5099052 - DNA, 21 bp, Homo sapiens
aagagagacagcacaggcagc

SEQ ID NO: 5099053 - DNA, 10 bp, Homo sapiens
aagagagaga

SEQ ID NO: 5099054 - DNA, 21 bp, Homo sapiens
aagagagagaaacaaactttt

SEQ ID NO: 5099055 - DNA, 21 bp, Homo sapiens
aagagagagagagagaaagaa

SEQ ID NO: 5099056 - DNA, 22 bp, Homo sapiens
aagagagagagagagagagaag

SEQ ID NO: 5099057 - DNA, 17 bp, Homo sapiens
aagagagagagagaggt

SEQ ID NO: 5099058 - DNA, 22 bp, Homo sapiens
aagagagagccatgaagcatta

SEQ ID NO: 5099059 - DNA, 14 bp, Homo sapiens
aagagagatgagaa

SEQ ID NO: 5099060 - DNA, 15 bp, Homo sapiens
aagagagatgagaaa

SEQ ID NO: 5099061 - DNA, 15 bp, Homo sapiens
aagagagatgttttg

SEQ ID NO: 5099062 - DNA, 19 bp, Homo sapiens
aagagagattgggactgag

SEQ ID NO: 5099063 - DNA, 15 bp, Homo sapiens
aagagagcagagaat

SEQ ID NO: 5099064 - DNA, 19 bp, Homo sapiens
aagagagcagcgcccaggc

SEQ ID NO: 5099065 - DNA, 21 bp, Homo sapiens
aagagagcagcgcccaggcct

SEQ ID NO: 5099066 - DNA, 13 bp, Homo sapiens
aagagagcctgcc

SEQ ID NO: 5099067 - DNA, 22 bp, Homo sapiens
aagagagccttggttcatcagt

SEQ ID NO: 5099068 - DNA, 17 bp, Homo sapiens
aagagagcttattgttt

SEQ ID NO: 5099069 - DNA, 21 bp, Homo sapiens
aagagaggaaggacccctcac

SEQ ID NO: 5099070 - DNA, 22 bp, Homo sapiens
aagagaggaaggacccctcacc

SEQ ID NO: 5099071 - DNA, 24 bp, Homo sapiens
aagagaggactggttctgaggcca

SEQ ID NO: 5099072 - DNA, 17 bp, Homo sapiens
aagagaggagaggagag

SEQ ID NO: 5099073 - DNA, 14 bp, Homo sapiens
aagagaggagttca

SEQ ID NO: 5099074 - DNA, 16 bp, Homo sapiens
aagagaggagttcaat

SEQ ID NO: 5099075 - DNA, 20 bp, Homo sapiens
aagagaggagttcaatgatc

SEQ ID NO: 5099076 - DNA, 22 bp, Homo sapiens
aagagaggagttcaatgatcta

SEQ ID NO: 5099077 - DNA, 19 bp, Homo sapiens
aagagaggatgtgcaagcg

SEQ ID NO: 5099078 - DNA, 12 bp, Homo sapiens
aagagaggcacc

SEQ ID NO: 5099079 - DNA, 19 bp, Homo sapiens
aagagaggcacctgctgga

SEQ ID NO: 5099080 - DNA, 13 bp, Homo sapiens
aagagagggacag

SEQ ID NO: 5099081 - DNA, 15 bp, Homo sapiens
aagagaggggaagaa

SEQ ID NO: 5099082 - DNA, 19 bp, Homo sapiens
aagagaggggaagaattta

SEQ ID NO: 5099083 - DNA, 20 bp, Homo sapiens
aagagaggggaagaatttaa

SEQ ID NO: 5099084 - DNA, 12 bp, Homo sapiens
aagagaggtcca

SEQ ID NO: 5099085 - DNA, 15 bp, Homo sapiens
aagagaggtgccggg

SEQ ID NO: 5099086 - DNA, 23 bp, Homo sapiens
aagagagtagctcgtcctcactg

SEQ ID NO: 5099087 - DNA, 17 bp, Homo sapiens
aagagagtggggcctgc

SEQ ID NO: 5099088 - DNA, 21 bp, Homo sapiens
aagagagtggggcctgccctc

SEQ ID NO: 5099089 - DNA, 17 bp, Homo sapiens
aagagatacttacattt

SEQ ID NO: 5099090 - DNA, 16 bp, Homo sapiens
aagagatatgctcatt

SEQ ID NO: 5099091 - DNA, 18 bp, Homo sapiens
aagagatatgctcattat

SEQ ID NO: 5099092 - DNA, 20 bp, Homo sapiens
aagagatattgatattgaag

SEQ ID NO: 5099093 - DNA, 20 bp, Homo sapiens
aagagatattttaaaatgag

SEQ ID NO: 5099094 - DNA, 16 bp, Homo sapiens
aagagatccaaagact

SEQ ID NO: 5099095 - DNA, 14 bp, Homo sapiens
aagagatctttctt

SEQ ID NO: 5099096 - DNA, 19 bp, Homo sapiens
aagagatgaacatctgggg

SEQ ID NO: 5099097 - DNA, 19 bp, Homo sapiens
aagagatgaattgcattat

SEQ ID NO: 5099098 - DNA, 16 bp, Homo sapiens
aagagatgacaaacca

SEQ ID NO: 5099099 - DNA, 20 bp, Homo sapiens
aagagatgacaacaaatttt

SEQ ID NO: 5099100 - DNA, 21 bp, Homo sapiens
aagagatgacaacaaattttg

SEQ ID NO: 5099101 - DNA, 19 bp, Homo sapiens
aagagatgaggaaataaga

SEQ ID NO: 5099102 - DNA, 19 bp, Homo sapiens
aagagatggaaaaaaagta

SEQ ID NO: 5099103 - DNA, 17 bp, Homo sapiens
aagagatggcctgagaa

SEQ ID NO: 5099104 - DNA, 21 bp, Homo sapiens
aagagatgggccttttcttga

SEQ ID NO: 5099105 - DNA, 17 bp, Homo sapiens
aagagatgggcttgttt

SEQ ID NO: 5099106 - DNA, 20 bp, Homo sapiens
aagagatgggcttgttttct

SEQ ID NO: 5099107 - DNA, 21 bp, Homo sapiens
aagagatgggggtgtattgga

SEQ ID NO: 5099108 - DNA, 20 bp, Homo sapiens
aagagatgtagcagaataat

SEQ ID NO: 5099109 - DNA, 21 bp, Homo sapiens
aagagattcgaatgacggtaa

SEQ ID NO: 5099110 - DNA, 22 bp, Homo sapiens
aagagattctgcctcagcctcc

SEQ ID NO: 5099111 - DNA, 14 bp, Homo sapiens
aagagattcttcta

SEQ ID NO: 5099112 - DNA, 19 bp, Homo sapiens
aagagattgctaattgctg

SEQ ID NO: 5099113 - DNA, 13 bp, Homo sapiens
aagagattgctga

SEQ ID NO: 5099114 - DNA, 20 bp, Homo sapiens
aagagattgtggtggtgcta

SEQ ID NO: 5099115 - DNA, 19 bp, Homo sapiens
aagagattgtggtttcatt

SEQ ID NO: 5099116 - DNA, 17 bp, Homo sapiens
aagagattgttgtttgc

SEQ ID NO: 5099117 - DNA, 18 bp, Homo sapiens
aagagatttatctttata

SEQ ID NO: 5099118 - DNA, 22 bp, Homo sapiens
aagagatttatctttatacaga

SEQ ID NO: 5099119 - DNA, 14 bp, Homo sapiens
aagagatttcaaga

SEQ ID NO: 5099120 - DNA, 15 bp, Homo sapiens
aagagatttttcatg

SEQ ID NO: 5099121 - DNA, 15 bp, Homo sapiens
aagagcaaactttag

SEQ ID NO: 5099122 - DNA, 16 bp, Homo sapiens
aagagcaaactttagt

SEQ ID NO: 5099123 - DNA, 14 bp, Homo sapiens
aagagcaaatcaat

SEQ ID NO: 5099124 - DNA, 17 bp, Homo sapiens
aagagcaaggaaggtaa

SEQ ID NO: 5099125 - DNA, 17 bp, Homo sapiens
aagagcaatcaaagcag

SEQ ID NO: 5099126 - DNA, 16 bp, Homo sapiens
aagagcacaaacattt

SEQ ID NO: 5099127 - DNA, 21 bp, Homo sapiens
aagagcacactgcacagggaa

SEQ ID NO: 5099128 - DNA, 19 bp, Homo sapiens
aagagcacagccctcccgc

SEQ ID NO: 5099129 - DNA, 20 bp, Homo sapiens
aagagcacccggtcagtcag

SEQ ID NO: 5099130 - DNA, 21 bp, Homo sapiens
aagagcacttaagagaatatt

SEQ ID NO: 5099131 - DNA, 15 bp, Homo sapiens
aagagcagagtctgg

SEQ ID NO: 5099132 - DNA, 19 bp, Homo sapiens
aagagcagagtctgggcct

SEQ ID NO: 5099133 - DNA, 17 bp, Homo sapiens
aagagcagcacctcctc

SEQ ID NO: 5099134 - DNA, 12 bp, Homo sapiens
aagagcagcatt

SEQ ID NO: 5099135 - DNA, 15 bp, Homo sapiens
aagagcagcctgatg

SEQ ID NO: 5099136 - DNA, 14 bp, Homo sapiens
aagagcagcctgtg

SEQ ID NO: 5099137 - DNA, 16 bp, Homo sapiens
aagagcagcctgtggc

SEQ ID NO: 5099138 - DNA, 17 bp, Homo sapiens
aagagcagcctgtggca

SEQ ID NO: 5099139 - DNA, 18 bp, Homo sapiens
aagagcagcctgtggcat

SEQ ID NO: 5099140 - DNA, 19 bp, Homo sapiens
aagagcagcctgtggcatc

SEQ ID NO: 5099141 - DNA, 22 bp, Homo sapiens
aagagcagctccttcctagcct

SEQ ID NO: 5099142 - DNA, 16 bp, Homo sapiens
aagagcagctgggaac

SEQ ID NO: 5099143 - DNA, 17 bp, Homo sapiens
aagagcaggactccagg

SEQ ID NO: 5099144 - DNA, 18 bp, Homo sapiens
aagatttgtgaactggaa

SEQ ID NO: 5099145 - DNA, 22 bp, Homo sapiens
aagatttgtgtttttctttttc

SEQ ID NO: 5099146 - DNA, 18 bp, Homo sapiens
aagatttgttactgtatt

SEQ ID NO: 5099147 - DNA, 20 bp, Homo sapiens
aagatttgtttttaaactgt

SEQ ID NO: 5099148 - DNA, 16 bp, Homo sapiens
aagatttgtttttgta

SEQ ID NO: 5099149 - DNA, 17 bp, Homo sapiens
aagattttaatcaagtt

SEQ ID NO: 5099150 - DNA, 22 bp, Homo sapiens
aagattttagggcttttatttt

SEQ ID NO: 5099151 - DNA, 24 bp, Homo sapiens
aagattttatggttttataactat

SEQ ID NO: 5099152 - DNA, 15 bp, Homo sapiens
aagattttattgtat

SEQ ID NO: 5099153 - DNA, 13 bp, Homo sapiens
aagattttcagaa

SEQ ID NO: 5099154 - DNA, 16 bp, Homo sapiens
aagattttcctcttgt

SEQ ID NO: 5099155 - DNA, 18 bp, Homo sapiens
aagattttccttttttat

SEQ ID NO: 5099156 - DNA, 15 bp, Homo sapiens
aagattttctaagga

SEQ ID NO: 5099157 - DNA, 23 bp, Homo sapiens
aagattttctgggcctaaaggat

SEQ ID NO: 5099158 - DNA, 20 bp, Homo sapiens
aagattttgaaaactacatt

SEQ ID NO: 5099159 - DNA, 23 bp, Homo sapiens
aagattttgatctcacattttta

SEQ ID NO: 5099160 - DNA, 21 bp, Homo sapiens
aagattttggaggagaaggac

SEQ ID NO: 5099161 - DNA, 16 bp, Homo sapiens
aagattttgtgaaatt

SEQ ID NO: 5099162 - DNA, 21 bp, Homo sapiens
aagattttgtgaaatttcatg

SEQ ID NO: 5099163 - DNA, 22 bp, Homo sapiens
aagattttgtgaaatttcatga

SEQ ID NO: 5099164 - DNA, 24 bp, Homo sapiens
aagatttttaccttcctttctaaa

SEQ ID NO: 5099165 - DNA, 17 bp, Homo sapiens
aagatttttactaatat

SEQ ID NO: 5099166 - DNA, 14 bp, Homo sapiens
aagatttttcaaaa

SEQ ID NO: 5099167 - DNA, 14 bp, Homo sapiens
aagatttttctcaa

SEQ ID NO: 5099168 - DNA, 19 bp, Homo sapiens
aagatttttctcaaagttt

SEQ ID NO: 5099169 - DNA, 13 bp, Homo sapiens
aagatttttcttt

SEQ ID NO: 5099170 - DNA, 14 bp, Homo sapiens
aagatttttgttaa

SEQ ID NO: 5099171 - DNA, 18 bp, Homo sapiens
aagatttttgttaagctc

SEQ ID NO: 5099172 - DNA, 20 bp, Homo sapiens
aagatttttgttaagctcag

SEQ ID NO: 5099173 - DNA, 21 bp, Homo sapiens
aagatttttgttaagctcagg

SEQ ID NO: 5099174 - DNA, 17 bp, Homo sapiens
aagattttttaataatt

SEQ ID NO: 5099175 - DNA, 18 bp, Homo sapiens
aagattttttaattgttt

SEQ ID NO: 5099176 - DNA, 14 bp, Homo sapiens
aagattttttcatt

SEQ ID NO: 5099177 - DNA, 15 bp, Homo sapiens
aagattttttttgta

SEQ ID NO: 5099178 - DNA, 23 bp, Homo sapiens
aagattttttttttttctctcaa

SEQ ID NO: 5099179 - DNA, 15 bp, Homo sapiens
aagcaaaaaactgca

SEQ ID NO: 5099180 - DNA, 15 bp, Homo sapiens
aagcaaaaaagaaaa

SEQ ID NO: 5099181 - DNA, 13 bp, Homo sapiens
aagcaaaaaataa

SEQ ID NO: 5099182 - DNA, 21 bp, Homo sapiens
aagcaaaaaataaaataagtc

SEQ ID NO: 5099183 - DNA, 13 bp, Homo sapiens
aagcaaaaacaat

SEQ ID NO: 5099184 - DNA, 20 bp, Homo sapiens
aagcaaaaacgaaagctggg

SEQ ID NO: 5099185 - DNA, 13 bp, Homo sapiens
aagcaaaaactac

SEQ ID NO: 5099186 - DNA, 12 bp, Homo sapiens
aagcaaaaagat

SEQ ID NO: 5099187 - DNA, 14 bp, Homo sapiens
aagcaaaaagtgat

SEQ ID NO: 5099188 - DNA, 21 bp, Homo sapiens
aagcaaaaatgacaacagaaa

SEQ ID NO: 5099189 - DNA, 12 bp, Homo sapiens
aagcaaaaatgc

SEQ ID NO: 5099190 - DNA, 17 bp, Homo sapiens
aagcaaaaatgctaata

SEQ ID NO: 5099191 - DNA, 17 bp, Homo sapiens
aagcaaaaattcacaaa

SEQ ID NO: 5099192 - DNA, 16 bp, Homo sapiens
aagcaaaacatcacat

SEQ ID NO: 5099193 - DNA, 21 bp, Homo sapiens
aagcaaaacatctctgcagtt

SEQ ID NO: 5099194 - DNA, 12 bp, Homo sapiens
aagcaaaacatt

SEQ ID NO: 5099195 - DNA, 17 bp, Homo sapiens
aagcaaaacattttgta

SEQ ID NO: 5099196 - DNA, 20 bp, Homo sapiens
aagcaaaactcccaatggat

SEQ ID NO: 5099197 - DNA, 13 bp, Homo sapiens
aagcaaaagaaaa

SEQ ID NO: 5099198 - DNA, 16 bp, Homo sapiens
aagcaaaagcaaggga

SEQ ID NO: 5099199 - DNA, 13 bp, Homo sapiens
aagcaaaatacat

SEQ ID NO: 5099200 - DNA, 12 bp, Homo sapiens
aagcaaaatatt

SEQ ID NO: 5099201 - DNA, 15 bp, Homo sapiens
aagcaaaatatttgt

SEQ ID NO: 5099202 - DNA, 13 bp, Homo sapiens
aagcaaaatcctg

SEQ ID NO: 5099203 - DNA, 15 bp, Homo sapiens
aagcaaaatgtctct

SEQ ID NO: 5099204 - DNA, 22 bp, Homo sapiens
aagcaaaattataagaagagga

SEQ ID NO: 5099205 - DNA, 13 bp, Homo sapiens
aagcaaaattatt

SEQ ID NO: 5099206 - DNA, 13 bp, Homo sapiens
aagcaaaattttt

SEQ ID NO: 5099207 - DNA, 12 bp, Homo sapiens
aagcaaacaagc

SEQ ID NO: 5099208 - DNA, 12 bp, Homo sapiens
aagcaaacacat

SEQ ID NO: 5099209 - DNA, 13 bp, Homo sapiens
aagcaaacacatt

SEQ ID NO: 5099210 - DNA, 14 bp, Homo sapiens
aagcaaacacatta

SEQ ID NO: 5099211 - DNA, 16 bp, Homo sapiens
aagcaaacatcaaata

SEQ ID NO: 5099212 - DNA, 21 bp, Homo sapiens
aagcaaaccgccctgcagcat

SEQ ID NO: 5099213 - DNA, 14 bp, Homo sapiens
aagcaaaccttctc

SEQ ID NO: 5099214 - DNA, 16 bp, Homo sapiens
aagcaaaccttctcag

SEQ ID NO: 5099215 - DNA, 16 bp, Homo sapiens
aagcaaacgtctattt

SEQ ID NO: 5099216 - DNA, 15 bp, Homo sapiens
aagcaaactatattt

SEQ ID NO: 5099217 - DNA, 22 bp, Homo sapiens
aagcaaactatgatttattttg

SEQ ID NO: 5099218 - DNA, 15 bp, Homo sapiens
aagcaaactgaaatt

SEQ ID NO: 5099219 - DNA, 22 bp, Homo sapiens
aagcaaactgaaattagtgttt

SEQ ID NO: 5099220 - DNA, 22 bp, Homo sapiens
aagcaaactggttatttaaaat

SEQ ID NO: 5099221 - DNA, 13 bp, Homo sapiens
aagcaaacttaca

SEQ ID NO: 5099222 - DNA, 17 bp, Homo sapiens
aagcaaagacaaaagaa

SEQ ID NO: 5099223 - DNA, 20 bp, Homo sapiens
aagcaaagacaaaagaaact

SEQ ID NO: 5099224 - DNA, 22 bp, Homo sapiens
aagcaaagacaaaagaaactta

SEQ ID NO: 5099225 - DNA, 22 bp, Homo sapiens
aagcaaagactttcctcttagt

SEQ ID NO: 5099226 - DNA, 11 bp, Homo sapiens
aagcaaagatg

SEQ ID NO: 5099227 - DNA, 15 bp, Homo sapiens
aagcaaagcacagag

SEQ ID NO: 5099228 - DNA, 21 bp, Homo sapiens
aagcaaagcacccatttcaat

SEQ ID NO: 5099229 - DNA, 20 bp, Homo sapiens
aagcaaagcgctaagtaaaa

SEQ ID NO: 5099230 - DNA, 13 bp, Homo sapiens
aagcaaaggagat

SEQ ID NO: 5099231 - DNA, 14 bp, Homo sapiens
aagcaaaggctccc

SEQ ID NO: 5099232 - DNA, 16 bp, Homo sapiens
aagcaaaggctccctc

SEQ ID NO: 5099233 - DNA, 18 bp, Homo sapiens
aagcaaaggggacagctg

SEQ ID NO: 5099234 - DNA, 14 bp, Homo sapiens
aagcaaagggggga

SEQ ID NO: 5099235 - DNA, 16 bp, Homo sapiens
aagcaaaggggggagg

SEQ ID NO: 5099236 - DNA, 11 bp, Homo sapiens
aagcaaaggtg

SEQ ID NO: 5099237 - DNA, 20 bp, Homo sapiens
aagcaaaggtgcactccaga

SEQ ID NO: 5099238 - DNA, 18 bp, Homo sapiens
aagcaaagtattgtgaaa

SEQ ID NO: 5099239 - DNA, 14 bp, Homo sapiens
aagcaaagtcactt

SEQ ID NO: 5099240 - DNA, 19 bp, Homo sapiens
aagcaaagtgctttgactt

SEQ ID NO: 5099241 - DNA, 14 bp, Homo sapiens
aagcaaagttcaac

SEQ ID NO: 5099242 - DNA, 18 bp, Homo sapiens
aagcaaagttcaacttat

SEQ ID NO: 5099243 - DNA, 22 bp, Homo sapiens
aagcaaataccaaagcagttgg

SEQ ID NO: 5099244 - DNA, 23 bp, Homo sapiens
aagcaaatactgattttcaaaaa

SEQ ID NO: 5099245 - DNA, 18 bp, Homo sapiens
aagcaaatacttagcaaa

SEQ ID NO: 5099246 - DNA, 18 bp, Homo sapiens
aagcaaatataaacagca

SEQ ID NO: 5099247 - DNA, 15 bp, Homo sapiens
aagcaaatatagaaa

SEQ ID NO: 5099248 - DNA, 19 bp, Homo sapiens
aagcaaatatttatgacct

SEQ ID NO: 5099249 - DNA, 20 bp, Homo sapiens
aagcaaatatttatgacctc

SEQ ID NO: 5099250 - DNA, 14 bp, Homo sapiens
aagcaaatcagaaa

SEQ ID NO: 5099251 - DNA, 20 bp, Homo sapiens
aagcaaatcccaacatttct

SEQ ID NO: 5099252 - DNA, 14 bp, Homo sapiens
aagcaaatctacag

SEQ ID NO: 5099253 - DNA, 21 bp, Homo sapiens
aagcaaatctgtataaatgtg

SEQ ID NO: 5099254 - DNA, 22 bp, Homo sapiens
aagcaaatctgtataaatgtga

SEQ ID NO: 5099255 - DNA, 21 bp, Homo sapiens
aagcaaatctttctgtaaaca

SEQ ID NO: 5099256 - DNA, 16 bp, Homo sapiens
aagcaaatgcattcta

SEQ ID NO: 5099257 - DNA, 17 bp, Homo sapiens
aagcaaatgcattctat

SEQ ID NO: 5099258 - DNA, 16 bp, Homo sapiens
aagcaaatgcctgcca

SEQ ID NO: 5099259 - DNA, 21 bp, Homo sapiens
aagcaaatgcctgccaaattt

SEQ ID NO: 5099260 - DNA, 13 bp, Homo sapiens
aagcaaatgcttt

SEQ ID NO: 5099261 - DNA, 23 bp, Homo sapiens
aagcaaatggcaaaaccagtagc

SEQ ID NO: 5099262 - DNA, 17 bp, Homo sapiens
aagcaaatgttaaaagt

SEQ ID NO: 5099263 - DNA, 13 bp, Homo sapiens
aagcaaattattt

SEQ ID NO: 5099264 - DNA, 14 bp, Homo sapiens
aagcaaattgatga

SEQ ID NO: 5099265 - DNA, 13 bp, Homo sapiens
aagcaaatttcaa

SEQ ID NO: 5099266 - DNA, 19 bp, Homo sapiens
aagcaaatttgtggttgta

SEQ ID NO: 5099267 - DNA, 20 bp, Homo sapiens
aagcaaattttgtattattg

SEQ ID NO: 5099268 - DNA, 19 bp, Homo sapiens
aagcaacaaagagcgagtc

SEQ ID NO: 5099269 - DNA, 20 bp, Homo sapiens
aagcaacaaagattgagaag

SEQ ID NO: 5099270 - DNA, 12 bp, Homo sapiens
aagcaacaaatt

SEQ ID NO: 5099271 - DNA, 16 bp, Homo sapiens
aagcaacaaccttaaa

SEQ ID NO: 5099272 - DNA, 22 bp, Homo sapiens
aagcaacaaccttaaaggccgt

SEQ ID NO: 5099273 - DNA, 16 bp, Homo sapiens
aagcaacaactttgtt

SEQ ID NO: 5099274 - DNA, 12 bp, Homo sapiens
aagcaacaatgg

SEQ ID NO: 5099275 - DNA, 16 bp, Homo sapiens
aagcaacaatggatat

SEQ ID NO: 5099276 - DNA, 12 bp, Homo sapiens
aagcaacaattt

SEQ ID NO: 5099277 - DNA, 16 bp, Homo sapiens
aagcaacactttttat

SEQ ID NO: 5099278 - DNA, 14 bp, Homo sapiens
aagcaacagctgga

SEQ ID NO: 5099279 - DNA, 14 bp, Homo sapiens
aagcaacaggtttt

SEQ ID NO: 5099280 - DNA, 12 bp, Homo sapiens
aagcaacataaa

SEQ ID NO: 5099281 - DNA, 19 bp, Homo sapiens
aagcaacataaaacaatga

SEQ ID NO: 5099282 - DNA, 14 bp, Homo sapiens
aagcaacatcagct

SEQ ID NO: 5099283 - DNA, 15 bp, Homo sapiens
aagcaacatggcttt

SEQ ID NO: 5099284 - DNA, 14 bp, Homo sapiens
aagcaacatttgta

SEQ ID NO: 5099285 - DNA, 17 bp, Homo sapiens
aagcaacccaaatgttc

SEQ ID NO: 5099286 - DNA, 21 bp, Homo sapiens
aagcaacctgggtccaaataa

SEQ ID NO: 5099287 - DNA, 18 bp, Homo sapiens
aagcaacgtgttaattat

SEQ ID NO: 5099288 - DNA, 23 bp, Homo sapiens
aagcaacgtgttaattataaaca

SEQ ID NO: 5099289 - DNA, 18 bp, Homo sapiens
aagcaactaagttaataa

SEQ ID NO: 5099290 - DNA, 14 bp, Homo sapiens
aagcaactcacacg

SEQ ID NO: 5099291 - DNA, 13 bp, Homo sapiens
aagcaactggaaa

SEQ ID NO: 5099292 - DNA, 15 bp, Homo sapiens
aagcaactgtaaaaa

SEQ ID NO: 5099293 - DNA, 18 bp, Homo sapiens
aagcaactgtctatttct

SEQ ID NO: 5099294 - DNA, 16 bp, Homo sapiens
aagcaacttcatttga

SEQ ID NO: 5099295 - DNA, 15 bp, Homo sapiens
aagcaacttgcttct

SEQ ID NO: 5099296 - DNA, 18 bp, Homo sapiens
aagcaacttgcttctaaa

SEQ ID NO: 5099297 - DNA, 22 bp, Homo sapiens
aagcaacttgcttctaaatgcc

SEQ ID NO: 5099298 - DNA, 19 bp, Homo sapiens
aagcaacttggtccagatt

SEQ ID NO: 5099299 - DNA, 23 bp, Homo sapiens
aagcaagaatcagagaaggaaca

SEQ ID NO: 5099300 - DNA, 13 bp, Homo sapiens
aagcaagactgag

SEQ ID NO: 5099301 - DNA, 19 bp, Homo sapiens
aagcaagacttccaggtag

SEQ ID NO: 5099302 - DNA, 14 bp, Homo sapiens
aagcaagatctact

SEQ ID NO: 5099303 - DNA, 17 bp, Homo sapiens
aagcaagatgttttgta

SEQ ID NO: 5099304 - DNA, 18 bp, Homo sapiens
aagcaagatgttttgtat

SEQ ID NO: 5099305 - DNA, 20 bp, Homo sapiens
aagcaagatgttttgtataa

SEQ ID NO: 5099306 - DNA, 23 bp, Homo sapiens
aagcaagatgttttgtataaaat

SEQ ID NO: 5099307 - DNA, 15 bp, Homo sapiens
aagcaagatttcaga

SEQ ID NO: 5099308 - DNA, 16 bp, Homo sapiens
aagcaagatttcagat

SEQ ID NO: 5099309 - DNA, 15 bp, Homo sapiens
aagcaagcaagaggc

SEQ ID NO: 5099310 - DNA, 24 bp, Homo sapiens
aagcaagcacctgggtgtgctcca

SEQ ID NO: 5099311 - DNA, 14 bp, Homo sapiens
aagcaagcagatga

SEQ ID NO: 5099312 - DNA, 13 bp, Homo sapiens
aagcaagccagac

SEQ ID NO: 5099313 - DNA, 16 bp, Homo sapiens
aagcaagccaggagaa

SEQ ID NO: 5099314 - DNA, 15 bp, Homo sapiens
aagcaagctaacctt

SEQ ID NO: 5099315 - DNA, 12 bp, Homo sapiens
aagcaagctctc

SEQ ID NO: 5099316 - DNA, 18 bp, Homo sapiens
aagcaagctcttctcctc

SEQ ID NO: 5099317 - DNA, 11 bp, Homo sapiens
aagcaagctgt

SEQ ID NO: 5099318 - DNA, 12 bp, Homo sapiens
aagcaagctgtg

SEQ ID NO: 5099319 - DNA, 13 bp, Homo sapiens
aagcaagctgtgt

SEQ ID NO: 5099320 - DNA, 16 bp, Homo sapiens
aagcaagctgtgttac

SEQ ID NO: 5099321 - DNA, 12 bp, Homo sapiens
aagcaaggaagt

SEQ ID NO: 5099322 - DNA, 14 bp, Homo sapiens
aagcaaggaagtaa

SEQ ID NO: 5099323 - DNA, 12 bp, Homo sapiens
aagcaaggctgg

SEQ ID NO: 5099324 - DNA, 13 bp, Homo sapiens
aagcaagggagaa

SEQ ID NO: 5099325 - DNA, 20 bp, Homo sapiens
aagcaagggctccagcatcc

SEQ ID NO: 5099326 - DNA, 12 bp, Homo sapiens
aagcaaggggga

SEQ ID NO: 5099327 - DNA, 15 bp, Homo sapiens
aagcaagggggaagg

SEQ ID NO: 5099328 - DNA, 18 bp, Homo sapiens
aagcaaggtgtccctgcc

SEQ ID NO: 5099329 - DNA, 13 bp, Homo sapiens
aagcaaggtgttt

SEQ ID NO: 5099330 - DNA, 15 bp, Homo sapiens
aagcaaggtgtttaa

SEQ ID NO: 5099331 - DNA, 18 bp, Homo sapiens
aagcaaggtgtttaagta

SEQ ID NO: 5099332 - DNA, 13 bp, Homo sapiens
aagcaagtagctt

SEQ ID NO: 5099333 - DNA, 16 bp, Homo sapiens
aagcaagtagctttcc

SEQ ID NO: 5099334 - DNA, 22 bp, Homo sapiens
aagcaagtgattgggacagagg

SEQ ID NO: 5099335 - DNA, 16 bp, Homo sapiens
aagcaagtggttgttt

SEQ ID NO: 5099336 - DNA, 12 bp, Homo sapiens
aagcaagttcac

SEQ ID NO: 5099337 - DNA, 11 bp, Homo sapiens
aagcaataaaa

SEQ ID NO: 5099338 - DNA, 19 bp, Homo sapiens
aagcaataaaatttttttg

SEQ ID NO: 5099339 - DNA, 20 bp, Homo sapiens
aagcaataaagatttttcaa

SEQ ID NO: 5099340 - DNA, 13 bp, Homo sapiens
aagcaataactat

SEQ ID NO: 5099341 - DNA, 20 bp, Homo sapiens
aagcaataatggtcccatcc

SEQ ID NO: 5099342 - DNA, 22 bp, Homo sapiens
aagcaataatggtcccatccag

SEQ ID NO: 5099343 - DNA, 23 bp, Homo sapiens
aagcaataattaggatctatgca

SEQ ID NO: 5099344 - DNA, 21 bp, Homo sapiens
aagcaatacaactttaccata

SEQ ID NO: 5099345 - DNA, 17 bp, Homo sapiens
aagcaatactgtttcca

SEQ ID NO: 5099346 - DNA, 21 bp, Homo sapiens
aagcaatacttaggaggctta

SEQ ID NO: 5099347 - DNA, 12 bp, Homo sapiens
aagcaatagaaa

SEQ ID NO: 5099348 - DNA, 13 bp, Homo sapiens
aagcaatagaaac

SEQ ID NO: 5099349 - DNA, 14 bp, Homo sapiens
aagcaatagaaaca

SEQ ID NO: 5099350 - DNA, 17 bp, Homo sapiens
aagcaatagaaacaaca

SEQ ID NO: 5099351 - DNA, 19 bp, Homo sapiens
aagcaatcaagcaccagga

SEQ ID NO: 5099352 - DNA, 14 bp, Homo sapiens
aagcaatcactggg

SEQ ID NO: 5099353 - DNA, 16 bp, Homo sapiens
aagcaatcactgggcc

SEQ ID NO: 5099354 - DNA, 17 bp, Homo sapiens
aagcaatcactgggccc

SEQ ID NO: 5099355 - DNA, 23 bp, Homo sapiens
aagcaatcactgggcccagagga

SEQ ID NO: 5099356 - DNA, 18 bp, Homo sapiens
aagcaatcatagagaaac

SEQ ID NO: 5099357 - DNA, 15 bp, Homo sapiens
aagcaatccacctgc

SEQ ID NO: 5099358 - DNA, 16 bp, Homo sapiens
aagcaatccacctgcc

SEQ ID NO: 5099359 - DNA, 18 bp, Homo sapiens
aagcaatccacctgcctt

SEQ ID NO: 5099360 - DNA, 20 bp, Homo sapiens
aagcaatccacctgccttgg

SEQ ID NO: 5099361 - DNA, 15 bp, Homo sapiens
aagcaatcctaggta

SEQ ID NO: 5099362 - DNA, 14 bp, Homo sapiens
aagcaatcctccta

SEQ ID NO: 5099363 - DNA, 20 bp, Homo sapiens
aagcaatcctcctgcctcag

SEQ ID NO: 5099364 - DNA, 20 bp, Homo sapiens
aagcaatcctctcacctcag

SEQ ID NO: 5099365 - DNA, 19 bp, Homo sapiens
aagcaatccttctgccttg

SEQ ID NO: 5099366 - DNA, 15 bp, Homo sapiens
aagcaatctggaaga

SEQ ID NO: 5099367 - DNA, 14 bp, Homo sapiens
aagcaatctgttga

SEQ ID NO: 5099368 - DNA, 14 bp, Homo sapiens
aagcaatcttggca

SEQ ID NO: 5099369 - DNA, 16 bp, Homo sapiens
aagcaatctttgaaat

SEQ ID NO: 5099370 - DNA, 18 bp, Homo sapiens
aagcaatctttgaaataa

SEQ ID NO: 5099371 - DNA, 14 bp, Homo sapiens
aagcaatcttttat

SEQ ID NO: 5099372 - DNA, 14 bp, Homo sapiens
aagcaatgatgacc

SEQ ID NO: 5099373 - DNA, 21 bp, Homo sapiens
aagcaatggggaatacaagtt

SEQ ID NO: 5099374 - DNA, 20 bp, Homo sapiens
aagcaattaggtagcacagc

SEQ ID NO: 5099375 - DNA, 16 bp, Homo sapiens
aagcaattatattgtc

SEQ ID NO: 5099376 - DNA, 15 bp, Homo sapiens
aagcaattatttaaa

SEQ ID NO: 5099377 - DNA, 16 bp, Homo sapiens
aagcaattccaacctt

SEQ ID NO: 5099378 - DNA, 14 bp, Homo sapiens
aagcaattctaagt

SEQ ID NO: 5099379 - DNA, 15 bp, Homo sapiens
aagcaattctgactg

SEQ ID NO: 5099380 - DNA, 16 bp, Homo sapiens
aagcaattctgactgt

SEQ ID NO: 5099381 - DNA, 22 bp, Homo sapiens
aagcaattctgactgtccagga

SEQ ID NO: 5099382 - DNA, 20 bp, Homo sapiens
aagcaattctgccccacacc

SEQ ID NO: 5099383 - DNA, 17 bp, Homo sapiens
aagcaattgccctgtaa

SEQ ID NO: 5099384 - DNA, 17 bp, Homo sapiens
aagcaattgctgcatct

SEQ ID NO: 5099385 - DNA, 12 bp, Homo sapiens
aagcaatttata

SEQ ID NO: 5099386 - DNA, 22 bp, Homo sapiens
aagcaatttatatctttatgca

SEQ ID NO: 5099387 - DNA, 22 bp, Homo sapiens
aagcaatttcagttttaaaaat

SEQ ID NO: 5099388 - DNA, 17 bp, Homo sapiens
aagcaatttgaaataat

SEQ ID NO: 5099389 - DNA, 19 bp, Homo sapiens
aagcaattttcatttacct

SEQ ID NO: 5099390 - DNA, 16 bp, Homo sapiens
aagcaattttccttga

SEQ ID NO: 5099391 - DNA, 17 bp, Homo sapiens
aagcaattttccttgaa

SEQ ID NO: 5099392 - DNA, 18 bp, Homo sapiens
aagcaattttccttgaag

SEQ ID NO: 5099393 - DNA, 21 bp, Homo sapiens
aagcaattttccttgaagccg

SEQ ID NO: 5099394 - DNA, 17 bp, Homo sapiens
aagcacaaaccctgggg

SEQ ID NO: 5099395 - DNA, 18 bp, Homo sapiens
aagcacaaaccctgggga

SEQ ID NO: 5099396 - DNA, 18 bp, Homo sapiens
aagcacaaactgtcgtct

SEQ ID NO: 5099397 - DNA, 23 bp, Homo sapiens
aagcacaaagcagtttttccccc

SEQ ID NO: 5099398 - DNA, 16 bp, Homo sapiens
aagcacaaagctcaag

SEQ ID NO: 5099399 - DNA, 13 bp, Homo sapiens
aagcacaaaggaa

SEQ ID NO: 5099400 - DNA, 22 bp, Homo sapiens
aagcacaaagttctcagagctc

SEQ ID NO: 5099401 - DNA, 18 bp, Homo sapiens
aagcacaactgaaaccag

SEQ ID NO: 5099402 - DNA, 13 bp, Homo sapiens
aagcacaagaagc

SEQ ID NO: 5099403 - DNA, 13 bp, Homo sapiens
aagcacaagactg

SEQ ID NO: 5099404 - DNA, 14 bp, Homo sapiens
aagcacaataacta

SEQ ID NO: 5099405 - DNA, 19 bp, Homo sapiens
aagcacaatttaaaacaat

SEQ ID NO: 5099406 - DNA, 18 bp, Homo sapiens
aagcacacacaaaataaa

SEQ ID NO: 5099407 - DNA, 18 bp, Homo sapiens
aagcacacacaataaaga

SEQ ID NO: 5099408 - DNA, 18 bp, Homo sapiens
aagcacacacatctggcc

SEQ ID NO: 5099409 - DNA, 21 bp, Homo sapiens
aagcacacacatctggccctg

SEQ ID NO: 5099410 - DNA, 18 bp, Homo sapiens
aagcacaccaatcttact

SEQ ID NO: 5099411 - DNA, 22 bp, Homo sapiens
aagcacaccaatcttactttgt

SEQ ID NO: 5099412 - DNA, 23 bp, Homo sapiens
aagcacaccatatgtccactgtt

SEQ ID NO: 5099413 - DNA, 23 bp, Homo sapiens
aagcacactgcagggctgctgtg

SEQ ID NO: 5099414 - DNA, 14 bp, Homo sapiens
aagcacacttgtag

SEQ ID NO: 5099415 - DNA, 15 bp, Homo sapiens
aagcacagaatattt

SEQ ID NO: 5099416 - DNA, 12 bp, Homo sapiens
aagcacagagcc

SEQ ID NO: 5099417 - DNA, 17 bp, Homo sapiens
aagcacagatttgcatt

SEQ ID NO: 5099418 - DNA, 11 bp, Homo sapiens
aagcacagcag

SEQ ID NO: 5099419 - DNA, 11 bp, Homo sapiens
aagcacagctc

SEQ ID NO: 5099420 - DNA, 13 bp, Homo sapiens
aagcacagctctc

SEQ ID NO: 5099421 - DNA, 14 bp, Homo sapiens
aagcacaggagaca

SEQ ID NO: 5099422 - DNA, 22 bp, Homo sapiens
aagcacaggcaagagtgttctt

SEQ ID NO: 5099423 - DNA, 20 bp, Homo sapiens
aagcacaggtccaaggctgg

SEQ ID NO: 5099424 - DNA, 20 bp, Homo sapiens
aagcacagtctgatgacaca

SEQ ID NO: 5099425 - DNA, 13 bp, Homo sapiens
aagcacagtggtg

SEQ ID NO: 5099426 - DNA, 18 bp, Homo sapiens
aagcacagtggtggcagg

SEQ ID NO: 5099427 - DNA, 19 bp, Homo sapiens
aagcacagtggtggcaggg

SEQ ID NO: 5099428 - DNA, 24 bp, Homo sapiens
aagcacagtggtggcagggcctag

SEQ ID NO: 5099429 - DNA, 18 bp, Homo sapiens
aagcacagtgttaaatga

SEQ ID NO: 5099430 - DNA, 20 bp, Homo sapiens
aagcacagtgttaaatgaaa

SEQ ID NO: 5099431 - DNA, 18 bp, Homo sapiens
aagcacagtttgaacaaa

SEQ ID NO: 5099432 - DNA, 15 bp, Homo sapiens
aagcacataactgga

SEQ ID NO: 5099433 - DNA, 19 bp, Homo sapiens
aagcacatacattaaaact

SEQ ID NO: 5099434 - DNA, 17 bp, Homo sapiens
aagcacatatgtgccaa

SEQ ID NO: 5099435 - DNA, 23 bp, Homo sapiens
aagcacatattagtgcagccaag

SEQ ID NO: 5099436 - DNA, 16 bp, Homo sapiens
aagcacatctgcattt

SEQ ID NO: 5099437 - DNA, 14 bp, Homo sapiens
aagcacatgcctct

SEQ ID NO: 5099438 - DNA, 16 bp, Homo sapiens
aagcacatgcctctct

SEQ ID NO: 5099439 - DNA, 19 bp, Homo sapiens
aagcacatgcctctctcag

SEQ ID NO: 5099440 - DNA, 21 bp, Homo sapiens
aagcacatgcctctctcaggc

SEQ ID NO: 5099441 - DNA, 17 bp, Homo sapiens
aagcacatggttcaaat

SEQ ID NO: 5099442 - DNA, 13 bp, Homo sapiens
aagcacatgtaat

SEQ ID NO: 5099443 - DNA, 15 bp, Homo sapiens
aagcacatgtttatt

SEQ ID NO: 5099444 - DNA, 17 bp, Homo sapiens
aagcaccaaaaaactaa

SEQ ID NO: 5099445 - DNA, 17 bp, Homo sapiens
aagcaccaaaataagaa

SEQ ID NO: 5099446 - DNA, 14 bp, Homo sapiens
aagcaccaacctcc

SEQ ID NO: 5099447 - DNA, 17 bp, Homo sapiens
aagcaccagcctcagtg

SEQ ID NO: 5099448 - DNA, 19 bp, Homo sapiens
aagcaccagcctcagtgca

SEQ ID NO: 5099449 - DNA, 20 bp, Homo sapiens
aagcaccagcttctccaggc

SEQ ID NO: 5099450 - DNA, 13 bp, Homo sapiens
aagcaccagggag

SEQ ID NO: 5099451 - DNA, 14 bp, Homo sapiens
aagcaccccatgcc

SEQ ID NO: 5099452 - DNA, 13 bp, Homo sapiens
aagcaccctgttc

SEQ ID NO: 5099453 - DNA, 14 bp, Homo sapiens
aagcaccctgttcc

SEQ ID NO: 5099454 - DNA, 15 bp, Homo sapiens
aagcaccgacaatct

SEQ ID NO: 5099455 - DNA, 16 bp, Homo sapiens
aagcacctactatgtg

SEQ ID NO: 5099456 - DNA, 19 bp, Homo sapiens
aagcacctactatgtgctg

SEQ ID NO: 5099457 - DNA, 15 bp, Homo sapiens
aagcacctcctgcct

SEQ ID NO: 5099458 - DNA, 14 bp, Homo sapiens
aagcacctttagaa

SEQ ID NO: 5099459 - DNA, 13 bp, Homo sapiens
aagcacgtattta

SEQ ID NO: 5099460 - DNA, 14 bp, Homo sapiens
aagcacgtgcaagg

SEQ ID NO: 5099461 - DNA, 20 bp, Homo sapiens
aagcactaaaaagttgaacc

SEQ ID NO: 5099462 - DNA, 16 bp, Homo sapiens
aagcactaaacaaaga

SEQ ID NO: 5099463 - DNA, 20 bp, Homo sapiens
aagcactaagactgcttcta

SEQ ID NO: 5099464 - DNA, 19 bp, Homo sapiens
aagcactacaccttgcctt

SEQ ID NO: 5099465 - DNA, 17 bp, Homo sapiens
aagcactagccttccca

SEQ ID NO: 5099466 - DNA, 17 bp, Homo sapiens
aagcactatgaatttgt

SEQ ID NO: 5099467 - DNA, 16 bp, Homo sapiens
aagcactattttatat

SEQ ID NO: 5099468 - DNA, 21 bp, Homo sapiens
aagcactattttatatttaaa

SEQ ID NO: 5099469 - DNA, 21 bp, Homo sapiens
aagcactcccttaggcattat

SEQ ID NO: 5099470 - DNA, 23 bp, Homo sapiens
aagcactcctccctgatgtacag

SEQ ID NO: 5099471 - DNA, 23 bp, Homo sapiens
aagcactcctgcttaatcttcaa

SEQ ID NO: 5099472 - DNA, 20 bp, Homo sapiens
aagcactcgagaccatcctg

SEQ ID NO: 5099473 - DNA, 22 bp, Homo sapiens
aagcactctctgcagtcctccg

SEQ ID NO: 5099474 - DNA, 13 bp, Homo sapiens
aagcactgacact

SEQ ID NO: 5099475 - DNA, 16 bp, Homo sapiens
aagcactgacctgtca

SEQ ID NO: 5099476 - DNA, 19 bp, Homo sapiens
aagcactgacttctaagta

SEQ ID NO: 5099477 - DNA, 11 bp, Homo sapiens
aagcactgata

SEQ ID NO: 5099478 - DNA, 23 bp, Homo sapiens
aagcactgctaggcgagtgccag

SEQ ID NO: 5099479 - DNA, 21 bp, Homo sapiens
aagcactgctcacgtctctgc

SEQ ID NO: 5099480 - DNA, 12 bp, Homo sapiens
aagcactgtgct

SEQ ID NO: 5099481 - DNA, 15 bp, Homo sapiens
aagcactgtgctcag

SEQ ID NO: 5099482 - DNA, 22 bp, Homo sapiens
aagcactgtgtttatatgtctt

SEQ ID NO: 5099483 - DNA, 21 bp, Homo sapiens
aagcacttaagtcttccttaa

SEQ ID NO: 5099484 - DNA, 18 bp, Homo sapiens
aagcacttcacagctgga

SEQ ID NO: 5099485 - DNA, 19 bp, Homo sapiens
aagcacttcccaggatctg

SEQ ID NO: 5099486 - DNA, 13 bp, Homo sapiens
aagcacttctaga

SEQ ID NO: 5099487 - DNA, 14 bp, Homo sapiens
aagcacttctagaa

SEQ ID NO: 5099488 - DNA, 17 bp, Homo sapiens
aagcactttaacacagt

SEQ ID NO: 5099489 - DNA, 13 bp, Homo sapiens
aagcactttacag

SEQ ID NO: 5099490 - DNA, 22 bp, Homo sapiens
aagcactttacgctgtctgtaa

SEQ ID NO: 5099491 - DNA, 13 bp, Homo sapiens
aagcactttgatt

SEQ ID NO: 5099492 - DNA, 18 bp, Homo sapiens
aagcactttgggattctt

SEQ ID NO: 5099493 - DNA, 13 bp, Homo sapiens
aagcacttttgtt

SEQ ID NO: 5099494 - DNA, 14 bp, Homo sapiens
aagcacttttgtta

SEQ ID NO: 5099495 - DNA, 23 bp, Homo sapiens
aagcacttttgttattccatcaa

SEQ ID NO: 5099496 - DNA, 18 bp, Homo sapiens
aagcactttttggctgac

SEQ ID NO: 5099497 - DNA, 16 bp, Homo sapiens
aagcagaaaaattaaa

SEQ ID NO: 5099498 - DNA, 19 bp, Homo sapiens
aagcagaaaataaaggaag

SEQ ID NO: 5099499 - DNA, 13 bp, Homo sapiens
aagcagaaaatac

SEQ ID NO: 5099500 - DNA, 15 bp, Homo sapiens
aagcagaaagtgcct

SEQ ID NO: 5099501 - DNA, 17 bp, Homo sapiens
aagcagaaagtgccttt

SEQ ID NO: 5099502 - DNA, 18 bp, Homo sapiens
aagcagaaagtgcctttc

SEQ ID NO: 5099503 - DNA, 12 bp, Homo sapiens
aagcagaaatac

SEQ ID NO: 5099504 - DNA, 22 bp, Homo sapiens
aagcagaaatcctgcaatgaaa

SEQ ID NO: 5099505 - DNA, 15 bp, Homo sapiens
aagcagaacaaatgt

SEQ ID NO: 5099506 - DNA, 22 bp, Homo sapiens
aagagcaggatagctcttcctc

SEQ ID NO: 5099507 - DNA, 23 bp, Homo sapiens
aagagcaggcacatggaggagct

SEQ ID NO: 5099508 - DNA, 18 bp, Homo sapiens
aagagcaggccagcccgg

SEQ ID NO: 5099509 - DNA, 18 bp, Homo sapiens
aagagcatcatgcctctg

SEQ ID NO: 5099510 - DNA, 19 bp, Homo sapiens
aagagcatcatgcctctga

SEQ ID NO: 5099511 - DNA, 21 bp, Homo sapiens
aagagcatcatgcctctgagg

SEQ ID NO: 5099512 - DNA, 23 bp, Homo sapiens
aagagcatcatgcctctgaggcc

SEQ ID NO: 5099513 - DNA, 12 bp, Homo sapiens
aagagcatcctg

SEQ ID NO: 5099514 - DNA, 14 bp, Homo sapiens
aagagcatctgatt

SEQ ID NO: 5099515 - DNA, 18 bp, Homo sapiens
aagagcatgatttgaaaa

SEQ ID NO: 5099516 - DNA, 14 bp, Homo sapiens
aagagcatggatgc

SEQ ID NO: 5099517 - DNA, 22 bp, Homo sapiens
aagagcatggatgcatttcaaa

SEQ ID NO: 5099518 - DNA, 23 bp, Homo sapiens
aagagcatggatgcatttcaaat

SEQ ID NO: 5099519 - DNA, 13 bp, Homo sapiens
aagagcatttggt

SEQ ID NO: 5099520 - DNA, 14 bp, Homo sapiens
aagagccacctgca

SEQ ID NO: 5099521 - DNA, 19 bp, Homo sapiens
aagagccacctgcaagatg

SEQ ID NO: 5099522 - DNA, 21 bp, Homo sapiens
aagagccactttcaagctgca

SEQ ID NO: 5099523 - DNA, 24 bp, Homo sapiens
aagagccactttcaagctgcactg

SEQ ID NO: 5099524 - DNA, 19 bp, Homo sapiens
aagagccatataagtttga

SEQ ID NO: 5099525 - DNA, 23 bp, Homo sapiens
aagagccattctggcactttaat

SEQ ID NO: 5099526 - DNA, 12 bp, Homo sapiens
aagagcccaggc

SEQ ID NO: 5099527 - DNA, 14 bp, Homo sapiens
aagagcccaggcct

SEQ ID NO: 5099528 - DNA, 14 bp, Homo sapiens
aagagcccagtctg

SEQ ID NO: 5099529 - DNA, 23 bp, Homo sapiens
aagagcccagtctgttgagttag

SEQ ID NO: 5099530 - DNA, 23 bp, Homo sapiens
aagagcccgcagggccatgcaga

SEQ ID NO: 5099531 - DNA, 23 bp, Homo sapiens
aagagcccgtcgcgctggacagc

SEQ ID NO: 5099532 - DNA, 21 bp, Homo sapiens
aagagccctgagctcaggctg

SEQ ID NO: 5099533 - DNA, 20 bp, Homo sapiens
aagagccctggacacccctg

SEQ ID NO: 5099534 - DNA, 16 bp, Homo sapiens
aagagccctggctctg

SEQ ID NO: 5099535 - DNA, 20 bp, Homo sapiens
aagagccctggctctgcccc

SEQ ID NO: 5099536 - DNA, 16 bp, Homo sapiens
aagagcccttccagga

SEQ ID NO: 5099537 - DNA, 13 bp, Homo sapiens
aagagcccttgcc

SEQ ID NO: 5099538 - DNA, 14 bp, Homo sapiens
aagagccggagcct

SEQ ID NO: 5099539 - DNA, 17 bp, Homo sapiens
aagagccggtggtgccc

SEQ ID NO: 5099540 - DNA, 13 bp, Homo sapiens
aagagcctcccct

SEQ ID NO: 5099541 - DNA, 16 bp, Homo sapiens
aagagcctctggaagg

SEQ ID NO: 5099542 - DNA, 20 bp, Homo sapiens
aagagcctctggaagggagg

SEQ ID NO: 5099543 - DNA, 18 bp, Homo sapiens
aagagcctgactgtgttc

SEQ ID NO: 5099544 - DNA, 13 bp, Homo sapiens
aagagcctgagac

SEQ ID NO: 5099545 - DNA, 16 bp, Homo sapiens
aagagcctgagactgg

SEQ ID NO: 5099546 - DNA, 12 bp, Homo sapiens
aagagcctgcag

SEQ ID NO: 5099547 - DNA, 16 bp, Homo sapiens
aagagcctgcaggtgc

SEQ ID NO: 5099548 - DNA, 22 bp, Homo sapiens
aagagcctgcaggtgctgctgc

SEQ ID NO: 5099549 - DNA, 11 bp, Homo sapiens
aagagcctgga

SEQ ID NO: 5099550 - DNA, 16 bp, Homo sapiens
aagagcctggagaagc

SEQ ID NO: 5099551 - DNA, 21 bp, Homo sapiens
aagagcctggagaagctgatg

SEQ ID NO: 5099552 - DNA, 13 bp, Homo sapiens
aagagccttaaaa

SEQ ID NO: 5099553 - DNA, 16 bp, Homo sapiens
aagagccttaaaacat

SEQ ID NO: 5099554 - DNA, 18 bp, Homo sapiens
aagagccttcacatgaaa

SEQ ID NO: 5099555 - DNA, 16 bp, Homo sapiens
aagagccttccaccca

SEQ ID NO: 5099556 - DNA, 22 bp, Homo sapiens
aagagccttggtgtccacctgg

SEQ ID NO: 5099557 - DNA, 15 bp, Homo sapiens
aagagcctttccaaa

SEQ ID NO: 5099558 - DNA, 21 bp, Homo sapiens
aagagcgagagatcaaagatg

SEQ ID NO: 5099559 - DNA, 18 bp, Homo sapiens
aagagcgctcctctgcct

SEQ ID NO: 5099560 - DNA, 14 bp, Homo sapiens
aagagctacataat

SEQ ID NO: 5099561 - DNA, 20 bp, Homo sapiens
aagagctacgtatttaatag

SEQ ID NO: 5099562 - DNA, 22 bp, Homo sapiens
aagagctagaaaaataaaatgt

SEQ ID NO: 5099563 - DNA, 19 bp, Homo sapiens
aagagctagcgctgccgca

SEQ ID NO: 5099564 - DNA, 22 bp, Homo sapiens
aagagctaggcagggtgtctgc

SEQ ID NO: 5099565 - DNA, 14 bp, Homo sapiens
aagagctatacagt

SEQ ID NO: 5099566 - DNA, 15 bp, Homo sapiens
aagagctatacagtt

SEQ ID NO: 5099567 - DNA, 17 bp, Homo sapiens
aagagctcaggagaagg

SEQ ID NO: 5099568 - DNA, 21 bp, Homo sapiens
aagagctcaggagaaggcctg

SEQ ID NO: 5099569 - DNA, 19 bp, Homo sapiens
aagagctcccctccacagc

SEQ ID NO: 5099570 - DNA, 19 bp, Homo sapiens
aagagctcccgaggaagca

SEQ ID NO: 5099571 - DNA, 12 bp, Homo sapiens
aagagctccttg

SEQ ID NO: 5099572 - DNA, 12 bp, Homo sapiens
aagagctctggt

SEQ ID NO: 5099573 - DNA, 21 bp, Homo sapiens
aagagctgatgtgagtgtgtg

SEQ ID NO: 5099574 - DNA, 14 bp, Homo sapiens
aagagctgcacagc

SEQ ID NO: 5099575 - DNA, 12 bp, Homo sapiens
aagagctgcctg

SEQ ID NO: 5099576 - DNA, 16 bp, Homo sapiens
aagagctgcctggatg

SEQ ID NO: 5099577 - DNA, 18 bp, Homo sapiens
aagagctgcctggatgag

SEQ ID NO: 5099578 - DNA, 16 bp, Homo sapiens
aagagctgctgtattt

SEQ ID NO: 5099579 - DNA, 18 bp, Homo sapiens
aagagctgctgtatttga

SEQ ID NO: 5099580 - DNA, 13 bp, Homo sapiens
aagagctgctgtc

SEQ ID NO: 5099581 - DNA, 17 bp, Homo sapiens
aagagctggtggtttga

SEQ ID NO: 5099582 - DNA, 18 bp, Homo sapiens
aagagctggtggtttgat

SEQ ID NO: 5099583 - DNA, 16 bp, Homo sapiens
aagagctgtctgactg

SEQ ID NO: 5099584 - DNA, 18 bp, Homo sapiens
aagagctgtcttcccctg

SEQ ID NO: 5099585 - DNA, 16 bp, Homo sapiens
aagagctgtggctggg

SEQ ID NO: 5099586 - DNA, 19 bp, Homo sapiens
aagagctgttatgctgttt

SEQ ID NO: 5099587 - DNA, 18 bp, Homo sapiens
aagagctgttcacagcca

SEQ ID NO: 5099588 - DNA, 19 bp, Homo sapiens
aagagctgttcacagccag

SEQ ID NO: 5099589 - DNA, 18 bp, Homo sapiens
aagagctgttttggatga

SEQ ID NO: 5099590 - DNA, 14 bp, Homo sapiens
aagagcttagaaac

SEQ ID NO: 5099591 - DNA, 19 bp, Homo sapiens
aagagcttagaaactggaa

SEQ ID NO: 5099592 - DNA, 19 bp, Homo sapiens
aagagcttcatgtgacaca

SEQ ID NO: 5099593 - DNA, 21 bp, Homo sapiens
aagagcttccagagctctgac

SEQ ID NO: 5099594 - DNA, 15 bp, Homo sapiens
aagagcttgctccag

SEQ ID NO: 5099595 - DNA, 18 bp, Homo sapiens
aagagctttacaaaaaga

SEQ ID NO: 5099596 - DNA, 12 bp, Homo sapiens
aagagctttcct

SEQ ID NO: 5099597 - DNA, 20 bp, Homo sapiens
aagaggaaaaacagggaaaa

SEQ ID NO: 5099598 - DNA, 15 bp, Homo sapiens
aagaggaaaagctaa

SEQ ID NO: 5099599 - DNA, 16 bp, Homo sapiens
aagaggaactgggcct

SEQ ID NO: 5099600 - DNA, 14 bp, Homo sapiens
aagaggaagagaga

SEQ ID NO: 5099601 - DNA, 18 bp, Homo sapiens
aagaggaagttaaaattt

SEQ ID NO: 5099602 - DNA, 16 bp, Homo sapiens
aagaggaagttcagat

SEQ ID NO: 5099603 - DNA, 23 bp, Homo sapiens
aagaggaatgaagtactcataca

SEQ ID NO: 5099604 - DNA, 12 bp, Homo sapiens
aagaggacacaa

SEQ ID NO: 5099605 - DNA, 22 bp, Homo sapiens
aagaggacataatggggtcctg

SEQ ID NO: 5099606 - DNA, 23 bp, Homo sapiens
aagaggactcgcttgtaaatacc

SEQ ID NO: 5099607 - DNA, 15 bp, Homo sapiens
aagaggactgagact

SEQ ID NO: 5099608 - DNA, 15 bp, Homo sapiens
aagaggagaaaaaga

SEQ ID NO: 5099609 - DNA, 13 bp, Homo sapiens
aagaggagcactt

SEQ ID NO: 5099610 - DNA, 18 bp, Homo sapiens
aagaggagcacttccaaa

SEQ ID NO: 5099611 - DNA, 18 bp, Homo sapiens
aagaggagccagagaagg

SEQ ID NO: 5099612 - DNA, 15 bp, Homo sapiens
aagaggagcctcaga

SEQ ID NO: 5099613 - DNA, 17 bp, Homo sapiens
aagaggagcctttccag

SEQ ID NO: 5099614 - DNA, 18 bp, Homo sapiens
aagaggagcctttccaga

SEQ ID NO: 5099615 - DNA, 18 bp, Homo sapiens
aagaggagctttttagtt

SEQ ID NO: 5099616 - DNA, 21 bp, Homo sapiens
aagaggaggacccctgccttc

SEQ ID NO: 5099617 - DNA, 12 bp, Homo sapiens
aagaggaggagg

SEQ ID NO: 5099618 - DNA, 16 bp, Homo sapiens
aagaggaggaggtggg

SEQ ID NO: 5099619 - DNA, 17 bp, Homo sapiens
aagaggaggcagaaaga

SEQ ID NO: 5099620 - DNA, 16 bp, Homo sapiens
aagaggaggcaggagg

SEQ ID NO: 5099621 - DNA, 20 bp, Homo sapiens
aagaggaggcaggaggagca

SEQ ID NO: 5099622 - DNA, 21 bp, Homo sapiens
aagaggagttctaacacattt

SEQ ID NO: 5099623 - DNA, 21 bp, Homo sapiens
aagaggagtttcgaggtagag

SEQ ID NO: 5099624 - DNA, 18 bp, Homo sapiens
aagaggatatcccttcct

SEQ ID NO: 5099625 - DNA, 15 bp, Homo sapiens
aagaggatattcttc

SEQ ID NO: 5099626 - DNA, 16 bp, Homo sapiens
aagaggatgagcagag

SEQ ID NO: 5099627 - DNA, 19 bp, Homo sapiens
aagaggatgagcagaggga

SEQ ID NO: 5099628 - DNA, 18 bp, Homo sapiens
aagaggatggatgaatct

SEQ ID NO: 5099629 - DNA, 16 bp, Homo sapiens
aagaggcaaagaatca

SEQ ID NO: 5099630 - DNA, 21 bp, Homo sapiens
aagaggcaacaatttggttct

SEQ ID NO: 5099631 - DNA, 14 bp, Homo sapiens
aagaggcaagaggc

SEQ ID NO: 5099632 - DNA, 15 bp, Homo sapiens
aagaggcaccaggaa

SEQ ID NO: 5099633 - DNA, 16 bp, Homo sapiens
aagaggcatcctgcct

SEQ ID NO: 5099634 - DNA, 14 bp, Homo sapiens
aagaggcccaggga

SEQ ID NO: 5099635 - DNA, 23 bp, Homo sapiens
aagaggccctgtctgtacctaac

SEQ ID NO: 5099636 - DNA, 16 bp, Homo sapiens
aagaggccgctgcagg

SEQ ID NO: 5099637 - DNA, 17 bp, Homo sapiens
aagaggcctcatgcctg

SEQ ID NO: 5099638 - DNA, 19 bp, Homo sapiens
aagaggcctcatgcctgct

SEQ ID NO: 5099639 - DNA, 20 bp, Homo sapiens
aagaggcctcatgcctgctg

SEQ ID NO: 5099640 - DNA, 21 bp, Homo sapiens
aagaggcctcatgcctgctga

SEQ ID NO: 5099641 - DNA, 11 bp, Homo sapiens
aagaggcctgt

SEQ ID NO: 5099642 - DNA, 15 bp, Homo sapiens
aagaggcgacttcct

SEQ ID NO: 5099643 - DNA, 20 bp, Homo sapiens
aagaggcgggccagccaggc

SEQ ID NO: 5099644 - DNA, 22 bp, Homo sapiens
aagaggcgggccagccaggcgg

SEQ ID NO: 5099645 - DNA, 17 bp, Homo sapiens
aagaggcgttgctttca

SEQ ID NO: 5099646 - DNA, 20 bp, Homo sapiens
aagaggcgttgctttcactc

SEQ ID NO: 5099647 - DNA, 15 bp, Homo sapiens
aagaggctacagggc

SEQ ID NO: 5099648 - DNA, 15 bp, Homo sapiens
aagaggctagcccca

SEQ ID NO: 5099649 - DNA, 18 bp, Homo sapiens
aagaggctagccccaggg

SEQ ID NO: 5099650 - DNA, 21 bp, Homo sapiens
aagaggctctggacagcagaa

SEQ ID NO: 5099651 - DNA, 16 bp, Homo sapiens
aagaggctgaaagagg

SEQ ID NO: 5099652 - DNA, 13 bp, Homo sapiens
aagaggctgaggc

SEQ ID NO: 5099653 - DNA, 15 bp, Homo sapiens
aagaggctgaggcct

SEQ ID NO: 5099654 - DNA, 18 bp, Homo sapiens
aagaggctgaggcctgga

SEQ ID NO: 5099655 - DNA, 22 bp, Homo sapiens
aagaggctgaggctggcacagg

SEQ ID NO: 5099656 - DNA, 22 bp, Homo sapiens
aagaggctgcccctctcaccaa

SEQ ID NO: 5099657 - DNA, 12 bp, Homo sapiens
aagaggctgctg

SEQ ID NO: 5099658 - DNA, 17 bp, Homo sapiens
aagaggctggtgctgtg

SEQ ID NO: 5099659 - DNA, 13 bp, Homo sapiens
aagaggctggttt

SEQ ID NO: 5099660 - DNA, 16 bp, Homo sapiens
aagaggctgtgtggcc

SEQ ID NO: 5099661 - DNA, 16 bp, Homo sapiens
aagagggaaaaagagc

SEQ ID NO: 5099662 - DNA, 14 bp, Homo sapiens
aagagggaaaacag

SEQ ID NO: 5099663 - DNA, 19 bp, Homo sapiens
aagagggaaaacagaaaac

SEQ ID NO: 5099664 - DNA, 18 bp, Homo sapiens
aagagggaaactctggag

SEQ ID NO: 5099665 - DNA, 14 bp, Homo sapiens
aagagggacagagc

SEQ ID NO: 5099666 - DNA, 14 bp, Homo sapiens
aagagggacaggct

SEQ ID NO: 5099667 - DNA, 20 bp, Homo sapiens
aagagggacataagataaaa

SEQ ID NO: 5099668 - DNA, 23 bp, Homo sapiens
aagagggacataagataaaatga

SEQ ID NO: 5099669 - DNA, 12 bp, Homo sapiens
aagagggactgt

SEQ ID NO: 5099670 - DNA, 23 bp, Homo sapiens
aagagggactgtatttctgtgga

SEQ ID NO: 5099671 - DNA, 15 bp, Homo sapiens
aagagggagacagag

SEQ ID NO: 5099672 - DNA, 16 bp, Homo sapiens
aagagggagacagaga

SEQ ID NO: 5099673 - DNA, 15 bp, Homo sapiens
aagagggagaggagg

SEQ ID NO: 5099674 - DNA, 18 bp, Homo sapiens
aagagggagatggagact

SEQ ID NO: 5099675 - DNA, 21 bp, Homo sapiens
aagagggagggagggctccag

SEQ ID NO: 5099676 - DNA, 18 bp, Homo sapiens
aagagggagttggctgga

SEQ ID NO: 5099677 - DNA, 19 bp, Homo sapiens
aagagggagttggctggat

SEQ ID NO: 5099678 - DNA, 15 bp, Homo sapiens
aagagggcaaagctg

SEQ ID NO: 5099679 - DNA, 13 bp, Homo sapiens
aagagggcaagtg

SEQ ID NO: 5099680 - DNA, 16 bp, Homo sapiens
aagagggcacacactg

SEQ ID NO: 5099681 - DNA, 17 bp, Homo sapiens
aagagggcacacactgt

SEQ ID NO: 5099682 - DNA, 20 bp, Homo sapiens
aagagggctttttaaatttg

SEQ ID NO: 5099683 - DNA, 14 bp, Homo sapiens
aagaggggaaaaca

SEQ ID NO: 5099684 - DNA, 13 bp, Homo sapiens
aagaggggcagcc

SEQ ID NO: 5099685 - DNA, 16 bp, Homo sapiens
aagcagaacaaatgtg

SEQ ID NO: 5099686 - DNA, 13 bp, Homo sapiens
aagcagaaccttc

SEQ ID NO: 5099687 - DNA, 21 bp, Homo sapiens
aagcagaactgaagccacttg

SEQ ID NO: 5099688 - DNA, 23 bp, Homo sapiens
aagcagaagacgggaggggaggc

SEQ ID NO: 5099689 - DNA, 14 bp, Homo sapiens
aagcagaagactct

SEQ ID NO: 5099690 - DNA, 12 bp, Homo sapiens
aagcagaataaa

SEQ ID NO: 5099691 - DNA, 15 bp, Homo sapiens
aagcagaataaagca

SEQ ID NO: 5099692 - DNA, 21 bp, Homo sapiens
aagcagaataaagcaattttc

SEQ ID NO: 5099693 - DNA, 22 bp, Homo sapiens
aagcagaataaagcaattttcc

SEQ ID NO: 5099694 - DNA, 11 bp, Homo sapiens
aagcagaatga

SEQ ID NO: 5099695 - DNA, 14 bp, Homo sapiens
aagcagacacacac

SEQ ID NO: 5099696 - DNA, 15 bp, Homo sapiens
aagcagacacacaca

SEQ ID NO: 5099697 - DNA, 18 bp, Homo sapiens
aagcagacacacacatat

SEQ ID NO: 5099698 - DNA, 22 bp, Homo sapiens
aagcagacacacacatatatac

SEQ ID NO: 5099699 - DNA, 20 bp, Homo sapiens
aagcagacagcaagggcttg

SEQ ID NO: 5099700 - DNA, 12 bp, Homo sapiens
aagcagacagct

SEQ ID NO: 5099701 - DNA, 23 bp, Homo sapiens
aagcagaccattggggctcccag

SEQ ID NO: 5099702 - DNA, 17 bp, Homo sapiens
aagcagactcagctgct

SEQ ID NO: 5099703 - DNA, 22 bp, Homo sapiens
aagcagactccagcccctggac

SEQ ID NO: 5099704 - DNA, 19 bp, Homo sapiens
aagcagacttttgtgtaaa

SEQ ID NO: 5099705 - DNA, 16 bp, Homo sapiens
aagcagagaggtggag

SEQ ID NO: 5099706 - DNA, 16 bp, Homo sapiens
aagcagagataaataa

SEQ ID NO: 5099707 - DNA, 14 bp, Homo sapiens
aagcagagcaaaat

SEQ ID NO: 5099708 - DNA, 15 bp, Homo sapiens
aagcagagcattttt

SEQ ID NO: 5099709 - DNA, 11 bp, Homo sapiens
aagcagagcca

SEQ ID NO: 5099710 - DNA, 12 bp, Homo sapiens
aagcagagccaa

SEQ ID NO: 5099711 - DNA, 15 bp, Homo sapiens
aagcagagccaaggc

SEQ ID NO: 5099712 - DNA, 16 bp, Homo sapiens
aagcagagccaaggcc

SEQ ID NO: 5099713 - DNA, 19 bp, Homo sapiens
aagcagagccaaggccacc

SEQ ID NO: 5099714 - DNA, 14 bp, Homo sapiens
aagcagaggaagga

SEQ ID NO: 5099715 - DNA, 15 bp, Homo sapiens
aagcagaggaccagg

SEQ ID NO: 5099716 - DNA, 19 bp, Homo sapiens
aagcagaggaccagggcct

SEQ ID NO: 5099717 - DNA, 14 bp, Homo sapiens
aagcagaggagggg

SEQ ID NO: 5099718 - DNA, 16 bp, Homo sapiens
aagcagaggccctgcc

SEQ ID NO: 5099719 - DNA, 19 bp, Homo sapiens
aagcagaggccctgccccc

SEQ ID NO: 5099720 - DNA, 21 bp, Homo sapiens
aagcagaggccctgcccccac

SEQ ID NO: 5099721 - DNA, 19 bp, Homo sapiens
aagcagaggtggaaaatga

SEQ ID NO: 5099722 - DNA, 22 bp, Homo sapiens
aagcagagtcaagctgatgaag

SEQ ID NO: 5099723 - DNA, 17 bp, Homo sapiens
aagcagagtgaaattca

SEQ ID NO: 5099724 - DNA, 18 bp, Homo sapiens
aagcagagtgcacagctg

SEQ ID NO: 5099725 - DNA, 15 bp, Homo sapiens
aagcagagttctttg

SEQ ID NO: 5099726 - DNA, 23 bp, Homo sapiens
aagcagataccttgcaaagcaac

SEQ ID NO: 5099727 - DNA, 12 bp, Homo sapiens
aagcagatcatc

SEQ ID NO: 5099728 - DNA, 11 bp, Homo sapiens
aagcagatgac

SEQ ID NO: 5099729 - DNA, 17 bp, Homo sapiens
aagcagatggaatgctg

SEQ ID NO: 5099730 - DNA, 19 bp, Homo sapiens
aagcagatggaatgctgtg

SEQ ID NO: 5099731 - DNA, 19 bp, Homo sapiens
aagcagatggacttgaaaa

SEQ ID NO: 5099732 - DNA, 16 bp, Homo sapiens
aagcagattacaataa

SEQ ID NO: 5099733 - DNA, 17 bp, Homo sapiens
aagcagattacaataaa

SEQ ID NO: 5099734 - DNA, 23 bp, Homo sapiens
aagcagattccctgttggattta

SEQ ID NO: 5099735 - DNA, 17 bp, Homo sapiens
aagcagattttcctaag

SEQ ID NO: 5099736 - DNA, 19 bp, Homo sapiens
aagcagcaaataaacaact

SEQ ID NO: 5099737 - DNA, 12 bp, Homo sapiens
aagcagcaacag

SEQ ID NO: 5099738 - DNA, 14 bp, Homo sapiens
aagcagcaactatt

SEQ ID NO: 5099739 - DNA, 16 bp, Homo sapiens
aagcagcacttataaa

SEQ ID NO: 5099740 - DNA, 21 bp, Homo sapiens
aagcagcagcctcgcccctgg

SEQ ID NO: 5099741 - DNA, 22 bp, Homo sapiens
aagcagcagctagaaagagaaa

SEQ ID NO: 5099742 - DNA, 18 bp, Homo sapiens
aagcagcaggcctctggt

SEQ ID NO: 5099743 - DNA, 15 bp, Homo sapiens
aagcagcatggaaaa

SEQ ID NO: 5099744 - DNA, 17 bp, Homo sapiens
aagcagcatggaaaaat

SEQ ID NO: 5099745 - DNA, 10 bp, Homo sapiens
aagcagccag

SEQ ID NO: 5099746 - DNA, 16 bp, Homo sapiens
aagcagccaggaggga

SEQ ID NO: 5099747 - DNA, 17 bp, Homo sapiens
aagcagccaggagggac

SEQ ID NO: 5099748 - DNA, 19 bp, Homo sapiens
aagcagccaggagggacct

SEQ ID NO: 5099749 - DNA, 22 bp, Homo sapiens
aagcagcccttgctttcggagc

SEQ ID NO: 5099750 - DNA, 17 bp, Homo sapiens
aagcagcctcagagtgg

SEQ ID NO: 5099751 - DNA, 13 bp, Homo sapiens
aagcagcctcatt

SEQ ID NO: 5099752 - DNA, 18 bp, Homo sapiens
aagcagcctcattctgag

SEQ ID NO: 5099753 - DNA, 15 bp, Homo sapiens
aagcagcctggagac

SEQ ID NO: 5099754 - DNA, 13 bp, Homo sapiens
aagcagcgggcta

SEQ ID NO: 5099755 - DNA, 20 bp, Homo sapiens
aagcagcgggctaacgggag

SEQ ID NO: 5099756 - DNA, 17 bp, Homo sapiens
aagcagcgtttctatga

SEQ ID NO: 5099757 - DNA, 20 bp, Homo sapiens
aagcagcgtttctatgacac

SEQ ID NO: 5099758 - DNA, 22 bp, Homo sapiens
aagcagcgtttctatgacacat

SEQ ID NO: 5099759 - DNA, 16 bp, Homo sapiens
aagcagctaaattttc

SEQ ID NO: 5099760 - DNA, 18 bp, Homo sapiens
aagcagctcaaaggcaca

SEQ ID NO: 5099761 - DNA, 22 bp, Homo sapiens
aagcagctctaaaacatagact

SEQ ID NO: 5099762 - DNA, 13 bp, Homo sapiens
aagcagctctgcc

SEQ ID NO: 5099763 - DNA, 17 bp, Homo sapiens
aagcagctctgccttct

SEQ ID NO: 5099764 - DNA, 11 bp, Homo sapiens
aagcagctctt

SEQ ID NO: 5099765 - DNA, 17 bp, Homo sapiens
aagcagctcttgctaat

SEQ ID NO: 5099766 - DNA, 16 bp, Homo sapiens
aagcagctgaagaaaa

SEQ ID NO: 5099767 - DNA, 19 bp, Homo sapiens
aagcagctggtcttttctc

SEQ ID NO: 5099768 - DNA, 17 bp, Homo sapiens
aagcagctttaaacaaa

SEQ ID NO: 5099769 - DNA, 22 bp, Homo sapiens
aagcaggaaaaaaggaatattt

SEQ ID NO: 5099770 - DNA, 18 bp, Homo sapiens
aagcaggaaaaacaaatg

SEQ ID NO: 5099771 - DNA, 22 bp, Homo sapiens
aagcaggaaataccaactgaag

SEQ ID NO: 5099772 - DNA, 17 bp, Homo sapiens
aagcaggaaggatggca

SEQ ID NO: 5099773 - DNA, 23 bp, Homo sapiens
aagcaggaaggtctcatgcctga

SEQ ID NO: 5099774 - DNA, 14 bp, Homo sapiens
aagcaggaattatg

SEQ ID NO: 5099775 - DNA, 13 bp, Homo sapiens
aagcaggacctgg

SEQ ID NO: 5099776 - DNA, 16 bp, Homo sapiens
aagcaggactgtgcct

SEQ ID NO: 5099777 - DNA, 19 bp, Homo sapiens
aagcaggactgtgcctcca

SEQ ID NO: 5099778 - DNA, 15 bp, Homo sapiens
aagcaggagcagctg

SEQ ID NO: 5099779 - DNA, 16 bp, Homo sapiens
aagcaggagcagctgt

SEQ ID NO: 5099780 - DNA, 12 bp, Homo sapiens
aagcaggcagag

SEQ ID NO: 5099781 - DNA, 23 bp, Homo sapiens
aagcaggcaggcagcctgagagc

SEQ ID NO: 5099782 - DNA, 13 bp, Homo sapiens
aagcaggccactt

SEQ ID NO: 5099783 - DNA, 18 bp, Homo sapiens
aagcaggcgctgtgctat

SEQ ID NO: 5099784 - DNA, 22 bp, Homo sapiens
aagcaggctacactgacactgg

SEQ ID NO: 5099785 - DNA, 17 bp, Homo sapiens
aagcaggctcaacataa

SEQ ID NO: 5099786 - DNA, 14 bp, Homo sapiens
aagcaggctggttt

SEQ ID NO: 5099787 - DNA, 19 bp, Homo sapiens
aagcagggaaacagggagg

SEQ ID NO: 5099788 - DNA, 17 bp, Homo sapiens
aagcagggacacccccc

SEQ ID NO: 5099789 - DNA, 15 bp, Homo sapiens
aagcagggcagcagg

SEQ ID NO: 5099790 - DNA, 22 bp, Homo sapiens
aagcagggctatatttcagtga

SEQ ID NO: 5099791 - DNA, 14 bp, Homo sapiens
aagcagggtaccct

SEQ ID NO: 5099792 - DNA, 19 bp, Homo sapiens
aagcaggtggatctatttc

SEQ ID NO: 5099793 - DNA, 23 bp, Homo sapiens
aagcaggtgtcctttcccctctc

SEQ ID NO: 5099794 - DNA, 14 bp, Homo sapiens
aagcaggttgataa

SEQ ID NO: 5099795 - DNA, 19 bp, Homo sapiens
aagcaggttgataaatcat

SEQ ID NO: 5099796 - DNA, 16 bp, Homo sapiens
aagcaggtttcaagga

SEQ ID NO: 5099797 - DNA, 14 bp, Homo sapiens
aagcaggtttgttt

SEQ ID NO: 5099798 - DNA, 17 bp, Homo sapiens
aagcagtaaatttgcta

SEQ ID NO: 5099799 - DNA, 13 bp, Homo sapiens
aagcagtaataat

SEQ ID NO: 5099800 - DNA, 16 bp, Homo sapiens
aagcagtacatcttgt

SEQ ID NO: 5099801 - DNA, 23 bp, Homo sapiens
aagcagtacatcttgtgcatgca

SEQ ID NO: 5099802 - DNA, 21 bp, Homo sapiens
aagcagtagaaataatatgca

SEQ ID NO: 5099803 - DNA, 22 bp, Homo sapiens
aagcagtagaaataatatgcat

SEQ ID NO: 5099804 - DNA, 12 bp, Homo sapiens
aagcagtatata

SEQ ID NO: 5099805 - DNA, 17 bp, Homo sapiens
aagcagtatataataac

SEQ ID NO: 5099806 - DNA, 18 bp, Homo sapiens
aagcagtatataataact

SEQ ID NO: 5099807 - DNA, 21 bp, Homo sapiens
aagcagtatataataacttta

SEQ ID NO: 5099808 - DNA, 13 bp, Homo sapiens
aagcagtattttg

SEQ ID NO: 5099809 - DNA, 15 bp, Homo sapiens
aagcagtattttggt

SEQ ID NO: 5099810 - DNA, 13 bp, Homo sapiens
aagcagtcataag

SEQ ID NO: 5099811 - DNA, 15 bp, Homo sapiens
aagcagtcccattca

SEQ ID NO: 5099812 - DNA, 23 bp, Homo sapiens
aagcagtcctcccaccttggcct

SEQ ID NO: 5099813 - DNA, 19 bp, Homo sapiens
aagcagtcgtgcctgtgtc

SEQ ID NO: 5099814 - DNA, 19 bp, Homo sapiens
aagcagtctacccacctca

SEQ ID NO: 5099815 - DNA, 19 bp, Homo sapiens
aagcagtctaccctgtcct

SEQ ID NO: 5099816 - DNA, 20 bp, Homo sapiens
aagcagtgaagcaatttcag

SEQ ID NO: 5099817 - DNA, 16 bp, Homo sapiens
aagcagtgcccaggtg

SEQ ID NO: 5099818 - DNA, 18 bp, Homo sapiens
aagcagtgcccaggtggc

SEQ ID NO: 5099819 - DNA, 20 bp, Homo sapiens
aagcagtgcctcgaggcacc

SEQ ID NO: 5099820 - DNA, 21 bp, Homo sapiens
aagcagtgcctcgaggcaccg

SEQ ID NO: 5099821 - DNA, 15 bp, Homo sapiens
aagcagtgccttcca

SEQ ID NO: 5099822 - DNA, 18 bp, Homo sapiens
aagcagtgccttccataa

SEQ ID NO: 5099823 - DNA, 18 bp, Homo sapiens
aagcagtgcttgtaaacc

SEQ ID NO: 5099824 - DNA, 18 bp, Homo sapiens
aagcagtggagcccagga

SEQ ID NO: 5099825 - DNA, 23 bp, Homo sapiens
aagcagtgtcgccgtccctctgc

SEQ ID NO: 5099826 - DNA, 17 bp, Homo sapiens
aagcagtgtctgtcagc

SEQ ID NO: 5099827 - DNA, 15 bp, Homo sapiens
aagcagtgtgtcctt

SEQ ID NO: 5099828 - DNA, 22 bp, Homo sapiens
aagcagtgtgtccttggggcac

SEQ ID NO: 5099829 - DNA, 15 bp, Homo sapiens
aagcagtgtttctac

SEQ ID NO: 5099830 - DNA, 22 bp, Homo sapiens
aagcagttatggtgatgactta

SEQ ID NO: 5099831 - DNA, 23 bp, Homo sapiens
aagcagttcatgtctgaaacaga

SEQ ID NO: 5099832 - DNA, 15 bp, Homo sapiens
aagcagttctcacaa

SEQ ID NO: 5099833 - DNA, 14 bp, Homo sapiens
aagcagttctgatg

SEQ ID NO: 5099834 - DNA, 22 bp, Homo sapiens
aagcagttgaaatgaggcatga

SEQ ID NO: 5099835 - DNA, 19 bp, Homo sapiens
aagcagttgagattctcta

SEQ ID NO: 5099836 - DNA, 21 bp, Homo sapiens
aagcagttgcaatgatcagac

SEQ ID NO: 5099837 - DNA, 19 bp, Homo sapiens
aagcagttggggccctctt

SEQ ID NO: 5099838 - DNA, 20 bp, Homo sapiens
aagcagttggggccctcttg

SEQ ID NO: 5099839 - DNA, 17 bp, Homo sapiens
aagcagtttcagataaa

SEQ ID NO: 5099840 - DNA, 16 bp, Homo sapiens
aagcagtttttccccc

SEQ ID NO: 5099841 - DNA, 16 bp, Homo sapiens
aagcagtttttgaaag

SEQ ID NO: 5099842 - DNA, 22 bp, Homo sapiens
aagcataaaaacattttaaaaa

SEQ ID NO: 5099843 - DNA, 15 bp, Homo sapiens
aagcataaaaattga

SEQ ID NO: 5099844 - DNA, 23 bp, Homo sapiens
aagcataaaagatgaaagagcag

SEQ ID NO: 5099845 - DNA, 20 bp, Homo sapiens
aagcataaagcaattgtgaa

SEQ ID NO: 5099846 - DNA, 13 bp, Homo sapiens
aagcataaatcac

SEQ ID NO: 5099847 - DNA, 14 bp, Homo sapiens
aagcataaatcact

SEQ ID NO: 5099848 - DNA, 15 bp, Homo sapiens
aagcataatttgttt

SEQ ID NO: 5099849 - DNA, 21 bp, Homo sapiens
aagcataatttgtttaaaatt

SEQ ID NO: 5099850 - DNA, 22 bp, Homo sapiens
aagcatagataatattgtttgg

SEQ ID NO: 5099851 - DNA, 18 bp, Homo sapiens
aagcatagctacaatttg

SEQ ID NO: 5099852 - DNA, 21 bp, Homo sapiens
aagcatagctacaatttgttt

SEQ ID NO: 5099853 - DNA, 17 bp, Homo sapiens
aagcatataaaatggca

SEQ ID NO: 5099854 - DNA, 15 bp, Homo sapiens
aagcatatataaaac

SEQ ID NO: 5099855 - DNA, 21 bp, Homo sapiens
aagcatatcgtaaagctgttc

SEQ ID NO: 5099856 - DNA, 17 bp, Homo sapiens
aagcatatgcagccaac

SEQ ID NO: 5099857 - DNA, 13 bp, Homo sapiens
aagcatattgact

SEQ ID NO: 5099858 - DNA, 18 bp, Homo sapiens
aagcatattgtaccccct

SEQ ID NO: 5099859 - DNA, 15 bp, Homo sapiens
aagcatcaaactctt

SEQ ID NO: 5099860 - DNA, 17 bp, Homo sapiens
aagcatcaaataataca

SEQ ID NO: 5099861 - DNA, 14 bp, Homo sapiens
aagcatcacaaatg

SEQ ID NO: 5099862 - DNA, 18 bp, Homo sapiens
aagcatcacctcaggcca

SEQ ID NO: 5099863 - DNA, 13 bp, Homo sapiens
aagcatcactgcc

SEQ ID NO: 5099864 - DNA, 14 bp, Homo sapiens
aagaggggcatact

SEQ ID NO: 5099865 - DNA, 14 bp, Homo sapiens
aagaggggccgctg

SEQ ID NO: 5099866 - DNA, 17 bp, Homo sapiens
aagaggggcgggctcag

SEQ ID NO: 5099867 - DNA, 18 bp, Homo sapiens
aagaggggcgggctcaga

SEQ ID NO: 5099868 - DNA, 15 bp, Homo sapiens
aagaggggctggggc

SEQ ID NO: 5099869 - DNA, 17 bp, Homo sapiens
aagagggggctctgccc

SEQ ID NO: 5099870 - DNA, 19 bp, Homo sapiens
aagaggggtataggacaag

SEQ ID NO: 5099871 - DNA, 19 bp, Homo sapiens
aagaggggtgcagaggctg

SEQ ID NO: 5099872 - DNA, 22 bp, Homo sapiens
aagagggtctgaggaatccaga

SEQ ID NO: 5099873 - DNA, 13 bp, Homo sapiens
aagagggtgaggg

SEQ ID NO: 5099874 - DNA, 23 bp, Homo sapiens
aagagggttttaggtagaaaaac

SEQ ID NO: 5099875 - DNA, 20 bp, Homo sapiens
aagaggtaactgaggtaaaa

SEQ ID NO: 5099876 - DNA, 20 bp, Homo sapiens
aagaggtaccaaaaaagaaa

SEQ ID NO: 5099877 - DNA, 21 bp, Homo sapiens
aagaggtatttatctttactt

SEQ ID NO: 5099878 - DNA, 15 bp, Homo sapiens
aagaggtccattaat

SEQ ID NO: 5099879 - DNA, 17 bp, Homo sapiens
aagaggtctccccatcc

SEQ ID NO: 5099880 - DNA, 18 bp, Homo sapiens
aagaggtctccccatccc

SEQ ID NO: 5099881 - DNA, 15 bp, Homo sapiens
aagaggtctgagccc

SEQ ID NO: 5099882 - DNA, 20 bp, Homo sapiens
aagaggtgaagtttatattt

SEQ ID NO: 5099883 - DNA, 17 bp, Homo sapiens
aagaggtgaccccaggg

SEQ ID NO: 5099884 - DNA, 18 bp, Homo sapiens
aagaggtgaccccagggc

SEQ ID NO: 5099885 - DNA, 19 bp, Homo sapiens
aagaggtgaccccagggca

SEQ ID NO: 5099886 - DNA, 18 bp, Homo sapiens
aagaggtgcctgggagga

SEQ ID NO: 5099887 - DNA, 21 bp, Homo sapiens
aagaggtgggtggtgggcttc

SEQ ID NO: 5099888 - DNA, 18 bp, Homo sapiens
aagaggttggagcaacaa

SEQ ID NO: 5099889 - DNA, 21 bp, Homo sapiens
aagaggtttggctcctgccca

SEQ ID NO: 5099890 - DNA, 12 bp, Homo sapiens
aagaggttttat

SEQ ID NO: 5099891 - DNA, 18 bp, Homo sapiens
aagagtaaaaccaaaggt

SEQ ID NO: 5099892 - DNA, 14 bp, Homo sapiens
aagagtaaagcaac

SEQ ID NO: 5099893 - DNA, 13 bp, Homo sapiens
aagagtaaatata

SEQ ID NO: 5099894 - DNA, 17 bp, Homo sapiens
aagagtaacacttgaaa

SEQ ID NO: 5099895 - DNA, 14 bp, Homo sapiens
aagagtaactttac

SEQ ID NO: 5099896 - DNA, 21 bp, Homo sapiens
aagagtaagggtaaaaaagat

SEQ ID NO: 5099897 - DNA, 22 bp, Homo sapiens
aagagtaagggtaaaaaagata

SEQ ID NO: 5099898 - DNA, 19 bp, Homo sapiens
aagagtactgggagaatca

SEQ ID NO: 5099899 - DNA, 21 bp, Homo sapiens
aagagtagaaaaggattgctt

SEQ ID NO: 5099900 - DNA, 13 bp, Homo sapiens
aagagtagaaact

SEQ ID NO: 5099901 - DNA, 19 bp, Homo sapiens
aagagtagaaagcttgaaa

SEQ ID NO: 5099902 - DNA, 17 bp, Homo sapiens
aagagtagaacccaggt

SEQ ID NO: 5099903 - DNA, 14 bp, Homo sapiens
aagagtagcatttc

SEQ ID NO: 5099904 - DNA, 17 bp, Homo sapiens
aagagtagcatttcatt

SEQ ID NO: 5099905 - DNA, 19 bp, Homo sapiens
aagagtagcatttcattct

SEQ ID NO: 5099906 - DNA, 13 bp, Homo sapiens
aagagtaggaaga

SEQ ID NO: 5099907 - DNA, 23 bp, Homo sapiens
aagagtagttgatgttgcatttt

SEQ ID NO: 5099908 - DNA, 17 bp, Homo sapiens
aagagtatccttccttc

SEQ ID NO: 5099909 - DNA, 18 bp, Homo sapiens
aagagtatccttccttca

SEQ ID NO: 5099910 - DNA, 20 bp, Homo sapiens
aagagtatgtggcaaaacat

SEQ ID NO: 5099911 - DNA, 15 bp, Homo sapiens
aagagtattaatgta

SEQ ID NO: 5099912 - DNA, 19 bp, Homo sapiens
aagagtatttttgacagaa

SEQ ID NO: 5099913 - DNA, 13 bp, Homo sapiens
aagagtcagacat

SEQ ID NO: 5099914 - DNA, 14 bp, Homo sapiens
aagagtcagacatt

SEQ ID NO: 5099915 - DNA, 19 bp, Homo sapiens
aagagtcagacatttcttt

SEQ ID NO: 5099916 - DNA, 13 bp, Homo sapiens
aagagtcattttc

SEQ ID NO: 5099917 - DNA, 21 bp, Homo sapiens
aagagtccattgtttaaaaat

SEQ ID NO: 5099918 - DNA, 20 bp, Homo sapiens
aagagtcctccttcccagct

SEQ ID NO: 5099919 - DNA, 20 bp, Homo sapiens
aagagtcctgaggcagaacc

SEQ ID NO: 5099920 - DNA, 23 bp, Homo sapiens
aagagtccttttgaattaaactc

SEQ ID NO: 5099921 - DNA, 21 bp, Homo sapiens
aagagtctacccgacataagt

SEQ ID NO: 5099922 - DNA, 23 bp, Homo sapiens
aagagtctagattcaaaggttct

SEQ ID NO: 5099923 - DNA, 15 bp, Homo sapiens
aagagtctattgtct

SEQ ID NO: 5099924 - DNA, 16 bp, Homo sapiens
aagagtctctccagcc

SEQ ID NO: 5099925 - DNA, 15 bp, Homo sapiens
aagagtctctggctc

SEQ ID NO: 5099926 - DNA, 20 bp, Homo sapiens
aagagtcttaattttctaaa

SEQ ID NO: 5099927 - DNA, 22 bp, Homo sapiens
aagagtgaaataccattattat

SEQ ID NO: 5099928 - DNA, 16 bp, Homo sapiens
aagagtgaatgtgtac

SEQ ID NO: 5099929 - DNA, 18 bp, Homo sapiens
aagagtgaattccctcac

SEQ ID NO: 5099930 - DNA, 19 bp, Homo sapiens
aagagtgactctccagggg

SEQ ID NO: 5099931 - DNA, 16 bp, Homo sapiens
aagagtgacttatttt

SEQ ID NO: 5099932 - DNA, 16 bp, Homo sapiens
aagagtgattcttgct

SEQ ID NO: 5099933 - DNA, 14 bp, Homo sapiens
aagagtgattgcag

SEQ ID NO: 5099934 - DNA, 17 bp, Homo sapiens
aagagtgcaaaacattg

SEQ ID NO: 5099935 - DNA, 18 bp, Homo sapiens
aagagtgcaaaacattga

SEQ ID NO: 5099936 - DNA, 14 bp, Homo sapiens
aagagtgcattttc

SEQ ID NO: 5099937 - DNA, 13 bp, Homo sapiens
aagagtgccctgc

SEQ ID NO: 5099938 - DNA, 17 bp, Homo sapiens
aagagtgccctgctttg

SEQ ID NO: 5099939 - DNA, 23 bp, Homo sapiens
aagagtgctaagcattagcttta

SEQ ID NO: 5099940 - DNA, 15 bp, Homo sapiens
aagagtggaaatggg

SEQ ID NO: 5099941 - DNA, 20 bp, Homo sapiens
aagagtggagagaagctctt

SEQ ID NO: 5099942 - DNA, 12 bp, Homo sapiens
aagagtggagga

SEQ ID NO: 5099943 - DNA, 15 bp, Homo sapiens
aagagtggaggagga

SEQ ID NO: 5099944 - DNA, 16 bp, Homo sapiens
aagagtggaggaggag

SEQ ID NO: 5099945 - DNA, 15 bp, Homo sapiens
aagagtggaggtgga

SEQ ID NO: 5099946 - DNA, 21 bp, Homo sapiens
aagagtggccccacctggccc

SEQ ID NO: 5099947 - DNA, 17 bp, Homo sapiens
aagagtgggctttccag

SEQ ID NO: 5099948 - DNA, 22 bp, Homo sapiens
aagagtgggctttccagggtct

SEQ ID NO: 5099949 - DNA, 20 bp, Homo sapiens
aagagtgggggagagcaggc

SEQ ID NO: 5099950 - DNA, 17 bp, Homo sapiens
aagagtggtatatacaa

SEQ ID NO: 5099951 - DNA, 13 bp, Homo sapiens
aagagtgtaacat

SEQ ID NO: 5099952 - DNA, 13 bp, Homo sapiens
aagagtgtagaag

SEQ ID NO: 5099953 - DNA, 19 bp, Homo sapiens
aagagtgtcagaatcagaa

SEQ ID NO: 5099954 - DNA, 23 bp, Homo sapiens
aagagtgtcctaggagtatcctc

SEQ ID NO: 5099955 - DNA, 13 bp, Homo sapiens
aagagtgtctatg

SEQ ID NO: 5099956 - DNA, 16 bp, Homo sapiens
aagagtgtgaaatctc

SEQ ID NO: 5099957 - DNA, 20 bp, Homo sapiens
aagagtgtgagagagactga

SEQ ID NO: 5099958 - DNA, 23 bp, Homo sapiens
aagagtgtggagtcattctcatt

SEQ ID NO: 5099959 - DNA, 19 bp, Homo sapiens
aagagttaagatatcccta

SEQ ID NO: 5099960 - DNA, 15 bp, Homo sapiens
aagagttacaataaa

SEQ ID NO: 5099961 - DNA, 21 bp, Homo sapiens
aagagttacaataaagtttac

SEQ ID NO: 5099962 - DNA, 19 bp, Homo sapiens
aagagttattcaaatgaag

SEQ ID NO: 5099963 - DNA, 21 bp, Homo sapiens
aagagttctatccccaagctg

SEQ ID NO: 5099964 - DNA, 22 bp, Homo sapiens
aagagttgccccgtctctgttc

SEQ ID NO: 5099965 - DNA, 17 bp, Homo sapiens
aagagttgtgcacgcag

SEQ ID NO: 5099966 - DNA, 19 bp, Homo sapiens
aagagttgtgttgttcttt

SEQ ID NO: 5099967 - DNA, 22 bp, Homo sapiens
aagagttgtgttgttcttttcc

SEQ ID NO: 5099968 - DNA, 14 bp, Homo sapiens
aagagtttaaaagc

SEQ ID NO: 5099969 - DNA, 15 bp, Homo sapiens
aagagtttaaacaaa

SEQ ID NO: 5099970 - DNA, 15 bp, Homo sapiens
aagagtttaaagaga

SEQ ID NO: 5099971 - DNA, 21 bp, Homo sapiens
aagagtttaactttgggccca

SEQ ID NO: 5099972 - DNA, 18 bp, Homo sapiens
aagagtttcagtttgttg

SEQ ID NO: 5099973 - DNA, 19 bp, Homo sapiens
aagagtttcttaacttact

SEQ ID NO: 5099974 - DNA, 23 bp, Homo sapiens
aagagttttagagaaaataaatt

SEQ ID NO: 5099975 - DNA, 23 bp, Homo sapiens
aagagttttgggagttgtagtta

SEQ ID NO: 5099976 - DNA, 16 bp, Homo sapiens
aagagtttttttctgt

SEQ ID NO: 5099977 - DNA, 22 bp, Homo sapiens
aagataaaaataataataaagt

SEQ ID NO: 5099978 - DNA, 14 bp, Homo sapiens
aagataaaaatcag

SEQ ID NO: 5099979 - DNA, 15 bp, Homo sapiens
aagataaaaggatag

SEQ ID NO: 5099980 - DNA, 20 bp, Homo sapiens
aagataaaatgatgttatac

SEQ ID NO: 5099981 - DNA, 18 bp, Homo sapiens
aagataaagaccagaaat

SEQ ID NO: 5099982 - DNA, 11 bp, Homo sapiens
aagataaatgc

SEQ ID NO: 5099983 - DNA, 12 bp, Homo sapiens
aagataaatgct

SEQ ID NO: 5099984 - DNA, 14 bp, Homo sapiens
aagataaatgcttt

SEQ ID NO: 5099985 - DNA, 16 bp, Homo sapiens
aagataaatgctttaa

SEQ ID NO: 5099986 - DNA, 21 bp, Homo sapiens
aagataaatgctttaaatagt

SEQ ID NO: 5099987 - DNA, 15 bp, Homo sapiens
aagataaatgggttt

SEQ ID NO: 5099988 - DNA, 13 bp, Homo sapiens
aagataaatgtgc

SEQ ID NO: 5099989 - DNA, 12 bp, Homo sapiens
aagataaattga

SEQ ID NO: 5099990 - DNA, 19 bp, Homo sapiens
aagataacccttattccat

SEQ ID NO: 5099991 - DNA, 14 bp, Homo sapiens
aagataacttactg

SEQ ID NO: 5099992 - DNA, 19 bp, Homo sapiens
aagataacttactgtatat

SEQ ID NO: 5099993 - DNA, 19 bp, Homo sapiens
aagataagaaatgatcttt

SEQ ID NO: 5099994 - DNA, 15 bp, Homo sapiens
aagataagcctgagc

SEQ ID NO: 5099995 - DNA, 16 bp, Homo sapiens
aagataagcctgagcc

SEQ ID NO: 5099996 - DNA, 20 bp, Homo sapiens
aagataagttggaaacacta

SEQ ID NO: 5099997 - DNA, 14 bp, Homo sapiens
aagataatatttaa

SEQ ID NO: 5099998 - DNA, 18 bp, Homo sapiens
aagataatcctagagtct

SEQ ID NO: 5099999 - DNA, 22 bp, Homo sapiens
aagataatggataatcttcggc

SEQ ID NO: 5100000 - DNA, 23 bp, Homo sapiens
aagataatgttctttaatgttgt

SEQ ID NO: 5100001 - DNA, 21 bp, Homo sapiens
aagataattaaatgaaatact

SEQ ID NO: 5100002 - DNA, 21 bp, Homo sapiens
aagataattgctatttatttt

SEQ ID NO: 5100003 - DNA, 15 bp, Homo sapiens
aagataattgtactt

SEQ ID NO: 5100004 - DNA, 22 bp, Homo sapiens
aagataattgtactttgaaaac

SEQ ID NO: 5100005 - DNA, 15 bp, Homo sapiens
aagataatttgcata

SEQ ID NO: 5100006 - DNA, 18 bp, Homo sapiens
aagatacaaaagcttttt

SEQ ID NO: 5100007 - DNA, 15 bp, Homo sapiens
aagatacaagtttca

SEQ ID NO: 5100008 - DNA, 14 bp, Homo sapiens
aagatacacagctc

SEQ ID NO: 5100009 - DNA, 21 bp, Homo sapiens
aagatacacattacagccagg

SEQ ID NO: 5100010 - DNA, 16 bp, Homo sapiens
aagatacactgcactt

SEQ ID NO: 5100011 - DNA, 16 bp, Homo sapiens
aagatacactgcagct

SEQ ID NO: 5100012 - DNA, 22 bp, Homo sapiens
aagatacagaactctttcaaaa

SEQ ID NO: 5100013 - DNA, 14 bp, Homo sapiens
aagatacagacatt

SEQ ID NO: 5100014 - DNA, 22 bp, Homo sapiens
aagatacagacattcaatgaat

SEQ ID NO: 5100015 - DNA, 19 bp, Homo sapiens
aagatacataaaagtgctt

SEQ ID NO: 5100016 - DNA, 20 bp, Homo sapiens
aagatacatagtaaatggta

SEQ ID NO: 5100017 - DNA, 13 bp, Homo sapiens
aagatacatcaca

SEQ ID NO: 5100018 - DNA, 15 bp, Homo sapiens
aagatacatcacagt

SEQ ID NO: 5100019 - DNA, 13 bp, Homo sapiens
aagatacctaaaa

SEQ ID NO: 5100020 - DNA, 19 bp, Homo sapiens
aagataccttaaaatttga

SEQ ID NO: 5100021 - DNA, 20 bp, Homo sapiens
aagataccttaaaatttgaa

SEQ ID NO: 5100022 - DNA, 23 bp, Homo sapiens
aagatacggttgcttcaccttgg

SEQ ID NO: 5100023 - DNA, 20 bp, Homo sapiens
aagatactcacatgagttct

SEQ ID NO: 5100024 - DNA, 17 bp, Homo sapiens
aagatacttaagtgctg

SEQ ID NO: 5100025 - DNA, 16 bp, Homo sapiens
aagatacttgatgcac

SEQ ID NO: 5100026 - DNA, 22 bp, Homo sapiens
aagatacttggaccgagtagag

SEQ ID NO: 5100027 - DNA, 12 bp, Homo sapiens
aagatactttgt

SEQ ID NO: 5100028 - DNA, 13 bp, Homo sapiens
aagatactttgta

SEQ ID NO: 5100029 - DNA, 16 bp, Homo sapiens
aagatagaaagctgga

SEQ ID NO: 5100030 - DNA, 19 bp, Homo sapiens
aagatagaaagctggactg

SEQ ID NO: 5100031 - DNA, 13 bp, Homo sapiens
aagatagaacagg

SEQ ID NO: 5100032 - DNA, 21 bp, Homo sapiens
aagatagaagaaaaaagaatg

SEQ ID NO: 5100033 - DNA, 12 bp, Homo sapiens
aagatagacagg

SEQ ID NO: 5100034 - DNA, 16 bp, Homo sapiens
aagatagatcctttta

SEQ ID NO: 5100035 - DNA, 23 bp, Homo sapiens
aagatagatttggaataggaata

SEQ ID NO: 5100036 - DNA, 14 bp, Homo sapiens
aagatagcagggca

SEQ ID NO: 5100037 - DNA, 15 bp, Homo sapiens
aagatagcagggcat

SEQ ID NO: 5100038 - DNA, 20 bp, Homo sapiens
aagatagcatcccatctcag

SEQ ID NO: 5100039 - DNA, 14 bp, Homo sapiens
aagatagctctctg

SEQ ID NO: 5100040 - DNA, 15 bp, Homo sapiens
aagatagctgtgact

SEQ ID NO: 5100041 - DNA, 17 bp, Homo sapiens
aagatagcttcacccca

SEQ ID NO: 5100042 - DNA, 14 bp, Homo sapiens
aagcatcactgcct

SEQ ID NO: 5100043 - DNA, 15 bp, Homo sapiens
aagcatcactgcctt

SEQ ID NO: 5100044 - DNA, 17 bp, Homo sapiens
aagcatcagcaagacaa

SEQ ID NO: 5100045 - DNA, 18 bp, Homo sapiens
aagcatcatggatcaacc

SEQ ID NO: 5100046 - DNA, 16 bp, Homo sapiens
aagcatcattacaata

SEQ ID NO: 5100047 - DNA, 18 bp, Homo sapiens
aagcatcattatttatgt

SEQ ID NO: 5100048 - DNA, 22 bp, Homo sapiens
aagcatcattatttatgtattg

SEQ ID NO: 5100049 - DNA, 22 bp, Homo sapiens
aagcatcattatttgcagagac

SEQ ID NO: 5100050 - DNA, 12 bp, Homo sapiens
aagcatcattgt

SEQ ID NO: 5100051 - DNA, 17 bp, Homo sapiens
aagcatcattgtaaatt

SEQ ID NO: 5100052 - DNA, 18 bp, Homo sapiens
aagcatcattgtaaatta

SEQ ID NO: 5100053 - DNA, 19 bp, Homo sapiens
aagcatccaaggaacttca

SEQ ID NO: 5100054 - DNA, 14 bp, Homo sapiens
aagcatccatgtgt

SEQ ID NO: 5100055 - DNA, 17 bp, Homo sapiens
aagcatccatgtgtgga

SEQ ID NO: 5100056 - DNA, 19 bp, Homo sapiens
aagcatccatgtgtggact

SEQ ID NO: 5100057 - DNA, 14 bp, Homo sapiens
aagcatccctcacc

SEQ ID NO: 5100058 - DNA, 14 bp, Homo sapiens
aagcatcctccaca

SEQ ID NO: 5100059 - DNA, 21 bp, Homo sapiens
aagcatcctccacatcctgtg

SEQ ID NO: 5100060 - DNA, 21 bp, Homo sapiens
aagcatcctccccaccagagc

SEQ ID NO: 5100061 - DNA, 23 bp, Homo sapiens
aagcatcctttagggttctgcct

SEQ ID NO: 5100062 - DNA, 17 bp, Homo sapiens
aagcatcggtcatgtgt

SEQ ID NO: 5100063 - DNA, 13 bp, Homo sapiens
aagcatctaagtt

SEQ ID NO: 5100064 - DNA, 18 bp, Homo sapiens
aagcatctaagttataag

SEQ ID NO: 5100065 - DNA, 13 bp, Homo sapiens
aagcatctacttc

SEQ ID NO: 5100066 - DNA, 14 bp, Homo sapiens
aagcatctctgacc

SEQ ID NO: 5100067 - DNA, 19 bp, Homo sapiens
aagcatctggctctaattc

SEQ ID NO: 5100068 - DNA, 18 bp, Homo sapiens
aagcatctgtaaatttgg

SEQ ID NO: 5100069 - DNA, 12 bp, Homo sapiens
aagcatgaaatg

SEQ ID NO: 5100070 - DNA, 17 bp, Homo sapiens
aagcatgaaatgtgaat

SEQ ID NO: 5100071 - DNA, 21 bp, Homo sapiens
aagcatgaacgtggattgtat

SEQ ID NO: 5100072 - DNA, 12 bp, Homo sapiens
aagcatgaataa

SEQ ID NO: 5100073 - DNA, 12 bp, Homo sapiens
aagcatgaattg

SEQ ID NO: 5100074 - DNA, 13 bp, Homo sapiens
aagcatgaattgg

SEQ ID NO: 5100075 - DNA, 21 bp, Homo sapiens
aagcatgacaacttttaaaga

SEQ ID NO: 5100076 - DNA, 18 bp, Homo sapiens
aagcatgatgggaaaata

SEQ ID NO: 5100077 - DNA, 23 bp, Homo sapiens
aagcatgcattgaaaaatttcta

SEQ ID NO: 5100078 - DNA, 19 bp, Homo sapiens
aagcatgctttgctgctat

SEQ ID NO: 5100079 - DNA, 20 bp, Homo sapiens
aagcatgctttgctgctatg

SEQ ID NO: 5100080 - DNA, 14 bp, Homo sapiens
aagcatggccctgc

SEQ ID NO: 5100081 - DNA, 18 bp, Homo sapiens
aagcatggccctgctgcc

SEQ ID NO: 5100082 - DNA, 13 bp, Homo sapiens
aagcatggctgtc

SEQ ID NO: 5100083 - DNA, 14 bp, Homo sapiens
aagcatggctgtct

SEQ ID NO: 5100084 - DNA, 23 bp, Homo sapiens
aagcatggcttgaataaggaaat

SEQ ID NO: 5100085 - DNA, 22 bp, Homo sapiens
aagcatgggggaccccttccca

SEQ ID NO: 5100086 - DNA, 15 bp, Homo sapiens
aagcatggtataatt

SEQ ID NO: 5100087 - DNA, 12 bp, Homo sapiens
aagcatgtacag

SEQ ID NO: 5100088 - DNA, 13 bp, Homo sapiens
aagcatgtacagt

SEQ ID NO: 5100089 - DNA, 22 bp, Homo sapiens
aagcatgtacagtgttctgttt

SEQ ID NO: 5100090 - DNA, 16 bp, Homo sapiens
aagcatgtcaattcat

SEQ ID NO: 5100091 - DNA, 17 bp, Homo sapiens
aagcatgtctcaatagt

SEQ ID NO: 5100092 - DNA, 19 bp, Homo sapiens
aagcatgtctctctgccaa

SEQ ID NO: 5100093 - DNA, 18 bp, Homo sapiens
aagcatgtgacacccaca

SEQ ID NO: 5100094 - DNA, 22 bp, Homo sapiens
aagcatgtggaaatgacccaaa

SEQ ID NO: 5100095 - DNA, 23 bp, Homo sapiens
aagcatgtggaaatgacccaaac

SEQ ID NO: 5100096 - DNA, 19 bp, Homo sapiens
aagcatgtggcatgttcat

SEQ ID NO: 5100097 - DNA, 13 bp, Homo sapiens
aagcatgttgtga

SEQ ID NO: 5100098 - DNA, 20 bp, Homo sapiens
aagcatgtttattctgttcc

SEQ ID NO: 5100099 - DNA, 14 bp, Homo sapiens
aagcatgtttcatg

SEQ ID NO: 5100100 - DNA, 16 bp, Homo sapiens
aagcatgtttcatgtt

SEQ ID NO: 5100101 - DNA, 19 bp, Homo sapiens
aagcatgtttcattctctg

SEQ ID NO: 5100102 - DNA, 15 bp, Homo sapiens
aagcatgttttgcat

SEQ ID NO: 5100103 - DNA, 18 bp, Homo sapiens
aagcattacatttccaaa

SEQ ID NO: 5100104 - DNA, 22 bp, Homo sapiens
aagcattactcttgtaagattt

SEQ ID NO: 5100105 - DNA, 18 bp, Homo sapiens
aagcattactttaacctc

SEQ ID NO: 5100106 - DNA, 15 bp, Homo sapiens
aagcattagctttaa

SEQ ID NO: 5100107 - DNA, 16 bp, Homo sapiens
aagcattagctttaat

SEQ ID NO: 5100108 - DNA, 15 bp, Homo sapiens
aagcattcagagagc

SEQ ID NO: 5100109 - DNA, 14 bp, Homo sapiens
aagcattccttctt

SEQ ID NO: 5100110 - DNA, 22 bp, Homo sapiens
aagcattccttctttgataatg

SEQ ID NO: 5100111 - DNA, 23 bp, Homo sapiens
aagcattctcattggaaatttag

SEQ ID NO: 5100112 - DNA, 16 bp, Homo sapiens
aagcattctgagctgg

SEQ ID NO: 5100113 - DNA, 15 bp, Homo sapiens
aagcattctgtttat

SEQ ID NO: 5100114 - DNA, 20 bp, Homo sapiens
aagcattgaaaacaaagaca

SEQ ID NO: 5100115 - DNA, 16 bp, Homo sapiens
aagcattgaatggcta

SEQ ID NO: 5100116 - DNA, 13 bp, Homo sapiens
aagcattgaattc

SEQ ID NO: 5100117 - DNA, 13 bp, Homo sapiens
aagcattgcctgg

SEQ ID NO: 5100118 - DNA, 16 bp, Homo sapiens
aagcattgcctggact

SEQ ID NO: 5100119 - DNA, 18 bp, Homo sapiens
aagcattgcctggactga

SEQ ID NO: 5100120 - DNA, 22 bp, Homo sapiens
aagcattgcctggactgaccac

SEQ ID NO: 5100121 - DNA, 13 bp, Homo sapiens
aagcattgctaaa

SEQ ID NO: 5100122 - DNA, 21 bp, Homo sapiens
aagcattgctgttatgtctgt

SEQ ID NO: 5100123 - DNA, 22 bp, Homo sapiens
aagcattgggtgggtaaattca

SEQ ID NO: 5100124 - DNA, 15 bp, Homo sapiens
aagcattgtaaaata

SEQ ID NO: 5100125 - DNA, 13 bp, Homo sapiens
aagcattgtgagt

SEQ ID NO: 5100126 - DNA, 11 bp, Homo sapiens
aagcattgttt

SEQ ID NO: 5100127 - DNA, 13 bp, Homo sapiens
aagcatttaaaag

SEQ ID NO: 5100128 - DNA, 21 bp, Homo sapiens
aagcatttaacccccctgtac

SEQ ID NO: 5100129 - DNA, 23 bp, Homo sapiens
aagcatttaacccccctgtacac

SEQ ID NO: 5100130 - DNA, 23 bp, Homo sapiens
aagcatttaatgtagccatggga

SEQ ID NO: 5100131 - DNA, 16 bp, Homo sapiens
aagcatttactttgtg

SEQ ID NO: 5100132 - DNA, 16 bp, Homo sapiens
aagcatttagatgtat

SEQ ID NO: 5100133 - DNA, 14 bp, Homo sapiens
aagcatttaggaat

SEQ ID NO: 5100134 - DNA, 19 bp, Homo sapiens
aagcatttatcattcttgt

SEQ ID NO: 5100135 - DNA, 16 bp, Homo sapiens
aagcatttcaaagccc

SEQ ID NO: 5100136 - DNA, 19 bp, Homo sapiens
aagcatttcaaagccctgc

SEQ ID NO: 5100137 - DNA, 19 bp, Homo sapiens
aagcatttcatgaaaaagc

SEQ ID NO: 5100138 - DNA, 17 bp, Homo sapiens
aagcatttccagcctat

SEQ ID NO: 5100139 - DNA, 14 bp, Homo sapiens
aagcatttgaatgc

SEQ ID NO: 5100140 - DNA, 15 bp, Homo sapiens
aagcatttgaatgca

SEQ ID NO: 5100141 - DNA, 16 bp, Homo sapiens
aagcatttgaatgcat

SEQ ID NO: 5100142 - DNA, 20 bp, Homo sapiens
aagcatttggtgcctatttg

SEQ ID NO: 5100143 - DNA, 13 bp, Homo sapiens
aagcatttgtaca

SEQ ID NO: 5100144 - DNA, 13 bp, Homo sapiens
aagcatttgtact

SEQ ID NO: 5100145 - DNA, 16 bp, Homo sapiens
aagcatttgtatatta

SEQ ID NO: 5100146 - DNA, 21 bp, Homo sapiens
aagcatttgtattttgtgtga

SEQ ID NO: 5100147 - DNA, 23 bp, Homo sapiens
aagcatttgtttctactttgata

SEQ ID NO: 5100148 - DNA, 22 bp, Homo sapiens
aagcattttactgtctgtaaga

SEQ ID NO: 5100149 - DNA, 21 bp, Homo sapiens
aagcattttataaatcgcttt

SEQ ID NO: 5100150 - DNA, 17 bp, Homo sapiens
aagcattttcagcatca

SEQ ID NO: 5100151 - DNA, 19 bp, Homo sapiens
aagcattttcgttacattg

SEQ ID NO: 5100152 - DNA, 15 bp, Homo sapiens
aagcattttctcctg

SEQ ID NO: 5100153 - DNA, 15 bp, Homo sapiens
aagcattttctctca

SEQ ID NO: 5100154 - DNA, 20 bp, Homo sapiens
aagcattttctttctgtttt

SEQ ID NO: 5100155 - DNA, 21 bp, Homo sapiens
aagcattttctttctgttttt

SEQ ID NO: 5100156 - DNA, 19 bp, Homo sapiens
aagcattttgaaacaaagt

SEQ ID NO: 5100157 - DNA, 23 bp, Homo sapiens
aagcattttgtaagttgaagcaa

SEQ ID NO: 5100158 - DNA, 22 bp, Homo sapiens
aagcattttttaaaagcatggc

SEQ ID NO: 5100159 - DNA, 13 bp, Homo sapiens
aagcattttttat

SEQ ID NO: 5100160 - DNA, 19 bp, Homo sapiens
aagcattttttataatttt

SEQ ID NO: 5100161 - DNA, 21 bp, Homo sapiens
aagccaaaagtccctccctgc

SEQ ID NO: 5100162 - DNA, 20 bp, Homo sapiens
aagccaaaattaaggtgttt

SEQ ID NO: 5100163 - DNA, 15 bp, Homo sapiens
aagccaaacaagcct

SEQ ID NO: 5100164 - DNA, 18 bp, Homo sapiens
aagccaaacattcttatt

SEQ ID NO: 5100165 - DNA, 19 bp, Homo sapiens
aagccaaacattcttattt

SEQ ID NO: 5100166 - DNA, 19 bp, Homo sapiens
aagccaaactcaggcccag

SEQ ID NO: 5100167 - DNA, 20 bp, Homo sapiens
aagccaaactcaggcccaga

SEQ ID NO: 5100168 - DNA, 21 bp, Homo sapiens
aagccaaactcaggcccagaa

SEQ ID NO: 5100169 - DNA, 15 bp, Homo sapiens
aagccaaagaaacaa

SEQ ID NO: 5100170 - DNA, 19 bp, Homo sapiens
aagccaaagagcctcccac

SEQ ID NO: 5100171 - DNA, 12 bp, Homo sapiens
aagccaaagagt

SEQ ID NO: 5100172 - DNA, 18 bp, Homo sapiens
aagccaaagctaggcctg

SEQ ID NO: 5100173 - DNA, 20 bp, Homo sapiens
aagccaaagctaggcctggc

SEQ ID NO: 5100174 - DNA, 22 bp, Homo sapiens
aagccaaagctaggcctggcca

SEQ ID NO: 5100175 - DNA, 19 bp, Homo sapiens
aagccaaaggtcaaacagg

SEQ ID NO: 5100176 - DNA, 22 bp, Homo sapiens
aagccaaagttttcaaactgct

SEQ ID NO: 5100177 - DNA, 14 bp, Homo sapiens
aagccaaatgaaac

SEQ ID NO: 5100178 - DNA, 15 bp, Homo sapiens
aagccaaatgaaact

SEQ ID NO: 5100179 - DNA, 13 bp, Homo sapiens
aagccaaatttat

SEQ ID NO: 5100180 - DNA, 21 bp, Homo sapiens
aagccaaatttatatgccacc

SEQ ID NO: 5100181 - DNA, 16 bp, Homo sapiens
aagccaaatttatcaa

SEQ ID NO: 5100182 - DNA, 15 bp, Homo sapiens
aagccaaattttttg

SEQ ID NO: 5100183 - DNA, 23 bp, Homo sapiens
aagccaacaggtaaacacataaa

SEQ ID NO: 5100184 - DNA, 13 bp, Homo sapiens
aagccaaccctgg

SEQ ID NO: 5100185 - DNA, 21 bp, Homo sapiens
aagccaaccttcaaagaaact

SEQ ID NO: 5100186 - DNA, 22 bp, Homo sapiens
aagccaaccttcaaagaaactt

SEQ ID NO: 5100187 - DNA, 16 bp, Homo sapiens
aagccaacgacaaagc

SEQ ID NO: 5100188 - DNA, 19 bp, Homo sapiens
aagccaactgacaaagatg

SEQ ID NO: 5100189 - DNA, 22 bp, Homo sapiens
aagccaacttggctttcccgga

SEQ ID NO: 5100190 - DNA, 16 bp, Homo sapiens
aagccaacttgtaaat

SEQ ID NO: 5100191 - DNA, 14 bp, Homo sapiens
aagccaagaaagat

SEQ ID NO: 5100192 - DNA, 16 bp, Homo sapiens
aagccaagaagtgagg

SEQ ID NO: 5100193 - DNA, 11 bp, Homo sapiens
aagccaagaat

SEQ ID NO: 5100194 - DNA, 13 bp, Homo sapiens
aagccaagacagt

SEQ ID NO: 5100195 - DNA, 15 bp, Homo sapiens
aagccaagacctcac

SEQ ID NO: 5100196 - DNA, 13 bp, Homo sapiens
aagccaagaggca

SEQ ID NO: 5100197 - DNA, 20 bp, Homo sapiens
aagccaagcaaaccaatggt

SEQ ID NO: 5100198 - DNA, 17 bp, Homo sapiens
aagccaagccctccgcc

SEQ ID NO: 5100199 - DNA, 17 bp, Homo sapiens
aagccaagctccctgga

SEQ ID NO: 5100200 - DNA, 13 bp, Homo sapiens
aagccaagctgtg

SEQ ID NO: 5100201 - DNA, 24 bp, Homo sapiens
aagccaaggcagcgaccccaggac

SEQ ID NO: 5100202 - DNA, 14 bp, Homo sapiens
aagccaagggaaag

SEQ ID NO: 5100203 - DNA, 19 bp, Homo sapiens
aagccaagggaacctgtgt

SEQ ID NO: 5100204 - DNA, 14 bp, Homo sapiens
aagccaagggcagt

SEQ ID NO: 5100205 - DNA, 16 bp, Homo sapiens
aagccaagggcctctt

SEQ ID NO: 5100206 - DNA, 22 bp, Homo sapiens
aagccaagtcagctttgccttc

SEQ ID NO: 5100207 - DNA, 14 bp, Homo sapiens
aagccaagtgtcct

SEQ ID NO: 5100208 - DNA, 20 bp, Homo sapiens
aagccaataaataatattat

SEQ ID NO: 5100209 - DNA, 20 bp, Homo sapiens
aagccaataacacacagcta

SEQ ID NO: 5100210 - DNA, 19 bp, Homo sapiens
aagccaatctacaatctct

SEQ ID NO: 5100211 - DNA, 14 bp, Homo sapiens
aagccaatttttct

SEQ ID NO: 5100212 - DNA, 16 bp, Homo sapiens
aagccaatttttctgc

SEQ ID NO: 5100213 - DNA, 18 bp, Homo sapiens
aagccacaagaaatttga

SEQ ID NO: 5100214 - DNA, 18 bp, Homo sapiens
aagccacaagtcttccag

SEQ ID NO: 5100215 - DNA, 15 bp, Homo sapiens
aagccacacagccca

SEQ ID NO: 5100216 - DNA, 20 bp, Homo sapiens
aagccacacagcccagaagg

SEQ ID NO: 5100217 - DNA, 12 bp, Homo sapiens
aagccacagaaa

SEQ ID NO: 5100218 - DNA, 13 bp, Homo sapiens
aagccacagaaat

SEQ ID NO: 5100219 - DNA, 11 bp, Homo sapiens
aagccacagcc

SEQ ID NO: 5100220 - DNA, 18 bp, Homo sapiens
aagccacagcccaggcct

SEQ ID NO: 5100221 - DNA, 24 bp, Homo sapiens
aagccacagcccaggcctccagct

SEQ ID NO: 5100222 - DNA, 15 bp, Homo sapiens
aagccacatcttgct

SEQ ID NO: 5100223 - DNA, 21 bp, Homo sapiens
aagccaccaacatactcccat

SEQ ID NO: 5100224 - DNA, 18 bp, Homo sapiens
aagccaccatccccaccc

SEQ ID NO: 5100225 - DNA, 20 bp, Homo sapiens
aagccaccatgtatgtggaa

SEQ ID NO: 5100226 - DNA, 16 bp, Homo sapiens
aagccaccctcccagc

SEQ ID NO: 5100227 - DNA, 14 bp, Homo sapiens
aagccacccttccc

SEQ ID NO: 5100228 - DNA, 17 bp, Homo sapiens
aagccacccttccctgc

SEQ ID NO: 5100229 - DNA, 19 bp, Homo sapiens
aagccacccttccctgcct

SEQ ID NO: 5100230 - DNA, 20 bp, Homo sapiens
aagccacccttccctgcctc

SEQ ID NO: 5100231 - DNA, 14 bp, Homo sapiens
aagccaccgcagct

SEQ ID NO: 5100232 - DNA, 18 bp, Homo sapiens
aagccaccgcagctgctg

SEQ ID NO: 5100233 - DNA, 21 bp, Homo sapiens
aagccaccgcagctgctgcca

SEQ ID NO: 5100234 - DNA, 13 bp, Homo sapiens
aagccacctctcc

SEQ ID NO: 5100235 - DNA, 17 bp, Homo sapiens
aagccacctctctgcct

SEQ ID NO: 5100236 - DNA, 12 bp, Homo sapiens
aagccacctgct

SEQ ID NO: 5100237 - DNA, 16 bp, Homo sapiens
aagccacgccctccct

SEQ ID NO: 5100238 - DNA, 19 bp, Homo sapiens
aagccacgccctccctgct

SEQ ID NO: 5100239 - DNA, 21 bp, Homo sapiens
aagccacgccctccctgctag

SEQ ID NO: 5100240 - DNA, 22 bp, Homo sapiens
aagccacgctgtcctctcgagc

SEQ ID NO: 5100241 - DNA, 19 bp, Homo sapiens
aagccacgctgtgtccctc

SEQ ID NO: 5100242 - DNA, 14 bp, Homo sapiens
aagccacgtgctgg

SEQ ID NO: 5100243 - DNA, 17 bp, Homo sapiens
aagccacgtgctggaga

SEQ ID NO: 5100244 - DNA, 19 bp, Homo sapiens
aagccacgtgctggagagt

SEQ ID NO: 5100245 - DNA, 15 bp, Homo sapiens
aagccacgttgcaga

SEQ ID NO: 5100246 - DNA, 14 bp, Homo sapiens
aagccactgaagct

SEQ ID NO: 5100247 - DNA, 17 bp, Homo sapiens
aagccactgcctctccc

SEQ ID NO: 5100248 - DNA, 22 bp, Homo sapiens
aagccactgcctctccctctgg

SEQ ID NO: 5100249 - DNA, 20 bp, Homo sapiens
aagccactggaaggagcaca

SEQ ID NO: 5100250 - DNA, 21 bp, Homo sapiens
aagccacttctggcttcagcc

SEQ ID NO: 5100251 - DNA, 18 bp, Homo sapiens
aagccacttgaaatgtta

SEQ ID NO: 5100252 - DNA, 20 bp, Homo sapiens
aagccactttcctcttcaga

SEQ ID NO: 5100253 - DNA, 15 bp, Homo sapiens
aagccagaaccagat

SEQ ID NO: 5100254 - DNA, 12 bp, Homo sapiens
aagccagaagct

SEQ ID NO: 5100255 - DNA, 20 bp, Homo sapiens
aagccagaagctaagctgca

SEQ ID NO: 5100256 - DNA, 17 bp, Homo sapiens
aagccagaagctgagca

SEQ ID NO: 5100257 - DNA, 23 bp, Homo sapiens
aagccagaatattctaacctact

SEQ ID NO: 5100258 - DNA, 12 bp, Homo sapiens
aagccagagccc

SEQ ID NO: 5100259 - DNA, 15 bp, Homo sapiens
aagccagaggagaag

SEQ ID NO: 5100260 - DNA, 15 bp, Homo sapiens
aagccagaggctggg

SEQ ID NO: 5100261 - DNA, 12 bp, Homo sapiens
aagccagagtca

SEQ ID NO: 5100262 - DNA, 13 bp, Homo sapiens
aagccagagtcaa

SEQ ID NO: 5100263 - DNA, 20 bp, Homo sapiens
aagccagagtggccacggcc

SEQ ID NO: 5100264 - DNA, 21 bp, Homo sapiens
aagccagagtggccacggccc

SEQ ID NO: 5100265 - DNA, 14 bp, Homo sapiens
aagccagagtgtat

SEQ ID NO: 5100266 - DNA, 22 bp, Homo sapiens
aagccagagtttttaaagcctt

SEQ ID NO: 5100267 - DNA, 23 bp, Homo sapiens
aagccagagtttttaaagccttc

SEQ ID NO: 5100268 - DNA, 21 bp, Homo sapiens
aagccagatgctagagcctct

SEQ ID NO: 5100269 - DNA, 19 bp, Homo sapiens
aagccagattttcctgaaa

SEQ ID NO: 5100270 - DNA, 23 bp, Homo sapiens
aagccagattttttaaaatttat

SEQ ID NO: 5100271 - DNA, 19 bp, Homo sapiens
aagccagcaaagcctccag

SEQ ID NO: 5100272 - DNA, 23 bp, Homo sapiens
aagccagcaccggaccagcctgg

SEQ ID NO: 5100273 - DNA, 15 bp, Homo sapiens
aagccagcaggctct

SEQ ID NO: 5100274 - DNA, 19 bp, Homo sapiens
aagccagcatttcctcagt

SEQ ID NO: 5100275 - DNA, 20 bp, Homo sapiens
aagccagccaagctttaaat

SEQ ID NO: 5100276 - DNA, 23 bp, Homo sapiens
aagccagccacagacccctggga

SEQ ID NO: 5100277 - DNA, 13 bp, Homo sapiens
aagccagcctggg

SEQ ID NO: 5100278 - DNA, 17 bp, Homo sapiens
aagccagcgtcctcctc

SEQ ID NO: 5100279 - DNA, 19 bp, Homo sapiens
aagccagcgtcctcctctg

SEQ ID NO: 5100280 - DNA, 14 bp, Homo sapiens
aagccagctctagg

SEQ ID NO: 5100281 - DNA, 17 bp, Homo sapiens
aagccagctctgagcag

SEQ ID NO: 5100282 - DNA, 11 bp, Homo sapiens
aagccagctgc

SEQ ID NO: 5100283 - DNA, 22 bp, Homo sapiens
aagccagctgcccccagagcca

SEQ ID NO: 5100284 - DNA, 13 bp, Homo sapiens
aagccagctgcct

SEQ ID NO: 5100285 - DNA, 14 bp, Homo sapiens
aagccagctgccta

SEQ ID NO: 5100286 - DNA, 19 bp, Homo sapiens
aagccagcttcctgtgcag

SEQ ID NO: 5100287 - DNA, 20 bp, Homo sapiens
aagccagcttcctgtgcaga

SEQ ID NO: 5100288 - DNA, 23 bp, Homo sapiens
aagccagcttgtttacatgctta

SEQ ID NO: 5100289 - DNA, 20 bp, Homo sapiens
aagccaggaacagggaccag

SEQ ID NO: 5100290 - DNA, 22 bp, Homo sapiens
aagccaggaatttcccaggacc

SEQ ID NO: 5100291 - DNA, 19 bp, Homo sapiens
aagccaggactattccctt

SEQ ID NO: 5100292 - DNA, 19 bp, Homo sapiens
aagccaggagaagacccct

SEQ ID NO: 5100293 - DNA, 20 bp, Homo sapiens
aagccaggagaagacccctg

SEQ ID NO: 5100294 - DNA, 12 bp, Homo sapiens
aagccaggagac

SEQ ID NO: 5100295 - DNA, 13 bp, Homo sapiens
aagccaggagacc

SEQ ID NO: 5100296 - DNA, 21 bp, Homo sapiens
aagccaggcaggtagccaggg

SEQ ID NO: 5100297 - DNA, 21 bp, Homo sapiens
aagccaggccaactgccccgc

SEQ ID NO: 5100298 - DNA, 16 bp, Homo sapiens
aagccaggctcactca

SEQ ID NO: 5100299 - DNA, 22 bp, Homo sapiens
aagccaggctcactcacagagt

SEQ ID NO: 5100300 - DNA, 16 bp, Homo sapiens
aagccaggctcaggag

SEQ ID NO: 5100301 - DNA, 11 bp, Homo sapiens
aagccagggcc

SEQ ID NO: 5100302 - DNA, 13 bp, Homo sapiens
aagccagggccca

SEQ ID NO: 5100303 - DNA, 17 bp, Homo sapiens
aagccagggcccagagc

SEQ ID NO: 5100304 - DNA, 18 bp, Homo sapiens
aagccagggcccagagcc

SEQ ID NO: 5100305 - DNA, 21 bp, Homo sapiens
aagccagggcccagagccctt

SEQ ID NO: 5100306 - DNA, 14 bp, Homo sapiens
aagccagggctgga

SEQ ID NO: 5100307 - DNA, 21 bp, Homo sapiens
aagccagggtctctccctcag

SEQ ID NO: 5100308 - DNA, 15 bp, Homo sapiens
aagccaggtacagga

SEQ ID NO: 5100309 - DNA, 22 bp, Homo sapiens
aagccaggtacaggagaggcag

SEQ ID NO: 5100310 - DNA, 13 bp, Homo sapiens
aagccaggtccct

SEQ ID NO: 5100311 - DNA, 21 bp, Homo sapiens
aagccaggttccacagaggac

SEQ ID NO: 5100312 - DNA, 20 bp, Homo sapiens
aagccagtcaccttctgggc

SEQ ID NO: 5100313 - DNA, 12 bp, Homo sapiens
aagccagtctta

SEQ ID NO: 5100314 - DNA, 17 bp, Homo sapiens
aagccagtgactccagg

SEQ ID NO: 5100315 - DNA, 22 bp, Homo sapiens
aagccagtgactccaggagagg

SEQ ID NO: 5100316 - DNA, 16 bp, Homo sapiens
aagccagtgctgtctg

SEQ ID NO: 5100317 - DNA, 23 bp, Homo sapiens
aagccagtgttgcctaagtatta

SEQ ID NO: 5100318 - DNA, 21 bp, Homo sapiens
aagccagttagtaaacttcct

SEQ ID NO: 5100319 - DNA, 23 bp, Homo sapiens
aagccagtttgggtaaaatactt

SEQ ID NO: 5100320 - DNA, 16 bp, Homo sapiens
aagccataacgtgccc

SEQ ID NO: 5100321 - DNA, 17 bp, Homo sapiens
aagccatagaccctgag

SEQ ID NO: 5100322 - DNA, 23 bp, Homo sapiens
aagccatagaccctgaggccctg

SEQ ID NO: 5100323 - DNA, 18 bp, Homo sapiens
aagccatagatgctggct

SEQ ID NO: 5100324 - DNA, 18 bp, Homo sapiens
aagccatagccccaggcc

SEQ ID NO: 5100325 - DNA, 18 bp, Homo sapiens
aagccatagcctccacgg

SEQ ID NO: 5100326 - DNA, 14 bp, Homo sapiens
aagccataggccca

SEQ ID NO: 5100327 - DNA, 18 bp, Homo sapiens
aagccataggcccaggat

SEQ ID NO: 5100328 - DNA, 17 bp, Homo sapiens
aagccatagggggctgc

SEQ ID NO: 5100329 - DNA, 22 bp, Homo sapiens
aagccatatatgaccagaagcc

SEQ ID NO: 5100330 - DNA, 23 bp, Homo sapiens
aagccatatgacaatttcaaaat

SEQ ID NO: 5100331 - DNA, 12 bp, Homo sapiens
aagccatattcc

SEQ ID NO: 5100332 - DNA, 23 bp, Homo sapiens
aagccatcaattttaacatttga

SEQ ID NO: 5100333 - DNA, 24 bp, Homo sapiens
aagccatcaattttaacatttgat

SEQ ID NO: 5100334 - DNA, 15 bp, Homo sapiens
aagccatcacacctg

SEQ ID NO: 5100335 - DNA, 16 bp, Homo sapiens
aagccatcacctcaga

SEQ ID NO: 5100336 - DNA, 14 bp, Homo sapiens
aagccatcacttct

SEQ ID NO: 5100337 - DNA, 19 bp, Homo sapiens
aagccatcctgcccttctg

SEQ ID NO: 5100338 - DNA, 14 bp, Homo sapiens
aagccatgagaatg

SEQ ID NO: 5100339 - DNA, 22 bp, Homo sapiens
aagccatgctgctttgcacaca

SEQ ID NO: 5100340 - DNA, 20 bp, Homo sapiens
aagccatggagattctcata

SEQ ID NO: 5100341 - DNA, 21 bp, Homo sapiens
aagccatggagtgagacccag

SEQ ID NO: 5100342 - DNA, 22 bp, Homo sapiens
aagccatggagtgagacccagg

SEQ ID NO: 5100343 - DNA, 18 bp, Homo sapiens
aagccatggcatgctcct

SEQ ID NO: 5100344 - DNA, 22 bp, Homo sapiens
aagccatgggacctcctccctc

SEQ ID NO: 5100345 - DNA, 19 bp, Homo sapiens
aagccatggtgacacacag

SEQ ID NO: 5100346 - DNA, 22 bp, Homo sapiens
aagccatggtgacacacagcag

SEQ ID NO: 5100347 - DNA, 18 bp, Homo sapiens
aagccatgtactcaagta

SEQ ID NO: 5100348 - DNA, 21 bp, Homo sapiens
aagccatgtactcaagtacca

SEQ ID NO: 5100349 - DNA, 16 bp, Homo sapiens
aagccatgtgctgcgg

SEQ ID NO: 5100350 - DNA, 23 bp, Homo sapiens
aagccatgttaaatgacttgatt

SEQ ID NO: 5100351 - DNA, 14 bp, Homo sapiens
aagccatgtttaag

SEQ ID NO: 5100352 - DNA, 15 bp, Homo sapiens
aagccatgtttaaga

SEQ ID NO: 5100353 - DNA, 18 bp, Homo sapiens
aagccatgtttaagattt

SEQ ID NO: 5100354 - DNA, 13 bp, Homo sapiens
aagccatgtttat

SEQ ID NO: 5100355 - DNA, 15 bp, Homo sapiens
aagccattccaaagt

SEQ ID NO: 5100356 - DNA, 22 bp, Homo sapiens
aagccattctcctgcctcagcc

SEQ ID NO: 5100357 - DNA, 13 bp, Homo sapiens
aagccattgtctt

SEQ ID NO: 5100358 - DNA, 14 bp, Homo sapiens
aagccattgtcttc

SEQ ID NO: 5100359 - DNA, 22 bp, Homo sapiens
aagccatttagagggtgaagga

SEQ ID NO: 5100360 - DNA, 15 bp, Homo sapiens
aagccatttgtctgt

SEQ ID NO: 5100361 - DNA, 17 bp, Homo sapiens
aagccatttttacatct

SEQ ID NO: 5100362 - DNA, 13 bp, Homo sapiens
aagcccaaagcct

SEQ ID NO: 5100363 - DNA, 14 bp, Homo sapiens
aagcccaaatggct

SEQ ID NO: 5100364 - DNA, 22 bp, Homo sapiens
aagcccaaatttaatttgcaac

SEQ ID NO: 5100365 - DNA, 12 bp, Homo sapiens
aagcccaacaca

SEQ ID NO: 5100366 - DNA, 17 bp, Homo sapiens
aagcccaacctcctgac

SEQ ID NO: 5100367 - DNA, 22 bp, Homo sapiens
aagcccaacctcctgacctgtc

SEQ ID NO: 5100368 - DNA, 20 bp, Homo sapiens
aagcccaagctaagctgcag

SEQ ID NO: 5100369 - DNA, 22 bp, Homo sapiens
aagcccaagctaagctgcaggc

SEQ ID NO: 5100370 - DNA, 11 bp, Homo sapiens
aagcccacact

SEQ ID NO: 5100371 - DNA, 16 bp, Homo sapiens
aagcccacactatgca

SEQ ID NO: 5100372 - DNA, 15 bp, Homo sapiens
aagcccaccaggtgt

SEQ ID NO: 5100373 - DNA, 19 bp, Homo sapiens
aagcccacccgccccagag

SEQ ID NO: 5100374 - DNA, 23 bp, Homo sapiens
aagcccacccgccccagagactg

SEQ ID NO: 5100375 - DNA, 22 bp, Homo sapiens
aagcccacctcggccctccctg

SEQ ID NO: 5100376 - DNA, 23 bp, Homo sapiens
aagcccacctcggccctccctgc

SEQ ID NO: 5100377 - DNA, 11 bp, Homo sapiens
aagcccacctg

SEQ ID NO: 5100378 - DNA, 22 bp, Homo sapiens
aagcccacctgaaagcctgtct

SEQ ID NO: 5100379 - DNA, 12 bp, Homo sapiens
aagcccacctgg

SEQ ID NO: 5100380 - DNA, 15 bp, Homo sapiens
aagcccactgcctcc

SEQ ID NO: 5100381 - DNA, 22 bp, Homo sapiens
aagcccagcccctactgctgtg

SEQ ID NO: 5100382 - DNA, 11 bp, Homo sapiens
aagcccagcct

SEQ ID NO: 5100383 - DNA, 20 bp, Homo sapiens
aagcccagcctatctctctt

SEQ ID NO: 5100384 - DNA, 22 bp, Homo sapiens
aagcccagcctatctctcttct

SEQ ID NO: 5100385 - DNA, 12 bp, Homo sapiens
aagcccagctcc

SEQ ID NO: 5100386 - DNA, 13 bp, Homo sapiens
aagcccagctcca

SEQ ID NO: 5100387 - DNA, 21 bp, Homo sapiens
aagcccagctccagggccaga

SEQ ID NO: 5100388 - DNA, 13 bp, Homo sapiens
aagcccagcttga

SEQ ID NO: 5100389 - DNA, 15 bp, Homo sapiens
aagcccaggagccca

SEQ ID NO: 5100390 - DNA, 16 bp, Homo sapiens
aagcccaggagcccat

SEQ ID NO: 5100391 - DNA, 13 bp, Homo sapiens
aagcccaggaggg

SEQ ID NO: 5100392 - DNA, 15 bp, Homo sapiens
aagcccaggatctct

SEQ ID NO: 5100393 - DNA, 15 bp, Homo sapiens
aagcccaggggccgg

SEQ ID NO: 5100394 - DNA, 17 bp, Homo sapiens
aagcccagtgcactgaa

SEQ ID NO: 5100395 - DNA, 22 bp, Homo sapiens
aagcccagtgcactgaaagtca

SEQ ID NO: 5100396 - DNA, 18 bp, Homo sapiens
aagcccagtgctgctgta

SEQ ID NO: 5100397 - DNA, 18 bp, Homo sapiens
aagcccagttcagcttgg

SEQ ID NO: 5100398 - DNA, 21 bp, Homo sapiens
aagataggaagaaaatttcct

SEQ ID NO: 5100399 - DNA, 14 bp, Homo sapiens
aagataggctctgc

SEQ ID NO: 5100400 - DNA, 15 bp, Homo sapiens
aagataggctctgca

SEQ ID NO: 5100401 - DNA, 18 bp, Homo sapiens
aagataggctctgcacag

SEQ ID NO: 5100402 - DNA, 21 bp, Homo sapiens
aagataggggcacactacaga

SEQ ID NO: 5100403 - DNA, 15 bp, Homo sapiens
aagataggtatggaa

SEQ ID NO: 5100404 - DNA, 21 bp, Homo sapiens
aagataggtttgagttcaaat

SEQ ID NO: 5100405 - DNA, 23 bp, Homo sapiens
aagataggtttgagttcaaattt

SEQ ID NO: 5100406 - DNA, 16 bp, Homo sapiens
aagatagtcttggaag

SEQ ID NO: 5100407 - DNA, 15 bp, Homo sapiens
aagatagtgtaactt

SEQ ID NO: 5100408 - DNA, 21 bp, Homo sapiens
aagatagtgtaacttgcttaa

SEQ ID NO: 5100409 - DNA, 17 bp, Homo sapiens
aagatagttacatttat

SEQ ID NO: 5100410 - DNA, 18 bp, Homo sapiens
aagatagttacatttatg

SEQ ID NO: 5100411 - DNA, 20 bp, Homo sapiens
aagatataactattgcccag

SEQ ID NO: 5100412 - DNA, 13 bp, Homo sapiens
aagatatatattc

SEQ ID NO: 5100413 - DNA, 22 bp, Homo sapiens
aagatatatatttactaaaaga

SEQ ID NO: 5100414 - DNA, 23 bp, Homo sapiens
aagatatatatttactaaaagaa

SEQ ID NO: 5100415 - DNA, 21 bp, Homo sapiens
aagatatattaaaaatataaa

SEQ ID NO: 5100416 - DNA, 22 bp, Homo sapiens
aagatatatttcacttttgttc

SEQ ID NO: 5100417 - DNA, 20 bp, Homo sapiens
aagatatatttgtcattttc

SEQ ID NO: 5100418 - DNA, 22 bp, Homo sapiens
aagatatcagagctcttaatgt

SEQ ID NO: 5100419 - DNA, 19 bp, Homo sapiens
aagatatcccagctttaaa

SEQ ID NO: 5100420 - DNA, 16 bp, Homo sapiens
aagatatgaagaacta

SEQ ID NO: 5100421 - DNA, 17 bp, Homo sapiens
aagatatggagaattgc

SEQ ID NO: 5100422 - DNA, 17 bp, Homo sapiens
aagatatggcacttctc

SEQ ID NO: 5100423 - DNA, 21 bp, Homo sapiens
aagatatgtatatttttgatc

SEQ ID NO: 5100424 - DNA, 21 bp, Homo sapiens
aagatattaccctcagaatat

SEQ ID NO: 5100425 - DNA, 23 bp, Homo sapiens
aagatattatttatcgaaagtaa

SEQ ID NO: 5100426 - DNA, 15 bp, Homo sapiens
aagatattccttttt

SEQ ID NO: 5100427 - DNA, 20 bp, Homo sapiens
aagatattcctttttaactt

SEQ ID NO: 5100428 - DNA, 15 bp, Homo sapiens
aagatattctttagt

SEQ ID NO: 5100429 - DNA, 14 bp, Homo sapiens
aagatattgaagga

SEQ ID NO: 5100430 - DNA, 15 bp, Homo sapiens
aagatattgatcaaa

SEQ ID NO: 5100431 - DNA, 20 bp, Homo sapiens
aagatattgatcaaatatag

SEQ ID NO: 5100432 - DNA, 21 bp, Homo sapiens
aagatattgtatctcctttaa

SEQ ID NO: 5100433 - DNA, 15 bp, Homo sapiens
aagatatttatatat

SEQ ID NO: 5100434 - DNA, 16 bp, Homo sapiens
aagatatttatatgtt

SEQ ID NO: 5100435 - DNA, 18 bp, Homo sapiens
aagatatttatatgttat

SEQ ID NO: 5100436 - DNA, 19 bp, Homo sapiens
aagatatttatatgttatt

SEQ ID NO: 5100437 - DNA, 21 bp, Homo sapiens
aagatattttatttctgatgt

SEQ ID NO: 5100438 - DNA, 16 bp, Homo sapiens
aagatatttttatagg

SEQ ID NO: 5100439 - DNA, 17 bp, Homo sapiens
aagatatttttattcaa

SEQ ID NO: 5100440 - DNA, 23 bp, Homo sapiens
aagatatttttattcaaactacc

SEQ ID NO: 5100441 - DNA, 22 bp, Homo sapiens
aagatatttttgaagtaaatta

SEQ ID NO: 5100442 - DNA, 21 bp, Homo sapiens
aagatcaaaaaggcttataaa

SEQ ID NO: 5100443 - DNA, 23 bp, Homo sapiens
aagatcaaaaggttaataaagta

SEQ ID NO: 5100444 - DNA, 13 bp, Homo sapiens
aagatcacaaata

SEQ ID NO: 5100445 - DNA, 19 bp, Homo sapiens
aagatcacacatcaagact

SEQ ID NO: 5100446 - DNA, 22 bp, Homo sapiens
aagatcacccgttgtattcacc

SEQ ID NO: 5100447 - DNA, 17 bp, Homo sapiens
aagatcaccttgtattc

SEQ ID NO: 5100448 - DNA, 19 bp, Homo sapiens
aagatcacgctccccgcct

SEQ ID NO: 5100449 - DNA, 21 bp, Homo sapiens
aagatcacttgttgttttact

SEQ ID NO: 5100450 - DNA, 17 bp, Homo sapiens
aagatcactttctcagt

SEQ ID NO: 5100451 - DNA, 23 bp, Homo sapiens
aagatcagctattcccttctgat

SEQ ID NO: 5100452 - DNA, 16 bp, Homo sapiens
aagatcatgtacccca

SEQ ID NO: 5100453 - DNA, 22 bp, Homo sapiens
aagatcattgaagaccagcttt

SEQ ID NO: 5100454 - DNA, 14 bp, Homo sapiens
aagatccagaaata

SEQ ID NO: 5100455 - DNA, 23 bp, Homo sapiens
aagatccatttgcctttctggga

SEQ ID NO: 5100456 - DNA, 16 bp, Homo sapiens
aagatcccaagtcaaa

SEQ ID NO: 5100457 - DNA, 15 bp, Homo sapiens
aagatccccaactgc

SEQ ID NO: 5100458 - DNA, 19 bp, Homo sapiens
aagatccccaactgctcca

SEQ ID NO: 5100459 - DNA, 23 bp, Homo sapiens
aagatccccaactgctccagcct

SEQ ID NO: 5100460 - DNA, 21 bp, Homo sapiens
aagatccccattctttctctt

SEQ ID NO: 5100461 - DNA, 13 bp, Homo sapiens
aagatcctaaact

SEQ ID NO: 5100462 - DNA, 15 bp, Homo sapiens
aagatcctaaactct

SEQ ID NO: 5100463 - DNA, 19 bp, Homo sapiens
aagatcctaaactctctag

SEQ ID NO: 5100464 - DNA, 21 bp, Homo sapiens
aagatcctccttccaggcccc

SEQ ID NO: 5100465 - DNA, 20 bp, Homo sapiens
aagatcctcttgccacatct

SEQ ID NO: 5100466 - DNA, 19 bp, Homo sapiens
aagatcgcaccactgcact

SEQ ID NO: 5100467 - DNA, 14 bp, Homo sapiens
aagatcgcatggca

SEQ ID NO: 5100468 - DNA, 21 bp, Homo sapiens
aagatcggctttcatgtaatt

SEQ ID NO: 5100469 - DNA, 19 bp, Homo sapiens
aagatctaccccagggaga

SEQ ID NO: 5100470 - DNA, 19 bp, Homo sapiens
aagatctacctgcaacaca

SEQ ID NO: 5100471 - DNA, 20 bp, Homo sapiens
aagatctacctgcaacacaa

SEQ ID NO: 5100472 - DNA, 15 bp, Homo sapiens
aagatctctagagtt

SEQ ID NO: 5100473 - DNA, 16 bp, Homo sapiens
aagatctctagagttt

SEQ ID NO: 5100474 - DNA, 18 bp, Homo sapiens
aagatctctgcagggccg

SEQ ID NO: 5100475 - DNA, 12 bp, Homo sapiens
aagatctgaaag

SEQ ID NO: 5100476 - DNA, 13 bp, Homo sapiens
aagatctgactgc

SEQ ID NO: 5100477 - DNA, 19 bp, Homo sapiens
aagatctgccagacctgca

SEQ ID NO: 5100478 - DNA, 13 bp, Homo sapiens
aagatctggggag

SEQ ID NO: 5100479 - DNA, 13 bp, Homo sapiens
aagatctgttaaa

SEQ ID NO: 5100480 - DNA, 23 bp, Homo sapiens
aagatctgttaaaaaagaaatct

SEQ ID NO: 5100481 - DNA, 15 bp, Homo sapiens
aagatcttaaatttt

SEQ ID NO: 5100482 - DNA, 17 bp, Homo sapiens
aagatcttaaattttgt

SEQ ID NO: 5100483 - DNA, 16 bp, Homo sapiens
aagatcttagattctc

SEQ ID NO: 5100484 - DNA, 17 bp, Homo sapiens
aagatcttagattctct

SEQ ID NO: 5100485 - DNA, 23 bp, Homo sapiens
aagatcttcaaaagtaatgcctc

SEQ ID NO: 5100486 - DNA, 21 bp, Homo sapiens
aagatcttgatggtgtttctt

SEQ ID NO: 5100487 - DNA, 11 bp, Homo sapiens
aagatcttgcc

SEQ ID NO: 5100488 - DNA, 23 bp, Homo sapiens
aagatcttggcttaatttaatgt

SEQ ID NO: 5100489 - DNA, 13 bp, Homo sapiens
aagatctttatat

SEQ ID NO: 5100490 - DNA, 12 bp, Homo sapiens
aagatcttttaa

SEQ ID NO: 5100491 - DNA, 21 bp, Homo sapiens
aagatcttttcgaagctgtta

SEQ ID NO: 5100492 - DNA, 13 bp, Homo sapiens
aagatgaaaatat

SEQ ID NO: 5100493 - DNA, 17 bp, Homo sapiens
aagatgaaatgcactgt

SEQ ID NO: 5100494 - DNA, 20 bp, Homo sapiens
aagatgaaatttgataaact

SEQ ID NO: 5100495 - DNA, 15 bp, Homo sapiens
aagatgaacagactg

SEQ ID NO: 5100496 - DNA, 22 bp, Homo sapiens
aagatgaacccgaggctgagaa

SEQ ID NO: 5100497 - DNA, 18 bp, Homo sapiens
aagatgaagagaagctga

SEQ ID NO: 5100498 - DNA, 23 bp, Homo sapiens
aagatgaaggagaggcaacatcc

SEQ ID NO: 5100499 - DNA, 15 bp, Homo sapiens
aagatgaatcaatgg

SEQ ID NO: 5100500 - DNA, 21 bp, Homo sapiens
aagatgaatccaaatgtgaaa

SEQ ID NO: 5100501 - DNA, 11 bp, Homo sapiens
aagatgaatga

SEQ ID NO: 5100502 - DNA, 15 bp, Homo sapiens
aagatgacagctctt

SEQ ID NO: 5100503 - DNA, 13 bp, Homo sapiens
aagatgacattgc

SEQ ID NO: 5100504 - DNA, 16 bp, Homo sapiens
aagatgacattgctaa

SEQ ID NO: 5100505 - DNA, 20 bp, Homo sapiens
aagatgacattgctaagatg

SEQ ID NO: 5100506 - DNA, 23 bp, Homo sapiens
aagatgacattgctaagatgctc

SEQ ID NO: 5100507 - DNA, 14 bp, Homo sapiens
aagatgactctgag

SEQ ID NO: 5100508 - DNA, 13 bp, Homo sapiens
aagatgacttccc

SEQ ID NO: 5100509 - DNA, 15 bp, Homo sapiens
aagatgacttcccaa

SEQ ID NO: 5100510 - DNA, 19 bp, Homo sapiens
aagatgacttcccctgcct

SEQ ID NO: 5100511 - DNA, 19 bp, Homo sapiens
aagatgagaacagataaag

SEQ ID NO: 5100512 - DNA, 16 bp, Homo sapiens
aagatgagaagccaaa

SEQ ID NO: 5100513 - DNA, 19 bp, Homo sapiens
aagatgagatttgccagca

SEQ ID NO: 5100514 - DNA, 13 bp, Homo sapiens
aagatgagcctgg

SEQ ID NO: 5100515 - DNA, 18 bp, Homo sapiens
aagatgagctgtgcgctg

SEQ ID NO: 5100516 - DNA, 16 bp, Homo sapiens
aagatgaggttctgag

SEQ ID NO: 5100517 - DNA, 19 bp, Homo sapiens
aagatgatattaagaactg

SEQ ID NO: 5100518 - DNA, 15 bp, Homo sapiens
aagatgatcagacct

SEQ ID NO: 5100519 - DNA, 13 bp, Homo sapiens
aagatgatccttc

SEQ ID NO: 5100520 - DNA, 16 bp, Homo sapiens
aagatgatgttaaatg

SEQ ID NO: 5100521 - DNA, 20 bp, Homo sapiens
aagatgattgttcttttgtt

SEQ ID NO: 5100522 - DNA, 23 bp, Homo sapiens
aagatgattgttcttttgtttca

SEQ ID NO: 5100523 - DNA, 22 bp, Homo sapiens
aagatgattttttaaggagctg

SEQ ID NO: 5100524 - DNA, 15 bp, Homo sapiens
aagatgcaatgtaga

SEQ ID NO: 5100525 - DNA, 12 bp, Homo sapiens
aagatgcagaag

SEQ ID NO: 5100526 - DNA, 21 bp, Homo sapiens
aagatgcatcatctcttcctc

SEQ ID NO: 5100527 - DNA, 17 bp, Homo sapiens
aagatgcattgtagttt

SEQ ID NO: 5100528 - DNA, 12 bp, Homo sapiens
aagatgcatttt

SEQ ID NO: 5100529 - DNA, 14 bp, Homo sapiens
aagatgcattttta

SEQ ID NO: 5100530 - DNA, 16 bp, Homo sapiens
aagatgccaacatcgg

SEQ ID NO: 5100531 - DNA, 23 bp, Homo sapiens
aagatgccaaggaggtcccagga

SEQ ID NO: 5100532 - DNA, 21 bp, Homo sapiens
aagatgccagcttctctctcc

SEQ ID NO: 5100533 - DNA, 11 bp, Homo sapiens
aagatgccctc

SEQ ID NO: 5100534 - DNA, 15 bp, Homo sapiens
aagatgcctgatcag

SEQ ID NO: 5100535 - DNA, 16 bp, Homo sapiens
aagatgcctgatcaga

SEQ ID NO: 5100536 - DNA, 23 bp, Homo sapiens
aagatgcctgttaatttataatg

SEQ ID NO: 5100537 - DNA, 13 bp, Homo sapiens
aagatgccttgaa

SEQ ID NO: 5100538 - DNA, 19 bp, Homo sapiens
aagatgctcatctgagcca

SEQ ID NO: 5100539 - DNA, 15 bp, Homo sapiens
aagatgctctatctt

SEQ ID NO: 5100540 - DNA, 21 bp, Homo sapiens
aagatgctctatcttgctctg

SEQ ID NO: 5100541 - DNA, 11 bp, Homo sapiens
aagatgctgcc

SEQ ID NO: 5100542 - DNA, 22 bp, Homo sapiens
aagatgctgctgagcacatctc

SEQ ID NO: 5100543 - DNA, 11 bp, Homo sapiens
aagatgctggg

SEQ ID NO: 5100544 - DNA, 14 bp, Homo sapiens
aagatgctgggttg

SEQ ID NO: 5100545 - DNA, 18 bp, Homo sapiens
aagatgctttaattgtgt

SEQ ID NO: 5100546 - DNA, 15 bp, Homo sapiens
aagatgcttttcaaa

SEQ ID NO: 5100547 - DNA, 18 bp, Homo sapiens
aagatggaaaaaaaaaac

SEQ ID NO: 5100548 - DNA, 15 bp, Homo sapiens
aagatggaaatacag

SEQ ID NO: 5100549 - DNA, 16 bp, Homo sapiens
aagatggaaatacagt

SEQ ID NO: 5100550 - DNA, 21 bp, Homo sapiens
aagatggaaattctgaaaact

SEQ ID NO: 5100551 - DNA, 16 bp, Homo sapiens
aagatggaagtcacct

SEQ ID NO: 5100552 - DNA, 22 bp, Homo sapiens
aagatggactctgaaaaacatt

SEQ ID NO: 5100553 - DNA, 19 bp, Homo sapiens
aagatggagacaccctctg

SEQ ID NO: 5100554 - DNA, 12 bp, Homo sapiens
aagatggagggg

SEQ ID NO: 5100555 - DNA, 17 bp, Homo sapiens
aagatggagttgtattt

SEQ ID NO: 5100556 - DNA, 14 bp, Homo sapiens
aagatggagtttct

SEQ ID NO: 5100557 - DNA, 14 bp, Homo sapiens
aagatggatgtaat

SEQ ID NO: 5100558 - DNA, 23 bp, Homo sapiens
aagatggcaactgtattaaagaa

SEQ ID NO: 5100559 - DNA, 17 bp, Homo sapiens
aagatggcactgtccag

SEQ ID NO: 5100560 - DNA, 19 bp, Homo sapiens
aagatggcactgtccaggg

SEQ ID NO: 5100561 - DNA, 24 bp, Homo sapiens
aagatggcactgtccagggcccat

SEQ ID NO: 5100562 - DNA, 23 bp, Homo sapiens
aagatggcacttataaccaaagc

SEQ ID NO: 5100563 - DNA, 22 bp, Homo sapiens
aagatggcccagctccccaaga

SEQ ID NO: 5100564 - DNA, 15 bp, Homo sapiens
aagatggctgctgcc

SEQ ID NO: 5100565 - DNA, 21 bp, Homo sapiens
aagatggctgtgcctctgcct

SEQ ID NO: 5100566 - DNA, 23 bp, Homo sapiens
aagatggcttttgtttcttccct

SEQ ID NO: 5100567 - DNA, 17 bp, Homo sapiens
aagatgggaaactgctt

SEQ ID NO: 5100568 - DNA, 23 bp, Homo sapiens
aagatgggcaatcctgggctggc

SEQ ID NO: 5100569 - DNA, 14 bp, Homo sapiens
aagatgggcacatg

SEQ ID NO: 5100570 - DNA, 15 bp, Homo sapiens
aagatgggcacatga

SEQ ID NO: 5100571 - DNA, 19 bp, Homo sapiens
aagatggggaaactgaggg

SEQ ID NO: 5100572 - DNA, 15 bp, Homo sapiens
aagatgggggctgga

SEQ ID NO: 5100573 - DNA, 15 bp, Homo sapiens
aagatggggtctgta

SEQ ID NO: 5100574 - DNA, 17 bp, Homo sapiens
aagatggggtctgtaaa

SEQ ID NO: 5100575 - DNA, 19 bp, Homo sapiens
aagatggggtctgtaaaat

SEQ ID NO: 5100576 - DNA, 21 bp, Homo sapiens
aagatggggtctgtaaaatct

SEQ ID NO: 5100577 - DNA, 22 bp, Homo sapiens
aagatggggtctgtaaaatctt

SEQ ID NO: 5100578 - DNA, 14 bp, Homo sapiens
aagatgggtgggga

SEQ ID NO: 5100579 - DNA, 16 bp, Homo sapiens
aagatggtacaacctt

SEQ ID NO: 5100580 - DNA, 17 bp, Homo sapiens
aagatggtcatattatt

SEQ ID NO: 5100581 - DNA, 23 bp, Homo sapiens
aagatggtccatttgttcctgct

SEQ ID NO: 5100582 - DNA, 19 bp, Homo sapiens
aagatggtccgtgcccagg

SEQ ID NO: 5100583 - DNA, 22 bp, Homo sapiens
aagatggtccgtgcccaggccc

SEQ ID NO: 5100584 - DNA, 23 bp, Homo sapiens
aagatggtccgtgcccaggccct

SEQ ID NO: 5100585 - DNA, 13 bp, Homo sapiens
aagatggtgaaga

SEQ ID NO: 5100586 - DNA, 19 bp, Homo sapiens
aagatggtgaagacagaaa

SEQ ID NO: 5100587 - DNA, 23 bp, Homo sapiens
aagatggtgctgggtaataaaat

SEQ ID NO: 5100588 - DNA, 17 bp, Homo sapiens
aagatggttcaaagata

SEQ ID NO: 5100589 - DNA, 15 bp, Homo sapiens
aagatggtttatgca

SEQ ID NO: 5100590 - DNA, 14 bp, Homo sapiens
aagatggtttcaat

SEQ ID NO: 5100591 - DNA, 14 bp, Homo sapiens
aagatgtaaattga

SEQ ID NO: 5100592 - DNA, 12 bp, Homo sapiens
aagatgtacatt

SEQ ID NO: 5100593 - DNA, 15 bp, Homo sapiens
aagatgtacatttaa

SEQ ID NO: 5100594 - DNA, 17 bp, Homo sapiens
aagatgtacctggtgga

SEQ ID NO: 5100595 - DNA, 16 bp, Homo sapiens
aagatgtactgagagg

SEQ ID NO: 5100596 - DNA, 13 bp, Homo sapiens
aagatgtagcaaa

SEQ ID NO: 5100597 - DNA, 14 bp, Homo sapiens
aagatgtagcacct

SEQ ID NO: 5100598 - DNA, 21 bp, Homo sapiens
aagatgtagcgctttgaatat

SEQ ID NO: 5100599 - DNA, 14 bp, Homo sapiens
aagatgtatatagg

SEQ ID NO: 5100600 - DNA, 18 bp, Homo sapiens
aagatgtatgctttgaat

SEQ ID NO: 5100601 - DNA, 23 bp, Homo sapiens
aagatgtattaacctacctgtga

SEQ ID NO: 5100602 - DNA, 18 bp, Homo sapiens
aagatgtattcagagcca

SEQ ID NO: 5100603 - DNA, 16 bp, Homo sapiens
aagatgtcaaagatat

SEQ ID NO: 5100604 - DNA, 14 bp, Homo sapiens
aagatgtcaaatat

SEQ ID NO: 5100605 - DNA, 21 bp, Homo sapiens
aagatgtcaagctggccgtgg

SEQ ID NO: 5100606 - DNA, 16 bp, Homo sapiens
aagatgtcagactggc

SEQ ID NO: 5100607 - DNA, 12 bp, Homo sapiens
aagatgtcccac

SEQ ID NO: 5100608 - DNA, 18 bp, Homo sapiens
aagatgtcccacagggac

SEQ ID NO: 5100609 - DNA, 23 bp, Homo sapiens
aagatgtctcaggtttgttttgt

SEQ ID NO: 5100610 - DNA, 18 bp, Homo sapiens
aagatgtctgtttgctga

SEQ ID NO: 5100611 - DNA, 13 bp, Homo sapiens
aagatgtgaaaat

SEQ ID NO: 5100612 - DNA, 19 bp, Homo sapiens
aagatgtgatattctaaga

SEQ ID NO: 5100613 - DNA, 17 bp, Homo sapiens
aagatgtgcaaaatcac

SEQ ID NO: 5100614 - DNA, 19 bp, Homo sapiens
aagatgtgcaaaatcactg

SEQ ID NO: 5100615 - DNA, 18 bp, Homo sapiens
aagatgtgtaaacaggta

SEQ ID NO: 5100616 - DNA, 13 bp, Homo sapiens
aagatgtgtaaat

SEQ ID NO: 5100617 - DNA, 16 bp, Homo sapiens
aagatgtgtaaataag

SEQ ID NO: 5100618 - DNA, 15 bp, Homo sapiens
aagatgtgttcttat

SEQ ID NO: 5100619 - DNA, 15 bp, Homo sapiens
aagatgttaaatgga

SEQ ID NO: 5100620 - DNA, 17 bp, Homo sapiens
aagatgttaacagtatt

SEQ ID NO: 5100621 - DNA, 18 bp, Homo sapiens
aagatgttaattactttt

SEQ ID NO: 5100622 - DNA, 14 bp, Homo sapiens
aagatgttatattt

SEQ ID NO: 5100623 - DNA, 20 bp, Homo sapiens
aagatgttcaatagaacatg

SEQ ID NO: 5100624 - DNA, 15 bp, Homo sapiens
aagatgttcattttt

SEQ ID NO: 5100625 - DNA, 15 bp, Homo sapiens
aagatgttccagtga

SEQ ID NO: 5100626 - DNA, 20 bp, Homo sapiens
aagatgttctggataccatt

SEQ ID NO: 5100627 - DNA, 18 bp, Homo sapiens
aagatgttgtgtcttgtg

SEQ ID NO: 5100628 - DNA, 15 bp, Homo sapiens
aagatgttgttttag

SEQ ID NO: 5100629 - DNA, 14 bp, Homo sapiens
aagatgtttacatt

SEQ ID NO: 5100630 - DNA, 14 bp, Homo sapiens
aagatgtttcttat

SEQ ID NO: 5100631 - DNA, 23 bp, Homo sapiens
aagatgtttcttatattattcca

SEQ ID NO: 5100632 - DNA, 14 bp, Homo sapiens
aagatgtttgaaaa

SEQ ID NO: 5100633 - DNA, 15 bp, Homo sapiens
aagatgtttgaaaat

SEQ ID NO: 5100634 - DNA, 11 bp, Homo sapiens
aagatgtttgc

SEQ ID NO: 5100635 - DNA, 21 bp, Homo sapiens
aagatgtttgtttacataaga

SEQ ID NO: 5100636 - DNA, 14 bp, Homo sapiens
aagatgttttgtat

SEQ ID NO: 5100637 - DNA, 15 bp, Homo sapiens
aagatgtttttagag

SEQ ID NO: 5100638 - DNA, 17 bp, Homo sapiens
aagattaaaattagtga

SEQ ID NO: 5100639 - DNA, 18 bp, Homo sapiens
aagattaaaattagtgag

SEQ ID NO: 5100640 - DNA, 17 bp, Homo sapiens
aagattaaacagatgat

SEQ ID NO: 5100641 - DNA, 15 bp, Homo sapiens
aagattaaaggaagg

SEQ ID NO: 5100642 - DNA, 17 bp, Homo sapiens
aagattaaaggaaggaa

SEQ ID NO: 5100643 - DNA, 19 bp, Homo sapiens
aagattaaaggaaggaaaa

SEQ ID NO: 5100644 - DNA, 15 bp, Homo sapiens
aagattaaatatgat

SEQ ID NO: 5100645 - DNA, 19 bp, Homo sapiens
aagattaatagcattcgaa

SEQ ID NO: 5100646 - DNA, 16 bp, Homo sapiens
aagattaatctttaaa

SEQ ID NO: 5100647 - DNA, 14 bp, Homo sapiens
aagattaattaaaa

SEQ ID NO: 5100648 - DNA, 12 bp, Homo sapiens
aagattaatttt

SEQ ID NO: 5100649 - DNA, 17 bp, Homo sapiens
aagattacaaaagcaat

SEQ ID NO: 5100650 - DNA, 21 bp, Homo sapiens
aagattacaaatcagaagtca

SEQ ID NO: 5100651 - DNA, 17 bp, Homo sapiens
aagattacaagataaaa

SEQ ID NO: 5100652 - DNA, 22 bp, Homo sapiens
aagattagaaagaattagccaa

SEQ ID NO: 5100653 - DNA, 18 bp, Homo sapiens
aagattagaatgaaaatt

SEQ ID NO: 5100654 - DNA, 19 bp, Homo sapiens
aagattaggagaaacacat

SEQ ID NO: 5100655 - DNA, 23 bp, Homo sapiens
aagattaggtactatctgtgaag

SEQ ID NO: 5100656 - DNA, 13 bp, Homo sapiens
aagattagtgatt

SEQ ID NO: 5100657 - DNA, 16 bp, Homo sapiens
aagattagtttcaatg

SEQ ID NO: 5100658 - DNA, 16 bp, Homo sapiens
aagattataatatgtg

SEQ ID NO: 5100659 - DNA, 23 bp, Homo sapiens
aagattataatatgtgccttaag

SEQ ID NO: 5100660 - DNA, 21 bp, Homo sapiens
aagattatagattctaaagat

SEQ ID NO: 5100661 - DNA, 15 bp, Homo sapiens
aagattatatacaaa

SEQ ID NO: 5100662 - DNA, 14 bp, Homo sapiens
aagattatatatca

SEQ ID NO: 5100663 - DNA, 13 bp, Homo sapiens
aagattatatgaa

SEQ ID NO: 5100664 - DNA, 24 bp, Homo sapiens
aagattatattataataatgttct

SEQ ID NO: 5100665 - DNA, 22 bp, Homo sapiens
aagattatcctgttactgaatt

SEQ ID NO: 5100666 - DNA, 20 bp, Homo sapiens
aagattatgtgacttgcaat

SEQ ID NO: 5100667 - DNA, 23 bp, Homo sapiens
aagattattgtctgattgaaaca

SEQ ID NO: 5100668 - DNA, 20 bp, Homo sapiens
aagattattgtgacttcact

SEQ ID NO: 5100669 - DNA, 21 bp, Homo sapiens
aagattattgtgacttcactg

SEQ ID NO: 5100670 - DNA, 19 bp, Homo sapiens
aagattattttattatgcg

SEQ ID NO: 5100671 - DNA, 17 bp, Homo sapiens
aagattcaatcccagga

SEQ ID NO: 5100672 - DNA, 21 bp, Homo sapiens
aagattcaatgcccctgaatt

SEQ ID NO: 5100673 - DNA, 23 bp, Homo sapiens
aagattcacacctgactctgaaa

SEQ ID NO: 5100674 - DNA, 14 bp, Homo sapiens
aagattcagcagtg

SEQ ID NO: 5100675 - DNA, 13 bp, Homo sapiens
aagattcaggctt

SEQ ID NO: 5100676 - DNA, 22 bp, Homo sapiens
aagattcaggcttgcattaaaa

SEQ ID NO: 5100677 - DNA, 17 bp, Homo sapiens
aagattcagttcaaatg

SEQ ID NO: 5100678 - DNA, 20 bp, Homo sapiens
aagattcatatttacttctt

SEQ ID NO: 5100679 - DNA, 12 bp, Homo sapiens
aagattccaaaa

SEQ ID NO: 5100680 - DNA, 18 bp, Homo sapiens
aagattcccagagacagg

SEQ ID NO: 5100681 - DNA, 19 bp, Homo sapiens
aagattcccagagacagga

SEQ ID NO: 5100682 - DNA, 13 bp, Homo sapiens
aagattcccagga

SEQ ID NO: 5100683 - DNA, 19 bp, Homo sapiens
aagattcccttgaaattta

SEQ ID NO: 5100684 - DNA, 24 bp, Homo sapiens
aagattccggatcctaagcatcta

SEQ ID NO: 5100685 - DNA, 12 bp, Homo sapiens
aagattcctggt

SEQ ID NO: 5100686 - DNA, 17 bp, Homo sapiens
aagattcctgtccttca

SEQ ID NO: 5100687 - DNA, 18 bp, Homo sapiens
aagattccttttcttgtt

SEQ ID NO: 5100688 - DNA, 12 bp, Homo sapiens
aagattctaaag

SEQ ID NO: 5100689 - DNA, 17 bp, Homo sapiens
aagattctaaagctcaa

SEQ ID NO: 5100690 - DNA, 18 bp, Homo sapiens
aagattctaaagctcaat

SEQ ID NO: 5100691 - DNA, 13 bp, Homo sapiens
aagattctactaa

SEQ ID NO: 5100692 - DNA, 13 bp, Homo sapiens
aagattctagatg

SEQ ID NO: 5100693 - DNA, 18 bp, Homo sapiens
aagattctcgccccttcc

SEQ ID NO: 5100694 - DNA, 23 bp, Homo sapiens
aagattctcgccccttccctctc

SEQ ID NO: 5100695 - DNA, 20 bp, Homo sapiens
aagattctctatgtatcaaa

SEQ ID NO: 5100696 - DNA, 15 bp, Homo sapiens
aagattctctttaaa

SEQ ID NO: 5100697 - DNA, 15 bp, Homo sapiens
aagattcttcccatt

SEQ ID NO: 5100698 - DNA, 19 bp, Homo sapiens
aagattcttcccattctcc

SEQ ID NO: 5100699 - DNA, 20 bp, Homo sapiens
aagattcttcccattctcca

SEQ ID NO: 5100700 - DNA, 21 bp, Homo sapiens
aagattcttcccattctccat

SEQ ID NO: 5100701 - DNA, 23 bp, Homo sapiens
aagattcttcccattctccattt

SEQ ID NO: 5100702 - DNA, 20 bp, Homo sapiens
aagattcttcttaaaagttt

SEQ ID NO: 5100703 - DNA, 17 bp, Homo sapiens
aagattcttggtatttg

SEQ ID NO: 5100704 - DNA, 13 bp, Homo sapiens
aagattctttccc

SEQ ID NO: 5100705 - DNA, 16 bp, Homo sapiens
aagattctttcccaat

SEQ ID NO: 5100706 - DNA, 20 bp, Homo sapiens
aagattgaaaaaaataaatt

SEQ ID NO: 5100707 - DNA, 15 bp, Homo sapiens
aagattgagaagcca

SEQ ID NO: 5100708 - DNA, 19 bp, Homo sapiens
aagattgagctctctgccc

SEQ ID NO: 5100709 - DNA, 17 bp, Homo sapiens
aagattgatagaaaatc

SEQ ID NO: 5100710 - DNA, 21 bp, Homo sapiens
aagattgatatctataaaata

SEQ ID NO: 5100711 - DNA, 17 bp, Homo sapiens
aagattgatcattttta

SEQ ID NO: 5100712 - DNA, 16 bp, Homo sapiens
aagattgctgaaattt

SEQ ID NO: 5100713 - DNA, 19 bp, Homo sapiens
aagattgcttaataaattg

SEQ ID NO: 5100714 - DNA, 20 bp, Homo sapiens
aagattggaaagacaggaag

SEQ ID NO: 5100715 - DNA, 13 bp, Homo sapiens
aagattggaaatg

SEQ ID NO: 5100716 - DNA, 17 bp, Homo sapiens
aagattggtgttttttt

SEQ ID NO: 5100717 - DNA, 19 bp, Homo sapiens
aagattggtgtttttttct

SEQ ID NO: 5100718 - DNA, 23 bp, Homo sapiens
aagattggtgtttttttctatgg

SEQ ID NO: 5100719 - DNA, 21 bp, Homo sapiens
aagattggtttaaaaagaaaa

SEQ ID NO: 5100720 - DNA, 17 bp, Homo sapiens
aagattgtcattagtga

SEQ ID NO: 5100721 - DNA, 20 bp, Homo sapiens
aagattgtgggggaaaaata

SEQ ID NO: 5100722 - DNA, 21 bp, Homo sapiens
aagattgtgtcccattccccc

SEQ ID NO: 5100723 - DNA, 23 bp, Homo sapiens
aagattgttgataggaactgtct

SEQ ID NO: 5100724 - DNA, 22 bp, Homo sapiens
aagattgttggcagtttcctcc

SEQ ID NO: 5100725 - DNA, 13 bp, Homo sapiens
aagattgtttatc

SEQ ID NO: 5100726 - DNA, 22 bp, Homo sapiens
aagattgtttatctagatgtaa

SEQ ID NO: 5100727 - DNA, 21 bp, Homo sapiens
aagatttaaagtattttaatt

SEQ ID NO: 5100728 - DNA, 14 bp, Homo sapiens
aagatttaacacta

SEQ ID NO: 5100729 - DNA, 13 bp, Homo sapiens
aagatttaatatt

SEQ ID NO: 5100730 - DNA, 14 bp, Homo sapiens
aagatttacattcc

SEQ ID NO: 5100731 - DNA, 16 bp, Homo sapiens
aagatttaccacttgt

SEQ ID NO: 5100732 - DNA, 22 bp, Homo sapiens
aagatttaccttttctgttgta

SEQ ID NO: 5100733 - DNA, 13 bp, Homo sapiens
aagatttactgct

SEQ ID NO: 5100734 - DNA, 13 bp, Homo sapiens
aagatttagaaaa

SEQ ID NO: 5100735 - DNA, 17 bp, Homo sapiens
aagatttagatgttttc

SEQ ID NO: 5100736 - DNA, 15 bp, Homo sapiens
aagatttatctgcaa

SEQ ID NO: 5100737 - DNA, 14 bp, Homo sapiens
aagatttatctgga

SEQ ID NO: 5100738 - DNA, 22 bp, Homo sapiens
aagatttatgaacagaaatatt

SEQ ID NO: 5100739 - DNA, 15 bp, Homo sapiens
aagatttcagtagaa

SEQ ID NO: 5100740 - DNA, 18 bp, Homo sapiens
aagatttcatgacgaaga

SEQ ID NO: 5100741 - DNA, 17 bp, Homo sapiens
aagatttccatttgtca

SEQ ID NO: 5100742 - DNA, 16 bp, Homo sapiens
aagatttcctactttc

SEQ ID NO: 5100743 - DNA, 18 bp, Homo sapiens
aagatttccttaaaatct

SEQ ID NO: 5100744 - DNA, 22 bp, Homo sapiens
aagatttccttctttttttctt

SEQ ID NO: 5100745 - DNA, 22 bp, Homo sapiens
aagatttcctttctgtggtgag

SEQ ID NO: 5100746 - DNA, 15 bp, Homo sapiens
aagatttctctaata

SEQ ID NO: 5100747 - DNA, 19 bp, Homo sapiens
aagatttctgctccaaatt

SEQ ID NO: 5100748 - DNA, 14 bp, Homo sapiens
aagatttgaccaaa

SEQ ID NO: 5100749 - DNA, 20 bp, Homo sapiens
aagatttgacgttgttgtca

SEQ ID NO: 5100750 - DNA, 23 bp, Homo sapiens
aagatttgatgctggagaggtta

SEQ ID NO: 5100751 - DNA, 21 bp, Homo sapiens
aagatttgatgggccacaact

SEQ ID NO: 5100752 - DNA, 17 bp, Homo sapiens
aagatttgtaattacag

SEQ ID NO: 5100753 - DNA, 14 bp, Homo sapiens
aagcccagttcatc

SEQ ID NO: 5100754 - DNA, 14 bp, Homo sapiens
aagcccatcctgac

SEQ ID NO: 5100755 - DNA, 18 bp, Homo sapiens
aagcccatgtcttctgct

SEQ ID NO: 5100756 - DNA, 19 bp, Homo sapiens
aagcccattcctctgccag

SEQ ID NO: 5100757 - DNA, 21 bp, Homo sapiens
aagcccattttcaactgcttt

SEQ ID NO: 5100758 - DNA, 22 bp, Homo sapiens
aagcccattttcaactgctttg

SEQ ID NO: 5100759 - DNA, 21 bp, Homo sapiens
aagccccaacgggaaaggaaa

SEQ ID NO: 5100760 - DNA, 13 bp, Homo sapiens
aagccccacatgt

SEQ ID NO: 5100761 - DNA, 16 bp, Homo sapiens
aagccccacatgtcca

SEQ ID NO: 5100762 - DNA, 16 bp, Homo sapiens
aagccccacccaggcc

SEQ ID NO: 5100763 - DNA, 17 bp, Homo sapiens
aagccccacccaggcca

SEQ ID NO: 5100764 - DNA, 18 bp, Homo sapiens
aagccccagcttggctca

SEQ ID NO: 5100765 - DNA, 17 bp, Homo sapiens
aagccccaggcaggctg

SEQ ID NO: 5100766 - DNA, 21 bp, Homo sapiens
aagccccaggcaggctgtgcg

SEQ ID NO: 5100767 - DNA, 17 bp, Homo sapiens
aagccccagggcctggg

SEQ ID NO: 5100768 - DNA, 19 bp, Homo sapiens
aagccccatgctggagcct

SEQ ID NO: 5100769 - DNA, 21 bp, Homo sapiens
aagccccatgctggagcctgt

SEQ ID NO: 5100770 - DNA, 23 bp, Homo sapiens
aagccccatgctggagcctgtgt

SEQ ID NO: 5100771 - DNA, 21 bp, Homo sapiens
aagccccattcacggcctggc

SEQ ID NO: 5100772 - DNA, 22 bp, Homo sapiens
aagccccattcacggcctggca

SEQ ID NO: 5100773 - DNA, 23 bp, Homo sapiens
aagccccattcacggcctggcat

SEQ ID NO: 5100774 - DNA, 20 bp, Homo sapiens
aagcccccacttctctccag

SEQ ID NO: 5100775 - DNA, 15 bp, Homo sapiens
aagcccccagagccc

SEQ ID NO: 5100776 - DNA, 17 bp, Homo sapiens
aagcccccagagcccag

SEQ ID NO: 5100777 - DNA, 16 bp, Homo sapiens
aagcccccagctaaga

SEQ ID NO: 5100778 - DNA, 21 bp, Homo sapiens
aagcccccagctaagaacctg

SEQ ID NO: 5100779 - DNA, 18 bp, Homo sapiens
aagcccccagggcctcca

SEQ ID NO: 5100780 - DNA, 19 bp, Homo sapiens
aagccccccacctttctcg

SEQ ID NO: 5100781 - DNA, 17 bp, Homo sapiens
aagccccctcttcctcc

SEQ ID NO: 5100782 - DNA, 18 bp, Homo sapiens
aagccccctcttgagagg

SEQ ID NO: 5100783 - DNA, 20 bp, Homo sapiens
aagccccctggcagctgccc

SEQ ID NO: 5100784 - DNA, 14 bp, Homo sapiens
aagccccctttgat

SEQ ID NO: 5100785 - DNA, 15 bp, Homo sapiens
aagccccctttgatt

SEQ ID NO: 5100786 - DNA, 13 bp, Homo sapiens
aagccccgacaca

SEQ ID NO: 5100787 - DNA, 20 bp, Homo sapiens
aagccccgtctgaccccagc

SEQ ID NO: 5100788 - DNA, 21 bp, Homo sapiens
aagccccgtctgaccccagcc

SEQ ID NO: 5100789 - DNA, 22 bp, Homo sapiens
aagcccctagtcttagagatac

SEQ ID NO: 5100790 - DNA, 15 bp, Homo sapiens
aagcccctcagccct

SEQ ID NO: 5100791 - DNA, 19 bp, Homo sapiens
aagcccctcagcccttgcc

SEQ ID NO: 5100792 - DNA, 18 bp, Homo sapiens
aagcccctgcccctcctc

SEQ ID NO: 5100793 - DNA, 15 bp, Homo sapiens
aagcccctgccctgg

SEQ ID NO: 5100794 - DNA, 18 bp, Homo sapiens
aagcccctgccctgggga

SEQ ID NO: 5100795 - DNA, 23 bp, Homo sapiens
aagcccctgccctggggagaaag

SEQ ID NO: 5100796 - DNA, 12 bp, Homo sapiens
aagcccctggaa

SEQ ID NO: 5100797 - DNA, 20 bp, Homo sapiens
aagcccctgtcgcccaccca

SEQ ID NO: 5100798 - DNA, 20 bp, Homo sapiens
aagcccctgtgaccctctca

SEQ ID NO: 5100799 - DNA, 13 bp, Homo sapiens
aagccccttctct

SEQ ID NO: 5100800 - DNA, 15 bp, Homo sapiens
aagccccttctctca

SEQ ID NO: 5100801 - DNA, 16 bp, Homo sapiens
aagccccttctctcaa

SEQ ID NO: 5100802 - DNA, 18 bp, Homo sapiens
aagccccttgtcctctcc

SEQ ID NO: 5100803 - DNA, 20 bp, Homo sapiens
aagccccttgtcctctcccg

SEQ ID NO: 5100804 - DNA, 22 bp, Homo sapiens
aagcccggctcctggtcaccta

SEQ ID NO: 5100805 - DNA, 17 bp, Homo sapiens
aagccctaactcagcca

SEQ ID NO: 5100806 - DNA, 16 bp, Homo sapiens
aagccctacagagctg

SEQ ID NO: 5100807 - DNA, 19 bp, Homo sapiens
aagccctatgtgaaaagat

SEQ ID NO: 5100808 - DNA, 21 bp, Homo sapiens
aagccctcaaagaagtcggaa

SEQ ID NO: 5100809 - DNA, 20 bp, Homo sapiens
aagccctcagatcccagggt

SEQ ID NO: 5100810 - DNA, 21 bp, Homo sapiens
aagccctccctgtctgtctgt

SEQ ID NO: 5100811 - DNA, 13 bp, Homo sapiens
aagccctcttcag

SEQ ID NO: 5100812 - DNA, 23 bp, Homo sapiens
aagccctcttcaggggtcacctc

SEQ ID NO: 5100813 - DNA, 13 bp, Homo sapiens
aagccctcttcca

SEQ ID NO: 5100814 - DNA, 21 bp, Homo sapiens
aagccctcttccatcatgtcc

SEQ ID NO: 5100815 - DNA, 22 bp, Homo sapiens
aagccctgaatttcttcttttc

SEQ ID NO: 5100816 - DNA, 17 bp, Homo sapiens
aagccctgaggcctgag

SEQ ID NO: 5100817 - DNA, 13 bp, Homo sapiens
aagccctgcccac

SEQ ID NO: 5100818 - DNA, 14 bp, Homo sapiens
aagccctgcctctg

SEQ ID NO: 5100819 - DNA, 12 bp, Homo sapiens
aagccctgctct

SEQ ID NO: 5100820 - DNA, 17 bp, Homo sapiens
aagccctgctctttctc

SEQ ID NO: 5100821 - DNA, 18 bp, Homo sapiens
aagccctgctctttctct

SEQ ID NO: 5100822 - DNA, 13 bp, Homo sapiens
aagccctgctggg

SEQ ID NO: 5100823 - DNA, 15 bp, Homo sapiens
aagccctgcttgctg

SEQ ID NO: 5100824 - DNA, 19 bp, Homo sapiens
aagccctggagccaactgc

SEQ ID NO: 5100825 - DNA, 22 bp, Homo sapiens
aagccctggcccccacagcgct

SEQ ID NO: 5100826 - DNA, 18 bp, Homo sapiens
aagccctgtcgagacact

SEQ ID NO: 5100827 - DNA, 12 bp, Homo sapiens
aagccctgtgct

SEQ ID NO: 5100828 - DNA, 13 bp, Homo sapiens
aagccctgtgctt

SEQ ID NO: 5100829 - DNA, 21 bp, Homo sapiens
aagccctgttctcgttgccct

SEQ ID NO: 5100830 - DNA, 22 bp, Homo sapiens
aagccctgttgacacaggtctt

SEQ ID NO: 5100831 - DNA, 18 bp, Homo sapiens
aagccctgttgtgccaca

SEQ ID NO: 5100832 - DNA, 16 bp, Homo sapiens
aagcccttaataataa

SEQ ID NO: 5100833 - DNA, 16 bp, Homo sapiens
aagcccttagggagag

SEQ ID NO: 5100834 - DNA, 20 bp, Homo sapiens
aagcccttccatgtcgcctc

SEQ ID NO: 5100835 - DNA, 16 bp, Homo sapiens
aagcccttgcacagct

SEQ ID NO: 5100836 - DNA, 21 bp, Homo sapiens
aagcccttgcacagctggaga

SEQ ID NO: 5100837 - DNA, 22 bp, Homo sapiens
aagcccttgcacagctggagaa

SEQ ID NO: 5100838 - DNA, 21 bp, Homo sapiens
aagcccttggaacaccctgga

SEQ ID NO: 5100839 - DNA, 23 bp, Homo sapiens
aagcccttggaacaccctggatg

SEQ ID NO: 5100840 - DNA, 12 bp, Homo sapiens
aagccctttgcc

SEQ ID NO: 5100841 - DNA, 22 bp, Homo sapiens
aagccctttgcctgtagagcca

SEQ ID NO: 5100842 - DNA, 15 bp, Homo sapiens
aagccctttgctctg

SEQ ID NO: 5100843 - DNA, 16 bp, Homo sapiens
aagccctttgctctgg

SEQ ID NO: 5100844 - DNA, 16 bp, Homo sapiens
aagccctttgctgttc

SEQ ID NO: 5100845 - DNA, 15 bp, Homo sapiens
aagccgaccttccct

SEQ ID NO: 5100846 - DNA, 18 bp, Homo sapiens
aagccgactctggccctg

SEQ ID NO: 5100847 - DNA, 17 bp, Homo sapiens
aagccgagagccttttg

SEQ ID NO: 5100848 - DNA, 13 bp, Homo sapiens
aagccgaggaggc

SEQ ID NO: 5100849 - DNA, 16 bp, Homo sapiens
aagccgcagacctgga

SEQ ID NO: 5100850 - DNA, 18 bp, Homo sapiens
aagccggacacggcttca

SEQ ID NO: 5100851 - DNA, 14 bp, Homo sapiens
aagccggacagctg

SEQ ID NO: 5100852 - DNA, 22 bp, Homo sapiens
aagccggacagctgcccagaca

SEQ ID NO: 5100853 - DNA, 18 bp, Homo sapiens
aagccggcggagctctgg

SEQ ID NO: 5100854 - DNA, 22 bp, Homo sapiens
aagccggcggagctctggcttt

SEQ ID NO: 5100855 - DNA, 14 bp, Homo sapiens
aagccggcggccca

SEQ ID NO: 5100856 - DNA, 14 bp, Homo sapiens
aagccgggagccaa

SEQ ID NO: 5100857 - DNA, 16 bp, Homo sapiens
aagccgggggaggggc

SEQ ID NO: 5100858 - DNA, 23 bp, Homo sapiens
aagccggggtgtaacttcctgct

SEQ ID NO: 5100859 - DNA, 13 bp, Homo sapiens
aagccggtgccca

SEQ ID NO: 5100860 - DNA, 14 bp, Homo sapiens
aagccggtgggcta

SEQ ID NO: 5100861 - DNA, 22 bp, Homo sapiens
aagccggttgcagagaatctgt

SEQ ID NO: 5100862 - DNA, 16 bp, Homo sapiens
aagccgtctgactcca

SEQ ID NO: 5100863 - DNA, 18 bp, Homo sapiens
aagccgtctgactccaga

SEQ ID NO: 5100864 - DNA, 19 bp, Homo sapiens
aagccgtctgactccagag

SEQ ID NO: 5100865 - DNA, 22 bp, Homo sapiens
aagccgtgctcgccccagcagg

SEQ ID NO: 5100866 - DNA, 13 bp, Homo sapiens
aagccgtggccgg

SEQ ID NO: 5100867 - DNA, 14 bp, Homo sapiens
aagccgtggcttcc

SEQ ID NO: 5100868 - DNA, 16 bp, Homo sapiens
aagccgtgttttatga

SEQ ID NO: 5100869 - DNA, 18 bp, Homo sapiens
aagccgttgaatctggga

SEQ ID NO: 5100870 - DNA, 20 bp, Homo sapiens
aagccgttgaatctgggagg

SEQ ID NO: 5100871 - DNA, 16 bp, Homo sapiens
aagcctaaatgcctta

SEQ ID NO: 5100872 - DNA, 23 bp, Homo sapiens
aagcctaaatgccttagaaatgt

SEQ ID NO: 5100873 - DNA, 14 bp, Homo sapiens
aagcctaaatttgt

SEQ ID NO: 5100874 - DNA, 15 bp, Homo sapiens
aagcctaaatttgtg

SEQ ID NO: 5100875 - DNA, 13 bp, Homo sapiens
aagcctaagaaaa

SEQ ID NO: 5100876 - DNA, 14 bp, Homo sapiens
aagcctaagaaaaa

SEQ ID NO: 5100877 - DNA, 21 bp, Homo sapiens
aagcctacccgactctattta

SEQ ID NO: 5100878 - DNA, 21 bp, Homo sapiens
aagcctagacaacctttctgt

SEQ ID NO: 5100879 - DNA, 23 bp, Homo sapiens
aagcctagacaacctttctgtag

SEQ ID NO: 5100880 - DNA, 18 bp, Homo sapiens
aagcctagatgttttata

SEQ ID NO: 5100881 - DNA, 16 bp, Homo sapiens
aagcctaggccgccct

SEQ ID NO: 5100882 - DNA, 23 bp, Homo sapiens
aagcctatttttatatttttaaa

SEQ ID NO: 5100883 - DNA, 21 bp, Homo sapiens
aagcctcacacgtaaaagaaa

SEQ ID NO: 5100884 - DNA, 15 bp, Homo sapiens
aagcctcagaggcct

SEQ ID NO: 5100885 - DNA, 11 bp, Homo sapiens
aagcctcaggc

SEQ ID NO: 5100886 - DNA, 14 bp, Homo sapiens
aagcctcaggcctg

SEQ ID NO: 5100887 - DNA, 14 bp, Homo sapiens
aagcctcagtccct

SEQ ID NO: 5100888 - DNA, 23 bp, Homo sapiens
aagcctcagtccctccctcctgg

SEQ ID NO: 5100889 - DNA, 23 bp, Homo sapiens
aagcctcatacgtttaaaataaa

SEQ ID NO: 5100890 - DNA, 18 bp, Homo sapiens
aagcctcatattttctgt

SEQ ID NO: 5100891 - DNA, 18 bp, Homo sapiens
aagcctccaagcacagag

SEQ ID NO: 5100892 - DNA, 19 bp, Homo sapiens
aagcctccaagcctgcctc

SEQ ID NO: 5100893 - DNA, 22 bp, Homo sapiens
aagcctccacctgcagccccag

SEQ ID NO: 5100894 - DNA, 16 bp, Homo sapiens
aagcctcccacgactg

SEQ ID NO: 5100895 - DNA, 19 bp, Homo sapiens
aagcctccgcctgctgtgt

SEQ ID NO: 5100896 - DNA, 15 bp, Homo sapiens
aagcctcctccagcc

SEQ ID NO: 5100897 - DNA, 18 bp, Homo sapiens
aagcctccttacattaaa

SEQ ID NO: 5100898 - DNA, 19 bp, Homo sapiens
aagcctccttagaaaaaaa

SEQ ID NO: 5100899 - DNA, 15 bp, Homo sapiens
aagcctctaaacaga

SEQ ID NO: 5100900 - DNA, 17 bp, Homo sapiens
aagcctctaacaaatga

SEQ ID NO: 5100901 - DNA, 15 bp, Homo sapiens
aagcctctctctccc

SEQ ID NO: 5100902 - DNA, 13 bp, Homo sapiens
aagcctctgccct

SEQ ID NO: 5100903 - DNA, 17 bp, Homo sapiens
aagcctctgccctgcct

SEQ ID NO: 5100904 - DNA, 19 bp, Homo sapiens
aagcctctgcctccctagc

SEQ ID NO: 5100905 - DNA, 19 bp, Homo sapiens
aagcctctggccgtcacac

SEQ ID NO: 5100906 - DNA, 12 bp, Homo sapiens
aagcctctggct

SEQ ID NO: 5100907 - DNA, 14 bp, Homo sapiens
aagcctctggctag

SEQ ID NO: 5100908 - DNA, 12 bp, Homo sapiens
aagcctctgtcc

SEQ ID NO: 5100909 - DNA, 14 bp, Homo sapiens
aagcctctgtcttt

SEQ ID NO: 5100910 - DNA, 17 bp, Homo sapiens
aagcctctgtcttttct

SEQ ID NO: 5100911 - DNA, 18 bp, Homo sapiens
aagcctctgtgtcactgg

SEQ ID NO: 5100912 - DNA, 21 bp, Homo sapiens
aagcctctgtgtcactggctg

SEQ ID NO: 5100913 - DNA, 24 bp, Homo sapiens
aagcctctgtgtcactggctgcct

SEQ ID NO: 5100914 - DNA, 16 bp, Homo sapiens
aagcctcttatttttc

SEQ ID NO: 5100915 - DNA, 12 bp, Homo sapiens
aagcctctttct

SEQ ID NO: 5100916 - DNA, 21 bp, Homo sapiens
aagcctgaaaattccaatttg

SEQ ID NO: 5100917 - DNA, 16 bp, Homo sapiens
aagcctgaactattta

SEQ ID NO: 5100918 - DNA, 19 bp, Homo sapiens
aagcctgaactgaggcctt

SEQ ID NO: 5100919 - DNA, 11 bp, Homo sapiens
aagcctgaagg

SEQ ID NO: 5100920 - DNA, 15 bp, Homo sapiens
aagcctgactgctcg

SEQ ID NO: 5100921 - DNA, 22 bp, Homo sapiens
aagcctgactgctcggtcagga

SEQ ID NO: 5100922 - DNA, 20 bp, Homo sapiens
aagcctgacttcacatctgc

SEQ ID NO: 5100923 - DNA, 23 bp, Homo sapiens
aagcctgactttggggacaccct

SEQ ID NO: 5100924 - DNA, 17 bp, Homo sapiens
aagcctgagcaggcagg

SEQ ID NO: 5100925 - DNA, 21 bp, Homo sapiens
aagcctgagggaaaggccagc

SEQ ID NO: 5100926 - DNA, 23 bp, Homo sapiens
aagcctgatactttagccatcat

SEQ ID NO: 5100927 - DNA, 13 bp, Homo sapiens
aagcctgatccag

SEQ ID NO: 5100928 - DNA, 22 bp, Homo sapiens
aagcctgcacaataaaaatgtt

SEQ ID NO: 5100929 - DNA, 23 bp, Homo sapiens
aagcctgcaggtccggggaggag

SEQ ID NO: 5100930 - DNA, 14 bp, Homo sapiens
aagatttgtacata

SEQ ID NO: 5100931 - DNA, 16 bp, Homo sapiens
aagatttgtacatatt

SEQ ID NO: 5100932 - DNA, 18 bp, Homo sapiens
aagatttgtacatattat

SEQ ID NO: 5100933 - DNA, 16 bp, Homo sapiens
aagatttgtgaactgg

SEQ ID NO: 5100934 - DNA, 19 bp, Homo sapiens
aagatttgtgaactggaag

SEQ ID NO: 5100935 - DNA, 20 bp, Homo sapiens
aagatttgttactgtatttt

SEQ ID NO: 5100936 - DNA, 21 bp, Homo sapiens
aagatttgttgacagcaaaat

SEQ ID NO: 5100937 - DNA, 16 bp, Homo sapiens
aagatttgtttttaaa

SEQ ID NO: 5100938 - DNA, 17 bp, Homo sapiens
aagatttgtttttaaac

SEQ ID NO: 5100939 - DNA, 23 bp, Homo sapiens
aagatttgtttttaaactgtaca

SEQ ID NO: 5100940 - DNA, 13 bp, Homo sapiens
aagattttaaatt

SEQ ID NO: 5100941 - DNA, 18 bp, Homo sapiens
aagattttaatcaagttg

SEQ ID NO: 5100942 - DNA, 15 bp, Homo sapiens
aagattttatgtgct

SEQ ID NO: 5100943 - DNA, 23 bp, Homo sapiens
aagattttattgtataaaaagtt

SEQ ID NO: 5100944 - DNA, 13 bp, Homo sapiens
aagattttattta

SEQ ID NO: 5100945 - DNA, 20 bp, Homo sapiens
aagattttcctattccttgg

SEQ ID NO: 5100946 - DNA, 15 bp, Homo sapiens
aagattttctttctc

SEQ ID NO: 5100947 - DNA, 12 bp, Homo sapiens
aagattttgaaa

SEQ ID NO: 5100948 - DNA, 21 bp, Homo sapiens
aagattttgatctcacatttt

SEQ ID NO: 5100949 - DNA, 17 bp, Homo sapiens
aagattttgtcaaaaac

SEQ ID NO: 5100950 - DNA, 15 bp, Homo sapiens
aagattttgtgaaat

SEQ ID NO: 5100951 - DNA, 19 bp, Homo sapiens
aagatttttactaatatat

SEQ ID NO: 5100952 - DNA, 22 bp, Homo sapiens
aagatttttactaatatatatt

SEQ ID NO: 5100953 - DNA, 15 bp, Homo sapiens
aagatttttctcaaa

SEQ ID NO: 5100954 - DNA, 19 bp, Homo sapiens
aagatttttgtaaaaagct

SEQ ID NO: 5100955 - DNA, 14 bp, Homo sapiens
aagattttttaata

SEQ ID NO: 5100956 - DNA, 16 bp, Homo sapiens
aagattttttaataat

SEQ ID NO: 5100957 - DNA, 19 bp, Homo sapiens
aagattttttaattgttta

SEQ ID NO: 5100958 - DNA, 20 bp, Homo sapiens
aagattttttaattgtttaa

SEQ ID NO: 5100959 - DNA, 17 bp, Homo sapiens
aagattttttcatttca

SEQ ID NO: 5100960 - DNA, 13 bp, Homo sapiens
aagatttttttcc

SEQ ID NO: 5100961 - DNA, 15 bp, Homo sapiens
aagatttttttcctg

SEQ ID NO: 5100962 - DNA, 14 bp, Homo sapiens
aagattttttttgt

SEQ ID NO: 5100963 - DNA, 16 bp, Homo sapiens
aagattttttttgtaa

SEQ ID NO: 5100964 - DNA, 19 bp, Homo sapiens
aagattttttttgtaactt

SEQ ID NO: 5100965 - DNA, 20 bp, Homo sapiens
aagattttttttgtaacttc

SEQ ID NO: 5100966 - DNA, 16 bp, Homo sapiens
aagcaaaaaacttcaa

SEQ ID NO: 5100967 - DNA, 22 bp, Homo sapiens
aagcaaaaaacttcaacatgca

SEQ ID NO: 5100968 - DNA, 15 bp, Homo sapiens
aagcaaaaaataaaa

SEQ ID NO: 5100969 - DNA, 17 bp, Homo sapiens
aagcaaaaaataaaata

SEQ ID NO: 5100970 - DNA, 23 bp, Homo sapiens
aagcaaaaacaaaccatgactga

SEQ ID NO: 5100971 - DNA, 18 bp, Homo sapiens
aagcaaaaacgaaagctg

SEQ ID NO: 5100972 - DNA, 14 bp, Homo sapiens
aagcaaaaactacc

SEQ ID NO: 5100973 - DNA, 17 bp, Homo sapiens
aagcaaaaactcttgtg

SEQ ID NO: 5100974 - DNA, 15 bp, Homo sapiens
aagcaaaaagatgta

SEQ ID NO: 5100975 - DNA, 18 bp, Homo sapiens
aagcaaaaagatgtatat

SEQ ID NO: 5100976 - DNA, 13 bp, Homo sapiens
aagcaaaaatgct

SEQ ID NO: 5100977 - DNA, 16 bp, Homo sapiens
aagcaaaaatgctaat

SEQ ID NO: 5100978 - DNA, 12 bp, Homo sapiens
aagcaaaacagt

SEQ ID NO: 5100979 - DNA, 15 bp, Homo sapiens
aagcaaaacattttg

SEQ ID NO: 5100980 - DNA, 14 bp, Homo sapiens
aagcaaaactcact

SEQ ID NO: 5100981 - DNA, 11 bp, Homo sapiens
aagcaaaagaa

SEQ ID NO: 5100982 - DNA, 14 bp, Homo sapiens
aagcaaaagaaaaa

SEQ ID NO: 5100983 - DNA, 13 bp, Homo sapiens
aagcaaaagagaa

SEQ ID NO: 5100984 - DNA, 20 bp, Homo sapiens
aagcaaaaggctgagaagga

SEQ ID NO: 5100985 - DNA, 21 bp, Homo sapiens
aagcaaaaggctgagaaggaa

SEQ ID NO: 5100986 - DNA, 22 bp, Homo sapiens
aagcaaaagtaatcacttaaag

SEQ ID NO: 5100987 - DNA, 15 bp, Homo sapiens
aagcaaaataaaaac

SEQ ID NO: 5100988 - DNA, 16 bp, Homo sapiens
aagcaaaataaaaact

SEQ ID NO: 5100989 - DNA, 15 bp, Homo sapiens
aagcaaaatagtatt

SEQ ID NO: 5100990 - DNA, 14 bp, Homo sapiens
aagcaaaatattat

SEQ ID NO: 5100991 - DNA, 23 bp, Homo sapiens
aagcaaaatcattttatatgtca

SEQ ID NO: 5100992 - DNA, 15 bp, Homo sapiens
aagcaaaatctaaaa

SEQ ID NO: 5100993 - DNA, 20 bp, Homo sapiens
aagcaaaatctaaaatgttt

SEQ ID NO: 5100994 - DNA, 22 bp, Homo sapiens
aagcaaaattatagaagtttag

SEQ ID NO: 5100995 - DNA, 15 bp, Homo sapiens
aagcaaaatttctgt

SEQ ID NO: 5100996 - DNA, 23 bp, Homo sapiens
aagcaaacacacagactctgtga

SEQ ID NO: 5100997 - DNA, 14 bp, Homo sapiens
aagcaaacatcaaa

SEQ ID NO: 5100998 - DNA, 18 bp, Homo sapiens
aagcaaacatcaaataaa

SEQ ID NO: 5100999 - DNA, 16 bp, Homo sapiens
aagcaaactgaaatta

SEQ ID NO: 5101000 - DNA, 21 bp, Homo sapiens
aagcaaactggggctgtgttt

SEQ ID NO: 5101001 - DNA, 23 bp, Homo sapiens
aagcaaacttacaggtcctgctg

SEQ ID NO: 5101002 - DNA, 13 bp, Homo sapiens
aagcaaagaaaat

SEQ ID NO: 5101003 - DNA, 12 bp, Homo sapiens
aagcaaagacaa

SEQ ID NO: 5101004 - DNA, 15 bp, Homo sapiens
aagcaaagacagttt

SEQ ID NO: 5101005 - DNA, 18 bp, Homo sapiens
aagcaaagacagtttctt

SEQ ID NO: 5101006 - DNA, 20 bp, Homo sapiens
aagcaaagacagtttcttgc

SEQ ID NO: 5101007 - DNA, 13 bp, Homo sapiens
aagcaaagatgca

SEQ ID NO: 5101008 - DNA, 19 bp, Homo sapiens
aagcaaagatttcagtaga

SEQ ID NO: 5101009 - DNA, 22 bp, Homo sapiens
aagcaaagatttcagtagaatt

SEQ ID NO: 5101010 - DNA, 12 bp, Homo sapiens
aagcaaagcaca

SEQ ID NO: 5101011 - DNA, 17 bp, Homo sapiens
aagcaaagcaccagctt

SEQ ID NO: 5101012 - DNA, 17 bp, Homo sapiens
aagcaaagccacatttt

SEQ ID NO: 5101013 - DNA, 16 bp, Homo sapiens
aagcaaaggaaaccaa

SEQ ID NO: 5101014 - DNA, 14 bp, Homo sapiens
aagcaaaggcagtc

SEQ ID NO: 5101015 - DNA, 14 bp, Homo sapiens
aagcaaagggctcc

SEQ ID NO: 5101016 - DNA, 12 bp, Homo sapiens
aagcaaagggga

SEQ ID NO: 5101017 - DNA, 17 bp, Homo sapiens
aagcaaaggggggaggt

SEQ ID NO: 5101018 - DNA, 20 bp, Homo sapiens
aagcaaagtattgtgaaagt

SEQ ID NO: 5101019 - DNA, 22 bp, Homo sapiens
aagcaaagtgctttgacttctt

SEQ ID NO: 5101020 - DNA, 16 bp, Homo sapiens
aagcaaataaatatca

SEQ ID NO: 5101021 - DNA, 21 bp, Homo sapiens
aagcaaatactgattttcaaa

SEQ ID NO: 5101022 - DNA, 13 bp, Homo sapiens
aagcaaatactta

SEQ ID NO: 5101023 - DNA, 23 bp, Homo sapiens
aagcaaatacttagcaaaaagtg

SEQ ID NO: 5101024 - DNA, 22 bp, Homo sapiens
aagcaaatatatttaggccagg

SEQ ID NO: 5101025 - DNA, 21 bp, Homo sapiens
aagcaaatatttatgacctca

SEQ ID NO: 5101026 - DNA, 19 bp, Homo sapiens
aagcaaatcagaaaaccca

SEQ ID NO: 5101027 - DNA, 14 bp, Homo sapiens
aagcaaatcagaca

SEQ ID NO: 5101028 - DNA, 16 bp, Homo sapiens
aagcaaatcagacaca

SEQ ID NO: 5101029 - DNA, 19 bp, Homo sapiens
aagcaaatcatttgtttaa

SEQ ID NO: 5101030 - DNA, 19 bp, Homo sapiens
aagcaaatcccatttcttg

SEQ ID NO: 5101031 - DNA, 15 bp, Homo sapiens
aagcaaatctacaga

SEQ ID NO: 5101032 - DNA, 19 bp, Homo sapiens
aagcaaatggaaaatgtat

SEQ ID NO: 5101033 - DNA, 23 bp, Homo sapiens
aagcaaatggatggggataagaa

SEQ ID NO: 5101034 - DNA, 21 bp, Homo sapiens
aagcaaatgtcatgctgcctt

SEQ ID NO: 5101035 - DNA, 12 bp, Homo sapiens
aagcaaatgtct

SEQ ID NO: 5101036 - DNA, 14 bp, Homo sapiens
aagcaaatgtgaat

SEQ ID NO: 5101037 - DNA, 14 bp, Homo sapiens
aagcaaatgttaca

SEQ ID NO: 5101038 - DNA, 17 bp, Homo sapiens
aagcaaattgctttttt

SEQ ID NO: 5101039 - DNA, 19 bp, Homo sapiens
aagcaaattgtttcagttt

SEQ ID NO: 5101040 - DNA, 14 bp, Homo sapiens
aagcaaatttcatt

SEQ ID NO: 5101041 - DNA, 23 bp, Homo sapiens
aagcaaatttcattatctaatga

SEQ ID NO: 5101042 - DNA, 12 bp, Homo sapiens
aagcaaattttg

SEQ ID NO: 5101043 - DNA, 22 bp, Homo sapiens
aagcaacaaattaactagatac

SEQ ID NO: 5101044 - DNA, 16 bp, Homo sapiens
aagcaacaagctattt

SEQ ID NO: 5101045 - DNA, 13 bp, Homo sapiens
aagcaacaatttt

SEQ ID NO: 5101046 - DNA, 17 bp, Homo sapiens
aagcaacaattttcaga

SEQ ID NO: 5101047 - DNA, 18 bp, Homo sapiens
aagcaacaattttcagat

SEQ ID NO: 5101048 - DNA, 20 bp, Homo sapiens
aagcaacaattttcagattt

SEQ ID NO: 5101049 - DNA, 23 bp, Homo sapiens
aagcaacacttggaacagtgttt

SEQ ID NO: 5101050 - DNA, 20 bp, Homo sapiens
aagcaacagcctttgaatgt

SEQ ID NO: 5101051 - DNA, 13 bp, Homo sapiens
aagcaacagctgg

SEQ ID NO: 5101052 - DNA, 21 bp, Homo sapiens
aagcaacattttatttaagaa

SEQ ID NO: 5101053 - DNA, 15 bp, Homo sapiens
aagcaaccaaaaaga

SEQ ID NO: 5101054 - DNA, 19 bp, Homo sapiens
aagcaaccacactgcttgg

SEQ ID NO: 5101055 - DNA, 19 bp, Homo sapiens
aagcaaccatatagaaagc

SEQ ID NO: 5101056 - DNA, 18 bp, Homo sapiens
aagcaacctcagtaattt

SEQ ID NO: 5101057 - DNA, 19 bp, Homo sapiens
aagcaacctcagtaattta

SEQ ID NO: 5101058 - DNA, 22 bp, Homo sapiens
aagcaacctcagtaatttagaa

SEQ ID NO: 5101059 - DNA, 22 bp, Homo sapiens
aagcaacctgggtccaaataaa

SEQ ID NO: 5101060 - DNA, 18 bp, Homo sapiens
aagcaaccttaaagcaat

SEQ ID NO: 5101061 - DNA, 20 bp, Homo sapiens
aagcaaccttaaagcaataa

SEQ ID NO: 5101062 - DNA, 21 bp, Homo sapiens
aagcaaccttaaagcaataag

SEQ ID NO: 5101063 - DNA, 14 bp, Homo sapiens
aagcaacctttccc

SEQ ID NO: 5101064 - DNA, 20 bp, Homo sapiens
aagcaacgactactttgcta

SEQ ID NO: 5101065 - DNA, 14 bp, Homo sapiens
aagcaacgataaaa

SEQ ID NO: 5101066 - DNA, 20 bp, Homo sapiens
aagcaacgataaaattacaa

SEQ ID NO: 5101067 - DNA, 21 bp, Homo sapiens
aagcaacgataaaattacaaa

SEQ ID NO: 5101068 - DNA, 18 bp, Homo sapiens
aagcaactacaacttctc

SEQ ID NO: 5101069 - DNA, 22 bp, Homo sapiens
aagcaactcaagttataggaaa

SEQ ID NO: 5101070 - DNA, 23 bp, Homo sapiens
aagcaactgtctatttctgctga

SEQ ID NO: 5101071 - DNA, 18 bp, Homo sapiens
aagcaacttcatcccagc

SEQ ID NO: 5101072 - DNA, 19 bp, Homo sapiens
aagcaacttcatcccagct

SEQ ID NO: 5101073 - DNA, 17 bp, Homo sapiens
aagcaacttcatttgac

SEQ ID NO: 5101074 - DNA, 14 bp, Homo sapiens
aagcaagaaacagt

SEQ ID NO: 5101075 - DNA, 13 bp, Homo sapiens
aagcaagaaagag

SEQ ID NO: 5101076 - DNA, 23 bp, Homo sapiens
aagcaagaaagagggtcccaggg

SEQ ID NO: 5101077 - DNA, 17 bp, Homo sapiens
aagcaagaaagccgtac

SEQ ID NO: 5101078 - DNA, 17 bp, Homo sapiens
aagcaagaatcagagaa

SEQ ID NO: 5101079 - DNA, 18 bp, Homo sapiens
aagcaagacgtcctggaa

SEQ ID NO: 5101080 - DNA, 21 bp, Homo sapiens
aagcaagacgtcctggaatga

SEQ ID NO: 5101081 - DNA, 17 bp, Homo sapiens
aagcaagagagatgttt

SEQ ID NO: 5101082 - DNA, 18 bp, Homo sapiens
aagcaagagagatgtttt

SEQ ID NO: 5101083 - DNA, 23 bp, Homo sapiens
aagcaagaggcaagctgaaattt

SEQ ID NO: 5101084 - DNA, 15 bp, Homo sapiens
aagcaagatctacta

SEQ ID NO: 5101085 - DNA, 18 bp, Homo sapiens
aagcaagatgagctgtgc

SEQ ID NO: 5101086 - DNA, 15 bp, Homo sapiens
aagcaagattgaaat

SEQ ID NO: 5101087 - DNA, 12 bp, Homo sapiens
aagcaagcaaaa

SEQ ID NO: 5101088 - DNA, 14 bp, Homo sapiens
aagcaagcaagagg

SEQ ID NO: 5101089 - DNA, 21 bp, Homo sapiens
aagcaagcattcagaagaaaa

SEQ ID NO: 5101090 - DNA, 15 bp, Homo sapiens
aagcaagctcttctc

SEQ ID NO: 5101091 - DNA, 19 bp, Homo sapiens
aagcaagctgattaaatga

SEQ ID NO: 5101092 - DNA, 19 bp, Homo sapiens
aagcaagctgtgttacttg

SEQ ID NO: 5101093 - DNA, 16 bp, Homo sapiens
aagcaaggaaaactta

SEQ ID NO: 5101094 - DNA, 19 bp, Homo sapiens
aagcaaggcagaaggccag

SEQ ID NO: 5101095 - DNA, 15 bp, Homo sapiens
aagcaaggccagccc

SEQ ID NO: 5101096 - DNA, 17 bp, Homo sapiens
aagcaaggccagccctg

SEQ ID NO: 5101097 - DNA, 14 bp, Homo sapiens
aagcaaggcggtgg

SEQ ID NO: 5101098 - DNA, 21 bp, Homo sapiens
aagcaagggagaaaagagaaa

SEQ ID NO: 5101099 - DNA, 24 bp, Homo sapiens
aagcaagggggaaggctgcaaagt

SEQ ID NO: 5101100 - DNA, 20 bp, Homo sapiens
aagcaaggtgtccctgcctt

SEQ ID NO: 5101101 - DNA, 19 bp, Homo sapiens
aagcaagtaaaaaggctaa

SEQ ID NO: 5101102 - DNA, 20 bp, Homo sapiens
aagcaagtaaaaaggctaaa

SEQ ID NO: 5101103 - DNA, 22 bp, Homo sapiens
aagcaagtcccttcagactggc

SEQ ID NO: 5101104 - DNA, 12 bp, Homo sapiens
aagcaagtgaca

SEQ ID NO: 5101105 - DNA, 17 bp, Homo sapiens
aagcaagtggttgtttt

SEQ ID NO: 5101106 - DNA, 12 bp, Homo sapiens
aagcaagtgttg

SEQ ID NO: 5101107 - DNA, 15 bp, Homo sapiens
aagcaataaaactgc

SEQ ID NO: 5101108 - DNA, 12 bp, Homo sapiens
aagcctgcattc

SEQ ID NO: 5101109 - DNA, 21 bp, Homo sapiens
aagcctgccccggccactctg

SEQ ID NO: 5101110 - DNA, 15 bp, Homo sapiens
aagcctgcccttgtc

SEQ ID NO: 5101111 - DNA, 20 bp, Homo sapiens
aagcctgcccttgtctgaga

SEQ ID NO: 5101112 - DNA, 13 bp, Homo sapiens
aagcctgcctccc

SEQ ID NO: 5101113 - DNA, 20 bp, Homo sapiens
aagcctgcctcgccttgtgt

SEQ ID NO: 5101114 - DNA, 17 bp, Homo sapiens
aagcctgcctggaagag

SEQ ID NO: 5101115 - DNA, 15 bp, Homo sapiens
aagcctgctggctgc

SEQ ID NO: 5101116 - DNA, 15 bp, Homo sapiens
aagcctggaagccat

SEQ ID NO: 5101117 - DNA, 16 bp, Homo sapiens
aagcctggaagccatc

SEQ ID NO: 5101118 - DNA, 17 bp, Homo sapiens
aagcctggactctaagc

SEQ ID NO: 5101119 - DNA, 15 bp, Homo sapiens
aagcctggagcccct

SEQ ID NO: 5101120 - DNA, 16 bp, Homo sapiens
aagcctggagcccctg

SEQ ID NO: 5101121 - DNA, 15 bp, Homo sapiens
aagcctggaggacaa

SEQ ID NO: 5101122 - DNA, 18 bp, Homo sapiens
aagcctggagtaggcctg

SEQ ID NO: 5101123 - DNA, 22 bp, Homo sapiens
aagcctggatgccaaggagccc

SEQ ID NO: 5101124 - DNA, 13 bp, Homo sapiens
aagcctggcaccc

SEQ ID NO: 5101125 - DNA, 13 bp, Homo sapiens
aagcctggcaggg

SEQ ID NO: 5101126 - DNA, 11 bp, Homo sapiens
aagcctggccc

SEQ ID NO: 5101127 - DNA, 12 bp, Homo sapiens
aagcctggccct

SEQ ID NO: 5101128 - DNA, 19 bp, Homo sapiens
aagcctggcttagaaggca

SEQ ID NO: 5101129 - DNA, 21 bp, Homo sapiens
aagcctggcttgggttgaaaa

SEQ ID NO: 5101130 - DNA, 18 bp, Homo sapiens
aagcctgggcagaaatgt

SEQ ID NO: 5101131 - DNA, 19 bp, Homo sapiens
aagcctgggggcctggctg

SEQ ID NO: 5101132 - DNA, 23 bp, Homo sapiens
aagcctgggggcctggctggctg

SEQ ID NO: 5101133 - DNA, 20 bp, Homo sapiens
aagcctgggtgtcaagtgcc

SEQ ID NO: 5101134 - DNA, 22 bp, Homo sapiens
aagcctgggtttggtgtatggt

SEQ ID NO: 5101135 - DNA, 15 bp, Homo sapiens
aagcctggtttttct

SEQ ID NO: 5101136 - DNA, 18 bp, Homo sapiens
aagcctgtcccaggactc

SEQ ID NO: 5101137 - DNA, 15 bp, Homo sapiens
aagcctgtccccaga

SEQ ID NO: 5101138 - DNA, 16 bp, Homo sapiens
aagcctgtccccagac

SEQ ID NO: 5101139 - DNA, 23 bp, Homo sapiens
aagcctgtgaataaaaaccctgt

SEQ ID NO: 5101140 - DNA, 13 bp, Homo sapiens
aagcctgtgcaaa

SEQ ID NO: 5101141 - DNA, 18 bp, Homo sapiens
aagcctgtgcaaaaaaat

SEQ ID NO: 5101142 - DNA, 20 bp, Homo sapiens
aagcctgtgccacctgcaag

SEQ ID NO: 5101143 - DNA, 14 bp, Homo sapiens
aagcctgtgccagc

SEQ ID NO: 5101144 - DNA, 18 bp, Homo sapiens
aagcctgtgcctcccagc

SEQ ID NO: 5101145 - DNA, 14 bp, Homo sapiens
aagcctgtggatga

SEQ ID NO: 5101146 - DNA, 15 bp, Homo sapiens
aagcctgtggatgat

SEQ ID NO: 5101147 - DNA, 22 bp, Homo sapiens
aagcctgtggatgatcaatcct

SEQ ID NO: 5101148 - DNA, 18 bp, Homo sapiens
aagcctgttcccctcact

SEQ ID NO: 5101149 - DNA, 18 bp, Homo sapiens
aagcctgttgtttaagtg

SEQ ID NO: 5101150 - DNA, 22 bp, Homo sapiens
aagccttaagaagataaatgag

SEQ ID NO: 5101151 - DNA, 14 bp, Homo sapiens
aagccttaagccat

SEQ ID NO: 5101152 - DNA, 13 bp, Homo sapiens
aagccttacagtt

SEQ ID NO: 5101153 - DNA, 15 bp, Homo sapiens
aagccttactcacct

SEQ ID NO: 5101154 - DNA, 16 bp, Homo sapiens
aagccttactcacctc

SEQ ID NO: 5101155 - DNA, 17 bp, Homo sapiens
aagccttactcacctct

SEQ ID NO: 5101156 - DNA, 20 bp, Homo sapiens
aagccttataaaccaatctt

SEQ ID NO: 5101157 - DNA, 22 bp, Homo sapiens
aagccttatcaagtgtcttcca

SEQ ID NO: 5101158 - DNA, 13 bp, Homo sapiens
aagccttcaagct

SEQ ID NO: 5101159 - DNA, 15 bp, Homo sapiens
aagccttcatttgca

SEQ ID NO: 5101160 - DNA, 21 bp, Homo sapiens
aagccttccccttatcctccc

SEQ ID NO: 5101161 - DNA, 14 bp, Homo sapiens
aagccttctggatc

SEQ ID NO: 5101162 - DNA, 19 bp, Homo sapiens
aagccttctggatccatgg

SEQ ID NO: 5101163 - DNA, 19 bp, Homo sapiens
aagccttcttatatctgaa

SEQ ID NO: 5101164 - DNA, 16 bp, Homo sapiens
aagccttcttgctgcc

SEQ ID NO: 5101165 - DNA, 23 bp, Homo sapiens
aagccttgattggtgttgccagt

SEQ ID NO: 5101166 - DNA, 20 bp, Homo sapiens
aagccttgcactaggttgca

SEQ ID NO: 5101167 - DNA, 14 bp, Homo sapiens
aagccttgcccagc

SEQ ID NO: 5101168 - DNA, 21 bp, Homo sapiens
aagccttgcccagcaaggacc

SEQ ID NO: 5101169 - DNA, 17 bp, Homo sapiens
aagccttggttgggtat

SEQ ID NO: 5101170 - DNA, 11 bp, Homo sapiens
aagccttgtgt

SEQ ID NO: 5101171 - DNA, 13 bp, Homo sapiens
aagccttgtgtat

SEQ ID NO: 5101172 - DNA, 19 bp, Homo sapiens
aagccttgtgtatatttgt

SEQ ID NO: 5101173 - DNA, 15 bp, Homo sapiens
aagccttgttttctc

SEQ ID NO: 5101174 - DNA, 13 bp, Homo sapiens
aagcctttaaatt

SEQ ID NO: 5101175 - DNA, 14 bp, Homo sapiens
aagcctttaaattg

SEQ ID NO: 5101176 - DNA, 20 bp, Homo sapiens
aagcctttagtatcagtgtt

SEQ ID NO: 5101177 - DNA, 13 bp, Homo sapiens
aagcctttgaagt

SEQ ID NO: 5101178 - DNA, 19 bp, Homo sapiens
aagcctttgccgtgagcat

SEQ ID NO: 5101179 - DNA, 21 bp, Homo sapiens
aagcctttggatggctatgga

SEQ ID NO: 5101180 - DNA, 21 bp, Homo sapiens
aagccttttgcaaatagtaga

SEQ ID NO: 5101181 - DNA, 17 bp, Homo sapiens
aagcgaaaaaaaaaaat

SEQ ID NO: 5101182 - DNA, 15 bp, Homo sapiens
aagcgaaaaaatcag

SEQ ID NO: 5101183 - DNA, 14 bp, Homo sapiens
aagcgaaaaactca

SEQ ID NO: 5101184 - DNA, 15 bp, Homo sapiens
aagcgaacaaaaagt

SEQ ID NO: 5101185 - DNA, 14 bp, Homo sapiens
aagcgaacatcttc

SEQ ID NO: 5101186 - DNA, 16 bp, Homo sapiens
aagcgaacatcttcat

SEQ ID NO: 5101187 - DNA, 22 bp, Homo sapiens
aagcgaagatgatttcagttca

SEQ ID NO: 5101188 - DNA, 21 bp, Homo sapiens
aagcgaaggaacctctcgcca

SEQ ID NO: 5101189 - DNA, 18 bp, Homo sapiens
aagcgacacaggctgccg

SEQ ID NO: 5101190 - DNA, 19 bp, Homo sapiens
aagcgacctctcttgaggt

SEQ ID NO: 5101191 - DNA, 20 bp, Homo sapiens
aagcgactctcctgtttgga

SEQ ID NO: 5101192 - DNA, 15 bp, Homo sapiens
aagcgagcacagtat

SEQ ID NO: 5101193 - DNA, 23 bp, Homo sapiens
aagcgaggcatgcctgagagaca

SEQ ID NO: 5101194 - DNA, 23 bp, Homo sapiens
aagcgagtcatttcgttccctga

SEQ ID NO: 5101195 - DNA, 23 bp, Homo sapiens
aagcgatcctccttcctcatcct

SEQ ID NO: 5101196 - DNA, 20 bp, Homo sapiens
aagcgatgaatttggagact

SEQ ID NO: 5101197 - DNA, 21 bp, Homo sapiens
aagcgattcttctgcttcagc

SEQ ID NO: 5101198 - DNA, 20 bp, Homo sapiens
aagcgattcttgtgcctcag

SEQ ID NO: 5101199 - DNA, 15 bp, Homo sapiens
aagcgcagggaggat

SEQ ID NO: 5101200 - DNA, 13 bp, Homo sapiens
aagcgccaggctg

SEQ ID NO: 5101201 - DNA, 14 bp, Homo sapiens
aagcgcccacccag

SEQ ID NO: 5101202 - DNA, 15 bp, Homo sapiens
aagcgcccacccagg

SEQ ID NO: 5101203 - DNA, 17 bp, Homo sapiens
aagcgcccacccaggtc

SEQ ID NO: 5101204 - DNA, 18 bp, Homo sapiens
aagcgcccacccaggtcc

SEQ ID NO: 5101205 - DNA, 18 bp, Homo sapiens
aagcgcccctcactcctg

SEQ ID NO: 5101206 - DNA, 21 bp, Homo sapiens
aagcgcctcagttacacagga

SEQ ID NO: 5101207 - DNA, 14 bp, Homo sapiens
aagcgcctccaacc

SEQ ID NO: 5101208 - DNA, 20 bp, Homo sapiens
aagcgcgttgtgtatattac

SEQ ID NO: 5101209 - DNA, 21 bp, Homo sapiens
aagcgctaagtaaaaatatta

SEQ ID NO: 5101210 - DNA, 22 bp, Homo sapiens
aagcgctagaggaagcagccaa

SEQ ID NO: 5101211 - DNA, 20 bp, Homo sapiens
aagcgctgttgcccgccctc

SEQ ID NO: 5101212 - DNA, 13 bp, Homo sapiens
aagcgctgtttcc

SEQ ID NO: 5101213 - DNA, 23 bp, Homo sapiens
aagcgcttctgctgaaagttcat

SEQ ID NO: 5101214 - DNA, 16 bp, Homo sapiens
aagcgcttctttctga

SEQ ID NO: 5101215 - DNA, 22 bp, Homo sapiens
aagcggaataaactagagaagg

SEQ ID NO: 5101216 - DNA, 16 bp, Homo sapiens
aagcggagagagccaa

SEQ ID NO: 5101217 - DNA, 17 bp, Homo sapiens
aagcggagagagccaag

SEQ ID NO: 5101218 - DNA, 21 bp, Homo sapiens
aagcggaggttgcagggagcc

SEQ ID NO: 5101219 - DNA, 21 bp, Homo sapiens
aagcggagttcctaacaggat

SEQ ID NO: 5101220 - DNA, 23 bp, Homo sapiens
aagcggccctgtgtgtttgacat

SEQ ID NO: 5101221 - DNA, 14 bp, Homo sapiens
aagcgggaaacatg

SEQ ID NO: 5101222 - DNA, 19 bp, Homo sapiens
aagcgggggcgtggctggc

SEQ ID NO: 5101223 - DNA, 13 bp, Homo sapiens
aagcggggggagg

SEQ ID NO: 5101224 - DNA, 14 bp, Homo sapiens
aagcgggtggtggc

SEQ ID NO: 5101225 - DNA, 15 bp, Homo sapiens
aagcggtcagactgg

SEQ ID NO: 5101226 - DNA, 16 bp, Homo sapiens
aagcggtggaggaagg

SEQ ID NO: 5101227 - DNA, 22 bp, Homo sapiens
aagcggtggataactagccaga

SEQ ID NO: 5101228 - DNA, 14 bp, Homo sapiens
aagcggtgtctctc

SEQ ID NO: 5101229 - DNA, 23 bp, Homo sapiens
aagcggtttgcatttacgcctgt

SEQ ID NO: 5101230 - DNA, 22 bp, Homo sapiens
aagcgtcacttctcctgctgct

SEQ ID NO: 5101231 - DNA, 18 bp, Homo sapiens
aagcgtctcccttggcca

SEQ ID NO: 5101232 - DNA, 12 bp, Homo sapiens
aagcgtctttaa

SEQ ID NO: 5101233 - DNA, 21 bp, Homo sapiens
aagcgtctttaagagactcac

SEQ ID NO: 5101234 - DNA, 15 bp, Homo sapiens
aagcgtgagccactg

SEQ ID NO: 5101235 - DNA, 17 bp, Homo sapiens
aagcgtgagccactgca

SEQ ID NO: 5101236 - DNA, 21 bp, Homo sapiens
aagcgtgagccactgcaccgg

SEQ ID NO: 5101237 - DNA, 13 bp, Homo sapiens
aagcgtgttctca

SEQ ID NO: 5101238 - DNA, 14 bp, Homo sapiens
aagcgtgttctcag

SEQ ID NO: 5101239 - DNA, 16 bp, Homo sapiens
aagcgttatctcttcc

SEQ ID NO: 5101240 - DNA, 20 bp, Homo sapiens
aagcgttcatatgctctgct

SEQ ID NO: 5101241 - DNA, 19 bp, Homo sapiens
aagcgttcctggccttctg

SEQ ID NO: 5101242 - DNA, 17 bp, Homo sapiens
aagcgtttttctttttc

SEQ ID NO: 5101243 - DNA, 22 bp, Homo sapiens
aagctaaaatatataatatact

SEQ ID NO: 5101244 - DNA, 12 bp, Homo sapiens
aagctaaaatgt

SEQ ID NO: 5101245 - DNA, 13 bp, Homo sapiens
aagctaaaatgtt

SEQ ID NO: 5101246 - DNA, 14 bp, Homo sapiens
aagctaaaatgtta

SEQ ID NO: 5101247 - DNA, 14 bp, Homo sapiens
aagctaaatcatat

SEQ ID NO: 5101248 - DNA, 12 bp, Homo sapiens
aagctaaattac

SEQ ID NO: 5101249 - DNA, 18 bp, Homo sapiens
aagctaaattttgttact

SEQ ID NO: 5101250 - DNA, 20 bp, Homo sapiens
aagctaacagggaaggcagg

SEQ ID NO: 5101251 - DNA, 17 bp, Homo sapiens
aagctaacatctttacg

SEQ ID NO: 5101252 - DNA, 19 bp, Homo sapiens
aagctaagtaaaaatatgt

SEQ ID NO: 5101253 - DNA, 20 bp, Homo sapiens
aagctaataaaatatcattc

SEQ ID NO: 5101254 - DNA, 18 bp, Homo sapiens
aagctaataattcttcac

SEQ ID NO: 5101255 - DNA, 23 bp, Homo sapiens
aagctaatgacgaggaaccgaaa

SEQ ID NO: 5101256 - DNA, 19 bp, Homo sapiens
aagctaatgtaggactgta

SEQ ID NO: 5101257 - DNA, 20 bp, Homo sapiens
aagctaatgtcacaattatg

SEQ ID NO: 5101258 - DNA, 12 bp, Homo sapiens
aagctaatgtga

SEQ ID NO: 5101259 - DNA, 13 bp, Homo sapiens
aagctaatgtgaa

SEQ ID NO: 5101260 - DNA, 19 bp, Homo sapiens
aagctaatgtttaaaagca

SEQ ID NO: 5101261 - DNA, 16 bp, Homo sapiens
aagctaattattttaa

SEQ ID NO: 5101262 - DNA, 12 bp, Homo sapiens
aagctaattttc

SEQ ID NO: 5101263 - DNA, 17 bp, Homo sapiens
aagctacaatattctct

SEQ ID NO: 5101264 - DNA, 20 bp, Homo sapiens
aagctacagaagaaactggg

SEQ ID NO: 5101265 - DNA, 14 bp, Homo sapiens
aagctacaggactg

SEQ ID NO: 5101266 - DNA, 22 bp, Homo sapiens
aagctacaggttacaacagatt

SEQ ID NO: 5101267 - DNA, 14 bp, Homo sapiens
aagctacagttgtc

SEQ ID NO: 5101268 - DNA, 18 bp, Homo sapiens
aagctacagttgtccaga

SEQ ID NO: 5101269 - DNA, 22 bp, Homo sapiens
aagctaccattttacatttcta

SEQ ID NO: 5101270 - DNA, 17 bp, Homo sapiens
aagctaccttgtcatat

SEQ ID NO: 5101271 - DNA, 22 bp, Homo sapiens
aagctactagcaaaataaaaca

SEQ ID NO: 5101272 - DNA, 17 bp, Homo sapiens
aagctactgtagaaaca

SEQ ID NO: 5101273 - DNA, 19 bp, Homo sapiens
aagctactgtgtgtgtgaa

SEQ ID NO: 5101274 - DNA, 23 bp, Homo sapiens
aagctactgtgtgtgtgaatgaa

SEQ ID NO: 5101275 - DNA, 13 bp, Homo sapiens
aagctacttattg

SEQ ID NO: 5101276 - DNA, 13 bp, Homo sapiens
aagctagaaacaa

SEQ ID NO: 5101277 - DNA, 17 bp, Homo sapiens
aagctagaacctggagg

SEQ ID NO: 5101278 - DNA, 15 bp, Homo sapiens
aagctagaaggaagc

SEQ ID NO: 5101279 - DNA, 10 bp, Homo sapiens
aagctagaat

SEQ ID NO: 5101280 - DNA, 20 bp, Homo sapiens
aagctagacaaaggcccaga

SEQ ID NO: 5101281 - DNA, 15 bp, Homo sapiens
aagctagacacatga

SEQ ID NO: 5101282 - DNA, 18 bp, Homo sapiens
aagctagacacatgaagg

SEQ ID NO: 5101283 - DNA, 21 bp, Homo sapiens
aagctagacacatgaaggtaa

SEQ ID NO: 5101284 - DNA, 15 bp, Homo sapiens
aagctagacagatcc

SEQ ID NO: 5101285 - DNA, 16 bp, Homo sapiens
aagctagactgtgtct

SEQ ID NO: 5101286 - DNA, 17 bp, Homo sapiens
aagctagactgtgtctg

SEQ ID NO: 5101287 - DNA, 17 bp, Homo sapiens
aagcaataaagaagagt

SEQ ID NO: 5101288 - DNA, 17 bp, Homo sapiens
aagcaataaagattttt

SEQ ID NO: 5101289 - DNA, 14 bp, Homo sapiens
aagcaataaatgaa

SEQ ID NO: 5101290 - DNA, 11 bp, Homo sapiens
aagcaataact

SEQ ID NO: 5101291 - DNA, 15 bp, Homo sapiens
aagcaataagttcat

SEQ ID NO: 5101292 - DNA, 12 bp, Homo sapiens
aagcaataatta

SEQ ID NO: 5101293 - DNA, 15 bp, Homo sapiens
aagcaataattgttt

SEQ ID NO: 5101294 - DNA, 18 bp, Homo sapiens
aagcaataggtagctggg

SEQ ID NO: 5101295 - DNA, 21 bp, Homo sapiens
aagcaatcactgggcccagag

SEQ ID NO: 5101296 - DNA, 22 bp, Homo sapiens
aagcaatcattaagtgactttg

SEQ ID NO: 5101297 - DNA, 16 bp, Homo sapiens
aagcaatcctcctgag

SEQ ID NO: 5101298 - DNA, 15 bp, Homo sapiens
aagcaatcctcctgc

SEQ ID NO: 5101299 - DNA, 18 bp, Homo sapiens
aagcaatctgtaactgct

SEQ ID NO: 5101300 - DNA, 19 bp, Homo sapiens
aagcaatgatgacccacta

SEQ ID NO: 5101301 - DNA, 12 bp, Homo sapiens
aagcaatgcaag

SEQ ID NO: 5101302 - DNA, 16 bp, Homo sapiens
aagcaatgcattttgg

SEQ ID NO: 5101303 - DNA, 23 bp, Homo sapiens
aagcaatgcttctgcctcagctt

SEQ ID NO: 5101304 - DNA, 17 bp, Homo sapiens
aagcaatggatatttgt

SEQ ID NO: 5101305 - DNA, 23 bp, Homo sapiens
aagcaatgtgagtcccagagccc

SEQ ID NO: 5101306 - DNA, 13 bp, Homo sapiens
aagcaatgtgttt

SEQ ID NO: 5101307 - DNA, 17 bp, Homo sapiens
aagcaatgtgttttttc

SEQ ID NO: 5101308 - DNA, 14 bp, Homo sapiens
aagcaattagaagc

SEQ ID NO: 5101309 - DNA, 13 bp, Homo sapiens
aagcaattatatt

SEQ ID NO: 5101310 - DNA, 18 bp, Homo sapiens
aagcaattatttaaagaa

SEQ ID NO: 5101311 - DNA, 15 bp, Homo sapiens
aagcaattccaacct

SEQ ID NO: 5101312 - DNA, 12 bp, Homo sapiens
aagcaattctgc

SEQ ID NO: 5101313 - DNA, 23 bp, Homo sapiens
aagcaattgctcatgttggccaa

SEQ ID NO: 5101314 - DNA, 21 bp, Homo sapiens
aagcaatttactgatgagaga

SEQ ID NO: 5101315 - DNA, 16 bp, Homo sapiens
aagcaattttcattta

SEQ ID NO: 5101316 - DNA, 13 bp, Homo sapiens
aagcaattttcct

SEQ ID NO: 5101317 - DNA, 20 bp, Homo sapiens
aagcaattttccttgaagcc

SEQ ID NO: 5101318 - DNA, 22 bp, Homo sapiens
aagcaattttccttgaagccga

SEQ ID NO: 5101319 - DNA, 15 bp, Homo sapiens
aagcacaaaccctgg

SEQ ID NO: 5101320 - DNA, 15 bp, Homo sapiens
aagcacaaactttag

SEQ ID NO: 5101321 - DNA, 16 bp, Homo sapiens
aagcacaaagttctca

SEQ ID NO: 5101322 - DNA, 15 bp, Homo sapiens
aagcacaactccctt

SEQ ID NO: 5101323 - DNA, 23 bp, Homo sapiens
aagcacaagaaactttggaagca

SEQ ID NO: 5101324 - DNA, 15 bp, Homo sapiens
aagcacaagactggc

SEQ ID NO: 5101325 - DNA, 18 bp, Homo sapiens
aagcacaagactggccca

SEQ ID NO: 5101326 - DNA, 17 bp, Homo sapiens
aagcacaagtacttttg

SEQ ID NO: 5101327 - DNA, 23 bp, Homo sapiens
aagcacaatcactaaactttatt

SEQ ID NO: 5101328 - DNA, 19 bp, Homo sapiens
aagcacacacaataaagaa

SEQ ID NO: 5101329 - DNA, 12 bp, Homo sapiens
aagcacacacac

SEQ ID NO: 5101330 - DNA, 22 bp, Homo sapiens
aagcacacacatctggccctga

SEQ ID NO: 5101331 - DNA, 18 bp, Homo sapiens
aagcacactaaaccaagt

SEQ ID NO: 5101332 - DNA, 16 bp, Homo sapiens
aagcacactgcagggc

SEQ ID NO: 5101333 - DNA, 20 bp, Homo sapiens
aagcacactgcagggctgct

SEQ ID NO: 5101334 - DNA, 14 bp, Homo sapiens
aagcacactggaat

SEQ ID NO: 5101335 - DNA, 17 bp, Homo sapiens
aagcacagaaaactaga

SEQ ID NO: 5101336 - DNA, 12 bp, Homo sapiens
aagcacagaaat

SEQ ID NO: 5101337 - DNA, 19 bp, Homo sapiens
aagcacagaaggaggagga

SEQ ID NO: 5101338 - DNA, 16 bp, Homo sapiens
aagcacagaatatttt

SEQ ID NO: 5101339 - DNA, 20 bp, Homo sapiens
aagcacagacaattctaatg

SEQ ID NO: 5101340 - DNA, 16 bp, Homo sapiens
aagcacagacattaaa

SEQ ID NO: 5101341 - DNA, 13 bp, Homo sapiens
aagcacagagcct

SEQ ID NO: 5101342 - DNA, 15 bp, Homo sapiens
aagcacagctgggca

SEQ ID NO: 5101343 - DNA, 16 bp, Homo sapiens
aagcacagctgggcat

SEQ ID NO: 5101344 - DNA, 15 bp, Homo sapiens
aagcacagcttgggt

SEQ ID NO: 5101345 - DNA, 14 bp, Homo sapiens
aagcacagtggtgg

SEQ ID NO: 5101346 - DNA, 20 bp, Homo sapiens
aagcacagtggtggcagggc

SEQ ID NO: 5101347 - DNA, 13 bp, Homo sapiens
aagcacagtgtta

SEQ ID NO: 5101348 - DNA, 14 bp, Homo sapiens
aagcacagtttgaa

SEQ ID NO: 5101349 - DNA, 15 bp, Homo sapiens
aagcacagtttgaac

SEQ ID NO: 5101350 - DNA, 16 bp, Homo sapiens
aagcacagtttgaaca

SEQ ID NO: 5101351 - DNA, 17 bp, Homo sapiens
aagcacataactggatt

SEQ ID NO: 5101352 - DNA, 12 bp, Homo sapiens
aagcacatacat

SEQ ID NO: 5101353 - DNA, 14 bp, Homo sapiens
aagcacatacatta

SEQ ID NO: 5101354 - DNA, 21 bp, Homo sapiens
aagcacatacattaaaactag

SEQ ID NO: 5101355 - DNA, 22 bp, Homo sapiens
aagcacatacggcagacctctt

SEQ ID NO: 5101356 - DNA, 16 bp, Homo sapiens
aagcacatgtttattt

SEQ ID NO: 5101357 - DNA, 12 bp, Homo sapiens
aagcacatttta

SEQ ID NO: 5101358 - DNA, 14 bp, Homo sapiens
aagcaccaagctca

SEQ ID NO: 5101359 - DNA, 19 bp, Homo sapiens
aagcaccagcttctccagg

SEQ ID NO: 5101360 - DNA, 13 bp, Homo sapiens
aagcaccaggaag

SEQ ID NO: 5101361 - DNA, 15 bp, Homo sapiens
aagcaccagggagag

SEQ ID NO: 5101362 - DNA, 19 bp, Homo sapiens
aagcaccagggagaggcct

SEQ ID NO: 5101363 - DNA, 17 bp, Homo sapiens
aagcaccataaccaaga

SEQ ID NO: 5101364 - DNA, 15 bp, Homo sapiens
aagcaccatcccctc

SEQ ID NO: 5101365 - DNA, 15 bp, Homo sapiens
aagcaccatggcctt

SEQ ID NO: 5101366 - DNA, 21 bp, Homo sapiens
aagcaccgaggttgcattcta

SEQ ID NO: 5101367 - DNA, 19 bp, Homo sapiens
aagcaccgcctccaaatgc

SEQ ID NO: 5101368 - DNA, 20 bp, Homo sapiens
aagcacctaaaacccaaagg

SEQ ID NO: 5101369 - DNA, 18 bp, Homo sapiens
aagcacctatgaaagcaa

SEQ ID NO: 5101370 - DNA, 21 bp, Homo sapiens
aagcacctcaagtgcaaggac

SEQ ID NO: 5101371 - DNA, 13 bp, Homo sapiens
aagcacctcctgc

SEQ ID NO: 5101372 - DNA, 19 bp, Homo sapiens
aagcacctcttgaagaact

SEQ ID NO: 5101373 - DNA, 14 bp, Homo sapiens
aagcacctgaacca

SEQ ID NO: 5101374 - DNA, 21 bp, Homo sapiens
aagcacctgcagattctgatt

SEQ ID NO: 5101375 - DNA, 20 bp, Homo sapiens
aagcacctgccgacctcgtc

SEQ ID NO: 5101376 - DNA, 17 bp, Homo sapiens
aagcacctgggtgtgct

SEQ ID NO: 5101377 - DNA, 13 bp, Homo sapiens
aagcacctgtaat

SEQ ID NO: 5101378 - DNA, 15 bp, Homo sapiens
aagcacgaaatgtta

SEQ ID NO: 5101379 - DNA, 17 bp, Homo sapiens
aagcacgcagttatgtt

SEQ ID NO: 5101380 - DNA, 22 bp, Homo sapiens
aagcacggggctggcagggcgt

SEQ ID NO: 5101381 - DNA, 15 bp, Homo sapiens
aagcacgggggagtg

SEQ ID NO: 5101382 - DNA, 21 bp, Homo sapiens
aagcactaaaaagttgaacca

SEQ ID NO: 5101383 - DNA, 23 bp, Homo sapiens
aagcactacaccttgccttgctg

SEQ ID NO: 5101384 - DNA, 13 bp, Homo sapiens
aagcactagagaa

SEQ ID NO: 5101385 - DNA, 14 bp, Homo sapiens
aagcactattgttt

SEQ ID NO: 5101386 - DNA, 19 bp, Homo sapiens
aagcactattttatattta

SEQ ID NO: 5101387 - DNA, 21 bp, Homo sapiens
aagcactcctccctgatgtac

SEQ ID NO: 5101388 - DNA, 17 bp, Homo sapiens
aagcactcctttaaagc

SEQ ID NO: 5101389 - DNA, 19 bp, Homo sapiens
aagcactcggggtccctgg

SEQ ID NO: 5101390 - DNA, 12 bp, Homo sapiens
aagcactcgtgt

SEQ ID NO: 5101391 - DNA, 14 bp, Homo sapiens
aagcactctgctgg

SEQ ID NO: 5101392 - DNA, 19 bp, Homo sapiens
aagcactctggatgatgga

SEQ ID NO: 5101393 - DNA, 21 bp, Homo sapiens
aagcactgacctgtcatgccc

SEQ ID NO: 5101394 - DNA, 20 bp, Homo sapiens
aagcactgacttctaagtaa

SEQ ID NO: 5101395 - DNA, 23 bp, Homo sapiens
aagcactgctcacgtctctgccg

SEQ ID NO: 5101396 - DNA, 20 bp, Homo sapiens
aagcactgctgtgtccgctt

SEQ ID NO: 5101397 - DNA, 13 bp, Homo sapiens
aagcactggcctt

SEQ ID NO: 5101398 - DNA, 18 bp, Homo sapiens
aagcacttaaacagaagc

SEQ ID NO: 5101399 - DNA, 15 bp, Homo sapiens
aagcacttcccagga

SEQ ID NO: 5101400 - DNA, 16 bp, Homo sapiens
aagcacttcccaggat

SEQ ID NO: 5101401 - DNA, 12 bp, Homo sapiens
aagcacttctag

SEQ ID NO: 5101402 - DNA, 14 bp, Homo sapiens
aagcacttgaagaa

SEQ ID NO: 5101403 - DNA, 20 bp, Homo sapiens
aagcacttgctcaaaatctg

SEQ ID NO: 5101404 - DNA, 20 bp, Homo sapiens
aagcacttggactcttgctc

SEQ ID NO: 5101405 - DNA, 14 bp, Homo sapiens
aagcactttaagct

SEQ ID NO: 5101406 - DNA, 15 bp, Homo sapiens
aagcactttgaaaat

SEQ ID NO: 5101407 - DNA, 23 bp, Homo sapiens
aagcactttgaaaatatttctat

SEQ ID NO: 5101408 - DNA, 14 bp, Homo sapiens
aagcactttgcact

SEQ ID NO: 5101409 - DNA, 15 bp, Homo sapiens
aagcactttgcactt

SEQ ID NO: 5101410 - DNA, 16 bp, Homo sapiens
aagcactttgcactta

SEQ ID NO: 5101411 - DNA, 15 bp, Homo sapiens
aagcacttttaaaaa

SEQ ID NO: 5101412 - DNA, 20 bp, Homo sapiens
aagcacttttgttattccat

SEQ ID NO: 5101413 - DNA, 12 bp, Homo sapiens
aagcagaaaaat

SEQ ID NO: 5101414 - DNA, 12 bp, Homo sapiens
aagcagaaagtg

SEQ ID NO: 5101415 - DNA, 19 bp, Homo sapiens
aagcagaaagtgcctttca

SEQ ID NO: 5101416 - DNA, 20 bp, Homo sapiens
aagcagaaagtgcctttcag

SEQ ID NO: 5101417 - DNA, 18 bp, Homo sapiens
aagcagaacatactgttc

SEQ ID NO: 5101418 - DNA, 17 bp, Homo sapiens
aagcagaactgaagcca

SEQ ID NO: 5101419 - DNA, 19 bp, Homo sapiens
aagcagaactgaagccact

SEQ ID NO: 5101420 - DNA, 14 bp, Homo sapiens
aagcagaagtctgg

SEQ ID NO: 5101421 - DNA, 22 bp, Homo sapiens
aagcagaagtggaatccagtgt

SEQ ID NO: 5101422 - DNA, 13 bp, Homo sapiens
aagcagaataaag

SEQ ID NO: 5101423 - DNA, 14 bp, Homo sapiens
aagcagaataaagc

SEQ ID NO: 5101424 - DNA, 16 bp, Homo sapiens
aagcagaataaagcaa

SEQ ID NO: 5101425 - DNA, 17 bp, Homo sapiens
aagcagaataaagcaat

SEQ ID NO: 5101426 - DNA, 16 bp, Homo sapiens
aagcagaattggaaaa

SEQ ID NO: 5101427 - DNA, 19 bp, Homo sapiens
aagcagaattggaaaagac

SEQ ID NO: 5101428 - DNA, 15 bp, Homo sapiens
aagcagaattttaat

SEQ ID NO: 5101429 - DNA, 21 bp, Homo sapiens
aagcagaattttaatgtgaag

SEQ ID NO: 5101430 - DNA, 16 bp, Homo sapiens
aagcagacacacacat

SEQ ID NO: 5101431 - DNA, 17 bp, Homo sapiens
aagcagacacacacata

SEQ ID NO: 5101432 - DNA, 20 bp, Homo sapiens
aagcagacacacacatatat

SEQ ID NO: 5101433 - DNA, 21 bp, Homo sapiens
aagcagacgtccatagctcct

SEQ ID NO: 5101434 - DNA, 23 bp, Homo sapiens
aagcagacgtccatagctcctct

SEQ ID NO: 5101435 - DNA, 22 bp, Homo sapiens
aagcagacgtgagtgtgacttt

SEQ ID NO: 5101436 - DNA, 16 bp, Homo sapiens
aagcagactccagccc

SEQ ID NO: 5101437 - DNA, 17 bp, Homo sapiens
aagcagactccagcccc

SEQ ID NO: 5101438 - DNA, 16 bp, Homo sapiens
aagcagacttttcaga

SEQ ID NO: 5101439 - DNA, 24 bp, Homo sapiens
aagcagacttttcagaagatggtg

SEQ ID NO: 5101440 - DNA, 23 bp, Homo sapiens
aagcagagatcgacagacagcca

SEQ ID NO: 5101441 - DNA, 23 bp, Homo sapiens
aagcagagattttcaacatttca

SEQ ID NO: 5101442 - DNA, 14 bp, Homo sapiens
aagcagagcatttt

SEQ ID NO: 5101443 - DNA, 18 bp, Homo sapiens
aagcagagccaaggccac

SEQ ID NO: 5101444 - DNA, 16 bp, Homo sapiens
aagcagagcctcctgg

SEQ ID NO: 5101445 - DNA, 13 bp, Homo sapiens
aagcagagcttcc

SEQ ID NO: 5101446 - DNA, 20 bp, Homo sapiens
aagcagaggaaggaaacata

SEQ ID NO: 5101447 - DNA, 23 bp, Homo sapiens
aagcagaggaaggaaacatagaa

SEQ ID NO: 5101448 - DNA, 18 bp, Homo sapiens
aagcagaggaccagggcc

SEQ ID NO: 5101449 - DNA, 15 bp, Homo sapiens
aagcagaggaggggc

SEQ ID NO: 5101450 - DNA, 22 bp, Homo sapiens
aagcagaggaggggccgctgcc

SEQ ID NO: 5101451 - DNA, 11 bp, Homo sapiens
aagcagaggcc

SEQ ID NO: 5101452 - DNA, 12 bp, Homo sapiens
aagcagaggccc

SEQ ID NO: 5101453 - DNA, 14 bp, Homo sapiens
aagcagaggccctg

SEQ ID NO: 5101454 - DNA, 14 bp, Homo sapiens
aagcagaggctttg

SEQ ID NO: 5101455 - DNA, 14 bp, Homo sapiens
aagcagagggaaat

SEQ ID NO: 5101456 - DNA, 14 bp, Homo sapiens
aagcagagggacaa

SEQ ID NO: 5101457 - DNA, 21 bp, Homo sapiens
aagcagaggtcttcagggctc

SEQ ID NO: 5101458 - DNA, 17 bp, Homo sapiens
aagcagagtgcacagct

SEQ ID NO: 5101459 - DNA, 19 bp, Homo sapiens
aagcagagtgcacagctgt

SEQ ID NO: 5101460 - DNA, 21 bp, Homo sapiens
aagcagagtgcacagctgtcc

SEQ ID NO: 5101461 - DNA, 11 bp, Homo sapiens
aagcagagtgg

SEQ ID NO: 5101462 - DNA, 20 bp, Homo sapiens
aagcagagtggcagtcttca

SEQ ID NO: 5101463 - DNA, 14 bp, Homo sapiens
aagcagagttttca

SEQ ID NO: 5101464 - DNA, 18 bp, Homo sapiens
aagcagatgcaaagaggc

SEQ ID NO: 5101465 - DNA, 23 bp, Homo sapiens
aagcagatgcaaagaggcaagag

SEQ ID NO: 5101466 - DNA, 18 bp, Homo sapiens
aagcagattacaataaat

SEQ ID NO: 5101467 - DNA, 14 bp, Homo sapiens
aagctagagatatg

SEQ ID NO: 5101468 - DNA, 20 bp, Homo sapiens
aagctagaggaataaagctg

SEQ ID NO: 5101469 - DNA, 15 bp, Homo sapiens
aagctagctcccctc

SEQ ID NO: 5101470 - DNA, 19 bp, Homo sapiens
aagctagctcccctcctct

SEQ ID NO: 5101471 - DNA, 21 bp, Homo sapiens
aagctaggaaaggcagaaaca

SEQ ID NO: 5101472 - DNA, 22 bp, Homo sapiens
aagctaggccccagaggccctg

SEQ ID NO: 5101473 - DNA, 23 bp, Homo sapiens
aagctaggccccagaggccctgg

SEQ ID NO: 5101474 - DNA, 12 bp, Homo sapiens
aagctaggcctg

SEQ ID NO: 5101475 - DNA, 22 bp, Homo sapiens
aagctagggtggcccttgcagt

SEQ ID NO: 5101476 - DNA, 23 bp, Homo sapiens
aagctaggtgctatttgtcatct

SEQ ID NO: 5101477 - DNA, 17 bp, Homo sapiens
aagctagtcaacagtac

SEQ ID NO: 5101478 - DNA, 12 bp, Homo sapiens
aagctagtcttt

SEQ ID NO: 5101479 - DNA, 16 bp, Homo sapiens
aagctagtcttttgct

SEQ ID NO: 5101480 - DNA, 18 bp, Homo sapiens
aagctagtggcttcaaaa

SEQ ID NO: 5101481 - DNA, 21 bp, Homo sapiens
aagctagttgaatacttgaac

SEQ ID NO: 5101482 - DNA, 14 bp, Homo sapiens
aagctataaattat

SEQ ID NO: 5101483 - DNA, 13 bp, Homo sapiens
aagctataacata

SEQ ID NO: 5101484 - DNA, 15 bp, Homo sapiens
aagctatatatgaat

SEQ ID NO: 5101485 - DNA, 17 bp, Homo sapiens
aagctatattagctgaa

SEQ ID NO: 5101486 - DNA, 14 bp, Homo sapiens
aagctatctaaagt

SEQ ID NO: 5101487 - DNA, 14 bp, Homo sapiens
aagctatgaatgtt

SEQ ID NO: 5101488 - DNA, 18 bp, Homo sapiens
aagctatgaatgttacta

SEQ ID NO: 5101489 - DNA, 12 bp, Homo sapiens
aagctatggtga

SEQ ID NO: 5101490 - DNA, 17 bp, Homo sapiens
aagctatgtctctagca

SEQ ID NO: 5101491 - DNA, 14 bp, Homo sapiens
aagctatgttttta

SEQ ID NO: 5101492 - DNA, 17 bp, Homo sapiens
aagctatgtttttaaag

SEQ ID NO: 5101493 - DNA, 22 bp, Homo sapiens
aagctattacttggcaaattct

SEQ ID NO: 5101494 - DNA, 19 bp, Homo sapiens
aagctattcctttcccttc

SEQ ID NO: 5101495 - DNA, 23 bp, Homo sapiens
aagctattggaatttttttttcc

SEQ ID NO: 5101496 - DNA, 24 bp, Homo sapiens
aagctatttatgtaaaatcaataa

SEQ ID NO: 5101497 - DNA, 13 bp, Homo sapiens
aagctatttcctt

SEQ ID NO: 5101498 - DNA, 13 bp, Homo sapiens
aagctatttttct

SEQ ID NO: 5101499 - DNA, 14 bp, Homo sapiens
aagctatttttcta

SEQ ID NO: 5101500 - DNA, 22 bp, Homo sapiens
aagctcaaatgtatatttaact

SEQ ID NO: 5101501 - DNA, 13 bp, Homo sapiens
aagctcaactgtt

SEQ ID NO: 5101502 - DNA, 23 bp, Homo sapiens
aagctcaactgttgccaggagat

SEQ ID NO: 5101503 - DNA, 22 bp, Homo sapiens
aagctcaagaggaaaagctaag

SEQ ID NO: 5101504 - DNA, 21 bp, Homo sapiens
aagctcacacctgtccttctc

SEQ ID NO: 5101505 - DNA, 22 bp, Homo sapiens
aagctcacacttgggctggcac

SEQ ID NO: 5101506 - DNA, 22 bp, Homo sapiens
aagctcacagttcctcgccctg

SEQ ID NO: 5101507 - DNA, 15 bp, Homo sapiens
aagctcactgctgat

SEQ ID NO: 5101508 - DNA, 23 bp, Homo sapiens
aagctcactgctgatcgtagaaa

SEQ ID NO: 5101509 - DNA, 23 bp, Homo sapiens
aagctcacttctgggcttcatct

SEQ ID NO: 5101510 - DNA, 16 bp, Homo sapiens
aagctcacttgcttta

SEQ ID NO: 5101511 - DNA, 12 bp, Homo sapiens
aagctcagaaag

SEQ ID NO: 5101512 - DNA, 16 bp, Homo sapiens
aagctcagaaggctct

SEQ ID NO: 5101513 - DNA, 13 bp, Homo sapiens
aagctcagaatcc

SEQ ID NO: 5101514 - DNA, 15 bp, Homo sapiens
aagctcagaatccaa

SEQ ID NO: 5101515 - DNA, 13 bp, Homo sapiens
aagctcagagcag

SEQ ID NO: 5101516 - DNA, 23 bp, Homo sapiens
aagctcagaggcgcactgtgacc

SEQ ID NO: 5101517 - DNA, 11 bp, Homo sapiens
aagctcagagt

SEQ ID NO: 5101518 - DNA, 12 bp, Homo sapiens
aagctcagcctt

SEQ ID NO: 5101519 - DNA, 17 bp, Homo sapiens
aagctcagctactgatt

SEQ ID NO: 5101520 - DNA, 19 bp, Homo sapiens
aagctcagctgccttcctg

SEQ ID NO: 5101521 - DNA, 18 bp, Homo sapiens
aagctcagggcctggctc

SEQ ID NO: 5101522 - DNA, 18 bp, Homo sapiens
aagctcataaactgccaa

SEQ ID NO: 5101523 - DNA, 20 bp, Homo sapiens
aagctcatagaggtgagaaa

SEQ ID NO: 5101524 - DNA, 18 bp, Homo sapiens
aagctcatagcacatgtt

SEQ ID NO: 5101525 - DNA, 20 bp, Homo sapiens
aagctcatatccttttgaag

SEQ ID NO: 5101526 - DNA, 18 bp, Homo sapiens
aagctcatccctggactt

SEQ ID NO: 5101527 - DNA, 22 bp, Homo sapiens
aagctcatccctggacttctgg

SEQ ID NO: 5101528 - DNA, 19 bp, Homo sapiens
aagctcatctatttggaac

SEQ ID NO: 5101529 - DNA, 21 bp, Homo sapiens
aagctcatgcatttcaagcag

SEQ ID NO: 5101530 - DNA, 15 bp, Homo sapiens
aagctcatgtcatta

SEQ ID NO: 5101531 - DNA, 17 bp, Homo sapiens
aagctccaagctcccag

SEQ ID NO: 5101532 - DNA, 16 bp, Homo sapiens
aagctccaccctcctg

SEQ ID NO: 5101533 - DNA, 19 bp, Homo sapiens
aagctccacggtgcgtggc

SEQ ID NO: 5101534 - DNA, 21 bp, Homo sapiens
aagctccacggtgcgtggctg

SEQ ID NO: 5101535 - DNA, 16 bp, Homo sapiens
aagctccactgtcacc

SEQ ID NO: 5101536 - DNA, 13 bp, Homo sapiens
aagctccaggtag

SEQ ID NO: 5101537 - DNA, 14 bp, Homo sapiens
aagctccaggtaga

SEQ ID NO: 5101538 - DNA, 21 bp, Homo sapiens
aagctccagtcctgctctcta

SEQ ID NO: 5101539 - DNA, 13 bp, Homo sapiens
aagctccagtgct

SEQ ID NO: 5101540 - DNA, 20 bp, Homo sapiens
aagctccatctccactccag

SEQ ID NO: 5101541 - DNA, 15 bp, Homo sapiens
aagctccatgtgcat

SEQ ID NO: 5101542 - DNA, 17 bp, Homo sapiens
aagctccatgtgcatat

SEQ ID NO: 5101543 - DNA, 16 bp, Homo sapiens
aagctccatgtgcctc

SEQ ID NO: 5101544 - DNA, 22 bp, Homo sapiens
aagctcccaagagcttccagag

SEQ ID NO: 5101545 - DNA, 13 bp, Homo sapiens
aagctcccacccc

SEQ ID NO: 5101546 - DNA, 11 bp, Homo sapiens
aagctcccagg

SEQ ID NO: 5101547 - DNA, 12 bp, Homo sapiens
aagctcccaggc

SEQ ID NO: 5101548 - DNA, 15 bp, Homo sapiens
aagctcccagggcct

SEQ ID NO: 5101549 - DNA, 15 bp, Homo sapiens
aagctcccccagcaa

SEQ ID NO: 5101550 - DNA, 15 bp, Homo sapiens
aagctccctgcccca

SEQ ID NO: 5101551 - DNA, 12 bp, Homo sapiens
aagctcctccct

SEQ ID NO: 5101552 - DNA, 19 bp, Homo sapiens
aagctcctcctccctgcat

SEQ ID NO: 5101553 - DNA, 21 bp, Homo sapiens
aagctcctcctccctgcatct

SEQ ID NO: 5101554 - DNA, 18 bp, Homo sapiens
aagctcctctccccagcc

SEQ ID NO: 5101555 - DNA, 20 bp, Homo sapiens
aagctcctctccccagccca

SEQ ID NO: 5101556 - DNA, 13 bp, Homo sapiens
aagctcctctgct

SEQ ID NO: 5101557 - DNA, 20 bp, Homo sapiens
aagctcctgtcctcccatcc

SEQ ID NO: 5101558 - DNA, 13 bp, Homo sapiens
aagctccttcctg

SEQ ID NO: 5101559 - DNA, 21 bp, Homo sapiens
aagctcgccccacctccacct

SEQ ID NO: 5101560 - DNA, 20 bp, Homo sapiens
aagctctaaggtaacaaatt

SEQ ID NO: 5101561 - DNA, 19 bp, Homo sapiens
aagctctagataaaacttt

SEQ ID NO: 5101562 - DNA, 16 bp, Homo sapiens
aagctctcaaatgtga

SEQ ID NO: 5101563 - DNA, 21 bp, Homo sapiens
aagctctcagcaagtgcccag

SEQ ID NO: 5101564 - DNA, 14 bp, Homo sapiens
aagctctcatagct

SEQ ID NO: 5101565 - DNA, 13 bp, Homo sapiens
aagctctccaggc

SEQ ID NO: 5101566 - DNA, 16 bp, Homo sapiens
aagctctccgagctct

SEQ ID NO: 5101567 - DNA, 17 bp, Homo sapiens
aagctctccgagctctg

SEQ ID NO: 5101568 - DNA, 22 bp, Homo sapiens
aagctctccgagctctggtgct

SEQ ID NO: 5101569 - DNA, 15 bp, Homo sapiens
aagctctctgggcct

SEQ ID NO: 5101570 - DNA, 20 bp, Homo sapiens
aagctctctgtactaaggag

SEQ ID NO: 5101571 - DNA, 22 bp, Homo sapiens
aagctctcttgccgaggagcca

SEQ ID NO: 5101572 - DNA, 23 bp, Homo sapiens
aagctctcttgccgaggagccag

SEQ ID NO: 5101573 - DNA, 12 bp, Homo sapiens
aagctctgaagt

SEQ ID NO: 5101574 - DNA, 15 bp, Homo sapiens
aagctctgaatagtt

SEQ ID NO: 5101575 - DNA, 16 bp, Homo sapiens
aagctctgaccacttg

SEQ ID NO: 5101576 - DNA, 12 bp, Homo sapiens
aagctctgagct

SEQ ID NO: 5101577 - DNA, 15 bp, Homo sapiens
aagctctgagctgtc

SEQ ID NO: 5101578 - DNA, 21 bp, Homo sapiens
aagctctgccccttccccatg

SEQ ID NO: 5101579 - DNA, 12 bp, Homo sapiens
aagctctgccct

SEQ ID NO: 5101580 - DNA, 13 bp, Homo sapiens
aagctctggctga

SEQ ID NO: 5101581 - DNA, 22 bp, Homo sapiens
aagctctggctgaaccctgtgc

SEQ ID NO: 5101582 - DNA, 11 bp, Homo sapiens
aagctcttcat

SEQ ID NO: 5101583 - DNA, 17 bp, Homo sapiens
aagctcttgaagacact

SEQ ID NO: 5101584 - DNA, 12 bp, Homo sapiens
aagctgaaaata

SEQ ID NO: 5101585 - DNA, 14 bp, Homo sapiens
aagctgaaaatata

SEQ ID NO: 5101586 - DNA, 13 bp, Homo sapiens
aagctgaaaatgt

SEQ ID NO: 5101587 - DNA, 16 bp, Homo sapiens
aagctgaaaatgtgta

SEQ ID NO: 5101588 - DNA, 12 bp, Homo sapiens
aagctgaaattt

SEQ ID NO: 5101589 - DNA, 13 bp, Homo sapiens
aagctgaaatttt

SEQ ID NO: 5101590 - DNA, 22 bp, Homo sapiens
aagctgaaattttagaaatatt

SEQ ID NO: 5101591 - DNA, 17 bp, Homo sapiens
aagctgaagaggttgaa

SEQ ID NO: 5101592 - DNA, 15 bp, Homo sapiens
aagctgaagccgcca

SEQ ID NO: 5101593 - DNA, 19 bp, Homo sapiens
aagctgaagtgaaggagaa

SEQ ID NO: 5101594 - DNA, 17 bp, Homo sapiens
aagctgaagtgcatcca

SEQ ID NO: 5101595 - DNA, 19 bp, Homo sapiens
aagctgaagtgcatccaaa

SEQ ID NO: 5101596 - DNA, 22 bp, Homo sapiens
aagctgaagtttcactccggag

SEQ ID NO: 5101597 - DNA, 14 bp, Homo sapiens
aagctgaataaagt

SEQ ID NO: 5101598 - DNA, 23 bp, Homo sapiens
aagctgaatacattctgctttca

SEQ ID NO: 5101599 - DNA, 13 bp, Homo sapiens
aagctgaatattt

SEQ ID NO: 5101600 - DNA, 23 bp, Homo sapiens
aagctgaatattttttatttcta

SEQ ID NO: 5101601 - DNA, 22 bp, Homo sapiens
aagctgaatgtcaaacagtgcc

SEQ ID NO: 5101602 - DNA, 19 bp, Homo sapiens
aagctgacagcactacaaa

SEQ ID NO: 5101603 - DNA, 20 bp, Homo sapiens
aagctgacgaacttccatgg

SEQ ID NO: 5101604 - DNA, 16 bp, Homo sapiens
aagctgacttggcact

SEQ ID NO: 5101605 - DNA, 14 bp, Homo sapiens
aagctgacttggct

SEQ ID NO: 5101606 - DNA, 22 bp, Homo sapiens
aagctgactttatagctgcaag

SEQ ID NO: 5101607 - DNA, 18 bp, Homo sapiens
aagctgagaactcctgac

SEQ ID NO: 5101608 - DNA, 21 bp, Homo sapiens
aagctgagaagaagctgagga

SEQ ID NO: 5101609 - DNA, 18 bp, Homo sapiens
aagctgagagaccctggc

SEQ ID NO: 5101610 - DNA, 20 bp, Homo sapiens
aagctgagagaccctggcct

SEQ ID NO: 5101611 - DNA, 23 bp, Homo sapiens
aagctgagcaggcccgacagaga

SEQ ID NO: 5101612 - DNA, 11 bp, Homo sapiens
aagctgagcca

SEQ ID NO: 5101613 - DNA, 11 bp, Homo sapiens
aagctgagcct

SEQ ID NO: 5101614 - DNA, 13 bp, Homo sapiens
aagctgagcctgc

SEQ ID NO: 5101615 - DNA, 15 bp, Homo sapiens
aagctgagcctgcag

SEQ ID NO: 5101616 - DNA, 15 bp, Homo sapiens
aagctgagctggctt

SEQ ID NO: 5101617 - DNA, 19 bp, Homo sapiens
aagctgaggaggtgctgca

SEQ ID NO: 5101618 - DNA, 12 bp, Homo sapiens
aagctgaggcct

SEQ ID NO: 5101619 - DNA, 14 bp, Homo sapiens
aagctgaggcggga

SEQ ID NO: 5101620 - DNA, 13 bp, Homo sapiens
aagctgaggtgcc

SEQ ID NO: 5101621 - DNA, 19 bp, Homo sapiens
aagctgaggtgcccaggag

SEQ ID NO: 5101622 - DNA, 12 bp, Homo sapiens
aagctgaggtgg

SEQ ID NO: 5101623 - DNA, 19 bp, Homo sapiens
aagctgagtattaaaatgt

SEQ ID NO: 5101624 - DNA, 23 bp, Homo sapiens
aagctgagtgactgtaggcaggg

SEQ ID NO: 5101625 - DNA, 23 bp, Homo sapiens
aagctgagttacttgtctgaggc

SEQ ID NO: 5101626 - DNA, 15 bp, Homo sapiens
aagctgagtttccta

SEQ ID NO: 5101627 - DNA, 22 bp, Homo sapiens
aagctgatagtgtttcgttaag

SEQ ID NO: 5101628 - DNA, 21 bp, Homo sapiens
aagctgatccagtttccggaa

SEQ ID NO: 5101629 - DNA, 23 bp, Homo sapiens
aagctgatccagtttccggaaac

SEQ ID NO: 5101630 - DNA, 18 bp, Homo sapiens
aagctgatgaagttaagc

SEQ ID NO: 5101631 - DNA, 12 bp, Homo sapiens
aagctgatggac

SEQ ID NO: 5101632 - DNA, 15 bp, Homo sapiens
aagctgattaaatga

SEQ ID NO: 5101633 - DNA, 17 bp, Homo sapiens
aagctgattactgtcaa

SEQ ID NO: 5101634 - DNA, 19 bp, Homo sapiens
aagctgattactgtcaata

SEQ ID NO: 5101635 - DNA, 23 bp, Homo sapiens
aagctgattactgtcaataaaca

SEQ ID NO: 5101636 - DNA, 13 bp, Homo sapiens
aagctgcaataaa

SEQ ID NO: 5101637 - DNA, 22 bp, Homo sapiens
aagctgcaccctcaggcaggtg

SEQ ID NO: 5101638 - DNA, 12 bp, Homo sapiens
aagctgcactca

SEQ ID NO: 5101639 - DNA, 12 bp, Homo sapiens
aagctgcactgt

SEQ ID NO: 5101640 - DNA, 12 bp, Homo sapiens
aagctgcagctt

SEQ ID NO: 5101641 - DNA, 22 bp, Homo sapiens
aagctgcaggtgccagggccca

SEQ ID NO: 5101642 - DNA, 14 bp, Homo sapiens
aagctgcatatgcc

SEQ ID NO: 5101643 - DNA, 17 bp, Homo sapiens
aagctgcatttaaatca

SEQ ID NO: 5101644 - DNA, 20 bp, Homo sapiens
aagctgccacccctcttctg

SEQ ID NO: 5101645 - DNA, 17 bp, Homo sapiens
aagctgccagcccagaa

SEQ ID NO: 5101646 - DNA, 22 bp, Homo sapiens
aagctgccagccgagatagcca

SEQ ID NO: 5101647 - DNA, 16 bp, Homo sapiens
aagcagattacctctt

SEQ ID NO: 5101648 - DNA, 19 bp, Homo sapiens
aagcagatttctgcttcct

SEQ ID NO: 5101649 - DNA, 21 bp, Homo sapiens
aagcagattttcctaaggcca

SEQ ID NO: 5101650 - DNA, 22 bp, Homo sapiens
aagcagattttcctaaggccac

SEQ ID NO: 5101651 - DNA, 14 bp, Homo sapiens
aagcagcaaaatcc

SEQ ID NO: 5101652 - DNA, 16 bp, Homo sapiens
aagcagcaaaatcctt

SEQ ID NO: 5101653 - DNA, 17 bp, Homo sapiens
aagcagcaaaatcctta

SEQ ID NO: 5101654 - DNA, 15 bp, Homo sapiens
aagcagcaaggtggg

SEQ ID NO: 5101655 - DNA, 21 bp, Homo sapiens
aagcagcaaggtgggggtcag

SEQ ID NO: 5101656 - DNA, 14 bp, Homo sapiens
aagcagcaattaat

SEQ ID NO: 5101657 - DNA, 15 bp, Homo sapiens
aagcagcacaaggaa

SEQ ID NO: 5101658 - DNA, 18 bp, Homo sapiens
aagcagcagaggtgagaa

SEQ ID NO: 5101659 - DNA, 18 bp, Homo sapiens
aagcagcagctaggactg

SEQ ID NO: 5101660 - DNA, 17 bp, Homo sapiens
aagcagcataaagaatt

SEQ ID NO: 5101661 - DNA, 16 bp, Homo sapiens
aagcagcatcttctgg

SEQ ID NO: 5101662 - DNA, 13 bp, Homo sapiens
aagcagcattcag

SEQ ID NO: 5101663 - DNA, 16 bp, Homo sapiens
aagcagcattctggag

SEQ ID NO: 5101664 - DNA, 14 bp, Homo sapiens
aagcagccaagctc

SEQ ID NO: 5101665 - DNA, 20 bp, Homo sapiens
aagcagccccctgtggcggc

SEQ ID NO: 5101666 - DNA, 14 bp, Homo sapiens
aagcagccctctgc

SEQ ID NO: 5101667 - DNA, 15 bp, Homo sapiens
aagcagccctctgcc

SEQ ID NO: 5101668 - DNA, 14 bp, Homo sapiens
aagcagcccttgct

SEQ ID NO: 5101669 - DNA, 15 bp, Homo sapiens
aagcagcccttgctt

SEQ ID NO: 5101670 - DNA, 16 bp, Homo sapiens
aagcagcccttggcca

SEQ ID NO: 5101671 - DNA, 22 bp, Homo sapiens
aagcagcctctccccaggtcca

SEQ ID NO: 5101672 - DNA, 19 bp, Homo sapiens
aagcagcctgattgaaaag

SEQ ID NO: 5101673 - DNA, 18 bp, Homo sapiens
aagcagcctttctgtgga

SEQ ID NO: 5101674 - DNA, 18 bp, Homo sapiens
aagcagcctttgtggttt

SEQ ID NO: 5101675 - DNA, 21 bp, Homo sapiens
aagcagcctttttcaccatgg

SEQ ID NO: 5101676 - DNA, 12 bp, Homo sapiens
aagcagcgagtg

SEQ ID NO: 5101677 - DNA, 15 bp, Homo sapiens
aagcagcgagtgcat

SEQ ID NO: 5101678 - DNA, 21 bp, Homo sapiens
aagcagcgctagtggagggtt

SEQ ID NO: 5101679 - DNA, 13 bp, Homo sapiens
aagcagctcaaag

SEQ ID NO: 5101680 - DNA, 19 bp, Homo sapiens
aagcagctcaaaggcacag

SEQ ID NO: 5101681 - DNA, 17 bp, Homo sapiens
aagcagctctaaaacat

SEQ ID NO: 5101682 - DNA, 13 bp, Homo sapiens
aagcagctctccc

SEQ ID NO: 5101683 - DNA, 14 bp, Homo sapiens
aagcagctctgcct

SEQ ID NO: 5101684 - DNA, 23 bp, Homo sapiens
aagcagctgattcagcagtgcct

SEQ ID NO: 5101685 - DNA, 19 bp, Homo sapiens
aagcagctgcattttttat

SEQ ID NO: 5101686 - DNA, 11 bp, Homo sapiens
aagcagctggg

SEQ ID NO: 5101687 - DNA, 15 bp, Homo sapiens
aagcagcttagagtt

SEQ ID NO: 5101688 - DNA, 23 bp, Homo sapiens
aagcaggaaaaaaggaatattta

SEQ ID NO: 5101689 - DNA, 21 bp, Homo sapiens
aagcaggaaagatcccaagtc

SEQ ID NO: 5101690 - DNA, 22 bp, Homo sapiens
aagcaggaaatgaaaatgtctt

SEQ ID NO: 5101691 - DNA, 11 bp, Homo sapiens
aagcaggaagc

SEQ ID NO: 5101692 - DNA, 13 bp, Homo sapiens
aagcaggaagctc

SEQ ID NO: 5101693 - DNA, 19 bp, Homo sapiens
aagcaggaaggatggcaag

SEQ ID NO: 5101694 - DNA, 22 bp, Homo sapiens
aagcaggacctagagccgggca

SEQ ID NO: 5101695 - DNA, 15 bp, Homo sapiens
aagcaggacctggca

SEQ ID NO: 5101696 - DNA, 15 bp, Homo sapiens
aagcaggaggccctt

SEQ ID NO: 5101697 - DNA, 18 bp, Homo sapiens
aagcaggaggcccttgtc

SEQ ID NO: 5101698 - DNA, 16 bp, Homo sapiens
aagcaggcaagcatgt

SEQ ID NO: 5101699 - DNA, 16 bp, Homo sapiens
aagcaggcagagcggg

SEQ ID NO: 5101700 - DNA, 20 bp, Homo sapiens
aagcaggcagagcggggagg

SEQ ID NO: 5101701 - DNA, 23 bp, Homo sapiens
aagcaggcgcaagggaggcccag

SEQ ID NO: 5101702 - DNA, 16 bp, Homo sapiens
aagcaggctacactga

SEQ ID NO: 5101703 - DNA, 20 bp, Homo sapiens
aagcagggaaagctccacgg

SEQ ID NO: 5101704 - DNA, 16 bp, Homo sapiens
aagcagggaatttcta

SEQ ID NO: 5101705 - DNA, 22 bp, Homo sapiens
aagcagggaatttctatctaaa

SEQ ID NO: 5101706 - DNA, 15 bp, Homo sapiens
aagcagggacttgaa

SEQ ID NO: 5101707 - DNA, 12 bp, Homo sapiens
aagcagggcagc

SEQ ID NO: 5101708 - DNA, 19 bp, Homo sapiens
aagcaggggagtatgcaaa

SEQ ID NO: 5101709 - DNA, 18 bp, Homo sapiens
aagcagggtaccctttgg

SEQ ID NO: 5101710 - DNA, 14 bp, Homo sapiens
aagcaggtggatct

SEQ ID NO: 5101711 - DNA, 20 bp, Homo sapiens
aagcaggtggatctatttca

SEQ ID NO: 5101712 - DNA, 15 bp, Homo sapiens
aagcaggttaaatgt

SEQ ID NO: 5101713 - DNA, 17 bp, Homo sapiens
aagcaggttaaatgttt

SEQ ID NO: 5101714 - DNA, 21 bp, Homo sapiens
aagcaggttaaatgttttgta

SEQ ID NO: 5101715 - DNA, 21 bp, Homo sapiens
aagcaggttagagaaaataga

SEQ ID NO: 5101716 - DNA, 18 bp, Homo sapiens
aagcaggttcccaagctc

SEQ ID NO: 5101717 - DNA, 19 bp, Homo sapiens
aagcaggttcccaagctca

SEQ ID NO: 5101718 - DNA, 15 bp, Homo sapiens
aagcaggttcttgat

SEQ ID NO: 5101719 - DNA, 16 bp, Homo sapiens
aagcaggttcttgatg

SEQ ID NO: 5101720 - DNA, 14 bp, Homo sapiens
aagcaggttcttgt

SEQ ID NO: 5101721 - DNA, 22 bp, Homo sapiens
aagcaggttgaggggctcctgg

SEQ ID NO: 5101722 - DNA, 17 bp, Homo sapiens
aagcaggtttcttgctt

SEQ ID NO: 5101723 - DNA, 14 bp, Homo sapiens
aagcaggtttttat

SEQ ID NO: 5101724 - DNA, 14 bp, Homo sapiens
aagcagtaaaaact

SEQ ID NO: 5101725 - DNA, 14 bp, Homo sapiens
aagcagtaaaataa

SEQ ID NO: 5101726 - DNA, 16 bp, Homo sapiens
aagcagtaaaataaaa

SEQ ID NO: 5101727 - DNA, 17 bp, Homo sapiens
aagcagtaaaataaaaa

SEQ ID NO: 5101728 - DNA, 19 bp, Homo sapiens
aagcagtaaaataaaaaac

SEQ ID NO: 5101729 - DNA, 17 bp, Homo sapiens
aagcagtacatcttgtg

SEQ ID NO: 5101730 - DNA, 20 bp, Homo sapiens
aagcagtacatcttgtgcat

SEQ ID NO: 5101731 - DNA, 22 bp, Homo sapiens
aagcagtacatcttgtgcatgc

SEQ ID NO: 5101732 - DNA, 14 bp, Homo sapiens
aagcagtaccctac

SEQ ID NO: 5101733 - DNA, 20 bp, Homo sapiens
aagcagtaggagaaacaaat

SEQ ID NO: 5101734 - DNA, 16 bp, Homo sapiens
aagcagtatataataa

SEQ ID NO: 5101735 - DNA, 23 bp, Homo sapiens
aagcagtatatattctttcacaa

SEQ ID NO: 5101736 - DNA, 20 bp, Homo sapiens
aagcagtatgtacaggctga

SEQ ID NO: 5101737 - DNA, 12 bp, Homo sapiens
aagcagtatttt

SEQ ID NO: 5101738 - DNA, 17 bp, Homo sapiens
aagcagtatttttcttg

SEQ ID NO: 5101739 - DNA, 18 bp, Homo sapiens
aagcagtatttttcttga

SEQ ID NO: 5101740 - DNA, 17 bp, Homo sapiens
aagcagtcccattcata

SEQ ID NO: 5101741 - DNA, 17 bp, Homo sapiens
aagcagtcgtgcctgtg

SEQ ID NO: 5101742 - DNA, 20 bp, Homo sapiens
aagcagtctaccctgtcctt

SEQ ID NO: 5101743 - DNA, 14 bp, Homo sapiens
aagcagtgcccagg

SEQ ID NO: 5101744 - DNA, 16 bp, Homo sapiens
aagcagtgcttgtaaa

SEQ ID NO: 5101745 - DNA, 17 bp, Homo sapiens
aagcagtggacaccagg

SEQ ID NO: 5101746 - DNA, 21 bp, Homo sapiens
aagcagtggcttagctgccat

SEQ ID NO: 5101747 - DNA, 22 bp, Homo sapiens
aagcagtggggtaggctgctgc

SEQ ID NO: 5101748 - DNA, 21 bp, Homo sapiens
aagcagtgtgagcagggctga

SEQ ID NO: 5101749 - DNA, 20 bp, Homo sapiens
aagcagttaagccccctcct

SEQ ID NO: 5101750 - DNA, 21 bp, Homo sapiens
aagcagttatggtgatgactt

SEQ ID NO: 5101751 - DNA, 14 bp, Homo sapiens
aagcagttcagaag

SEQ ID NO: 5101752 - DNA, 14 bp, Homo sapiens
aagcagttcattct

SEQ ID NO: 5101753 - DNA, 14 bp, Homo sapiens
aagcagttctcaca

SEQ ID NO: 5101754 - DNA, 16 bp, Homo sapiens
aagcagttctcacaat

SEQ ID NO: 5101755 - DNA, 15 bp, Homo sapiens
aagcagttgtgtcag

SEQ ID NO: 5101756 - DNA, 13 bp, Homo sapiens
aagcagtttcaat

SEQ ID NO: 5101757 - DNA, 15 bp, Homo sapiens
aagcagtttcagata

SEQ ID NO: 5101758 - DNA, 20 bp, Homo sapiens
aagcagtttcagataaatca

SEQ ID NO: 5101759 - DNA, 14 bp, Homo sapiens
aagcagttttgtaa

SEQ ID NO: 5101760 - DNA, 15 bp, Homo sapiens
aagcagttttgtaaa

SEQ ID NO: 5101761 - DNA, 16 bp, Homo sapiens
aagcagttttgtaaat

SEQ ID NO: 5101762 - DNA, 17 bp, Homo sapiens
aagcagttttgtaaatg

SEQ ID NO: 5101763 - DNA, 17 bp, Homo sapiens
aagcataaaaacatttt

SEQ ID NO: 5101764 - DNA, 15 bp, Homo sapiens
aagcataaaagatca

SEQ ID NO: 5101765 - DNA, 16 bp, Homo sapiens
aagcataaaagatcac

SEQ ID NO: 5101766 - DNA, 21 bp, Homo sapiens
aagcataaaatggaataacat

SEQ ID NO: 5101767 - DNA, 18 bp, Homo sapiens
aagcataaacatcacatg

SEQ ID NO: 5101768 - DNA, 20 bp, Homo sapiens
aagcataaacatcacatggc

SEQ ID NO: 5101769 - DNA, 17 bp, Homo sapiens
aagcataatctgaaaac

SEQ ID NO: 5101770 - DNA, 23 bp, Homo sapiens
aagcataatttgtttaaaattct

SEQ ID NO: 5101771 - DNA, 14 bp, Homo sapiens
aagcatactttgta

SEQ ID NO: 5101772 - DNA, 17 bp, Homo sapiens
aagcatactttgtaaat

SEQ ID NO: 5101773 - DNA, 16 bp, Homo sapiens
aagcatagacgtctca

SEQ ID NO: 5101774 - DNA, 20 bp, Homo sapiens
aagcatagataatattgttt

SEQ ID NO: 5101775 - DNA, 14 bp, Homo sapiens
aagcatagatgttt

SEQ ID NO: 5101776 - DNA, 16 bp, Homo sapiens
aagcatagatgttttg

SEQ ID NO: 5101777 - DNA, 17 bp, Homo sapiens
aagcatagatgttttgg

SEQ ID NO: 5101778 - DNA, 15 bp, Homo sapiens
aagcatagctacaat

SEQ ID NO: 5101779 - DNA, 20 bp, Homo sapiens
aagcatagctacaatttgtt

SEQ ID NO: 5101780 - DNA, 13 bp, Homo sapiens
aagcatataaaat

SEQ ID NO: 5101781 - DNA, 14 bp, Homo sapiens
aagcatataaaatg

SEQ ID NO: 5101782 - DNA, 15 bp, Homo sapiens
aagcatataaaatgg

SEQ ID NO: 5101783 - DNA, 15 bp, Homo sapiens
aagcatatagagatg

SEQ ID NO: 5101784 - DNA, 16 bp, Homo sapiens
aagcatatagagatga

SEQ ID NO: 5101785 - DNA, 19 bp, Homo sapiens
aagcatatgcagccaacca

SEQ ID NO: 5101786 - DNA, 18 bp, Homo sapiens
aagcatatgcctacttgt

SEQ ID NO: 5101787 - DNA, 19 bp, Homo sapiens
aagcatatgtgttggcttg

SEQ ID NO: 5101788 - DNA, 14 bp, Homo sapiens
aagcatattggaaa

SEQ ID NO: 5101789 - DNA, 16 bp, Homo sapiens
aagcatattggaaagt

SEQ ID NO: 5101790 - DNA, 13 bp, Homo sapiens
aagcatatttgag

SEQ ID NO: 5101791 - DNA, 18 bp, Homo sapiens
aagcatcaaataatacat

SEQ ID NO: 5101792 - DNA, 17 bp, Homo sapiens
aagcatcacacagtggc

SEQ ID NO: 5101793 - DNA, 19 bp, Homo sapiens
aagcatcacctcaggccag

SEQ ID NO: 5101794 - DNA, 22 bp, Homo sapiens
aagcatcagagatggtaatcta

SEQ ID NO: 5101795 - DNA, 18 bp, Homo sapiens
aagcatcagggggaagaa

SEQ ID NO: 5101796 - DNA, 15 bp, Homo sapiens
aagcatcagtagctg

SEQ ID NO: 5101797 - DNA, 22 bp, Homo sapiens
aagcatcattacaatacagtat

SEQ ID NO: 5101798 - DNA, 14 bp, Homo sapiens
aagcatcattattt

SEQ ID NO: 5101799 - DNA, 13 bp, Homo sapiens
aagcatcattgtc

SEQ ID NO: 5101800 - DNA, 14 bp, Homo sapiens
aagcatcattgtcc

SEQ ID NO: 5101801 - DNA, 13 bp, Homo sapiens
aagcatccaggca

SEQ ID NO: 5101802 - DNA, 23 bp, Homo sapiens
aagcatccctcacccatcctaga

SEQ ID NO: 5101803 - DNA, 14 bp, Homo sapiens
aagcatcctcagaa

SEQ ID NO: 5101804 - DNA, 16 bp, Homo sapiens
aagcatcctccacatc

SEQ ID NO: 5101805 - DNA, 23 bp, Homo sapiens
aagcatcctccccaccagagctg

SEQ ID NO: 5101806 - DNA, 21 bp, Homo sapiens
aagcatcctctccaaagttgg

SEQ ID NO: 5101807 - DNA, 18 bp, Homo sapiens
aagcatcggagggaattg

SEQ ID NO: 5101808 - DNA, 23 bp, Homo sapiens
aagcatcggtcatgtgtgtattt

SEQ ID NO: 5101809 - DNA, 12 bp, Homo sapiens
aagcatctaaac

SEQ ID NO: 5101810 - DNA, 13 bp, Homo sapiens
aagcatctaaact

SEQ ID NO: 5101811 - DNA, 13 bp, Homo sapiens
aagcatctaagga

SEQ ID NO: 5101812 - DNA, 12 bp, Homo sapiens
aagcatctactt

SEQ ID NO: 5101813 - DNA, 12 bp, Homo sapiens
aagcatctcctg

SEQ ID NO: 5101814 - DNA, 16 bp, Homo sapiens
aagcatctctgaccag

SEQ ID NO: 5101815 - DNA, 16 bp, Homo sapiens
aagcatctgatagaat

SEQ ID NO: 5101816 - DNA, 18 bp, Homo sapiens
aagcatctgccacaaaaa

SEQ ID NO: 5101817 - DNA, 23 bp, Homo sapiens
aagcatctgccacaaaaatgttc

SEQ ID NO: 5101818 - DNA, 13 bp, Homo sapiens
aagcatctggctc

SEQ ID NO: 5101819 - DNA, 17 bp, Homo sapiens
aagcatctggctctaat

SEQ ID NO: 5101820 - DNA, 12 bp, Homo sapiens
aagcatctgtgt

SEQ ID NO: 5101821 - DNA, 14 bp, Homo sapiens
aagcatcttgcatt

SEQ ID NO: 5101822 - DNA, 13 bp, Homo sapiens
aagcatgaaaaag

SEQ ID NO: 5101823 - DNA, 14 bp, Homo sapiens
aagcatgaaacatt

SEQ ID NO: 5101824 - DNA, 13 bp, Homo sapiens
aagcatgaaatgt

SEQ ID NO: 5101825 - DNA, 12 bp, Homo sapiens
aagcatgaacag

SEQ ID NO: 5101826 - DNA, 17 bp, Homo sapiens
aagcatgaataaaatta

SEQ ID NO: 5101827 - DNA, 20 bp, Homo sapiens
aagcatgaataaaattaggt

SEQ ID NO: 5101828 - DNA, 20 bp, Homo sapiens
aagctgccgaaccaaaagaa

SEQ ID NO: 5101829 - DNA, 16 bp, Homo sapiens
aagctgcctcaaggaa

SEQ ID NO: 5101830 - DNA, 20 bp, Homo sapiens
aagctgcctccctgtccacc

SEQ ID NO: 5101831 - DNA, 15 bp, Homo sapiens
aagctgcctgctttt

SEQ ID NO: 5101832 - DNA, 20 bp, Homo sapiens
aagctgcctgcttttcactg

SEQ ID NO: 5101833 - DNA, 15 bp, Homo sapiens
aagctgcctggtata

SEQ ID NO: 5101834 - DNA, 14 bp, Homo sapiens
aagctgcctgtagt

SEQ ID NO: 5101835 - DNA, 12 bp, Homo sapiens
aagctgcctgtg

SEQ ID NO: 5101836 - DNA, 14 bp, Homo sapiens
aagctgcctgtgcc

SEQ ID NO: 5101837 - DNA, 16 bp, Homo sapiens
aagctgcctgtgccat

SEQ ID NO: 5101838 - DNA, 20 bp, Homo sapiens
aagctgctcaacttgcaaaa

SEQ ID NO: 5101839 - DNA, 19 bp, Homo sapiens
aagctgctcactgctcaca

SEQ ID NO: 5101840 - DNA, 17 bp, Homo sapiens
aagctgctccaggcctg

SEQ ID NO: 5101841 - DNA, 20 bp, Homo sapiens
aagctgctctgagccacagt

SEQ ID NO: 5101842 - DNA, 12 bp, Homo sapiens
aagctgctctgc

SEQ ID NO: 5101843 - DNA, 16 bp, Homo sapiens
aagctgctgacagtgt

SEQ ID NO: 5101844 - DNA, 22 bp, Homo sapiens
aagctgctgaccaattgtgctg

SEQ ID NO: 5101845 - DNA, 13 bp, Homo sapiens
aagctgctgcagc

SEQ ID NO: 5101846 - DNA, 19 bp, Homo sapiens
aagctgctgccgcctcacc

SEQ ID NO: 5101847 - DNA, 14 bp, Homo sapiens
aagctgctgggcca

SEQ ID NO: 5101848 - DNA, 12 bp, Homo sapiens
aagctgctgtct

SEQ ID NO: 5101849 - DNA, 15 bp, Homo sapiens
aagctgctgtctcta

SEQ ID NO: 5101850 - DNA, 13 bp, Homo sapiens
aagctgctgtgtc

SEQ ID NO: 5101851 - DNA, 14 bp, Homo sapiens
aagctgctgtgtcc

SEQ ID NO: 5101852 - DNA, 13 bp, Homo sapiens
aagctgcttgaat

SEQ ID NO: 5101853 - DNA, 15 bp, Homo sapiens
aagctgcttgactat

SEQ ID NO: 5101854 - DNA, 22 bp, Homo sapiens
aagctgctttcttctctgcctc

SEQ ID NO: 5101855 - DNA, 24 bp, Homo sapiens
aagctgctttcttctctgcctcct

SEQ ID NO: 5101856 - DNA, 14 bp, Homo sapiens
aagctggaaaggcc

SEQ ID NO: 5101857 - DNA, 21 bp, Homo sapiens
aagctggaagactgtgcagaa

SEQ ID NO: 5101858 - DNA, 11 bp, Homo sapiens
aagctggaagc

SEQ ID NO: 5101859 - DNA, 19 bp, Homo sapiens
aagctggacaagaagctgc

SEQ ID NO: 5101860 - DNA, 15 bp, Homo sapiens
aagctggaccttttc

SEQ ID NO: 5101861 - DNA, 16 bp, Homo sapiens
aagctggactgaccaa

SEQ ID NO: 5101862 - DNA, 19 bp, Homo sapiens
aagctggacttctgtgggc

SEQ ID NO: 5101863 - DNA, 16 bp, Homo sapiens
aagctggagcagcgga

SEQ ID NO: 5101864 - DNA, 23 bp, Homo sapiens
aagctggaggactagaacctgga

SEQ ID NO: 5101865 - DNA, 22 bp, Homo sapiens
aagctggaggctccaggactcc

SEQ ID NO: 5101866 - DNA, 23 bp, Homo sapiens
aagctggaggctccaggactcca

SEQ ID NO: 5101867 - DNA, 17 bp, Homo sapiens
aagctggagtgcagtgg

SEQ ID NO: 5101868 - DNA, 16 bp, Homo sapiens
aagctggcaggagaca

SEQ ID NO: 5101869 - DNA, 11 bp, Homo sapiens
aagctggccct

SEQ ID NO: 5101870 - DNA, 20 bp, Homo sapiens
aagctggccctcagctccct

SEQ ID NO: 5101871 - DNA, 13 bp, Homo sapiens
aagctggccctgc

SEQ ID NO: 5101872 - DNA, 20 bp, Homo sapiens
aagctggccctgcctcctgg

SEQ ID NO: 5101873 - DNA, 12 bp, Homo sapiens
aagctggcctct

SEQ ID NO: 5101874 - DNA, 22 bp, Homo sapiens
aagctggcctctaccacaaggg

SEQ ID NO: 5101875 - DNA, 21 bp, Homo sapiens
aagctggctagtcctttctgt

SEQ ID NO: 5101876 - DNA, 17 bp, Homo sapiens
aagctggctctgtttga

SEQ ID NO: 5101877 - DNA, 12 bp, Homo sapiens
aagctggctggg

SEQ ID NO: 5101878 - DNA, 16 bp, Homo sapiens
aagctggctttcatcc

SEQ ID NO: 5101879 - DNA, 21 bp, Homo sapiens
aagctggctttgaaacctcag

SEQ ID NO: 5101880 - DNA, 23 bp, Homo sapiens
aagctgggaacttctaaacactt

SEQ ID NO: 5101881 - DNA, 16 bp, Homo sapiens
aagctgggactcattc

SEQ ID NO: 5101882 - DNA, 13 bp, Homo sapiens
aagctgggaggga

SEQ ID NO: 5101883 - DNA, 18 bp, Homo sapiens
aagctgggagggaggggg

SEQ ID NO: 5101884 - DNA, 11 bp, Homo sapiens
aagctgggcag

SEQ ID NO: 5101885 - DNA, 13 bp, Homo sapiens
aagctgggcaggt

SEQ ID NO: 5101886 - DNA, 19 bp, Homo sapiens
aagctgggcatgaacgcac

SEQ ID NO: 5101887 - DNA, 11 bp, Homo sapiens
aagctgggccc

SEQ ID NO: 5101888 - DNA, 13 bp, Homo sapiens
aagctgggctctt

SEQ ID NO: 5101889 - DNA, 15 bp, Homo sapiens
aagctggggacagct

SEQ ID NO: 5101890 - DNA, 17 bp, Homo sapiens
aagctgggggtggggag

SEQ ID NO: 5101891 - DNA, 16 bp, Homo sapiens
aagctggggttcatga

SEQ ID NO: 5101892 - DNA, 22 bp, Homo sapiens
aagctggggttcatgacaatgg

SEQ ID NO: 5101893 - DNA, 18 bp, Homo sapiens
aagctggtcccactcagt

SEQ ID NO: 5101894 - DNA, 21 bp, Homo sapiens
aagctggtcccactcagtcca

SEQ ID NO: 5101895 - DNA, 18 bp, Homo sapiens
aagctggtctttgagcga

SEQ ID NO: 5101896 - DNA, 13 bp, Homo sapiens
aagctggtgctac

SEQ ID NO: 5101897 - DNA, 21 bp, Homo sapiens
aagctggtgggtgaaagaaat

SEQ ID NO: 5101898 - DNA, 15 bp, Homo sapiens
aagctggtttacaga

SEQ ID NO: 5101899 - DNA, 14 bp, Homo sapiens
aagctgtaaattac

SEQ ID NO: 5101900 - DNA, 23 bp, Homo sapiens
aagctgtaaattactatggctga

SEQ ID NO: 5101901 - DNA, 17 bp, Homo sapiens
aagctgtaatatcattt

SEQ ID NO: 5101902 - DNA, 22 bp, Homo sapiens
aagctgtaatatcattttatag

SEQ ID NO: 5101903 - DNA, 18 bp, Homo sapiens
aagctgtacaaagggaag

SEQ ID NO: 5101904 - DNA, 20 bp, Homo sapiens
aagctgtacaaagggaagca

SEQ ID NO: 5101905 - DNA, 18 bp, Homo sapiens
aagctgtactcagagcag

SEQ ID NO: 5101906 - DNA, 20 bp, Homo sapiens
aagctgtactcagagcagag

SEQ ID NO: 5101907 - DNA, 14 bp, Homo sapiens
aagctgtattttga

SEQ ID NO: 5101908 - DNA, 16 bp, Homo sapiens
aagctgtcagaagttt

SEQ ID NO: 5101909 - DNA, 12 bp, Homo sapiens
aagctgtccctg

SEQ ID NO: 5101910 - DNA, 21 bp, Homo sapiens
aagctgtccctgcagggccat

SEQ ID NO: 5101911 - DNA, 23 bp, Homo sapiens
aagctgtctactggacaatctta

SEQ ID NO: 5101912 - DNA, 13 bp, Homo sapiens
aagctgtcttgga

SEQ ID NO: 5101913 - DNA, 23 bp, Homo sapiens
aagctgtcttggaagtctgtctc

SEQ ID NO: 5101914 - DNA, 13 bp, Homo sapiens
aagctgtgaaatt

SEQ ID NO: 5101915 - DNA, 14 bp, Homo sapiens
aagctgtgccttca

SEQ ID NO: 5101916 - DNA, 19 bp, Homo sapiens
aagctgtgccttcagctgt

SEQ ID NO: 5101917 - DNA, 14 bp, Homo sapiens
aagctgtgtctctg

SEQ ID NO: 5101918 - DNA, 16 bp, Homo sapiens
aagctgtgtctctgta

SEQ ID NO: 5101919 - DNA, 21 bp, Homo sapiens
aagctgtgtctgcccaatgaa

SEQ ID NO: 5101920 - DNA, 23 bp, Homo sapiens
aagctgtgtctgcccaatgaata

SEQ ID NO: 5101921 - DNA, 21 bp, Homo sapiens
aagctgtgtgctctccaagcc

SEQ ID NO: 5101922 - DNA, 18 bp, Homo sapiens
aagctgtgtggcagtctg

SEQ ID NO: 5101923 - DNA, 18 bp, Homo sapiens
aagctgtgttacttgaag

SEQ ID NO: 5101924 - DNA, 17 bp, Homo sapiens
aagctgtgttcatccag

SEQ ID NO: 5101925 - DNA, 16 bp, Homo sapiens
aagctgtgttgaaaca

SEQ ID NO: 5101926 - DNA, 20 bp, Homo sapiens
aagctgtgttgaaacagaaa

SEQ ID NO: 5101927 - DNA, 22 bp, Homo sapiens
aagctgttaaaatacataactt

SEQ ID NO: 5101928 - DNA, 18 bp, Homo sapiens
aagctgttaaactgttag

SEQ ID NO: 5101929 - DNA, 20 bp, Homo sapiens
aagctgttaaactgttagca

SEQ ID NO: 5101930 - DNA, 18 bp, Homo sapiens
aagctgttagttaaaatc

SEQ ID NO: 5101931 - DNA, 16 bp, Homo sapiens
aagctgttatttcttc

SEQ ID NO: 5101932 - DNA, 23 bp, Homo sapiens
aagctgttctcattcctgttctt

SEQ ID NO: 5101933 - DNA, 14 bp, Homo sapiens
aagctgttctctgc

SEQ ID NO: 5101934 - DNA, 16 bp, Homo sapiens
aagctgttctctgctt

SEQ ID NO: 5101935 - DNA, 16 bp, Homo sapiens
aagctgttcttcctgg

SEQ ID NO: 5101936 - DNA, 16 bp, Homo sapiens
aagctgttgggagaaa

SEQ ID NO: 5101937 - DNA, 13 bp, Homo sapiens
aagctgttgtaca

SEQ ID NO: 5101938 - DNA, 21 bp, Homo sapiens
aagctgtttagtttgttaatt

SEQ ID NO: 5101939 - DNA, 15 bp, Homo sapiens
aagctgtttccatag

SEQ ID NO: 5101940 - DNA, 20 bp, Homo sapiens
aagctgtttgccaagctgaa

SEQ ID NO: 5101941 - DNA, 21 bp, Homo sapiens
aagctgtttgccaagctgaag

SEQ ID NO: 5101942 - DNA, 17 bp, Homo sapiens
aagctgtttggaaaaga

SEQ ID NO: 5101943 - DNA, 17 bp, Homo sapiens
aagctgtttggttttaa

SEQ ID NO: 5101944 - DNA, 19 bp, Homo sapiens
aagctgtttttgtgctctt

SEQ ID NO: 5101945 - DNA, 15 bp, Homo sapiens
aagcttaaaactttg

SEQ ID NO: 5101946 - DNA, 17 bp, Homo sapiens
aagcttaaaactttgaa

SEQ ID NO: 5101947 - DNA, 14 bp, Homo sapiens
aagcttaaaataag

SEQ ID NO: 5101948 - DNA, 18 bp, Homo sapiens
aagcttaaaataagtgaa

SEQ ID NO: 5101949 - DNA, 19 bp, Homo sapiens
aagcttaaagtatctacct

SEQ ID NO: 5101950 - DNA, 22 bp, Homo sapiens
aagcttaaattgcttttgttgt

SEQ ID NO: 5101951 - DNA, 14 bp, Homo sapiens
aagcttaacatttc

SEQ ID NO: 5101952 - DNA, 13 bp, Homo sapiens
aagcttaaggaga

SEQ ID NO: 5101953 - DNA, 16 bp, Homo sapiens
aagcttaaggagagga

SEQ ID NO: 5101954 - DNA, 17 bp, Homo sapiens
aagcttaatagccctcc

SEQ ID NO: 5101955 - DNA, 14 bp, Homo sapiens
aagcttagtataaa

SEQ ID NO: 5101956 - DNA, 17 bp, Homo sapiens
aagcttagtcctgggag

SEQ ID NO: 5101957 - DNA, 19 bp, Homo sapiens
aagcttagtcctgggagag

SEQ ID NO: 5101958 - DNA, 19 bp, Homo sapiens
aagcttagtgagcagtgag

SEQ ID NO: 5101959 - DNA, 17 bp, Homo sapiens
aagcttatgtttcttat

SEQ ID NO: 5101960 - DNA, 15 bp, Homo sapiens
aagcttattaatgct

SEQ ID NO: 5101961 - DNA, 20 bp, Homo sapiens
aagcttattaatgctaaggg

SEQ ID NO: 5101962 - DNA, 14 bp, Homo sapiens
aagcttatttaatt

SEQ ID NO: 5101963 - DNA, 18 bp, Homo sapiens
aagcttatttttatgtgg

SEQ ID NO: 5101964 - DNA, 14 bp, Homo sapiens
aagcttcaaaaact

SEQ ID NO: 5101965 - DNA, 17 bp, Homo sapiens
aagcttcaaagccatat

SEQ ID NO: 5101966 - DNA, 19 bp, Homo sapiens
aagcttcaaagtttatatg

SEQ ID NO: 5101967 - DNA, 14 bp, Homo sapiens
aagcttcaaattaa

SEQ ID NO: 5101968 - DNA, 19 bp, Homo sapiens
aagcttcaaccctcagcct

SEQ ID NO: 5101969 - DNA, 16 bp, Homo sapiens
aagcttcagagcctag

SEQ ID NO: 5101970 - DNA, 17 bp, Homo sapiens
aagcttcagagcctagc

SEQ ID NO: 5101971 - DNA, 18 bp, Homo sapiens
aagcttcagagcctagcc

SEQ ID NO: 5101972 - DNA, 19 bp, Homo sapiens
aagcttcagagcctagcca

SEQ ID NO: 5101973 - DNA, 20 bp, Homo sapiens
aagcttcagagcctagccac

SEQ ID NO: 5101974 - DNA, 15 bp, Homo sapiens
aagcttcagcaggag

SEQ ID NO: 5101975 - DNA, 15 bp, Homo sapiens
aagcttcagtttcct

SEQ ID NO: 5101976 - DNA, 21 bp, Homo sapiens
aagcttcatgcacttaaagaa

SEQ ID NO: 5101977 - DNA, 14 bp, Homo sapiens
aagcttcattctca

SEQ ID NO: 5101978 - DNA, 21 bp, Homo sapiens
aagcttccaggaaaaaggaca

SEQ ID NO: 5101979 - DNA, 19 bp, Homo sapiens
aagcttccagtccaatctc

SEQ ID NO: 5101980 - DNA, 15 bp, Homo sapiens
aagcttccatgatgc

SEQ ID NO: 5101981 - DNA, 16 bp, Homo sapiens
aagcttccatgattct

SEQ ID NO: 5101982 - DNA, 17 bp, Homo sapiens
aagcttccctccctgct

SEQ ID NO: 5101983 - DNA, 19 bp, Homo sapiens
aagcttcctagcttatctc

SEQ ID NO: 5101984 - DNA, 21 bp, Homo sapiens
aagcttcctagcttatctccc

SEQ ID NO: 5101985 - DNA, 18 bp, Homo sapiens
aagcttctagaggctcat

SEQ ID NO: 5101986 - DNA, 23 bp, Homo sapiens
aagcttctagaggctcatggccc

SEQ ID NO: 5101987 - DNA, 15 bp, Homo sapiens
aagcttctctctgag

SEQ ID NO: 5101988 - DNA, 18 bp, Homo sapiens
aagcttctgccttctgga

SEQ ID NO: 5101989 - DNA, 20 bp, Homo sapiens
aagcttcttaaatgagaagg

SEQ ID NO: 5101990 - DNA, 12 bp, Homo sapiens
aagcttcttaat

SEQ ID NO: 5101991 - DNA, 14 bp, Homo sapiens
aagcttcttgctga

SEQ ID NO: 5101992 - DNA, 18 bp, Homo sapiens
aagcttgagcctccccca

SEQ ID NO: 5101993 - DNA, 13 bp, Homo sapiens
aagcttgaggcca

SEQ ID NO: 5101994 - DNA, 14 bp, Homo sapiens
aagcttggaggagg

SEQ ID NO: 5101995 - DNA, 15 bp, Homo sapiens
aagcttggaggaggg

SEQ ID NO: 5101996 - DNA, 21 bp, Homo sapiens
aagcttggctgtagaaggaga

SEQ ID NO: 5101997 - DNA, 12 bp, Homo sapiens
aagcttggggaa

SEQ ID NO: 5101998 - DNA, 16 bp, Homo sapiens
aagcttggtcaaactt

SEQ ID NO: 5101999 - DNA, 18 bp, Homo sapiens
aagcttggtcaaactttt

SEQ ID NO: 5102000 - DNA, 23 bp, Homo sapiens
aagcttggtcaaactttttccag

SEQ ID NO: 5102001 - DNA, 15 bp, Homo sapiens
aagcttgtaaatatg

SEQ ID NO: 5102002 - DNA, 13 bp, Homo sapiens
aagcttgtatata

SEQ ID NO: 5102003 - DNA, 20 bp, Homo sapiens
aagcttgtattatcagtgaa

SEQ ID NO: 5102004 - DNA, 23 bp, Homo sapiens
aagcttgtattatcagtgaatat

SEQ ID NO: 5102005 - DNA, 17 bp, Homo sapiens
aagcttgtcctgagaag

SEQ ID NO: 5102006 - DNA, 13 bp, Homo sapiens
aagcttgtggagg

SEQ ID NO: 5102007 - DNA, 21 bp, Homo sapiens
aagcttgtggaggagggagag

SEQ ID NO: 5102008 - DNA, 22 bp, Homo sapiens
aagcatgaataacatttaaatt

SEQ ID NO: 5102009 - DNA, 23 bp, Homo sapiens
aagcatgaataacatttaaattc

SEQ ID NO: 5102010 - DNA, 17 bp, Homo sapiens
aagcatgaatatttctt

SEQ ID NO: 5102011 - DNA, 15 bp, Homo sapiens
aagcatgaattggaa

SEQ ID NO: 5102012 - DNA, 18 bp, Homo sapiens
aagcatgacagaaaatat

SEQ ID NO: 5102013 - DNA, 20 bp, Homo sapiens
aagcatgacagaaaatatgt

SEQ ID NO: 5102014 - DNA, 22 bp, Homo sapiens
aagcatgacagaaaatatgtat

SEQ ID NO: 5102015 - DNA, 23 bp, Homo sapiens
aagcatgaggtgagagaaagcca

SEQ ID NO: 5102016 - DNA, 15 bp, Homo sapiens
aagcatgagtggcct

SEQ ID NO: 5102017 - DNA, 14 bp, Homo sapiens
aagcatgatcttgt

SEQ ID NO: 5102018 - DNA, 21 bp, Homo sapiens
aagcatgatcttgttaatgca

SEQ ID NO: 5102019 - DNA, 22 bp, Homo sapiens
aagcatgatgggaaaatatttc

SEQ ID NO: 5102020 - DNA, 14 bp, Homo sapiens
aagcatgcataaat

SEQ ID NO: 5102021 - DNA, 15 bp, Homo sapiens
aagcatgcataaatc

SEQ ID NO: 5102022 - DNA, 13 bp, Homo sapiens
aagcatgcattct

SEQ ID NO: 5102023 - DNA, 16 bp, Homo sapiens
aagcatgccaatttct

SEQ ID NO: 5102024 - DNA, 19 bp, Homo sapiens
aagcatgccgttctgcacc

SEQ ID NO: 5102025 - DNA, 17 bp, Homo sapiens
aagcatgctcagtattg

SEQ ID NO: 5102026 - DNA, 18 bp, Homo sapiens
aagcatgctcagtattga

SEQ ID NO: 5102027 - DNA, 21 bp, Homo sapiens
aagcatgctttctttgagttt

SEQ ID NO: 5102028 - DNA, 16 bp, Homo sapiens
aagcatgctttgctgc

SEQ ID NO: 5102029 - DNA, 17 bp, Homo sapiens
aagcatggaacaaagca

SEQ ID NO: 5102030 - DNA, 18 bp, Homo sapiens
aagcatggaacaaagcat

SEQ ID NO: 5102031 - DNA, 19 bp, Homo sapiens
aagcatggaacaaagcatg

SEQ ID NO: 5102032 - DNA, 16 bp, Homo sapiens
aagcatggcctggact

SEQ ID NO: 5102033 - DNA, 22 bp, Homo sapiens
aagcatggcctggactgactgc

SEQ ID NO: 5102034 - DNA, 15 bp, Homo sapiens
aagcatggctgtctg

SEQ ID NO: 5102035 - DNA, 17 bp, Homo sapiens
aagcatggctgtctgca

SEQ ID NO: 5102036 - DNA, 23 bp, Homo sapiens
aagcatggctgtctgcacagagg

SEQ ID NO: 5102037 - DNA, 16 bp, Homo sapiens
aagcatgggaaaaaga

SEQ ID NO: 5102038 - DNA, 19 bp, Homo sapiens
aagcatgtaacttatatta

SEQ ID NO: 5102039 - DNA, 16 bp, Homo sapiens
aagcatgtacagtgtt

SEQ ID NO: 5102040 - DNA, 21 bp, Homo sapiens
aagcatgtacagtgttctgtt

SEQ ID NO: 5102041 - DNA, 21 bp, Homo sapiens
aagcatgtctctctgccaaga

SEQ ID NO: 5102042 - DNA, 12 bp, Homo sapiens
aagcatgtgaga

SEQ ID NO: 5102043 - DNA, 12 bp, Homo sapiens
aagcatgtttca

SEQ ID NO: 5102044 - DNA, 15 bp, Homo sapiens
aagcatgtttcatgt

SEQ ID NO: 5102045 - DNA, 15 bp, Homo sapiens
aagcattaaaatgca

SEQ ID NO: 5102046 - DNA, 17 bp, Homo sapiens
aagcattaacttctctg

SEQ ID NO: 5102047 - DNA, 13 bp, Homo sapiens
aagcattactctt

SEQ ID NO: 5102048 - DNA, 16 bp, Homo sapiens
aagcattactcttgta

SEQ ID NO: 5102049 - DNA, 19 bp, Homo sapiens
aagcattactttaacctcc

SEQ ID NO: 5102050 - DNA, 17 bp, Homo sapiens
aagcattactttgtaga

SEQ ID NO: 5102051 - DNA, 13 bp, Homo sapiens
aagcattcacaac

SEQ ID NO: 5102052 - DNA, 15 bp, Homo sapiens
aagcattcagaagaa

SEQ ID NO: 5102053 - DNA, 22 bp, Homo sapiens
aagcattccttagcagctcagg

SEQ ID NO: 5102054 - DNA, 23 bp, Homo sapiens
aagcattccttagcagctcaggc

SEQ ID NO: 5102055 - DNA, 13 bp, Homo sapiens
aagcattccttct

SEQ ID NO: 5102056 - DNA, 20 bp, Homo sapiens
aagcattccttctttgataa

SEQ ID NO: 5102057 - DNA, 21 bp, Homo sapiens
aagcattccttctttgataat

SEQ ID NO: 5102058 - DNA, 23 bp, Homo sapiens
aagcattccttctttgataatgt

SEQ ID NO: 5102059 - DNA, 15 bp, Homo sapiens
aagcattctcattgg

SEQ ID NO: 5102060 - DNA, 14 bp, Homo sapiens
aagcattctcccca

SEQ ID NO: 5102061 - DNA, 13 bp, Homo sapiens
aagcattctttaa

SEQ ID NO: 5102062 - DNA, 13 bp, Homo sapiens
aagcattgaaatt

SEQ ID NO: 5102063 - DNA, 19 bp, Homo sapiens
aagcattgcctggactgac

SEQ ID NO: 5102064 - DNA, 20 bp, Homo sapiens
aagcattgcttttattttga

SEQ ID NO: 5102065 - DNA, 19 bp, Homo sapiens
aagcattgggtcagaccca

SEQ ID NO: 5102066 - DNA, 14 bp, Homo sapiens
aagcattgtgagta

SEQ ID NO: 5102067 - DNA, 22 bp, Homo sapiens
aagcattgtttgcttattgttc

SEQ ID NO: 5102068 - DNA, 23 bp, Homo sapiens
aagcattgtttgcttattgttcc

SEQ ID NO: 5102069 - DNA, 22 bp, Homo sapiens
aagcatttaacccccctgtaca

SEQ ID NO: 5102070 - DNA, 19 bp, Homo sapiens
aagcatttaatgtagccat

SEQ ID NO: 5102071 - DNA, 16 bp, Homo sapiens
aagcatttagaaaact

SEQ ID NO: 5102072 - DNA, 12 bp, Homo sapiens
aagcatttataa

SEQ ID NO: 5102073 - DNA, 15 bp, Homo sapiens
aagcatttatcattc

SEQ ID NO: 5102074 - DNA, 21 bp, Homo sapiens
aagcatttcaaagccctgcct

SEQ ID NO: 5102075 - DNA, 16 bp, Homo sapiens
aagcatttcaggccag

SEQ ID NO: 5102076 - DNA, 16 bp, Homo sapiens
aagcatttcatgaaaa

SEQ ID NO: 5102077 - DNA, 21 bp, Homo sapiens
aagcatttctagtcccttctc

SEQ ID NO: 5102078 - DNA, 13 bp, Homo sapiens
aagcatttgaatg

SEQ ID NO: 5102079 - DNA, 21 bp, Homo sapiens
aagcatttgaatgcattttgt

SEQ ID NO: 5102080 - DNA, 19 bp, Homo sapiens
aagcatttgatattatcta

SEQ ID NO: 5102081 - DNA, 20 bp, Homo sapiens
aagcatttggtttttcacat

SEQ ID NO: 5102082 - DNA, 13 bp, Homo sapiens
aagcatttgtata

SEQ ID NO: 5102083 - DNA, 14 bp, Homo sapiens
aagcatttgtattt

SEQ ID NO: 5102084 - DNA, 17 bp, Homo sapiens
aagcatttgtattttgt

SEQ ID NO: 5102085 - DNA, 21 bp, Homo sapiens
aagcattttaatgatattgga

SEQ ID NO: 5102086 - DNA, 18 bp, Homo sapiens
aagcattttactgtctgt

SEQ ID NO: 5102087 - DNA, 20 bp, Homo sapiens
aagcattttactgtctgtaa

SEQ ID NO: 5102088 - DNA, 14 bp, Homo sapiens
aagcattttataaa

SEQ ID NO: 5102089 - DNA, 17 bp, Homo sapiens
aagcattttataaatcg

SEQ ID NO: 5102090 - DNA, 15 bp, Homo sapiens
aagcattttcagcat

SEQ ID NO: 5102091 - DNA, 16 bp, Homo sapiens
aagcattttcagcatc

SEQ ID NO: 5102092 - DNA, 21 bp, Homo sapiens
aagcattttcagcatcaaaca

SEQ ID NO: 5102093 - DNA, 22 bp, Homo sapiens
aagcattttcgttacattgtgt

SEQ ID NO: 5102094 - DNA, 12 bp, Homo sapiens
aagcattttgaa

SEQ ID NO: 5102095 - DNA, 16 bp, Homo sapiens
aagcattttgaaacaa

SEQ ID NO: 5102096 - DNA, 15 bp, Homo sapiens
aagcattttgcaaac

SEQ ID NO: 5102097 - DNA, 18 bp, Homo sapiens
aagcattttgggatcctt

SEQ ID NO: 5102098 - DNA, 13 bp, Homo sapiens
aagcattttgtaa

SEQ ID NO: 5102099 - DNA, 18 bp, Homo sapiens
aagcatttttcaatatat

SEQ ID NO: 5102100 - DNA, 19 bp, Homo sapiens
aagcatttttcaatatatt

SEQ ID NO: 5102101 - DNA, 22 bp, Homo sapiens
aagccaaaaaccttagctccct

SEQ ID NO: 5102102 - DNA, 16 bp, Homo sapiens
aagccaaacaaaactg

SEQ ID NO: 5102103 - DNA, 18 bp, Homo sapiens
aagccaaacaagccttag

SEQ ID NO: 5102104 - DNA, 14 bp, Homo sapiens
aagccaaactctgc

SEQ ID NO: 5102105 - DNA, 15 bp, Homo sapiens
aagccaaactctgcc

SEQ ID NO: 5102106 - DNA, 20 bp, Homo sapiens
aagccaaactctgccagcca

SEQ ID NO: 5102107 - DNA, 14 bp, Homo sapiens
aagccaaactgttg

SEQ ID NO: 5102108 - DNA, 12 bp, Homo sapiens
aagccaaagaaa

SEQ ID NO: 5102109 - DNA, 13 bp, Homo sapiens
aagccaaagaaaa

SEQ ID NO: 5102110 - DNA, 14 bp, Homo sapiens
aagccaaagaaaca

SEQ ID NO: 5102111 - DNA, 17 bp, Homo sapiens
aagccaaagaaacaagc

SEQ ID NO: 5102112 - DNA, 22 bp, Homo sapiens
aagccaaagtggcatgttttgt

SEQ ID NO: 5102113 - DNA, 13 bp, Homo sapiens
aagccaaatgaaa

SEQ ID NO: 5102114 - DNA, 18 bp, Homo sapiens
aagccaacaactctgcct

SEQ ID NO: 5102115 - DNA, 19 bp, Homo sapiens
aagccaaccactttcacct

SEQ ID NO: 5102116 - DNA, 23 bp, Homo sapiens
aagccaaccactttcacctggga

SEQ ID NO: 5102117 - DNA, 16 bp, Homo sapiens
aagccaaccagccttt

SEQ ID NO: 5102118 - DNA, 20 bp, Homo sapiens
aagccaaccctggaaaagga

SEQ ID NO: 5102119 - DNA, 17 bp, Homo sapiens
aagccaacttgtaaata

SEQ ID NO: 5102120 - DNA, 19 bp, Homo sapiens
aagccaacttgtaaataca

SEQ ID NO: 5102121 - DNA, 14 bp, Homo sapiens
aagccaagacagtg

SEQ ID NO: 5102122 - DNA, 20 bp, Homo sapiens
aagccaagacagtggcagca

SEQ ID NO: 5102123 - DNA, 19 bp, Homo sapiens
aagccaagctccctggagc

SEQ ID NO: 5102124 - DNA, 17 bp, Homo sapiens
aagccaagctgtgttca

SEQ ID NO: 5102125 - DNA, 17 bp, Homo sapiens
aagccaaggcagcgacc

SEQ ID NO: 5102126 - DNA, 21 bp, Homo sapiens
aagccaaggcagcgaccccag

SEQ ID NO: 5102127 - DNA, 14 bp, Homo sapiens
aagccaaggcagct

SEQ ID NO: 5102128 - DNA, 13 bp, Homo sapiens
aagccaagggaaa

SEQ ID NO: 5102129 - DNA, 16 bp, Homo sapiens
aagccaagggaaaggg

SEQ ID NO: 5102130 - DNA, 23 bp, Homo sapiens
aagccaagggaaaggggtgcttt

SEQ ID NO: 5102131 - DNA, 16 bp, Homo sapiens
aagccaataaataata

SEQ ID NO: 5102132 - DNA, 18 bp, Homo sapiens
aagccaataacacacagc

SEQ ID NO: 5102133 - DNA, 21 bp, Homo sapiens
aagccaatatttactcatcag

SEQ ID NO: 5102134 - DNA, 15 bp, Homo sapiens
aagccaatcccctcc

SEQ ID NO: 5102135 - DNA, 19 bp, Homo sapiens
aagccaatcccctccttgg

SEQ ID NO: 5102136 - DNA, 15 bp, Homo sapiens
aagccaatgtgaatt

SEQ ID NO: 5102137 - DNA, 14 bp, Homo sapiens
aagccaatttcaat

SEQ ID NO: 5102138 - DNA, 13 bp, Homo sapiens
aagccaatttttc

SEQ ID NO: 5102139 - DNA, 20 bp, Homo sapiens
aagccaatttttctgcactg

SEQ ID NO: 5102140 - DNA, 22 bp, Homo sapiens
aagccaatttttctgcactgag

SEQ ID NO: 5102141 - DNA, 13 bp, Homo sapiens
aagccacacagcc

SEQ ID NO: 5102142 - DNA, 13 bp, Homo sapiens
aagccacagcaga

SEQ ID NO: 5102143 - DNA, 12 bp, Homo sapiens
aagccacagcct

SEQ ID NO: 5102144 - DNA, 14 bp, Homo sapiens
aagccacagcctgt

SEQ ID NO: 5102145 - DNA, 13 bp, Homo sapiens
aagccacaggaag

SEQ ID NO: 5102146 - DNA, 19 bp, Homo sapiens
aagccacaggagccccacc

SEQ ID NO: 5102147 - DNA, 13 bp, Homo sapiens
aagccacaggcct

SEQ ID NO: 5102148 - DNA, 14 bp, Homo sapiens
aagccacaggcctg

SEQ ID NO: 5102149 - DNA, 15 bp, Homo sapiens
aagccacaggcctgg

SEQ ID NO: 5102150 - DNA, 18 bp, Homo sapiens
aagccacaggcctggcct

SEQ ID NO: 5102151 - DNA, 23 bp, Homo sapiens
aagccacaggcctggcctcaact

SEQ ID NO: 5102152 - DNA, 13 bp, Homo sapiens
aagccacagggtg

SEQ ID NO: 5102153 - DNA, 15 bp, Homo sapiens
aagccacataaccag

SEQ ID NO: 5102154 - DNA, 13 bp, Homo sapiens
aagccacatagag

SEQ ID NO: 5102155 - DNA, 12 bp, Homo sapiens
aagccacatctt

SEQ ID NO: 5102156 - DNA, 17 bp, Homo sapiens
aagccacatcttgctct

SEQ ID NO: 5102157 - DNA, 18 bp, Homo sapiens
aagccacatcttgctctg

SEQ ID NO: 5102158 - DNA, 18 bp, Homo sapiens
aagccacattatttctag

SEQ ID NO: 5102159 - DNA, 15 bp, Homo sapiens
aagccaccctcccag

SEQ ID NO: 5102160 - DNA, 18 bp, Homo sapiens
aagccaccctcccagctc

SEQ ID NO: 5102161 - DNA, 19 bp, Homo sapiens
aagccaccctcccagctct

SEQ ID NO: 5102162 - DNA, 21 bp, Homo sapiens
aagccaccctcccagctctga

SEQ ID NO: 5102163 - DNA, 17 bp, Homo sapiens
aagccaccgcagctgct

SEQ ID NO: 5102164 - DNA, 19 bp, Homo sapiens
aagccaccgcagctgctgc

SEQ ID NO: 5102165 - DNA, 20 bp, Homo sapiens
aagccaccgcagctgctgcc

SEQ ID NO: 5102166 - DNA, 23 bp, Homo sapiens
aagccaccgcagctgctgccact

SEQ ID NO: 5102167 - DNA, 14 bp, Homo sapiens
aagccaccgggaga

SEQ ID NO: 5102168 - DNA, 11 bp, Homo sapiens
aagccacctct

SEQ ID NO: 5102169 - DNA, 20 bp, Homo sapiens
aagccacctctccctcaaca

SEQ ID NO: 5102170 - DNA, 14 bp, Homo sapiens
aagccacctgctgc

SEQ ID NO: 5102171 - DNA, 15 bp, Homo sapiens
aagccacctgctgcg

SEQ ID NO: 5102172 - DNA, 19 bp, Homo sapiens
aagccaccttgttacaaat

SEQ ID NO: 5102173 - DNA, 23 bp, Homo sapiens
aagccacgccctccctgctagca

SEQ ID NO: 5102174 - DNA, 15 bp, Homo sapiens
aagccactagactct

SEQ ID NO: 5102175 - DNA, 21 bp, Homo sapiens
aagccactcccgccacacgct

SEQ ID NO: 5102176 - DNA, 13 bp, Homo sapiens
aagccactgaagc

SEQ ID NO: 5102177 - DNA, 17 bp, Homo sapiens
aagccactgaagctggg

SEQ ID NO: 5102178 - DNA, 18 bp, Homo sapiens
aagccactgcctctccct

SEQ ID NO: 5102179 - DNA, 19 bp, Homo sapiens
aagccactgcctctccctc

SEQ ID NO: 5102180 - DNA, 16 bp, Homo sapiens
aagccacttggcccag

SEQ ID NO: 5102181 - DNA, 14 bp, Homo sapiens
aagccacttgtctt

SEQ ID NO: 5102182 - DNA, 17 bp, Homo sapiens
aagccagacaacttctg

SEQ ID NO: 5102183 - DNA, 19 bp, Homo sapiens
aagccagacctagcaggct

SEQ ID NO: 5102184 - DNA, 21 bp, Homo sapiens
aagccagacctagcaggctgt

SEQ ID NO: 5102185 - DNA, 12 bp, Homo sapiens
aagccagagccg

SEQ ID NO: 5102186 - DNA, 14 bp, Homo sapiens
aagccagagcctgg

SEQ ID NO: 5102187 - DNA, 14 bp, Homo sapiens
aagccagagtcaac

SEQ ID NO: 5102188 - DNA, 20 bp, Homo sapiens
aagcttgtggccaatggaac

SEQ ID NO: 5102189 - DNA, 20 bp, Homo sapiens
aagcttgtggtgttcctgaa

SEQ ID NO: 5102190 - DNA, 21 bp, Homo sapiens
aagcttgtggtgttcctgaag

SEQ ID NO: 5102191 - DNA, 12 bp, Homo sapiens
aagcttgtgtat

SEQ ID NO: 5102192 - DNA, 23 bp, Homo sapiens
aagcttgtgtatccattatcatg

SEQ ID NO: 5102193 - DNA, 14 bp, Homo sapiens
aagcttgtgtatct

SEQ ID NO: 5102194 - DNA, 15 bp, Homo sapiens
aagcttgtttccctg

SEQ ID NO: 5102195 - DNA, 16 bp, Homo sapiens
aagcttgtttccctgc

SEQ ID NO: 5102196 - DNA, 20 bp, Homo sapiens
aagcttgtttccctgctggc

SEQ ID NO: 5102197 - DNA, 15 bp, Homo sapiens
aagcttgttttccag

SEQ ID NO: 5102198 - DNA, 17 bp, Homo sapiens
aagctttaaaaaataaa

SEQ ID NO: 5102199 - DNA, 22 bp, Homo sapiens
aagctttaaatgacagtaatat

SEQ ID NO: 5102200 - DNA, 13 bp, Homo sapiens
aagctttactact

SEQ ID NO: 5102201 - DNA, 19 bp, Homo sapiens
aagctttactactgtggaa

SEQ ID NO: 5102202 - DNA, 21 bp, Homo sapiens
aagctttactttagaatttag

SEQ ID NO: 5102203 - DNA, 19 bp, Homo sapiens
aagctttagattgaaattt

SEQ ID NO: 5102204 - DNA, 22 bp, Homo sapiens
aagctttagattgaaatttatg

SEQ ID NO: 5102205 - DNA, 14 bp, Homo sapiens
aagctttaggcaga

SEQ ID NO: 5102206 - DNA, 16 bp, Homo sapiens
aagctttataaacttt

SEQ ID NO: 5102207 - DNA, 14 bp, Homo sapiens
aagctttatctatt

SEQ ID NO: 5102208 - DNA, 13 bp, Homo sapiens
aagctttatcttt

SEQ ID NO: 5102209 - DNA, 15 bp, Homo sapiens
aagctttatctttgt

SEQ ID NO: 5102210 - DNA, 18 bp, Homo sapiens
aagctttatgattttcat

SEQ ID NO: 5102211 - DNA, 16 bp, Homo sapiens
aagctttattaccagt

SEQ ID NO: 5102212 - DNA, 21 bp, Homo sapiens
aagctttattaccagtggcgt

SEQ ID NO: 5102213 - DNA, 16 bp, Homo sapiens
aagctttatttctagc

SEQ ID NO: 5102214 - DNA, 20 bp, Homo sapiens
aagctttattttgagatgta

SEQ ID NO: 5102215 - DNA, 16 bp, Homo sapiens
aagctttcagaatatg

SEQ ID NO: 5102216 - DNA, 21 bp, Homo sapiens
aagctttcagaatatgtcagt

SEQ ID NO: 5102217 - DNA, 23 bp, Homo sapiens
aagctttcatgtaaactgtgcac

SEQ ID NO: 5102218 - DNA, 21 bp, Homo sapiens
aagctttccgagtcaagtgat

SEQ ID NO: 5102219 - DNA, 12 bp, Homo sapiens
aagctttcctgc

SEQ ID NO: 5102220 - DNA, 21 bp, Homo sapiens
aagctttcctgccccaggcct

SEQ ID NO: 5102221 - DNA, 22 bp, Homo sapiens
aagctttcctgtttccagggtc

SEQ ID NO: 5102222 - DNA, 16 bp, Homo sapiens
aagctttctcctttga

SEQ ID NO: 5102223 - DNA, 19 bp, Homo sapiens
aagctttctgacaagataa

SEQ ID NO: 5102224 - DNA, 23 bp, Homo sapiens
aagctttcttctacaaccagagc

SEQ ID NO: 5102225 - DNA, 18 bp, Homo sapiens
aagctttcttttctaact

SEQ ID NO: 5102226 - DNA, 18 bp, Homo sapiens
aagctttgaaataaaata

SEQ ID NO: 5102227 - DNA, 23 bp, Homo sapiens
aagctttgaatacccccagagac

SEQ ID NO: 5102228 - DNA, 19 bp, Homo sapiens
aagctttgaatactaaatt

SEQ ID NO: 5102229 - DNA, 22 bp, Homo sapiens
aagctttgaggctctgtcactg

SEQ ID NO: 5102230 - DNA, 11 bp, Homo sapiens
aagctttgcta

SEQ ID NO: 5102231 - DNA, 17 bp, Homo sapiens
aagctttgctacaaatt

SEQ ID NO: 5102232 - DNA, 12 bp, Homo sapiens
aagctttggaaa

SEQ ID NO: 5102233 - DNA, 16 bp, Homo sapiens
aagctttggaaaaatc

SEQ ID NO: 5102234 - DNA, 16 bp, Homo sapiens
aagctttggaagcagc

SEQ ID NO: 5102235 - DNA, 15 bp, Homo sapiens
aagctttggccctca

SEQ ID NO: 5102236 - DNA, 21 bp, Homo sapiens
aagctttgggggagtgggcgc

SEQ ID NO: 5102237 - DNA, 17 bp, Homo sapiens
aagctttggttatgaaa

SEQ ID NO: 5102238 - DNA, 23 bp, Homo sapiens
aagctttgtaattcagaaatcct

SEQ ID NO: 5102239 - DNA, 20 bp, Homo sapiens
aagctttgtcccctgcttca

SEQ ID NO: 5102240 - DNA, 13 bp, Homo sapiens
aagctttgtgaaa

SEQ ID NO: 5102241 - DNA, 14 bp, Homo sapiens
aagctttgttctgg

SEQ ID NO: 5102242 - DNA, 17 bp, Homo sapiens
aagcttttaagaaaaac

SEQ ID NO: 5102243 - DNA, 14 bp, Homo sapiens
aagcttttagaaat

SEQ ID NO: 5102244 - DNA, 12 bp, Homo sapiens
aagcttttatga

SEQ ID NO: 5102245 - DNA, 11 bp, Homo sapiens
aagcttttatt

SEQ ID NO: 5102246 - DNA, 17 bp, Homo sapiens
aagcttttatttcttgt

SEQ ID NO: 5102247 - DNA, 18 bp, Homo sapiens
aagcttttcattttaata

SEQ ID NO: 5102248 - DNA, 14 bp, Homo sapiens
aagcttttcctaat

SEQ ID NO: 5102249 - DNA, 13 bp, Homo sapiens
aagcttttctttt

SEQ ID NO: 5102250 - DNA, 13 bp, Homo sapiens
aagcttttgcata

SEQ ID NO: 5102251 - DNA, 19 bp, Homo sapiens
aagcttttgcatattgcat

SEQ ID NO: 5102252 - DNA, 18 bp, Homo sapiens
aagcttttgcctgcaaga

SEQ ID NO: 5102253 - DNA, 19 bp, Homo sapiens
aagcttttgtctacacacc

SEQ ID NO: 5102254 - DNA, 22 bp, Homo sapiens
aagcttttgtctacacaccctg

SEQ ID NO: 5102255 - DNA, 22 bp, Homo sapiens
aagcttttgttttgcttacaaa

SEQ ID NO: 5102256 - DNA, 12 bp, Homo sapiens
aagctttttaat

SEQ ID NO: 5102257 - DNA, 23 bp, Homo sapiens
aagctttttattcctcctgctca

SEQ ID NO: 5102258 - DNA, 21 bp, Homo sapiens
aagctttttgatgtataaaac

SEQ ID NO: 5102259 - DNA, 15 bp, Homo sapiens
aagctttttgtttgc

SEQ ID NO: 5102260 - DNA, 20 bp, Homo sapiens
aagctttttgtttgcatcat

SEQ ID NO: 5102261 - DNA, 22 bp, Homo sapiens
aagcttttttattttttataca

SEQ ID NO: 5102262 - DNA, 22 bp, Homo sapiens
aagctttttttcttgctagtat

SEQ ID NO: 5102263 - DNA, 22 bp, Homo sapiens
aagctttttttttttgaacccc

SEQ ID NO: 5102264 - DNA, 23 bp, Homo sapiens
aagctttttttttttgaacccca

SEQ ID NO: 5102265 - DNA, 16 bp, Homo sapiens
aaggaaaaaaaacaca

SEQ ID NO: 5102266 - DNA, 23 bp, Homo sapiens
aaggaaaaaaaacacaaaacaac

SEQ ID NO: 5102267 - DNA, 17 bp, Homo sapiens
aaggaaaaaagaaaaaa

SEQ ID NO: 5102268 - DNA, 21 bp, Homo sapiens
aaggaaaaaagaaaaaagcaa

SEQ ID NO: 5102269 - DNA, 13 bp, Homo sapiens
aaggaaaaaagga

SEQ ID NO: 5102270 - DNA, 16 bp, Homo sapiens
aaggaaaaaaggagga

SEQ ID NO: 5102271 - DNA, 17 bp, Homo sapiens
aaggaaaaaatgcaaac

SEQ ID NO: 5102272 - DNA, 20 bp, Homo sapiens
aaggaaaaaattatgttttt

SEQ ID NO: 5102273 - DNA, 23 bp, Homo sapiens
aaggaaaaaattatgtttttcag

SEQ ID NO: 5102274 - DNA, 19 bp, Homo sapiens
aaggaaaaacacaagcaaa

SEQ ID NO: 5102275 - DNA, 18 bp, Homo sapiens
aaggaaaaactgatgttt

SEQ ID NO: 5102276 - DNA, 12 bp, Homo sapiens
aaggaaaaagct

SEQ ID NO: 5102277 - DNA, 17 bp, Homo sapiens
aaggaaaaataaatatt

SEQ ID NO: 5102278 - DNA, 15 bp, Homo sapiens
aaggaaaaataatca

SEQ ID NO: 5102279 - DNA, 16 bp, Homo sapiens
aaggaaaaataatcaa

SEQ ID NO: 5102280 - DNA, 17 bp, Homo sapiens
aaggaaaaataatcaag

SEQ ID NO: 5102281 - DNA, 14 bp, Homo sapiens
aaggaaaaatgtgt

SEQ ID NO: 5102282 - DNA, 17 bp, Homo sapiens
aaggaaaaatgtgtaat

SEQ ID NO: 5102283 - DNA, 21 bp, Homo sapiens
aaggaaaaatttttttgttgt

SEQ ID NO: 5102284 - DNA, 18 bp, Homo sapiens
aaggaaaacaaaaaactt

SEQ ID NO: 5102285 - DNA, 15 bp, Homo sapiens
aaggaaaaccaggga

SEQ ID NO: 5102286 - DNA, 16 bp, Homo sapiens
aaggaaaaccagggat

SEQ ID NO: 5102287 - DNA, 16 bp, Homo sapiens
aaggaaaactacctgt

SEQ ID NO: 5102288 - DNA, 22 bp, Homo sapiens
aaggaaaactatgtattaattt

SEQ ID NO: 5102289 - DNA, 20 bp, Homo sapiens
aaggaaaactcaccatttca

SEQ ID NO: 5102290 - DNA, 15 bp, Homo sapiens
aaggaaaactcttgg

SEQ ID NO: 5102291 - DNA, 19 bp, Homo sapiens
aaggaaaactgccataaca

SEQ ID NO: 5102292 - DNA, 13 bp, Homo sapiens
aaggaaaagaaaa

SEQ ID NO: 5102293 - DNA, 16 bp, Homo sapiens
aaggaaaagaaaaaaa

SEQ ID NO: 5102294 - DNA, 20 bp, Homo sapiens
aaggaaaagagaaacactaa

SEQ ID NO: 5102295 - DNA, 12 bp, Homo sapiens
aaggaaaagagt

SEQ ID NO: 5102296 - DNA, 14 bp, Homo sapiens
aaggaaaagagtaa

SEQ ID NO: 5102297 - DNA, 23 bp, Homo sapiens
aaggaaaagagtatcaaaggcag

SEQ ID NO: 5102298 - DNA, 14 bp, Homo sapiens
aaggaaaagcaaga

SEQ ID NO: 5102299 - DNA, 12 bp, Homo sapiens
aaggaaaagcac

SEQ ID NO: 5102300 - DNA, 14 bp, Homo sapiens
aaggaaaagcacaa

SEQ ID NO: 5102301 - DNA, 15 bp, Homo sapiens
aaggaaaaggaggag

SEQ ID NO: 5102302 - DNA, 14 bp, Homo sapiens
aaggaaaaggctgg

SEQ ID NO: 5102303 - DNA, 15 bp, Homo sapiens
aaggaaaaggctggc

SEQ ID NO: 5102304 - DNA, 13 bp, Homo sapiens
aaggaaaagtaag

SEQ ID NO: 5102305 - DNA, 23 bp, Homo sapiens
aaggaaaagtcaacatcttctct

SEQ ID NO: 5102306 - DNA, 13 bp, Homo sapiens
aaggaaaagttct

SEQ ID NO: 5102307 - DNA, 14 bp, Homo sapiens
aaggaaaatgatct

SEQ ID NO: 5102308 - DNA, 16 bp, Homo sapiens
aaggaaaattgaaagt

SEQ ID NO: 5102309 - DNA, 19 bp, Homo sapiens
aaggaaacaacaaaggaag

SEQ ID NO: 5102310 - DNA, 16 bp, Homo sapiens
aaggaaacaacatttt

SEQ ID NO: 5102311 - DNA, 19 bp, Homo sapiens
aaggaaacaatggtcacaa

SEQ ID NO: 5102312 - DNA, 17 bp, Homo sapiens
aaggaaacactaaggct

SEQ ID NO: 5102313 - DNA, 23 bp, Homo sapiens
aaggaaacactaaggctgcttca

SEQ ID NO: 5102314 - DNA, 16 bp, Homo sapiens
aaggaaacattttatc

SEQ ID NO: 5102315 - DNA, 22 bp, Homo sapiens
aaggaaaccaagtggtcaggag

SEQ ID NO: 5102316 - DNA, 16 bp, Homo sapiens
aaggaaaccacagctg

SEQ ID NO: 5102317 - DNA, 20 bp, Homo sapiens
aaggaaaccacagctgctgg

SEQ ID NO: 5102318 - DNA, 16 bp, Homo sapiens
aaggaaacccagctct

SEQ ID NO: 5102319 - DNA, 21 bp, Homo sapiens
aaggaaaccgcctagtttact

SEQ ID NO: 5102320 - DNA, 18 bp, Homo sapiens
aaggaaaccttttcatgc

SEQ ID NO: 5102321 - DNA, 13 bp, Homo sapiens
aaggaaactagac

SEQ ID NO: 5102322 - DNA, 21 bp, Homo sapiens
aaggaaactagacaagtaaaa

SEQ ID NO: 5102323 - DNA, 19 bp, Homo sapiens
aaggaaactcttatctcag

SEQ ID NO: 5102324 - DNA, 18 bp, Homo sapiens
aaggaaactgaggcccag

SEQ ID NO: 5102325 - DNA, 22 bp, Homo sapiens
aaggaaactgctttatttttat

SEQ ID NO: 5102326 - DNA, 19 bp, Homo sapiens
aaggaaacttctatgtaaa

SEQ ID NO: 5102327 - DNA, 21 bp, Homo sapiens
aaggaaacttctgatgtttat

SEQ ID NO: 5102328 - DNA, 13 bp, Homo sapiens
aaggaaactttat

SEQ ID NO: 5102329 - DNA, 14 bp, Homo sapiens
aaggaaactttcct

SEQ ID NO: 5102330 - DNA, 12 bp, Homo sapiens
aaggaaagaaaa

SEQ ID NO: 5102331 - DNA, 15 bp, Homo sapiens
aaggaaagaaaacat

SEQ ID NO: 5102332 - DNA, 15 bp, Homo sapiens
aaggaaagaaggaga

SEQ ID NO: 5102333 - DNA, 20 bp, Homo sapiens
aaggaaagaaggagatgaat

SEQ ID NO: 5102334 - DNA, 22 bp, Homo sapiens
aaggaaagatgatgctcagttt

SEQ ID NO: 5102335 - DNA, 19 bp, Homo sapiens
aaggaaagatttgtgaact

SEQ ID NO: 5102336 - DNA, 16 bp, Homo sapiens
aaggaaagcaaggcag

SEQ ID NO: 5102337 - DNA, 13 bp, Homo sapiens
aaggaaagcaata

SEQ ID NO: 5102338 - DNA, 14 bp, Homo sapiens
aaggaaagcatgtc

SEQ ID NO: 5102339 - DNA, 20 bp, Homo sapiens
aaggaaagccagaaggaaaa

SEQ ID NO: 5102340 - DNA, 18 bp, Homo sapiens
aaggaaagctgtgtttat

SEQ ID NO: 5102341 - DNA, 14 bp, Homo sapiens
aaggaaaggaatat

SEQ ID NO: 5102342 - DNA, 19 bp, Homo sapiens
aaggaaaggtctcagcttg

SEQ ID NO: 5102343 - DNA, 19 bp, Homo sapiens
aaggaaagttggacttgag

SEQ ID NO: 5102344 - DNA, 20 bp, Homo sapiens
aaggaaataaaaaagtctct

SEQ ID NO: 5102345 - DNA, 16 bp, Homo sapiens
aaggaaatacacttct

SEQ ID NO: 5102346 - DNA, 13 bp, Homo sapiens
aaggaaatacttt

SEQ ID NO: 5102347 - DNA, 14 bp, Homo sapiens
aaggaaatatacct

SEQ ID NO: 5102348 - DNA, 15 bp, Homo sapiens
aaggaaatatatttg

SEQ ID NO: 5102349 - DNA, 14 bp, Homo sapiens
aaggaaatattctt

SEQ ID NO: 5102350 - DNA, 19 bp, Homo sapiens
aaggaaatgagtggccagc

SEQ ID NO: 5102351 - DNA, 12 bp, Homo sapiens
aaggaaatgatg

SEQ ID NO: 5102352 - DNA, 17 bp, Homo sapiens
aaggaaatgtcctgcat

SEQ ID NO: 5102353 - DNA, 13 bp, Homo sapiens
aaggaaatgttga

SEQ ID NO: 5102354 - DNA, 17 bp, Homo sapiens
aaggaaatgttgagggc

SEQ ID NO: 5102355 - DNA, 15 bp, Homo sapiens
aaggaaattaagaac

SEQ ID NO: 5102356 - DNA, 18 bp, Homo sapiens
aaggaaatttgtttgtat

SEQ ID NO: 5102357 - DNA, 13 bp, Homo sapiens
aaggaacaaaaat

SEQ ID NO: 5102358 - DNA, 22 bp, Homo sapiens
aaggaacaaaaattacaaagaa

SEQ ID NO: 5102359 - DNA, 13 bp, Homo sapiens
aaggaacaaagac

SEQ ID NO: 5102360 - DNA, 12 bp, Homo sapiens
aaggaacaatgc

SEQ ID NO: 5102361 - DNA, 13 bp, Homo sapiens
aaggaacaatgcc

SEQ ID NO: 5102362 - DNA, 14 bp, Homo sapiens
aaggaacaatgccg

SEQ ID NO: 5102363 - DNA, 13 bp, Homo sapiens
aaggaacactgac

SEQ ID NO: 5102364 - DNA, 15 bp, Homo sapiens
aaggaacactggaaa

SEQ ID NO: 5102365 - DNA, 21 bp, Homo sapiens
aaggaacactggcttgaagga

SEQ ID NO: 5102366 - DNA, 13 bp, Homo sapiens
aaggaacagccac

SEQ ID NO: 5102367 - DNA, 14 bp, Homo sapiens
aaggaacagccaca

SEQ ID NO: 5102368 - DNA, 21 bp, Homo sapiens
aagccagagtttttaaagcct

SEQ ID NO: 5102369 - DNA, 15 bp, Homo sapiens
aagccagcaaagcct

SEQ ID NO: 5102370 - DNA, 22 bp, Homo sapiens
aagccagcaccggaccagcctg

SEQ ID NO: 5102371 - DNA, 11 bp, Homo sapiens
aagccagccac

SEQ ID NO: 5102372 - DNA, 14 bp, Homo sapiens
aagccagccacaga

SEQ ID NO: 5102373 - DNA, 21 bp, Homo sapiens
aagccagccacagacccctgg

SEQ ID NO: 5102374 - DNA, 21 bp, Homo sapiens
aagccagccccctccagctca

SEQ ID NO: 5102375 - DNA, 22 bp, Homo sapiens
aagccagccccctccagctcat

SEQ ID NO: 5102376 - DNA, 19 bp, Homo sapiens
aagccagcctgaccttcct

SEQ ID NO: 5102377 - DNA, 13 bp, Homo sapiens
aagccagcctggt

SEQ ID NO: 5102378 - DNA, 21 bp, Homo sapiens
aagccagcctggtccatgcag

SEQ ID NO: 5102379 - DNA, 20 bp, Homo sapiens
aagccagcgtcctcctctgt

SEQ ID NO: 5102380 - DNA, 19 bp, Homo sapiens
aagccagctctaggcttca

SEQ ID NO: 5102381 - DNA, 12 bp, Homo sapiens
aagccagctgcc

SEQ ID NO: 5102382 - DNA, 21 bp, Homo sapiens
aagccagctgcccccagagcc

SEQ ID NO: 5102383 - DNA, 15 bp, Homo sapiens
aagccagctgcccta

SEQ ID NO: 5102384 - DNA, 15 bp, Homo sapiens
aagccagctgccgac

SEQ ID NO: 5102385 - DNA, 23 bp, Homo sapiens
aagccagctgccgaccagagccc

SEQ ID NO: 5102386 - DNA, 15 bp, Homo sapiens
aagccagctgcctag

SEQ ID NO: 5102387 - DNA, 11 bp, Homo sapiens
aagccagcttg

SEQ ID NO: 5102388 - DNA, 21 bp, Homo sapiens
aagccagcttgtttacatgct

SEQ ID NO: 5102389 - DNA, 17 bp, Homo sapiens
aagccaggaaacatgaa

SEQ ID NO: 5102390 - DNA, 21 bp, Homo sapiens
aagccaggaatttcccaggac

SEQ ID NO: 5102391 - DNA, 11 bp, Homo sapiens
aagccaggaga

SEQ ID NO: 5102392 - DNA, 22 bp, Homo sapiens
aagccaggaggctttaagctcc

SEQ ID NO: 5102393 - DNA, 19 bp, Homo sapiens
aagccaggctcactcacag

SEQ ID NO: 5102394 - DNA, 13 bp, Homo sapiens
aagccaggctcag

SEQ ID NO: 5102395 - DNA, 22 bp, Homo sapiens
aagccaggctcaggagaagcca

SEQ ID NO: 5102396 - DNA, 22 bp, Homo sapiens
aagccagggatggggccacagc

SEQ ID NO: 5102397 - DNA, 19 bp, Homo sapiens
aagccagggcccagagccc

SEQ ID NO: 5102398 - DNA, 16 bp, Homo sapiens
aagccagggctggaga

SEQ ID NO: 5102399 - DNA, 12 bp, Homo sapiens
aagccagggtct

SEQ ID NO: 5102400 - DNA, 19 bp, Homo sapiens
aagccagggtctctccctc

SEQ ID NO: 5102401 - DNA, 20 bp, Homo sapiens
aagccagggtctctccctca

SEQ ID NO: 5102402 - DNA, 16 bp, Homo sapiens
aagccagggtgtgtct

SEQ ID NO: 5102403 - DNA, 17 bp, Homo sapiens
aagccagggttccagac

SEQ ID NO: 5102404 - DNA, 18 bp, Homo sapiens
aagccagggttccagaca

SEQ ID NO: 5102405 - DNA, 15 bp, Homo sapiens
aagccaggtccctct

SEQ ID NO: 5102406 - DNA, 17 bp, Homo sapiens
aagccaggtccctctca

SEQ ID NO: 5102407 - DNA, 16 bp, Homo sapiens
aagccagtcatcatct

SEQ ID NO: 5102408 - DNA, 19 bp, Homo sapiens
aagccagtcatcatctctt

SEQ ID NO: 5102409 - DNA, 16 bp, Homo sapiens
aagccagtctgcgtca

SEQ ID NO: 5102410 - DNA, 23 bp, Homo sapiens
aagccagtggggtcccccctgag

SEQ ID NO: 5102411 - DNA, 20 bp, Homo sapiens
aagccagtgtccttcgagga

SEQ ID NO: 5102412 - DNA, 21 bp, Homo sapiens
aagccagttctccttccctgc

SEQ ID NO: 5102413 - DNA, 16 bp, Homo sapiens
aagccagttttcattt

SEQ ID NO: 5102414 - DNA, 19 bp, Homo sapiens
aagccataacgtgccccca

SEQ ID NO: 5102415 - DNA, 16 bp, Homo sapiens
aagccatagccccagg

SEQ ID NO: 5102416 - DNA, 21 bp, Homo sapiens
aagccatagccccaggcccgc

SEQ ID NO: 5102417 - DNA, 16 bp, Homo sapiens
aagccataggcccagg

SEQ ID NO: 5102418 - DNA, 17 bp, Homo sapiens
aagccataggcccagga

SEQ ID NO: 5102419 - DNA, 20 bp, Homo sapiens
aagccatatgacaatttcaa

SEQ ID NO: 5102420 - DNA, 24 bp, Homo sapiens
aagccatatgacaatttcaaaatg

SEQ ID NO: 5102421 - DNA, 17 bp, Homo sapiens
aagccatatggacactg

SEQ ID NO: 5102422 - DNA, 22 bp, Homo sapiens
aagccatatggacactgtgaca

SEQ ID NO: 5102423 - DNA, 17 bp, Homo sapiens
aagccatcaattttaac

SEQ ID NO: 5102424 - DNA, 23 bp, Homo sapiens
aagccatcacctcagatggcagc

SEQ ID NO: 5102425 - DNA, 19 bp, Homo sapiens
aagccatcatatcccctgt

SEQ ID NO: 5102426 - DNA, 20 bp, Homo sapiens
aagccatcatatcccctgtg

SEQ ID NO: 5102427 - DNA, 14 bp, Homo sapiens
aagccatcatcctc

SEQ ID NO: 5102428 - DNA, 18 bp, Homo sapiens
aagccatcatcctccatt

SEQ ID NO: 5102429 - DNA, 12 bp, Homo sapiens
aagccatctcag

SEQ ID NO: 5102430 - DNA, 17 bp, Homo sapiens
aagccatctgacagcag

SEQ ID NO: 5102431 - DNA, 15 bp, Homo sapiens
aagccatcttggtaa

SEQ ID NO: 5102432 - DNA, 16 bp, Homo sapiens
aagccatgaccttgtg

SEQ ID NO: 5102433 - DNA, 22 bp, Homo sapiens
aagccatgagttccagaaagta

SEQ ID NO: 5102434 - DNA, 15 bp, Homo sapiens
aagccatgctggaaa

SEQ ID NO: 5102435 - DNA, 21 bp, Homo sapiens
aagccatggctgacctctgga

SEQ ID NO: 5102436 - DNA, 18 bp, Homo sapiens
aagccatgggtagcctgg

SEQ ID NO: 5102437 - DNA, 22 bp, Homo sapiens
aagccatgggtagcctgggtgt

SEQ ID NO: 5102438 - DNA, 17 bp, Homo sapiens
aagccatggtgacacac

SEQ ID NO: 5102439 - DNA, 18 bp, Homo sapiens
aagccatggtgacacaca

SEQ ID NO: 5102440 - DNA, 21 bp, Homo sapiens
aagccatggtgacacacagca

SEQ ID NO: 5102441 - DNA, 21 bp, Homo sapiens
aagccatgtataaatgtgata

SEQ ID NO: 5102442 - DNA, 20 bp, Homo sapiens
aagccatgtatttcagggac

SEQ ID NO: 5102443 - DNA, 23 bp, Homo sapiens
aagccatgtatttcagggacctc

SEQ ID NO: 5102444 - DNA, 23 bp, Homo sapiens
aagccatgtgctgcggtcactca

SEQ ID NO: 5102445 - DNA, 22 bp, Homo sapiens
aagccatgtgctttagcataaa

SEQ ID NO: 5102446 - DNA, 20 bp, Homo sapiens
aagccatgttaaatgacttg

SEQ ID NO: 5102447 - DNA, 21 bp, Homo sapiens
aagccatgttccccagttcag

SEQ ID NO: 5102448 - DNA, 15 bp, Homo sapiens
aagccatgtttatta

SEQ ID NO: 5102449 - DNA, 20 bp, Homo sapiens
aagccatgtttattacagta

SEQ ID NO: 5102450 - DNA, 21 bp, Homo sapiens
aagccatgtttattacagtat

SEQ ID NO: 5102451 - DNA, 23 bp, Homo sapiens
aagccatgtttattacagtataa

SEQ ID NO: 5102452 - DNA, 22 bp, Homo sapiens
aagccattaaatgaatattttg

SEQ ID NO: 5102453 - DNA, 23 bp, Homo sapiens
aagccattcacttccccaatctt

SEQ ID NO: 5102454 - DNA, 14 bp, Homo sapiens
aagccattccaaag

SEQ ID NO: 5102455 - DNA, 20 bp, Homo sapiens
aagccattctaaggaaatta

SEQ ID NO: 5102456 - DNA, 16 bp, Homo sapiens
aagccattctgcctca

SEQ ID NO: 5102457 - DNA, 14 bp, Homo sapiens
aagccattctttta

SEQ ID NO: 5102458 - DNA, 17 bp, Homo sapiens
aagccattgaccaccca

SEQ ID NO: 5102459 - DNA, 20 bp, Homo sapiens
aagccattgcttctccctca

SEQ ID NO: 5102460 - DNA, 17 bp, Homo sapiens
aagccattggagagctg

SEQ ID NO: 5102461 - DNA, 12 bp, Homo sapiens
aagccattgtct

SEQ ID NO: 5102462 - DNA, 22 bp, Homo sapiens
aagccattgtttccattacaaa

SEQ ID NO: 5102463 - DNA, 17 bp, Homo sapiens
aagccatttagagggtg

SEQ ID NO: 5102464 - DNA, 20 bp, Homo sapiens
aagccattttttgaggagag

SEQ ID NO: 5102465 - DNA, 14 bp, Homo sapiens
aagcccaaagcctg

SEQ ID NO: 5102466 - DNA, 20 bp, Homo sapiens
aagcccaaatggctctgtga

SEQ ID NO: 5102467 - DNA, 12 bp, Homo sapiens
aagcccaacctc

SEQ ID NO: 5102468 - DNA, 12 bp, Homo sapiens
aagcccaactgg

SEQ ID NO: 5102469 - DNA, 13 bp, Homo sapiens
aagcccaactgtg

SEQ ID NO: 5102470 - DNA, 19 bp, Homo sapiens
aagcccaaggcagtgttcc

SEQ ID NO: 5102471 - DNA, 20 bp, Homo sapiens
aagcccaccaatctgccctt

SEQ ID NO: 5102472 - DNA, 12 bp, Homo sapiens
aagcccaccagg

SEQ ID NO: 5102473 - DNA, 19 bp, Homo sapiens
aagcccaccaggtgtcagg

SEQ ID NO: 5102474 - DNA, 16 bp, Homo sapiens
aagcccaccatttggc

SEQ ID NO: 5102475 - DNA, 14 bp, Homo sapiens
aagcccacccgccc

SEQ ID NO: 5102476 - DNA, 14 bp, Homo sapiens
aagcccacctgggc

SEQ ID NO: 5102477 - DNA, 17 bp, Homo sapiens
aagcccacctgggctgg

SEQ ID NO: 5102478 - DNA, 14 bp, Homo sapiens
aagcccactgcctc

SEQ ID NO: 5102479 - DNA, 16 bp, Homo sapiens
aagcccactgcctcct

SEQ ID NO: 5102480 - DNA, 16 bp, Homo sapiens
aagcccacttcacaca

SEQ ID NO: 5102481 - DNA, 18 bp, Homo sapiens
aagcccagaaaaggacag

SEQ ID NO: 5102482 - DNA, 20 bp, Homo sapiens
aagcccagcactgcttgagg

SEQ ID NO: 5102483 - DNA, 12 bp, Homo sapiens
aagcccagcccg

SEQ ID NO: 5102484 - DNA, 15 bp, Homo sapiens
aagcccagcccggct

SEQ ID NO: 5102485 - DNA, 15 bp, Homo sapiens
aagcccagctccagg

SEQ ID NO: 5102486 - DNA, 16 bp, Homo sapiens
aagcccagctctttgt

SEQ ID NO: 5102487 - DNA, 14 bp, Homo sapiens
aagcccaggaaagg

SEQ ID NO: 5102488 - DNA, 14 bp, Homo sapiens
aagcccaggagccc

SEQ ID NO: 5102489 - DNA, 11 bp, Homo sapiens
aagcccaggat

SEQ ID NO: 5102490 - DNA, 14 bp, Homo sapiens
aagcccaggcccct

SEQ ID NO: 5102491 - DNA, 11 bp, Homo sapiens
aagcccaggct

SEQ ID NO: 5102492 - DNA, 12 bp, Homo sapiens
aagcccaggctc

SEQ ID NO: 5102493 - DNA, 17 bp, Homo sapiens
aagcccaggcttcctgg

SEQ ID NO: 5102494 - DNA, 21 bp, Homo sapiens
aagcccaggtgccagcctgag

SEQ ID NO: 5102495 - DNA, 23 bp, Homo sapiens
aagcccagtgctgctgtaaatac

SEQ ID NO: 5102496 - DNA, 16 bp, Homo sapiens
aagcccagtggtgagg

SEQ ID NO: 5102497 - DNA, 14 bp, Homo sapiens
aagcccagtttccc

SEQ ID NO: 5102498 - DNA, 18 bp, Homo sapiens
aagcccatcctgaccagc

SEQ ID NO: 5102499 - DNA, 20 bp, Homo sapiens
aagcccatcctgaccagctg

SEQ ID NO: 5102500 - DNA, 19 bp, Homo sapiens
aagcccatgagtccttgaa

SEQ ID NO: 5102501 - DNA, 20 bp, Homo sapiens
aagcccatgagtccttgaaa

SEQ ID NO: 5102502 - DNA, 14 bp, Homo sapiens
aagcccatgtcttc

SEQ ID NO: 5102503 - DNA, 21 bp, Homo sapiens
aagcccatgtcttctgctgtt

SEQ ID NO: 5102504 - DNA, 21 bp, Homo sapiens
aagcccattcattccattctg

SEQ ID NO: 5102505 - DNA, 16 bp, Homo sapiens
aagcccattcctctgc

SEQ ID NO: 5102506 - DNA, 20 bp, Homo sapiens
aagcccattcctctgccagg

SEQ ID NO: 5102507 - DNA, 18 bp, Homo sapiens
aagccccacccaggccag

SEQ ID NO: 5102508 - DNA, 14 bp, Homo sapiens
aagccccagcaagc

SEQ ID NO: 5102509 - DNA, 13 bp, Homo sapiens
aagccccagcagc

SEQ ID NO: 5102510 - DNA, 16 bp, Homo sapiens
aagccccagcagccct

SEQ ID NO: 5102511 - DNA, 14 bp, Homo sapiens
aagccccaggcagg

SEQ ID NO: 5102512 - DNA, 16 bp, Homo sapiens
aagccccagggcctgg

SEQ ID NO: 5102513 - DNA, 22 bp, Homo sapiens
aagccccatgctggagcctgtg

SEQ ID NO: 5102514 - DNA, 14 bp, Homo sapiens
aagcccccaccgtg

SEQ ID NO: 5102515 - DNA, 20 bp, Homo sapiens
aagcccccaccgtgggcagg

SEQ ID NO: 5102516 - DNA, 18 bp, Homo sapiens
aagcccccaccttccctc

SEQ ID NO: 5102517 - DNA, 13 bp, Homo sapiens
aagcccccagagc

SEQ ID NO: 5102518 - DNA, 16 bp, Homo sapiens
aagcccccagagccca

SEQ ID NO: 5102519 - DNA, 18 bp, Homo sapiens
aagcccccagagcccagg

SEQ ID NO: 5102520 - DNA, 23 bp, Homo sapiens
aagcccccagctaagaacctgga

SEQ ID NO: 5102521 - DNA, 14 bp, Homo sapiens
aagcccccagggcc

SEQ ID NO: 5102522 - DNA, 20 bp, Homo sapiens
aagcccccagggcctccagg

SEQ ID NO: 5102523 - DNA, 22 bp, Homo sapiens
aagccccccacctttctcgctg

SEQ ID NO: 5102524 - DNA, 23 bp, Homo sapiens
aagcccccccttatagtttgggc

SEQ ID NO: 5102525 - DNA, 16 bp, Homo sapiens
aagcccccccttccac

SEQ ID NO: 5102526 - DNA, 12 bp, Homo sapiens
aagccccctggc

SEQ ID NO: 5102527 - DNA, 13 bp, Homo sapiens
aagccccctggca

SEQ ID NO: 5102528 - DNA, 13 bp, Homo sapiens
aagccccctttga

SEQ ID NO: 5102529 - DNA, 20 bp, Homo sapiens
aagcccctcagcccttgccc

SEQ ID NO: 5102530 - DNA, 14 bp, Homo sapiens
aagcccctgccctg

SEQ ID NO: 5102531 - DNA, 20 bp, Homo sapiens
aagcccctgccctggggaga

SEQ ID NO: 5102532 - DNA, 21 bp, Homo sapiens
aagcccctgccctggggagaa

SEQ ID NO: 5102533 - DNA, 14 bp, Homo sapiens
aagcccctgggccc

SEQ ID NO: 5102534 - DNA, 12 bp, Homo sapiens
aagcccctgtct

SEQ ID NO: 5102535 - DNA, 13 bp, Homo sapiens
aagccccttattt

SEQ ID NO: 5102536 - DNA, 15 bp, Homo sapiens
aagcccgacttgctg

SEQ ID NO: 5102537 - DNA, 19 bp, Homo sapiens
aagcccgcctccagcacca

SEQ ID NO: 5102538 - DNA, 18 bp, Homo sapiens
aagcccgcctctgtccta

SEQ ID NO: 5102539 - DNA, 15 bp, Homo sapiens
aagcccgcttgctcg

SEQ ID NO: 5102540 - DNA, 22 bp, Homo sapiens
aagcccgcttgctcgcttgctg

SEQ ID NO: 5102541 - DNA, 16 bp, Homo sapiens
aagcccggactgacca

SEQ ID NO: 5102542 - DNA, 19 bp, Homo sapiens
aagcccgttagccccaggg

SEQ ID NO: 5102543 - DNA, 19 bp, Homo sapiens
aagccctaagcctgtcccc

SEQ ID NO: 5102544 - DNA, 21 bp, Homo sapiens
aagccctatccttctctgcct

SEQ ID NO: 5102545 - DNA, 12 bp, Homo sapiens
aagccctcagat

SEQ ID NO: 5102546 - DNA, 18 bp, Homo sapiens
aaggaacagttgcattta

SEQ ID NO: 5102547 - DNA, 16 bp, Homo sapiens
aaggaacataaagatt

SEQ ID NO: 5102548 - DNA, 17 bp, Homo sapiens
aaggaaccaacaatctt

SEQ ID NO: 5102549 - DNA, 16 bp, Homo sapiens
aaggaaccaccgaaga

SEQ ID NO: 5102550 - DNA, 19 bp, Homo sapiens
aaggaacctaattgaaatt

SEQ ID NO: 5102551 - DNA, 16 bp, Homo sapiens
aaggaacggcttcctc

SEQ ID NO: 5102552 - DNA, 18 bp, Homo sapiens
aaggaactctggcttcca

SEQ ID NO: 5102553 - DNA, 20 bp, Homo sapiens
aaggaactctggcttccagg

SEQ ID NO: 5102554 - DNA, 17 bp, Homo sapiens
aaggaactgatacatct

SEQ ID NO: 5102555 - DNA, 18 bp, Homo sapiens
aaggaacttcatgcttga

SEQ ID NO: 5102556 - DNA, 15 bp, Homo sapiens
aaggaagaaaaatca

SEQ ID NO: 5102557 - DNA, 17 bp, Homo sapiens
aaggaagaaattaactt

SEQ ID NO: 5102558 - DNA, 22 bp, Homo sapiens
aaggaagaataaaaaagaagag

SEQ ID NO: 5102559 - DNA, 21 bp, Homo sapiens
aaggaagacctcaagaaaaat

SEQ ID NO: 5102560 - DNA, 20 bp, Homo sapiens
aaggaagatcttgagagctg

SEQ ID NO: 5102561 - DNA, 22 bp, Homo sapiens
aaggaagatcttgagagctgct

SEQ ID NO: 5102562 - DNA, 13 bp, Homo sapiens
aaggaagattctt

SEQ ID NO: 5102563 - DNA, 22 bp, Homo sapiens
aaggaagcaagccggcagaaat

SEQ ID NO: 5102564 - DNA, 18 bp, Homo sapiens
aaggaagcattgtaaaat

SEQ ID NO: 5102565 - DNA, 23 bp, Homo sapiens
aaggaagcattgtaaaataattc

SEQ ID NO: 5102566 - DNA, 13 bp, Homo sapiens
aaggaagccaaag

SEQ ID NO: 5102567 - DNA, 19 bp, Homo sapiens
aaggaagccggggaagaga

SEQ ID NO: 5102568 - DNA, 13 bp, Homo sapiens
aaggaagctcctt

SEQ ID NO: 5102569 - DNA, 15 bp, Homo sapiens
aaggaagctccttcc

SEQ ID NO: 5102570 - DNA, 16 bp, Homo sapiens
aaggaagctccttcct

SEQ ID NO: 5102571 - DNA, 15 bp, Homo sapiens
aaggaagctgtgcgt

SEQ ID NO: 5102572 - DNA, 18 bp, Homo sapiens
aaggaagctgtgttgaaa

SEQ ID NO: 5102573 - DNA, 21 bp, Homo sapiens
aaggaagctgtgttgaaacag

SEQ ID NO: 5102574 - DNA, 19 bp, Homo sapiens
aaggaagctttctctgctt

SEQ ID NO: 5102575 - DNA, 15 bp, Homo sapiens
aaggaagctttggaa

SEQ ID NO: 5102576 - DNA, 21 bp, Homo sapiens
aaggaagctttggaagcagca

SEQ ID NO: 5102577 - DNA, 13 bp, Homo sapiens
aaggaaggaaaat

SEQ ID NO: 5102578 - DNA, 14 bp, Homo sapiens
aaggaaggaaacaa

SEQ ID NO: 5102579 - DNA, 16 bp, Homo sapiens
aaggaaggacatttcc

SEQ ID NO: 5102580 - DNA, 14 bp, Homo sapiens
aaggaaggaccagg

SEQ ID NO: 5102581 - DNA, 14 bp, Homo sapiens
aaggaaggagagat

SEQ ID NO: 5102582 - DNA, 12 bp, Homo sapiens
aaggaaggagcc

SEQ ID NO: 5102583 - DNA, 13 bp, Homo sapiens
aaggaaggcgtgt

SEQ ID NO: 5102584 - DNA, 17 bp, Homo sapiens
aaggaaggctccatctc

SEQ ID NO: 5102585 - DNA, 16 bp, Homo sapiens
aaggaagggacacaca

SEQ ID NO: 5102586 - DNA, 18 bp, Homo sapiens
aaggaagggacacacaca

SEQ ID NO: 5102587 - DNA, 23 bp, Homo sapiens
aaggaaggggctatcctgggacc

SEQ ID NO: 5102588 - DNA, 17 bp, Homo sapiens
aaggaaggtagttcaag

SEQ ID NO: 5102589 - DNA, 18 bp, Homo sapiens
aaggaaggtggatggccc

SEQ ID NO: 5102590 - DNA, 15 bp, Homo sapiens
aaggaaggttcatgt

SEQ ID NO: 5102591 - DNA, 16 bp, Homo sapiens
aaggaaggttctggtg

SEQ ID NO: 5102592 - DNA, 17 bp, Homo sapiens
aaggaaggttttctcca

SEQ ID NO: 5102593 - DNA, 21 bp, Homo sapiens
aaggaagtcaaagcaaggaaa

SEQ ID NO: 5102594 - DNA, 16 bp, Homo sapiens
aaggaagtcaccaaaa

SEQ ID NO: 5102595 - DNA, 14 bp, Homo sapiens
aaggaagtctagga

SEQ ID NO: 5102596 - DNA, 14 bp, Homo sapiens
aaggaagtcttcaa

SEQ ID NO: 5102597 - DNA, 18 bp, Homo sapiens
aaggaagtggggacagat

SEQ ID NO: 5102598 - DNA, 23 bp, Homo sapiens
aaggaagtgggggccgctggccc

SEQ ID NO: 5102599 - DNA, 17 bp, Homo sapiens
aaggaagtgtgtttgcc

SEQ ID NO: 5102600 - DNA, 13 bp, Homo sapiens
aaggaataaatga

SEQ ID NO: 5102601 - DNA, 16 bp, Homo sapiens
aaggaatagccagaga

SEQ ID NO: 5102602 - DNA, 18 bp, Homo sapiens
aaggaatagccagagagg

SEQ ID NO: 5102603 - DNA, 21 bp, Homo sapiens
aaggaatagtcgcgcaagcat

SEQ ID NO: 5102604 - DNA, 21 bp, Homo sapiens
aaggaatataccacaccgagg

SEQ ID NO: 5102605 - DNA, 21 bp, Homo sapiens
aaggaatatgggagaaatagt

SEQ ID NO: 5102606 - DNA, 15 bp, Homo sapiens
aaggaatcaaatctt

SEQ ID NO: 5102607 - DNA, 23 bp, Homo sapiens
aaggaatccactcccaggcagcc

SEQ ID NO: 5102608 - DNA, 20 bp, Homo sapiens
aaggaatccatcctgcaaag

SEQ ID NO: 5102609 - DNA, 18 bp, Homo sapiens
aaggaatcgtttcaaatg

SEQ ID NO: 5102610 - DNA, 18 bp, Homo sapiens
aaggaatctagccagtga

SEQ ID NO: 5102611 - DNA, 14 bp, Homo sapiens
aaggaatctgtgca

SEQ ID NO: 5102612 - DNA, 15 bp, Homo sapiens
aaggaatctgtgcag

SEQ ID NO: 5102613 - DNA, 21 bp, Homo sapiens
aaggaatctgtgcagatgagc

SEQ ID NO: 5102614 - DNA, 20 bp, Homo sapiens
aaggaatgaaagagagctct

SEQ ID NO: 5102615 - DNA, 21 bp, Homo sapiens
aaggaatgactcatgcctctg

SEQ ID NO: 5102616 - DNA, 16 bp, Homo sapiens
aaggaatgatatattc

SEQ ID NO: 5102617 - DNA, 22 bp, Homo sapiens
aaggaatgatccatactgaaaa

SEQ ID NO: 5102618 - DNA, 23 bp, Homo sapiens
aaggaatgattaattaaaacaca

SEQ ID NO: 5102619 - DNA, 21 bp, Homo sapiens
aaggaatgtgtccaagacaca

SEQ ID NO: 5102620 - DNA, 16 bp, Homo sapiens
aaggaatgttatcagt

SEQ ID NO: 5102621 - DNA, 18 bp, Homo sapiens
aaggaattatagacctct

SEQ ID NO: 5102622 - DNA, 20 bp, Homo sapiens
aaggaattgacttcagcagg

SEQ ID NO: 5102623 - DNA, 16 bp, Homo sapiens
aaggaatttaaaactg

SEQ ID NO: 5102624 - DNA, 22 bp, Homo sapiens
aaggaatttccctgtgtggatg

SEQ ID NO: 5102625 - DNA, 19 bp, Homo sapiens
aaggaatttcttaacttct

SEQ ID NO: 5102626 - DNA, 23 bp, Homo sapiens
aaggaatttcttaacttcttgct

SEQ ID NO: 5102627 - DNA, 14 bp, Homo sapiens
aaggaatttgatga

SEQ ID NO: 5102628 - DNA, 13 bp, Homo sapiens
aaggaatttgtac

SEQ ID NO: 5102629 - DNA, 15 bp, Homo sapiens
aaggaatttgtactt

SEQ ID NO: 5102630 - DNA, 16 bp, Homo sapiens
aaggaatttgtacttc

SEQ ID NO: 5102631 - DNA, 12 bp, Homo sapiens
aaggaattttat

SEQ ID NO: 5102632 - DNA, 19 bp, Homo sapiens
aaggaattttgctaagtaa

SEQ ID NO: 5102633 - DNA, 17 bp, Homo sapiens
aaggacaaaaatgaact

SEQ ID NO: 5102634 - DNA, 12 bp, Homo sapiens
aaggacaaacag

SEQ ID NO: 5102635 - DNA, 21 bp, Homo sapiens
aaggacaaacagtgaatttaa

SEQ ID NO: 5102636 - DNA, 17 bp, Homo sapiens
aaggacaaagtctccag

SEQ ID NO: 5102637 - DNA, 14 bp, Homo sapiens
aaggacaaagtgcc

SEQ ID NO: 5102638 - DNA, 15 bp, Homo sapiens
aaggacaaataaagc

SEQ ID NO: 5102639 - DNA, 22 bp, Homo sapiens
aaggacaatgccttgggagaga

SEQ ID NO: 5102640 - DNA, 14 bp, Homo sapiens
aaggacacactaat

SEQ ID NO: 5102641 - DNA, 18 bp, Homo sapiens
aaggacacagatgaaaca

SEQ ID NO: 5102642 - DNA, 18 bp, Homo sapiens
aaggacacagcagtattg

SEQ ID NO: 5102643 - DNA, 12 bp, Homo sapiens
aaggacacagtg

SEQ ID NO: 5102644 - DNA, 15 bp, Homo sapiens
aaggacacagtgatg

SEQ ID NO: 5102645 - DNA, 20 bp, Homo sapiens
aaggacacagtgatgaatgt

SEQ ID NO: 5102646 - DNA, 15 bp, Homo sapiens
aaggacactggatca

SEQ ID NO: 5102647 - DNA, 18 bp, Homo sapiens
aaggacactggggtctgt

SEQ ID NO: 5102648 - DNA, 14 bp, Homo sapiens
aaggacacttcctg

SEQ ID NO: 5102649 - DNA, 16 bp, Homo sapiens
aaggacacttcctgcc

SEQ ID NO: 5102650 - DNA, 17 bp, Homo sapiens
aaggacacttcctgcct

SEQ ID NO: 5102651 - DNA, 18 bp, Homo sapiens
aaggacacttcctgccta

SEQ ID NO: 5102652 - DNA, 22 bp, Homo sapiens
aaggacagactggccgggcagg

SEQ ID NO: 5102653 - DNA, 14 bp, Homo sapiens
aaggacagagccag

SEQ ID NO: 5102654 - DNA, 14 bp, Homo sapiens
aaggacagctttga

SEQ ID NO: 5102655 - DNA, 13 bp, Homo sapiens
aaggacaggaccc

SEQ ID NO: 5102656 - DNA, 15 bp, Homo sapiens
aaggacaggaccctc

SEQ ID NO: 5102657 - DNA, 15 bp, Homo sapiens
aaggacaggagcctg

SEQ ID NO: 5102658 - DNA, 16 bp, Homo sapiens
aaggacaggagcctgg

SEQ ID NO: 5102659 - DNA, 16 bp, Homo sapiens
aaggacaggaggagga

SEQ ID NO: 5102660 - DNA, 15 bp, Homo sapiens
aaggacaggcagaaa

SEQ ID NO: 5102661 - DNA, 13 bp, Homo sapiens
aaggacagggctg

SEQ ID NO: 5102662 - DNA, 16 bp, Homo sapiens
aaggacaggtctctga

SEQ ID NO: 5102663 - DNA, 18 bp, Homo sapiens
aaggacagtccctgctgg

SEQ ID NO: 5102664 - DNA, 19 bp, Homo sapiens
aaggacagtccctgctggg

SEQ ID NO: 5102665 - DNA, 13 bp, Homo sapiens
aaggacagtgttc

SEQ ID NO: 5102666 - DNA, 15 bp, Homo sapiens
aaggacagtgttcaa

SEQ ID NO: 5102667 - DNA, 17 bp, Homo sapiens
aaggacagtgttcaaat

SEQ ID NO: 5102668 - DNA, 22 bp, Homo sapiens
aaggacagtgttcaaattctga

SEQ ID NO: 5102669 - DNA, 20 bp, Homo sapiens
aaggacatgaacagacactt

SEQ ID NO: 5102670 - DNA, 18 bp, Homo sapiens
aaggacatgatgctttta

SEQ ID NO: 5102671 - DNA, 23 bp, Homo sapiens
aaggacattacagaccatggata

SEQ ID NO: 5102672 - DNA, 17 bp, Homo sapiens
aaggacattatgtgtgc

SEQ ID NO: 5102673 - DNA, 13 bp, Homo sapiens
aaggacattgccc

SEQ ID NO: 5102674 - DNA, 15 bp, Homo sapiens
aaggacattgcccca

SEQ ID NO: 5102675 - DNA, 16 bp, Homo sapiens
aaggacattgccccaa

SEQ ID NO: 5102676 - DNA, 19 bp, Homo sapiens
aaggacattgccccaagat

SEQ ID NO: 5102677 - DNA, 20 bp, Homo sapiens
aaggacattgccccaagata

SEQ ID NO: 5102678 - DNA, 23 bp, Homo sapiens
aaggacatttgggactgtcttga

SEQ ID NO: 5102679 - DNA, 21 bp, Homo sapiens
aaggacattttctctttaaaa

SEQ ID NO: 5102680 - DNA, 22 bp, Homo sapiens
aaggacattttctctttaaaag

SEQ ID NO: 5102681 - DNA, 19 bp, Homo sapiens
aaggaccaacaagggcagt

SEQ ID NO: 5102682 - DNA, 19 bp, Homo sapiens
aaggaccacattttatatt

SEQ ID NO: 5102683 - DNA, 14 bp, Homo sapiens
aaggaccagccctt

SEQ ID NO: 5102684 - DNA, 20 bp, Homo sapiens
aaggaccagcccttgaggga

SEQ ID NO: 5102685 - DNA, 13 bp, Homo sapiens
aaggaccagcttt

SEQ ID NO: 5102686 - DNA, 13 bp, Homo sapiens
aaggaccaggact

SEQ ID NO: 5102687 - DNA, 16 bp, Homo sapiens
aaggaccagtgagaca

SEQ ID NO: 5102688 - DNA, 18 bp, Homo sapiens
aaggaccagtttcttgaa

SEQ ID NO: 5102689 - DNA, 21 bp, Homo sapiens
aaggacccaaatttccctggg

SEQ ID NO: 5102690 - DNA, 13 bp, Homo sapiens
aaggacccagccc

SEQ ID NO: 5102691 - DNA, 14 bp, Homo sapiens
aaggacccagccct

SEQ ID NO: 5102692 - DNA, 17 bp, Homo sapiens
aaggacccaggcgctgc

SEQ ID NO: 5102693 - DNA, 18 bp, Homo sapiens
aaggacccaggcgctgca

SEQ ID NO: 5102694 - DNA, 14 bp, Homo sapiens
aaggaccccctccc

SEQ ID NO: 5102695 - DNA, 15 bp, Homo sapiens
aaggacccctcacct

SEQ ID NO: 5102696 - DNA, 21 bp, Homo sapiens
aaggaccctgtgccctccttc

SEQ ID NO: 5102697 - DNA, 15 bp, Homo sapiens
aaggaccctgtttct

SEQ ID NO: 5102698 - DNA, 21 bp, Homo sapiens
aaggaccctgtttctgtagaa

SEQ ID NO: 5102699 - DNA, 20 bp, Homo sapiens
aaggacccttcagaggtggc

SEQ ID NO: 5102700 - DNA, 16 bp, Homo sapiens
aaggacccttttaagc

SEQ ID NO: 5102701 - DNA, 17 bp, Homo sapiens
aaggacccttttaagca

SEQ ID NO: 5102702 - DNA, 19 bp, Homo sapiens
aaggaccgtggccctgccc

SEQ ID NO: 5102703 - DNA, 12 bp, Homo sapiens
aaggacctaaaa

SEQ ID NO: 5102704 - DNA, 15 bp, Homo sapiens
aaggacctaaaaatt

SEQ ID NO: 5102705 - DNA, 18 bp, Homo sapiens
aaggacctccccctgtgt

SEQ ID NO: 5102706 - DNA, 23 bp, Homo sapiens
aaggacctcctcttcccccttcc

SEQ ID NO: 5102707 - DNA, 22 bp, Homo sapiens
aaggacctctttactctctccg

SEQ ID NO: 5102708 - DNA, 22 bp, Homo sapiens
aaggaccttcactctaagatgt

SEQ ID NO: 5102709 - DNA, 14 bp, Homo sapiens
aaggacgcactgag

SEQ ID NO: 5102710 - DNA, 14 bp, Homo sapiens
aaggacgctggcta

SEQ ID NO: 5102711 - DNA, 16 bp, Homo sapiens
aaggacgtgtgtaaat

SEQ ID NO: 5102712 - DNA, 17 bp, Homo sapiens
aaggactaacataaaat

SEQ ID NO: 5102713 - DNA, 21 bp, Homo sapiens
aaggactaacataaaatctgt

SEQ ID NO: 5102714 - DNA, 21 bp, Homo sapiens
aaggactacgttaagggaagg

SEQ ID NO: 5102715 - DNA, 17 bp, Homo sapiens
aaggactagacgcatat

SEQ ID NO: 5102716 - DNA, 15 bp, Homo sapiens
aaggactagggtcct

SEQ ID NO: 5102717 - DNA, 15 bp, Homo sapiens
aaggactccaatgtc

SEQ ID NO: 5102718 - DNA, 14 bp, Homo sapiens
aaggactgaagaaa

SEQ ID NO: 5102719 - DNA, 18 bp, Homo sapiens
aaggactgacgagagatg

SEQ ID NO: 5102720 - DNA, 13 bp, Homo sapiens
aaggactgaggga

SEQ ID NO: 5102721 - DNA, 19 bp, Homo sapiens
aaggactgagggcagtgcc

SEQ ID NO: 5102722 - DNA, 22 bp, Homo sapiens
aaggactgagggcagtgccctt

SEQ ID NO: 5102723 - DNA, 22 bp, Homo sapiens
aaggactgcatggtaatttata

SEQ ID NO: 5102724 - DNA, 22 bp, Homo sapiens
aaggactggaaaaatgaactgt

SEQ ID NO: 5102725 - DNA, 15 bp, Homo sapiens
aagccctcagatccc

SEQ ID NO: 5102726 - DNA, 14 bp, Homo sapiens
aagccctcagctgg

SEQ ID NO: 5102727 - DNA, 22 bp, Homo sapiens
aagccctcatttttataacctg

SEQ ID NO: 5102728 - DNA, 9 bp, Homo sapiens
aagccctcc

SEQ ID NO: 5102729 - DNA, 14 bp, Homo sapiens
aagccctccacatt

SEQ ID NO: 5102730 - DNA, 20 bp, Homo sapiens
aagccctcccaggtgttaac

SEQ ID NO: 5102731 - DNA, 22 bp, Homo sapiens
aagccctcctccccagagctgg

SEQ ID NO: 5102732 - DNA, 12 bp, Homo sapiens
aagccctccttc

SEQ ID NO: 5102733 - DNA, 17 bp, Homo sapiens
aagccctccttgccacc

SEQ ID NO: 5102734 - DNA, 21 bp, Homo sapiens
aagccctcgaaccaaggcagc

SEQ ID NO: 5102735 - DNA, 15 bp, Homo sapiens
aagccctcggcctcc

SEQ ID NO: 5102736 - DNA, 17 bp, Homo sapiens
aagccctcggcctccag

SEQ ID NO: 5102737 - DNA, 18 bp, Homo sapiens
aagccctgaggcctgagg

SEQ ID NO: 5102738 - DNA, 21 bp, Homo sapiens
aagccctgaggcctgaggcct

SEQ ID NO: 5102739 - DNA, 12 bp, Homo sapiens
aagccctgaggg

SEQ ID NO: 5102740 - DNA, 23 bp, Homo sapiens
aagccctgattgtgtatattcat

SEQ ID NO: 5102741 - DNA, 13 bp, Homo sapiens
aagccctgcaaat

SEQ ID NO: 5102742 - DNA, 11 bp, Homo sapiens
aagccctgccc

SEQ ID NO: 5102743 - DNA, 13 bp, Homo sapiens
aagccctgcctct

SEQ ID NO: 5102744 - DNA, 19 bp, Homo sapiens
aagccctgcctctgtgtag

SEQ ID NO: 5102745 - DNA, 11 bp, Homo sapiens
aagccctgctc

SEQ ID NO: 5102746 - DNA, 16 bp, Homo sapiens
aagccctgctctttct

SEQ ID NO: 5102747 - DNA, 16 bp, Homo sapiens
aagccctgcttttgca

SEQ ID NO: 5102748 - DNA, 14 bp, Homo sapiens
aagccctggagaaa

SEQ ID NO: 5102749 - DNA, 11 bp, Homo sapiens
aagccctggca

SEQ ID NO: 5102750 - DNA, 14 bp, Homo sapiens
aagccctggcaaca

SEQ ID NO: 5102751 - DNA, 14 bp, Homo sapiens
aagccctggggcag

SEQ ID NO: 5102752 - DNA, 21 bp, Homo sapiens
aagccctgtgctccatggctg

SEQ ID NO: 5102753 - DNA, 19 bp, Homo sapiens
aagccctgttctcgttgcc

SEQ ID NO: 5102754 - DNA, 22 bp, Homo sapiens
aagccctgttctcgttgcccta

SEQ ID NO: 5102755 - DNA, 22 bp, Homo sapiens
aagccctgttgtgccacagagt

SEQ ID NO: 5102756 - DNA, 17 bp, Homo sapiens
aagcccttagggagagc

SEQ ID NO: 5102757 - DNA, 13 bp, Homo sapiens
aagcccttatttg

SEQ ID NO: 5102758 - DNA, 15 bp, Homo sapiens
aagcccttccatgtc

SEQ ID NO: 5102759 - DNA, 20 bp, Homo sapiens
aagcccttggaacaccctgg

SEQ ID NO: 5102760 - DNA, 14 bp, Homo sapiens
aagccctttgctct

SEQ ID NO: 5102761 - DNA, 18 bp, Homo sapiens
aagccctttgctctggag

SEQ ID NO: 5102762 - DNA, 13 bp, Homo sapiens
aagccctttgctg

SEQ ID NO: 5102763 - DNA, 14 bp, Homo sapiens
aagccctttgctgt

SEQ ID NO: 5102764 - DNA, 23 bp, Homo sapiens
aagccctttgtgggacccgggcc

SEQ ID NO: 5102765 - DNA, 16 bp, Homo sapiens
aagccgactctggccc

SEQ ID NO: 5102766 - DNA, 21 bp, Homo sapiens
aagccgactctggccctggcc

SEQ ID NO: 5102767 - DNA, 14 bp, Homo sapiens
aagccgcaccacca

SEQ ID NO: 5102768 - DNA, 15 bp, Homo sapiens
aagccgcagacctgg

SEQ ID NO: 5102769 - DNA, 17 bp, Homo sapiens
aagccgcagacctggag

SEQ ID NO: 5102770 - DNA, 18 bp, Homo sapiens
aagccgcagacctggagc

SEQ ID NO: 5102771 - DNA, 15 bp, Homo sapiens
aagccgccaggaccg

SEQ ID NO: 5102772 - DNA, 18 bp, Homo sapiens
aagccgccagttcatctt

SEQ ID NO: 5102773 - DNA, 13 bp, Homo sapiens
aagccgctgctgg

SEQ ID NO: 5102774 - DNA, 20 bp, Homo sapiens
aagccgctggggccagttgg

SEQ ID NO: 5102775 - DNA, 17 bp, Homo sapiens
aagccggacagctgccc

SEQ ID NO: 5102776 - DNA, 18 bp, Homo sapiens
aagccggacagctgccca

SEQ ID NO: 5102777 - DNA, 19 bp, Homo sapiens
aagccggacagctgcccag

SEQ ID NO: 5102778 - DNA, 20 bp, Homo sapiens
aagccggacagctgcccaga

SEQ ID NO: 5102779 - DNA, 18 bp, Homo sapiens
aagccggcagaaatagct

SEQ ID NO: 5102780 - DNA, 14 bp, Homo sapiens
aagccggcccaacc

SEQ ID NO: 5102781 - DNA, 12 bp, Homo sapiens
aagccggcggcc

SEQ ID NO: 5102782 - DNA, 21 bp, Homo sapiens
aagccggggaagagatccaaa

SEQ ID NO: 5102783 - DNA, 22 bp, Homo sapiens
aagccggggaagagatccaaag

SEQ ID NO: 5102784 - DNA, 13 bp, Homo sapiens
aagccgggggagg

SEQ ID NO: 5102785 - DNA, 15 bp, Homo sapiens
aagccgggggagggg

SEQ ID NO: 5102786 - DNA, 23 bp, Homo sapiens
aagccgggggaggggccctcagg

SEQ ID NO: 5102787 - DNA, 21 bp, Homo sapiens
aagccggggtgtaacttcctg

SEQ ID NO: 5102788 - DNA, 22 bp, Homo sapiens
aagccggggtgtaacttcctgc

SEQ ID NO: 5102789 - DNA, 16 bp, Homo sapiens
aagccggtgcctgggt

SEQ ID NO: 5102790 - DNA, 19 bp, Homo sapiens
aagccggtgggctagaaag

SEQ ID NO: 5102791 - DNA, 18 bp, Homo sapiens
aagccggtgtccctggat

SEQ ID NO: 5102792 - DNA, 13 bp, Homo sapiens
aagccgtcctggc

SEQ ID NO: 5102793 - DNA, 14 bp, Homo sapiens
aagccgtctgactc

SEQ ID NO: 5102794 - DNA, 20 bp, Homo sapiens
aagccgtctgactccagagt

SEQ ID NO: 5102795 - DNA, 14 bp, Homo sapiens
aagccgtgccctgc

SEQ ID NO: 5102796 - DNA, 14 bp, Homo sapiens
aagccgtgcctttc

SEQ ID NO: 5102797 - DNA, 20 bp, Homo sapiens
aagccgtggccggggtccag

SEQ ID NO: 5102798 - DNA, 21 bp, Homo sapiens
aagccgtggccggggtccagg

SEQ ID NO: 5102799 - DNA, 22 bp, Homo sapiens
aagccgttgaatctgggaggga

SEQ ID NO: 5102800 - DNA, 23 bp, Homo sapiens
aagccgttgaatctgggagggaa

SEQ ID NO: 5102801 - DNA, 23 bp, Homo sapiens
aagcctaaaagtgggcttgattc

SEQ ID NO: 5102802 - DNA, 13 bp, Homo sapiens
aagcctaaaattg

SEQ ID NO: 5102803 - DNA, 13 bp, Homo sapiens
aagcctaaagatt

SEQ ID NO: 5102804 - DNA, 15 bp, Homo sapiens
aagcctaagaaaaag

SEQ ID NO: 5102805 - DNA, 19 bp, Homo sapiens
aagcctaagaaaaaggaaa

SEQ ID NO: 5102806 - DNA, 20 bp, Homo sapiens
aagcctaagaaaaaggaaat

SEQ ID NO: 5102807 - DNA, 17 bp, Homo sapiens
aagcctaattgtcacat

SEQ ID NO: 5102808 - DNA, 14 bp, Homo sapiens
aagcctacctgctc

SEQ ID NO: 5102809 - DNA, 16 bp, Homo sapiens
aagcctacctgctctc

SEQ ID NO: 5102810 - DNA, 15 bp, Homo sapiens
aagcctactatttaa

SEQ ID NO: 5102811 - DNA, 18 bp, Homo sapiens
aagcctatacgtttctgt

SEQ ID NO: 5102812 - DNA, 18 bp, Homo sapiens
aagcctattgtaaataca

SEQ ID NO: 5102813 - DNA, 15 bp, Homo sapiens
aagcctcaaaacaaa

SEQ ID NO: 5102814 - DNA, 20 bp, Homo sapiens
aagcctcagattccttccca

SEQ ID NO: 5102815 - DNA, 21 bp, Homo sapiens
aagcctcagattccttcccat

SEQ ID NO: 5102816 - DNA, 10 bp, Homo sapiens
aagcctcagc

SEQ ID NO: 5102817 - DNA, 22 bp, Homo sapiens
aagcctcagcaaacccaaagat

SEQ ID NO: 5102818 - DNA, 13 bp, Homo sapiens
aagcctcaggcct

SEQ ID NO: 5102819 - DNA, 20 bp, Homo sapiens
aagcctcaggcctggccctt

SEQ ID NO: 5102820 - DNA, 22 bp, Homo sapiens
aagcctcagtccctccctcctg

SEQ ID NO: 5102821 - DNA, 22 bp, Homo sapiens
aagcctcatttgaatgtgtgaa

SEQ ID NO: 5102822 - DNA, 20 bp, Homo sapiens
aagcctccacaccagctgct

SEQ ID NO: 5102823 - DNA, 12 bp, Homo sapiens
aagcctccacag

SEQ ID NO: 5102824 - DNA, 15 bp, Homo sapiens
aagcctccacagcga

SEQ ID NO: 5102825 - DNA, 14 bp, Homo sapiens
aagcctccacctgc

SEQ ID NO: 5102826 - DNA, 15 bp, Homo sapiens
aagcctccagcatct

SEQ ID NO: 5102827 - DNA, 19 bp, Homo sapiens
aagcctccatttagttctt

SEQ ID NO: 5102828 - DNA, 20 bp, Homo sapiens
aagcctccatttagttcttt

SEQ ID NO: 5102829 - DNA, 22 bp, Homo sapiens
aagcctccatttagttctttgt

SEQ ID NO: 5102830 - DNA, 13 bp, Homo sapiens
aagcctccctcct

SEQ ID NO: 5102831 - DNA, 16 bp, Homo sapiens
aagcctccgctgggct

SEQ ID NO: 5102832 - DNA, 15 bp, Homo sapiens
aagcctccggtttcc

SEQ ID NO: 5102833 - DNA, 17 bp, Homo sapiens
aagcctccgtcaggaga

SEQ ID NO: 5102834 - DNA, 18 bp, Homo sapiens
aagcctcctctggagaat

SEQ ID NO: 5102835 - DNA, 17 bp, Homo sapiens
aagcctccttacattaa

SEQ ID NO: 5102836 - DNA, 13 bp, Homo sapiens
aagcctccttttt

SEQ ID NO: 5102837 - DNA, 15 bp, Homo sapiens
aagcctcgacacaga

SEQ ID NO: 5102838 - DNA, 23 bp, Homo sapiens
aagcctctctccttggccacaga

SEQ ID NO: 5102839 - DNA, 12 bp, Homo sapiens
aagcctctctct

SEQ ID NO: 5102840 - DNA, 23 bp, Homo sapiens
aagcctctctctccctccctctc

SEQ ID NO: 5102841 - DNA, 17 bp, Homo sapiens
aagcctctgccccaagg

SEQ ID NO: 5102842 - DNA, 14 bp, Homo sapiens
aagcctctgccctg

SEQ ID NO: 5102843 - DNA, 11 bp, Homo sapiens
aagcctctgct

SEQ ID NO: 5102844 - DNA, 22 bp, Homo sapiens
aagcctctggccgtcacacgta

SEQ ID NO: 5102845 - DNA, 14 bp, Homo sapiens
aagcctctggtgga

SEQ ID NO: 5102846 - DNA, 20 bp, Homo sapiens
aagcctctgtgtcactggct

SEQ ID NO: 5102847 - DNA, 22 bp, Homo sapiens
aagcctctgtgtcactggctgc

SEQ ID NO: 5102848 - DNA, 23 bp, Homo sapiens
aagcctctgtgtcactggctgcc

SEQ ID NO: 5102849 - DNA, 13 bp, Homo sapiens
aagcctcttctga

SEQ ID NO: 5102850 - DNA, 12 bp, Homo sapiens
aagcctgaaaat

SEQ ID NO: 5102851 - DNA, 15 bp, Homo sapiens
aagcctgaactattt

SEQ ID NO: 5102852 - DNA, 16 bp, Homo sapiens
aagcctgaactgaggc

SEQ ID NO: 5102853 - DNA, 18 bp, Homo sapiens
aagcctgaactgaggcct

SEQ ID NO: 5102854 - DNA, 23 bp, Homo sapiens
aagcctgaactgaggccttgtgt

SEQ ID NO: 5102855 - DNA, 15 bp, Homo sapiens
aagcctgaagagctt

SEQ ID NO: 5102856 - DNA, 16 bp, Homo sapiens
aagcctgaagggcctc

SEQ ID NO: 5102857 - DNA, 17 bp, Homo sapiens
aagcctgaagggcctcc

SEQ ID NO: 5102858 - DNA, 21 bp, Homo sapiens
aagcctgaaggggcgtctgtt

SEQ ID NO: 5102859 - DNA, 24 bp, Homo sapiens
aagcctgaaggggcgtctgttccc

SEQ ID NO: 5102860 - DNA, 15 bp, Homo sapiens
aagcctgagcaggca

SEQ ID NO: 5102861 - DNA, 11 bp, Homo sapiens
aagcctgagcc

SEQ ID NO: 5102862 - DNA, 22 bp, Homo sapiens
aagcctgaggacagaaagaccc

SEQ ID NO: 5102863 - DNA, 15 bp, Homo sapiens
aagcctgaggctggg

SEQ ID NO: 5102864 - DNA, 19 bp, Homo sapiens
aagcctgagggaggaggca

SEQ ID NO: 5102865 - DNA, 22 bp, Homo sapiens
aagcctgagtactccacactgc

SEQ ID NO: 5102866 - DNA, 20 bp, Homo sapiens
aagcctgagtttgctttcaa

SEQ ID NO: 5102867 - DNA, 16 bp, Homo sapiens
aagcctgatccagcct

SEQ ID NO: 5102868 - DNA, 15 bp, Homo sapiens
aagcctgatgctgac

SEQ ID NO: 5102869 - DNA, 21 bp, Homo sapiens
aagcctgatttaggcactgct

SEQ ID NO: 5102870 - DNA, 22 bp, Homo sapiens
aagcctgcaatttcatatgctg

SEQ ID NO: 5102871 - DNA, 21 bp, Homo sapiens
aagcctgcacaataaaaatgt

SEQ ID NO: 5102872 - DNA, 16 bp, Homo sapiens
aagcctgcagcgagct

SEQ ID NO: 5102873 - DNA, 22 bp, Homo sapiens
aagcctgcagcgagctgagatc

SEQ ID NO: 5102874 - DNA, 23 bp, Homo sapiens
aagcctgcagcgagctgagatca

SEQ ID NO: 5102875 - DNA, 15 bp, Homo sapiens
aagcctgcaggagaa

SEQ ID NO: 5102876 - DNA, 15 bp, Homo sapiens
aagcctgcattctta

SEQ ID NO: 5102877 - DNA, 10 bp, Homo sapiens
aagcctgccc

SEQ ID NO: 5102878 - DNA, 12 bp, Homo sapiens
aagcctgccccg

SEQ ID NO: 5102879 - DNA, 16 bp, Homo sapiens
aagcctgccccggcca

SEQ ID NO: 5102880 - DNA, 15 bp, Homo sapiens
aagcctgcctcaatc

SEQ ID NO: 5102881 - DNA, 19 bp, Homo sapiens
aagcctgcctcgccttgtg

SEQ ID NO: 5102882 - DNA, 19 bp, Homo sapiens
aagcctgcggcgccagcct

SEQ ID NO: 5102883 - DNA, 22 bp, Homo sapiens
aagcctgcgttggtccagagcg

SEQ ID NO: 5102884 - DNA, 19 bp, Homo sapiens
aagcctgctaaatgaagag

SEQ ID NO: 5102885 - DNA, 12 bp, Homo sapiens
aagcctgctcct

SEQ ID NO: 5102886 - DNA, 17 bp, Homo sapiens
aagcctgctgatttcta

SEQ ID NO: 5102887 - DNA, 20 bp, Homo sapiens
aagcctgctgatttctacaa

SEQ ID NO: 5102888 - DNA, 12 bp, Homo sapiens
aagcctgctggc

SEQ ID NO: 5102889 - DNA, 13 bp, Homo sapiens
aagcctggacaca

SEQ ID NO: 5102890 - DNA, 21 bp, Homo sapiens
aagcctggagtaggcctgggg

SEQ ID NO: 5102891 - DNA, 13 bp, Homo sapiens
aagcctggattcc

SEQ ID NO: 5102892 - DNA, 16 bp, Homo sapiens
aagcctggcacccacc

SEQ ID NO: 5102893 - DNA, 20 bp, Homo sapiens
aagcctggcaggggatccag

SEQ ID NO: 5102894 - DNA, 13 bp, Homo sapiens
aagcctggcccag

SEQ ID NO: 5102895 - DNA, 12 bp, Homo sapiens
aagcctggccta

SEQ ID NO: 5102896 - DNA, 13 bp, Homo sapiens
aagcctggcttct

SEQ ID NO: 5102897 - DNA, 15 bp, Homo sapiens
aagcctgggccactg

SEQ ID NO: 5102898 - DNA, 16 bp, Homo sapiens
aagcctgggggcctgg

SEQ ID NO: 5102899 - DNA, 22 bp, Homo sapiens
aagcctggtctcctcccaaaat

SEQ ID NO: 5102900 - DNA, 18 bp, Homo sapiens
aagcctggtttttctcaa

SEQ ID NO: 5102901 - DNA, 13 bp, Homo sapiens
aagcctgtataga

SEQ ID NO: 5102902 - DNA, 19 bp, Homo sapiens
aagcctgtcgtgttctctc

SEQ ID NO: 5102903 - DNA, 15 bp, Homo sapiens
aagcctgtctctttc

SEQ ID NO: 5102904 - DNA, 17 bp, Homo sapiens
aagcctgtgcaaaaaaa

SEQ ID NO: 5102905 - DNA, 17 bp, Homo sapiens
aaggactggattggcca

SEQ ID NO: 5102906 - DNA, 18 bp, Homo sapiens
aaggactggattggccaa

SEQ ID NO: 5102907 - DNA, 20 bp, Homo sapiens
aaggactggccgtggctcca

SEQ ID NO: 5102908 - DNA, 22 bp, Homo sapiens
aaggactggccgtggctccaga

SEQ ID NO: 5102909 - DNA, 23 bp, Homo sapiens
aaggacttagctggccacagtga

SEQ ID NO: 5102910 - DNA, 16 bp, Homo sapiens
aaggacttcaggaaca

SEQ ID NO: 5102911 - DNA, 17 bp, Homo sapiens
aaggacttccacatttt

SEQ ID NO: 5102912 - DNA, 18 bp, Homo sapiens
aaggacttccacattttt

SEQ ID NO: 5102913 - DNA, 22 bp, Homo sapiens
aaggacttcctgattggtttct

SEQ ID NO: 5102914 - DNA, 22 bp, Homo sapiens
aaggacttcctgtccagctcca

SEQ ID NO: 5102915 - DNA, 13 bp, Homo sapiens
aaggacttctgca

SEQ ID NO: 5102916 - DNA, 20 bp, Homo sapiens
aaggacttctttaattttgg

SEQ ID NO: 5102917 - DNA, 15 bp, Homo sapiens
aaggacttgtgcctc

SEQ ID NO: 5102918 - DNA, 15 bp, Homo sapiens
aaggacttgttagat

SEQ ID NO: 5102919 - DNA, 20 bp, Homo sapiens
aaggactttccaaatccagg

SEQ ID NO: 5102920 - DNA, 15 bp, Homo sapiens
aaggactttgtacat

SEQ ID NO: 5102921 - DNA, 17 bp, Homo sapiens
aaggagaaaaaaaacct

SEQ ID NO: 5102922 - DNA, 18 bp, Homo sapiens
aaggagaaaaaaaacctt

SEQ ID NO: 5102923 - DNA, 21 bp, Homo sapiens
aaggagaaaagtgggctgcag

SEQ ID NO: 5102924 - DNA, 16 bp, Homo sapiens
aaggagaaagcaccga

SEQ ID NO: 5102925 - DNA, 13 bp, Homo sapiens
aaggagaaaggag

SEQ ID NO: 5102926 - DNA, 16 bp, Homo sapiens
aaggagaaatagctgt

SEQ ID NO: 5102927 - DNA, 15 bp, Homo sapiens
aaggagaaattttgg

SEQ ID NO: 5102928 - DNA, 15 bp, Homo sapiens
aaggagaacaaatat

SEQ ID NO: 5102929 - DNA, 15 bp, Homo sapiens
aaggagaaccagcac

SEQ ID NO: 5102930 - DNA, 15 bp, Homo sapiens
aaggagaactgtgct

SEQ ID NO: 5102931 - DNA, 23 bp, Homo sapiens
aaggagaagcacagctcctgcca

SEQ ID NO: 5102932 - DNA, 18 bp, Homo sapiens
aaggagaaggaaaaagaa

SEQ ID NO: 5102933 - DNA, 17 bp, Homo sapiens
aaggagaaggagtgcca

SEQ ID NO: 5102934 - DNA, 19 bp, Homo sapiens
aaggagaatcatcaggacc

SEQ ID NO: 5102935 - DNA, 23 bp, Homo sapiens
aaggagaatcatcaggaccctgg

SEQ ID NO: 5102936 - DNA, 20 bp, Homo sapiens
aaggagaatcatgtttcttt

SEQ ID NO: 5102937 - DNA, 14 bp, Homo sapiens
aaggagaatgaatc

SEQ ID NO: 5102938 - DNA, 17 bp, Homo sapiens
aaggagacaaagcagga

SEQ ID NO: 5102939 - DNA, 14 bp, Homo sapiens
aaggagacaagttc

SEQ ID NO: 5102940 - DNA, 18 bp, Homo sapiens
aaggagacacagatgttc

SEQ ID NO: 5102941 - DNA, 20 bp, Homo sapiens
aaggagacattgctctatgt

SEQ ID NO: 5102942 - DNA, 19 bp, Homo sapiens
aaggagaccttttcacaat

SEQ ID NO: 5102943 - DNA, 23 bp, Homo sapiens
aaggagactcacctctgcctcaa

SEQ ID NO: 5102944 - DNA, 11 bp, Homo sapiens
aaggagagaaa

SEQ ID NO: 5102945 - DNA, 12 bp, Homo sapiens
aaggagagaaag

SEQ ID NO: 5102946 - DNA, 18 bp, Homo sapiens
aaggagagactcccatga

SEQ ID NO: 5102947 - DNA, 23 bp, Homo sapiens
aaggagagactcccatgaagcct

SEQ ID NO: 5102948 - DNA, 16 bp, Homo sapiens
aaggagagagtctttt

SEQ ID NO: 5102949 - DNA, 17 bp, Homo sapiens
aaggagagatgacccct

SEQ ID NO: 5102950 - DNA, 13 bp, Homo sapiens
aaggagaggaggc

SEQ ID NO: 5102951 - DNA, 12 bp, Homo sapiens
aaggagaggagt

SEQ ID NO: 5102952 - DNA, 16 bp, Homo sapiens
aaggagaggagttctt

SEQ ID NO: 5102953 - DNA, 22 bp, Homo sapiens
aaggagaggatttggctcgctg

SEQ ID NO: 5102954 - DNA, 14 bp, Homo sapiens
aaggagaggcaaag

SEQ ID NO: 5102955 - DNA, 22 bp, Homo sapiens
aaggagagtcttgcagtgatta

SEQ ID NO: 5102956 - DNA, 22 bp, Homo sapiens
aaggagatagacgggttgaaag

SEQ ID NO: 5102957 - DNA, 23 bp, Homo sapiens
aaggagatatatcagtgttgtct

SEQ ID NO: 5102958 - DNA, 15 bp, Homo sapiens
aaggagatgaagcaa

SEQ ID NO: 5102959 - DNA, 18 bp, Homo sapiens
aaggagatgaatagaaga

SEQ ID NO: 5102960 - DNA, 20 bp, Homo sapiens
aaggagatgaatagaagaaa

SEQ ID NO: 5102961 - DNA, 18 bp, Homo sapiens
aaggagatggggagggcg

SEQ ID NO: 5102962 - DNA, 18 bp, Homo sapiens
aaggagatgtaagagctt

SEQ ID NO: 5102963 - DNA, 23 bp, Homo sapiens
aaggagatgtaatgacagagagt

SEQ ID NO: 5102964 - DNA, 15 bp, Homo sapiens
aaggagattccacac

SEQ ID NO: 5102965 - DNA, 15 bp, Homo sapiens
aaggagattgtgggg

SEQ ID NO: 5102966 - DNA, 17 bp, Homo sapiens
aaggagatttacaactg

SEQ ID NO: 5102967 - DNA, 14 bp, Homo sapiens
aaggagatttctta

SEQ ID NO: 5102968 - DNA, 18 bp, Homo sapiens
aaggagattttccttcct

SEQ ID NO: 5102969 - DNA, 13 bp, Homo sapiens
aaggagcaagaaa

SEQ ID NO: 5102970 - DNA, 22 bp, Homo sapiens
aaggagcaagtcagaatagaaa

SEQ ID NO: 5102971 - DNA, 12 bp, Homo sapiens
aaggagcacagg

SEQ ID NO: 5102972 - DNA, 18 bp, Homo sapiens
aaggagcacatactacct

SEQ ID NO: 5102973 - DNA, 15 bp, Homo sapiens
aaggagcagaataaa

SEQ ID NO: 5102974 - DNA, 18 bp, Homo sapiens
aaggagcagaataaatgt

SEQ ID NO: 5102975 - DNA, 23 bp, Homo sapiens
aaggagcagagctgatggagaag

SEQ ID NO: 5102976 - DNA, 23 bp, Homo sapiens
aaggagcaggccctgggcctcca

SEQ ID NO: 5102977 - DNA, 22 bp, Homo sapiens
aaggagcatttttttattcagc

SEQ ID NO: 5102978 - DNA, 23 bp, Homo sapiens
aaggagcatttttttattcagca

SEQ ID NO: 5102979 - DNA, 15 bp, Homo sapiens
aaggagccagctccc

SEQ ID NO: 5102980 - DNA, 17 bp, Homo sapiens
aaggagccagctcccag

SEQ ID NO: 5102981 - DNA, 20 bp, Homo sapiens
aaggagcccttatctgtgct

SEQ ID NO: 5102982 - DNA, 21 bp, Homo sapiens
aaggagcctaggccaggtgca

SEQ ID NO: 5102983 - DNA, 12 bp, Homo sapiens
aaggagcctgcg

SEQ ID NO: 5102984 - DNA, 13 bp, Homo sapiens
aaggagcctgtga

SEQ ID NO: 5102985 - DNA, 17 bp, Homo sapiens
aaggagccttttgctct

SEQ ID NO: 5102986 - DNA, 20 bp, Homo sapiens
aaggagccttttgctctctg

SEQ ID NO: 5102987 - DNA, 19 bp, Homo sapiens
aaggagcgctagtgccttg

SEQ ID NO: 5102988 - DNA, 19 bp, Homo sapiens
aaggagcggcgccctggac

SEQ ID NO: 5102989 - DNA, 23 bp, Homo sapiens
aaggagcggcgccctggacttgg

SEQ ID NO: 5102990 - DNA, 15 bp, Homo sapiens
aaggagcgggcaggg

SEQ ID NO: 5102991 - DNA, 16 bp, Homo sapiens
aaggagcgggcagggc

SEQ ID NO: 5102992 - DNA, 16 bp, Homo sapiens
aaggagctcaactaaa

SEQ ID NO: 5102993 - DNA, 16 bp, Homo sapiens
aaggagctcaccctgc

SEQ ID NO: 5102994 - DNA, 20 bp, Homo sapiens
aaggagctcccaggaggggc

SEQ ID NO: 5102995 - DNA, 20 bp, Homo sapiens
aaggagctcttcttgtgaaa

SEQ ID NO: 5102996 - DNA, 16 bp, Homo sapiens
aaggagctgagaatag

SEQ ID NO: 5102997 - DNA, 17 bp, Homo sapiens
aaggagctgagaataga

SEQ ID NO: 5102998 - DNA, 19 bp, Homo sapiens
aaggagctgatttccaggc

SEQ ID NO: 5102999 - DNA, 16 bp, Homo sapiens
aaggagctgcctggac

SEQ ID NO: 5103000 - DNA, 19 bp, Homo sapiens
aaggagctgcctggacccg

SEQ ID NO: 5103001 - DNA, 21 bp, Homo sapiens
aaggagcttacccaagctgtg

SEQ ID NO: 5103002 - DNA, 13 bp, Homo sapiens
aaggagctttctc

SEQ ID NO: 5103003 - DNA, 20 bp, Homo sapiens
aaggagctttctcaatgtct

SEQ ID NO: 5103004 - DNA, 13 bp, Homo sapiens
aaggagctttgct

SEQ ID NO: 5103005 - DNA, 14 bp, Homo sapiens
aaggagctttgctc

SEQ ID NO: 5103006 - DNA, 12 bp, Homo sapiens
aaggaggaaaac

SEQ ID NO: 5103007 - DNA, 18 bp, Homo sapiens
aaggaggaagagaaaaaa

SEQ ID NO: 5103008 - DNA, 12 bp, Homo sapiens
aaggaggaccag

SEQ ID NO: 5103009 - DNA, 14 bp, Homo sapiens
aaggaggacccagg

SEQ ID NO: 5103010 - DNA, 22 bp, Homo sapiens
aaggaggacccaggacaggatc

SEQ ID NO: 5103011 - DNA, 15 bp, Homo sapiens
aaggaggagagggaa

SEQ ID NO: 5103012 - DNA, 16 bp, Homo sapiens
aaggaggagcctgtcc

SEQ ID NO: 5103013 - DNA, 22 bp, Homo sapiens
aaggaggagcctgtcctgcctg

SEQ ID NO: 5103014 - DNA, 15 bp, Homo sapiens
aaggaggaggaggga

SEQ ID NO: 5103015 - DNA, 17 bp, Homo sapiens
aaggaggaggagggaga

SEQ ID NO: 5103016 - DNA, 21 bp, Homo sapiens
aaggaggaggagggagaagag

SEQ ID NO: 5103017 - DNA, 23 bp, Homo sapiens
aaggaggaggagggagaagagaa

SEQ ID NO: 5103018 - DNA, 16 bp, Homo sapiens
aaggaggaggctccca

SEQ ID NO: 5103019 - DNA, 16 bp, Homo sapiens
aaggaggatagaaaaa

SEQ ID NO: 5103020 - DNA, 20 bp, Homo sapiens
aaggaggccaaccagcccga

SEQ ID NO: 5103021 - DNA, 23 bp, Homo sapiens
aaggaggccaaccagcccgacag

SEQ ID NO: 5103022 - DNA, 19 bp, Homo sapiens
aaggaggccacctcctaaa

SEQ ID NO: 5103023 - DNA, 23 bp, Homo sapiens
aaggaggcgcactttcctcctgg

SEQ ID NO: 5103024 - DNA, 17 bp, Homo sapiens
aaggaggctccaggcag

SEQ ID NO: 5103025 - DNA, 14 bp, Homo sapiens
aaggaggctggcag

SEQ ID NO: 5103026 - DNA, 18 bp, Homo sapiens
aaggaggctggctggggc

SEQ ID NO: 5103027 - DNA, 14 bp, Homo sapiens
aaggagggacttgg

SEQ ID NO: 5103028 - DNA, 17 bp, Homo sapiens
aaggagggacttggctg

SEQ ID NO: 5103029 - DNA, 15 bp, Homo sapiens
aaggagggagaaagg

SEQ ID NO: 5103030 - DNA, 16 bp, Homo sapiens
aaggagggagaaagga

SEQ ID NO: 5103031 - DNA, 18 bp, Homo sapiens
aaggagggagaaaggaga

SEQ ID NO: 5103032 - DNA, 21 bp, Homo sapiens
aaggagggatgcgtgttccag

SEQ ID NO: 5103033 - DNA, 17 bp, Homo sapiens
aaggagggcagagccat

SEQ ID NO: 5103034 - DNA, 12 bp, Homo sapiens
aaggagggcctc

SEQ ID NO: 5103035 - DNA, 18 bp, Homo sapiens
aaggaggggaaaaaaatg

SEQ ID NO: 5103036 - DNA, 20 bp, Homo sapiens
aaggaggggaaaaaaatgtt

SEQ ID NO: 5103037 - DNA, 15 bp, Homo sapiens
aaggaggggaagctg

SEQ ID NO: 5103038 - DNA, 13 bp, Homo sapiens
aaggaggggccag

SEQ ID NO: 5103039 - DNA, 19 bp, Homo sapiens
aaggagggggcctcattgt

SEQ ID NO: 5103040 - DNA, 16 bp, Homo sapiens
aaggaggggtacattg

SEQ ID NO: 5103041 - DNA, 12 bp, Homo sapiens
aaggagggtcca

SEQ ID NO: 5103042 - DNA, 18 bp, Homo sapiens
aaggagggttagggaggg

SEQ ID NO: 5103043 - DNA, 20 bp, Homo sapiens
aaggaggtaaaggatgaggg

SEQ ID NO: 5103044 - DNA, 15 bp, Homo sapiens
aaggaggtagagagg

SEQ ID NO: 5103045 - DNA, 14 bp, Homo sapiens
aaggaggttctaat

SEQ ID NO: 5103046 - DNA, 13 bp, Homo sapiens
aaggagtagaaaa

SEQ ID NO: 5103047 - DNA, 21 bp, Homo sapiens
aaggagtaggccactctttaa

SEQ ID NO: 5103048 - DNA, 18 bp, Homo sapiens
aaggagtcactgagacca

SEQ ID NO: 5103049 - DNA, 17 bp, Homo sapiens
aaggagtcttctaatgt

SEQ ID NO: 5103050 - DNA, 17 bp, Homo sapiens
aaggagtgcatggccac

SEQ ID NO: 5103051 - DNA, 22 bp, Homo sapiens
aaggagtgcatggccacagcca

SEQ ID NO: 5103052 - DNA, 17 bp, Homo sapiens
aaggagtgtaaaatgta

SEQ ID NO: 5103053 - DNA, 13 bp, Homo sapiens
aaggagttaagag

SEQ ID NO: 5103054 - DNA, 20 bp, Homo sapiens
aaggagttagaaccacagca

SEQ ID NO: 5103055 - DNA, 20 bp, Homo sapiens
aaggagttcgtggctgcaaa

SEQ ID NO: 5103056 - DNA, 18 bp, Homo sapiens
aaggagttctcttccgca

SEQ ID NO: 5103057 - DNA, 16 bp, Homo sapiens
aaggagttggaagtga

SEQ ID NO: 5103058 - DNA, 12 bp, Homo sapiens
aaggagtttatg

SEQ ID NO: 5103059 - DNA, 17 bp, Homo sapiens
aaggagtttatgttcca

SEQ ID NO: 5103060 - DNA, 17 bp, Homo sapiens
aaggagtttattacaat

SEQ ID NO: 5103061 - DNA, 19 bp, Homo sapiens
aaggagtttattacaatgt

SEQ ID NO: 5103062 - DNA, 22 bp, Homo sapiens
aaggagtttattacaatgtatc

SEQ ID NO: 5103063 - DNA, 13 bp, Homo sapiens
aaggagttttgtt

SEQ ID NO: 5103064 - DNA, 22 bp, Homo sapiens
aaggataaacttttagaaactt

SEQ ID NO: 5103065 - DNA, 11 bp, Homo sapiens
aaggataaagt

SEQ ID NO: 5103066 - DNA, 13 bp, Homo sapiens
aaggataaattgt

SEQ ID NO: 5103067 - DNA, 13 bp, Homo sapiens
aaggataaatttt

SEQ ID NO: 5103068 - DNA, 13 bp, Homo sapiens
aaggataactctg

SEQ ID NO: 5103069 - DNA, 16 bp, Homo sapiens
aaggataagaaccaca

SEQ ID NO: 5103070 - DNA, 23 bp, Homo sapiens
aaggataagaaccacagaacact

SEQ ID NO: 5103071 - DNA, 19 bp, Homo sapiens
aaggataatgaaataatca

SEQ ID NO: 5103072 - DNA, 19 bp, Homo sapiens
aaggatactgtaacacttt

SEQ ID NO: 5103073 - DNA, 13 bp, Homo sapiens
aaggatacttatt

SEQ ID NO: 5103074 - DNA, 19 bp, Homo sapiens
aaggatagatcaaagtcaa

SEQ ID NO: 5103075 - DNA, 20 bp, Homo sapiens
aaggatagatgctggcccag

SEQ ID NO: 5103076 - DNA, 16 bp, Homo sapiens
aaggatagcctttgta

SEQ ID NO: 5103077 - DNA, 20 bp, Homo sapiens
aaggatagtaagcatagaaa

SEQ ID NO: 5103078 - DNA, 14 bp, Homo sapiens
aaggatagtgtgaa

SEQ ID NO: 5103079 - DNA, 16 bp, Homo sapiens
aaggatagtgtgaaga

SEQ ID NO: 5103080 - DNA, 14 bp, Homo sapiens
aaggatatattatg

SEQ ID NO: 5103081 - DNA, 23 bp, Homo sapiens
aaggatatttaagaaaatacaat

SEQ ID NO: 5103082 - DNA, 15 bp, Homo sapiens
aaggatatttcaaat

SEQ ID NO: 5103083 - DNA, 22 bp, Homo sapiens
aaggatcagaacagcagaggtt

SEQ ID NO: 5103084 - DNA, 16 bp, Homo sapiens
aagcctgtgccacctg

SEQ ID NO: 5103085 - DNA, 18 bp, Homo sapiens
aagcctgtgccacctgca

SEQ ID NO: 5103086 - DNA, 12 bp, Homo sapiens
aagcctgtgcct

SEQ ID NO: 5103087 - DNA, 17 bp, Homo sapiens
aagcctgtggatgatca

SEQ ID NO: 5103088 - DNA, 21 bp, Homo sapiens
aagcctgtgtatcgtggagaa

SEQ ID NO: 5103089 - DNA, 20 bp, Homo sapiens
aagcctgttccataggaagg

SEQ ID NO: 5103090 - DNA, 18 bp, Homo sapiens
aagcctgtttaagagaca

SEQ ID NO: 5103091 - DNA, 17 bp, Homo sapiens
aagccttaaactgtaca

SEQ ID NO: 5103092 - DNA, 21 bp, Homo sapiens
aagccttaaactgtacagaat

SEQ ID NO: 5103093 - DNA, 15 bp, Homo sapiens
aagccttaagcaaat

SEQ ID NO: 5103094 - DNA, 16 bp, Homo sapiens
aagccttaagcaaatt

SEQ ID NO: 5103095 - DNA, 21 bp, Homo sapiens
aagccttaagccataggccca

SEQ ID NO: 5103096 - DNA, 17 bp, Homo sapiens
aagccttaagctgcagg

SEQ ID NO: 5103097 - DNA, 12 bp, Homo sapiens
aagccttacaaa

SEQ ID NO: 5103098 - DNA, 21 bp, Homo sapiens
aagccttacacagggcgaggg

SEQ ID NO: 5103099 - DNA, 14 bp, Homo sapiens
aagccttcaagctc

SEQ ID NO: 5103100 - DNA, 16 bp, Homo sapiens
aagccttcaagctctg

SEQ ID NO: 5103101 - DNA, 16 bp, Homo sapiens
aagccttcagctccag

SEQ ID NO: 5103102 - DNA, 16 bp, Homo sapiens
aagccttcattgcctt

SEQ ID NO: 5103103 - DNA, 20 bp, Homo sapiens
aagccttccccttatcctcc

SEQ ID NO: 5103104 - DNA, 22 bp, Homo sapiens
aagccttcgaaaagaaattgtc

SEQ ID NO: 5103105 - DNA, 15 bp, Homo sapiens
aagccttctgacctg

SEQ ID NO: 5103106 - DNA, 15 bp, Homo sapiens
aagccttctggatcc

SEQ ID NO: 5103107 - DNA, 14 bp, Homo sapiens
aagccttctgtgag

SEQ ID NO: 5103108 - DNA, 13 bp, Homo sapiens
aagccttcttctg

SEQ ID NO: 5103109 - DNA, 21 bp, Homo sapiens
aagccttgaagaaaatgactt

SEQ ID NO: 5103110 - DNA, 13 bp, Homo sapiens
aagccttgacaca

SEQ ID NO: 5103111 - DNA, 14 bp, Homo sapiens
aagccttgacacac

SEQ ID NO: 5103112 - DNA, 22 bp, Homo sapiens
aagccttggctcgttctcttct

SEQ ID NO: 5103113 - DNA, 13 bp, Homo sapiens
aagcctttaaaac

SEQ ID NO: 5103114 - DNA, 17 bp, Homo sapiens
aagcctttactgaccct

SEQ ID NO: 5103115 - DNA, 21 bp, Homo sapiens
aagcctttagtatcagtgttt

SEQ ID NO: 5103116 - DNA, 17 bp, Homo sapiens
aagcctttagttcctac

SEQ ID NO: 5103117 - DNA, 20 bp, Homo sapiens
aagcctttgacctgttcaga

SEQ ID NO: 5103118 - DNA, 19 bp, Homo sapiens
aagcctttgagactgttcc

SEQ ID NO: 5103119 - DNA, 20 bp, Homo sapiens
aagcctttggtgaattcctt

SEQ ID NO: 5103120 - DNA, 18 bp, Homo sapiens
aagcctttgttgaactgt

SEQ ID NO: 5103121 - DNA, 14 bp, Homo sapiens
aagccttttaaatc

SEQ ID NO: 5103122 - DNA, 16 bp, Homo sapiens
aagcctttttccccaa

SEQ ID NO: 5103123 - DNA, 15 bp, Homo sapiens
aagcctttttttagt

SEQ ID NO: 5103124 - DNA, 22 bp, Homo sapiens
aagcctttttttagtaaatcct

SEQ ID NO: 5103125 - DNA, 13 bp, Homo sapiens
aagcgaacatctt

SEQ ID NO: 5103126 - DNA, 15 bp, Homo sapiens
aagcgaacatcttca

SEQ ID NO: 5103127 - DNA, 18 bp, Homo sapiens
aagcgaacatcttcatat

SEQ ID NO: 5103128 - DNA, 19 bp, Homo sapiens
aagcgaacatcttcatata

SEQ ID NO: 5103129 - DNA, 21 bp, Homo sapiens
aagcgaacatcttcatataaa

SEQ ID NO: 5103130 - DNA, 17 bp, Homo sapiens
aagcgaagatgatttca

SEQ ID NO: 5103131 - DNA, 22 bp, Homo sapiens
aagcgacatcccagtagtgttt

SEQ ID NO: 5103132 - DNA, 14 bp, Homo sapiens
aagcgaccaaggat

SEQ ID NO: 5103133 - DNA, 23 bp, Homo sapiens
aagcgacctaaacagctgcttta

SEQ ID NO: 5103134 - DNA, 14 bp, Homo sapiens
aagcgactcccagc

SEQ ID NO: 5103135 - DNA, 14 bp, Homo sapiens
aagcgactctcctg

SEQ ID NO: 5103136 - DNA, 18 bp, Homo sapiens
aagcgacttttgttctct

SEQ ID NO: 5103137 - DNA, 18 bp, Homo sapiens
aagcgagatcccatctct

SEQ ID NO: 5103138 - DNA, 18 bp, Homo sapiens
aagcgagcacagtattat

SEQ ID NO: 5103139 - DNA, 18 bp, Homo sapiens
aagcgaggtcaacagaga

SEQ ID NO: 5103140 - DNA, 21 bp, Homo sapiens
aagcgatatacagatgaaaat

SEQ ID NO: 5103141 - DNA, 17 bp, Homo sapiens
aagcgattctcctgcct

SEQ ID NO: 5103142 - DNA, 20 bp, Homo sapiens
aagcgattctcctgcctcag

SEQ ID NO: 5103143 - DNA, 21 bp, Homo sapiens
aagcgattctcctgcctcagc

SEQ ID NO: 5103144 - DNA, 23 bp, Homo sapiens
aagcgattctcctgtctcagcct

SEQ ID NO: 5103145 - DNA, 15 bp, Homo sapiens
aagcgatttgaaaca

SEQ ID NO: 5103146 - DNA, 17 bp, Homo sapiens
aagcgatttgaaacact

SEQ ID NO: 5103147 - DNA, 22 bp, Homo sapiens
aagcgcatccaatctcaaggaa

SEQ ID NO: 5103148 - DNA, 14 bp, Homo sapiens
aagcgccctggccc

SEQ ID NO: 5103149 - DNA, 21 bp, Homo sapiens
aagcgccctggcccccacatg

SEQ ID NO: 5103150 - DNA, 16 bp, Homo sapiens
aagcgcctcagttaca

SEQ ID NO: 5103151 - DNA, 15 bp, Homo sapiens
aagcgcctccaaccc

SEQ ID NO: 5103152 - DNA, 16 bp, Homo sapiens
aagcgcctccaaccct

SEQ ID NO: 5103153 - DNA, 20 bp, Homo sapiens
aagcgcctccaaccctagca

SEQ ID NO: 5103154 - DNA, 15 bp, Homo sapiens
aagcgcggctaactt

SEQ ID NO: 5103155 - DNA, 19 bp, Homo sapiens
aagcgctaagtaaaaatat

SEQ ID NO: 5103156 - DNA, 19 bp, Homo sapiens
aagcgctcatgttgagcca

SEQ ID NO: 5103157 - DNA, 12 bp, Homo sapiens
aagcgctccagg

SEQ ID NO: 5103158 - DNA, 13 bp, Homo sapiens
aagcgctgccctg

SEQ ID NO: 5103159 - DNA, 14 bp, Homo sapiens
aagcgctgccctgt

SEQ ID NO: 5103160 - DNA, 15 bp, Homo sapiens
aagcgctgccctgtg

SEQ ID NO: 5103161 - DNA, 22 bp, Homo sapiens
aagcgctgttgcccgccctcca

SEQ ID NO: 5103162 - DNA, 16 bp, Homo sapiens
aagcgcttctgctgaa

SEQ ID NO: 5103163 - DNA, 17 bp, Homo sapiens
aagcgcttctgctgaaa

SEQ ID NO: 5103164 - DNA, 23 bp, Homo sapiens
aagcgcttctttctgactctaaa

SEQ ID NO: 5103165 - DNA, 15 bp, Homo sapiens
aagcggagagagcca

SEQ ID NO: 5103166 - DNA, 19 bp, Homo sapiens
aagcggccaggcggggcgc

SEQ ID NO: 5103167 - DNA, 20 bp, Homo sapiens
aagcggccctaagggagtgt

SEQ ID NO: 5103168 - DNA, 21 bp, Homo sapiens
aagcggccctaagggagtgtc

SEQ ID NO: 5103169 - DNA, 13 bp, Homo sapiens
aagcggctgcctc

SEQ ID NO: 5103170 - DNA, 12 bp, Homo sapiens
aagcgggcagcc

SEQ ID NO: 5103171 - DNA, 15 bp, Homo sapiens
aagcgggcagccccg

SEQ ID NO: 5103172 - DNA, 22 bp, Homo sapiens
aagcgggctgggggtagcctgg

SEQ ID NO: 5103173 - DNA, 14 bp, Homo sapiens
aagcgggggcgtgg

SEQ ID NO: 5103174 - DNA, 17 bp, Homo sapiens
aagcgggggcgtggctg

SEQ ID NO: 5103175 - DNA, 20 bp, Homo sapiens
aagcggtcagactggaggtc

SEQ ID NO: 5103176 - DNA, 15 bp, Homo sapiens
aagcgtatggcttta

SEQ ID NO: 5103177 - DNA, 14 bp, Homo sapiens
aagcgtatttaatg

SEQ ID NO: 5103178 - DNA, 20 bp, Homo sapiens
aagcgtcacttctcctgctg

SEQ ID NO: 5103179 - DNA, 15 bp, Homo sapiens
aagcgtctcccttgg

SEQ ID NO: 5103180 - DNA, 19 bp, Homo sapiens
aagcgtctcccttggccac

SEQ ID NO: 5103181 - DNA, 16 bp, Homo sapiens
aagcgtctttaagaga

SEQ ID NO: 5103182 - DNA, 21 bp, Homo sapiens
aagcgtgattcctgctgcctg

SEQ ID NO: 5103183 - DNA, 21 bp, Homo sapiens
aagcgtgcacaaggattgaaa

SEQ ID NO: 5103184 - DNA, 18 bp, Homo sapiens
aagcgtgctgacatcaga

SEQ ID NO: 5103185 - DNA, 16 bp, Homo sapiens
aagcgtggtcccgagg

SEQ ID NO: 5103186 - DNA, 19 bp, Homo sapiens
aagcgtggtcccgaggaag

SEQ ID NO: 5103187 - DNA, 15 bp, Homo sapiens
aagcgtgttctcagc

SEQ ID NO: 5103188 - DNA, 18 bp, Homo sapiens
aagcgttaagggcagagt

SEQ ID NO: 5103189 - DNA, 18 bp, Homo sapiens
aagcgtttaatggtatct

SEQ ID NO: 5103190 - DNA, 15 bp, Homo sapiens
aagctaaaaatatta

SEQ ID NO: 5103191 - DNA, 13 bp, Homo sapiens
aagctaaaacact

SEQ ID NO: 5103192 - DNA, 16 bp, Homo sapiens
aagctaaaacctgagc

SEQ ID NO: 5103193 - DNA, 13 bp, Homo sapiens
aagctaaaataaa

SEQ ID NO: 5103194 - DNA, 23 bp, Homo sapiens
aagctaaaatatataatatacta

SEQ ID NO: 5103195 - DNA, 11 bp, Homo sapiens
aagctaaactg

SEQ ID NO: 5103196 - DNA, 11 bp, Homo sapiens
aagctaaagag

SEQ ID NO: 5103197 - DNA, 21 bp, Homo sapiens
aagctaacagggaaggcaggc

SEQ ID NO: 5103198 - DNA, 17 bp, Homo sapiens
aagctaaggtttagata

SEQ ID NO: 5103199 - DNA, 14 bp, Homo sapiens
aagctaatctgcct

SEQ ID NO: 5103200 - DNA, 20 bp, Homo sapiens
aagctaatgtaggactgtat

SEQ ID NO: 5103201 - DNA, 13 bp, Homo sapiens
aagctaatgtcac

SEQ ID NO: 5103202 - DNA, 22 bp, Homo sapiens
aagctaatttgcattaaattca

SEQ ID NO: 5103203 - DNA, 13 bp, Homo sapiens
aagctacaggact

SEQ ID NO: 5103204 - DNA, 20 bp, Homo sapiens
aagctacaggttacaacaga

SEQ ID NO: 5103205 - DNA, 22 bp, Homo sapiens
aagctacccctcaaactgcaca

SEQ ID NO: 5103206 - DNA, 13 bp, Homo sapiens
aagctaccttttt

SEQ ID NO: 5103207 - DNA, 18 bp, Homo sapiens
aagctaccttttttttac

SEQ ID NO: 5103208 - DNA, 23 bp, Homo sapiens
aagctaccttttttttacggaat

SEQ ID NO: 5103209 - DNA, 18 bp, Homo sapiens
aagctactattttggaaa

SEQ ID NO: 5103210 - DNA, 21 bp, Homo sapiens
aagctactgaatttattgccg

SEQ ID NO: 5103211 - DNA, 17 bp, Homo sapiens
aagctactgccatcctg

SEQ ID NO: 5103212 - DNA, 22 bp, Homo sapiens
aagctactgtgtgtgtgaatga

SEQ ID NO: 5103213 - DNA, 15 bp, Homo sapiens
aagctagaaaaatta

SEQ ID NO: 5103214 - DNA, 19 bp, Homo sapiens
aagctagaaggccacatgt

SEQ ID NO: 5103215 - DNA, 19 bp, Homo sapiens
aagctagacaaaggcccag

SEQ ID NO: 5103216 - DNA, 20 bp, Homo sapiens
aagctagacacatgaaggta

SEQ ID NO: 5103217 - DNA, 22 bp, Homo sapiens
aagctagacacatgaaggtaaa

SEQ ID NO: 5103218 - DNA, 18 bp, Homo sapiens
aagctagagagaaaaaga

SEQ ID NO: 5103219 - DNA, 16 bp, Homo sapiens
aagctagatatgcctt

SEQ ID NO: 5103220 - DNA, 12 bp, Homo sapiens
aagctagctccc

SEQ ID NO: 5103221 - DNA, 20 bp, Homo sapiens
aagctagctcccctcctctc

SEQ ID NO: 5103222 - DNA, 19 bp, Homo sapiens
aagctaggaaaagaaatct

SEQ ID NO: 5103223 - DNA, 23 bp, Homo sapiens
aagctaggaaaagaaatctatag

SEQ ID NO: 5103224 - DNA, 16 bp, Homo sapiens
aagctaggaaagagga

SEQ ID NO: 5103225 - DNA, 13 bp, Homo sapiens
aagctaggaaagg

SEQ ID NO: 5103226 - DNA, 14 bp, Homo sapiens
aagctaggaatgaa

SEQ ID NO: 5103227 - DNA, 14 bp, Homo sapiens
aagctaggccccag

SEQ ID NO: 5103228 - DNA, 20 bp, Homo sapiens
aagctaggccccagaggccc

SEQ ID NO: 5103229 - DNA, 17 bp, Homo sapiens
aagctaggcctggccag

SEQ ID NO: 5103230 - DNA, 21 bp, Homo sapiens
aagctagtgtacctcctctca

SEQ ID NO: 5103231 - DNA, 15 bp, Homo sapiens
aagctagtgtttcta

SEQ ID NO: 5103232 - DNA, 13 bp, Homo sapiens
aagctagttgaat

SEQ ID NO: 5103233 - DNA, 17 bp, Homo sapiens
aagctagttgaatactt

SEQ ID NO: 5103234 - DNA, 20 bp, Homo sapiens
aagctagttgaatacttgaa

SEQ ID NO: 5103235 - DNA, 15 bp, Homo sapiens
aagctataaagcagt

SEQ ID NO: 5103236 - DNA, 18 bp, Homo sapiens
aagctataaattcctctt

SEQ ID NO: 5103237 - DNA, 21 bp, Homo sapiens
aagctataaattcctctttgc

SEQ ID NO: 5103238 - DNA, 22 bp, Homo sapiens
aagctatatcaatctctcttag

SEQ ID NO: 5103239 - DNA, 20 bp, Homo sapiens
aagctatattagctgaaaca

SEQ ID NO: 5103240 - DNA, 21 bp, Homo sapiens
aagctatattagctgaaacaa

SEQ ID NO: 5103241 - DNA, 21 bp, Homo sapiens
aagctatcacctagcagcctc

SEQ ID NO: 5103242 - DNA, 20 bp, Homo sapiens
aagctatccttgcacctcag

SEQ ID NO: 5103243 - DNA, 17 bp, Homo sapiens
aagctatcgtaaaatta

SEQ ID NO: 5103244 - DNA, 13 bp, Homo sapiens
aagctatctgtgc

SEQ ID NO: 5103245 - DNA, 22 bp, Homo sapiens
aagctatcttaaaatatagaaa

SEQ ID NO: 5103246 - DNA, 21 bp, Homo sapiens
aagctatgacacgagaatcag

SEQ ID NO: 5103247 - DNA, 13 bp, Homo sapiens
aagctatgagttg

SEQ ID NO: 5103248 - DNA, 21 bp, Homo sapiens
aagctatgagttgaaatgttc

SEQ ID NO: 5103249 - DNA, 19 bp, Homo sapiens
aagctatggcccatctgta

SEQ ID NO: 5103250 - DNA, 16 bp, Homo sapiens
aagctatgtctctagc

SEQ ID NO: 5103251 - DNA, 13 bp, Homo sapiens
aagctatgttttt

SEQ ID NO: 5103252 - DNA, 14 bp, Homo sapiens
aagctattaaagtt

SEQ ID NO: 5103253 - DNA, 19 bp, Homo sapiens
aagctattaaagtttgtgt

SEQ ID NO: 5103254 - DNA, 16 bp, Homo sapiens
aagctattagccagga

SEQ ID NO: 5103255 - DNA, 21 bp, Homo sapiens
aagctattagccaggatcatg

SEQ ID NO: 5103256 - DNA, 22 bp, Homo sapiens
aagctattcagtaataactcta

SEQ ID NO: 5103257 - DNA, 14 bp, Homo sapiens
aagctattcctttc

SEQ ID NO: 5103258 - DNA, 16 bp, Homo sapiens
aagctattgatgtttc

SEQ ID NO: 5103259 - DNA, 15 bp, Homo sapiens
aagctattggaattt

SEQ ID NO: 5103260 - DNA, 15 bp, Homo sapiens
aagctatttatgtaa

SEQ ID NO: 5103261 - DNA, 16 bp, Homo sapiens
aagctatttttctaac

SEQ ID NO: 5103262 - DNA, 22 bp, Homo sapiens
aagctcaaaggtttggaaggag

SEQ ID NO: 5103263 - DNA, 13 bp, Homo sapiens
aaggatcatctga

SEQ ID NO: 5103264 - DNA, 13 bp, Homo sapiens
aaggatccaagac

SEQ ID NO: 5103265 - DNA, 13 bp, Homo sapiens
aaggatccagaga

SEQ ID NO: 5103266 - DNA, 16 bp, Homo sapiens
aaggatccaggaatat

SEQ ID NO: 5103267 - DNA, 16 bp, Homo sapiens
aaggatcctctccact

SEQ ID NO: 5103268 - DNA, 11 bp, Homo sapiens
aaggatcctga

SEQ ID NO: 5103269 - DNA, 13 bp, Homo sapiens
aaggatcctgagc

SEQ ID NO: 5103270 - DNA, 14 bp, Homo sapiens
aaggatcctgagcc

SEQ ID NO: 5103271 - DNA, 14 bp, Homo sapiens
aaggatcctggaac

SEQ ID NO: 5103272 - DNA, 21 bp, Homo sapiens
aaggatcctggaaccactgat

SEQ ID NO: 5103273 - DNA, 21 bp, Homo sapiens
aaggatcggactctgcccctg

SEQ ID NO: 5103274 - DNA, 20 bp, Homo sapiens
aaggatctctataacagatc

SEQ ID NO: 5103275 - DNA, 21 bp, Homo sapiens
aaggatctctcaggagcacag

SEQ ID NO: 5103276 - DNA, 14 bp, Homo sapiens
aaggatcttcatct

SEQ ID NO: 5103277 - DNA, 23 bp, Homo sapiens
aaggatctttcacccacagaaag

SEQ ID NO: 5103278 - DNA, 20 bp, Homo sapiens
aaggatctttgtggccaagg

SEQ ID NO: 5103279 - DNA, 14 bp, Homo sapiens
aaggatcttttgta

SEQ ID NO: 5103280 - DNA, 23 bp, Homo sapiens
aaggatcttttgtccattccatt

SEQ ID NO: 5103281 - DNA, 14 bp, Homo sapiens
aaggatgaaagaca

SEQ ID NO: 5103282 - DNA, 20 bp, Homo sapiens
aaggatgaagaacacagcat

SEQ ID NO: 5103283 - DNA, 16 bp, Homo sapiens
aaggatgaccacaccc

SEQ ID NO: 5103284 - DNA, 13 bp, Homo sapiens
aaggatgactttt

SEQ ID NO: 5103285 - DNA, 17 bp, Homo sapiens
aaggatgagaatgtgac

SEQ ID NO: 5103286 - DNA, 23 bp, Homo sapiens
aaggatgatcgcccgataaagac

SEQ ID NO: 5103287 - DNA, 23 bp, Homo sapiens
aaggatgatctaggaagactttg

SEQ ID NO: 5103288 - DNA, 18 bp, Homo sapiens
aaggatgatggaaaaatc

SEQ ID NO: 5103289 - DNA, 13 bp, Homo sapiens
aaggatgatttta

SEQ ID NO: 5103290 - DNA, 14 bp, Homo sapiens
aaggatgattttaa

SEQ ID NO: 5103291 - DNA, 19 bp, Homo sapiens
aaggatgccccgtccccct

SEQ ID NO: 5103292 - DNA, 19 bp, Homo sapiens
aaggatgccttagcatgtg

SEQ ID NO: 5103293 - DNA, 23 bp, Homo sapiens
aaggatgcttctgctcacattcc

SEQ ID NO: 5103294 - DNA, 16 bp, Homo sapiens
aaggatggaaaaataa

SEQ ID NO: 5103295 - DNA, 14 bp, Homo sapiens
aaggatggaagaaa

SEQ ID NO: 5103296 - DNA, 13 bp, Homo sapiens
aaggatggatggc

SEQ ID NO: 5103297 - DNA, 22 bp, Homo sapiens
aaggatggcagcctcagggctt

SEQ ID NO: 5103298 - DNA, 18 bp, Homo sapiens
aaggatgggggaaagaag

SEQ ID NO: 5103299 - DNA, 12 bp, Homo sapiens
aaggatggggtt

SEQ ID NO: 5103300 - DNA, 20 bp, Homo sapiens
aaggatggtggttattttaa

SEQ ID NO: 5103301 - DNA, 22 bp, Homo sapiens
aaggatgtgattgtggaatgga

SEQ ID NO: 5103302 - DNA, 16 bp, Homo sapiens
aaggatgtgggggaag

SEQ ID NO: 5103303 - DNA, 23 bp, Homo sapiens
aaggatgttacaagtttgctaaa

SEQ ID NO: 5103304 - DNA, 21 bp, Homo sapiens
aaggatgttctggctttacat

SEQ ID NO: 5103305 - DNA, 13 bp, Homo sapiens
aaggattaatgaa

SEQ ID NO: 5103306 - DNA, 18 bp, Homo sapiens
aaggattaatgaaaacct

SEQ ID NO: 5103307 - DNA, 20 bp, Homo sapiens
aaggattacagaaactgatg

SEQ ID NO: 5103308 - DNA, 18 bp, Homo sapiens
aaggattaggcaaaaata

SEQ ID NO: 5103309 - DNA, 19 bp, Homo sapiens
aaggattatggaaaaataa

SEQ ID NO: 5103310 - DNA, 20 bp, Homo sapiens
aaggattatggaaaaataaa

SEQ ID NO: 5103311 - DNA, 17 bp, Homo sapiens
aaggattctaaacagat

SEQ ID NO: 5103312 - DNA, 18 bp, Homo sapiens
aaggattctgaagtttta

SEQ ID NO: 5103313 - DNA, 20 bp, Homo sapiens
aaggattctgctggcctctg

SEQ ID NO: 5103314 - DNA, 13 bp, Homo sapiens
aaggattctggaa

SEQ ID NO: 5103315 - DNA, 20 bp, Homo sapiens
aaggattctgttctgcaact

SEQ ID NO: 5103316 - DNA, 15 bp, Homo sapiens
aaggattcttttttc

SEQ ID NO: 5103317 - DNA, 13 bp, Homo sapiens
aaggattgccttt

SEQ ID NO: 5103318 - DNA, 16 bp, Homo sapiens
aaggattggatgattg

SEQ ID NO: 5103319 - DNA, 12 bp, Homo sapiens
aaggattgtaaa

SEQ ID NO: 5103320 - DNA, 21 bp, Homo sapiens
aaggattgtaaaaaaaaatgc

SEQ ID NO: 5103321 - DNA, 19 bp, Homo sapiens
aaggattgttaacatgcct

SEQ ID NO: 5103322 - DNA, 16 bp, Homo sapiens
aaggatttactttttg

SEQ ID NO: 5103323 - DNA, 13 bp, Homo sapiens
aaggatttattct

SEQ ID NO: 5103324 - DNA, 15 bp, Homo sapiens
aaggatttattctca

SEQ ID NO: 5103325 - DNA, 19 bp, Homo sapiens
aaggatttattctcagaac

SEQ ID NO: 5103326 - DNA, 22 bp, Homo sapiens
aaggatttattctcagaacacc

SEQ ID NO: 5103327 - DNA, 18 bp, Homo sapiens
aaggatttcttgtattgg

SEQ ID NO: 5103328 - DNA, 21 bp, Homo sapiens
aaggatttgatgcttttctct

SEQ ID NO: 5103329 - DNA, 16 bp, Homo sapiens
aaggatttgtgtttta

SEQ ID NO: 5103330 - DNA, 12 bp, Homo sapiens
aaggatttgttc

SEQ ID NO: 5103331 - DNA, 11 bp, Homo sapiens
aaggattttaa

SEQ ID NO: 5103332 - DNA, 14 bp, Homo sapiens
aaggattttaccaa

SEQ ID NO: 5103333 - DNA, 20 bp, Homo sapiens
aaggattttaccaaagcatc

SEQ ID NO: 5103334 - DNA, 23 bp, Homo sapiens
aaggattttatgagttcttgttt

SEQ ID NO: 5103335 - DNA, 23 bp, Homo sapiens
aaggattttatgctttaaacatt

SEQ ID NO: 5103336 - DNA, 18 bp, Homo sapiens
aaggattttcatgttgat

SEQ ID NO: 5103337 - DNA, 18 bp, Homo sapiens
aaggatttttccatgtgt

SEQ ID NO: 5103338 - DNA, 19 bp, Homo sapiens
aaggatttttccatgtgtg

SEQ ID NO: 5103339 - DNA, 12 bp, Homo sapiens
aaggatttttct

SEQ ID NO: 5103340 - DNA, 22 bp, Homo sapiens
aaggattttttaaaaattggca

SEQ ID NO: 5103341 - DNA, 23 bp, Homo sapiens
aaggcaaaaaactcttaatctgt

SEQ ID NO: 5103342 - DNA, 18 bp, Homo sapiens
aaggcaaaaatatcagga

SEQ ID NO: 5103343 - DNA, 15 bp, Homo sapiens
aaggcaaaaccgtgc

SEQ ID NO: 5103344 - DNA, 23 bp, Homo sapiens
aaggcaaaagactggtttgtttg

SEQ ID NO: 5103345 - DNA, 12 bp, Homo sapiens
aaggcaaaattg

SEQ ID NO: 5103346 - DNA, 19 bp, Homo sapiens
aaggcaaaattgcaaatct

SEQ ID NO: 5103347 - DNA, 15 bp, Homo sapiens
aaggcaaacccatca

SEQ ID NO: 5103348 - DNA, 20 bp, Homo sapiens
aaggcaaacccatcaacaaa

SEQ ID NO: 5103349 - DNA, 17 bp, Homo sapiens
aaggcaaagcccctgga

SEQ ID NO: 5103350 - DNA, 19 bp, Homo sapiens
aaggcaaagtaaaattaga

SEQ ID NO: 5103351 - DNA, 15 bp, Homo sapiens
aaggcaaagtttcca

SEQ ID NO: 5103352 - DNA, 17 bp, Homo sapiens
aaggcaaataatggaaa

SEQ ID NO: 5103353 - DNA, 18 bp, Homo sapiens
aaggcaaatattatccag

SEQ ID NO: 5103354 - DNA, 20 bp, Homo sapiens
aaggcaaatctcctttgtcc

SEQ ID NO: 5103355 - DNA, 17 bp, Homo sapiens
aaggcaaatctgacttt

SEQ ID NO: 5103356 - DNA, 15 bp, Homo sapiens
aaggcaaatgacttt

SEQ ID NO: 5103357 - DNA, 14 bp, Homo sapiens
aaggcaaatgtcca

SEQ ID NO: 5103358 - DNA, 18 bp, Homo sapiens
aaggcaaatgtgtacatg

SEQ ID NO: 5103359 - DNA, 15 bp, Homo sapiens
aaggcaacattcctt

SEQ ID NO: 5103360 - DNA, 21 bp, Homo sapiens
aaggcaacattcctttcttgt

SEQ ID NO: 5103361 - DNA, 12 bp, Homo sapiens
aaggcaactcaa

SEQ ID NO: 5103362 - DNA, 20 bp, Homo sapiens
aaggcaactgaacaaaaaaa

SEQ ID NO: 5103363 - DNA, 21 bp, Homo sapiens
aaggcaactgaacaaaaaaat

SEQ ID NO: 5103364 - DNA, 19 bp, Homo sapiens
aaggcaacttgaagaaacg

SEQ ID NO: 5103365 - DNA, 19 bp, Homo sapiens
aaggcaagagggggtggag

SEQ ID NO: 5103366 - DNA, 16 bp, Homo sapiens
aaggcaaggctgtcaa

SEQ ID NO: 5103367 - DNA, 21 bp, Homo sapiens
aaggcaagttaagagaaactt

SEQ ID NO: 5103368 - DNA, 17 bp, Homo sapiens
aaggcaatattaaccta

SEQ ID NO: 5103369 - DNA, 21 bp, Homo sapiens
aaggcaatcaagagcttccag

SEQ ID NO: 5103370 - DNA, 14 bp, Homo sapiens
aaggcaatggaaac

SEQ ID NO: 5103371 - DNA, 15 bp, Homo sapiens
aaggcaatggaaact

SEQ ID NO: 5103372 - DNA, 20 bp, Homo sapiens
aaggcaatttctctgcacac

SEQ ID NO: 5103373 - DNA, 16 bp, Homo sapiens
aaggcaattttagtgt

SEQ ID NO: 5103374 - DNA, 17 bp, Homo sapiens
aaggcacaaaattttgt

SEQ ID NO: 5103375 - DNA, 22 bp, Homo sapiens
aaggcacacagagattctggat

SEQ ID NO: 5103376 - DNA, 17 bp, Homo sapiens
aaggcacaggtgtaaat

SEQ ID NO: 5103377 - DNA, 15 bp, Homo sapiens
aaggcaccagccggg

SEQ ID NO: 5103378 - DNA, 15 bp, Homo sapiens
aaggcacctgctccc

SEQ ID NO: 5103379 - DNA, 20 bp, Homo sapiens
aaggcacgtttggcatttct

SEQ ID NO: 5103380 - DNA, 14 bp, Homo sapiens
aaggcactctagat

SEQ ID NO: 5103381 - DNA, 21 bp, Homo sapiens
aaggcactctgttatttagac

SEQ ID NO: 5103382 - DNA, 12 bp, Homo sapiens
aaggcactgagc

SEQ ID NO: 5103383 - DNA, 15 bp, Homo sapiens
aaggcactgcacata

SEQ ID NO: 5103384 - DNA, 16 bp, Homo sapiens
aaggcacttgaggggg

SEQ ID NO: 5103385 - DNA, 12 bp, Homo sapiens
aaggcacttgtc

SEQ ID NO: 5103386 - DNA, 18 bp, Homo sapiens
aaggcacttgtcactatg

SEQ ID NO: 5103387 - DNA, 15 bp, Homo sapiens
aaggcagaaagcaaa

SEQ ID NO: 5103388 - DNA, 16 bp, Homo sapiens
aaggcagaaagcaaaa

SEQ ID NO: 5103389 - DNA, 14 bp, Homo sapiens
aaggcagaaaggag

SEQ ID NO: 5103390 - DNA, 16 bp, Homo sapiens
aaggcagaaaggagat

SEQ ID NO: 5103391 - DNA, 14 bp, Homo sapiens
aaggcagaagcagc

SEQ ID NO: 5103392 - DNA, 21 bp, Homo sapiens
aaggcagaagcttggaggagg

SEQ ID NO: 5103393 - DNA, 22 bp, Homo sapiens
aaggcagacacaccgcggccag

SEQ ID NO: 5103394 - DNA, 12 bp, Homo sapiens
aaggcagacagg

SEQ ID NO: 5103395 - DNA, 15 bp, Homo sapiens
aaggcagacaggaag

SEQ ID NO: 5103396 - DNA, 16 bp, Homo sapiens
aaggcagagaaaacac

SEQ ID NO: 5103397 - DNA, 17 bp, Homo sapiens
aaggcagagaaaacaca

SEQ ID NO: 5103398 - DNA, 13 bp, Homo sapiens
aaggcagaggctg

SEQ ID NO: 5103399 - DNA, 17 bp, Homo sapiens
aaggcagcaaagagggg

SEQ ID NO: 5103400 - DNA, 14 bp, Homo sapiens
aaggcagcaaggcc

SEQ ID NO: 5103401 - DNA, 16 bp, Homo sapiens
aaggcagccacagaca

SEQ ID NO: 5103402 - DNA, 12 bp, Homo sapiens
aaggcagccctc

SEQ ID NO: 5103403 - DNA, 19 bp, Homo sapiens
aaggcagccgtgggcccca

SEQ ID NO: 5103404 - DNA, 21 bp, Homo sapiens
aaggcagcctccagagccagc

SEQ ID NO: 5103405 - DNA, 15 bp, Homo sapiens
aaggcagcgacccca

SEQ ID NO: 5103406 - DNA, 22 bp, Homo sapiens
aaggcagctaagatagaaagct

SEQ ID NO: 5103407 - DNA, 15 bp, Homo sapiens
aaggcagctcacccc

SEQ ID NO: 5103408 - DNA, 21 bp, Homo sapiens
aaggcagctcacccctgggca

SEQ ID NO: 5103409 - DNA, 20 bp, Homo sapiens
aaggcagctctaaatgtcaa

SEQ ID NO: 5103410 - DNA, 11 bp, Homo sapiens
aaggcagctgc

SEQ ID NO: 5103411 - DNA, 13 bp, Homo sapiens
aaggcagctgcct

SEQ ID NO: 5103412 - DNA, 17 bp, Homo sapiens
aaggcagctgcctctgc

SEQ ID NO: 5103413 - DNA, 19 bp, Homo sapiens
aaggcagctgcctctgctc

SEQ ID NO: 5103414 - DNA, 12 bp, Homo sapiens
aaggcagctgtg

SEQ ID NO: 5103415 - DNA, 16 bp, Homo sapiens
aaggcagctgtgtctg

SEQ ID NO: 5103416 - DNA, 20 bp, Homo sapiens
aaggcagctgtgtctgagcc

SEQ ID NO: 5103417 - DNA, 15 bp, Homo sapiens
aaggcaggaagggaa

SEQ ID NO: 5103418 - DNA, 19 bp, Homo sapiens
aaggcaggaatgtgtggca

SEQ ID NO: 5103419 - DNA, 18 bp, Homo sapiens
aaggcagggaaaggctct

SEQ ID NO: 5103420 - DNA, 18 bp, Homo sapiens
aaggcagggaatgcctgg

SEQ ID NO: 5103421 - DNA, 12 bp, Homo sapiens
aaggcagggacc

SEQ ID NO: 5103422 - DNA, 20 bp, Homo sapiens
aaggcagggagcgagggaga

SEQ ID NO: 5103423 - DNA, 12 bp, Homo sapiens
aaggcagggagg

SEQ ID NO: 5103424 - DNA, 19 bp, Homo sapiens
aaggcagggagggcctggg

SEQ ID NO: 5103425 - DNA, 14 bp, Homo sapiens
aaggcagggccctg

SEQ ID NO: 5103426 - DNA, 21 bp, Homo sapiens
aaggcagggccctgaaatggc

SEQ ID NO: 5103427 - DNA, 22 bp, Homo sapiens
aaggcagggctcctccctggag

SEQ ID NO: 5103428 - DNA, 23 bp, Homo sapiens
aaggcagggctcctccctggagc

SEQ ID NO: 5103429 - DNA, 16 bp, Homo sapiens
aaggcaggtgcctcca

SEQ ID NO: 5103430 - DNA, 19 bp, Homo sapiens
aaggcaggtgggcagacag

SEQ ID NO: 5103431 - DNA, 13 bp, Homo sapiens
aaggcaggtttca

SEQ ID NO: 5103432 - DNA, 23 bp, Homo sapiens
aaggcagtagaactccaggccct

SEQ ID NO: 5103433 - DNA, 18 bp, Homo sapiens
aaggcagtagttttcaaa

SEQ ID NO: 5103434 - DNA, 20 bp, Homo sapiens
aaggcagtagttttcaaaac

SEQ ID NO: 5103435 - DNA, 16 bp, Homo sapiens
aaggcagtccagagct

SEQ ID NO: 5103436 - DNA, 15 bp, Homo sapiens
aaggcagtcccggga

SEQ ID NO: 5103437 - DNA, 18 bp, Homo sapiens
aaggcagtgcatgcatgt

SEQ ID NO: 5103438 - DNA, 19 bp, Homo sapiens
aaggcagtgcatgcatgtt

SEQ ID NO: 5103439 - DNA, 16 bp, Homo sapiens
aaggcagtggcagggg

SEQ ID NO: 5103440 - DNA, 23 bp, Homo sapiens
aaggcagttaccattaaaccatc

SEQ ID NO: 5103441 - DNA, 13 bp, Homo sapiens
aaggcagttctgt

SEQ ID NO: 5103442 - DNA, 21 bp, Homo sapiens
aaggcatacgagagcagaggt

SEQ ID NO: 5103443 - DNA, 18 bp, Homo sapiens
aagctcaaataaaaataa

SEQ ID NO: 5103444 - DNA, 18 bp, Homo sapiens
aagctcaaatgaaatgta

SEQ ID NO: 5103445 - DNA, 19 bp, Homo sapiens
aagctcaaatgaaatgtat

SEQ ID NO: 5103446 - DNA, 16 bp, Homo sapiens
aagctcaaatgtatat

SEQ ID NO: 5103447 - DNA, 19 bp, Homo sapiens
aagctcaaggctgcagtga

SEQ ID NO: 5103448 - DNA, 17 bp, Homo sapiens
aagctcacacagcagga

SEQ ID NO: 5103449 - DNA, 16 bp, Homo sapiens
aagctcacaccaaatt

SEQ ID NO: 5103450 - DNA, 18 bp, Homo sapiens
aagctcacacctgtcctt

SEQ ID NO: 5103451 - DNA, 18 bp, Homo sapiens
aagctcacactgatgggc

SEQ ID NO: 5103452 - DNA, 11 bp, Homo sapiens
aagctcacagt

SEQ ID NO: 5103453 - DNA, 19 bp, Homo sapiens
aagctcacagttcctcgcc

SEQ ID NO: 5103454 - DNA, 16 bp, Homo sapiens
aagctcaccctgctcc

SEQ ID NO: 5103455 - DNA, 16 bp, Homo sapiens
aagctcacctgttgct

SEQ ID NO: 5103456 - DNA, 18 bp, Homo sapiens
aagctcacctgttgctta

SEQ ID NO: 5103457 - DNA, 23 bp, Homo sapiens
aagctcacctgttgcttacaatt

SEQ ID NO: 5103458 - DNA, 13 bp, Homo sapiens
aagctcactgctg

SEQ ID NO: 5103459 - DNA, 17 bp, Homo sapiens
aagctcagactggttga

SEQ ID NO: 5103460 - DNA, 15 bp, Homo sapiens
aagctcagccagccc

SEQ ID NO: 5103461 - DNA, 16 bp, Homo sapiens
aagctcagcccacccc

SEQ ID NO: 5103462 - DNA, 15 bp, Homo sapiens
aagctcagccttctc

SEQ ID NO: 5103463 - DNA, 17 bp, Homo sapiens
aagctcagctatgaaat

SEQ ID NO: 5103464 - DNA, 15 bp, Homo sapiens
aagctcagctgcatt

SEQ ID NO: 5103465 - DNA, 16 bp, Homo sapiens
aagctcagggcctggc

SEQ ID NO: 5103466 - DNA, 17 bp, Homo sapiens
aagctcaggtcctgctg

SEQ ID NO: 5103467 - DNA, 16 bp, Homo sapiens
aagctcaggttccctg

SEQ ID NO: 5103468 - DNA, 17 bp, Homo sapiens
aagctcaggttccctgc

SEQ ID NO: 5103469 - DNA, 12 bp, Homo sapiens
aagctcagtgct

SEQ ID NO: 5103470 - DNA, 16 bp, Homo sapiens
aagctcagtgctctct

SEQ ID NO: 5103471 - DNA, 22 bp, Homo sapiens
aagctcagtggcaagaatgaaa

SEQ ID NO: 5103472 - DNA, 16 bp, Homo sapiens
aagctcagttgggttt

SEQ ID NO: 5103473 - DNA, 16 bp, Homo sapiens
aagctcagtttggctg

SEQ ID NO: 5103474 - DNA, 21 bp, Homo sapiens
aagctcatattttgtatatat

SEQ ID NO: 5103475 - DNA, 13 bp, Homo sapiens
aagctcatctatt

SEQ ID NO: 5103476 - DNA, 23 bp, Homo sapiens
aagctccacggtgcgtggctgtg

SEQ ID NO: 5103477 - DNA, 18 bp, Homo sapiens
aagctccagtcctgctct

SEQ ID NO: 5103478 - DNA, 16 bp, Homo sapiens
aagctccagtgcttta

SEQ ID NO: 5103479 - DNA, 14 bp, Homo sapiens
aagctccatctcca

SEQ ID NO: 5103480 - DNA, 18 bp, Homo sapiens
aagctccatgtgcatata

SEQ ID NO: 5103481 - DNA, 19 bp, Homo sapiens
aagctccatgtgcatataa

SEQ ID NO: 5103482 - DNA, 21 bp, Homo sapiens
aagctccattgggactgattt

SEQ ID NO: 5103483 - DNA, 19 bp, Homo sapiens
aagctcccacacccacctc

SEQ ID NO: 5103484 - DNA, 21 bp, Homo sapiens
aagctcccacacccacctctg

SEQ ID NO: 5103485 - DNA, 14 bp, Homo sapiens
aagctcccaggaac

SEQ ID NO: 5103486 - DNA, 14 bp, Homo sapiens
aagctcccaggccg

SEQ ID NO: 5103487 - DNA, 16 bp, Homo sapiens
aagctcccctgcctta

SEQ ID NO: 5103488 - DNA, 13 bp, Homo sapiens
aagctccctggag

SEQ ID NO: 5103489 - DNA, 15 bp, Homo sapiens
aagctccctggagcc

SEQ ID NO: 5103490 - DNA, 16 bp, Homo sapiens
aagctccctggagccc

SEQ ID NO: 5103491 - DNA, 21 bp, Homo sapiens
aagctccctggagccctgttg

SEQ ID NO: 5103492 - DNA, 13 bp, Homo sapiens
aagctccctggtg

SEQ ID NO: 5103493 - DNA, 14 bp, Homo sapiens
aagctccctggtga

SEQ ID NO: 5103494 - DNA, 22 bp, Homo sapiens
aagctccctggtgagggagcct

SEQ ID NO: 5103495 - DNA, 15 bp, Homo sapiens
aagctccgcaggact

SEQ ID NO: 5103496 - DNA, 16 bp, Homo sapiens
aagctccgcaggactt

SEQ ID NO: 5103497 - DNA, 16 bp, Homo sapiens
aagctcctagcagaga

SEQ ID NO: 5103498 - DNA, 18 bp, Homo sapiens
aagctcctagcagagaga

SEQ ID NO: 5103499 - DNA, 17 bp, Homo sapiens
aagctcctatctgtttt

SEQ ID NO: 5103500 - DNA, 13 bp, Homo sapiens
aagctcctcctcc

SEQ ID NO: 5103501 - DNA, 16 bp, Homo sapiens
aagctcctcctccctg

SEQ ID NO: 5103502 - DNA, 17 bp, Homo sapiens
aagctcctcctccctgc

SEQ ID NO: 5103503 - DNA, 16 bp, Homo sapiens
aagctcctctccccag

SEQ ID NO: 5103504 - DNA, 21 bp, Homo sapiens
aagctcctctccccagcccag

SEQ ID NO: 5103505 - DNA, 22 bp, Homo sapiens
aagctcctctccccagcccaga

SEQ ID NO: 5103506 - DNA, 12 bp, Homo sapiens
aagctcctctgc

SEQ ID NO: 5103507 - DNA, 22 bp, Homo sapiens
aagctcctgaatccctttcagt

SEQ ID NO: 5103508 - DNA, 23 bp, Homo sapiens
aagctcctggtatgggtttctcc

SEQ ID NO: 5103509 - DNA, 19 bp, Homo sapiens
aagctcctggtcttgagat

SEQ ID NO: 5103510 - DNA, 14 bp, Homo sapiens
aagctcctgtcctc

SEQ ID NO: 5103511 - DNA, 22 bp, Homo sapiens
aagctcctgtcctcccatcccc

SEQ ID NO: 5103512 - DNA, 22 bp, Homo sapiens
aagctccttgagtaaaaaggtg

SEQ ID NO: 5103513 - DNA, 23 bp, Homo sapiens
aagctcgatgtggtcacagctgt

SEQ ID NO: 5103514 - DNA, 19 bp, Homo sapiens
aagctcgccccacctccac

SEQ ID NO: 5103515 - DNA, 16 bp, Homo sapiens
aagctctagtgggaag

SEQ ID NO: 5103516 - DNA, 15 bp, Homo sapiens
aagctctattaagat

SEQ ID NO: 5103517 - DNA, 18 bp, Homo sapiens
aagctctcatagctcata

SEQ ID NO: 5103518 - DNA, 18 bp, Homo sapiens
aagctctccgagctctgg

SEQ ID NO: 5103519 - DNA, 20 bp, Homo sapiens
aagctctccgagctctggtg

SEQ ID NO: 5103520 - DNA, 15 bp, Homo sapiens
aagctctctgcatct

SEQ ID NO: 5103521 - DNA, 20 bp, Homo sapiens
aagctctctgggcctgggtt

SEQ ID NO: 5103522 - DNA, 20 bp, Homo sapiens
aagctctctttggaatgaac

SEQ ID NO: 5103523 - DNA, 18 bp, Homo sapiens
aagctctgaacaaaagct

SEQ ID NO: 5103524 - DNA, 19 bp, Homo sapiens
aagctctgaacaaaagctt

SEQ ID NO: 5103525 - DNA, 15 bp, Homo sapiens
aagctctgaagaact

SEQ ID NO: 5103526 - DNA, 16 bp, Homo sapiens
aagctctgaagtcaca

SEQ ID NO: 5103527 - DNA, 22 bp, Homo sapiens
aagctctgaagtcacatcacag

SEQ ID NO: 5103528 - DNA, 23 bp, Homo sapiens
aagctctgaattcaggtcccagt

SEQ ID NO: 5103529 - DNA, 11 bp, Homo sapiens
aagctctgagc

SEQ ID NO: 5103530 - DNA, 13 bp, Homo sapiens
aagctctgcccct

SEQ ID NO: 5103531 - DNA, 13 bp, Homo sapiens
aagctctgccctg

SEQ ID NO: 5103532 - DNA, 17 bp, Homo sapiens
aagctctgccctggctg

SEQ ID NO: 5103533 - DNA, 14 bp, Homo sapiens
aagctctgcctccc

SEQ ID NO: 5103534 - DNA, 13 bp, Homo sapiens
aagctctgctcct

SEQ ID NO: 5103535 - DNA, 18 bp, Homo sapiens
aagctctggccccaggct

SEQ ID NO: 5103536 - DNA, 11 bp, Homo sapiens
aagctctggct

SEQ ID NO: 5103537 - DNA, 15 bp, Homo sapiens
aagctctggctgaac

SEQ ID NO: 5103538 - DNA, 24 bp, Homo sapiens
aagctctggctgaaccctgtgctg

SEQ ID NO: 5103539 - DNA, 12 bp, Homo sapiens
aagctctgggga

SEQ ID NO: 5103540 - DNA, 21 bp, Homo sapiens
aagctctggtgacaccagcct

SEQ ID NO: 5103541 - DNA, 16 bp, Homo sapiens
aagctcttactctttc

SEQ ID NO: 5103542 - DNA, 18 bp, Homo sapiens
aagctcttcccttgctca

SEQ ID NO: 5103543 - DNA, 12 bp, Homo sapiens
aagctcttcctt

SEQ ID NO: 5103544 - DNA, 21 bp, Homo sapiens
aagctcttggacaacagctct

SEQ ID NO: 5103545 - DNA, 22 bp, Homo sapiens
aagctcttggacaacagctctc

SEQ ID NO: 5103546 - DNA, 16 bp, Homo sapiens
aagctctttgaaacaa

SEQ ID NO: 5103547 - DNA, 18 bp, Homo sapiens
aagctgaaattttagaaa

SEQ ID NO: 5103548 - DNA, 20 bp, Homo sapiens
aagctgaaattttagaaata

SEQ ID NO: 5103549 - DNA, 18 bp, Homo sapiens
aagctgaacacatttctt

SEQ ID NO: 5103550 - DNA, 13 bp, Homo sapiens
aagctgaagaaaa

SEQ ID NO: 5103551 - DNA, 22 bp, Homo sapiens
aagctgaagaggttgaagctaa

SEQ ID NO: 5103552 - DNA, 12 bp, Homo sapiens
aagctgaagatc

SEQ ID NO: 5103553 - DNA, 14 bp, Homo sapiens
aagctgaagatccc

SEQ ID NO: 5103554 - DNA, 17 bp, Homo sapiens
aagctgaagcccccctt

SEQ ID NO: 5103555 - DNA, 14 bp, Homo sapiens
aagctgaagtgaag

SEQ ID NO: 5103556 - DNA, 15 bp, Homo sapiens
aagctgaagtgaagg

SEQ ID NO: 5103557 - DNA, 21 bp, Homo sapiens
aagctgaagtgcatccaaagg

SEQ ID NO: 5103558 - DNA, 21 bp, Homo sapiens
aagctgaatcagacagtggat

SEQ ID NO: 5103559 - DNA, 11 bp, Homo sapiens
aagctgacctt

SEQ ID NO: 5103560 - DNA, 22 bp, Homo sapiens
aagctgacgaacttccatggcc

SEQ ID NO: 5103561 - DNA, 15 bp, Homo sapiens
aagctgacttggctg

SEQ ID NO: 5103562 - DNA, 16 bp, Homo sapiens
aagctgacttggctgg

SEQ ID NO: 5103563 - DNA, 14 bp, Homo sapiens
aagctgagaaaagt

SEQ ID NO: 5103564 - DNA, 15 bp, Homo sapiens
aagctgagaaaagta

SEQ ID NO: 5103565 - DNA, 20 bp, Homo sapiens
aagctgagaagaagctgagg

SEQ ID NO: 5103566 - DNA, 22 bp, Homo sapiens
aagctgagaagaagctgaggat

SEQ ID NO: 5103567 - DNA, 21 bp, Homo sapiens
aagctgagagaccctggcctc

SEQ ID NO: 5103568 - DNA, 24 bp, Homo sapiens
aagctgagatgaaccctggcattt

SEQ ID NO: 5103569 - DNA, 12 bp, Homo sapiens
aagctgagcagg

SEQ ID NO: 5103570 - DNA, 22 bp, Homo sapiens
aagctgagcaggacagccagca

SEQ ID NO: 5103571 - DNA, 13 bp, Homo sapiens
aagctgagcaggc

SEQ ID NO: 5103572 - DNA, 14 bp, Homo sapiens
aagctgagcaggcc

SEQ ID NO: 5103573 - DNA, 16 bp, Homo sapiens
aagctgagcaggcccg

SEQ ID NO: 5103574 - DNA, 21 bp, Homo sapiens
aagctgagcccctccctcctg

SEQ ID NO: 5103575 - DNA, 14 bp, Homo sapiens
aagctgagtttcct

SEQ ID NO: 5103576 - DNA, 20 bp, Homo sapiens
aagctgatattatttcttct

SEQ ID NO: 5103577 - DNA, 22 bp, Homo sapiens
aagctgatattatttcttctct

SEQ ID NO: 5103578 - DNA, 22 bp, Homo sapiens
aagctgatcataagtgaattta

SEQ ID NO: 5103579 - DNA, 21 bp, Homo sapiens
aagctgatgatgtctcttgta

SEQ ID NO: 5103580 - DNA, 16 bp, Homo sapiens
aagctgattactgtca

SEQ ID NO: 5103581 - DNA, 22 bp, Homo sapiens
aagctgattcccagagcagacc

SEQ ID NO: 5103582 - DNA, 19 bp, Homo sapiens
aagctgattttcatgaaaa

SEQ ID NO: 5103583 - DNA, 18 bp, Homo sapiens
aagctgcaaaaggcctgt

SEQ ID NO: 5103584 - DNA, 20 bp, Homo sapiens
aagctgcaaatcagccatgt

SEQ ID NO: 5103585 - DNA, 15 bp, Homo sapiens
aagctgcaaatctga

SEQ ID NO: 5103586 - DNA, 12 bp, Homo sapiens
aagctgcacatg

SEQ ID NO: 5103587 - DNA, 20 bp, Homo sapiens
aagctgcaccctcaggcagg

SEQ ID NO: 5103588 - DNA, 21 bp, Homo sapiens
aagctgcaccctcaggcaggt

SEQ ID NO: 5103589 - DNA, 17 bp, Homo sapiens
aagctgcactgtgaacc

SEQ ID NO: 5103590 - DNA, 15 bp, Homo sapiens
aagctgcagagattt

SEQ ID NO: 5103591 - DNA, 23 bp, Homo sapiens
aagctgcagagatttctcattga

SEQ ID NO: 5103592 - DNA, 17 bp, Homo sapiens
aagctgcagcttcctgt

SEQ ID NO: 5103593 - DNA, 13 bp, Homo sapiens
aagctgcagcttg

SEQ ID NO: 5103594 - DNA, 22 bp, Homo sapiens
aagctgcaggcacacacgcctt

SEQ ID NO: 5103595 - DNA, 18 bp, Homo sapiens
aagctgcatctagaggct

SEQ ID NO: 5103596 - DNA, 19 bp, Homo sapiens
aagctgccacccctcttct

SEQ ID NO: 5103597 - DNA, 15 bp, Homo sapiens
aagctgccagcccag

SEQ ID NO: 5103598 - DNA, 22 bp, Homo sapiens
aagctgcccaatttcacagagt

SEQ ID NO: 5103599 - DNA, 20 bp, Homo sapiens
aagctgcccactgtttctct

SEQ ID NO: 5103600 - DNA, 12 bp, Homo sapiens
aagctgcccagc

SEQ ID NO: 5103601 - DNA, 13 bp, Homo sapiens
aagctgcccagcc

SEQ ID NO: 5103602 - DNA, 16 bp, Homo sapiens
aagctgcccagccctg

SEQ ID NO: 5103603 - DNA, 17 bp, Homo sapiens
aagctgcccagccctgg

SEQ ID NO: 5103604 - DNA, 21 bp, Homo sapiens
aagctgccgaaccaaaagaat

SEQ ID NO: 5103605 - DNA, 23 bp, Homo sapiens
aagctgccgtagcttcagccagg

SEQ ID NO: 5103606 - DNA, 22 bp, Homo sapiens
aagctgcctctgacagcagcct

SEQ ID NO: 5103607 - DNA, 14 bp, Homo sapiens
aagctgcctctggg

SEQ ID NO: 5103608 - DNA, 15 bp, Homo sapiens
aagctgcctgtagtt

SEQ ID NO: 5103609 - DNA, 19 bp, Homo sapiens
aagctgcctgtagttagga

SEQ ID NO: 5103610 - DNA, 22 bp, Homo sapiens
aagctgcctgtagttaggaaat

SEQ ID NO: 5103611 - DNA, 22 bp, Homo sapiens
aagctgcctgtgccatgcccaa

SEQ ID NO: 5103612 - DNA, 22 bp, Homo sapiens
aagctgctaaatctcctatttt

SEQ ID NO: 5103613 - DNA, 15 bp, Homo sapiens
aagctgctgcacagc

SEQ ID NO: 5103614 - DNA, 16 bp, Homo sapiens
aagctgctgcacagct

SEQ ID NO: 5103615 - DNA, 15 bp, Homo sapiens
aagctgctgcagctc

SEQ ID NO: 5103616 - DNA, 21 bp, Homo sapiens
aagctgctggagcccgcactg

SEQ ID NO: 5103617 - DNA, 16 bp, Homo sapiens
aagctgctgggccagt

SEQ ID NO: 5103618 - DNA, 20 bp, Homo sapiens
aagctgctgggccagtggca

SEQ ID NO: 5103619 - DNA, 23 bp, Homo sapiens
aagctgctgggccagtggcactc

SEQ ID NO: 5103620 - DNA, 22 bp, Homo sapiens
aagctgctgtgactgtgtcccc

SEQ ID NO: 5103621 - DNA, 20 bp, Homo sapiens
aaggcatatcatgctttgaa

SEQ ID NO: 5103622 - DNA, 17 bp, Homo sapiens
aaggcatcactttcctg

SEQ ID NO: 5103623 - DNA, 19 bp, Homo sapiens
aaggcatccaggccagggc

SEQ ID NO: 5103624 - DNA, 15 bp, Homo sapiens
aaggcatcccagcct

SEQ ID NO: 5103625 - DNA, 16 bp, Homo sapiens
aaggcatcccagcctg

SEQ ID NO: 5103626 - DNA, 17 bp, Homo sapiens
aaggcatcccagcctgg

SEQ ID NO: 5103627 - DNA, 21 bp, Homo sapiens
aaggcatcccagcctgggggc

SEQ ID NO: 5103628 - DNA, 20 bp, Homo sapiens
aaggcatccttgtcttttga

SEQ ID NO: 5103629 - DNA, 22 bp, Homo sapiens
aaggcatcgtcatgcacagtat

SEQ ID NO: 5103630 - DNA, 17 bp, Homo sapiens
aaggcatctaagacatt

SEQ ID NO: 5103631 - DNA, 15 bp, Homo sapiens
aaggcatctgagtgt

SEQ ID NO: 5103632 - DNA, 12 bp, Homo sapiens
aaggcatgagaa

SEQ ID NO: 5103633 - DNA, 15 bp, Homo sapiens
aaggcatgagaaaga

SEQ ID NO: 5103634 - DNA, 15 bp, Homo sapiens
aaggcatgtgtgaaa

SEQ ID NO: 5103635 - DNA, 14 bp, Homo sapiens
aaggcatgttggga

SEQ ID NO: 5103636 - DNA, 17 bp, Homo sapiens
aaggcattccacaggat

SEQ ID NO: 5103637 - DNA, 15 bp, Homo sapiens
aaggcattgattgca

SEQ ID NO: 5103638 - DNA, 17 bp, Homo sapiens
aaggcatttggctgctg

SEQ ID NO: 5103639 - DNA, 16 bp, Homo sapiens
aaggccaaaatcaaga

SEQ ID NO: 5103640 - DNA, 16 bp, Homo sapiens
aaggccaaacctctgt

SEQ ID NO: 5103641 - DNA, 14 bp, Homo sapiens
aaggccaaagataa

SEQ ID NO: 5103642 - DNA, 18 bp, Homo sapiens
aaggccaaggcctcagga

SEQ ID NO: 5103643 - DNA, 21 bp, Homo sapiens
aaggccaataaagagttagaa

SEQ ID NO: 5103644 - DNA, 20 bp, Homo sapiens
aaggccaataataaagacat

SEQ ID NO: 5103645 - DNA, 16 bp, Homo sapiens
aaggccacaaaaacaa

SEQ ID NO: 5103646 - DNA, 23 bp, Homo sapiens
aaggccacctcccactcctgctg

SEQ ID NO: 5103647 - DNA, 16 bp, Homo sapiens
aaggccacctctgcct

SEQ ID NO: 5103648 - DNA, 21 bp, Homo sapiens
aaggccacctcttcctggccg

SEQ ID NO: 5103649 - DNA, 22 bp, Homo sapiens
aaggccacctcttcctggccgg

SEQ ID NO: 5103650 - DNA, 12 bp, Homo sapiens
aaggccacctgc

SEQ ID NO: 5103651 - DNA, 14 bp, Homo sapiens
aaggccacctgcag

SEQ ID NO: 5103652 - DNA, 21 bp, Homo sapiens
aaggccaccttggaggaggat

SEQ ID NO: 5103653 - DNA, 24 bp, Homo sapiens
aaggccacgtatagtcctagctga

SEQ ID NO: 5103654 - DNA, 16 bp, Homo sapiens
aaggccagaaaaagaa

SEQ ID NO: 5103655 - DNA, 15 bp, Homo sapiens
aaggccagagaggga

SEQ ID NO: 5103656 - DNA, 19 bp, Homo sapiens
aaggccagcaaggtggagt

SEQ ID NO: 5103657 - DNA, 16 bp, Homo sapiens
aaggccagcagccttc

SEQ ID NO: 5103658 - DNA, 19 bp, Homo sapiens
aaggccagcagccttccag

SEQ ID NO: 5103659 - DNA, 14 bp, Homo sapiens
aaggccagcccact

SEQ ID NO: 5103660 - DNA, 17 bp, Homo sapiens
aaggccagcccactggg

SEQ ID NO: 5103661 - DNA, 22 bp, Homo sapiens
aaggccagcccactgggccctg

SEQ ID NO: 5103662 - DNA, 13 bp, Homo sapiens
aaggccagctaga

SEQ ID NO: 5103663 - DNA, 20 bp, Homo sapiens
aaggccaggacgggccacac

SEQ ID NO: 5103664 - DNA, 21 bp, Homo sapiens
aaggccaggagtaagcccaag

SEQ ID NO: 5103665 - DNA, 12 bp, Homo sapiens
aaggccagggca

SEQ ID NO: 5103666 - DNA, 18 bp, Homo sapiens
aaggccaggggcttttgc

SEQ ID NO: 5103667 - DNA, 22 bp, Homo sapiens
aaggccagtccccatttctgcc

SEQ ID NO: 5103668 - DNA, 21 bp, Homo sapiens
aaggccagtggaaattcaggt

SEQ ID NO: 5103669 - DNA, 18 bp, Homo sapiens
aaggccataaaacaggta

SEQ ID NO: 5103670 - DNA, 23 bp, Homo sapiens
aaggccatattttaaaaaatcaa

SEQ ID NO: 5103671 - DNA, 18 bp, Homo sapiens
aaggccatggagagctgg

SEQ ID NO: 5103672 - DNA, 22 bp, Homo sapiens
aaggccatggggcagcctccag

SEQ ID NO: 5103673 - DNA, 19 bp, Homo sapiens
aaggcccaaaccaggggga

SEQ ID NO: 5103674 - DNA, 13 bp, Homo sapiens
aaggcccaagagc

SEQ ID NO: 5103675 - DNA, 15 bp, Homo sapiens
aaggcccacaggagg

SEQ ID NO: 5103676 - DNA, 21 bp, Homo sapiens
aaggcccacgagcttgttctt

SEQ ID NO: 5103677 - DNA, 13 bp, Homo sapiens
aaggcccagacct

SEQ ID NO: 5103678 - DNA, 21 bp, Homo sapiens
aaggcccagagagaagagccc

SEQ ID NO: 5103679 - DNA, 16 bp, Homo sapiens
aaggcccagctgccag

SEQ ID NO: 5103680 - DNA, 17 bp, Homo sapiens
aaggcccagctgccagg

SEQ ID NO: 5103681 - DNA, 18 bp, Homo sapiens
aaggcccagctgccaggg

SEQ ID NO: 5103682 - DNA, 16 bp, Homo sapiens
aaggcccaggggtggg

SEQ ID NO: 5103683 - DNA, 20 bp, Homo sapiens
aaggcccaggtcaacatcta

SEQ ID NO: 5103684 - DNA, 14 bp, Homo sapiens
aaggccccagagac

SEQ ID NO: 5103685 - DNA, 16 bp, Homo sapiens
aaggccccagagagac

SEQ ID NO: 5103686 - DNA, 15 bp, Homo sapiens
aaggccccagggaca

SEQ ID NO: 5103687 - DNA, 14 bp, Homo sapiens
aaggccccagggca

SEQ ID NO: 5103688 - DNA, 16 bp, Homo sapiens
aaggcccccacctctg

SEQ ID NO: 5103689 - DNA, 15 bp, Homo sapiens
aaggccccctgcctg

SEQ ID NO: 5103690 - DNA, 14 bp, Homo sapiens
aaggccccgcccag

SEQ ID NO: 5103691 - DNA, 17 bp, Homo sapiens
aaggcccgagcagctga

SEQ ID NO: 5103692 - DNA, 19 bp, Homo sapiens
aaggcccgagcagctgagc

SEQ ID NO: 5103693 - DNA, 16 bp, Homo sapiens
aaggcccggagatgca

SEQ ID NO: 5103694 - DNA, 14 bp, Homo sapiens
aaggccctcggagc

SEQ ID NO: 5103695 - DNA, 22 bp, Homo sapiens
aaggccctcggagctggctgtg

SEQ ID NO: 5103696 - DNA, 11 bp, Homo sapiens
aaggccctcta

SEQ ID NO: 5103697 - DNA, 13 bp, Homo sapiens
aaggccctgccct

SEQ ID NO: 5103698 - DNA, 18 bp, Homo sapiens
aaggcccttagagggaat

SEQ ID NO: 5103699 - DNA, 11 bp, Homo sapiens
aaggcccttgt

SEQ ID NO: 5103700 - DNA, 22 bp, Homo sapiens
aaggccgaagaagggtccttcc

SEQ ID NO: 5103701 - DNA, 17 bp, Homo sapiens
aaggccgagaagcaaga

SEQ ID NO: 5103702 - DNA, 15 bp, Homo sapiens
aaggccgagggccag

SEQ ID NO: 5103703 - DNA, 14 bp, Homo sapiens
aaggccgcccacct

SEQ ID NO: 5103704 - DNA, 23 bp, Homo sapiens
aaggccggagacccacagccctg

SEQ ID NO: 5103705 - DNA, 16 bp, Homo sapiens
aaggccgtgtctctga

SEQ ID NO: 5103706 - DNA, 17 bp, Homo sapiens
aaggccgtgtctctgag

SEQ ID NO: 5103707 - DNA, 22 bp, Homo sapiens
aaggccgtgtgtttagaagcct

SEQ ID NO: 5103708 - DNA, 22 bp, Homo sapiens
aaggcctaattctatgcctgtc

SEQ ID NO: 5103709 - DNA, 18 bp, Homo sapiens
aaggcctaccccagttcc

SEQ ID NO: 5103710 - DNA, 17 bp, Homo sapiens
aaggcctactatacatt

SEQ ID NO: 5103711 - DNA, 18 bp, Homo sapiens
aaggcctaggattctaaa

SEQ ID NO: 5103712 - DNA, 17 bp, Homo sapiens
aaggcctaggctaggac

SEQ ID NO: 5103713 - DNA, 12 bp, Homo sapiens
aaggcctcagga

SEQ ID NO: 5103714 - DNA, 15 bp, Homo sapiens
aaggcctcccacagt

SEQ ID NO: 5103715 - DNA, 16 bp, Homo sapiens
aaggcctcccacagtg

SEQ ID NO: 5103716 - DNA, 11 bp, Homo sapiens
aaggcctcccc

SEQ ID NO: 5103717 - DNA, 16 bp, Homo sapiens
aaggcctcccctgagg

SEQ ID NO: 5103718 - DNA, 19 bp, Homo sapiens
aaggcctccctagccagca

SEQ ID NO: 5103719 - DNA, 19 bp, Homo sapiens
aaggcctccctcaggctct

SEQ ID NO: 5103720 - DNA, 20 bp, Homo sapiens
aaggcctccctcaggctctg

SEQ ID NO: 5103721 - DNA, 21 bp, Homo sapiens
aaggcctccctcaggctctgt

SEQ ID NO: 5103722 - DNA, 15 bp, Homo sapiens
aaggcctcctggctg

SEQ ID NO: 5103723 - DNA, 20 bp, Homo sapiens
aaggcctcgctcttgacaga

SEQ ID NO: 5103724 - DNA, 17 bp, Homo sapiens
aaggcctctctctgcct

SEQ ID NO: 5103725 - DNA, 14 bp, Homo sapiens
aaggcctctggact

SEQ ID NO: 5103726 - DNA, 12 bp, Homo sapiens
aaggcctcttgg

SEQ ID NO: 5103727 - DNA, 20 bp, Homo sapiens
aaggcctcttggagacctta

SEQ ID NO: 5103728 - DNA, 20 bp, Homo sapiens
aaggcctcttgtaaagactg

SEQ ID NO: 5103729 - DNA, 11 bp, Homo sapiens
aaggcctgagc

SEQ ID NO: 5103730 - DNA, 12 bp, Homo sapiens
aaggcctgaggg

SEQ ID NO: 5103731 - DNA, 15 bp, Homo sapiens
aaggcctgcacacaa

SEQ ID NO: 5103732 - DNA, 13 bp, Homo sapiens
aaggcctgccctc

SEQ ID NO: 5103733 - DNA, 14 bp, Homo sapiens
aaggcctgccctcc

SEQ ID NO: 5103734 - DNA, 16 bp, Homo sapiens
aaggcctgccctccca

SEQ ID NO: 5103735 - DNA, 22 bp, Homo sapiens
aaggcctgcttttgtgtcccat

SEQ ID NO: 5103736 - DNA, 13 bp, Homo sapiens
aaggcctggaaga

SEQ ID NO: 5103737 - DNA, 17 bp, Homo sapiens
aaggcctggcccacagc

SEQ ID NO: 5103738 - DNA, 12 bp, Homo sapiens
aaggcctggctg

SEQ ID NO: 5103739 - DNA, 11 bp, Homo sapiens
aaggcctgggg

SEQ ID NO: 5103740 - DNA, 16 bp, Homo sapiens
aaggcctgtccctggc

SEQ ID NO: 5103741 - DNA, 22 bp, Homo sapiens
aaggcctgtgaatggcagcctg

SEQ ID NO: 5103742 - DNA, 16 bp, Homo sapiens
aaggccttccctgtca

SEQ ID NO: 5103743 - DNA, 15 bp, Homo sapiens
aaggccttctcctcc

SEQ ID NO: 5103744 - DNA, 13 bp, Homo sapiens
aaggccttgcctt

SEQ ID NO: 5103745 - DNA, 11 bp, Homo sapiens
aaggcctttgg

SEQ ID NO: 5103746 - DNA, 17 bp, Homo sapiens
aaggccttttatgtaat

SEQ ID NO: 5103747 - DNA, 21 bp, Homo sapiens
aaggccttttatgtaatttct

SEQ ID NO: 5103748 - DNA, 18 bp, Homo sapiens
aaggcgctaacttgctta

SEQ ID NO: 5103749 - DNA, 22 bp, Homo sapiens
aaggcgctaacttgcttaaatg

SEQ ID NO: 5103750 - DNA, 12 bp, Homo sapiens
aaggcgctgaga

SEQ ID NO: 5103751 - DNA, 17 bp, Homo sapiens
aaggcgctgagactgtg

SEQ ID NO: 5103752 - DNA, 19 bp, Homo sapiens
aaggcggagggtctccctg

SEQ ID NO: 5103753 - DNA, 13 bp, Homo sapiens
aaggcggcaggca

SEQ ID NO: 5103754 - DNA, 16 bp, Homo sapiens
aaggcggcaggcagag

SEQ ID NO: 5103755 - DNA, 17 bp, Homo sapiens
aaggcggcaggcagaga

SEQ ID NO: 5103756 - DNA, 19 bp, Homo sapiens
aaggcggcaggcagagaag

SEQ ID NO: 5103757 - DNA, 18 bp, Homo sapiens
aaggcgggagcatctctt

SEQ ID NO: 5103758 - DNA, 12 bp, Homo sapiens
aaggcggtgttt

SEQ ID NO: 5103759 - DNA, 14 bp, Homo sapiens
aaggcgtggagctg

SEQ ID NO: 5103760 - DNA, 18 bp, Homo sapiens
aaggcgtggcttctgcag

SEQ ID NO: 5103761 - DNA, 16 bp, Homo sapiens
aaggctaaaacttaac

SEQ ID NO: 5103762 - DNA, 15 bp, Homo sapiens
aaggctaaatgtaaa

SEQ ID NO: 5103763 - DNA, 17 bp, Homo sapiens
aaggctaagaaaaagga

SEQ ID NO: 5103764 - DNA, 20 bp, Homo sapiens
aaggctacaacaaaaatcac

SEQ ID NO: 5103765 - DNA, 15 bp, Homo sapiens
aaggctacctttgta

SEQ ID NO: 5103766 - DNA, 19 bp, Homo sapiens
aaggctacctttgtattct

SEQ ID NO: 5103767 - DNA, 15 bp, Homo sapiens
aaggctacgctgaca

SEQ ID NO: 5103768 - DNA, 16 bp, Homo sapiens
aaggctactggcatta

SEQ ID NO: 5103769 - DNA, 20 bp, Homo sapiens
aaggctacttcggggctggg

SEQ ID NO: 5103770 - DNA, 23 bp, Homo sapiens
aaggctacttgagccggacacca

SEQ ID NO: 5103771 - DNA, 21 bp, Homo sapiens
aaggctagtttattttgttac

SEQ ID NO: 5103772 - DNA, 15 bp, Homo sapiens
aaggctatacttgtc

SEQ ID NO: 5103773 - DNA, 23 bp, Homo sapiens
aaggctatggggatagatgtgtg

SEQ ID NO: 5103774 - DNA, 21 bp, Homo sapiens
aaggctcagaaggaatggtgc

SEQ ID NO: 5103775 - DNA, 18 bp, Homo sapiens
aaggctcagactgggcac

SEQ ID NO: 5103776 - DNA, 16 bp, Homo sapiens
aaggctcagccccacg

SEQ ID NO: 5103777 - DNA, 14 bp, Homo sapiens
aaggctcatttaaa

SEQ ID NO: 5103778 - DNA, 15 bp, Homo sapiens
aaggctcatttaaaa

SEQ ID NO: 5103779 - DNA, 18 bp, Homo sapiens
aaggctcatttaaaacag

SEQ ID NO: 5103780 - DNA, 15 bp, Homo sapiens
aaggctccaggagca

SEQ ID NO: 5103781 - DNA, 16 bp, Homo sapiens
aaggctccaggagcag

SEQ ID NO: 5103782 - DNA, 16 bp, Homo sapiens
aaggctccatatatat

SEQ ID NO: 5103783 - DNA, 22 bp, Homo sapiens
aaggctccctcgccctgtgagg

SEQ ID NO: 5103784 - DNA, 15 bp, Homo sapiens
aaggctcctgccccc

SEQ ID NO: 5103785 - DNA, 20 bp, Homo sapiens
aaggctcgagcatgcctgga

SEQ ID NO: 5103786 - DNA, 22 bp, Homo sapiens
aaggctcgagcatgcctggatg

SEQ ID NO: 5103787 - DNA, 15 bp, Homo sapiens
aaggctcgattttgt

SEQ ID NO: 5103788 - DNA, 17 bp, Homo sapiens
aaggctcgattttgtat

SEQ ID NO: 5103789 - DNA, 12 bp, Homo sapiens
aaggctctagat

SEQ ID NO: 5103790 - DNA, 13 bp, Homo sapiens
aaggctctagatc

SEQ ID NO: 5103791 - DNA, 21 bp, Homo sapiens
aaggctctatctgctgggctg

SEQ ID NO: 5103792 - DNA, 19 bp, Homo sapiens
aaggctctcacccccatcc

SEQ ID NO: 5103793 - DNA, 17 bp, Homo sapiens
aaggctctgagagtcta

SEQ ID NO: 5103794 - DNA, 19 bp, Homo sapiens
aaggctcttctccccagag

SEQ ID NO: 5103795 - DNA, 16 bp, Homo sapiens
aaggctcttctgacta

SEQ ID NO: 5103796 - DNA, 22 bp, Homo sapiens
aaggctcttggtatctttctgt

SEQ ID NO: 5103797 - DNA, 19 bp, Homo sapiens
aaggctgaactcttcagaa

SEQ ID NO: 5103798 - DNA, 24 bp, Homo sapiens
aaggctgaatcaaagacatttcat

SEQ ID NO: 5103799 - DNA, 15 bp, Homo sapiens
aaggctgacattcac

SEQ ID NO: 5103800 - DNA, 17 bp, Homo sapiens
aaggctgaccaagagag

SEQ ID NO: 5103801 - DNA, 13 bp, Homo sapiens
aagctgctgtgat

SEQ ID NO: 5103802 - DNA, 19 bp, Homo sapiens
aagctgctgtgtcctctag

SEQ ID NO: 5103803 - DNA, 17 bp, Homo sapiens
aagctgcttctgcccac

SEQ ID NO: 5103804 - DNA, 14 bp, Homo sapiens
aagctgcttctggg

SEQ ID NO: 5103805 - DNA, 13 bp, Homo sapiens
aagctgcttgact

SEQ ID NO: 5103806 - DNA, 19 bp, Homo sapiens
aagctgcttgtcctgggcc

SEQ ID NO: 5103807 - DNA, 21 bp, Homo sapiens
aagctgctttaaaaaaataca

SEQ ID NO: 5103808 - DNA, 14 bp, Homo sapiens
aagctgctttattc

SEQ ID NO: 5103809 - DNA, 17 bp, Homo sapiens
aagctgctttcttctct

SEQ ID NO: 5103810 - DNA, 14 bp, Homo sapiens
aagctgcttttgac

SEQ ID NO: 5103811 - DNA, 16 bp, Homo sapiens
aagctggaacatttga

SEQ ID NO: 5103812 - DNA, 23 bp, Homo sapiens
aagctggaagactgtgcagaaga

SEQ ID NO: 5103813 - DNA, 17 bp, Homo sapiens
aagctggacaagaagct

SEQ ID NO: 5103814 - DNA, 20 bp, Homo sapiens
aagctggacaagaagctgct

SEQ ID NO: 5103815 - DNA, 23 bp, Homo sapiens
aagctggaccttttcccttgctg

SEQ ID NO: 5103816 - DNA, 14 bp, Homo sapiens
aagctggactagtg

SEQ ID NO: 5103817 - DNA, 11 bp, Homo sapiens
aagctggactg

SEQ ID NO: 5103818 - DNA, 12 bp, Homo sapiens
aagctggactga

SEQ ID NO: 5103819 - DNA, 13 bp, Homo sapiens
aagctggagcagc

SEQ ID NO: 5103820 - DNA, 21 bp, Homo sapiens
aagctggagcagcggattgct

SEQ ID NO: 5103821 - DNA, 20 bp, Homo sapiens
aagctggagccaatggtgag

SEQ ID NO: 5103822 - DNA, 23 bp, Homo sapiens
aagctggagccaatggtgagggc

SEQ ID NO: 5103823 - DNA, 16 bp, Homo sapiens
aagctggagctcttgg

SEQ ID NO: 5103824 - DNA, 20 bp, Homo sapiens
aagctggagctcttggaaga

SEQ ID NO: 5103825 - DNA, 19 bp, Homo sapiens
aagctggaggactagaacc

SEQ ID NO: 5103826 - DNA, 18 bp, Homo sapiens
aagctggaggctccagga

SEQ ID NO: 5103827 - DNA, 20 bp, Homo sapiens
aagctggagtgcagtggcat

SEQ ID NO: 5103828 - DNA, 19 bp, Homo sapiens
aagctggatgcagtggctc

SEQ ID NO: 5103829 - DNA, 16 bp, Homo sapiens
aagctggcaacatgaa

SEQ ID NO: 5103830 - DNA, 21 bp, Homo sapiens
aagctggcacaaaagacagct

SEQ ID NO: 5103831 - DNA, 15 bp, Homo sapiens
aagctggcagcactc

SEQ ID NO: 5103832 - DNA, 19 bp, Homo sapiens
aagctggcagctgtcattc

SEQ ID NO: 5103833 - DNA, 15 bp, Homo sapiens
aagctggcaggagac

SEQ ID NO: 5103834 - DNA, 15 bp, Homo sapiens
aagctggccaaagtc

SEQ ID NO: 5103835 - DNA, 19 bp, Homo sapiens
aagctggccaaagtcactt

SEQ ID NO: 5103836 - DNA, 22 bp, Homo sapiens
aagctggccctcagctccctga

SEQ ID NO: 5103837 - DNA, 19 bp, Homo sapiens
aagctggccctgcctcctg

SEQ ID NO: 5103838 - DNA, 21 bp, Homo sapiens
aagctggccctgcctcctggg

SEQ ID NO: 5103839 - DNA, 22 bp, Homo sapiens
aagctggccctgcctcctggga

SEQ ID NO: 5103840 - DNA, 13 bp, Homo sapiens
aagctggcctgag

SEQ ID NO: 5103841 - DNA, 21 bp, Homo sapiens
aagctggcctggaccattcct

SEQ ID NO: 5103842 - DNA, 12 bp, Homo sapiens
aagctggctctg

SEQ ID NO: 5103843 - DNA, 20 bp, Homo sapiens
aagctggctgggctggctga

SEQ ID NO: 5103844 - DNA, 23 bp, Homo sapiens
aagctggctggggtggcctgtgt

SEQ ID NO: 5103845 - DNA, 22 bp, Homo sapiens
aagctgggaaaaaagttttgat

SEQ ID NO: 5103846 - DNA, 15 bp, Homo sapiens
aagctgggagggagg

SEQ ID NO: 5103847 - DNA, 15 bp, Homo sapiens
aagctgggcaggttg

SEQ ID NO: 5103848 - DNA, 12 bp, Homo sapiens
aagctgggccca

SEQ ID NO: 5103849 - DNA, 18 bp, Homo sapiens
aagctgggccccagccca

SEQ ID NO: 5103850 - DNA, 16 bp, Homo sapiens
aagctgggctgtctct

SEQ ID NO: 5103851 - DNA, 13 bp, Homo sapiens
aagctggggagga

SEQ ID NO: 5103852 - DNA, 13 bp, Homo sapiens
aagctggggcttg

SEQ ID NO: 5103853 - DNA, 16 bp, Homo sapiens
aagctggtaaaaatga

SEQ ID NO: 5103854 - DNA, 17 bp, Homo sapiens
aagctggtggccttggc

SEQ ID NO: 5103855 - DNA, 17 bp, Homo sapiens
aagctggtgggtgaaag

SEQ ID NO: 5103856 - DNA, 23 bp, Homo sapiens
aagctggtgggtgaaagaaatca

SEQ ID NO: 5103857 - DNA, 19 bp, Homo sapiens
aagctgtacgcgtttgtct

SEQ ID NO: 5103858 - DNA, 14 bp, Homo sapiens
aagctgtactttta

SEQ ID NO: 5103859 - DNA, 22 bp, Homo sapiens
aagctgtagtagccctttctgt

SEQ ID NO: 5103860 - DNA, 23 bp, Homo sapiens
aagctgtagtagccctttctgtg

SEQ ID NO: 5103861 - DNA, 17 bp, Homo sapiens
aagctgtataaacagaa

SEQ ID NO: 5103862 - DNA, 17 bp, Homo sapiens
aagctgtatcactgcct

SEQ ID NO: 5103863 - DNA, 16 bp, Homo sapiens
aagctgtcaggctggg

SEQ ID NO: 5103864 - DNA, 16 bp, Homo sapiens
aagctgtgaaatgtgc

SEQ ID NO: 5103865 - DNA, 13 bp, Homo sapiens
aagctgtgagaca

SEQ ID NO: 5103866 - DNA, 13 bp, Homo sapiens
aagctgtgagcaa

SEQ ID NO: 5103867 - DNA, 13 bp, Homo sapiens
aagctgtgcaggc

SEQ ID NO: 5103868 - DNA, 20 bp, Homo sapiens
aagctgtgccaccctgggct

SEQ ID NO: 5103869 - DNA, 21 bp, Homo sapiens
aagctgtgccaccctgggctc

SEQ ID NO: 5103870 - DNA, 21 bp, Homo sapiens
aagctgtgctgggaagcccgg

SEQ ID NO: 5103871 - DNA, 14 bp, Homo sapiens
aagctgtggaatga

SEQ ID NO: 5103872 - DNA, 17 bp, Homo sapiens
aagctgtggcagccgtc

SEQ ID NO: 5103873 - DNA, 20 bp, Homo sapiens
aagctgtgtccttgcacctg

SEQ ID NO: 5103874 - DNA, 19 bp, Homo sapiens
aagctgtgtctttagacaa

SEQ ID NO: 5103875 - DNA, 11 bp, Homo sapiens
aagctgtgtgc

SEQ ID NO: 5103876 - DNA, 14 bp, Homo sapiens
aagctgtgtgcagg

SEQ ID NO: 5103877 - DNA, 15 bp, Homo sapiens
aagctgtgttgaaac

SEQ ID NO: 5103878 - DNA, 23 bp, Homo sapiens
aagctgtgttgaaacagaaaaat

SEQ ID NO: 5103879 - DNA, 16 bp, Homo sapiens
aagctgttaaaataca

SEQ ID NO: 5103880 - DNA, 14 bp, Homo sapiens
aagctgttaaactg

SEQ ID NO: 5103881 - DNA, 22 bp, Homo sapiens
aagctgttagttaaaatcccaa

SEQ ID NO: 5103882 - DNA, 18 bp, Homo sapiens
aagctgttattcttgtta

SEQ ID NO: 5103883 - DNA, 18 bp, Homo sapiens
aagctgttctcattcctg

SEQ ID NO: 5103884 - DNA, 20 bp, Homo sapiens
aagctgttctctgcttttcc

SEQ ID NO: 5103885 - DNA, 15 bp, Homo sapiens
aagctgttcttcctg

SEQ ID NO: 5103886 - DNA, 13 bp, Homo sapiens
aagctgttcttga

SEQ ID NO: 5103887 - DNA, 19 bp, Homo sapiens
aagctgttggcctctgcaa

SEQ ID NO: 5103888 - DNA, 20 bp, Homo sapiens
aagctgttgtacatttatga

SEQ ID NO: 5103889 - DNA, 21 bp, Homo sapiens
aagctgttgtacatttatgat

SEQ ID NO: 5103890 - DNA, 19 bp, Homo sapiens
aagctgtttatttattcac

SEQ ID NO: 5103891 - DNA, 23 bp, Homo sapiens
aagctgtttccatagggtgacac

SEQ ID NO: 5103892 - DNA, 14 bp, Homo sapiens
aagctgtttggaaa

SEQ ID NO: 5103893 - DNA, 20 bp, Homo sapiens
aagcttaaaaaagaaagatt

SEQ ID NO: 5103894 - DNA, 13 bp, Homo sapiens
aagcttaaaactt

SEQ ID NO: 5103895 - DNA, 15 bp, Homo sapiens
aagcttaaactgaat

SEQ ID NO: 5103896 - DNA, 14 bp, Homo sapiens
aagcttaaatagga

SEQ ID NO: 5103897 - DNA, 14 bp, Homo sapiens
aagcttaataaatt

SEQ ID NO: 5103898 - DNA, 15 bp, Homo sapiens
aagcttaataaattc

SEQ ID NO: 5103899 - DNA, 18 bp, Homo sapiens
aagcttaatagccctccc

SEQ ID NO: 5103900 - DNA, 19 bp, Homo sapiens
aagcttaatggctgataat

SEQ ID NO: 5103901 - DNA, 21 bp, Homo sapiens
aagcttacatagttttcttcc

SEQ ID NO: 5103902 - DNA, 23 bp, Homo sapiens
aagcttacccttggtttgcacat

SEQ ID NO: 5103903 - DNA, 15 bp, Homo sapiens
aagcttactacagtg

SEQ ID NO: 5103904 - DNA, 15 bp, Homo sapiens
aagcttactctctgc

SEQ ID NO: 5103905 - DNA, 22 bp, Homo sapiens
aagcttacttccattgcaaaat

SEQ ID NO: 5103906 - DNA, 10 bp, Homo sapiens
aagcttagaa

SEQ ID NO: 5103907 - DNA, 18 bp, Homo sapiens
aagcttagattttctgta

SEQ ID NO: 5103908 - DNA, 15 bp, Homo sapiens
aagcttagcaggaga

SEQ ID NO: 5103909 - DNA, 22 bp, Homo sapiens
aagcttagcaggagaggagagc

SEQ ID NO: 5103910 - DNA, 16 bp, Homo sapiens
aagcttagtcctggga

SEQ ID NO: 5103911 - DNA, 13 bp, Homo sapiens
aagcttatgtttc

SEQ ID NO: 5103912 - DNA, 16 bp, Homo sapiens
aagcttattttggaga

SEQ ID NO: 5103913 - DNA, 17 bp, Homo sapiens
aagcttatttttatgtg

SEQ ID NO: 5103914 - DNA, 22 bp, Homo sapiens
aagcttcaaagccatatggaca

SEQ ID NO: 5103915 - DNA, 17 bp, Homo sapiens
aagcttcaaattataga

SEQ ID NO: 5103916 - DNA, 18 bp, Homo sapiens
aagcttcaagtgatatat

SEQ ID NO: 5103917 - DNA, 14 bp, Homo sapiens
aagcttcagagcct

SEQ ID NO: 5103918 - DNA, 15 bp, Homo sapiens
aagcttcagagccta

SEQ ID NO: 5103919 - DNA, 19 bp, Homo sapiens
aagcttcatatatgctttg

SEQ ID NO: 5103920 - DNA, 15 bp, Homo sapiens
aagcttccacaaaat

SEQ ID NO: 5103921 - DNA, 18 bp, Homo sapiens
aagcttccatagctgctg

SEQ ID NO: 5103922 - DNA, 19 bp, Homo sapiens
aagcttccatgatgcacag

SEQ ID NO: 5103923 - DNA, 15 bp, Homo sapiens
aagcttccatgattc

SEQ ID NO: 5103924 - DNA, 16 bp, Homo sapiens
aagcttccattccaca

SEQ ID NO: 5103925 - DNA, 11 bp, Homo sapiens
aagcttccctc

SEQ ID NO: 5103926 - DNA, 11 bp, Homo sapiens
aagcttcctgt

SEQ ID NO: 5103927 - DNA, 12 bp, Homo sapiens
aagcttcctgtg

SEQ ID NO: 5103928 - DNA, 21 bp, Homo sapiens
aagcttcctgtgccctcaccc

SEQ ID NO: 5103929 - DNA, 23 bp, Homo sapiens
aagcttcctttgtttttttttcc

SEQ ID NO: 5103930 - DNA, 22 bp, Homo sapiens
aagcttcgaggcccagcgacct

SEQ ID NO: 5103931 - DNA, 15 bp, Homo sapiens
aagcttctaaatggt

SEQ ID NO: 5103932 - DNA, 11 bp, Homo sapiens
aagcttctaat

SEQ ID NO: 5103933 - DNA, 16 bp, Homo sapiens
aagcttctaataaatt

SEQ ID NO: 5103934 - DNA, 18 bp, Homo sapiens
aagcttctaataaattat

SEQ ID NO: 5103935 - DNA, 13 bp, Homo sapiens
aagcttctaatta

SEQ ID NO: 5103936 - DNA, 18 bp, Homo sapiens
aagcttctagacactcct

SEQ ID NO: 5103937 - DNA, 15 bp, Homo sapiens
aagcttctataaaat

SEQ ID NO: 5103938 - DNA, 16 bp, Homo sapiens
aagcttctctctgagc

SEQ ID NO: 5103939 - DNA, 17 bp, Homo sapiens
aagcttctctctgagct

SEQ ID NO: 5103940 - DNA, 17 bp, Homo sapiens
aagcttctctgttctgg

SEQ ID NO: 5103941 - DNA, 14 bp, Homo sapiens
aagcttctgagtct

SEQ ID NO: 5103942 - DNA, 22 bp, Homo sapiens
aagcttcttaaatgagaaggaa

SEQ ID NO: 5103943 - DNA, 12 bp, Homo sapiens
aagcttgactcc

SEQ ID NO: 5103944 - DNA, 15 bp, Homo sapiens
aagcttgactcccaa

SEQ ID NO: 5103945 - DNA, 23 bp, Homo sapiens
aagcttgagtctcaagggtggca

SEQ ID NO: 5103946 - DNA, 17 bp, Homo sapiens
aagcttgcaccttttca

SEQ ID NO: 5103947 - DNA, 13 bp, Homo sapiens
aagcttggaggag

SEQ ID NO: 5103948 - DNA, 20 bp, Homo sapiens
aagcttggcttcctcttctt

SEQ ID NO: 5103949 - DNA, 19 bp, Homo sapiens
aagcttggtcaaacttttt

SEQ ID NO: 5103950 - DNA, 21 bp, Homo sapiens
aagcttggtcaaactttttcc

SEQ ID NO: 5103951 - DNA, 19 bp, Homo sapiens
aagcttggtgacaaaattc

SEQ ID NO: 5103952 - DNA, 20 bp, Homo sapiens
aagcttggtgacaaaattca

SEQ ID NO: 5103953 - DNA, 17 bp, Homo sapiens
aagcttggttctgtgaa

SEQ ID NO: 5103954 - DNA, 21 bp, Homo sapiens
aagcttggttctgtgaacaag

SEQ ID NO: 5103955 - DNA, 20 bp, Homo sapiens
aagcttgtaaatatggggat

SEQ ID NO: 5103956 - DNA, 14 bp, Homo sapiens
aagcttgtatatac

SEQ ID NO: 5103957 - DNA, 15 bp, Homo sapiens
aagcttgtatataca

SEQ ID NO: 5103958 - DNA, 16 bp, Homo sapiens
aagcttgtatatacat

SEQ ID NO: 5103959 - DNA, 18 bp, Homo sapiens
aagcttgtatatacatat

SEQ ID NO: 5103960 - DNA, 22 bp, Homo sapiens
aagcttgtatatacatattata

SEQ ID NO: 5103961 - DNA, 17 bp, Homo sapiens
aagcttgtcaaagatgc

SEQ ID NO: 5103962 - DNA, 19 bp, Homo sapiens
aagcttgtggccaatggaa

SEQ ID NO: 5103963 - DNA, 23 bp, Homo sapiens
aagcttgtggccccttttacttt

SEQ ID NO: 5103964 - DNA, 18 bp, Homo sapiens
aagcttgtgtatcttgat

SEQ ID NO: 5103965 - DNA, 15 bp, Homo sapiens
aagcttgtgtgggcc

SEQ ID NO: 5103966 - DNA, 21 bp, Homo sapiens
aagcttgtttccctgctggcc

SEQ ID NO: 5103967 - DNA, 22 bp, Homo sapiens
aagcttgtttccctgctggcca

SEQ ID NO: 5103968 - DNA, 16 bp, Homo sapiens
aagctttaaaaaataa

SEQ ID NO: 5103969 - DNA, 13 bp, Homo sapiens
aagctttaaatta

SEQ ID NO: 5103970 - DNA, 14 bp, Homo sapiens
aagctttaaattat

SEQ ID NO: 5103971 - DNA, 17 bp, Homo sapiens
aagctttaaattatgtg

SEQ ID NO: 5103972 - DNA, 22 bp, Homo sapiens
aagctttatacgtgtagctata

SEQ ID NO: 5103973 - DNA, 12 bp, Homo sapiens
aagctttatgat

SEQ ID NO: 5103974 - DNA, 21 bp, Homo sapiens
aagctttatttatagaaatga

SEQ ID NO: 5103975 - DNA, 21 bp, Homo sapiens
aagctttatttatttctttgt

SEQ ID NO: 5103976 - DNA, 17 bp, Homo sapiens
aagctttatttgcatat

SEQ ID NO: 5103977 - DNA, 13 bp, Homo sapiens
aagctttcaacat

SEQ ID NO: 5103978 - DNA, 21 bp, Homo sapiens
aagctttcagtattagtgatg

SEQ ID NO: 5103979 - DNA, 21 bp, Homo sapiens
aagctttcatgtcccagaact

SEQ ID NO: 5103980 - DNA, 17 bp, Homo sapiens
aaggctgactcttacta

SEQ ID NO: 5103981 - DNA, 23 bp, Homo sapiens
aaggctgagacagtgaatttggg

SEQ ID NO: 5103982 - DNA, 17 bp, Homo sapiens
aaggctgagagctctct

SEQ ID NO: 5103983 - DNA, 19 bp, Homo sapiens
aaggctgagaggagagaga

SEQ ID NO: 5103984 - DNA, 19 bp, Homo sapiens
aaggctgaggaaaggccag

SEQ ID NO: 5103985 - DNA, 20 bp, Homo sapiens
aaggctgaggcaggagaatc

SEQ ID NO: 5103986 - DNA, 23 bp, Homo sapiens
aaggctgaggctgccctgaccct

SEQ ID NO: 5103987 - DNA, 20 bp, Homo sapiens
aaggctgataatatgacaaa

SEQ ID NO: 5103988 - DNA, 17 bp, Homo sapiens
aaggctgccagacatgg

SEQ ID NO: 5103989 - DNA, 19 bp, Homo sapiens
aaggctgcccctgtaaggt

SEQ ID NO: 5103990 - DNA, 13 bp, Homo sapiens
aaggctgccgagg

SEQ ID NO: 5103991 - DNA, 13 bp, Homo sapiens
aaggctgcctgct

SEQ ID NO: 5103992 - DNA, 21 bp, Homo sapiens
aaggctgcctgctatgtattt

SEQ ID NO: 5103993 - DNA, 14 bp, Homo sapiens
aaggctgcgtctgg

SEQ ID NO: 5103994 - DNA, 16 bp, Homo sapiens
aaggctgcgtctggag

SEQ ID NO: 5103995 - DNA, 23 bp, Homo sapiens
aaggctgctaagtggaagacaga

SEQ ID NO: 5103996 - DNA, 23 bp, Homo sapiens
aaggctgctcacaagttctattt

SEQ ID NO: 5103997 - DNA, 14 bp, Homo sapiens
aaggctgctcagag

SEQ ID NO: 5103998 - DNA, 21 bp, Homo sapiens
aaggctgctgcaagtcattga

SEQ ID NO: 5103999 - DNA, 14 bp, Homo sapiens
aaggctgctggctt

SEQ ID NO: 5104000 - DNA, 17 bp, Homo sapiens
aaggctggatgggaaag

SEQ ID NO: 5104001 - DNA, 22 bp, Homo sapiens
aaggctggcgagagtctggccc

SEQ ID NO: 5104002 - DNA, 20 bp, Homo sapiens
aaggctggctgaaaatcact

SEQ ID NO: 5104003 - DNA, 14 bp, Homo sapiens
aaggctggctgtgt

SEQ ID NO: 5104004 - DNA, 14 bp, Homo sapiens
aaggctggggcatg

SEQ ID NO: 5104005 - DNA, 14 bp, Homo sapiens
aaggctgggggaag

SEQ ID NO: 5104006 - DNA, 16 bp, Homo sapiens
aaggctgggggaagaa

SEQ ID NO: 5104007 - DNA, 22 bp, Homo sapiens
aaggctggtacaacggaggcct

SEQ ID NO: 5104008 - DNA, 17 bp, Homo sapiens
aaggctggtcccacact

SEQ ID NO: 5104009 - DNA, 20 bp, Homo sapiens
aaggctggtctcccccagcc

SEQ ID NO: 5104010 - DNA, 21 bp, Homo sapiens
aaggctggtggacagacccag

SEQ ID NO: 5104011 - DNA, 17 bp, Homo sapiens
aaggctgtatctatttt

SEQ ID NO: 5104012 - DNA, 18 bp, Homo sapiens
aaggctgtctcagataaa

SEQ ID NO: 5104013 - DNA, 23 bp, Homo sapiens
aaggctgtgaccttacagccatt

SEQ ID NO: 5104014 - DNA, 13 bp, Homo sapiens
aaggctgtgccag

SEQ ID NO: 5104015 - DNA, 14 bp, Homo sapiens
aaggctgtgccagg

SEQ ID NO: 5104016 - DNA, 16 bp, Homo sapiens
aaggctgtgccaggct

SEQ ID NO: 5104017 - DNA, 18 bp, Homo sapiens
aaggctgtgccaggctgg

SEQ ID NO: 5104018 - DNA, 20 bp, Homo sapiens
aaggctgtgccaggctggga

SEQ ID NO: 5104019 - DNA, 22 bp, Homo sapiens
aaggctgtgctccctggttctg

SEQ ID NO: 5104020 - DNA, 21 bp, Homo sapiens
aaggctgtgctgccctgaaga

SEQ ID NO: 5104021 - DNA, 23 bp, Homo sapiens
aaggctgttgcatgggctaatga

SEQ ID NO: 5104022 - DNA, 13 bp, Homo sapiens
aaggctgtttgct

SEQ ID NO: 5104023 - DNA, 16 bp, Homo sapiens
aaggcttaagaactgc

SEQ ID NO: 5104024 - DNA, 15 bp, Homo sapiens
aaggcttaattgact

SEQ ID NO: 5104025 - DNA, 18 bp, Homo sapiens
aaggcttaattgactgaa

SEQ ID NO: 5104026 - DNA, 20 bp, Homo sapiens
aaggcttaattgactgaaat

SEQ ID NO: 5104027 - DNA, 14 bp, Homo sapiens
aaggcttaggactt

SEQ ID NO: 5104028 - DNA, 16 bp, Homo sapiens
aaggcttataaaacag

SEQ ID NO: 5104029 - DNA, 21 bp, Homo sapiens
aaggcttatattcaaccatgg

SEQ ID NO: 5104030 - DNA, 23 bp, Homo sapiens
aaggcttatattcaaccatggac

SEQ ID NO: 5104031 - DNA, 13 bp, Homo sapiens
aaggcttatctct

SEQ ID NO: 5104032 - DNA, 12 bp, Homo sapiens
aaggcttccagg

SEQ ID NO: 5104033 - DNA, 19 bp, Homo sapiens
aaggcttccaggctgagag

SEQ ID NO: 5104034 - DNA, 14 bp, Homo sapiens
aaggcttccggctg

SEQ ID NO: 5104035 - DNA, 15 bp, Homo sapiens
aaggcttctctctca

SEQ ID NO: 5104036 - DNA, 16 bp, Homo sapiens
aaggcttctctctcac

SEQ ID NO: 5104037 - DNA, 17 bp, Homo sapiens
aaggcttctctctcacc

SEQ ID NO: 5104038 - DNA, 17 bp, Homo sapiens
aaggcttctctctgtgg

SEQ ID NO: 5104039 - DNA, 14 bp, Homo sapiens
aaggcttgaagctg

SEQ ID NO: 5104040 - DNA, 12 bp, Homo sapiens
aaggcttgcagt

SEQ ID NO: 5104041 - DNA, 22 bp, Homo sapiens
aaggcttgccgcacatgaaaca

SEQ ID NO: 5104042 - DNA, 20 bp, Homo sapiens
aaggcttgttgtgcttttag

SEQ ID NO: 5104043 - DNA, 15 bp, Homo sapiens
aaggctttatctcag

SEQ ID NO: 5104044 - DNA, 23 bp, Homo sapiens
aaggctttgattagttttcttgt

SEQ ID NO: 5104045 - DNA, 16 bp, Homo sapiens
aaggctttgccatggg

SEQ ID NO: 5104046 - DNA, 11 bp, Homo sapiens
aaggctttgtg

SEQ ID NO: 5104047 - DNA, 17 bp, Homo sapiens
aagggaaaaaaaatgta

SEQ ID NO: 5104048 - DNA, 14 bp, Homo sapiens
aagggaaaaaagag

SEQ ID NO: 5104049 - DNA, 12 bp, Homo sapiens
aagggaaaaaga

SEQ ID NO: 5104050 - DNA, 13 bp, Homo sapiens
aagggaaaaagac

SEQ ID NO: 5104051 - DNA, 14 bp, Homo sapiens
aagggaaaaagttg

SEQ ID NO: 5104052 - DNA, 12 bp, Homo sapiens
aagggaaaaata

SEQ ID NO: 5104053 - DNA, 18 bp, Homo sapiens
aagggaaaaatcaagttt

SEQ ID NO: 5104054 - DNA, 16 bp, Homo sapiens
aagggaaactgccagc

SEQ ID NO: 5104055 - DNA, 15 bp, Homo sapiens
aagggaaactggctg

SEQ ID NO: 5104056 - DNA, 16 bp, Homo sapiens
aagggaaactggctga

SEQ ID NO: 5104057 - DNA, 14 bp, Homo sapiens
aagggaaagcctct

SEQ ID NO: 5104058 - DNA, 17 bp, Homo sapiens
aagggaaagcctctggc

SEQ ID NO: 5104059 - DNA, 17 bp, Homo sapiens
aagggaaagcgggcagc

SEQ ID NO: 5104060 - DNA, 19 bp, Homo sapiens
aagggaaagcgggcagccc

SEQ ID NO: 5104061 - DNA, 17 bp, Homo sapiens
aagggaaaggaaaagaa

SEQ ID NO: 5104062 - DNA, 18 bp, Homo sapiens
aagggaaaggcaagcttg

SEQ ID NO: 5104063 - DNA, 17 bp, Homo sapiens
aagggaaagggctcttt

SEQ ID NO: 5104064 - DNA, 16 bp, Homo sapiens
aagggaaatatcattt

SEQ ID NO: 5104065 - DNA, 14 bp, Homo sapiens
aagggaacagaaag

SEQ ID NO: 5104066 - DNA, 15 bp, Homo sapiens
aagggaacctgtgtc

SEQ ID NO: 5104067 - DNA, 16 bp, Homo sapiens
aagggaactagataac

SEQ ID NO: 5104068 - DNA, 17 bp, Homo sapiens
aagggaactgaagacct

SEQ ID NO: 5104069 - DNA, 14 bp, Homo sapiens
aagggaagaaactg

SEQ ID NO: 5104070 - DNA, 17 bp, Homo sapiens
aagggaagaaggggcca

SEQ ID NO: 5104071 - DNA, 13 bp, Homo sapiens
aagggaagacatt

SEQ ID NO: 5104072 - DNA, 15 bp, Homo sapiens
aagggaagacatttc

SEQ ID NO: 5104073 - DNA, 16 bp, Homo sapiens
aagggaagacatttct

SEQ ID NO: 5104074 - DNA, 15 bp, Homo sapiens
aagggaagagccttt

SEQ ID NO: 5104075 - DNA, 16 bp, Homo sapiens
aagggaagatttatgt

SEQ ID NO: 5104076 - DNA, 18 bp, Homo sapiens
aagggaagcagagcctgg

SEQ ID NO: 5104077 - DNA, 16 bp, Homo sapiens
aagggaagcccagcct

SEQ ID NO: 5104078 - DNA, 13 bp, Homo sapiens
aagggaagccctg

SEQ ID NO: 5104079 - DNA, 13 bp, Homo sapiens
aagggaagcctga

SEQ ID NO: 5104080 - DNA, 17 bp, Homo sapiens
aagggaagcctgactgc

SEQ ID NO: 5104081 - DNA, 22 bp, Homo sapiens
aagggaaggcaaaggcagagga

SEQ ID NO: 5104082 - DNA, 15 bp, Homo sapiens
aagggaaggctgctg

SEQ ID NO: 5104083 - DNA, 22 bp, Homo sapiens
aagggaaggggcctccctccga

SEQ ID NO: 5104084 - DNA, 17 bp, Homo sapiens
aagggaagtaagcaaac

SEQ ID NO: 5104085 - DNA, 17 bp, Homo sapiens
aagggaagtgaccaagg

SEQ ID NO: 5104086 - DNA, 20 bp, Homo sapiens
aagggaagtgaggcccaagg

SEQ ID NO: 5104087 - DNA, 12 bp, Homo sapiens
aagggaagtggg

SEQ ID NO: 5104088 - DNA, 15 bp, Homo sapiens
aagggaagtggggag

SEQ ID NO: 5104089 - DNA, 21 bp, Homo sapiens
aagggaagttcaggctctgag

SEQ ID NO: 5104090 - DNA, 20 bp, Homo sapiens
aagggaatcacatcttttaa

SEQ ID NO: 5104091 - DNA, 19 bp, Homo sapiens
aagggaatttaatactttt

SEQ ID NO: 5104092 - DNA, 21 bp, Homo sapiens
aagggacacccctacacacac

SEQ ID NO: 5104093 - DNA, 18 bp, Homo sapiens
aagggacaggaaggtctg

SEQ ID NO: 5104094 - DNA, 14 bp, Homo sapiens
aagggacagtttgt

SEQ ID NO: 5104095 - DNA, 15 bp, Homo sapiens
aagggacattgaagt

SEQ ID NO: 5104096 - DNA, 22 bp, Homo sapiens
aagggaccaagcgaccaaggat

SEQ ID NO: 5104097 - DNA, 21 bp, Homo sapiens
aagggaccagggagatgccac

SEQ ID NO: 5104098 - DNA, 17 bp, Homo sapiens
aagggaccatctgctgc

SEQ ID NO: 5104099 - DNA, 13 bp, Homo sapiens
aagggacccacct

SEQ ID NO: 5104100 - DNA, 17 bp, Homo sapiens
aagggacccacctgcta

SEQ ID NO: 5104101 - DNA, 13 bp, Homo sapiens
aagggaccccccc

SEQ ID NO: 5104102 - DNA, 18 bp, Homo sapiens
aagggacccgaagcccag

SEQ ID NO: 5104103 - DNA, 18 bp, Homo sapiens
aagggacgctacccggga

SEQ ID NO: 5104104 - DNA, 20 bp, Homo sapiens
aagggacggctgtgggacca

SEQ ID NO: 5104105 - DNA, 22 bp, Homo sapiens
aagggacggggcccgccccagg

SEQ ID NO: 5104106 - DNA, 15 bp, Homo sapiens
aagggacgggggtgg

SEQ ID NO: 5104107 - DNA, 18 bp, Homo sapiens
aagggactacctctgtgc

SEQ ID NO: 5104108 - DNA, 22 bp, Homo sapiens
aagggactgaagtatacattta

SEQ ID NO: 5104109 - DNA, 17 bp, Homo sapiens
aagggactgatgtttgt

SEQ ID NO: 5104110 - DNA, 20 bp, Homo sapiens
aagggactggtccaggcatg

SEQ ID NO: 5104111 - DNA, 20 bp, Homo sapiens
aagggacttggaagctccgc

SEQ ID NO: 5104112 - DNA, 19 bp, Homo sapiens
aagggagaagaaatccata

SEQ ID NO: 5104113 - DNA, 20 bp, Homo sapiens
aagggagaataaaattccta

SEQ ID NO: 5104114 - DNA, 19 bp, Homo sapiens
aagggagaatggtgctgtt

SEQ ID NO: 5104115 - DNA, 23 bp, Homo sapiens
aagggagacattgtttggatttc

SEQ ID NO: 5104116 - DNA, 15 bp, Homo sapiens
aagggagactgacca

SEQ ID NO: 5104117 - DNA, 16 bp, Homo sapiens
aagggagagagagagg

SEQ ID NO: 5104118 - DNA, 17 bp, Homo sapiens
aagggagagctgagcca

SEQ ID NO: 5104119 - DNA, 16 bp, Homo sapiens
aagggagaggaagaga

SEQ ID NO: 5104120 - DNA, 13 bp, Homo sapiens
aagggagaggagg

SEQ ID NO: 5104121 - DNA, 17 bp, Homo sapiens
aagggagagggagggag

SEQ ID NO: 5104122 - DNA, 23 bp, Homo sapiens
aagggagagggcctctgcctggg

SEQ ID NO: 5104123 - DNA, 16 bp, Homo sapiens
aagggagcagagaagg

SEQ ID NO: 5104124 - DNA, 9 bp, Homo sapiens
aagggagcc

SEQ ID NO: 5104125 - DNA, 11 bp, Homo sapiens
aagggagccaa

SEQ ID NO: 5104126 - DNA, 12 bp, Homo sapiens
aagggagccaag

SEQ ID NO: 5104127 - DNA, 21 bp, Homo sapiens
aagggagccaagggatggaca

SEQ ID NO: 5104128 - DNA, 14 bp, Homo sapiens
aagggagcccctcc

SEQ ID NO: 5104129 - DNA, 23 bp, Homo sapiens
aagggagcccctcctctgagcag

SEQ ID NO: 5104130 - DNA, 17 bp, Homo sapiens
aagggagcgaggtcaga

SEQ ID NO: 5104131 - DNA, 20 bp, Homo sapiens
aagggagcgaggtcagagga

SEQ ID NO: 5104132 - DNA, 16 bp, Homo sapiens
aagggaggaaggcctt

SEQ ID NO: 5104133 - DNA, 21 bp, Homo sapiens
aagggaggaaggcctttcttc

SEQ ID NO: 5104134 - DNA, 22 bp, Homo sapiens
aagggaggacgggagctgggga

SEQ ID NO: 5104135 - DNA, 11 bp, Homo sapiens
aagggaggagg

SEQ ID NO: 5104136 - DNA, 16 bp, Homo sapiens
aagggaggcccagcgc

SEQ ID NO: 5104137 - DNA, 16 bp, Homo sapiens
aagggaggctgctgct

SEQ ID NO: 5104138 - DNA, 14 bp, Homo sapiens
aagggagggaaggg

SEQ ID NO: 5104139 - DNA, 17 bp, Homo sapiens
aagggagggaagggcca

SEQ ID NO: 5104140 - DNA, 19 bp, Homo sapiens
aagggagggagcaagccct

SEQ ID NO: 5104141 - DNA, 15 bp, Homo sapiens
aagggagggagctga

SEQ ID NO: 5104142 - DNA, 18 bp, Homo sapiens
aagggagggagctgaggc

SEQ ID NO: 5104143 - DNA, 13 bp, Homo sapiens
aagggagggctct

SEQ ID NO: 5104144 - DNA, 16 bp, Homo sapiens
aagggagggctctgag

SEQ ID NO: 5104145 - DNA, 19 bp, Homo sapiens
aagggagggctctgaggcg

SEQ ID NO: 5104146 - DNA, 15 bp, Homo sapiens
aagggagggggctgg

SEQ ID NO: 5104147 - DNA, 16 bp, Homo sapiens
aagggaggggtcctga

SEQ ID NO: 5104148 - DNA, 17 bp, Homo sapiens
aagggaggtgggccgtg

SEQ ID NO: 5104149 - DNA, 16 bp, Homo sapiens
aagggagtctgccagg

SEQ ID NO: 5104150 - DNA, 15 bp, Homo sapiens
aagggagtttttgat

SEQ ID NO: 5104151 - DNA, 19 bp, Homo sapiens
aagggatatataagatgga

SEQ ID NO: 5104152 - DNA, 15 bp, Homo sapiens
aagggatatgtgaaa

SEQ ID NO: 5104153 - DNA, 12 bp, Homo sapiens
aagggatatttt

SEQ ID NO: 5104154 - DNA, 17 bp, Homo sapiens
aagggatccagagacct

SEQ ID NO: 5104155 - DNA, 21 bp, Homo sapiens
aagggatccagagacctgctc

SEQ ID NO: 5104156 - DNA, 13 bp, Homo sapiens
aagggatcctgcc

SEQ ID NO: 5104157 - DNA, 17 bp, Homo sapiens
aagggatgaattgtaaa

SEQ ID NO: 5104158 - DNA, 16 bp, Homo sapiens
aagggatgcaggctcc

SEQ ID NO: 5104159 - DNA, 15 bp, Homo sapiens
aagggatggaaaagg

SEQ ID NO: 5104160 - DNA, 16 bp, Homo sapiens
aagctttcctgcccca

SEQ ID NO: 5104161 - DNA, 14 bp, Homo sapiens
aagctttcctgctg

SEQ ID NO: 5104162 - DNA, 17 bp, Homo sapiens
aagctttcctgttgaat

SEQ ID NO: 5104163 - DNA, 16 bp, Homo sapiens
aagctttcctgtttcc

SEQ ID NO: 5104164 - DNA, 14 bp, Homo sapiens
aagctttctccttt

SEQ ID NO: 5104165 - DNA, 16 bp, Homo sapiens
aagctttctctcagaa

SEQ ID NO: 5104166 - DNA, 17 bp, Homo sapiens
aagctttctctgcttca

SEQ ID NO: 5104167 - DNA, 19 bp, Homo sapiens
aagctttctctgcttcagc

SEQ ID NO: 5104168 - DNA, 23 bp, Homo sapiens
aagctttctctgcttcagcttgc

SEQ ID NO: 5104169 - DNA, 20 bp, Homo sapiens
aagctttgaatactgtgaaa

SEQ ID NO: 5104170 - DNA, 20 bp, Homo sapiens
aagctttgactctataagca

SEQ ID NO: 5104171 - DNA, 21 bp, Homo sapiens
aagctttgaggctctgtcact

SEQ ID NO: 5104172 - DNA, 16 bp, Homo sapiens
aagctttgagttgact

SEQ ID NO: 5104173 - DNA, 21 bp, Homo sapiens
aagctttgctacaaatttatg

SEQ ID NO: 5104174 - DNA, 14 bp, Homo sapiens
aagctttggaagca

SEQ ID NO: 5104175 - DNA, 19 bp, Homo sapiens
aagctttggtgagaacctg

SEQ ID NO: 5104176 - DNA, 22 bp, Homo sapiens
aagctttggtgagaacctgggt

SEQ ID NO: 5104177 - DNA, 18 bp, Homo sapiens
aagctttggttctctgat

SEQ ID NO: 5104178 - DNA, 20 bp, Homo sapiens
aagctttggtttatggtttt

SEQ ID NO: 5104179 - DNA, 20 bp, Homo sapiens
aagctttgtccttttgctct

SEQ ID NO: 5104180 - DNA, 12 bp, Homo sapiens
aagctttgtgaa

SEQ ID NO: 5104181 - DNA, 17 bp, Homo sapiens
aagctttgttctgggag

SEQ ID NO: 5104182 - DNA, 18 bp, Homo sapiens
aagcttttaagaaaaaca

SEQ ID NO: 5104183 - DNA, 20 bp, Homo sapiens
aagcttttaagaaaaacaaa

SEQ ID NO: 5104184 - DNA, 13 bp, Homo sapiens
aagcttttagaaa

SEQ ID NO: 5104185 - DNA, 13 bp, Homo sapiens
aagcttttatgag

SEQ ID NO: 5104186 - DNA, 19 bp, Homo sapiens
aagcttttatgtgaaacat

SEQ ID NO: 5104187 - DNA, 14 bp, Homo sapiens
aagcttttattcct

SEQ ID NO: 5104188 - DNA, 23 bp, Homo sapiens
aagcttttatttaacagtgcaaa

SEQ ID NO: 5104189 - DNA, 17 bp, Homo sapiens
aagcttttcacaaacat

SEQ ID NO: 5104190 - DNA, 21 bp, Homo sapiens
aagcttttcattttaatatat

SEQ ID NO: 5104191 - DNA, 17 bp, Homo sapiens
aagcttttcctttcttt

SEQ ID NO: 5104192 - DNA, 14 bp, Homo sapiens
aagctttttaaaat

SEQ ID NO: 5104193 - DNA, 16 bp, Homo sapiens
aagctttttaaaattt

SEQ ID NO: 5104194 - DNA, 20 bp, Homo sapiens
aagctttttatttaggcttt

SEQ ID NO: 5104195 - DNA, 16 bp, Homo sapiens
aagctttttcctcctg

SEQ ID NO: 5104196 - DNA, 13 bp, Homo sapiens
aagctttttggaa

SEQ ID NO: 5104197 - DNA, 18 bp, Homo sapiens
aagctttttggaatcttt

SEQ ID NO: 5104198 - DNA, 16 bp, Homo sapiens
aagctttttgtttgca

SEQ ID NO: 5104199 - DNA, 21 bp, Homo sapiens
aagctttttttcttgctagta

SEQ ID NO: 5104200 - DNA, 15 bp, Homo sapiens
aaggaaaaaagaaaa

SEQ ID NO: 5104201 - DNA, 16 bp, Homo sapiens
aaggaaaaaagaaaaa

SEQ ID NO: 5104202 - DNA, 22 bp, Homo sapiens
aaggaaaaaagaaaaaaaattt

SEQ ID NO: 5104203 - DNA, 19 bp, Homo sapiens
aaggaaaaaagagaagtat

SEQ ID NO: 5104204 - DNA, 16 bp, Homo sapiens
aaggaaaaaagatttt

SEQ ID NO: 5104205 - DNA, 16 bp, Homo sapiens
aaggaaaaaataacaa

SEQ ID NO: 5104206 - DNA, 15 bp, Homo sapiens
aaggaaaaacaaact

SEQ ID NO: 5104207 - DNA, 16 bp, Homo sapiens
aaggaaaaacacaagc

SEQ ID NO: 5104208 - DNA, 13 bp, Homo sapiens
aaggaaaaacaga

SEQ ID NO: 5104209 - DNA, 14 bp, Homo sapiens
aaggaaaaacatgc

SEQ ID NO: 5104210 - DNA, 15 bp, Homo sapiens
aaggaaaaacatgct

SEQ ID NO: 5104211 - DNA, 23 bp, Homo sapiens
aaggaaaaagctccatgtgcctc

SEQ ID NO: 5104212 - DNA, 13 bp, Homo sapiens
aaggaaaaataac

SEQ ID NO: 5104213 - DNA, 15 bp, Homo sapiens
aaggaaaaataacaa

SEQ ID NO: 5104214 - DNA, 14 bp, Homo sapiens
aaggaaaaataatc

SEQ ID NO: 5104215 - DNA, 19 bp, Homo sapiens
aaggaaaaataatcaagat

SEQ ID NO: 5104216 - DNA, 15 bp, Homo sapiens
aaggaaaaatgtgta

SEQ ID NO: 5104217 - DNA, 21 bp, Homo sapiens
aaggaaaaatgtgtaattttg

SEQ ID NO: 5104218 - DNA, 23 bp, Homo sapiens
aaggaaaacaattcaagctgaga

SEQ ID NO: 5104219 - DNA, 19 bp, Homo sapiens
aaggaaaacatgctgctct

SEQ ID NO: 5104220 - DNA, 21 bp, Homo sapiens
aaggaaaactatgtattaatt

SEQ ID NO: 5104221 - DNA, 18 bp, Homo sapiens
aaggaaaactcaccattt

SEQ ID NO: 5104222 - DNA, 21 bp, Homo sapiens
aaggaaaactcaccatttcat

SEQ ID NO: 5104223 - DNA, 22 bp, Homo sapiens
aaggaaaactcaccatttcatc

SEQ ID NO: 5104224 - DNA, 17 bp, Homo sapiens
aaggaaaactgcatgga

SEQ ID NO: 5104225 - DNA, 21 bp, Homo sapiens
aaggaaaactgccataacata

SEQ ID NO: 5104226 - DNA, 18 bp, Homo sapiens
aaggaaaagatcattaaa

SEQ ID NO: 5104227 - DNA, 16 bp, Homo sapiens
aaggaaaagcaagaaa

SEQ ID NO: 5104228 - DNA, 19 bp, Homo sapiens
aaggaaaagcaagaaacag

SEQ ID NO: 5104229 - DNA, 12 bp, Homo sapiens
aaggaaaagtaa

SEQ ID NO: 5104230 - DNA, 16 bp, Homo sapiens
aaggaaaataagtgaa

SEQ ID NO: 5104231 - DNA, 19 bp, Homo sapiens
aaggaaaatactacctgtc

SEQ ID NO: 5104232 - DNA, 17 bp, Homo sapiens
aaggaaaatagtaatgt

SEQ ID NO: 5104233 - DNA, 17 bp, Homo sapiens
aaggaaaatatttcatt

SEQ ID NO: 5104234 - DNA, 15 bp, Homo sapiens
aaggaaaatctatat

SEQ ID NO: 5104235 - DNA, 14 bp, Homo sapiens
aaggaaaattgaaa

SEQ ID NO: 5104236 - DNA, 15 bp, Homo sapiens
aaggaaaattgaaag

SEQ ID NO: 5104237 - DNA, 18 bp, Homo sapiens
aaggaaaattgaaagtat

SEQ ID NO: 5104238 - DNA, 16 bp, Homo sapiens
aaggaaaattgcacta

SEQ ID NO: 5104239 - DNA, 13 bp, Homo sapiens
aaggaaacaaatg

SEQ ID NO: 5104240 - DNA, 20 bp, Homo sapiens
aaggaaacaaccatgtcatt

SEQ ID NO: 5104241 - DNA, 14 bp, Homo sapiens
aaggaaacagattt

SEQ ID NO: 5104242 - DNA, 19 bp, Homo sapiens
aaggaaacataagagcttt

SEQ ID NO: 5104243 - DNA, 15 bp, Homo sapiens
aaggaaacatagaaa

SEQ ID NO: 5104244 - DNA, 15 bp, Homo sapiens
aaggaaaccagtgca

SEQ ID NO: 5104245 - DNA, 19 bp, Homo sapiens
aaggaaaccttttcttgta

SEQ ID NO: 5104246 - DNA, 16 bp, Homo sapiens
aaggaaacgctacctc

SEQ ID NO: 5104247 - DNA, 13 bp, Homo sapiens
aaggaaactctta

SEQ ID NO: 5104248 - DNA, 16 bp, Homo sapiens
aaggaaactgctttat

SEQ ID NO: 5104249 - DNA, 20 bp, Homo sapiens
aaggaaactgggttcctgca

SEQ ID NO: 5104250 - DNA, 20 bp, Homo sapiens
aaggaaacttcagttgatct

SEQ ID NO: 5104251 - DNA, 12 bp, Homo sapiens
aaggaaactttc

SEQ ID NO: 5104252 - DNA, 13 bp, Homo sapiens
aaggaaactttcc

SEQ ID NO: 5104253 - DNA, 13 bp, Homo sapiens
aaggaaagaagga

SEQ ID NO: 5104254 - DNA, 14 bp, Homo sapiens
aaggaaagaaggag

SEQ ID NO: 5104255 - DNA, 15 bp, Homo sapiens
aaggaaagagggagg

SEQ ID NO: 5104256 - DNA, 16 bp, Homo sapiens
aaggaaagcaataaat

SEQ ID NO: 5104257 - DNA, 20 bp, Homo sapiens
aaggaaagcactaagaaaca

SEQ ID NO: 5104258 - DNA, 12 bp, Homo sapiens
aaggaaagctgt

SEQ ID NO: 5104259 - DNA, 13 bp, Homo sapiens
aaggaaaggcaga

SEQ ID NO: 5104260 - DNA, 14 bp, Homo sapiens
aaggaaaggcctga

SEQ ID NO: 5104261 - DNA, 18 bp, Homo sapiens
aaggaaaggctcatttaa

SEQ ID NO: 5104262 - DNA, 20 bp, Homo sapiens
aaggaaaggctcatttaaaa

SEQ ID NO: 5104263 - DNA, 13 bp, Homo sapiens
aaggaaagggaag

SEQ ID NO: 5104264 - DNA, 23 bp, Homo sapiens
aaggaaagttctattatctgggt

SEQ ID NO: 5104265 - DNA, 23 bp, Homo sapiens
aaggaaagttggacttgagaaag

SEQ ID NO: 5104266 - DNA, 12 bp, Homo sapiens
aaggaaataaag

SEQ ID NO: 5104267 - DNA, 22 bp, Homo sapiens
aaggaaataaagcgtcctctca

SEQ ID NO: 5104268 - DNA, 13 bp, Homo sapiens
aaggaaataacat

SEQ ID NO: 5104269 - DNA, 15 bp, Homo sapiens
aaggaaataacattg

SEQ ID NO: 5104270 - DNA, 20 bp, Homo sapiens
aaggaaatacccttctttta

SEQ ID NO: 5104271 - DNA, 21 bp, Homo sapiens
aaggaaatactttgcataaat

SEQ ID NO: 5104272 - DNA, 22 bp, Homo sapiens
aaggaaatactttgcataaatt

SEQ ID NO: 5104273 - DNA, 16 bp, Homo sapiens
aaggaaatagactttg

SEQ ID NO: 5104274 - DNA, 21 bp, Homo sapiens
aaggaaatatatttgtaaaag

SEQ ID NO: 5104275 - DNA, 14 bp, Homo sapiens
aaggaaatattttt

SEQ ID NO: 5104276 - DNA, 15 bp, Homo sapiens
aaggaaatatttttc

SEQ ID NO: 5104277 - DNA, 17 bp, Homo sapiens
aaggaaatatttttcaa

SEQ ID NO: 5104278 - DNA, 15 bp, Homo sapiens
aaggaaatccagccc

SEQ ID NO: 5104279 - DNA, 20 bp, Homo sapiens
aaggaaatctcctcttttgt

SEQ ID NO: 5104280 - DNA, 14 bp, Homo sapiens
aaggaaatgagtgg

SEQ ID NO: 5104281 - DNA, 22 bp, Homo sapiens
aaggaaatgagtggccagcgcc

SEQ ID NO: 5104282 - DNA, 18 bp, Homo sapiens
aaggaaatgcaagctctg

SEQ ID NO: 5104283 - DNA, 20 bp, Homo sapiens
aaggaaatgcaagctctgga

SEQ ID NO: 5104284 - DNA, 19 bp, Homo sapiens
aaggaaatgtgtgttgtaa

SEQ ID NO: 5104285 - DNA, 14 bp, Homo sapiens
aaggaaattaagaa

SEQ ID NO: 5104286 - DNA, 14 bp, Homo sapiens
aaggaaattctaac

SEQ ID NO: 5104287 - DNA, 20 bp, Homo sapiens
aaggaaatttgtttgtattt

SEQ ID NO: 5104288 - DNA, 19 bp, Homo sapiens
aaggaacaatgccgcctgt

SEQ ID NO: 5104289 - DNA, 18 bp, Homo sapiens
aaggaacacccggaaaga

SEQ ID NO: 5104290 - DNA, 21 bp, Homo sapiens
aaggaacacgtgggtgagcgt

SEQ ID NO: 5104291 - DNA, 14 bp, Homo sapiens
aaggaacactgaca

SEQ ID NO: 5104292 - DNA, 13 bp, Homo sapiens
aaggaaccaacaa

SEQ ID NO: 5104293 - DNA, 21 bp, Homo sapiens
aaggaacccggtcccaggccg

SEQ ID NO: 5104294 - DNA, 18 bp, Homo sapiens
aaggaaccctcaggccac

SEQ ID NO: 5104295 - DNA, 21 bp, Homo sapiens
aaggaacctaattgaaattta

SEQ ID NO: 5104296 - DNA, 21 bp, Homo sapiens
aaggaaccttccttcctgctt

SEQ ID NO: 5104297 - DNA, 23 bp, Homo sapiens
aaggaaccttccttcctgcttga

SEQ ID NO: 5104298 - DNA, 16 bp, Homo sapiens
aaggaacttaaaactt

SEQ ID NO: 5104299 - DNA, 18 bp, Homo sapiens
aaggaacttgaaaaatac

SEQ ID NO: 5104300 - DNA, 22 bp, Homo sapiens
aaggaacttgccctgagcactc

SEQ ID NO: 5104301 - DNA, 13 bp, Homo sapiens
aaggaacttgtct

SEQ ID NO: 5104302 - DNA, 22 bp, Homo sapiens
aaggaacttttaaactgcagtt

SEQ ID NO: 5104303 - DNA, 12 bp, Homo sapiens
aaggaagaaaaa

SEQ ID NO: 5104304 - DNA, 13 bp, Homo sapiens
aaggaagaaaaat

SEQ ID NO: 5104305 - DNA, 13 bp, Homo sapiens
aaggaagaaacca

SEQ ID NO: 5104306 - DNA, 11 bp, Homo sapiens
aaggaagaaat

SEQ ID NO: 5104307 - DNA, 13 bp, Homo sapiens
aaggaagactaga

SEQ ID NO: 5104308 - DNA, 13 bp, Homo sapiens
aaggaagagaaga

SEQ ID NO: 5104309 - DNA, 15 bp, Homo sapiens
aaggaagagccagcc

SEQ ID NO: 5104310 - DNA, 16 bp, Homo sapiens
aaggaagagccagccg

SEQ ID NO: 5104311 - DNA, 17 bp, Homo sapiens
aaggaagagccagccgt

SEQ ID NO: 5104312 - DNA, 11 bp, Homo sapiens
aaggaagaggg

SEQ ID NO: 5104313 - DNA, 14 bp, Homo sapiens
aaggaagagggctg

SEQ ID NO: 5104314 - DNA, 13 bp, Homo sapiens
aaggaagatttga

SEQ ID NO: 5104315 - DNA, 18 bp, Homo sapiens
aaggaagcacaaaagaca

SEQ ID NO: 5104316 - DNA, 20 bp, Homo sapiens
aaggaagcacaaaagacaag

SEQ ID NO: 5104317 - DNA, 13 bp, Homo sapiens
aaggaagcacatg

SEQ ID NO: 5104318 - DNA, 22 bp, Homo sapiens
aaggaagcacctatgaaagcaa

SEQ ID NO: 5104319 - DNA, 12 bp, Homo sapiens
aaggaagcagaa

SEQ ID NO: 5104320 - DNA, 16 bp, Homo sapiens
aaggaagccaaattta

SEQ ID NO: 5104321 - DNA, 19 bp, Homo sapiens
aaggaagccaaatttatca

SEQ ID NO: 5104322 - DNA, 22 bp, Homo sapiens
aaggaagccagtcaccttctgg

SEQ ID NO: 5104323 - DNA, 18 bp, Homo sapiens
aaggaagccctctcagat

SEQ ID NO: 5104324 - DNA, 16 bp, Homo sapiens
aaggaagccttgctca

SEQ ID NO: 5104325 - DNA, 22 bp, Homo sapiens
aaggaagccttgctcattcttg

SEQ ID NO: 5104326 - DNA, 18 bp, Homo sapiens
aaggaagctccactgtca

SEQ ID NO: 5104327 - DNA, 22 bp, Homo sapiens
aaggaagctttctctgcttcag

SEQ ID NO: 5104328 - DNA, 11 bp, Homo sapiens
aaggaaggaaa

SEQ ID NO: 5104329 - DNA, 13 bp, Homo sapiens
aaggaaggaaaga

SEQ ID NO: 5104330 - DNA, 13 bp, Homo sapiens
aaggaaggaccag

SEQ ID NO: 5104331 - DNA, 22 bp, Homo sapiens
aaggaaggagactcacctctgc

SEQ ID NO: 5104332 - DNA, 12 bp, Homo sapiens
aaggaaggagag

SEQ ID NO: 5104333 - DNA, 14 bp, Homo sapiens
aaggaaggagggca

SEQ ID NO: 5104334 - DNA, 16 bp, Homo sapiens
aaggaaggagggcaca

SEQ ID NO: 5104335 - DNA, 12 bp, Homo sapiens
aaggaaggatgc

SEQ ID NO: 5104336 - DNA, 17 bp, Homo sapiens
aaggaaggcctgagccc

SEQ ID NO: 5104337 - DNA, 12 bp, Homo sapiens
aaggaaggctct

SEQ ID NO: 5104338 - DNA, 16 bp, Homo sapiens
aaggaaggtaaaaagt

SEQ ID NO: 5104339 - DNA, 18 bp, Homo sapiens
aaggaaggtaaaaagtta

SEQ ID NO: 5104340 - DNA, 17 bp, Homo sapiens
aaggaaggtggatggcc

SEQ ID NO: 5104341 - DNA, 20 bp, Homo sapiens
aagggatggaaaaggaagac

SEQ ID NO: 5104342 - DNA, 16 bp, Homo sapiens
aagggatggacatctt

SEQ ID NO: 5104343 - DNA, 24 bp, Homo sapiens
aagggatggaggtcacactggtag

SEQ ID NO: 5104344 - DNA, 15 bp, Homo sapiens
aagggatggcaccac

SEQ ID NO: 5104345 - DNA, 11 bp, Homo sapiens
aagggatggcc

SEQ ID NO: 5104346 - DNA, 16 bp, Homo sapiens
aagggatggtcaggcc

SEQ ID NO: 5104347 - DNA, 19 bp, Homo sapiens
aagggatggtcaggcccag

SEQ ID NO: 5104348 - DNA, 17 bp, Homo sapiens
aagggattacccaagca

SEQ ID NO: 5104349 - DNA, 16 bp, Homo sapiens
aagggattactagaga

SEQ ID NO: 5104350 - DNA, 15 bp, Homo sapiens
aagggattctccagg

SEQ ID NO: 5104351 - DNA, 23 bp, Homo sapiens
aagggattgaggagttgcctgac

SEQ ID NO: 5104352 - DNA, 17 bp, Homo sapiens
aagggattttagtcaca

SEQ ID NO: 5104353 - DNA, 15 bp, Homo sapiens
aagggattttcagcc

SEQ ID NO: 5104354 - DNA, 18 bp, Homo sapiens
aagggcaaattggagaaa

SEQ ID NO: 5104355 - DNA, 23 bp, Homo sapiens
aagggcaagaaatggcgtctgct

SEQ ID NO: 5104356 - DNA, 15 bp, Homo sapiens
aagggcacaagctca

SEQ ID NO: 5104357 - DNA, 15 bp, Homo sapiens
aagggcacacccctg

SEQ ID NO: 5104358 - DNA, 14 bp, Homo sapiens
aagggcacattgcc

SEQ ID NO: 5104359 - DNA, 14 bp, Homo sapiens
aagggcacttaatt

SEQ ID NO: 5104360 - DNA, 18 bp, Homo sapiens
aagggcagaacactaacc

SEQ ID NO: 5104361 - DNA, 14 bp, Homo sapiens
aagggcagagaact

SEQ ID NO: 5104362 - DNA, 17 bp, Homo sapiens
aagggcagaggaagaga

SEQ ID NO: 5104363 - DNA, 16 bp, Homo sapiens
aagggcagaggcaagg

SEQ ID NO: 5104364 - DNA, 11 bp, Homo sapiens
aagggcagagt

SEQ ID NO: 5104365 - DNA, 18 bp, Homo sapiens
aagggcagcaagataaac

SEQ ID NO: 5104366 - DNA, 15 bp, Homo sapiens
aagggcagccccgcg

SEQ ID NO: 5104367 - DNA, 15 bp, Homo sapiens
aagggcagcccctcc

SEQ ID NO: 5104368 - DNA, 18 bp, Homo sapiens
aagggcagcccctcccca

SEQ ID NO: 5104369 - DNA, 17 bp, Homo sapiens
aagggcagccctccatg

SEQ ID NO: 5104370 - DNA, 20 bp, Homo sapiens
aagggcagctttgctcatat

SEQ ID NO: 5104371 - DNA, 14 bp, Homo sapiens
aagggcaggaagac

SEQ ID NO: 5104372 - DNA, 13 bp, Homo sapiens
aagggcaggagcc

SEQ ID NO: 5104373 - DNA, 18 bp, Homo sapiens
aagggcaggagcctagag

SEQ ID NO: 5104374 - DNA, 19 bp, Homo sapiens
aagggcaggagcctagagg

SEQ ID NO: 5104375 - DNA, 15 bp, Homo sapiens
aagggcaggagctca

SEQ ID NO: 5104376 - DNA, 16 bp, Homo sapiens
aagggcagggcccacg

SEQ ID NO: 5104377 - DNA, 14 bp, Homo sapiens
aagggcagtggagg

SEQ ID NO: 5104378 - DNA, 14 bp, Homo sapiens
aagggcatccttct

SEQ ID NO: 5104379 - DNA, 14 bp, Homo sapiens
aagggcatgccttg

SEQ ID NO: 5104380 - DNA, 23 bp, Homo sapiens
aagggcattggccattctattgt

SEQ ID NO: 5104381 - DNA, 12 bp, Homo sapiens
aagggccaaaga

SEQ ID NO: 5104382 - DNA, 20 bp, Homo sapiens
aagggccaaagaaccaaaga

SEQ ID NO: 5104383 - DNA, 17 bp, Homo sapiens
aagggccaatggagaaa

SEQ ID NO: 5104384 - DNA, 21 bp, Homo sapiens
aagggccaatggagaaaatga

SEQ ID NO: 5104385 - DNA, 16 bp, Homo sapiens
aagggccaccctgctg

SEQ ID NO: 5104386 - DNA, 9 bp, Homo sapiens
aagggccag

SEQ ID NO: 5104387 - DNA, 11 bp, Homo sapiens
aagggccagag

SEQ ID NO: 5104388 - DNA, 12 bp, Homo sapiens
aagggccagagc

SEQ ID NO: 5104389 - DNA, 15 bp, Homo sapiens
aagggccagagccag

SEQ ID NO: 5104390 - DNA, 17 bp, Homo sapiens
aagggccagagccaggg

SEQ ID NO: 5104391 - DNA, 15 bp, Homo sapiens
aagggccagagcctg

SEQ ID NO: 5104392 - DNA, 14 bp, Homo sapiens
aagggccagcccta

SEQ ID NO: 5104393 - DNA, 21 bp, Homo sapiens
aagggccagcgtggctctaaa

SEQ ID NO: 5104394 - DNA, 12 bp, Homo sapiens
aagggccaggag

SEQ ID NO: 5104395 - DNA, 15 bp, Homo sapiens
aagggccaggagaga

SEQ ID NO: 5104396 - DNA, 21 bp, Homo sapiens
aagggccaggtgcggcctggg

SEQ ID NO: 5104397 - DNA, 16 bp, Homo sapiens
aagggccagtcctgcc

SEQ ID NO: 5104398 - DNA, 19 bp, Homo sapiens
aagggccatgctgaaggga

SEQ ID NO: 5104399 - DNA, 18 bp, Homo sapiens
aagggcccacacctggtg

SEQ ID NO: 5104400 - DNA, 18 bp, Homo sapiens
aagggcccagaccctggg

SEQ ID NO: 5104401 - DNA, 13 bp, Homo sapiens
aagggcccagaga

SEQ ID NO: 5104402 - DNA, 15 bp, Homo sapiens
aagggcccagagagg

SEQ ID NO: 5104403 - DNA, 16 bp, Homo sapiens
aagggccctggcaccc

SEQ ID NO: 5104404 - DNA, 20 bp, Homo sapiens
aagggcccttcactgccttt

SEQ ID NO: 5104405 - DNA, 19 bp, Homo sapiens
aagggccggcttctgcctg

SEQ ID NO: 5104406 - DNA, 13 bp, Homo sapiens
aagggcctgctgg

SEQ ID NO: 5104407 - DNA, 11 bp, Homo sapiens
aagggcctgga

SEQ ID NO: 5104408 - DNA, 14 bp, Homo sapiens
aagggcctggccag

SEQ ID NO: 5104409 - DNA, 14 bp, Homo sapiens
aagggcctggcctg

SEQ ID NO: 5104410 - DNA, 19 bp, Homo sapiens
aagggcctggcctgagctg

SEQ ID NO: 5104411 - DNA, 21 bp, Homo sapiens
aagggccttgagcatctggat

SEQ ID NO: 5104412 - DNA, 15 bp, Homo sapiens
aagggcgcaaagggc

SEQ ID NO: 5104413 - DNA, 15 bp, Homo sapiens
aagggcggaagagtt

SEQ ID NO: 5104414 - DNA, 17 bp, Homo sapiens
aagggcggaagagttac

SEQ ID NO: 5104415 - DNA, 15 bp, Homo sapiens
aagggcgggcctgtt

SEQ ID NO: 5104416 - DNA, 22 bp, Homo sapiens
aagggcggggctatgccttgtc

SEQ ID NO: 5104417 - DNA, 18 bp, Homo sapiens
aagggctacctctgagta

SEQ ID NO: 5104418 - DNA, 19 bp, Homo sapiens
aagggctagaacctggaga

SEQ ID NO: 5104419 - DNA, 18 bp, Homo sapiens
aagggctataagtagaaa

SEQ ID NO: 5104420 - DNA, 16 bp, Homo sapiens
aagggctatgtaaata

SEQ ID NO: 5104421 - DNA, 19 bp, Homo sapiens
aagggctcctatctttcct

SEQ ID NO: 5104422 - DNA, 19 bp, Homo sapiens
aagggctctttctctctgc

SEQ ID NO: 5104423 - DNA, 18 bp, Homo sapiens
aagggctgacctgcctct

SEQ ID NO: 5104424 - DNA, 19 bp, Homo sapiens
aagggctgagaggaagcaa

SEQ ID NO: 5104425 - DNA, 15 bp, Homo sapiens
aagggctgcatgatg

SEQ ID NO: 5104426 - DNA, 20 bp, Homo sapiens
aagggctgcatgatgtttgc

SEQ ID NO: 5104427 - DNA, 22 bp, Homo sapiens
aagggctggcacttttttaaat

SEQ ID NO: 5104428 - DNA, 13 bp, Homo sapiens
aagggctggctcc

SEQ ID NO: 5104429 - DNA, 22 bp, Homo sapiens
aagggctggctccccctcccca

SEQ ID NO: 5104430 - DNA, 16 bp, Homo sapiens
aagggctggggcggag

SEQ ID NO: 5104431 - DNA, 12 bp, Homo sapiens
aagggctgggtg

SEQ ID NO: 5104432 - DNA, 17 bp, Homo sapiens
aagggctgttataatct

SEQ ID NO: 5104433 - DNA, 20 bp, Homo sapiens
aagggcttatctagccaaag

SEQ ID NO: 5104434 - DNA, 23 bp, Homo sapiens
aagggcttcggccacaggcaggt

SEQ ID NO: 5104435 - DNA, 19 bp, Homo sapiens
aagggcttctgcaccctcc

SEQ ID NO: 5104436 - DNA, 18 bp, Homo sapiens
aagggcttggtggccaag

SEQ ID NO: 5104437 - DNA, 21 bp, Homo sapiens
aagggcttggtggccaagcct

SEQ ID NO: 5104438 - DNA, 20 bp, Homo sapiens
aagggcttgtttttcttcag

SEQ ID NO: 5104439 - DNA, 21 bp, Homo sapiens
aagggcttgtttttcttcagc

SEQ ID NO: 5104440 - DNA, 14 bp, Homo sapiens
aagggctttaaata

SEQ ID NO: 5104441 - DNA, 16 bp, Homo sapiens
aagggctttaaataaa

SEQ ID NO: 5104442 - DNA, 20 bp, Homo sapiens
aagggctttaaataaaagag

SEQ ID NO: 5104443 - DNA, 22 bp, Homo sapiens
aagggctttggttccttctctg

SEQ ID NO: 5104444 - DNA, 13 bp, Homo sapiens
aaggggaaaaatg

SEQ ID NO: 5104445 - DNA, 14 bp, Homo sapiens
aaggggaaaaatgg

SEQ ID NO: 5104446 - DNA, 13 bp, Homo sapiens
aaggggaaaacct

SEQ ID NO: 5104447 - DNA, 14 bp, Homo sapiens
aaggggaaaacctc

SEQ ID NO: 5104448 - DNA, 18 bp, Homo sapiens
aaggggaaacctgtgaaa

SEQ ID NO: 5104449 - DNA, 22 bp, Homo sapiens
aaggggaaacgtctcccagatc

SEQ ID NO: 5104450 - DNA, 18 bp, Homo sapiens
aaggggaagcactcgtgt

SEQ ID NO: 5104451 - DNA, 22 bp, Homo sapiens
aaggggaatgtgtcctcctgct

SEQ ID NO: 5104452 - DNA, 15 bp, Homo sapiens
aaggggaattaacaa

SEQ ID NO: 5104453 - DNA, 20 bp, Homo sapiens
aaggggacaagtagccacct

SEQ ID NO: 5104454 - DNA, 15 bp, Homo sapiens
aaggggacaggcctc

SEQ ID NO: 5104455 - DNA, 19 bp, Homo sapiens
aaggggaccctccgctctg

SEQ ID NO: 5104456 - DNA, 23 bp, Homo sapiens
aaggggacgcgggctgtgcctta

SEQ ID NO: 5104457 - DNA, 22 bp, Homo sapiens
aaggggagaaactgaaagtgtt

SEQ ID NO: 5104458 - DNA, 19 bp, Homo sapiens
aaggggagagcctgctggc

SEQ ID NO: 5104459 - DNA, 22 bp, Homo sapiens
aaggggagccagaaatgggcag

SEQ ID NO: 5104460 - DNA, 15 bp, Homo sapiens
aaggggaggagggga

SEQ ID NO: 5104461 - DNA, 21 bp, Homo sapiens
aaggggaggcacactttctgg

SEQ ID NO: 5104462 - DNA, 22 bp, Homo sapiens
aaggggagggtgttcagaggca

SEQ ID NO: 5104463 - DNA, 21 bp, Homo sapiens
aaggggatcataaagttagaa

SEQ ID NO: 5104464 - DNA, 21 bp, Homo sapiens
aaggggatctaaaaaaatgtt

SEQ ID NO: 5104465 - DNA, 17 bp, Homo sapiens
aaggggatggaggccag

SEQ ID NO: 5104466 - DNA, 15 bp, Homo sapiens
aaggggatggagtga

SEQ ID NO: 5104467 - DNA, 22 bp, Homo sapiens
aaggggatgggaaataaagaaa

SEQ ID NO: 5104468 - DNA, 22 bp, Homo sapiens
aaggggatgtatccatgggggc

SEQ ID NO: 5104469 - DNA, 14 bp, Homo sapiens
aaggggatttttat

SEQ ID NO: 5104470 - DNA, 12 bp, Homo sapiens
aaggggcaaatt

SEQ ID NO: 5104471 - DNA, 17 bp, Homo sapiens
aaggggcacaccactgc

SEQ ID NO: 5104472 - DNA, 21 bp, Homo sapiens
aaggggcacaccactgccctg

SEQ ID NO: 5104473 - DNA, 23 bp, Homo sapiens
aaggggcacaccactgccctgcc

SEQ ID NO: 5104474 - DNA, 23 bp, Homo sapiens
aaggggcacctgggaaaacagag

SEQ ID NO: 5104475 - DNA, 15 bp, Homo sapiens
aaggggcagctcctg

SEQ ID NO: 5104476 - DNA, 22 bp, Homo sapiens
aaggggcagctcctgaccaaag

SEQ ID NO: 5104477 - DNA, 23 bp, Homo sapiens
aaggggcagctcctgaccaaaga

SEQ ID NO: 5104478 - DNA, 19 bp, Homo sapiens
aaggggcagtctggagggg

SEQ ID NO: 5104479 - DNA, 17 bp, Homo sapiens
aaggggcagtggtggtt

SEQ ID NO: 5104480 - DNA, 15 bp, Homo sapiens
aaggggcattttgta

SEQ ID NO: 5104481 - DNA, 17 bp, Homo sapiens
aaggggccagaggctcg

SEQ ID NO: 5104482 - DNA, 16 bp, Homo sapiens
aaggggccaggaaggg

SEQ ID NO: 5104483 - DNA, 20 bp, Homo sapiens
aaggggccaggaaggggaca

SEQ ID NO: 5104484 - DNA, 23 bp, Homo sapiens
aaggggccatttggcataccttt

SEQ ID NO: 5104485 - DNA, 22 bp, Homo sapiens
aaggggcccaaattctttcagt

SEQ ID NO: 5104486 - DNA, 19 bp, Homo sapiens
aaggggcccaagagagaca

SEQ ID NO: 5104487 - DNA, 16 bp, Homo sapiens
aaggggcccaagcccc

SEQ ID NO: 5104488 - DNA, 16 bp, Homo sapiens
aaggggccccggggct

SEQ ID NO: 5104489 - DNA, 14 bp, Homo sapiens
aaggggccctagga

SEQ ID NO: 5104490 - DNA, 15 bp, Homo sapiens
aaggggcccttggag

SEQ ID NO: 5104491 - DNA, 17 bp, Homo sapiens
aaggggccggggagggg

SEQ ID NO: 5104492 - DNA, 13 bp, Homo sapiens
aaggggcctgagc

SEQ ID NO: 5104493 - DNA, 14 bp, Homo sapiens
aaggggcctgggct

SEQ ID NO: 5104494 - DNA, 21 bp, Homo sapiens
aaggggcctgggctgtgagga

SEQ ID NO: 5104495 - DNA, 13 bp, Homo sapiens
aaggggccttgct

SEQ ID NO: 5104496 - DNA, 21 bp, Homo sapiens
aaggggcctttgtcttgtcaa

SEQ ID NO: 5104497 - DNA, 19 bp, Homo sapiens
aaggggctagggctgagca

SEQ ID NO: 5104498 - DNA, 20 bp, Homo sapiens
aaggggctatcctgggacct

SEQ ID NO: 5104499 - DNA, 20 bp, Homo sapiens
aaggggctcttcatctgcct

SEQ ID NO: 5104500 - DNA, 16 bp, Homo sapiens
aaggggctcttctgag

SEQ ID NO: 5104501 - DNA, 14 bp, Homo sapiens
aaggggctgctggg

SEQ ID NO: 5104502 - DNA, 17 bp, Homo sapiens
aaggggctgcttctggg

SEQ ID NO: 5104503 - DNA, 14 bp, Homo sapiens
aaggggcttctaat

SEQ ID NO: 5104504 - DNA, 16 bp, Homo sapiens
aaggggcttctaatga

SEQ ID NO: 5104505 - DNA, 20 bp, Homo sapiens
aagggggacttaaactgctg

SEQ ID NO: 5104506 - DNA, 19 bp, Homo sapiens
aagggggagtttttagttt

SEQ ID NO: 5104507 - DNA, 18 bp, Homo sapiens
aagggggcatctggcctt

SEQ ID NO: 5104508 - DNA, 13 bp, Homo sapiens
aagggggccctgc

SEQ ID NO: 5104509 - DNA, 16 bp, Homo sapiens
aagggggccttggaat

SEQ ID NO: 5104510 - DNA, 23 bp, Homo sapiens
aagggggctattccctggagacc

SEQ ID NO: 5104511 - DNA, 23 bp, Homo sapiens
aagggggctgggacatgggaaag

SEQ ID NO: 5104512 - DNA, 15 bp, Homo sapiens
aaggggggagctggg

SEQ ID NO: 5104513 - DNA, 13 bp, Homo sapiens
aaggggggagggg

SEQ ID NO: 5104514 - DNA, 18 bp, Homo sapiens
aaggggggcagggagtga

SEQ ID NO: 5104515 - DNA, 17 bp, Homo sapiens
aaggggggtgggagggg

SEQ ID NO: 5104516 - DNA, 21 bp, Homo sapiens
aaggggggttgcagtggagag

SEQ ID NO: 5104517 - DNA, 16 bp, Homo sapiens
aagggggtccacccag

SEQ ID NO: 5104518 - DNA, 17 bp, Homo sapiens
aagggggtcccagtggg

SEQ ID NO: 5104519 - DNA, 18 bp, Homo sapiens
aagggggtgaccatgcaa

SEQ ID NO: 5104520 - DNA, 14 bp, Homo sapiens
aaggaagtgaagag

SEQ ID NO: 5104521 - DNA, 17 bp, Homo sapiens
aaggaagtgggggccgc

SEQ ID NO: 5104522 - DNA, 14 bp, Homo sapiens
aaggaagtggggtg

SEQ ID NO: 5104523 - DNA, 13 bp, Homo sapiens
aaggaatacactt

SEQ ID NO: 5104524 - DNA, 14 bp, Homo sapiens
aaggaatataagaa

SEQ ID NO: 5104525 - DNA, 16 bp, Homo sapiens
aaggaatataagaaaa

SEQ ID NO: 5104526 - DNA, 23 bp, Homo sapiens
aaggaatatatatggaataagtg

SEQ ID NO: 5104527 - DNA, 15 bp, Homo sapiens
aaggaatatatggca

SEQ ID NO: 5104528 - DNA, 17 bp, Homo sapiens
aaggaatatatggcaga

SEQ ID NO: 5104529 - DNA, 18 bp, Homo sapiens
aaggaatatatggcagag

SEQ ID NO: 5104530 - DNA, 22 bp, Homo sapiens
aaggaatatatggcagagttgt

SEQ ID NO: 5104531 - DNA, 23 bp, Homo sapiens
aaggaatatatggcagagttgta

SEQ ID NO: 5104532 - DNA, 23 bp, Homo sapiens
aaggaatcactttagaaagccag

SEQ ID NO: 5104533 - DNA, 16 bp, Homo sapiens
aaggaatcattccagt

SEQ ID NO: 5104534 - DNA, 18 bp, Homo sapiens
aaggaatcattccagtgc

SEQ ID NO: 5104535 - DNA, 21 bp, Homo sapiens
aaggaatccactcccaggcag

SEQ ID NO: 5104536 - DNA, 22 bp, Homo sapiens
aaggaatccccagatatttatg

SEQ ID NO: 5104537 - DNA, 23 bp, Homo sapiens
aaggaatctagccagtgaacata

SEQ ID NO: 5104538 - DNA, 21 bp, Homo sapiens
aaggaatctccagttttcagt

SEQ ID NO: 5104539 - DNA, 14 bp, Homo sapiens
aaggaatctttaag

SEQ ID NO: 5104540 - DNA, 14 bp, Homo sapiens
aaggaatgatatat

SEQ ID NO: 5104541 - DNA, 16 bp, Homo sapiens
aaggaatgtctttggt

SEQ ID NO: 5104542 - DNA, 18 bp, Homo sapiens
aaggaatgtgtccaagac

SEQ ID NO: 5104543 - DNA, 21 bp, Homo sapiens
aaggaattaccaagaatatcc

SEQ ID NO: 5104544 - DNA, 15 bp, Homo sapiens
aaggaattctaggca

SEQ ID NO: 5104545 - DNA, 22 bp, Homo sapiens
aaggaattgacttcagcagggg

SEQ ID NO: 5104546 - DNA, 16 bp, Homo sapiens
aaggaatttccctgtg

SEQ ID NO: 5104547 - DNA, 13 bp, Homo sapiens
aaggaatttcctc

SEQ ID NO: 5104548 - DNA, 16 bp, Homo sapiens
aaggaatttcttaact

SEQ ID NO: 5104549 - DNA, 15 bp, Homo sapiens
aaggaatttgattgc

SEQ ID NO: 5104550 - DNA, 18 bp, Homo sapiens
aaggaatttgattgcttt

SEQ ID NO: 5104551 - DNA, 14 bp, Homo sapiens
aaggaatttgtact

SEQ ID NO: 5104552 - DNA, 23 bp, Homo sapiens
aaggacaaaaatgaactgaagtt

SEQ ID NO: 5104553 - DNA, 18 bp, Homo sapiens
aaggacaaagaaggaaat

SEQ ID NO: 5104554 - DNA, 16 bp, Homo sapiens
aaggacaaagtgccaa

SEQ ID NO: 5104555 - DNA, 17 bp, Homo sapiens
aaggacaaataaaacat

SEQ ID NO: 5104556 - DNA, 13 bp, Homo sapiens
aaggacaaattag

SEQ ID NO: 5104557 - DNA, 22 bp, Homo sapiens
aaggacaaattagcatgcaagc

SEQ ID NO: 5104558 - DNA, 17 bp, Homo sapiens
aaggacaacctgcccct

SEQ ID NO: 5104559 - DNA, 21 bp, Homo sapiens
aaggacaagcaattagaagcc

SEQ ID NO: 5104560 - DNA, 20 bp, Homo sapiens
aaggacaatgccttgggaga

SEQ ID NO: 5104561 - DNA, 14 bp, Homo sapiens
aaggacaatttcaa

SEQ ID NO: 5104562 - DNA, 14 bp, Homo sapiens
aaggacacaaactt

SEQ ID NO: 5104563 - DNA, 22 bp, Homo sapiens
aaggacacagatgaaacacaaa

SEQ ID NO: 5104564 - DNA, 13 bp, Homo sapiens
aaggacacagtga

SEQ ID NO: 5104565 - DNA, 16 bp, Homo sapiens
aaggacacagtgatga

SEQ ID NO: 5104566 - DNA, 19 bp, Homo sapiens
aaggacacattgttttcca

SEQ ID NO: 5104567 - DNA, 13 bp, Homo sapiens
aaggacactagaa

SEQ ID NO: 5104568 - DNA, 13 bp, Homo sapiens
aaggacactgatg

SEQ ID NO: 5104569 - DNA, 16 bp, Homo sapiens
aaggacactggggtct

SEQ ID NO: 5104570 - DNA, 16 bp, Homo sapiens
aaggacagacagcagg

SEQ ID NO: 5104571 - DNA, 21 bp, Homo sapiens
aaggacagagggttttgattt

SEQ ID NO: 5104572 - DNA, 17 bp, Homo sapiens
aaggacagagtatgaac

SEQ ID NO: 5104573 - DNA, 19 bp, Homo sapiens
aaggacagcccctcctcca

SEQ ID NO: 5104574 - DNA, 16 bp, Homo sapiens
aaggacaggaagctgg

SEQ ID NO: 5104575 - DNA, 19 bp, Homo sapiens
aaggacaggagcctggtcc

SEQ ID NO: 5104576 - DNA, 20 bp, Homo sapiens
aaggacaggcagaaagagtt

SEQ ID NO: 5104577 - DNA, 16 bp, Homo sapiens
aaggacagtccctgct

SEQ ID NO: 5104578 - DNA, 21 bp, Homo sapiens
aaggacagtcctatttagaca

SEQ ID NO: 5104579 - DNA, 12 bp, Homo sapiens
aaggacagtgtt

SEQ ID NO: 5104580 - DNA, 13 bp, Homo sapiens
aaggacagttcag

SEQ ID NO: 5104581 - DNA, 23 bp, Homo sapiens
aaggacataaaatttaaaaactt

SEQ ID NO: 5104582 - DNA, 14 bp, Homo sapiens
aaggacatcagcaa

SEQ ID NO: 5104583 - DNA, 15 bp, Homo sapiens
aaggacatcagcaaa

SEQ ID NO: 5104584 - DNA, 17 bp, Homo sapiens
aaggacatcagcaaaca

SEQ ID NO: 5104585 - DNA, 19 bp, Homo sapiens
aaggacatgagatcagggc

SEQ ID NO: 5104586 - DNA, 21 bp, Homo sapiens
aaggacatgagatcagggcct

SEQ ID NO: 5104587 - DNA, 17 bp, Homo sapiens
aaggacatgcggcctgc

SEQ ID NO: 5104588 - DNA, 21 bp, Homo sapiens
aaggacattacagaccatgga

SEQ ID NO: 5104589 - DNA, 21 bp, Homo sapiens
aaggacattgccccaagatag

SEQ ID NO: 5104590 - DNA, 15 bp, Homo sapiens
aaggacattgtatgc

SEQ ID NO: 5104591 - DNA, 18 bp, Homo sapiens
aaggaccaaattgcttta

SEQ ID NO: 5104592 - DNA, 21 bp, Homo sapiens
aaggaccaactggcttctgtg

SEQ ID NO: 5104593 - DNA, 16 bp, Homo sapiens
aaggaccacattttat

SEQ ID NO: 5104594 - DNA, 20 bp, Homo sapiens
aaggaccacattttatattt

SEQ ID NO: 5104595 - DNA, 23 bp, Homo sapiens
aaggaccacattttatatttatt

SEQ ID NO: 5104596 - DNA, 12 bp, Homo sapiens
aaggaccaggac

SEQ ID NO: 5104597 - DNA, 20 bp, Homo sapiens
aaggaccagtttcttgaagt

SEQ ID NO: 5104598 - DNA, 18 bp, Homo sapiens
aaggacccaaatttccct

SEQ ID NO: 5104599 - DNA, 23 bp, Homo sapiens
aaggacccacccatcttcctgct

SEQ ID NO: 5104600 - DNA, 11 bp, Homo sapiens
aaggacccagg

SEQ ID NO: 5104601 - DNA, 19 bp, Homo sapiens
aaggacccctcaccacccc

SEQ ID NO: 5104602 - DNA, 22 bp, Homo sapiens
aaggacccggaggggcctggca

SEQ ID NO: 5104603 - DNA, 15 bp, Homo sapiens
aaggaccctggctct

SEQ ID NO: 5104604 - DNA, 14 bp, Homo sapiens
aaggaccctgtgcc

SEQ ID NO: 5104605 - DNA, 22 bp, Homo sapiens
aaggaccctgttttccacacca

SEQ ID NO: 5104606 - DNA, 23 bp, Homo sapiens
aaggacctccccctgtgtggccc

SEQ ID NO: 5104607 - DNA, 21 bp, Homo sapiens
aaggacctcctaaataaatta

SEQ ID NO: 5104608 - DNA, 23 bp, Homo sapiens
aaggacctcggggaataaaacat

SEQ ID NO: 5104609 - DNA, 19 bp, Homo sapiens
aaggacctgaaattccaaa

SEQ ID NO: 5104610 - DNA, 19 bp, Homo sapiens
aaggaccttaagacagagt

SEQ ID NO: 5104611 - DNA, 20 bp, Homo sapiens
aaggaccttcactctaagat

SEQ ID NO: 5104612 - DNA, 23 bp, Homo sapiens
aaggaccttcactctaagatgtt

SEQ ID NO: 5104613 - DNA, 20 bp, Homo sapiens
aaggacgctggctactgtct

SEQ ID NO: 5104614 - DNA, 21 bp, Homo sapiens
aaggacggccttcaactgaaa

SEQ ID NO: 5104615 - DNA, 12 bp, Homo sapiens
aaggacggctga

SEQ ID NO: 5104616 - DNA, 21 bp, Homo sapiens
aaggacggtgccaagggcccc

SEQ ID NO: 5104617 - DNA, 15 bp, Homo sapiens
aaggactaatagaaa

SEQ ID NO: 5104618 - DNA, 15 bp, Homo sapiens
aaggactacagaatt

SEQ ID NO: 5104619 - DNA, 18 bp, Homo sapiens
aaggactagggtcctggg

SEQ ID NO: 5104620 - DNA, 20 bp, Homo sapiens
aaggactagggtcctgggga

SEQ ID NO: 5104621 - DNA, 21 bp, Homo sapiens
aaggactatgaaaagctagaa

SEQ ID NO: 5104622 - DNA, 15 bp, Homo sapiens
aaggactattatgtg

SEQ ID NO: 5104623 - DNA, 21 bp, Homo sapiens
aaggactatttataactaata

SEQ ID NO: 5104624 - DNA, 16 bp, Homo sapiens
aaggactcagctgtgg

SEQ ID NO: 5104625 - DNA, 23 bp, Homo sapiens
aaggactcccggagcctgtgcag

SEQ ID NO: 5104626 - DNA, 15 bp, Homo sapiens
aaggactcctgaaaa

SEQ ID NO: 5104627 - DNA, 16 bp, Homo sapiens
aaggactctggcctct

SEQ ID NO: 5104628 - DNA, 23 bp, Homo sapiens
aaggactctggtttctcattctt

SEQ ID NO: 5104629 - DNA, 19 bp, Homo sapiens
aaggactgactgaggcagt

SEQ ID NO: 5104630 - DNA, 15 bp, Homo sapiens
aaggactgagggcag

SEQ ID NO: 5104631 - DNA, 22 bp, Homo sapiens
aaggactgcagacaggctctga

SEQ ID NO: 5104632 - DNA, 17 bp, Homo sapiens
aaggactggaaaaatga

SEQ ID NO: 5104633 - DNA, 21 bp, Homo sapiens
aaggactggtgcgacccccca

SEQ ID NO: 5104634 - DNA, 14 bp, Homo sapiens
aaggactgtaatct

SEQ ID NO: 5104635 - DNA, 21 bp, Homo sapiens
aaggactgtgacaggcagcag

SEQ ID NO: 5104636 - DNA, 15 bp, Homo sapiens
aaggactgtggctgc

SEQ ID NO: 5104637 - DNA, 17 bp, Homo sapiens
aaggactgtggctgcag

SEQ ID NO: 5104638 - DNA, 16 bp, Homo sapiens
aaggactgtgtgacct

SEQ ID NO: 5104639 - DNA, 23 bp, Homo sapiens
aaggactgttttttcctgagctt

SEQ ID NO: 5104640 - DNA, 20 bp, Homo sapiens
aaggacttcctgtccagctc

SEQ ID NO: 5104641 - DNA, 23 bp, Homo sapiens
aaggacttcctgtccagctccaa

SEQ ID NO: 5104642 - DNA, 16 bp, Homo sapiens
aaggacttctgcagct

SEQ ID NO: 5104643 - DNA, 21 bp, Homo sapiens
aaggacttctttaattttgga

SEQ ID NO: 5104644 - DNA, 12 bp, Homo sapiens
aaggacttgaaa

SEQ ID NO: 5104645 - DNA, 14 bp, Homo sapiens
aaggacttggtgat

SEQ ID NO: 5104646 - DNA, 15 bp, Homo sapiens
aaggacttgtttccc

SEQ ID NO: 5104647 - DNA, 19 bp, Homo sapiens
aaggactttccaaatccag

SEQ ID NO: 5104648 - DNA, 21 bp, Homo sapiens
aaggactttccaaatccagga

SEQ ID NO: 5104649 - DNA, 21 bp, Homo sapiens
aaggactttggcttacatttg

SEQ ID NO: 5104650 - DNA, 22 bp, Homo sapiens
aaggactttggcttacatttga

SEQ ID NO: 5104651 - DNA, 15 bp, Homo sapiens
aaggagaaaagtggg

SEQ ID NO: 5104652 - DNA, 17 bp, Homo sapiens
aaggagaaaagtgggct

SEQ ID NO: 5104653 - DNA, 14 bp, Homo sapiens
aaggagaaatctgg

SEQ ID NO: 5104654 - DNA, 12 bp, Homo sapiens
aaggagaacaaa

SEQ ID NO: 5104655 - DNA, 19 bp, Homo sapiens
aaggagaagagtattttta

SEQ ID NO: 5104656 - DNA, 16 bp, Homo sapiens
aaggagaaggctggag

SEQ ID NO: 5104657 - DNA, 17 bp, Homo sapiens
aaggagaaggctggaga

SEQ ID NO: 5104658 - DNA, 19 bp, Homo sapiens
aaggagaatcatgtttctt

SEQ ID NO: 5104659 - DNA, 22 bp, Homo sapiens
aaggagaatcatgtttctttga

SEQ ID NO: 5104660 - DNA, 13 bp, Homo sapiens
aaggagaatggga

SEQ ID NO: 5104661 - DNA, 14 bp, Homo sapiens
aaggagaattgaat

SEQ ID NO: 5104662 - DNA, 19 bp, Homo sapiens
aaggagacaaagcaggagt

SEQ ID NO: 5104663 - DNA, 14 bp, Homo sapiens
aaggagacacagat

SEQ ID NO: 5104664 - DNA, 16 bp, Homo sapiens
aaggagacacagatgt

SEQ ID NO: 5104665 - DNA, 17 bp, Homo sapiens
aaggagacacagatgtt

SEQ ID NO: 5104666 - DNA, 22 bp, Homo sapiens
aaggagacaggatgaggtctcg

SEQ ID NO: 5104667 - DNA, 19 bp, Homo sapiens
aaggagacaggcagagctg

SEQ ID NO: 5104668 - DNA, 14 bp, Homo sapiens
aaggagacatatca

SEQ ID NO: 5104669 - DNA, 20 bp, Homo sapiens
aaggagactggtaggaggag

SEQ ID NO: 5104670 - DNA, 13 bp, Homo sapiens
aaggagactgtgg

SEQ ID NO: 5104671 - DNA, 14 bp, Homo sapiens
aaggagactgtgtt

SEQ ID NO: 5104672 - DNA, 11 bp, Homo sapiens
aaggagagaag

SEQ ID NO: 5104673 - DNA, 18 bp, Homo sapiens
aaggagagaaggggagga

SEQ ID NO: 5104674 - DNA, 20 bp, Homo sapiens
aaggagagactcccatgaag

SEQ ID NO: 5104675 - DNA, 21 bp, Homo sapiens
aaggagagactcccatgaagc

SEQ ID NO: 5104676 - DNA, 21 bp, Homo sapiens
aaggagagattattaaatcgt

SEQ ID NO: 5104677 - DNA, 17 bp, Homo sapiens
aaggagagcaagaagga

SEQ ID NO: 5104678 - DNA, 22 bp, Homo sapiens
aaggagagcaagaaggaaagat

SEQ ID NO: 5104679 - DNA, 11 bp, Homo sapiens
aaggagagcta

SEQ ID NO: 5104680 - DNA, 17 bp, Homo sapiens
aaggagaggaaagaact

SEQ ID NO: 5104681 - DNA, 23 bp, Homo sapiens
aaggagaggagtgcgctagagca

SEQ ID NO: 5104682 - DNA, 20 bp, Homo sapiens
aaggagaggcaacatccaaa

SEQ ID NO: 5104683 - DNA, 20 bp, Homo sapiens
aaggagaggcccggtgcagc

SEQ ID NO: 5104684 - DNA, 22 bp, Homo sapiens
aaggagagttcaagcctgtggg

SEQ ID NO: 5104685 - DNA, 17 bp, Homo sapiens
aaggagatagggaaaag

SEQ ID NO: 5104686 - DNA, 15 bp, Homo sapiens
aaggagatataaaat

SEQ ID NO: 5104687 - DNA, 14 bp, Homo sapiens
aaggagatcagggc

SEQ ID NO: 5104688 - DNA, 22 bp, Homo sapiens
aaggagatggggagggcgcttt

SEQ ID NO: 5104689 - DNA, 18 bp, Homo sapiens
aaggagatttacaactgg

SEQ ID NO: 5104690 - DNA, 13 bp, Homo sapiens
aaggagatttctt

SEQ ID NO: 5104691 - DNA, 20 bp, Homo sapiens
aaggagatttcttagttcat

SEQ ID NO: 5104692 - DNA, 13 bp, Homo sapiens
aaggagcacaagc

SEQ ID NO: 5104693 - DNA, 18 bp, Homo sapiens
aaggagcagctagctgct

SEQ ID NO: 5104694 - DNA, 15 bp, Homo sapiens
aaggagcagggtcct

SEQ ID NO: 5104695 - DNA, 18 bp, Homo sapiens
aaggagcatccttggcag

SEQ ID NO: 5104696 - DNA, 18 bp, Homo sapiens
aaggagcattaagcccaa

SEQ ID NO: 5104697 - DNA, 15 bp, Homo sapiens
aagggggtgactgga

SEQ ID NO: 5104698 - DNA, 23 bp, Homo sapiens
aagggggtgcaaagactctgagc

SEQ ID NO: 5104699 - DNA, 13 bp, Homo sapiens
aaggggtaaaagg

SEQ ID NO: 5104700 - DNA, 16 bp, Homo sapiens
aaggggtctgaaattt

SEQ ID NO: 5104701 - DNA, 20 bp, Homo sapiens
aaggggtctgctcctgtggc

SEQ ID NO: 5104702 - DNA, 13 bp, Homo sapiens
aaggggtgattga

SEQ ID NO: 5104703 - DNA, 20 bp, Homo sapiens
aaggggtgattgaaagaaaa

SEQ ID NO: 5104704 - DNA, 22 bp, Homo sapiens
aaggggtgattgaaagaaaaaa

SEQ ID NO: 5104705 - DNA, 22 bp, Homo sapiens
aaggggtgccctctggatcctg

SEQ ID NO: 5104706 - DNA, 14 bp, Homo sapiens
aaggggtgctgtga

SEQ ID NO: 5104707 - DNA, 20 bp, Homo sapiens
aaggggtgctgtgaggcttg

SEQ ID NO: 5104708 - DNA, 14 bp, Homo sapiens
aaggggtggaaggg

SEQ ID NO: 5104709 - DNA, 20 bp, Homo sapiens
aaggggtggaagggcaggag

SEQ ID NO: 5104710 - DNA, 21 bp, Homo sapiens
aaggggtgggactggtggggg

SEQ ID NO: 5104711 - DNA, 23 bp, Homo sapiens
aaggggtgggtcagaacatgtta

SEQ ID NO: 5104712 - DNA, 21 bp, Homo sapiens
aaggggttcccactggctcct

SEQ ID NO: 5104713 - DNA, 22 bp, Homo sapiens
aaggggttggggtgacagtcat

SEQ ID NO: 5104714 - DNA, 16 bp, Homo sapiens
aaggggtttgccattt

SEQ ID NO: 5104715 - DNA, 20 bp, Homo sapiens
aaggggtttgccatttgata

SEQ ID NO: 5104716 - DNA, 22 bp, Homo sapiens
aaggggttttcttgataatttt

SEQ ID NO: 5104717 - DNA, 19 bp, Homo sapiens
aaggggttttttgggaaga

SEQ ID NO: 5104718 - DNA, 12 bp, Homo sapiens
aagggtaaacaa

SEQ ID NO: 5104719 - DNA, 13 bp, Homo sapiens
aagggtaaacaat

SEQ ID NO: 5104720 - DNA, 15 bp, Homo sapiens
aagggtaaacaatat

SEQ ID NO: 5104721 - DNA, 19 bp, Homo sapiens
aagggtaaattataaatgt

SEQ ID NO: 5104722 - DNA, 19 bp, Homo sapiens
aagggtagccccctcatct

SEQ ID NO: 5104723 - DNA, 17 bp, Homo sapiens
aagggtaggatgttgct

SEQ ID NO: 5104724 - DNA, 21 bp, Homo sapiens
aagggtaggatgttgcttctg

SEQ ID NO: 5104725 - DNA, 16 bp, Homo sapiens
aagggtatcaggtgct

SEQ ID NO: 5104726 - DNA, 16 bp, Homo sapiens
aagggtatctggtgac

SEQ ID NO: 5104727 - DNA, 18 bp, Homo sapiens
aagggtatgggaagccat

SEQ ID NO: 5104728 - DNA, 21 bp, Homo sapiens
aagggtatgtcacaaagagct

SEQ ID NO: 5104729 - DNA, 23 bp, Homo sapiens
aagggtatgtcacaaagagctga

SEQ ID NO: 5104730 - DNA, 17 bp, Homo sapiens
aagggtcaacggccctg

SEQ ID NO: 5104731 - DNA, 22 bp, Homo sapiens
aagggtcactggcctctcccca

SEQ ID NO: 5104732 - DNA, 22 bp, Homo sapiens
aagggtcagaggacctgtattt

SEQ ID NO: 5104733 - DNA, 20 bp, Homo sapiens
aagggtcaggcctttgagct

SEQ ID NO: 5104734 - DNA, 11 bp, Homo sapiens
aagggtcaggg

SEQ ID NO: 5104735 - DNA, 16 bp, Homo sapiens
aagggtcatagaaagg

SEQ ID NO: 5104736 - DNA, 13 bp, Homo sapiens
aagggtccagaag

SEQ ID NO: 5104737 - DNA, 21 bp, Homo sapiens
aagggtcgaaagctctagaat

SEQ ID NO: 5104738 - DNA, 22 bp, Homo sapiens
aagggtcgaaagctctagaatc

SEQ ID NO: 5104739 - DNA, 19 bp, Homo sapiens
aagggtcgcctatttttaa

SEQ ID NO: 5104740 - DNA, 18 bp, Homo sapiens
aagggtctctctccaggt

SEQ ID NO: 5104741 - DNA, 16 bp, Homo sapiens
aagggtctgtggccag

SEQ ID NO: 5104742 - DNA, 16 bp, Homo sapiens
aagggtcttgggaaat

SEQ ID NO: 5104743 - DNA, 14 bp, Homo sapiens
aagggtgacatccc

SEQ ID NO: 5104744 - DNA, 17 bp, Homo sapiens
aagggtgcccatttgtg

SEQ ID NO: 5104745 - DNA, 13 bp, Homo sapiens
aagggtgcctggc

SEQ ID NO: 5104746 - DNA, 14 bp, Homo sapiens
aagggtgcctggct

SEQ ID NO: 5104747 - DNA, 16 bp, Homo sapiens
aagggtgcctggctgg

SEQ ID NO: 5104748 - DNA, 19 bp, Homo sapiens
aagggtgctgcttccctct

SEQ ID NO: 5104749 - DNA, 22 bp, Homo sapiens
aagggtggcctgttccctagag

SEQ ID NO: 5104750 - DNA, 21 bp, Homo sapiens
aagggtggctttgcatttctt

SEQ ID NO: 5104751 - DNA, 22 bp, Homo sapiens
aagggtggctttgcatttcttg

SEQ ID NO: 5104752 - DNA, 21 bp, Homo sapiens
aagggtgggagtggggccttt

SEQ ID NO: 5104753 - DNA, 15 bp, Homo sapiens
aagggtgggccctgg

SEQ ID NO: 5104754 - DNA, 18 bp, Homo sapiens
aagggtgggccctggagg

SEQ ID NO: 5104755 - DNA, 16 bp, Homo sapiens
aagggtgggtgctcag

SEQ ID NO: 5104756 - DNA, 16 bp, Homo sapiens
aagggtggtagttttc

SEQ ID NO: 5104757 - DNA, 20 bp, Homo sapiens
aagggtggtagttttcccta

SEQ ID NO: 5104758 - DNA, 18 bp, Homo sapiens
aagggtggtctgagcacc

SEQ ID NO: 5104759 - DNA, 20 bp, Homo sapiens
aagggtgtaggggccacctc

SEQ ID NO: 5104760 - DNA, 12 bp, Homo sapiens
aagggtgtatag

SEQ ID NO: 5104761 - DNA, 21 bp, Homo sapiens
aagggtgttgggagggtggtt

SEQ ID NO: 5104762 - DNA, 22 bp, Homo sapiens
aagggttaatcatatttgaaaa

SEQ ID NO: 5104763 - DNA, 20 bp, Homo sapiens
aagggttacttgctgctcac

SEQ ID NO: 5104764 - DNA, 21 bp, Homo sapiens
aagggttagacaagcctggag

SEQ ID NO: 5104765 - DNA, 16 bp, Homo sapiens
aagggttccctcaaga

SEQ ID NO: 5104766 - DNA, 17 bp, Homo sapiens
aagggttgagagccagt

SEQ ID NO: 5104767 - DNA, 14 bp, Homo sapiens
aagggttgagctgg

SEQ ID NO: 5104768 - DNA, 19 bp, Homo sapiens
aagggttgcttgcttgccc

SEQ ID NO: 5104769 - DNA, 19 bp, Homo sapiens
aagggttggtgggctggcc

SEQ ID NO: 5104770 - DNA, 12 bp, Homo sapiens
aagggttgtgag

SEQ ID NO: 5104771 - DNA, 21 bp, Homo sapiens
aagggtttcagagaaaggact

SEQ ID NO: 5104772 - DNA, 18 bp, Homo sapiens
aagggtttcgactggtcc

SEQ ID NO: 5104773 - DNA, 13 bp, Homo sapiens
aagggtttctcta

SEQ ID NO: 5104774 - DNA, 22 bp, Homo sapiens
aagggttttccaggtgtagcta

SEQ ID NO: 5104775 - DNA, 13 bp, Homo sapiens
aagggttttcttt

SEQ ID NO: 5104776 - DNA, 21 bp, Homo sapiens
aagggttttttttttttcctt

SEQ ID NO: 5104777 - DNA, 17 bp, Homo sapiens
aaggtaaaaacccagcg

SEQ ID NO: 5104778 - DNA, 21 bp, Homo sapiens
aaggtaaaaacccagcggctt

SEQ ID NO: 5104779 - DNA, 14 bp, Homo sapiens
aaggtaaaatcact

SEQ ID NO: 5104780 - DNA, 22 bp, Homo sapiens
aaggtaaaatgccatgatgcct

SEQ ID NO: 5104781 - DNA, 14 bp, Homo sapiens
aaggtaaaattcta

SEQ ID NO: 5104782 - DNA, 15 bp, Homo sapiens
aaggtaaaattctaa

SEQ ID NO: 5104783 - DNA, 16 bp, Homo sapiens
aaggtaaataaaaaga

SEQ ID NO: 5104784 - DNA, 13 bp, Homo sapiens
aaggtaaatacaa

SEQ ID NO: 5104785 - DNA, 14 bp, Homo sapiens
aaggtaaatacaag

SEQ ID NO: 5104786 - DNA, 17 bp, Homo sapiens
aaggtaaatcccacatc

SEQ ID NO: 5104787 - DNA, 12 bp, Homo sapiens
aaggtaaatggt

SEQ ID NO: 5104788 - DNA, 21 bp, Homo sapiens
aaggtaaatggttaaatttta

SEQ ID NO: 5104789 - DNA, 20 bp, Homo sapiens
aaggtaacaagagtatgtgg

SEQ ID NO: 5104790 - DNA, 23 bp, Homo sapiens
aaggtaactactgctaatgttga

SEQ ID NO: 5104791 - DNA, 14 bp, Homo sapiens
aaggtaatctgaaa

SEQ ID NO: 5104792 - DNA, 18 bp, Homo sapiens
aaggtaccaaacaaggaa

SEQ ID NO: 5104793 - DNA, 21 bp, Homo sapiens
aaggtacggtgagactctgag

SEQ ID NO: 5104794 - DNA, 14 bp, Homo sapiens
aaggtactggtgag

SEQ ID NO: 5104795 - DNA, 14 bp, Homo sapiens
aaggtactgtatga

SEQ ID NO: 5104796 - DNA, 15 bp, Homo sapiens
aaggtactgtatgat

SEQ ID NO: 5104797 - DNA, 19 bp, Homo sapiens
aaggtactgtatgatcaaa

SEQ ID NO: 5104798 - DNA, 14 bp, Homo sapiens
aaggtacttggata

SEQ ID NO: 5104799 - DNA, 15 bp, Homo sapiens
aaggtacttttgttt

SEQ ID NO: 5104800 - DNA, 17 bp, Homo sapiens
aaggtagaaatgtctat

SEQ ID NO: 5104801 - DNA, 22 bp, Homo sapiens
aaggtagaacaaagaaaatgtt

SEQ ID NO: 5104802 - DNA, 13 bp, Homo sapiens
aaggtagaatgac

SEQ ID NO: 5104803 - DNA, 19 bp, Homo sapiens
aaggtagaatgaccttgta

SEQ ID NO: 5104804 - DNA, 18 bp, Homo sapiens
aaggtagagatgtgtgtg

SEQ ID NO: 5104805 - DNA, 20 bp, Homo sapiens
aaggtagatcctgagatgat

SEQ ID NO: 5104806 - DNA, 21 bp, Homo sapiens
aaggtagattttaagaatggt

SEQ ID NO: 5104807 - DNA, 18 bp, Homo sapiens
aaggtagcattctttgga

SEQ ID NO: 5104808 - DNA, 12 bp, Homo sapiens
aaggtagctcta

SEQ ID NO: 5104809 - DNA, 20 bp, Homo sapiens
aaggtagcttacctgacaca

SEQ ID NO: 5104810 - DNA, 19 bp, Homo sapiens
aaggtaggaaggtcaaggt

SEQ ID NO: 5104811 - DNA, 22 bp, Homo sapiens
aaggtagggtaggcagcctgag

SEQ ID NO: 5104812 - DNA, 18 bp, Homo sapiens
aaggtaggtgcatgcctt

SEQ ID NO: 5104813 - DNA, 22 bp, Homo sapiens
aaggtagttcaagaaatgaaga

SEQ ID NO: 5104814 - DNA, 14 bp, Homo sapiens
aaggtagtttttct

SEQ ID NO: 5104815 - DNA, 16 bp, Homo sapiens
aaggtataaataataa

SEQ ID NO: 5104816 - DNA, 20 bp, Homo sapiens
aaggtataaggatcttttgt

SEQ ID NO: 5104817 - DNA, 12 bp, Homo sapiens
aaggtataataa

SEQ ID NO: 5104818 - DNA, 16 bp, Homo sapiens
aaggtataataaaatt

SEQ ID NO: 5104819 - DNA, 13 bp, Homo sapiens
aaggtatacctca

SEQ ID NO: 5104820 - DNA, 16 bp, Homo sapiens
aaggtatcacacactt

SEQ ID NO: 5104821 - DNA, 19 bp, Homo sapiens
aaggtatcagttatatgat

SEQ ID NO: 5104822 - DNA, 14 bp, Homo sapiens
aaggtatcttttta

SEQ ID NO: 5104823 - DNA, 21 bp, Homo sapiens
aaggtattaagattataattg

SEQ ID NO: 5104824 - DNA, 15 bp, Homo sapiens
aaggtattagcaaag

SEQ ID NO: 5104825 - DNA, 22 bp, Homo sapiens
aaggtattatacatgtgataca

SEQ ID NO: 5104826 - DNA, 22 bp, Homo sapiens
aaggtattccttgttcttccct

SEQ ID NO: 5104827 - DNA, 22 bp, Homo sapiens
aaggtattctattctaataact

SEQ ID NO: 5104828 - DNA, 19 bp, Homo sapiens
aaggtattgagccattttt

SEQ ID NO: 5104829 - DNA, 23 bp, Homo sapiens
aaggtattgcaaggtcactttgc

SEQ ID NO: 5104830 - DNA, 19 bp, Homo sapiens
aaggtatttaaagtatttt

SEQ ID NO: 5104831 - DNA, 17 bp, Homo sapiens
aaggtatttacacatac

SEQ ID NO: 5104832 - DNA, 17 bp, Homo sapiens
aaggtatttcgaaactg

SEQ ID NO: 5104833 - DNA, 17 bp, Homo sapiens
aaggtatttgggaaact

SEQ ID NO: 5104834 - DNA, 18 bp, Homo sapiens
aaggtattttgtagatgt

SEQ ID NO: 5104835 - DNA, 19 bp, Homo sapiens
aaggtattttgtagatgtg

SEQ ID NO: 5104836 - DNA, 15 bp, Homo sapiens
aaggtcaaacaggct

SEQ ID NO: 5104837 - DNA, 21 bp, Homo sapiens
aaggtcaaactaattctcaca

SEQ ID NO: 5104838 - DNA, 14 bp, Homo sapiens
aaggtcaaatttat

SEQ ID NO: 5104839 - DNA, 17 bp, Homo sapiens
aaggtcaaggaaggaaa

SEQ ID NO: 5104840 - DNA, 17 bp, Homo sapiens
aaggtcacagaagtagt

SEQ ID NO: 5104841 - DNA, 19 bp, Homo sapiens
aaggtcacatagctgggat

SEQ ID NO: 5104842 - DNA, 19 bp, Homo sapiens
aaggtcaccagcaccaaca

SEQ ID NO: 5104843 - DNA, 19 bp, Homo sapiens
aaggtcacctcactcagca

SEQ ID NO: 5104844 - DNA, 22 bp, Homo sapiens
aaggtcacctcactcagcacca

SEQ ID NO: 5104845 - DNA, 16 bp, Homo sapiens
aaggtcactcttggtc

SEQ ID NO: 5104846 - DNA, 14 bp, Homo sapiens
aaggtcactgtttc

SEQ ID NO: 5104847 - DNA, 18 bp, Homo sapiens
aaggtcactgtttcctgg

SEQ ID NO: 5104848 - DNA, 17 bp, Homo sapiens
aaggtcagcgagaagga

SEQ ID NO: 5104849 - DNA, 18 bp, Homo sapiens
aaggtcagcgagaaggag

SEQ ID NO: 5104850 - DNA, 19 bp, Homo sapiens
aaggtcagcgagaaggagt

SEQ ID NO: 5104851 - DNA, 16 bp, Homo sapiens
aaggtcagggacacat

SEQ ID NO: 5104852 - DNA, 22 bp, Homo sapiens
aaggtcatcaaacatttgccaa

SEQ ID NO: 5104853 - DNA, 13 bp, Homo sapiens
aaggtcatcatcg

SEQ ID NO: 5104854 - DNA, 21 bp, Homo sapiens
aaggtcatccaaagaacatct

SEQ ID NO: 5104855 - DNA, 22 bp, Homo sapiens
aaggtcattgtggctatctgca

SEQ ID NO: 5104856 - DNA, 21 bp, Homo sapiens
aaggtccaacaagaatgcatt

SEQ ID NO: 5104857 - DNA, 11 bp, Homo sapiens
aaggtccagtg

SEQ ID NO: 5104858 - DNA, 19 bp, Homo sapiens
aaggtcccacagccctgag

SEQ ID NO: 5104859 - DNA, 19 bp, Homo sapiens
aaggtcccatggcctgctg

SEQ ID NO: 5104860 - DNA, 20 bp, Homo sapiens
aaggtcccatggcctgctgg

SEQ ID NO: 5104861 - DNA, 16 bp, Homo sapiens
aaggtccccagcagaa

SEQ ID NO: 5104862 - DNA, 17 bp, Homo sapiens
aaggtccccagcagaat

SEQ ID NO: 5104863 - DNA, 12 bp, Homo sapiens
aaggtccctggg

SEQ ID NO: 5104864 - DNA, 14 bp, Homo sapiens
aaggtcggaccagc

SEQ ID NO: 5104865 - DNA, 20 bp, Homo sapiens
aaggtcgtttttttcattcc

SEQ ID NO: 5104866 - DNA, 20 bp, Homo sapiens
aaggtctaactgtggaatat

SEQ ID NO: 5104867 - DNA, 15 bp, Homo sapiens
aaggtctataaacat

SEQ ID NO: 5104868 - DNA, 18 bp, Homo sapiens
aaggtctcacactcctcc

SEQ ID NO: 5104869 - DNA, 17 bp, Homo sapiens
aaggtctcatgcctgag

SEQ ID NO: 5104870 - DNA, 21 bp, Homo sapiens
aaggtctcctaaaactgggat

SEQ ID NO: 5104871 - DNA, 19 bp, Homo sapiens
aaggtctccttactctgag

SEQ ID NO: 5104872 - DNA, 20 bp, Homo sapiens
aaggtctccttactctgagc

SEQ ID NO: 5104873 - DNA, 13 bp, Homo sapiens
aaggtctgatttg

SEQ ID NO: 5104874 - DNA, 15 bp, Homo sapiens
aaggagccagtttgc

SEQ ID NO: 5104875 - DNA, 14 bp, Homo sapiens
aaggagcccagaaa

SEQ ID NO: 5104876 - DNA, 19 bp, Homo sapiens
aaggagcccagaaaacctc

SEQ ID NO: 5104877 - DNA, 17 bp, Homo sapiens
aaggagccccattcctg

SEQ ID NO: 5104878 - DNA, 19 bp, Homo sapiens
aaggagccccattcctggg

SEQ ID NO: 5104879 - DNA, 21 bp, Homo sapiens
aaggagccccccaaagacact

SEQ ID NO: 5104880 - DNA, 12 bp, Homo sapiens
aaggagcccctg

SEQ ID NO: 5104881 - DNA, 16 bp, Homo sapiens
aaggagcctaggccag

SEQ ID NO: 5104882 - DNA, 10 bp, Homo sapiens
aaggagcctg

SEQ ID NO: 5104883 - DNA, 11 bp, Homo sapiens
aaggagcctgc

SEQ ID NO: 5104884 - DNA, 18 bp, Homo sapiens
aaggagcctgcggctgct

SEQ ID NO: 5104885 - DNA, 12 bp, Homo sapiens
aaggagcctgtg

SEQ ID NO: 5104886 - DNA, 21 bp, Homo sapiens
aaggagcctgtgaacccagga

SEQ ID NO: 5104887 - DNA, 15 bp, Homo sapiens
aaggagccttgttgg

SEQ ID NO: 5104888 - DNA, 15 bp, Homo sapiens
aaggagcgctagtgc

SEQ ID NO: 5104889 - DNA, 20 bp, Homo sapiens
aaggagcggcgccctggact

SEQ ID NO: 5104890 - DNA, 21 bp, Homo sapiens
aaggagcggcgccctggactt

SEQ ID NO: 5104891 - DNA, 22 bp, Homo sapiens
aaggagcggcgccctggacttg

SEQ ID NO: 5104892 - DNA, 19 bp, Homo sapiens
aaggagctcaccctgcccg

SEQ ID NO: 5104893 - DNA, 21 bp, Homo sapiens
aaggagctcaccctgcccgct

SEQ ID NO: 5104894 - DNA, 22 bp, Homo sapiens
aaggagctcactgtggtgtctg

SEQ ID NO: 5104895 - DNA, 23 bp, Homo sapiens
aaggagctgagaatagaaggaaa

SEQ ID NO: 5104896 - DNA, 20 bp, Homo sapiens
aaggagctgatttccaggcc

SEQ ID NO: 5104897 - DNA, 21 bp, Homo sapiens
aaggagctgatttccaggccc

SEQ ID NO: 5104898 - DNA, 12 bp, Homo sapiens
aaggagctgcct

SEQ ID NO: 5104899 - DNA, 12 bp, Homo sapiens
aaggagctgcta

SEQ ID NO: 5104900 - DNA, 11 bp, Homo sapiens
aaggagctggg

SEQ ID NO: 5104901 - DNA, 14 bp, Homo sapiens
aaggagctttctca

SEQ ID NO: 5104902 - DNA, 17 bp, Homo sapiens
aaggagctttcttgttt

SEQ ID NO: 5104903 - DNA, 16 bp, Homo sapiens
aaggagctttgctctt

SEQ ID NO: 5104904 - DNA, 19 bp, Homo sapiens
aaggaggaaataactaaga

SEQ ID NO: 5104905 - DNA, 18 bp, Homo sapiens
aaggaggaaatgtggaaa

SEQ ID NO: 5104906 - DNA, 16 bp, Homo sapiens
aaggaggaaggagcct

SEQ ID NO: 5104907 - DNA, 20 bp, Homo sapiens
aaggaggacaagaccctctc

SEQ ID NO: 5104908 - DNA, 21 bp, Homo sapiens
aaggaggaccagtcaggatga

SEQ ID NO: 5104909 - DNA, 10 bp, Homo sapiens
aaggaggaga

SEQ ID NO: 5104910 - DNA, 12 bp, Homo sapiens
aaggaggagaaa

SEQ ID NO: 5104911 - DNA, 21 bp, Homo sapiens
aaggaggagagagaggggaag

SEQ ID NO: 5104912 - DNA, 19 bp, Homo sapiens
aaggaggaggagggagaag

SEQ ID NO: 5104913 - DNA, 20 bp, Homo sapiens
aaggaggaggagtcagatga

SEQ ID NO: 5104914 - DNA, 20 bp, Homo sapiens
aaggaggaggtgtctggggt

SEQ ID NO: 5104915 - DNA, 23 bp, Homo sapiens
aaggaggatggcatataatacaa

SEQ ID NO: 5104916 - DNA, 18 bp, Homo sapiens
aaggaggcatgcctctga

SEQ ID NO: 5104917 - DNA, 20 bp, Homo sapiens
aaggaggcatgcctctgata

SEQ ID NO: 5104918 - DNA, 18 bp, Homo sapiens
aaggaggccaaccagccc

SEQ ID NO: 5104919 - DNA, 21 bp, Homo sapiens
aaggaggccctgttccctgga

SEQ ID NO: 5104920 - DNA, 20 bp, Homo sapiens
aaggaggcctggggaggccc

SEQ ID NO: 5104921 - DNA, 13 bp, Homo sapiens
aaggaggctggct

SEQ ID NO: 5104922 - DNA, 17 bp, Homo sapiens
aaggagggaaggattta

SEQ ID NO: 5104923 - DNA, 11 bp, Homo sapiens
aaggagggaga

SEQ ID NO: 5104924 - DNA, 13 bp, Homo sapiens
aaggagggagaaa

SEQ ID NO: 5104925 - DNA, 20 bp, Homo sapiens
aaggagggatgcgtgttcca

SEQ ID NO: 5104926 - DNA, 14 bp, Homo sapiens
aaggagggcagagc

SEQ ID NO: 5104927 - DNA, 19 bp, Homo sapiens
aaggagggcagagccatgg

SEQ ID NO: 5104928 - DNA, 15 bp, Homo sapiens
aaggagggcctcaga

SEQ ID NO: 5104929 - DNA, 21 bp, Homo sapiens
aaggagggcctcagagacagc

SEQ ID NO: 5104930 - DNA, 17 bp, Homo sapiens
aaggaggggaaaaaaat

SEQ ID NO: 5104931 - DNA, 19 bp, Homo sapiens
aaggaggggaaaaaaatgt

SEQ ID NO: 5104932 - DNA, 18 bp, Homo sapiens
aaggaggggaaacaatga

SEQ ID NO: 5104933 - DNA, 21 bp, Homo sapiens
aaggaggggaaacaatgaaaa

SEQ ID NO: 5104934 - DNA, 18 bp, Homo sapiens
aaggaggggaagctgcag

SEQ ID NO: 5104935 - DNA, 15 bp, Homo sapiens
aaggaggggacggga

SEQ ID NO: 5104936 - DNA, 21 bp, Homo sapiens
aaggaggggagagacaggcag

SEQ ID NO: 5104937 - DNA, 11 bp, Homo sapiens
aaggagggggc

SEQ ID NO: 5104938 - DNA, 15 bp, Homo sapiens
aaggaggggtacatt

SEQ ID NO: 5104939 - DNA, 21 bp, Homo sapiens
aaggagggtggatcacctgag

SEQ ID NO: 5104940 - DNA, 18 bp, Homo sapiens
aaggaggtagctcccagc

SEQ ID NO: 5104941 - DNA, 19 bp, Homo sapiens
aaggaggtgagggatgtga

SEQ ID NO: 5104942 - DNA, 14 bp, Homo sapiens
aaggaggtggctgt

SEQ ID NO: 5104943 - DNA, 18 bp, Homo sapiens
aaggaggtgggccacacc

SEQ ID NO: 5104944 - DNA, 20 bp, Homo sapiens
aaggaggtgggccacaccca

SEQ ID NO: 5104945 - DNA, 15 bp, Homo sapiens
aaggagtaagaacct

SEQ ID NO: 5104946 - DNA, 18 bp, Homo sapiens
aaggagtaatctgtgtac

SEQ ID NO: 5104947 - DNA, 19 bp, Homo sapiens
aaggagtaatctgtgtaca

SEQ ID NO: 5104948 - DNA, 17 bp, Homo sapiens
aaggagtagtattttgg

SEQ ID NO: 5104949 - DNA, 20 bp, Homo sapiens
aaggagtcagacattttaag

SEQ ID NO: 5104950 - DNA, 18 bp, Homo sapiens
aaggagtggccacagcac

SEQ ID NO: 5104951 - DNA, 15 bp, Homo sapiens
aaggagtgtaaaatg

SEQ ID NO: 5104952 - DNA, 19 bp, Homo sapiens
aaggagtgtagcaactaca

SEQ ID NO: 5104953 - DNA, 16 bp, Homo sapiens
aaggagttacagggaa

SEQ ID NO: 5104954 - DNA, 18 bp, Homo sapiens
aaggagttagaaccacag

SEQ ID NO: 5104955 - DNA, 13 bp, Homo sapiens
aaggagtttatgt

SEQ ID NO: 5104956 - DNA, 13 bp, Homo sapiens
aaggagttttttt

SEQ ID NO: 5104957 - DNA, 21 bp, Homo sapiens
aaggataaagttggtaaacct

SEQ ID NO: 5104958 - DNA, 20 bp, Homo sapiens
aaggataatgaaataatcag

SEQ ID NO: 5104959 - DNA, 17 bp, Homo sapiens
aaggatacacttatttg

SEQ ID NO: 5104960 - DNA, 17 bp, Homo sapiens
aaggatacccggtggct

SEQ ID NO: 5104961 - DNA, 17 bp, Homo sapiens
aaggataccttcttatt

SEQ ID NO: 5104962 - DNA, 19 bp, Homo sapiens
aaggataccttcttattta

SEQ ID NO: 5104963 - DNA, 19 bp, Homo sapiens
aaggatagatgctggccca

SEQ ID NO: 5104964 - DNA, 17 bp, Homo sapiens
aaggatagcctcagcca

SEQ ID NO: 5104965 - DNA, 13 bp, Homo sapiens
aaggatagccttt

SEQ ID NO: 5104966 - DNA, 15 bp, Homo sapiens
aaggatagtaagcat

SEQ ID NO: 5104967 - DNA, 20 bp, Homo sapiens
aaggatagtgcgatgtttca

SEQ ID NO: 5104968 - DNA, 17 bp, Homo sapiens
aaggatagtgtgaagat

SEQ ID NO: 5104969 - DNA, 16 bp, Homo sapiens
aaggatatactgcagc

SEQ ID NO: 5104970 - DNA, 16 bp, Homo sapiens
aaggatatcagagctg

SEQ ID NO: 5104971 - DNA, 20 bp, Homo sapiens
aaggatatgaaactctacat

SEQ ID NO: 5104972 - DNA, 22 bp, Homo sapiens
aaggatatttactacttttgca

SEQ ID NO: 5104973 - DNA, 12 bp, Homo sapiens
aaggatcacaga

SEQ ID NO: 5104974 - DNA, 16 bp, Homo sapiens
aaggatcaccccagcc

SEQ ID NO: 5104975 - DNA, 15 bp, Homo sapiens
aaggatcagaatgga

SEQ ID NO: 5104976 - DNA, 17 bp, Homo sapiens
aaggatccaggaatatg

SEQ ID NO: 5104977 - DNA, 18 bp, Homo sapiens
aaggatcctctccactcc

SEQ ID NO: 5104978 - DNA, 15 bp, Homo sapiens
aaggatcctgagcca

SEQ ID NO: 5104979 - DNA, 17 bp, Homo sapiens
aaggatcctgagccaga

SEQ ID NO: 5104980 - DNA, 18 bp, Homo sapiens
aaggatcggactctgccc

SEQ ID NO: 5104981 - DNA, 20 bp, Homo sapiens
aaggatctctcaggagcaca

SEQ ID NO: 5104982 - DNA, 19 bp, Homo sapiens
aaggatctctgaaacatat

SEQ ID NO: 5104983 - DNA, 13 bp, Homo sapiens
aaggatctgctga

SEQ ID NO: 5104984 - DNA, 16 bp, Homo sapiens
aaggatctgctgaggc

SEQ ID NO: 5104985 - DNA, 18 bp, Homo sapiens
aaggatctgtgattggct

SEQ ID NO: 5104986 - DNA, 15 bp, Homo sapiens
aaggatctgttttta

SEQ ID NO: 5104987 - DNA, 12 bp, Homo sapiens
aaggatctttca

SEQ ID NO: 5104988 - DNA, 22 bp, Homo sapiens
aaggatctttcacccacagaaa

SEQ ID NO: 5104989 - DNA, 17 bp, Homo sapiens
aaggatctttgttcctc

SEQ ID NO: 5104990 - DNA, 24 bp, Homo sapiens
aaggatcttttggacctggctaat

SEQ ID NO: 5104991 - DNA, 15 bp, Homo sapiens
aaggatcttttgtaa

SEQ ID NO: 5104992 - DNA, 17 bp, Homo sapiens
aaggatcttttgtaaat

SEQ ID NO: 5104993 - DNA, 19 bp, Homo sapiens
aaggatgaagaacacagca

SEQ ID NO: 5104994 - DNA, 22 bp, Homo sapiens
aaggatgaagaacacagcatgt

SEQ ID NO: 5104995 - DNA, 19 bp, Homo sapiens
aaggatgaataagttttat

SEQ ID NO: 5104996 - DNA, 23 bp, Homo sapiens
aaggatgaatgaggtcccaggca

SEQ ID NO: 5104997 - DNA, 11 bp, Homo sapiens
aaggatgactt

SEQ ID NO: 5104998 - DNA, 19 bp, Homo sapiens
aaggatgacttttttatac

SEQ ID NO: 5104999 - DNA, 19 bp, Homo sapiens
aaggatgagaatgtgacct

SEQ ID NO: 5105000 - DNA, 21 bp, Homo sapiens
aaggatgagatttttcatgta

SEQ ID NO: 5105001 - DNA, 14 bp, Homo sapiens
aaggatgagcagag

SEQ ID NO: 5105002 - DNA, 18 bp, Homo sapiens
aaggatgatctaggaaga

SEQ ID NO: 5105003 - DNA, 19 bp, Homo sapiens
aaggatgatggaaaaatca

SEQ ID NO: 5105004 - DNA, 19 bp, Homo sapiens
aaggatgatgtctttttat

SEQ ID NO: 5105005 - DNA, 18 bp, Homo sapiens
aaggatgcacagagttgt

SEQ ID NO: 5105006 - DNA, 24 bp, Homo sapiens
aaggatgcacagagttgttacatt

SEQ ID NO: 5105007 - DNA, 16 bp, Homo sapiens
aaggatgccacttggg

SEQ ID NO: 5105008 - DNA, 15 bp, Homo sapiens
aaggatggaagaaag

SEQ ID NO: 5105009 - DNA, 17 bp, Homo sapiens
aaggatggaagaaagaa

SEQ ID NO: 5105010 - DNA, 14 bp, Homo sapiens
aaggatggatggca

SEQ ID NO: 5105011 - DNA, 15 bp, Homo sapiens
aaggatggatggcac

SEQ ID NO: 5105012 - DNA, 17 bp, Homo sapiens
aaggatggatggcaccc

SEQ ID NO: 5105013 - DNA, 18 bp, Homo sapiens
aaggatggatggcaccct

SEQ ID NO: 5105014 - DNA, 19 bp, Homo sapiens
aaggatggcagcctcaggg

SEQ ID NO: 5105015 - DNA, 20 bp, Homo sapiens
aaggatgggaaaaactgcag

SEQ ID NO: 5105016 - DNA, 22 bp, Homo sapiens
aaggatgggggctcctggcagt

SEQ ID NO: 5105017 - DNA, 16 bp, Homo sapiens
aaggatggttagacag

SEQ ID NO: 5105018 - DNA, 20 bp, Homo sapiens
aaggatgtaaacagtgcctg

SEQ ID NO: 5105019 - DNA, 23 bp, Homo sapiens
aaggatgtaaacagtgcctgctg

SEQ ID NO: 5105020 - DNA, 15 bp, Homo sapiens
aaggatgtacatttc

SEQ ID NO: 5105021 - DNA, 23 bp, Homo sapiens
aaggatgtagcttttcaccttta

SEQ ID NO: 5105022 - DNA, 15 bp, Homo sapiens
aaggatgtgattgtg

SEQ ID NO: 5105023 - DNA, 10 bp, Homo sapiens
aaggatgtgt

SEQ ID NO: 5105024 - DNA, 20 bp, Homo sapiens
aaggatgtgttttcagtctt

SEQ ID NO: 5105025 - DNA, 22 bp, Homo sapiens
aaggatgttacaagtttgctaa

SEQ ID NO: 5105026 - DNA, 15 bp, Homo sapiens
aaggatgttctagca

SEQ ID NO: 5105027 - DNA, 18 bp, Homo sapiens
aaggatgtttagcagtgg

SEQ ID NO: 5105028 - DNA, 19 bp, Homo sapiens
aaggatgtttagcagtggc

SEQ ID NO: 5105029 - DNA, 21 bp, Homo sapiens
aaggatgtttagcagtggctg

SEQ ID NO: 5105030 - DNA, 19 bp, Homo sapiens
aaggatgttttgtcccatt

SEQ ID NO: 5105031 - DNA, 14 bp, Homo sapiens
aaggatgtttttaa

SEQ ID NO: 5105032 - DNA, 16 bp, Homo sapiens
aaggatgtttttaatg

SEQ ID NO: 5105033 - DNA, 12 bp, Homo sapiens
aaggattacaga

SEQ ID NO: 5105034 - DNA, 16 bp, Homo sapiens
aaggattacagaaact

SEQ ID NO: 5105035 - DNA, 17 bp, Homo sapiens
aaggattacagaaactg

SEQ ID NO: 5105036 - DNA, 18 bp, Homo sapiens
aaggattacagaaactga

SEQ ID NO: 5105037 - DNA, 23 bp, Homo sapiens
aaggattacagaaactgatgcca

SEQ ID NO: 5105038 - DNA, 16 bp, Homo sapiens
aaggattatggaaaaa

SEQ ID NO: 5105039 - DNA, 20 bp, Homo sapiens
aaggattattactaattcta

SEQ ID NO: 5105040 - DNA, 22 bp, Homo sapiens
aaggattcagcaccagttatgt

SEQ ID NO: 5105041 - DNA, 21 bp, Homo sapiens
aaggattcagtggaggctggc

SEQ ID NO: 5105042 - DNA, 20 bp, Homo sapiens
aaggattctgaagttttatt

SEQ ID NO: 5105043 - DNA, 13 bp, Homo sapiens
aaggattctgcag

SEQ ID NO: 5105044 - DNA, 20 bp, Homo sapiens
aaggattctgggaatcatgt

SEQ ID NO: 5105045 - DNA, 21 bp, Homo sapiens
aaggattcttttttcaatgta

SEQ ID NO: 5105046 - DNA, 21 bp, Homo sapiens
aaggattgatcactttgttaa

SEQ ID NO: 5105047 - DNA, 16 bp, Homo sapiens
aaggattgcatcctgc

SEQ ID NO: 5105048 - DNA, 22 bp, Homo sapiens
aaggattgttgggcttggggga

SEQ ID NO: 5105049 - DNA, 16 bp, Homo sapiens
aaggatttattctcag

SEQ ID NO: 5105050 - DNA, 17 bp, Homo sapiens
aaggatttattctcaga

SEQ ID NO: 5105051 - DNA, 20 bp, Homo sapiens
aaggatttattctcagaaca

SEQ ID NO: 5105052 - DNA, 15 bp, Homo sapiens
aaggtctgatttgca

SEQ ID NO: 5105053 - DNA, 23 bp, Homo sapiens
aaggtctggagaagctcccagga

SEQ ID NO: 5105054 - DNA, 20 bp, Homo sapiens
aaggtctgggagtgttctgt

SEQ ID NO: 5105055 - DNA, 14 bp, Homo sapiens
aaggtctgttttga

SEQ ID NO: 5105056 - DNA, 20 bp, Homo sapiens
aaggtctgttttgtgtactt

SEQ ID NO: 5105057 - DNA, 23 bp, Homo sapiens
aaggtctgttttgtgtactttta

SEQ ID NO: 5105058 - DNA, 21 bp, Homo sapiens
aaggtcttgcagtggcttttc

SEQ ID NO: 5105059 - DNA, 12 bp, Homo sapiens
aaggtctttgta

SEQ ID NO: 5105060 - DNA, 13 bp, Homo sapiens
aaggtctttgtaa

SEQ ID NO: 5105061 - DNA, 19 bp, Homo sapiens
aaggtcttttgagggctaa

SEQ ID NO: 5105062 - DNA, 20 bp, Homo sapiens
aaggtgaaaattgtataaat

SEQ ID NO: 5105063 - DNA, 15 bp, Homo sapiens
aaggtgaaacacaca

SEQ ID NO: 5105064 - DNA, 12 bp, Homo sapiens
aaggtgaaacag

SEQ ID NO: 5105065 - DNA, 14 bp, Homo sapiens
aaggtgaactttgt

SEQ ID NO: 5105066 - DNA, 21 bp, Homo sapiens
aaggtgaagatgaagaagcct

SEQ ID NO: 5105067 - DNA, 23 bp, Homo sapiens
aaggtgaagcacatacggcagac

SEQ ID NO: 5105068 - DNA, 16 bp, Homo sapiens
aaggtgaaggaatata

SEQ ID NO: 5105069 - DNA, 18 bp, Homo sapiens
aaggtgaaggaatatatg

SEQ ID NO: 5105070 - DNA, 19 bp, Homo sapiens
aaggtgaagtgaggacaaa

SEQ ID NO: 5105071 - DNA, 15 bp, Homo sapiens
aaggtgaatagccat

SEQ ID NO: 5105072 - DNA, 20 bp, Homo sapiens
aaggtgacatcggaaaaata

SEQ ID NO: 5105073 - DNA, 21 bp, Homo sapiens
aaggtgacatcggaaaaataa

SEQ ID NO: 5105074 - DNA, 17 bp, Homo sapiens
aaggtgacccaatgatt

SEQ ID NO: 5105075 - DNA, 23 bp, Homo sapiens
aaggtgactcgagtgtttaaatg

SEQ ID NO: 5105076 - DNA, 19 bp, Homo sapiens
aaggtgagaggaaatgttg

SEQ ID NO: 5105077 - DNA, 17 bp, Homo sapiens
aaggtgagcataaatca

SEQ ID NO: 5105078 - DNA, 22 bp, Homo sapiens
aaggtgaggagggcagtccaag

SEQ ID NO: 5105079 - DNA, 18 bp, Homo sapiens
aaggtgaggcctgtctgt

SEQ ID NO: 5105080 - DNA, 21 bp, Homo sapiens
aaggtgaggcctgtctgtgac

SEQ ID NO: 5105081 - DNA, 22 bp, Homo sapiens
aaggtgaggcctgtctgtgacc

SEQ ID NO: 5105082 - DNA, 13 bp, Homo sapiens
aaggtgaggtgaa

SEQ ID NO: 5105083 - DNA, 20 bp, Homo sapiens
aaggtgagtttgagctgcct

SEQ ID NO: 5105084 - DNA, 23 bp, Homo sapiens
aaggtgatatataatttcctcac

SEQ ID NO: 5105085 - DNA, 17 bp, Homo sapiens
aaggtgatatatttaaa

SEQ ID NO: 5105086 - DNA, 19 bp, Homo sapiens
aaggtgatttcagactgca

SEQ ID NO: 5105087 - DNA, 21 bp, Homo sapiens
aaggtgattttcctgtgtcca

SEQ ID NO: 5105088 - DNA, 13 bp, Homo sapiens
aaggtgcactcca

SEQ ID NO: 5105089 - DNA, 14 bp, Homo sapiens
aaggtgcactccag

SEQ ID NO: 5105090 - DNA, 22 bp, Homo sapiens
aaggtgcactccagactctggg

SEQ ID NO: 5105091 - DNA, 21 bp, Homo sapiens
aaggtgcatatagaaaacaaa

SEQ ID NO: 5105092 - DNA, 16 bp, Homo sapiens
aaggtgccagaaggaa

SEQ ID NO: 5105093 - DNA, 17 bp, Homo sapiens
aaggtgccatggaagag

SEQ ID NO: 5105094 - DNA, 14 bp, Homo sapiens
aaggtgccatgtct

SEQ ID NO: 5105095 - DNA, 20 bp, Homo sapiens
aaggtgccgtgagcaggctt

SEQ ID NO: 5105096 - DNA, 20 bp, Homo sapiens
aaggtgcctcagttttcctt

SEQ ID NO: 5105097 - DNA, 18 bp, Homo sapiens
aaggtgcctgtgaggcag

SEQ ID NO: 5105098 - DNA, 15 bp, Homo sapiens
aaggtgctaaatctg

SEQ ID NO: 5105099 - DNA, 22 bp, Homo sapiens
aaggtgctacggtagtgatgaa

SEQ ID NO: 5105100 - DNA, 20 bp, Homo sapiens
aaggtgctatataattgtga

SEQ ID NO: 5105101 - DNA, 17 bp, Homo sapiens
aaggtgctcaaagatgt

SEQ ID NO: 5105102 - DNA, 14 bp, Homo sapiens
aaggtgctctgtgt

SEQ ID NO: 5105103 - DNA, 13 bp, Homo sapiens
aaggtgctgagct

SEQ ID NO: 5105104 - DNA, 18 bp, Homo sapiens
aaggtgctgatggccctc

SEQ ID NO: 5105105 - DNA, 20 bp, Homo sapiens
aaggtgctggaggtgggagc

SEQ ID NO: 5105106 - DNA, 23 bp, Homo sapiens
aaggtgctggtgggtctgagctg

SEQ ID NO: 5105107 - DNA, 19 bp, Homo sapiens
aaggtgcttgggcttctgc

SEQ ID NO: 5105108 - DNA, 15 bp, Homo sapiens
aaggtgcttgttatg

SEQ ID NO: 5105109 - DNA, 14 bp, Homo sapiens
aaggtgctttctcc

SEQ ID NO: 5105110 - DNA, 22 bp, Homo sapiens
aaggtggaaagtgttcattgca

SEQ ID NO: 5105111 - DNA, 22 bp, Homo sapiens
aaggtggaccttttaaagtgtt

SEQ ID NO: 5105112 - DNA, 15 bp, Homo sapiens
aaggtggagggaagg

SEQ ID NO: 5105113 - DNA, 20 bp, Homo sapiens
aaggtggagggaaggataaa

SEQ ID NO: 5105114 - DNA, 14 bp, Homo sapiens
aaggtggcatagcc

SEQ ID NO: 5105115 - DNA, 23 bp, Homo sapiens
aaggtggcatccgaaggtgtctc

SEQ ID NO: 5105116 - DNA, 14 bp, Homo sapiens
aaggtggccacagc

SEQ ID NO: 5105117 - DNA, 18 bp, Homo sapiens
aaggtggcctctgcctgg

SEQ ID NO: 5105118 - DNA, 19 bp, Homo sapiens
aaggtggcctctgcctggg

SEQ ID NO: 5105119 - DNA, 20 bp, Homo sapiens
aaggtgggaaaaaaaaaagt

SEQ ID NO: 5105120 - DNA, 17 bp, Homo sapiens
aaggtgggccttgctac

SEQ ID NO: 5105121 - DNA, 19 bp, Homo sapiens
aaggtgggctgagccctgg

SEQ ID NO: 5105122 - DNA, 20 bp, Homo sapiens
aaggtgggctgagccctggc

SEQ ID NO: 5105123 - DNA, 21 bp, Homo sapiens
aaggtgggctgagccctggca

SEQ ID NO: 5105124 - DNA, 20 bp, Homo sapiens
aaggtggggacctgggggga

SEQ ID NO: 5105125 - DNA, 16 bp, Homo sapiens
aaggtggggagaaggg

SEQ ID NO: 5105126 - DNA, 19 bp, Homo sapiens
aaggtggggccctgcccct

SEQ ID NO: 5105127 - DNA, 18 bp, Homo sapiens
aaggtgggggagcctgga

SEQ ID NO: 5105128 - DNA, 22 bp, Homo sapiens
aaggtgggggttggctgggtac

SEQ ID NO: 5105129 - DNA, 19 bp, Homo sapiens
aaggtgggtgaggctgggc

SEQ ID NO: 5105130 - DNA, 21 bp, Homo sapiens
aaggtgggttccagggactgt

SEQ ID NO: 5105131 - DNA, 19 bp, Homo sapiens
aaggtggtaaattcagaca

SEQ ID NO: 5105132 - DNA, 21 bp, Homo sapiens
aaggtggtatggttgtataca

SEQ ID NO: 5105133 - DNA, 14 bp, Homo sapiens
aaggtggtctgcac

SEQ ID NO: 5105134 - DNA, 23 bp, Homo sapiens
aaggtggtctgcaccccacagga

SEQ ID NO: 5105135 - DNA, 22 bp, Homo sapiens
aaggtggtctgctcgggcccag

SEQ ID NO: 5105136 - DNA, 20 bp, Homo sapiens
aaggtggtcttggagaggag

SEQ ID NO: 5105137 - DNA, 20 bp, Homo sapiens
aaggtggtggggctgccgga

SEQ ID NO: 5105138 - DNA, 15 bp, Homo sapiens
aaggtggtggtggtg

SEQ ID NO: 5105139 - DNA, 13 bp, Homo sapiens
aaggtgtaaaaca

SEQ ID NO: 5105140 - DNA, 17 bp, Homo sapiens
aaggtgtaaaatatcta

SEQ ID NO: 5105141 - DNA, 12 bp, Homo sapiens
aaggtgtattta

SEQ ID NO: 5105142 - DNA, 17 bp, Homo sapiens
aaggtgtcatttgacaa

SEQ ID NO: 5105143 - DNA, 16 bp, Homo sapiens
aaggtgtcctacagaa

SEQ ID NO: 5105144 - DNA, 15 bp, Homo sapiens
aaggtgtccttttcc

SEQ ID NO: 5105145 - DNA, 17 bp, Homo sapiens
aaggtgtccttttcctt

SEQ ID NO: 5105146 - DNA, 19 bp, Homo sapiens
aaggtgtcttttccactcc

SEQ ID NO: 5105147 - DNA, 18 bp, Homo sapiens
aaggtgtgctagaacaag

SEQ ID NO: 5105148 - DNA, 19 bp, Homo sapiens
aaggtgtggaggctcctgt

SEQ ID NO: 5105149 - DNA, 22 bp, Homo sapiens
aaggtgttcattcacttgcatt

SEQ ID NO: 5105150 - DNA, 16 bp, Homo sapiens
aaggtgttggacaggg

SEQ ID NO: 5105151 - DNA, 20 bp, Homo sapiens
aaggtgttgttaaaacacaa

SEQ ID NO: 5105152 - DNA, 17 bp, Homo sapiens
aaggtgtttaagtaatt

SEQ ID NO: 5105153 - DNA, 22 bp, Homo sapiens
aaggtgtttaagtaattgccag

SEQ ID NO: 5105154 - DNA, 20 bp, Homo sapiens
aaggtgtttgaaaatagttt

SEQ ID NO: 5105155 - DNA, 21 bp, Homo sapiens
aaggtgtttgaaaatagttta

SEQ ID NO: 5105156 - DNA, 18 bp, Homo sapiens
aaggtgttttctgtgtaa

SEQ ID NO: 5105157 - DNA, 12 bp, Homo sapiens
aaggttaaattg

SEQ ID NO: 5105158 - DNA, 14 bp, Homo sapiens
aaggttaacagtaa

SEQ ID NO: 5105159 - DNA, 18 bp, Homo sapiens
aaggttaacagtaaaaat

SEQ ID NO: 5105160 - DNA, 19 bp, Homo sapiens
aaggttaacagtaaaaatt

SEQ ID NO: 5105161 - DNA, 21 bp, Homo sapiens
aaggttaacagtaaaaatttc

SEQ ID NO: 5105162 - DNA, 16 bp, Homo sapiens
aaggttaagccctgag

SEQ ID NO: 5105163 - DNA, 18 bp, Homo sapiens
aaggttaccaagaagcct

SEQ ID NO: 5105164 - DNA, 21 bp, Homo sapiens
aaggttactcagcagcagaga

SEQ ID NO: 5105165 - DNA, 23 bp, Homo sapiens
aaggttactgggagtgtgggctg

SEQ ID NO: 5105166 - DNA, 18 bp, Homo sapiens
aaggttagagaataaatt

SEQ ID NO: 5105167 - DNA, 14 bp, Homo sapiens
aaggttagaggttt

SEQ ID NO: 5105168 - DNA, 15 bp, Homo sapiens
aaggttagaggtttg

SEQ ID NO: 5105169 - DNA, 18 bp, Homo sapiens
aaggttaggtttgtcaac

SEQ ID NO: 5105170 - DNA, 22 bp, Homo sapiens
aaggttatagtaacatcaaaga

SEQ ID NO: 5105171 - DNA, 17 bp, Homo sapiens
aaggttatgttcatttt

SEQ ID NO: 5105172 - DNA, 19 bp, Homo sapiens
aaggttccaactgtatata

SEQ ID NO: 5105173 - DNA, 21 bp, Homo sapiens
aaggttccacagagtaagaca

SEQ ID NO: 5105174 - DNA, 17 bp, Homo sapiens
aaggttccagaggccct

SEQ ID NO: 5105175 - DNA, 15 bp, Homo sapiens
aaggttcccttgtgg

SEQ ID NO: 5105176 - DNA, 13 bp, Homo sapiens
aaggttctaggtt

SEQ ID NO: 5105177 - DNA, 19 bp, Homo sapiens
aaggttctatgatatacaa

SEQ ID NO: 5105178 - DNA, 17 bp, Homo sapiens
aaggttctcataggaaa

SEQ ID NO: 5105179 - DNA, 13 bp, Homo sapiens
aaggttctggtaa

SEQ ID NO: 5105180 - DNA, 22 bp, Homo sapiens
aaggttcttcttgggagtatgt

SEQ ID NO: 5105181 - DNA, 17 bp, Homo sapiens
aaggttgactcaagttt

SEQ ID NO: 5105182 - DNA, 13 bp, Homo sapiens
aaggttgcagtgc

SEQ ID NO: 5105183 - DNA, 19 bp, Homo sapiens
aaggttggaactgctgcca

SEQ ID NO: 5105184 - DNA, 21 bp, Homo sapiens
aaggttggaactgctgccatg

SEQ ID NO: 5105185 - DNA, 16 bp, Homo sapiens
aaggttggagcccagg

SEQ ID NO: 5105186 - DNA, 17 bp, Homo sapiens
aaggttggagcccaggg

SEQ ID NO: 5105187 - DNA, 19 bp, Homo sapiens
aaggttggcgactgtcatg

SEQ ID NO: 5105188 - DNA, 16 bp, Homo sapiens
aaggttggtggggggt

SEQ ID NO: 5105189 - DNA, 13 bp, Homo sapiens
aaggttgtattgc

SEQ ID NO: 5105190 - DNA, 16 bp, Homo sapiens
aaggtttaaagtttga

SEQ ID NO: 5105191 - DNA, 19 bp, Homo sapiens
aaggtttaaagtttgaaga

SEQ ID NO: 5105192 - DNA, 21 bp, Homo sapiens
aaggtttacaatttacaaagt

SEQ ID NO: 5105193 - DNA, 15 bp, Homo sapiens
aaggtttaggctggt

SEQ ID NO: 5105194 - DNA, 14 bp, Homo sapiens
aaggtttataaagc

SEQ ID NO: 5105195 - DNA, 21 bp, Homo sapiens
aaggtttcaacaaatttcatt

SEQ ID NO: 5105196 - DNA, 23 bp, Homo sapiens
aaggtttcaacaaatttcattgc

SEQ ID NO: 5105197 - DNA, 13 bp, Homo sapiens
aaggtttcaatgc

SEQ ID NO: 5105198 - DNA, 16 bp, Homo sapiens
aaggtttcactgttca

SEQ ID NO: 5105199 - DNA, 23 bp, Homo sapiens
aaggtttcagaaagaagtgggga

SEQ ID NO: 5105200 - DNA, 16 bp, Homo sapiens
aaggtttcagatgagg

SEQ ID NO: 5105201 - DNA, 17 bp, Homo sapiens
aaggtttcagatgaggt

SEQ ID NO: 5105202 - DNA, 18 bp, Homo sapiens
aaggtttcccaaaacaat

SEQ ID NO: 5105203 - DNA, 23 bp, Homo sapiens
aaggtttcccagtgagcctctgc

SEQ ID NO: 5105204 - DNA, 12 bp, Homo sapiens
aaggtttgcaaa

SEQ ID NO: 5105205 - DNA, 16 bp, Homo sapiens
aaggtttgcaaattaa

SEQ ID NO: 5105206 - DNA, 21 bp, Homo sapiens
aaggtttgcagatattctcta

SEQ ID NO: 5105207 - DNA, 19 bp, Homo sapiens
aaggtttggaaggagcaga

SEQ ID NO: 5105208 - DNA, 18 bp, Homo sapiens
aaggtttggtccagcctg

SEQ ID NO: 5105209 - DNA, 20 bp, Homo sapiens
aaggtttgttttccatccat

SEQ ID NO: 5105210 - DNA, 23 bp, Homo sapiens
aaggttttaatttagtaaaccaa

SEQ ID NO: 5105211 - DNA, 16 bp, Homo sapiens
aaggttttaggttcta

SEQ ID NO: 5105212 - DNA, 20 bp, Homo sapiens
aaggttttaggttctaaagt

SEQ ID NO: 5105213 - DNA, 15 bp, Homo sapiens
aaggttttattttgt

SEQ ID NO: 5105214 - DNA, 16 bp, Homo sapiens
aaggttttattttgta

SEQ ID NO: 5105215 - DNA, 15 bp, Homo sapiens
aaggttttcatttgc

SEQ ID NO: 5105216 - DNA, 14 bp, Homo sapiens
aaggttttctccac

SEQ ID NO: 5105217 - DNA, 22 bp, Homo sapiens
aaggttttggatcttgaatgtg

SEQ ID NO: 5105218 - DNA, 12 bp, Homo sapiens
aaggttttgtct

SEQ ID NO: 5105219 - DNA, 20 bp, Homo sapiens
aaggtttttaaattgtttca

SEQ ID NO: 5105220 - DNA, 18 bp, Homo sapiens
aaggtttttgtaaagatt

SEQ ID NO: 5105221 - DNA, 22 bp, Homo sapiens
aaggttttttttttaagtgcaa

SEQ ID NO: 5105222 - DNA, 11 bp, Homo sapiens
aagtaaaaaca

SEQ ID NO: 5105223 - DNA, 20 bp, Homo sapiens
aagtaaaaacaaagaaatta

SEQ ID NO: 5105224 - DNA, 15 bp, Homo sapiens
aagtaaaaatattaa

SEQ ID NO: 5105225 - DNA, 16 bp, Homo sapiens
aagtaaaaattgaact

SEQ ID NO: 5105226 - DNA, 22 bp, Homo sapiens
aagtaaaaattgaactgtaaac

SEQ ID NO: 5105227 - DNA, 16 bp, Homo sapiens
aagtaaaacaatacat

SEQ ID NO: 5105228 - DNA, 15 bp, Homo sapiens
aaggatttcttattt

SEQ ID NO: 5105229 - DNA, 12 bp, Homo sapiens
aaggatttgaaa

SEQ ID NO: 5105230 - DNA, 17 bp, Homo sapiens
aaggatttgaaaacacc

SEQ ID NO: 5105231 - DNA, 13 bp, Homo sapiens
aaggattttacca

SEQ ID NO: 5105232 - DNA, 17 bp, Homo sapiens
aaggattttaccaaagc

SEQ ID NO: 5105233 - DNA, 19 bp, Homo sapiens
aaggattttaccaaagcat

SEQ ID NO: 5105234 - DNA, 22 bp, Homo sapiens
aaggattttatgctttaaacat

SEQ ID NO: 5105235 - DNA, 21 bp, Homo sapiens
aaggattttctttttaacttt

SEQ ID NO: 5105236 - DNA, 17 bp, Homo sapiens
aaggattttggaaaaga

SEQ ID NO: 5105237 - DNA, 20 bp, Homo sapiens
aaggattttggaaaagaaac

SEQ ID NO: 5105238 - DNA, 16 bp, Homo sapiens
aaggatttttccatgt

SEQ ID NO: 5105239 - DNA, 14 bp, Homo sapiens
aaggattttttaaa

SEQ ID NO: 5105240 - DNA, 15 bp, Homo sapiens
aaggattttttaaaa

SEQ ID NO: 5105241 - DNA, 18 bp, Homo sapiens
aaggcaaaaaaggtggag

SEQ ID NO: 5105242 - DNA, 14 bp, Homo sapiens
aaggcaaaaacaaa

SEQ ID NO: 5105243 - DNA, 19 bp, Homo sapiens
aaggcaaaaactgtactgt

SEQ ID NO: 5105244 - DNA, 21 bp, Homo sapiens
aaggcaaaaatagtttggata

SEQ ID NO: 5105245 - DNA, 14 bp, Homo sapiens
aaggcaaaaatgta

SEQ ID NO: 5105246 - DNA, 14 bp, Homo sapiens
aaggcaaaattgca

SEQ ID NO: 5105247 - DNA, 15 bp, Homo sapiens
aaggcaaaattgcaa

SEQ ID NO: 5105248 - DNA, 20 bp, Homo sapiens
aaggcaaaccctgttcaggc

SEQ ID NO: 5105249 - DNA, 22 bp, Homo sapiens
aaggcaaacctttctataattt

SEQ ID NO: 5105250 - DNA, 21 bp, Homo sapiens
aaggcaaagggtccagaagga

SEQ ID NO: 5105251 - DNA, 20 bp, Homo sapiens
aaggcaaatattgaagttgt

SEQ ID NO: 5105252 - DNA, 18 bp, Homo sapiens
aaggcaaatctgactttt

SEQ ID NO: 5105253 - DNA, 14 bp, Homo sapiens
aaggcaaatgactt

SEQ ID NO: 5105254 - DNA, 16 bp, Homo sapiens
aaggcaaatgactttg

SEQ ID NO: 5105255 - DNA, 22 bp, Homo sapiens
aaggcaacataattcttccttc

SEQ ID NO: 5105256 - DNA, 15 bp, Homo sapiens
aaggcaaccaataaa

SEQ ID NO: 5105257 - DNA, 20 bp, Homo sapiens
aaggcaaccaataaaagcca

SEQ ID NO: 5105258 - DNA, 21 bp, Homo sapiens
aaggcaaccaataaaagccag

SEQ ID NO: 5105259 - DNA, 22 bp, Homo sapiens
aaggcaaccaataaaagccaga

SEQ ID NO: 5105260 - DNA, 13 bp, Homo sapiens
aaggcaacggcac

SEQ ID NO: 5105261 - DNA, 18 bp, Homo sapiens
aaggcaactagtggagag

SEQ ID NO: 5105262 - DNA, 12 bp, Homo sapiens
aaggcaactggg

SEQ ID NO: 5105263 - DNA, 15 bp, Homo sapiens
aaggcaacttgaaga

SEQ ID NO: 5105264 - DNA, 17 bp, Homo sapiens
aaggcaacttgaagaaa

SEQ ID NO: 5105265 - DNA, 16 bp, Homo sapiens
aaggcaagagatgaat

SEQ ID NO: 5105266 - DNA, 18 bp, Homo sapiens
aaggcaagagctcaaggt

SEQ ID NO: 5105267 - DNA, 21 bp, Homo sapiens
aaggcaagagggggtggaggg

SEQ ID NO: 5105268 - DNA, 21 bp, Homo sapiens
aaggcaagattggaaagacag

SEQ ID NO: 5105269 - DNA, 14 bp, Homo sapiens
aaggcaagcatgaa

SEQ ID NO: 5105270 - DNA, 16 bp, Homo sapiens
aaggcaagccacagaa

SEQ ID NO: 5105271 - DNA, 15 bp, Homo sapiens
aaggcaagccaggct

SEQ ID NO: 5105272 - DNA, 16 bp, Homo sapiens
aaggcaagccaggctc

SEQ ID NO: 5105273 - DNA, 15 bp, Homo sapiens
aaggcaagcttgagg

SEQ ID NO: 5105274 - DNA, 13 bp, Homo sapiens
aaggcaaggctga

SEQ ID NO: 5105275 - DNA, 13 bp, Homo sapiens
aaggcaaggctgt

SEQ ID NO: 5105276 - DNA, 20 bp, Homo sapiens
aaggcaataccaacctgaaa

SEQ ID NO: 5105277 - DNA, 17 bp, Homo sapiens
aaggcaatgctcaaaca

SEQ ID NO: 5105278 - DNA, 21 bp, Homo sapiens
aaggcaatgggctaccctcat

SEQ ID NO: 5105279 - DNA, 14 bp, Homo sapiens
aaggcaattatatc

SEQ ID NO: 5105280 - DNA, 20 bp, Homo sapiens
aaggcaattttagtgtatta

SEQ ID NO: 5105281 - DNA, 20 bp, Homo sapiens
aaggcacaaaccttactatg

SEQ ID NO: 5105282 - DNA, 16 bp, Homo sapiens
aaggcacagtgggagc

SEQ ID NO: 5105283 - DNA, 22 bp, Homo sapiens
aaggcacagtgggagctgagct

SEQ ID NO: 5105284 - DNA, 16 bp, Homo sapiens
aaggcacatgtcacct

SEQ ID NO: 5105285 - DNA, 19 bp, Homo sapiens
aaggcacattgaaatactt

SEQ ID NO: 5105286 - DNA, 19 bp, Homo sapiens
aaggcacccatctgtctgc

SEQ ID NO: 5105287 - DNA, 21 bp, Homo sapiens
aaggcacctgcccccacagct

SEQ ID NO: 5105288 - DNA, 20 bp, Homo sapiens
aaggcacctgctcccacaga

SEQ ID NO: 5105289 - DNA, 12 bp, Homo sapiens
aaggcaccttct

SEQ ID NO: 5105290 - DNA, 17 bp, Homo sapiens
aaggcactaatgatgtt

SEQ ID NO: 5105291 - DNA, 13 bp, Homo sapiens
aaggcactgagcg

SEQ ID NO: 5105292 - DNA, 19 bp, Homo sapiens
aaggcactgtcaggaatgg

SEQ ID NO: 5105293 - DNA, 15 bp, Homo sapiens
aaggcactgtgaact

SEQ ID NO: 5105294 - DNA, 18 bp, Homo sapiens
aaggcacttcatgtaaag

SEQ ID NO: 5105295 - DNA, 17 bp, Homo sapiens
aaggcagaaagcaaaat

SEQ ID NO: 5105296 - DNA, 19 bp, Homo sapiens
aaggcagaaagcaaaatta

SEQ ID NO: 5105297 - DNA, 20 bp, Homo sapiens
aaggcagacaggaaggaagc

SEQ ID NO: 5105298 - DNA, 20 bp, Homo sapiens
aaggcagagaaaacacacgc

SEQ ID NO: 5105299 - DNA, 24 bp, Homo sapiens
aaggcagagaaaacacacgctcct

SEQ ID NO: 5105300 - DNA, 13 bp, Homo sapiens
aaggcagagaaat

SEQ ID NO: 5105301 - DNA, 15 bp, Homo sapiens
aaggcagaggcctgg

SEQ ID NO: 5105302 - DNA, 16 bp, Homo sapiens
aaggcagaggcctggg

SEQ ID NO: 5105303 - DNA, 17 bp, Homo sapiens
aaggcagaggcctgggc

SEQ ID NO: 5105304 - DNA, 19 bp, Homo sapiens
aaggcagaggcctgggctg

SEQ ID NO: 5105305 - DNA, 22 bp, Homo sapiens
aaggcagatgtaaatgatgtgt

SEQ ID NO: 5105306 - DNA, 21 bp, Homo sapiens
aaggcagcatgtatagttgct

SEQ ID NO: 5105307 - DNA, 20 bp, Homo sapiens
aaggcagccagatccccagg

SEQ ID NO: 5105308 - DNA, 16 bp, Homo sapiens
aaggcagccctcacct

SEQ ID NO: 5105309 - DNA, 23 bp, Homo sapiens
aaggcagccgtgggccccaccct

SEQ ID NO: 5105310 - DNA, 11 bp, Homo sapiens
aaggcagcctc

SEQ ID NO: 5105311 - DNA, 13 bp, Homo sapiens
aaggcagcctcca

SEQ ID NO: 5105312 - DNA, 17 bp, Homo sapiens
aaggcagcctccagagc

SEQ ID NO: 5105313 - DNA, 19 bp, Homo sapiens
aaggcagcctccagagcca

SEQ ID NO: 5105314 - DNA, 20 bp, Homo sapiens
aaggcagcctccagagccag

SEQ ID NO: 5105315 - DNA, 23 bp, Homo sapiens
aaggcagcctttttctggccttg

SEQ ID NO: 5105316 - DNA, 17 bp, Homo sapiens
aaggcagcgaccccagg

SEQ ID NO: 5105317 - DNA, 20 bp, Homo sapiens
aaggcagcgaccccaggacc

SEQ ID NO: 5105318 - DNA, 22 bp, Homo sapiens
aaggcagcgtgccgagccagca

SEQ ID NO: 5105319 - DNA, 23 bp, Homo sapiens
aaggcagctcacccctgggcagg

SEQ ID NO: 5105320 - DNA, 15 bp, Homo sapiens
aaggcagctctgtcg

SEQ ID NO: 5105321 - DNA, 18 bp, Homo sapiens
aaggcagctcttctggag

SEQ ID NO: 5105322 - DNA, 20 bp, Homo sapiens
aaggcagctcttctggagtt

SEQ ID NO: 5105323 - DNA, 18 bp, Homo sapiens
aaggcagctgaaaagtaa

SEQ ID NO: 5105324 - DNA, 14 bp, Homo sapiens
aaggcagctgcctc

SEQ ID NO: 5105325 - DNA, 18 bp, Homo sapiens
aaggcagctgcctctgct

SEQ ID NO: 5105326 - DNA, 23 bp, Homo sapiens
aaggcagctgcctctgctccctc

SEQ ID NO: 5105327 - DNA, 12 bp, Homo sapiens
aaggcagctgct

SEQ ID NO: 5105328 - DNA, 18 bp, Homo sapiens
aaggcagctgttgtctct

SEQ ID NO: 5105329 - DNA, 17 bp, Homo sapiens
aaggcaggaccatgagg

SEQ ID NO: 5105330 - DNA, 12 bp, Homo sapiens
aaggcaggagcc

SEQ ID NO: 5105331 - DNA, 13 bp, Homo sapiens
aaggcaggagcct

SEQ ID NO: 5105332 - DNA, 16 bp, Homo sapiens
aaggcaggaggatcac

SEQ ID NO: 5105333 - DNA, 22 bp, Homo sapiens
aaggcaggagtgctgccctctc

SEQ ID NO: 5105334 - DNA, 20 bp, Homo sapiens
aaggcaggagttgggggcag

SEQ ID NO: 5105335 - DNA, 16 bp, Homo sapiens
aaggcaggcagggctc

SEQ ID NO: 5105336 - DNA, 17 bp, Homo sapiens
aaggcaggcagggctct

SEQ ID NO: 5105337 - DNA, 21 bp, Homo sapiens
aaggcaggcagggctctcctg

SEQ ID NO: 5105338 - DNA, 15 bp, Homo sapiens
aaggcaggcctattt

SEQ ID NO: 5105339 - DNA, 14 bp, Homo sapiens
aaggcaggcctccg

SEQ ID NO: 5105340 - DNA, 18 bp, Homo sapiens
aaggcagggaaaggaaaa

SEQ ID NO: 5105341 - DNA, 20 bp, Homo sapiens
aaggcagggacagagatgga

SEQ ID NO: 5105342 - DNA, 22 bp, Homo sapiens
aaggcagggagggcctgggccc

SEQ ID NO: 5105343 - DNA, 11 bp, Homo sapiens
aaggcagggcc

SEQ ID NO: 5105344 - DNA, 12 bp, Homo sapiens
aaggcagggctc

SEQ ID NO: 5105345 - DNA, 16 bp, Homo sapiens
aaggcagggctcctcc

SEQ ID NO: 5105346 - DNA, 23 bp, Homo sapiens
aaggcaggtagatcgcttgagcc

SEQ ID NO: 5105347 - DNA, 18 bp, Homo sapiens
aaggcaggtgcttttggc

SEQ ID NO: 5105348 - DNA, 19 bp, Homo sapiens
aaggcaggtttcatttctt

SEQ ID NO: 5105349 - DNA, 19 bp, Homo sapiens
aaggcagtagttttcaaaa

SEQ ID NO: 5105350 - DNA, 18 bp, Homo sapiens
aaggcagtccagagcttt

SEQ ID NO: 5105351 - DNA, 15 bp, Homo sapiens
aaggcagtgcagtgc

SEQ ID NO: 5105352 - DNA, 18 bp, Homo sapiens
aaggcagtggcaggggag

SEQ ID NO: 5105353 - DNA, 16 bp, Homo sapiens
aaggcagtgttcctca

SEQ ID NO: 5105354 - DNA, 22 bp, Homo sapiens
aaggcagttaccattaaaccat

SEQ ID NO: 5105355 - DNA, 22 bp, Homo sapiens
aaggcagttctgtgtcctcgca

SEQ ID NO: 5105356 - DNA, 19 bp, Homo sapiens
aaggcagtttgcaaaaaat

SEQ ID NO: 5105357 - DNA, 15 bp, Homo sapiens
aaggcagttttctaa

SEQ ID NO: 5105358 - DNA, 22 bp, Homo sapiens
aaggcatacgagagcagaggtc

SEQ ID NO: 5105359 - DNA, 21 bp, Homo sapiens
aaggcatacttttaatcaagt

SEQ ID NO: 5105360 - DNA, 15 bp, Homo sapiens
aaggcatatacaaat

SEQ ID NO: 5105361 - DNA, 19 bp, Homo sapiens
aaggcatatactttgtctt

SEQ ID NO: 5105362 - DNA, 20 bp, Homo sapiens
aaggcatatcagtctctgag

SEQ ID NO: 5105363 - DNA, 23 bp, Homo sapiens
aaggcatcagtccccctgtgcat

SEQ ID NO: 5105364 - DNA, 20 bp, Homo sapiens
aaggcatcagtccctatgta

SEQ ID NO: 5105365 - DNA, 18 bp, Homo sapiens
aaggcatcccagcctggg

SEQ ID NO: 5105366 - DNA, 12 bp, Homo sapiens
aaggcatgaagg

SEQ ID NO: 5105367 - DNA, 13 bp, Homo sapiens
aaggcatgagaaa

SEQ ID NO: 5105368 - DNA, 13 bp, Homo sapiens
aaggcatgcagtc

SEQ ID NO: 5105369 - DNA, 21 bp, Homo sapiens
aaggcatgcctggacaaaccc

SEQ ID NO: 5105370 - DNA, 20 bp, Homo sapiens
aaggcatgcgaaatgttctc

SEQ ID NO: 5105371 - DNA, 14 bp, Homo sapiens
aaggcatggtcggg

SEQ ID NO: 5105372 - DNA, 21 bp, Homo sapiens
aaggcatgtggcctttatctc

SEQ ID NO: 5105373 - DNA, 18 bp, Homo sapiens
aaggcatgtgtgaaacat

SEQ ID NO: 5105374 - DNA, 20 bp, Homo sapiens
aaggcatgttttaaaatcta

SEQ ID NO: 5105375 - DNA, 17 bp, Homo sapiens
aaggcattcagcagttt

SEQ ID NO: 5105376 - DNA, 18 bp, Homo sapiens
aaggcattctcccagctc

SEQ ID NO: 5105377 - DNA, 14 bp, Homo sapiens
aaggcattctctga

SEQ ID NO: 5105378 - DNA, 17 bp, Homo sapiens
aaggcattctctgaaga

SEQ ID NO: 5105379 - DNA, 22 bp, Homo sapiens
aaggcattctgtataaatgcaa

SEQ ID NO: 5105380 - DNA, 20 bp, Homo sapiens
aaggcattggcatctgcttt

SEQ ID NO: 5105381 - DNA, 21 bp, Homo sapiens
aaggcattggcatctgctttt

SEQ ID NO: 5105382 - DNA, 17 bp, Homo sapiens
aaggcattgtcctgtga

SEQ ID NO: 5105383 - DNA, 15 bp, Homo sapiens
aaggcattgtttgag

SEQ ID NO: 5105384 - DNA, 16 bp, Homo sapiens
aaggccaaaagaagtt

SEQ ID NO: 5105385 - DNA, 17 bp, Homo sapiens
aaggccaaagataaaag

SEQ ID NO: 5105386 - DNA, 18 bp, Homo sapiens
aaggccaaaggaagcaca

SEQ ID NO: 5105387 - DNA, 14 bp, Homo sapiens
aaggccaacagcat

SEQ ID NO: 5105388 - DNA, 21 bp, Homo sapiens
aaggccaacagcattggcctg

SEQ ID NO: 5105389 - DNA, 20 bp, Homo sapiens
aaggccacaaaagttccctc

SEQ ID NO: 5105390 - DNA, 23 bp, Homo sapiens
aaggccacaaaagttccctctca

SEQ ID NO: 5105391 - DNA, 18 bp, Homo sapiens
aaggccacaggcagtcca

SEQ ID NO: 5105392 - DNA, 18 bp, Homo sapiens
aaggccacaggccactgc

SEQ ID NO: 5105393 - DNA, 19 bp, Homo sapiens
aaggccacatacctctctg

SEQ ID NO: 5105394 - DNA, 22 bp, Homo sapiens
aaggccacatacctctctgaga

SEQ ID NO: 5105395 - DNA, 19 bp, Homo sapiens
aaggccacatgtgaaaacc

SEQ ID NO: 5105396 - DNA, 22 bp, Homo sapiens
aaggccacctcccactcctgct

SEQ ID NO: 5105397 - DNA, 17 bp, Homo sapiens
aaggccacctctgcctc

SEQ ID NO: 5105398 - DNA, 20 bp, Homo sapiens
aaggccacctcttcctggcc

SEQ ID NO: 5105399 - DNA, 14 bp, Homo sapiens
aaggccactcagga

SEQ ID NO: 5105400 - DNA, 20 bp, Homo sapiens
aaggccactgttttaaaaga

SEQ ID NO: 5105401 - DNA, 20 bp, Homo sapiens
aaggccagaaaaggcagcca

SEQ ID NO: 5105402 - DNA, 21 bp, Homo sapiens
aaggccagaaaaggcagccag

SEQ ID NO: 5105403 - DNA, 18 bp, Homo sapiens
aaggccagacctgcagac

SEQ ID NO: 5105404 - DNA, 20 bp, Homo sapiens
aaggccagacctgcagacgc

SEQ ID NO: 5105405 - DNA, 18 bp, Homo sapiens
aagtaaaacaatacatca

SEQ ID NO: 5105406 - DNA, 12 bp, Homo sapiens
aagtaaaacttg

SEQ ID NO: 5105407 - DNA, 15 bp, Homo sapiens
aagtaaaagctaatt

SEQ ID NO: 5105408 - DNA, 21 bp, Homo sapiens
aagtaaaagtctacctgtgtt

SEQ ID NO: 5105409 - DNA, 13 bp, Homo sapiens
aagtaaaataaat

SEQ ID NO: 5105410 - DNA, 18 bp, Homo sapiens
aagtaaaatgaacatttt

SEQ ID NO: 5105411 - DNA, 14 bp, Homo sapiens
aagtaaaattgttt

SEQ ID NO: 5105412 - DNA, 13 bp, Homo sapiens
aagtaaacagatt

SEQ ID NO: 5105413 - DNA, 20 bp, Homo sapiens
aagtaaacctagtaaaacct

SEQ ID NO: 5105414 - DNA, 17 bp, Homo sapiens
aagtaaactaatgagtt

SEQ ID NO: 5105415 - DNA, 20 bp, Homo sapiens
aagtaaactttttgttctgg

SEQ ID NO: 5105416 - DNA, 13 bp, Homo sapiens
aagtaaagacagc

SEQ ID NO: 5105417 - DNA, 19 bp, Homo sapiens
aagtaaagactattctgtt

SEQ ID NO: 5105418 - DNA, 17 bp, Homo sapiens
aagtaaagccattaaat

SEQ ID NO: 5105419 - DNA, 21 bp, Homo sapiens
aagtaaagctaaaatgatttt

SEQ ID NO: 5105420 - DNA, 16 bp, Homo sapiens
aagtaaaggcctcctc

SEQ ID NO: 5105421 - DNA, 18 bp, Homo sapiens
aagtaaaggcctcctccc

SEQ ID NO: 5105422 - DNA, 17 bp, Homo sapiens
aagtaaaggtcagtttt

SEQ ID NO: 5105423 - DNA, 12 bp, Homo sapiens
aagtaaagtaaa

SEQ ID NO: 5105424 - DNA, 18 bp, Homo sapiens
aagtaaagtattggattt

SEQ ID NO: 5105425 - DNA, 13 bp, Homo sapiens
aagtaaagtgctt

SEQ ID NO: 5105426 - DNA, 17 bp, Homo sapiens
aagtaaagtggttttgt

SEQ ID NO: 5105427 - DNA, 12 bp, Homo sapiens
aagtaaatatat

SEQ ID NO: 5105428 - DNA, 16 bp, Homo sapiens
aagtaaatctatctct

SEQ ID NO: 5105429 - DNA, 22 bp, Homo sapiens
aagtaaatctatctctatataa

SEQ ID NO: 5105430 - DNA, 15 bp, Homo sapiens
aagtaaatctcttct

SEQ ID NO: 5105431 - DNA, 16 bp, Homo sapiens
aagtaaatctcttctg

SEQ ID NO: 5105432 - DNA, 14 bp, Homo sapiens
aagtaaatctcttt

SEQ ID NO: 5105433 - DNA, 15 bp, Homo sapiens
aagtaaatgtctgtg

SEQ ID NO: 5105434 - DNA, 21 bp, Homo sapiens
aagtaaatgtcttcatgttga

SEQ ID NO: 5105435 - DNA, 17 bp, Homo sapiens
aagtaaattattttatg

SEQ ID NO: 5105436 - DNA, 14 bp, Homo sapiens
aagtaaattctgtt

SEQ ID NO: 5105437 - DNA, 21 bp, Homo sapiens
aagtaaattgcctgatttgtt

SEQ ID NO: 5105438 - DNA, 21 bp, Homo sapiens
aagtaaatttgtataaataag

SEQ ID NO: 5105439 - DNA, 13 bp, Homo sapiens
aagtaacaatatg

SEQ ID NO: 5105440 - DNA, 19 bp, Homo sapiens
aagtaacaatctatggctt

SEQ ID NO: 5105441 - DNA, 17 bp, Homo sapiens
aagtaacaatgcatgct

SEQ ID NO: 5105442 - DNA, 17 bp, Homo sapiens
aagtaacacagtattat

SEQ ID NO: 5105443 - DNA, 19 bp, Homo sapiens
aagtaacacagtattatgc

SEQ ID NO: 5105444 - DNA, 14 bp, Homo sapiens
aagtaacacatttg

SEQ ID NO: 5105445 - DNA, 20 bp, Homo sapiens
aagtaacacatttggccaca

SEQ ID NO: 5105446 - DNA, 21 bp, Homo sapiens
aagtaacactttaaaaccagt

SEQ ID NO: 5105447 - DNA, 18 bp, Homo sapiens
aagtaacagttgaagaaa

SEQ ID NO: 5105448 - DNA, 18 bp, Homo sapiens
aagtaacatgcatacttt

SEQ ID NO: 5105449 - DNA, 21 bp, Homo sapiens
aagtaacatgcatactttatt

SEQ ID NO: 5105450 - DNA, 13 bp, Homo sapiens
aagtaacattttt

SEQ ID NO: 5105451 - DNA, 17 bp, Homo sapiens
aagtaacccctcctggc

SEQ ID NO: 5105452 - DNA, 19 bp, Homo sapiens
aagtaacctctacaggcat

SEQ ID NO: 5105453 - DNA, 15 bp, Homo sapiens
aagtaacgcaataaa

SEQ ID NO: 5105454 - DNA, 16 bp, Homo sapiens
aagtaacgtgctcact

SEQ ID NO: 5105455 - DNA, 20 bp, Homo sapiens
aagtaacgtgctcactgtgt

SEQ ID NO: 5105456 - DNA, 18 bp, Homo sapiens
aagtaactataacaaaaa

SEQ ID NO: 5105457 - DNA, 19 bp, Homo sapiens
aagtaactataacaaaaaa

SEQ ID NO: 5105458 - DNA, 21 bp, Homo sapiens
aagtaactcagtgaaggccca

SEQ ID NO: 5105459 - DNA, 16 bp, Homo sapiens
aagtaactcatttgtt

SEQ ID NO: 5105460 - DNA, 14 bp, Homo sapiens
aagtaactgtgaga

SEQ ID NO: 5105461 - DNA, 14 bp, Homo sapiens
aagtaacttaagga

SEQ ID NO: 5105462 - DNA, 17 bp, Homo sapiens
aagtaacttatttgact

SEQ ID NO: 5105463 - DNA, 16 bp, Homo sapiens
aagtaacttattttgt

SEQ ID NO: 5105464 - DNA, 15 bp, Homo sapiens
aagtaacttgtctta

SEQ ID NO: 5105465 - DNA, 19 bp, Homo sapiens
aagtaactttattcttgaa

SEQ ID NO: 5105466 - DNA, 22 bp, Homo sapiens
aagtaactttgcgggatattta

SEQ ID NO: 5105467 - DNA, 18 bp, Homo sapiens
aagtaacttttaaaattt

SEQ ID NO: 5105468 - DNA, 12 bp, Homo sapiens
aagtaagaaatt

SEQ ID NO: 5105469 - DNA, 15 bp, Homo sapiens
aagtaagaagacatg

SEQ ID NO: 5105470 - DNA, 18 bp, Homo sapiens
aagtaagaagaggagcct

SEQ ID NO: 5105471 - DNA, 15 bp, Homo sapiens
aagtaagaatgcaaa

SEQ ID NO: 5105472 - DNA, 12 bp, Homo sapiens
aagtaagacaca

SEQ ID NO: 5105473 - DNA, 15 bp, Homo sapiens
aagtaagacatctca

SEQ ID NO: 5105474 - DNA, 17 bp, Homo sapiens
aagtaagacatctcaaa

SEQ ID NO: 5105475 - DNA, 20 bp, Homo sapiens
aagtaagacatctcaaatac

SEQ ID NO: 5105476 - DNA, 20 bp, Homo sapiens
aagtaagagtactgggagaa

SEQ ID NO: 5105477 - DNA, 16 bp, Homo sapiens
aagtaagcatttccag

SEQ ID NO: 5105478 - DNA, 23 bp, Homo sapiens
aagtaagcccttgaagatatctt

SEQ ID NO: 5105479 - DNA, 17 bp, Homo sapiens
aagtaaggacaaagaag

SEQ ID NO: 5105480 - DNA, 18 bp, Homo sapiens
aagtaaggtgcagttccc

SEQ ID NO: 5105481 - DNA, 20 bp, Homo sapiens
aagtaaggtgcttggagttt

SEQ ID NO: 5105482 - DNA, 21 bp, Homo sapiens
aagtaagtaccactcaggcca

SEQ ID NO: 5105483 - DNA, 23 bp, Homo sapiens
aagtaagtcttttttttttccaa

SEQ ID NO: 5105484 - DNA, 22 bp, Homo sapiens
aagtaagtgaactaccatgctt

SEQ ID NO: 5105485 - DNA, 15 bp, Homo sapiens
aagtaagttctgaaa

SEQ ID NO: 5105486 - DNA, 14 bp, Homo sapiens
aagtaataaaaaga

SEQ ID NO: 5105487 - DNA, 13 bp, Homo sapiens
aagtaataaagag

SEQ ID NO: 5105488 - DNA, 14 bp, Homo sapiens
aagtaataaagaga

SEQ ID NO: 5105489 - DNA, 15 bp, Homo sapiens
aagtaataaagagaa

SEQ ID NO: 5105490 - DNA, 16 bp, Homo sapiens
aagtaatacaaactaa

SEQ ID NO: 5105491 - DNA, 16 bp, Homo sapiens
aagtaatataatggaa

SEQ ID NO: 5105492 - DNA, 15 bp, Homo sapiens
aagtaatatgcacac

SEQ ID NO: 5105493 - DNA, 21 bp, Homo sapiens
aagtaatatgcacacattttt

SEQ ID NO: 5105494 - DNA, 15 bp, Homo sapiens
aagtaatattattac

SEQ ID NO: 5105495 - DNA, 17 bp, Homo sapiens
aagtaatatttaaagat

SEQ ID NO: 5105496 - DNA, 14 bp, Homo sapiens
aagtaatatttatt

SEQ ID NO: 5105497 - DNA, 17 bp, Homo sapiens
aagtaatcatctaagtc

SEQ ID NO: 5105498 - DNA, 21 bp, Homo sapiens
aagtaatcgggcgcccgaaga

SEQ ID NO: 5105499 - DNA, 18 bp, Homo sapiens
aagtaatctttaaactgg

SEQ ID NO: 5105500 - DNA, 20 bp, Homo sapiens
aagtaatctttttacagttg

SEQ ID NO: 5105501 - DNA, 21 bp, Homo sapiens
aagtaatgaatttttatgata

SEQ ID NO: 5105502 - DNA, 16 bp, Homo sapiens
aagtaatgatttcttg

SEQ ID NO: 5105503 - DNA, 21 bp, Homo sapiens
aagtaatgcatttgagcatgg

SEQ ID NO: 5105504 - DNA, 17 bp, Homo sapiens
aagtaatgcctctgtct

SEQ ID NO: 5105505 - DNA, 23 bp, Homo sapiens
aagtaatgtattagtatggttca

SEQ ID NO: 5105506 - DNA, 13 bp, Homo sapiens
aagtaatgtggaa

SEQ ID NO: 5105507 - DNA, 15 bp, Homo sapiens
aagtaattaaaaaga

SEQ ID NO: 5105508 - DNA, 22 bp, Homo sapiens
aagtaattatcgggaacagtgt

SEQ ID NO: 5105509 - DNA, 13 bp, Homo sapiens
aagtaattatgca

SEQ ID NO: 5105510 - DNA, 14 bp, Homo sapiens
aagtaattcctctc

SEQ ID NO: 5105511 - DNA, 15 bp, Homo sapiens
aagtaattcttctgc

SEQ ID NO: 5105512 - DNA, 15 bp, Homo sapiens
aagtaattgttccag

SEQ ID NO: 5105513 - DNA, 13 bp, Homo sapiens
aagtaatttcagt

SEQ ID NO: 5105514 - DNA, 16 bp, Homo sapiens
aagtaatttcttctca

SEQ ID NO: 5105515 - DNA, 23 bp, Homo sapiens
aagtaatttgtaaaaaagatttg

SEQ ID NO: 5105516 - DNA, 17 bp, Homo sapiens
aagtaattttgtcacat

SEQ ID NO: 5105517 - DNA, 22 bp, Homo sapiens
aagtaattttgtcacattattt

SEQ ID NO: 5105518 - DNA, 22 bp, Homo sapiens
aagtacaaaaaattagccagtc

SEQ ID NO: 5105519 - DNA, 12 bp, Homo sapiens
aagtacaaaaac

SEQ ID NO: 5105520 - DNA, 15 bp, Homo sapiens
aagtacaaaattgcc

SEQ ID NO: 5105521 - DNA, 19 bp, Homo sapiens
aagtacaaactaaggtgct

SEQ ID NO: 5105522 - DNA, 17 bp, Homo sapiens
aagtacaattcattgtt

SEQ ID NO: 5105523 - DNA, 18 bp, Homo sapiens
aagtacacaataagcaaa

SEQ ID NO: 5105524 - DNA, 15 bp, Homo sapiens
aagtacactctgctg

SEQ ID NO: 5105525 - DNA, 21 bp, Homo sapiens
aagtacagaaaaatactttga

SEQ ID NO: 5105526 - DNA, 13 bp, Homo sapiens
aagtacagaattt

SEQ ID NO: 5105527 - DNA, 14 bp, Homo sapiens
aagtacagaatttg

SEQ ID NO: 5105528 - DNA, 13 bp, Homo sapiens
aagtacagagaag

SEQ ID NO: 5105529 - DNA, 15 bp, Homo sapiens
aagtacaggtacttt

SEQ ID NO: 5105530 - DNA, 13 bp, Homo sapiens
aagtacatattta

SEQ ID NO: 5105531 - DNA, 14 bp, Homo sapiens
aagtacatctgtac

SEQ ID NO: 5105532 - DNA, 14 bp, Homo sapiens
aagtacattgtaaa

SEQ ID NO: 5105533 - DNA, 16 bp, Homo sapiens
aagtacattttttgaa

SEQ ID NO: 5105534 - DNA, 16 bp, Homo sapiens
aagtaccaatctctgc

SEQ ID NO: 5105535 - DNA, 16 bp, Homo sapiens
aagtaccacactgagt

SEQ ID NO: 5105536 - DNA, 18 bp, Homo sapiens
aagtaccacattccatga

SEQ ID NO: 5105537 - DNA, 17 bp, Homo sapiens
aagtaccactcaggcca

SEQ ID NO: 5105538 - DNA, 14 bp, Homo sapiens
aagtaccagattat

SEQ ID NO: 5105539 - DNA, 15 bp, Homo sapiens
aagtaccagcatgtt

SEQ ID NO: 5105540 - DNA, 17 bp, Homo sapiens
aagtaccatagaacaga

SEQ ID NO: 5105541 - DNA, 24 bp, Homo sapiens
aagtacccgctacaattctgcaga

SEQ ID NO: 5105542 - DNA, 19 bp, Homo sapiens
aagtaccctcttttaccaa

SEQ ID NO: 5105543 - DNA, 18 bp, Homo sapiens
aagtaccctgatgccttt

SEQ ID NO: 5105544 - DNA, 22 bp, Homo sapiens
aagtacctatattgatttaaaa

SEQ ID NO: 5105545 - DNA, 14 bp, Homo sapiens
aagtacctattgaa

SEQ ID NO: 5105546 - DNA, 17 bp, Homo sapiens
aagtacctttcctacat

SEQ ID NO: 5105547 - DNA, 19 bp, Homo sapiens
aagtacctttcctacattt

SEQ ID NO: 5105548 - DNA, 23 bp, Homo sapiens
aagtacctttcctacattttctt

SEQ ID NO: 5105549 - DNA, 21 bp, Homo sapiens
aagtacgaatcttatttttcc

SEQ ID NO: 5105550 - DNA, 23 bp, Homo sapiens
aagtacgtcccagcggcctcagg

SEQ ID NO: 5105551 - DNA, 13 bp, Homo sapiens
aagtacgtgttta

SEQ ID NO: 5105552 - DNA, 16 bp, Homo sapiens
aagtacgttattgttg

SEQ ID NO: 5105553 - DNA, 17 bp, Homo sapiens
aagtactctaatataca

SEQ ID NO: 5105554 - DNA, 24 bp, Homo sapiens
aagtactctttaacatacaagaaa

SEQ ID NO: 5105555 - DNA, 13 bp, Homo sapiens
aagtactgagcag

SEQ ID NO: 5105556 - DNA, 18 bp, Homo sapiens
aagtactgcaaaatgctt

SEQ ID NO: 5105557 - DNA, 20 bp, Homo sapiens
aagtactgcatgatcttaca

SEQ ID NO: 5105558 - DNA, 15 bp, Homo sapiens
aagtactggaattta

SEQ ID NO: 5105559 - DNA, 15 bp, Homo sapiens
aagtactggagaaaa

SEQ ID NO: 5105560 - DNA, 17 bp, Homo sapiens
aagtactggctctttat

SEQ ID NO: 5105561 - DNA, 21 bp, Homo sapiens
aagtactggtaagattgttat

SEQ ID NO: 5105562 - DNA, 23 bp, Homo sapiens
aagtactggtaagattgttatta

SEQ ID NO: 5105563 - DNA, 11 bp, Homo sapiens
aagtactgtaa

SEQ ID NO: 5105564 - DNA, 15 bp, Homo sapiens
aagtactgtaagaat

SEQ ID NO: 5105565 - DNA, 19 bp, Homo sapiens
aagtactgtaagaataatt

SEQ ID NO: 5105566 - DNA, 23 bp, Homo sapiens
aagtactgtaagaataatttata

SEQ ID NO: 5105567 - DNA, 20 bp, Homo sapiens
aagtactgtttaccattttt

SEQ ID NO: 5105568 - DNA, 21 bp, Homo sapiens
aagtactgttttgaagctggg

SEQ ID NO: 5105569 - DNA, 20 bp, Homo sapiens
aagtacttaaacttccacaa

SEQ ID NO: 5105570 - DNA, 17 bp, Homo sapiens
aagtacttccctcaggc

SEQ ID NO: 5105571 - DNA, 17 bp, Homo sapiens
aagtacttcctctagga

SEQ ID NO: 5105572 - DNA, 23 bp, Homo sapiens
aagtacttctccaccctgctctc

SEQ ID NO: 5105573 - DNA, 19 bp, Homo sapiens
aagtacttgactacctact

SEQ ID NO: 5105574 - DNA, 21 bp, Homo sapiens
aagtacttgagaataaatgag

SEQ ID NO: 5105575 - DNA, 22 bp, Homo sapiens
aagtacttgagtgtaatgtttg

SEQ ID NO: 5105576 - DNA, 14 bp, Homo sapiens
aagtactttctggt

SEQ ID NO: 5105577 - DNA, 17 bp, Homo sapiens
aagtactttcttataaa

SEQ ID NO: 5105578 - DNA, 20 bp, Homo sapiens
aagtagaaaaattgtttcca

SEQ ID NO: 5105579 - DNA, 20 bp, Homo sapiens
aagtagaaaagttgcagatg

SEQ ID NO: 5105580 - DNA, 16 bp, Homo sapiens
aagtagaaacaaaata

SEQ ID NO: 5105581 - DNA, 21 bp, Homo sapiens
aagtagaaactactaattttt

SEQ ID NO: 5105582 - DNA, 13 bp, Homo sapiens
aagtagaaatcat

SEQ ID NO: 5105583 - DNA, 11 bp, Homo sapiens
aagtagaaatg

SEQ ID NO: 5105584 - DNA, 20 bp, Homo sapiens
aaggccagagtggcctggcc

SEQ ID NO: 5105585 - DNA, 22 bp, Homo sapiens
aaggccagagtggcctggccag

SEQ ID NO: 5105586 - DNA, 15 bp, Homo sapiens
aaggccagcaacatt

SEQ ID NO: 5105587 - DNA, 19 bp, Homo sapiens
aaggccagccacaccacag

SEQ ID NO: 5105588 - DNA, 14 bp, Homo sapiens
aaggccagctggca

SEQ ID NO: 5105589 - DNA, 22 bp, Homo sapiens
aaggccaggacgggccacacgt

SEQ ID NO: 5105590 - DNA, 13 bp, Homo sapiens
aaggccagggcac

SEQ ID NO: 5105591 - DNA, 23 bp, Homo sapiens
aaggccagggcacagctggagac

SEQ ID NO: 5105592 - DNA, 17 bp, Homo sapiens
aaggccagtggaagaaa

SEQ ID NO: 5105593 - DNA, 15 bp, Homo sapiens
aaggccatattttaa

SEQ ID NO: 5105594 - DNA, 14 bp, Homo sapiens
aaggccatcagagc

SEQ ID NO: 5105595 - DNA, 17 bp, Homo sapiens
aaggccatggggcagcc

SEQ ID NO: 5105596 - DNA, 19 bp, Homo sapiens
aaggccatggggcagcctc

SEQ ID NO: 5105597 - DNA, 21 bp, Homo sapiens
aaggccatggggcagcctcca

SEQ ID NO: 5105598 - DNA, 22 bp, Homo sapiens
aaggcccaagagcagagtctgg

SEQ ID NO: 5105599 - DNA, 15 bp, Homo sapiens
aaggcccactgtaat

SEQ ID NO: 5105600 - DNA, 15 bp, Homo sapiens
aaggcccagacctgg

SEQ ID NO: 5105601 - DNA, 17 bp, Homo sapiens
aaggcccagacctggcc

SEQ ID NO: 5105602 - DNA, 20 bp, Homo sapiens
aaggcccagccataaaagca

SEQ ID NO: 5105603 - DNA, 14 bp, Homo sapiens
aaggcccagcccct

SEQ ID NO: 5105604 - DNA, 22 bp, Homo sapiens
aaggcccagggaggcagcgtgg

SEQ ID NO: 5105605 - DNA, 18 bp, Homo sapiens
aaggcccatgaaggaaat

SEQ ID NO: 5105606 - DNA, 14 bp, Homo sapiens
aaggcccatgcccc

SEQ ID NO: 5105607 - DNA, 16 bp, Homo sapiens
aaggcccatgccccct

SEQ ID NO: 5105608 - DNA, 17 bp, Homo sapiens
aaggcccatgccccctt

SEQ ID NO: 5105609 - DNA, 17 bp, Homo sapiens
aaggccccagagagacc

SEQ ID NO: 5105610 - DNA, 19 bp, Homo sapiens
aaggccccctgcctgccct

SEQ ID NO: 5105611 - DNA, 13 bp, Homo sapiens
aaggccccctttc

SEQ ID NO: 5105612 - DNA, 16 bp, Homo sapiens
aaggccccgcccaggc

SEQ ID NO: 5105613 - DNA, 15 bp, Homo sapiens
aaggcccctgcaatg

SEQ ID NO: 5105614 - DNA, 18 bp, Homo sapiens
aaggcccgagcagctgag

SEQ ID NO: 5105615 - DNA, 21 bp, Homo sapiens
aaggcccggaagcgccaggct

SEQ ID NO: 5105616 - DNA, 22 bp, Homo sapiens
aaggccctatctgtttacagtg

SEQ ID NO: 5105617 - DNA, 20 bp, Homo sapiens
aaggccctcggagctggctg

SEQ ID NO: 5105618 - DNA, 20 bp, Homo sapiens
aaggccctgcatctgtctgc

SEQ ID NO: 5105619 - DNA, 23 bp, Homo sapiens
aaggccctgcatctgtctgctct

SEQ ID NO: 5105620 - DNA, 18 bp, Homo sapiens
aaggccctgctgagtcat

SEQ ID NO: 5105621 - DNA, 13 bp, Homo sapiens
aaggccctgtggt

SEQ ID NO: 5105622 - DNA, 16 bp, Homo sapiens
aaggccgaagctctgg

SEQ ID NO: 5105623 - DNA, 20 bp, Homo sapiens
aaggccgaagctctggctga

SEQ ID NO: 5105624 - DNA, 13 bp, Homo sapiens
aaggccgagccca

SEQ ID NO: 5105625 - DNA, 14 bp, Homo sapiens
aaggccgagcccac

SEQ ID NO: 5105626 - DNA, 15 bp, Homo sapiens
aaggccgagcccaca

SEQ ID NO: 5105627 - DNA, 13 bp, Homo sapiens
aaggccgcccacc

SEQ ID NO: 5105628 - DNA, 14 bp, Homo sapiens
aaggccgctgcccc

SEQ ID NO: 5105629 - DNA, 19 bp, Homo sapiens
aaggccgctgccccagccc

SEQ ID NO: 5105630 - DNA, 20 bp, Homo sapiens
aaggccggagacccacagcc

SEQ ID NO: 5105631 - DNA, 18 bp, Homo sapiens
aaggccggtgggaagagg

SEQ ID NO: 5105632 - DNA, 15 bp, Homo sapiens
aaggccgtgtgttta

SEQ ID NO: 5105633 - DNA, 22 bp, Homo sapiens
aaggcctaccccagttcctagc

SEQ ID NO: 5105634 - DNA, 16 bp, Homo sapiens
aaggcctaggattcta

SEQ ID NO: 5105635 - DNA, 13 bp, Homo sapiens
aaggcctcccaca

SEQ ID NO: 5105636 - DNA, 17 bp, Homo sapiens
aaggcctcccacagtga

SEQ ID NO: 5105637 - DNA, 19 bp, Homo sapiens
aaggcctcccacagtgact

SEQ ID NO: 5105638 - DNA, 12 bp, Homo sapiens
aaggcctcccct

SEQ ID NO: 5105639 - DNA, 15 bp, Homo sapiens
aaggcctcctccccc

SEQ ID NO: 5105640 - DNA, 15 bp, Homo sapiens
aaggcctcggcagaa

SEQ ID NO: 5105641 - DNA, 16 bp, Homo sapiens
aaggcctcggcagaac

SEQ ID NO: 5105642 - DNA, 17 bp, Homo sapiens
aaggcctcggcagaact

SEQ ID NO: 5105643 - DNA, 18 bp, Homo sapiens
aaggcctctcagacccag

SEQ ID NO: 5105644 - DNA, 13 bp, Homo sapiens
aaggcctctctct

SEQ ID NO: 5105645 - DNA, 18 bp, Homo sapiens
aaggcctctctctgcctg

SEQ ID NO: 5105646 - DNA, 13 bp, Homo sapiens
aaggcctctgtcc

SEQ ID NO: 5105647 - DNA, 16 bp, Homo sapiens
aaggcctcttccttgc

SEQ ID NO: 5105648 - DNA, 14 bp, Homo sapiens
aaggcctcttctca

SEQ ID NO: 5105649 - DNA, 15 bp, Homo sapiens
aaggcctcttgctgg

SEQ ID NO: 5105650 - DNA, 16 bp, Homo sapiens
aaggcctcttggagac

SEQ ID NO: 5105651 - DNA, 23 bp, Homo sapiens
aaggcctcttggagaccttaccc

SEQ ID NO: 5105652 - DNA, 23 bp, Homo sapiens
aaggcctcttgtgctcacgctcc

SEQ ID NO: 5105653 - DNA, 13 bp, Homo sapiens
aaggcctgaatca

SEQ ID NO: 5105654 - DNA, 14 bp, Homo sapiens
aaggcctgagcccc

SEQ ID NO: 5105655 - DNA, 18 bp, Homo sapiens
aaggcctgccctcccatg

SEQ ID NO: 5105656 - DNA, 22 bp, Homo sapiens
aaggcctgcttgactttccaga

SEQ ID NO: 5105657 - DNA, 15 bp, Homo sapiens
aaggcctgcttttgt

SEQ ID NO: 5105658 - DNA, 22 bp, Homo sapiens
aaggcctggaaccagggaggag

SEQ ID NO: 5105659 - DNA, 13 bp, Homo sapiens
aaggcctggctgg

SEQ ID NO: 5105660 - DNA, 14 bp, Homo sapiens
aaggcctggctgga

SEQ ID NO: 5105661 - DNA, 15 bp, Homo sapiens
aaggcctggggtgac

SEQ ID NO: 5105662 - DNA, 14 bp, Homo sapiens
aaggcctggtcagc

SEQ ID NO: 5105663 - DNA, 20 bp, Homo sapiens
aaggcctggtgtttcttgat

SEQ ID NO: 5105664 - DNA, 17 bp, Homo sapiens
aaggcctgtggggagcc

SEQ ID NO: 5105665 - DNA, 20 bp, Homo sapiens
aaggcctgtggggagccgag

SEQ ID NO: 5105666 - DNA, 18 bp, Homo sapiens
aaggccttcaacccgaga

SEQ ID NO: 5105667 - DNA, 17 bp, Homo sapiens
aaggccttcagacacat

SEQ ID NO: 5105668 - DNA, 19 bp, Homo sapiens
aaggccttgccagcaacac

SEQ ID NO: 5105669 - DNA, 17 bp, Homo sapiens
aaggccttgctcactca

SEQ ID NO: 5105670 - DNA, 23 bp, Homo sapiens
aaggccttggtggagcagccaga

SEQ ID NO: 5105671 - DNA, 11 bp, Homo sapiens
aaggcctttaa

SEQ ID NO: 5105672 - DNA, 15 bp, Homo sapiens
aaggcctttaaaatt

SEQ ID NO: 5105673 - DNA, 20 bp, Homo sapiens
aaggcctttagtaatgaatg

SEQ ID NO: 5105674 - DNA, 14 bp, Homo sapiens
aaggcctttctgtg

SEQ ID NO: 5105675 - DNA, 17 bp, Homo sapiens
aaggcctttcttctgtg

SEQ ID NO: 5105676 - DNA, 12 bp, Homo sapiens
aaggcctttggg

SEQ ID NO: 5105677 - DNA, 14 bp, Homo sapiens
aaggcctttgggat

SEQ ID NO: 5105678 - DNA, 15 bp, Homo sapiens
aaggcctttgggatt

SEQ ID NO: 5105679 - DNA, 18 bp, Homo sapiens
aaggccttttatgtaatt

SEQ ID NO: 5105680 - DNA, 21 bp, Homo sapiens
aaggcgagcttgagttctgca

SEQ ID NO: 5105681 - DNA, 13 bp, Homo sapiens
aaggcgcccccgc

SEQ ID NO: 5105682 - DNA, 22 bp, Homo sapiens
aaggcgcccccgccccaggctt

SEQ ID NO: 5105683 - DNA, 14 bp, Homo sapiens
aaggcggcaggcag

SEQ ID NO: 5105684 - DNA, 13 bp, Homo sapiens
aaggcggcccctc

SEQ ID NO: 5105685 - DNA, 21 bp, Homo sapiens
aaggcggggtattcccactca

SEQ ID NO: 5105686 - DNA, 15 bp, Homo sapiens
aaggcgggtggatca

SEQ ID NO: 5105687 - DNA, 16 bp, Homo sapiens
aaggcgtggagctgcc

SEQ ID NO: 5105688 - DNA, 19 bp, Homo sapiens
aaggcgtggagctgcctga

SEQ ID NO: 5105689 - DNA, 17 bp, Homo sapiens
aaggctaaaaagcaaca

SEQ ID NO: 5105690 - DNA, 13 bp, Homo sapiens
aaggctaaaaagt

SEQ ID NO: 5105691 - DNA, 21 bp, Homo sapiens
aaggctaattttttatccttt

SEQ ID NO: 5105692 - DNA, 18 bp, Homo sapiens
aaggctactggcattaat

SEQ ID NO: 5105693 - DNA, 19 bp, Homo sapiens
aaggctatcggagcagttc

SEQ ID NO: 5105694 - DNA, 21 bp, Homo sapiens
aaggctatgaagggacagctg

SEQ ID NO: 5105695 - DNA, 20 bp, Homo sapiens
aaggctcacgaagggcatcc

SEQ ID NO: 5105696 - DNA, 17 bp, Homo sapiens
aaggctcatttaaaaca

SEQ ID NO: 5105697 - DNA, 19 bp, Homo sapiens
aaggctccaggagcagcca

SEQ ID NO: 5105698 - DNA, 18 bp, Homo sapiens
aaggctcccattttcagt

SEQ ID NO: 5105699 - DNA, 14 bp, Homo sapiens
aaggctccccaccc

SEQ ID NO: 5105700 - DNA, 13 bp, Homo sapiens
aaggctccctcgc

SEQ ID NO: 5105701 - DNA, 15 bp, Homo sapiens
aaggctcctgagaca

SEQ ID NO: 5105702 - DNA, 16 bp, Homo sapiens
aaggctcgagcatgcc

SEQ ID NO: 5105703 - DNA, 18 bp, Homo sapiens
aaggctcgagcatgcctg

SEQ ID NO: 5105704 - DNA, 21 bp, Homo sapiens
aaggctctatgagtctagatg

SEQ ID NO: 5105705 - DNA, 14 bp, Homo sapiens
aaggctctcacccc

SEQ ID NO: 5105706 - DNA, 22 bp, Homo sapiens
aaggctctcgggtgggggagcc

SEQ ID NO: 5105707 - DNA, 19 bp, Homo sapiens
aaggctctctctgtccctg

SEQ ID NO: 5105708 - DNA, 14 bp, Homo sapiens
aaggctctctggtc

SEQ ID NO: 5105709 - DNA, 12 bp, Homo sapiens
aaggctctgaga

SEQ ID NO: 5105710 - DNA, 13 bp, Homo sapiens
aaggctctgagag

SEQ ID NO: 5105711 - DNA, 23 bp, Homo sapiens
aaggctctgagcaaatgtggctc

SEQ ID NO: 5105712 - DNA, 18 bp, Homo sapiens
aaggctctgtcactccag

SEQ ID NO: 5105713 - DNA, 11 bp, Homo sapiens
aaggctctgtg

SEQ ID NO: 5105714 - DNA, 23 bp, Homo sapiens
aaggctctgtgccttggtctctc

SEQ ID NO: 5105715 - DNA, 21 bp, Homo sapiens
aaggctctgttatcagctggg

SEQ ID NO: 5105716 - DNA, 23 bp, Homo sapiens
aaggctctgttatcagctgggca

SEQ ID NO: 5105717 - DNA, 16 bp, Homo sapiens
aaggctcttcttcctc

SEQ ID NO: 5105718 - DNA, 14 bp, Homo sapiens
aaggctcttttgta

SEQ ID NO: 5105719 - DNA, 12 bp, Homo sapiens
aaggctgaaaag

SEQ ID NO: 5105720 - DNA, 15 bp, Homo sapiens
aaggctgaaaagaag

SEQ ID NO: 5105721 - DNA, 23 bp, Homo sapiens
aaggctgaatcaaagacatttca

SEQ ID NO: 5105722 - DNA, 22 bp, Homo sapiens
aaggctgacagactcactggga

SEQ ID NO: 5105723 - DNA, 20 bp, Homo sapiens
aaggctgacattcactgagt

SEQ ID NO: 5105724 - DNA, 14 bp, Homo sapiens
aaggctgagaagga

SEQ ID NO: 5105725 - DNA, 17 bp, Homo sapiens
aaggctgaggaaaggcc

SEQ ID NO: 5105726 - DNA, 20 bp, Homo sapiens
aaggctgaggaaaggccagc

SEQ ID NO: 5105727 - DNA, 23 bp, Homo sapiens
aaggctgaggcaggaggatcact

SEQ ID NO: 5105728 - DNA, 20 bp, Homo sapiens
aaggctgagggctgccagca

SEQ ID NO: 5105729 - DNA, 14 bp, Homo sapiens
aaggctgatgcatt

SEQ ID NO: 5105730 - DNA, 23 bp, Homo sapiens
aaggctgatgccaagttgtttga

SEQ ID NO: 5105731 - DNA, 16 bp, Homo sapiens
aaggctgatgtcaatt

SEQ ID NO: 5105732 - DNA, 17 bp, Homo sapiens
aaggctgcacactgaca

SEQ ID NO: 5105733 - DNA, 19 bp, Homo sapiens
aaggctgcagctaatttgt

SEQ ID NO: 5105734 - DNA, 12 bp, Homo sapiens
aaggctgcccct

SEQ ID NO: 5105735 - DNA, 12 bp, Homo sapiens
aaggctgcctgg

SEQ ID NO: 5105736 - DNA, 17 bp, Homo sapiens
aaggctgcctggagaaa

SEQ ID NO: 5105737 - DNA, 20 bp, Homo sapiens
aaggctgcctggagaaagga

SEQ ID NO: 5105738 - DNA, 15 bp, Homo sapiens
aaggctgctggcttc

SEQ ID NO: 5105739 - DNA, 23 bp, Homo sapiens
aaggctgctggcttcagggaggg

SEQ ID NO: 5105740 - DNA, 16 bp, Homo sapiens
aaggctgctgtactga

SEQ ID NO: 5105741 - DNA, 17 bp, Homo sapiens
aaggctggatgtgcttt

SEQ ID NO: 5105742 - DNA, 13 bp, Homo sapiens
aaggctggcaggt

SEQ ID NO: 5105743 - DNA, 22 bp, Homo sapiens
aaggctggccagcaaggcaggt

SEQ ID NO: 5105744 - DNA, 20 bp, Homo sapiens
aaggctggcgagagtctggc

SEQ ID NO: 5105745 - DNA, 13 bp, Homo sapiens
aaggctggggcat

SEQ ID NO: 5105746 - DNA, 23 bp, Homo sapiens
aaggctggggccagtgtaaggca

SEQ ID NO: 5105747 - DNA, 18 bp, Homo sapiens
aaggctgggtccagggga

SEQ ID NO: 5105748 - DNA, 18 bp, Homo sapiens
aaggctggtaagagaagt

SEQ ID NO: 5105749 - DNA, 16 bp, Homo sapiens
aaggctgtacatagtc

SEQ ID NO: 5105750 - DNA, 18 bp, Homo sapiens
aaggctgtccacgtactt

SEQ ID NO: 5105751 - DNA, 18 bp, Homo sapiens
aaggctgtcttctcccag

SEQ ID NO: 5105752 - DNA, 15 bp, Homo sapiens
aaggctgtgccaggc

SEQ ID NO: 5105753 - DNA, 16 bp, Homo sapiens
aaggctgtgctccctg

SEQ ID NO: 5105754 - DNA, 15 bp, Homo sapiens
aaggctgtgctcttc

SEQ ID NO: 5105755 - DNA, 17 bp, Homo sapiens
aaggctgtgctgccctg

SEQ ID NO: 5105756 - DNA, 13 bp, Homo sapiens
aaggctgtgtaag

SEQ ID NO: 5105757 - DNA, 14 bp, Homo sapiens
aaggctgtgtaaga

SEQ ID NO: 5105758 - DNA, 19 bp, Homo sapiens
aaggctgtgtttagattgt

SEQ ID NO: 5105759 - DNA, 20 bp, Homo sapiens
aaggctgtgtttagattgta

SEQ ID NO: 5105760 - DNA, 22 bp, Homo sapiens
aaggctgttaaatacaggaaac

SEQ ID NO: 5105761 - DNA, 23 bp, Homo sapiens
aaggctgttctttaaatgtctga

SEQ ID NO: 5105762 - DNA, 22 bp, Homo sapiens
aaggcttaattgactgaaatta

SEQ ID NO: 5105763 - DNA, 17 bp, Homo sapiens
aagtagaacaaaaacta

SEQ ID NO: 5105764 - DNA, 22 bp, Homo sapiens
aagtagaactcttaaatacttt

SEQ ID NO: 5105765 - DNA, 13 bp, Homo sapiens
aagtagaagagga

SEQ ID NO: 5105766 - DNA, 14 bp, Homo sapiens
aagtagaagaggag

SEQ ID NO: 5105767 - DNA, 22 bp, Homo sapiens
aagtagaattatatctaattta

SEQ ID NO: 5105768 - DNA, 19 bp, Homo sapiens
aagtagacagttttgagaa

SEQ ID NO: 5105769 - DNA, 16 bp, Homo sapiens
aagtagacctcttttt

SEQ ID NO: 5105770 - DNA, 19 bp, Homo sapiens
aagtagacttcatttttcc

SEQ ID NO: 5105771 - DNA, 16 bp, Homo sapiens
aagtagagaacagtca

SEQ ID NO: 5105772 - DNA, 12 bp, Homo sapiens
aagtagagaagt

SEQ ID NO: 5105773 - DNA, 12 bp, Homo sapiens
aagtagaggagg

SEQ ID NO: 5105774 - DNA, 14 bp, Homo sapiens
aagtagaggtggct

SEQ ID NO: 5105775 - DNA, 20 bp, Homo sapiens
aagtagaggttgtatacacc

SEQ ID NO: 5105776 - DNA, 16 bp, Homo sapiens
aagtagatcacctcct

SEQ ID NO: 5105777 - DNA, 21 bp, Homo sapiens
aagtagatctgctttctgttc

SEQ ID NO: 5105778 - DNA, 15 bp, Homo sapiens
aagtagatgcatttg

SEQ ID NO: 5105779 - DNA, 14 bp, Homo sapiens
aagtagattaaaat

SEQ ID NO: 5105780 - DNA, 13 bp, Homo sapiens
aagtagatttcat

SEQ ID NO: 5105781 - DNA, 14 bp, Homo sapiens
aagtagatttcatg

SEQ ID NO: 5105782 - DNA, 18 bp, Homo sapiens
aagtagcaaacagggctt

SEQ ID NO: 5105783 - DNA, 19 bp, Homo sapiens
aagtagcaaatgtttactg

SEQ ID NO: 5105784 - DNA, 21 bp, Homo sapiens
aagtagcaaatgtttactgta

SEQ ID NO: 5105785 - DNA, 16 bp, Homo sapiens
aagtagcacaggctga

SEQ ID NO: 5105786 - DNA, 18 bp, Homo sapiens
aagtagcactgactattt

SEQ ID NO: 5105787 - DNA, 17 bp, Homo sapiens
aagtagcattcatgtaa

SEQ ID NO: 5105788 - DNA, 16 bp, Homo sapiens
aagtagcatttactgt

SEQ ID NO: 5105789 - DNA, 14 bp, Homo sapiens
aagtagcctctggg

SEQ ID NO: 5105790 - DNA, 22 bp, Homo sapiens
aagtagcctctgggatctgcca

SEQ ID NO: 5105791 - DNA, 16 bp, Homo sapiens
aagtagctagtagcaa

SEQ ID NO: 5105792 - DNA, 13 bp, Homo sapiens
aagtagctgctag

SEQ ID NO: 5105793 - DNA, 19 bp, Homo sapiens
aagtagctgggattacagg

SEQ ID NO: 5105794 - DNA, 14 bp, Homo sapiens
aagtagctgggttt

SEQ ID NO: 5105795 - DNA, 13 bp, Homo sapiens
aagtagctttgaa

SEQ ID NO: 5105796 - DNA, 14 bp, Homo sapiens
aagtaggaaagtca

SEQ ID NO: 5105797 - DNA, 22 bp, Homo sapiens
aagtaggactttcctaaatgtt

SEQ ID NO: 5105798 - DNA, 21 bp, Homo sapiens
aagtaggagacacagatggca

SEQ ID NO: 5105799 - DNA, 12 bp, Homo sapiens
aagtaggctgcc

SEQ ID NO: 5105800 - DNA, 16 bp, Homo sapiens
aagtagggaagtttta

SEQ ID NO: 5105801 - DNA, 17 bp, Homo sapiens
aagtagggatgcggatc

SEQ ID NO: 5105802 - DNA, 16 bp, Homo sapiens
aagtaggtatacaaaa

SEQ ID NO: 5105803 - DNA, 21 bp, Homo sapiens
aagtaggtatacaaaagacta

SEQ ID NO: 5105804 - DNA, 15 bp, Homo sapiens
aagtaggtggcttga

SEQ ID NO: 5105805 - DNA, 13 bp, Homo sapiens
aagtagtaaatca

SEQ ID NO: 5105806 - DNA, 22 bp, Homo sapiens
aagtagtacttcttctgtaata

SEQ ID NO: 5105807 - DNA, 15 bp, Homo sapiens
aagtagtcctggcag

SEQ ID NO: 5105808 - DNA, 14 bp, Homo sapiens
aagtagtcctgtga

SEQ ID NO: 5105809 - DNA, 17 bp, Homo sapiens
aagtagtgtatcacagt

SEQ ID NO: 5105810 - DNA, 18 bp, Homo sapiens
aagtagtgtcattcatat

SEQ ID NO: 5105811 - DNA, 19 bp, Homo sapiens
aagtagttatcatgttagt

SEQ ID NO: 5105812 - DNA, 16 bp, Homo sapiens
aagtagttcctatttt

SEQ ID NO: 5105813 - DNA, 20 bp, Homo sapiens
aagtagttgattcagccctc

SEQ ID NO: 5105814 - DNA, 16 bp, Homo sapiens
aagtagttggtttgta

SEQ ID NO: 5105815 - DNA, 19 bp, Homo sapiens
aagtagttggtttgtatga

SEQ ID NO: 5105816 - DNA, 12 bp, Homo sapiens
aagtagtttgta

SEQ ID NO: 5105817 - DNA, 15 bp, Homo sapiens
aagtataaaatacaa

SEQ ID NO: 5105818 - DNA, 20 bp, Homo sapiens
aagtataaaatagtatgaaa

SEQ ID NO: 5105819 - DNA, 21 bp, Homo sapiens
aagtataaatttgtgtaatat

SEQ ID NO: 5105820 - DNA, 16 bp, Homo sapiens
aagtataacaattaaa

SEQ ID NO: 5105821 - DNA, 18 bp, Homo sapiens
aagtataactaatttgct

SEQ ID NO: 5105822 - DNA, 13 bp, Homo sapiens
aagtataaggtgc

SEQ ID NO: 5105823 - DNA, 13 bp, Homo sapiens
aagtataatgttt

SEQ ID NO: 5105824 - DNA, 20 bp, Homo sapiens
aagtataatgtttattaaat

SEQ ID NO: 5105825 - DNA, 15 bp, Homo sapiens
aagtataatttcagt

SEQ ID NO: 5105826 - DNA, 23 bp, Homo sapiens
aagtatacaggaggatgtgaata

SEQ ID NO: 5105827 - DNA, 12 bp, Homo sapiens
aagtatacagtt

SEQ ID NO: 5105828 - DNA, 15 bp, Homo sapiens
aagtatacatgtcaa

SEQ ID NO: 5105829 - DNA, 12 bp, Homo sapiens
aagtatacattt

SEQ ID NO: 5105830 - DNA, 14 bp, Homo sapiens
aagtatacatttag

SEQ ID NO: 5105831 - DNA, 20 bp, Homo sapiens
aagtatacctggctttttaa

SEQ ID NO: 5105832 - DNA, 18 bp, Homo sapiens
aagtatagaaaatcttca

SEQ ID NO: 5105833 - DNA, 22 bp, Homo sapiens
aagtatagcctatggcagaaaa

SEQ ID NO: 5105834 - DNA, 20 bp, Homo sapiens
aagtataggataaattacat

SEQ ID NO: 5105835 - DNA, 21 bp, Homo sapiens
aagtataggataaattacatt

SEQ ID NO: 5105836 - DNA, 22 bp, Homo sapiens
aagtatataaatactatagtta

SEQ ID NO: 5105837 - DNA, 16 bp, Homo sapiens
aagtatataatatgtc

SEQ ID NO: 5105838 - DNA, 23 bp, Homo sapiens
aagtatataatggtttcaaagat

SEQ ID NO: 5105839 - DNA, 16 bp, Homo sapiens
aagtatatacagagcc

SEQ ID NO: 5105840 - DNA, 19 bp, Homo sapiens
aagtatatacttttaaatt

SEQ ID NO: 5105841 - DNA, 16 bp, Homo sapiens
aagtatatagtatatt

SEQ ID NO: 5105842 - DNA, 14 bp, Homo sapiens
aagtatatattcta

SEQ ID NO: 5105843 - DNA, 19 bp, Homo sapiens
aagtatatcttaagaatgt

SEQ ID NO: 5105844 - DNA, 15 bp, Homo sapiens
aagtatatgtgagaa

SEQ ID NO: 5105845 - DNA, 19 bp, Homo sapiens
aagtatatgtgagaaatca

SEQ ID NO: 5105846 - DNA, 14 bp, Homo sapiens
aagtatattaaaca

SEQ ID NO: 5105847 - DNA, 19 bp, Homo sapiens
aagtatattcaaaaattat

SEQ ID NO: 5105848 - DNA, 15 bp, Homo sapiens
aagtatattcttatt

SEQ ID NO: 5105849 - DNA, 19 bp, Homo sapiens
aagtatattgtgagttttc

SEQ ID NO: 5105850 - DNA, 20 bp, Homo sapiens
aagtatattgtgagttttct

SEQ ID NO: 5105851 - DNA, 15 bp, Homo sapiens
aagtatatttgtaaa

SEQ ID NO: 5105852 - DNA, 19 bp, Homo sapiens
aagtatatttgtaaaagct

SEQ ID NO: 5105853 - DNA, 16 bp, Homo sapiens
aagtatcactctaaaa

SEQ ID NO: 5105854 - DNA, 14 bp, Homo sapiens
aagtatcacttttc

SEQ ID NO: 5105855 - DNA, 20 bp, Homo sapiens
aagtatcaggaatataaata

SEQ ID NO: 5105856 - DNA, 22 bp, Homo sapiens
aagtatcatctaaatattatgc

SEQ ID NO: 5105857 - DNA, 21 bp, Homo sapiens
aagtatcatggaaatattatg

SEQ ID NO: 5105858 - DNA, 15 bp, Homo sapiens
aagtatccagacctt

SEQ ID NO: 5105859 - DNA, 17 bp, Homo sapiens
aagtatccctactgtaa

SEQ ID NO: 5105860 - DNA, 16 bp, Homo sapiens
aagtatcctgcgacct

SEQ ID NO: 5105861 - DNA, 15 bp, Homo sapiens
aagtatccttcattg

SEQ ID NO: 5105862 - DNA, 23 bp, Homo sapiens
aagtatccttcattgtgaggttt

SEQ ID NO: 5105863 - DNA, 21 bp, Homo sapiens
aagtatcgggggctggggcag

SEQ ID NO: 5105864 - DNA, 23 bp, Homo sapiens
aagtatctaactcttctggaaac

SEQ ID NO: 5105865 - DNA, 17 bp, Homo sapiens
aagtatctacatgcggt

SEQ ID NO: 5105866 - DNA, 20 bp, Homo sapiens
aagtatctctactttcctga

SEQ ID NO: 5105867 - DNA, 20 bp, Homo sapiens
aagtatctgggattattctt

SEQ ID NO: 5105868 - DNA, 21 bp, Homo sapiens
aagtatctgggattattcttt

SEQ ID NO: 5105869 - DNA, 15 bp, Homo sapiens
aagtatctgtacctg

SEQ ID NO: 5105870 - DNA, 19 bp, Homo sapiens
aagtatcttcgttcttgtt

SEQ ID NO: 5105871 - DNA, 20 bp, Homo sapiens
aagtatcttctatttttatc

SEQ ID NO: 5105872 - DNA, 15 bp, Homo sapiens
aagtatctttaacaa

SEQ ID NO: 5105873 - DNA, 14 bp, Homo sapiens
aagtatgaatctat

SEQ ID NO: 5105874 - DNA, 17 bp, Homo sapiens
aagtatgagttatcagc

SEQ ID NO: 5105875 - DNA, 22 bp, Homo sapiens
aagtatgcaatgcttcattatt

SEQ ID NO: 5105876 - DNA, 16 bp, Homo sapiens
aagtatgcactaatca

SEQ ID NO: 5105877 - DNA, 13 bp, Homo sapiens
aagtatgccttaa

SEQ ID NO: 5105878 - DNA, 21 bp, Homo sapiens
aagtatgccttaagcagaaca

SEQ ID NO: 5105879 - DNA, 15 bp, Homo sapiens
aagtatggtgtgttc

SEQ ID NO: 5105880 - DNA, 13 bp, Homo sapiens
aagtatgtaaaca

SEQ ID NO: 5105881 - DNA, 12 bp, Homo sapiens
aagtatgtaaag

SEQ ID NO: 5105882 - DNA, 20 bp, Homo sapiens
aagtatgtatattaaaaaag

SEQ ID NO: 5105883 - DNA, 21 bp, Homo sapiens
aagtatgtatattaaaaaaga

SEQ ID NO: 5105884 - DNA, 13 bp, Homo sapiens
aagtatgtgaaaa

SEQ ID NO: 5105885 - DNA, 14 bp, Homo sapiens
aagtatgtgagtag

SEQ ID NO: 5105886 - DNA, 21 bp, Homo sapiens
aagtatgtgagtagtcttatg

SEQ ID NO: 5105887 - DNA, 18 bp, Homo sapiens
aagtatgtgagtgtgtcc

SEQ ID NO: 5105888 - DNA, 18 bp, Homo sapiens
aagtatgtgatatctgaa

SEQ ID NO: 5105889 - DNA, 19 bp, Homo sapiens
aagtatgtgtaaaatgtga

SEQ ID NO: 5105890 - DNA, 13 bp, Homo sapiens
aagtatgttgtac

SEQ ID NO: 5105891 - DNA, 16 bp, Homo sapiens
aagtatgttgtacata

SEQ ID NO: 5105892 - DNA, 14 bp, Homo sapiens
aagtatgttgtata

SEQ ID NO: 5105893 - DNA, 14 bp, Homo sapiens
aagtatgtttttaa

SEQ ID NO: 5105894 - DNA, 17 bp, Homo sapiens
aagtattaaaacattgg

SEQ ID NO: 5105895 - DNA, 21 bp, Homo sapiens
aagtattaaactgtaaatcat

SEQ ID NO: 5105896 - DNA, 14 bp, Homo sapiens
aagtattaagcata

SEQ ID NO: 5105897 - DNA, 18 bp, Homo sapiens
aagtattaagcatatatt

SEQ ID NO: 5105898 - DNA, 19 bp, Homo sapiens
aagtattacaaccatatat

SEQ ID NO: 5105899 - DNA, 17 bp, Homo sapiens
aagtattactaaattga

SEQ ID NO: 5105900 - DNA, 17 bp, Homo sapiens
aagtattataaattatg

SEQ ID NO: 5105901 - DNA, 19 bp, Homo sapiens
aagtattatacctttttta

SEQ ID NO: 5105902 - DNA, 15 bp, Homo sapiens
aagtattatatttta

SEQ ID NO: 5105903 - DNA, 13 bp, Homo sapiens
aagtattatcaga

SEQ ID NO: 5105904 - DNA, 23 bp, Homo sapiens
aagtattatcattgctcccctga

SEQ ID NO: 5105905 - DNA, 13 bp, Homo sapiens
aagtattatctgt

SEQ ID NO: 5105906 - DNA, 22 bp, Homo sapiens
aagtattatctgtaaaaattgt

SEQ ID NO: 5105907 - DNA, 22 bp, Homo sapiens
aagtattatgccccagttcaga

SEQ ID NO: 5105908 - DNA, 16 bp, Homo sapiens
aagtattattcaaacc

SEQ ID NO: 5105909 - DNA, 15 bp, Homo sapiens
aagtattattttcca

SEQ ID NO: 5105910 - DNA, 12 bp, Homo sapiens
aagtattcacaa

SEQ ID NO: 5105911 - DNA, 13 bp, Homo sapiens
aagtattcagaaa

SEQ ID NO: 5105912 - DNA, 16 bp, Homo sapiens
aagtattccaccttaa

SEQ ID NO: 5105913 - DNA, 19 bp, Homo sapiens
aagtattccaccttaaatt

SEQ ID NO: 5105914 - DNA, 15 bp, Homo sapiens
aagtattccttggcc

SEQ ID NO: 5105915 - DNA, 19 bp, Homo sapiens
aagtattccttggcccagc

SEQ ID NO: 5105916 - DNA, 13 bp, Homo sapiens
aagtattctaaat

SEQ ID NO: 5105917 - DNA, 15 bp, Homo sapiens
aagtattctaaattt

SEQ ID NO: 5105918 - DNA, 19 bp, Homo sapiens
aagtattctacctaaatct

SEQ ID NO: 5105919 - DNA, 20 bp, Homo sapiens
aagtattctgcctttgcaga

SEQ ID NO: 5105920 - DNA, 19 bp, Homo sapiens
aagtattcttatttaatga

SEQ ID NO: 5105921 - DNA, 17 bp, Homo sapiens
aagtattcttttcaatt

SEQ ID NO: 5105922 - DNA, 23 bp, Homo sapiens
aagtattcttttcaattatattg

SEQ ID NO: 5105923 - DNA, 14 bp, Homo sapiens
aagtattctttttc

SEQ ID NO: 5105924 - DNA, 22 bp, Homo sapiens
aagtattgaaagccaacaactc

SEQ ID NO: 5105925 - DNA, 13 bp, Homo sapiens
aagtattgaaagt

SEQ ID NO: 5105926 - DNA, 22 bp, Homo sapiens
aagtattgcatctgtataagta

SEQ ID NO: 5105927 - DNA, 18 bp, Homo sapiens
aagtattgccaaacatta

SEQ ID NO: 5105928 - DNA, 14 bp, Homo sapiens
aagtattgctgaaa

SEQ ID NO: 5105929 - DNA, 15 bp, Homo sapiens
aagtattgctgaaaa

SEQ ID NO: 5105930 - DNA, 21 bp, Homo sapiens
aagtattgctgagtccaacaa

SEQ ID NO: 5105931 - DNA, 12 bp, Homo sapiens
aagtattgtaaa

SEQ ID NO: 5105932 - DNA, 14 bp, Homo sapiens
aagtattgtgaaag

SEQ ID NO: 5105933 - DNA, 13 bp, Homo sapiens
aagtattgtttcc

SEQ ID NO: 5105934 - DNA, 15 bp, Homo sapiens
aagtatttaaacttt

SEQ ID NO: 5105935 - DNA, 19 bp, Homo sapiens
aagtatttaagcctaaaga

SEQ ID NO: 5105936 - DNA, 16 bp, Homo sapiens
aagtatttaattagtg

SEQ ID NO: 5105937 - DNA, 18 bp, Homo sapiens
aagtatttaattagtgct

SEQ ID NO: 5105938 - DNA, 12 bp, Homo sapiens
aagtatttatat

SEQ ID NO: 5105939 - DNA, 14 bp, Homo sapiens
aagtatttatatat

SEQ ID NO: 5105940 - DNA, 16 bp, Homo sapiens
aagtatttatatattt

SEQ ID NO: 5105941 - DNA, 20 bp, Homo sapiens
aagtatttatatatttataa

SEQ ID NO: 5105942 - DNA, 23 bp, Homo sapiens
aagtatttatatatttataactc

SEQ ID NO: 5105943 - DNA, 14 bp, Homo sapiens
aaggcttataaaac

SEQ ID NO: 5105944 - DNA, 15 bp, Homo sapiens
aaggcttataaaaca

SEQ ID NO: 5105945 - DNA, 18 bp, Homo sapiens
aaggcttatattcaacca

SEQ ID NO: 5105946 - DNA, 19 bp, Homo sapiens
aaggcttcaatttattgca

SEQ ID NO: 5105947 - DNA, 15 bp, Homo sapiens
aaggcttcagtctca

SEQ ID NO: 5105948 - DNA, 16 bp, Homo sapiens
aaggcttccaggctga

SEQ ID NO: 5105949 - DNA, 13 bp, Homo sapiens
aaggcttctccac

SEQ ID NO: 5105950 - DNA, 15 bp, Homo sapiens
aaggcttggctggtg

SEQ ID NO: 5105951 - DNA, 14 bp, Homo sapiens
aaggcttgggattt

SEQ ID NO: 5105952 - DNA, 19 bp, Homo sapiens
aaggcttgggatttgctgt

SEQ ID NO: 5105953 - DNA, 19 bp, Homo sapiens
aaggcttgttgtgctttta

SEQ ID NO: 5105954 - DNA, 21 bp, Homo sapiens
aaggctttaaaagtcattatt

SEQ ID NO: 5105955 - DNA, 14 bp, Homo sapiens
aaggctttctttat

SEQ ID NO: 5105956 - DNA, 20 bp, Homo sapiens
aaggctttgccatgggcctg

SEQ ID NO: 5105957 - DNA, 21 bp, Homo sapiens
aaggctttgccctgctgccct

SEQ ID NO: 5105958 - DNA, 22 bp, Homo sapiens
aaggctttgccctgctgccctc

SEQ ID NO: 5105959 - DNA, 17 bp, Homo sapiens
aaggctttggcaacaga

SEQ ID NO: 5105960 - DNA, 20 bp, Homo sapiens
aaggctttgggatatgctgt

SEQ ID NO: 5105961 - DNA, 22 bp, Homo sapiens
aaggcttttggtctccctggga

SEQ ID NO: 5105962 - DNA, 17 bp, Homo sapiens
aaggctttttcttccct

SEQ ID NO: 5105963 - DNA, 16 bp, Homo sapiens
aagggaaaaaaaatgt

SEQ ID NO: 5105964 - DNA, 13 bp, Homo sapiens
aagggaaaaaaga

SEQ ID NO: 5105965 - DNA, 15 bp, Homo sapiens
aagggaaaaaagaaa

SEQ ID NO: 5105966 - DNA, 17 bp, Homo sapiens
aagggaaaaaagaaaga

SEQ ID NO: 5105967 - DNA, 16 bp, Homo sapiens
aagggaaaaaataaaa

SEQ ID NO: 5105968 - DNA, 20 bp, Homo sapiens
aagggaaaaaataaaaatca

SEQ ID NO: 5105969 - DNA, 11 bp, Homo sapiens
aagggaaaaat

SEQ ID NO: 5105970 - DNA, 15 bp, Homo sapiens
aagggaaaaatatat

SEQ ID NO: 5105971 - DNA, 19 bp, Homo sapiens
aagggaaaaatttttatgt

SEQ ID NO: 5105972 - DNA, 23 bp, Homo sapiens
aagggaaaacaaatatttcactt

SEQ ID NO: 5105973 - DNA, 11 bp, Homo sapiens
aagggaaaagg

SEQ ID NO: 5105974 - DNA, 14 bp, Homo sapiens
aagggaaactggct

SEQ ID NO: 5105975 - DNA, 15 bp, Homo sapiens
aagggaaagcctctg

SEQ ID NO: 5105976 - DNA, 20 bp, Homo sapiens
aagggaaagcgggcagcccc

SEQ ID NO: 5105977 - DNA, 15 bp, Homo sapiens
aagggaaagtttttt

SEQ ID NO: 5105978 - DNA, 13 bp, Homo sapiens
aagggaaatatca

SEQ ID NO: 5105979 - DNA, 14 bp, Homo sapiens
aagggaaatatcat

SEQ ID NO: 5105980 - DNA, 21 bp, Homo sapiens
aagggaaattgtttatgtgtt

SEQ ID NO: 5105981 - DNA, 12 bp, Homo sapiens
aagggaacacaa

SEQ ID NO: 5105982 - DNA, 19 bp, Homo sapiens
aagggaacagcctgagccg

SEQ ID NO: 5105983 - DNA, 15 bp, Homo sapiens
aagggaaccagccct

SEQ ID NO: 5105984 - DNA, 21 bp, Homo sapiens
aagggaaccagccctccagag

SEQ ID NO: 5105985 - DNA, 20 bp, Homo sapiens
aagggaagaaggaggaatgc

SEQ ID NO: 5105986 - DNA, 18 bp, Homo sapiens
aagggaagcccagcctgc

SEQ ID NO: 5105987 - DNA, 20 bp, Homo sapiens
aagggaagccttttgcaaat

SEQ ID NO: 5105988 - DNA, 14 bp, Homo sapiens
aagggaagctttgt

SEQ ID NO: 5105989 - DNA, 18 bp, Homo sapiens
aagggaaggaactctggc

SEQ ID NO: 5105990 - DNA, 23 bp, Homo sapiens
aagggaaggccccacagacaagg

SEQ ID NO: 5105991 - DNA, 22 bp, Homo sapiens
aagggaagtgaggcccaaggag

SEQ ID NO: 5105992 - DNA, 18 bp, Homo sapiens
aagggaatactcacattt

SEQ ID NO: 5105993 - DNA, 12 bp, Homo sapiens
aagggaatcctc

SEQ ID NO: 5105994 - DNA, 17 bp, Homo sapiens
aagggaatcctcctcca

SEQ ID NO: 5105995 - DNA, 14 bp, Homo sapiens
aagggacacacaca

SEQ ID NO: 5105996 - DNA, 20 bp, Homo sapiens
aagggacacaggagaccacc

SEQ ID NO: 5105997 - DNA, 19 bp, Homo sapiens
aagggacagcaagtgagca

SEQ ID NO: 5105998 - DNA, 14 bp, Homo sapiens
aagggacaggaagg

SEQ ID NO: 5105999 - DNA, 21 bp, Homo sapiens
aagggacaggtgggcctggcg

SEQ ID NO: 5106000 - DNA, 23 bp, Homo sapiens
aagggacaggtgggcctggcggc

SEQ ID NO: 5106001 - DNA, 12 bp, Homo sapiens
aagggacatgaa

SEQ ID NO: 5106002 - DNA, 15 bp, Homo sapiens
aagggacatgtcttt

SEQ ID NO: 5106003 - DNA, 13 bp, Homo sapiens
aagggacattgaa

SEQ ID NO: 5106004 - DNA, 13 bp, Homo sapiens
aagggaccaaggc

SEQ ID NO: 5106005 - DNA, 16 bp, Homo sapiens
aagggacccacctgct

SEQ ID NO: 5106006 - DNA, 22 bp, Homo sapiens
aagggacccgaagcccaggctg

SEQ ID NO: 5106007 - DNA, 17 bp, Homo sapiens
aagggactccagaagca

SEQ ID NO: 5106008 - DNA, 13 bp, Homo sapiens
aagggactctggg

SEQ ID NO: 5106009 - DNA, 14 bp, Homo sapiens
aagggactctgggc

SEQ ID NO: 5106010 - DNA, 20 bp, Homo sapiens
aagggactctgggctgtgcc

SEQ ID NO: 5106011 - DNA, 17 bp, Homo sapiens
aagggactgaggcaagc

SEQ ID NO: 5106012 - DNA, 18 bp, Homo sapiens
aagggactggatctgcag

SEQ ID NO: 5106013 - DNA, 15 bp, Homo sapiens
aagggactggtccag

SEQ ID NO: 5106014 - DNA, 22 bp, Homo sapiens
aagggacttgtcccaagtctga

SEQ ID NO: 5106015 - DNA, 13 bp, Homo sapiens
aagggagaaaaag

SEQ ID NO: 5106016 - DNA, 13 bp, Homo sapiens
aagggagaaatgc

SEQ ID NO: 5106017 - DNA, 15 bp, Homo sapiens
aagggagaagaaagg

SEQ ID NO: 5106018 - DNA, 16 bp, Homo sapiens
aagggagaagaaaggt

SEQ ID NO: 5106019 - DNA, 16 bp, Homo sapiens
aagggagaagacactg

SEQ ID NO: 5106020 - DNA, 21 bp, Homo sapiens
aagggagaaggaagggcagag

SEQ ID NO: 5106021 - DNA, 13 bp, Homo sapiens
aagggagaatata

SEQ ID NO: 5106022 - DNA, 16 bp, Homo sapiens
aagggagagaaaagct

SEQ ID NO: 5106023 - DNA, 17 bp, Homo sapiens
aagggagagacctcatc

SEQ ID NO: 5106024 - DNA, 22 bp, Homo sapiens
aagggagagggcctctgcctgg

SEQ ID NO: 5106025 - DNA, 22 bp, Homo sapiens
aagggagagttctttgctgccc

SEQ ID NO: 5106026 - DNA, 15 bp, Homo sapiens
aagggagatgtcagg

SEQ ID NO: 5106027 - DNA, 22 bp, Homo sapiens
aagggagattcaaaaaaaaaat

SEQ ID NO: 5106028 - DNA, 19 bp, Homo sapiens
aagggagccaagggatgga

SEQ ID NO: 5106029 - DNA, 17 bp, Homo sapiens
aagggagctagccagag

SEQ ID NO: 5106030 - DNA, 13 bp, Homo sapiens
aagggaggaagat

SEQ ID NO: 5106031 - DNA, 20 bp, Homo sapiens
aagggaggaaggcctttctt

SEQ ID NO: 5106032 - DNA, 22 bp, Homo sapiens
aagggaggaaggcctttcttct

SEQ ID NO: 5106033 - DNA, 13 bp, Homo sapiens
aagggaggcagtg

SEQ ID NO: 5106034 - DNA, 15 bp, Homo sapiens
aagggaggcctgagg

SEQ ID NO: 5106035 - DNA, 20 bp, Homo sapiens
aagggaggcctgaggggcag

SEQ ID NO: 5106036 - DNA, 13 bp, Homo sapiens
aagggagggaagg

SEQ ID NO: 5106037 - DNA, 22 bp, Homo sapiens
aagggagggaagggccaccctg

SEQ ID NO: 5106038 - DNA, 14 bp, Homo sapiens
aagggagggagcaa

SEQ ID NO: 5106039 - DNA, 13 bp, Homo sapiens
aagggagggcaga

SEQ ID NO: 5106040 - DNA, 18 bp, Homo sapiens
aagggagggcagagctgg

SEQ ID NO: 5106041 - DNA, 19 bp, Homo sapiens
aagggagggcagagctggt

SEQ ID NO: 5106042 - DNA, 20 bp, Homo sapiens
aagggagggcagagctggtg

SEQ ID NO: 5106043 - DNA, 18 bp, Homo sapiens
aagggagggctctgaggc

SEQ ID NO: 5106044 - DNA, 13 bp, Homo sapiens
aagggaggggaag

SEQ ID NO: 5106045 - DNA, 20 bp, Homo sapiens
aagggaggggaagagagagg

SEQ ID NO: 5106046 - DNA, 23 bp, Homo sapiens
aagggaggggaagagagaggcct

SEQ ID NO: 5106047 - DNA, 11 bp, Homo sapiens
aagggagggtg

SEQ ID NO: 5106048 - DNA, 18 bp, Homo sapiens
aagggagggtgcagccct

SEQ ID NO: 5106049 - DNA, 12 bp, Homo sapiens
aagggaggtggg

SEQ ID NO: 5106050 - DNA, 15 bp, Homo sapiens
aagggagtctgccag

SEQ ID NO: 5106051 - DNA, 17 bp, Homo sapiens
aagggagttgctcactc

SEQ ID NO: 5106052 - DNA, 22 bp, Homo sapiens
aagggagttgctcactcaggac

SEQ ID NO: 5106053 - DNA, 23 bp, Homo sapiens
aagggagttgctcactcaggact

SEQ ID NO: 5106054 - DNA, 18 bp, Homo sapiens
aagggagtttaaaaatgg

SEQ ID NO: 5106055 - DNA, 13 bp, Homo sapiens
aagggataaagaa

SEQ ID NO: 5106056 - DNA, 18 bp, Homo sapiens
aagggatataaaatgaaa

SEQ ID NO: 5106057 - DNA, 16 bp, Homo sapiens
aagggatattaagaat

SEQ ID NO: 5106058 - DNA, 16 bp, Homo sapiens
aagggatcctgcctgc

SEQ ID NO: 5106059 - DNA, 16 bp, Homo sapiens
aagggatctgagaaca

SEQ ID NO: 5106060 - DNA, 23 bp, Homo sapiens
aagggatgcaggctcccctgagg

SEQ ID NO: 5106061 - DNA, 17 bp, Homo sapiens
aagggatggacatcttg

SEQ ID NO: 5106062 - DNA, 22 bp, Homo sapiens
aagggatggacttgtgattggc

SEQ ID NO: 5106063 - DNA, 14 bp, Homo sapiens
aagggatggcaaga

SEQ ID NO: 5106064 - DNA, 17 bp, Homo sapiens
aagggatggcaagatgt

SEQ ID NO: 5106065 - DNA, 14 bp, Homo sapiens
aagggatggcacca

SEQ ID NO: 5106066 - DNA, 14 bp, Homo sapiens
aagggatgggggaa

SEQ ID NO: 5106067 - DNA, 20 bp, Homo sapiens
aagggatggtcaggcccagt

SEQ ID NO: 5106068 - DNA, 22 bp, Homo sapiens
aagggatggtggagtgagagcc

SEQ ID NO: 5106069 - DNA, 16 bp, Homo sapiens
aagggatgtatttgta

SEQ ID NO: 5106070 - DNA, 22 bp, Homo sapiens
aagggatgttattatccttggg

SEQ ID NO: 5106071 - DNA, 19 bp, Homo sapiens
aagggattacccaagcaaa

SEQ ID NO: 5106072 - DNA, 16 bp, Homo sapiens
aagggattagtatttt

SEQ ID NO: 5106073 - DNA, 14 bp, Homo sapiens
aagggattctggga

SEQ ID NO: 5106074 - DNA, 15 bp, Homo sapiens
aagggattctgggaa

SEQ ID NO: 5106075 - DNA, 17 bp, Homo sapiens
aagggattgctgaggca

SEQ ID NO: 5106076 - DNA, 23 bp, Homo sapiens
aagggatttagtaacatcatttt

SEQ ID NO: 5106077 - DNA, 20 bp, Homo sapiens
aagggattttagtcacacgt

SEQ ID NO: 5106078 - DNA, 22 bp, Homo sapiens
aagggattttagtcacacgtgg

SEQ ID NO: 5106079 - DNA, 23 bp, Homo sapiens
aagggattttcagccctcagaat

SEQ ID NO: 5106080 - DNA, 20 bp, Homo sapiens
aagggcaacaataaaatagc

SEQ ID NO: 5106081 - DNA, 22 bp, Homo sapiens
aagggcaacagatcagtaaaga

SEQ ID NO: 5106082 - DNA, 21 bp, Homo sapiens
aagggcaaggaatcctctggg

SEQ ID NO: 5106083 - DNA, 21 bp, Homo sapiens
aagggcaataccgtgttggtt

SEQ ID NO: 5106084 - DNA, 16 bp, Homo sapiens
aagggcacattgccca

SEQ ID NO: 5106085 - DNA, 18 bp, Homo sapiens
aagggcagaaggggaaga

SEQ ID NO: 5106086 - DNA, 18 bp, Homo sapiens
aagggcagaagtagggga

SEQ ID NO: 5106087 - DNA, 21 bp, Homo sapiens
aagggcagagaactgtctttc

SEQ ID NO: 5106088 - DNA, 19 bp, Homo sapiens
aagggcagagaatggctgg

SEQ ID NO: 5106089 - DNA, 11 bp, Homo sapiens
aagggcagagg

SEQ ID NO: 5106090 - DNA, 15 bp, Homo sapiens
aagggcagaggaaga

SEQ ID NO: 5106091 - DNA, 24 bp, Homo sapiens
aagggcagaggcaaggatggtggg

SEQ ID NO: 5106092 - DNA, 15 bp, Homo sapiens
aagggcagagtcaca

SEQ ID NO: 5106093 - DNA, 12 bp, Homo sapiens
aagggcagccag

SEQ ID NO: 5106094 - DNA, 13 bp, Homo sapiens
aagggcagccagg

SEQ ID NO: 5106095 - DNA, 17 bp, Homo sapiens
aagggcagccaggggct

SEQ ID NO: 5106096 - DNA, 13 bp, Homo sapiens
aagggcagccccg

SEQ ID NO: 5106097 - DNA, 12 bp, Homo sapiens
aagggcagccct

SEQ ID NO: 5106098 - DNA, 13 bp, Homo sapiens
aagggcagccctc

SEQ ID NO: 5106099 - DNA, 15 bp, Homo sapiens
aagggcagcttcagt

SEQ ID NO: 5106100 - DNA, 19 bp, Homo sapiens
aagggcagctttgctcata

SEQ ID NO: 5106101 - DNA, 21 bp, Homo sapiens
aagggcaggaaggagagcctg

SEQ ID NO: 5106102 - DNA, 15 bp, Homo sapiens
aagggcaggtcttca

SEQ ID NO: 5106103 - DNA, 23 bp, Homo sapiens
aagggcaggtcttcatatttttg

SEQ ID NO: 5106104 - DNA, 16 bp, Homo sapiens
aagggcagtaaagttt

SEQ ID NO: 5106105 - DNA, 14 bp, Homo sapiens
aagggcagtgccca

SEQ ID NO: 5106106 - DNA, 15 bp, Homo sapiens
aagggcagtggaggt

SEQ ID NO: 5106107 - DNA, 14 bp, Homo sapiens
aagggcataaagta

SEQ ID NO: 5106108 - DNA, 16 bp, Homo sapiens
aagggcatcaggcact

SEQ ID NO: 5106109 - DNA, 17 bp, Homo sapiens
aagggcatcaggcactg

SEQ ID NO: 5106110 - DNA, 17 bp, Homo sapiens
aagggcatccttctgcc

SEQ ID NO: 5106111 - DNA, 21 bp, Homo sapiens
aagggcatgagcattggatac

SEQ ID NO: 5106112 - DNA, 15 bp, Homo sapiens
aagggcattttaccc

SEQ ID NO: 5106113 - DNA, 13 bp, Homo sapiens
aagggcattttta

SEQ ID NO: 5106114 - DNA, 21 bp, Homo sapiens
aagggccaaacccacttctgg

SEQ ID NO: 5106115 - DNA, 22 bp, Homo sapiens
aagggccaaagaaccaaagaag

SEQ ID NO: 5106116 - DNA, 14 bp, Homo sapiens
aagggccaccctga

SEQ ID NO: 5106117 - DNA, 17 bp, Homo sapiens
aagggccaccctgagca

SEQ ID NO: 5106118 - DNA, 20 bp, Homo sapiens
aagggccaccctgagcagat

SEQ ID NO: 5106119 - DNA, 20 bp, Homo sapiens
aagggccaccctgctgcact

SEQ ID NO: 5106120 - DNA, 15 bp, Homo sapiens
aagggccagacagac

SEQ ID NO: 5106121 - DNA, 14 bp, Homo sapiens
aagggccagagcca

SEQ ID NO: 5106122 - DNA, 16 bp, Homo sapiens
aagggccagagccagg

SEQ ID NO: 5106123 - DNA, 14 bp, Homo sapiens
aagtatttattccc

SEQ ID NO: 5106124 - DNA, 15 bp, Homo sapiens
aagtatttattccca

SEQ ID NO: 5106125 - DNA, 13 bp, Homo sapiens
aagtatttcatgt

SEQ ID NO: 5106126 - DNA, 12 bp, Homo sapiens
aagtatttccat

SEQ ID NO: 5106127 - DNA, 14 bp, Homo sapiens
aagtatttcccagc

SEQ ID NO: 5106128 - DNA, 16 bp, Homo sapiens
aagtatttgatgtaca

SEQ ID NO: 5106129 - DNA, 17 bp, Homo sapiens
aagtatttgatgtacat

SEQ ID NO: 5106130 - DNA, 20 bp, Homo sapiens
aagtatttgatgtacattac

SEQ ID NO: 5106131 - DNA, 20 bp, Homo sapiens
aagtattttatctgtgttgt

SEQ ID NO: 5106132 - DNA, 15 bp, Homo sapiens
aagtattttcctgta

SEQ ID NO: 5106133 - DNA, 18 bp, Homo sapiens
aagtattttcctgtaaaa

SEQ ID NO: 5106134 - DNA, 15 bp, Homo sapiens
aagtattttcctgtt

SEQ ID NO: 5106135 - DNA, 14 bp, Homo sapiens
aagtattttgaagt

SEQ ID NO: 5106136 - DNA, 15 bp, Homo sapiens
aagtattttgaagtt

SEQ ID NO: 5106137 - DNA, 19 bp, Homo sapiens
aagtattttgaagtttaca

SEQ ID NO: 5106138 - DNA, 15 bp, Homo sapiens
aagtattttgctgga

SEQ ID NO: 5106139 - DNA, 21 bp, Homo sapiens
aagtatttttataaatataag

SEQ ID NO: 5106140 - DNA, 17 bp, Homo sapiens
aagtatttttataatga

SEQ ID NO: 5106141 - DNA, 15 bp, Homo sapiens
aagtatttttgaaag

SEQ ID NO: 5106142 - DNA, 20 bp, Homo sapiens
aagtatttttgaaagaattc

SEQ ID NO: 5106143 - DNA, 22 bp, Homo sapiens
aagtatttttgaaagaattcta

SEQ ID NO: 5106144 - DNA, 18 bp, Homo sapiens
aagtatttttgattaaca

SEQ ID NO: 5106145 - DNA, 23 bp, Homo sapiens
aagtatttttgattaacaatgta

SEQ ID NO: 5106146 - DNA, 22 bp, Homo sapiens
aagtatttttgtctcttagaaa

SEQ ID NO: 5106147 - DNA, 16 bp, Homo sapiens
aagtattttttcagta

SEQ ID NO: 5106148 - DNA, 19 bp, Homo sapiens
aagtatttttttaatttct

SEQ ID NO: 5106149 - DNA, 20 bp, Homo sapiens
aagtatttttttaatttctg

SEQ ID NO: 5106150 - DNA, 13 bp, Homo sapiens
aagtcaaaaggaa

SEQ ID NO: 5106151 - DNA, 16 bp, Homo sapiens
aagtcaaaaggaacaa

SEQ ID NO: 5106152 - DNA, 21 bp, Homo sapiens
aagtcaaaataatctgaaatg

SEQ ID NO: 5106153 - DNA, 14 bp, Homo sapiens
aagtcaaaatatgt

SEQ ID NO: 5106154 - DNA, 21 bp, Homo sapiens
aagtcaaaatatttttaaaag

SEQ ID NO: 5106155 - DNA, 20 bp, Homo sapiens
aagtcaaacacttgtgactt

SEQ ID NO: 5106156 - DNA, 18 bp, Homo sapiens
aagtcaaacagtgtggct

SEQ ID NO: 5106157 - DNA, 15 bp, Homo sapiens
aagtcaaacttggat

SEQ ID NO: 5106158 - DNA, 23 bp, Homo sapiens
aagtcaaagacattctgacatct

SEQ ID NO: 5106159 - DNA, 17 bp, Homo sapiens
aagtcaaatgcattttt

SEQ ID NO: 5106160 - DNA, 19 bp, Homo sapiens
aagtcaaattaataatctt

SEQ ID NO: 5106161 - DNA, 16 bp, Homo sapiens
aagtcaacactcttct

SEQ ID NO: 5106162 - DNA, 13 bp, Homo sapiens
aagtcaacagtaa

SEQ ID NO: 5106163 - DNA, 14 bp, Homo sapiens
aagtcaacagtaaa

SEQ ID NO: 5106164 - DNA, 18 bp, Homo sapiens
aagtcaacatcttctctc

SEQ ID NO: 5106165 - DNA, 21 bp, Homo sapiens
aagtcaagcacatgtaataaa

SEQ ID NO: 5106166 - DNA, 22 bp, Homo sapiens
aagtcaaggcttagaccctcat

SEQ ID NO: 5106167 - DNA, 19 bp, Homo sapiens
aagtcaagggtagggtggg

SEQ ID NO: 5106168 - DNA, 16 bp, Homo sapiens
aagtcaatattgattt

SEQ ID NO: 5106169 - DNA, 16 bp, Homo sapiens
aagtcaatcatttctc

SEQ ID NO: 5106170 - DNA, 22 bp, Homo sapiens
aagtcaatcatttctcactgtg

SEQ ID NO: 5106171 - DNA, 18 bp, Homo sapiens
aagtcaatgtacttgttt

SEQ ID NO: 5106172 - DNA, 17 bp, Homo sapiens
aagtcaatgttttcagt

SEQ ID NO: 5106173 - DNA, 18 bp, Homo sapiens
aagtcaatgttttcagtt

SEQ ID NO: 5106174 - DNA, 21 bp, Homo sapiens
aagtcaattctgtgtggtata

SEQ ID NO: 5106175 - DNA, 22 bp, Homo sapiens
aagtcaattctgtgtggtatat

SEQ ID NO: 5106176 - DNA, 13 bp, Homo sapiens
aagtcacaaagga

SEQ ID NO: 5106177 - DNA, 15 bp, Homo sapiens
aagtcacaaaggaat

SEQ ID NO: 5106178 - DNA, 18 bp, Homo sapiens
aagtcacaaaggaatgga

SEQ ID NO: 5106179 - DNA, 19 bp, Homo sapiens
aagtcacaacaaaaggaag

SEQ ID NO: 5106180 - DNA, 18 bp, Homo sapiens
aagtcacacagacacaca

SEQ ID NO: 5106181 - DNA, 24 bp, Homo sapiens
aagtcacacagtattacttctgct

SEQ ID NO: 5106182 - DNA, 13 bp, Homo sapiens
aagtcacacagtg

SEQ ID NO: 5106183 - DNA, 14 bp, Homo sapiens
aagtcacactgtaa

SEQ ID NO: 5106184 - DNA, 22 bp, Homo sapiens
aagtcacagatatatttctcca

SEQ ID NO: 5106185 - DNA, 22 bp, Homo sapiens
aagtcacagctgcagctgggcc

SEQ ID NO: 5106186 - DNA, 23 bp, Homo sapiens
aagtcacagctgcagctgggccc

SEQ ID NO: 5106187 - DNA, 14 bp, Homo sapiens
aagtcacaggaaga

SEQ ID NO: 5106188 - DNA, 13 bp, Homo sapiens
aagtcacagttaa

SEQ ID NO: 5106189 - DNA, 16 bp, Homo sapiens
aagtcacagttaagga

SEQ ID NO: 5106190 - DNA, 19 bp, Homo sapiens
aagtcacagttaaggagaa

SEQ ID NO: 5106191 - DNA, 19 bp, Homo sapiens
aagtcacatcacaggacac

SEQ ID NO: 5106192 - DNA, 15 bp, Homo sapiens
aagtcacatgcgtaa

SEQ ID NO: 5106193 - DNA, 15 bp, Homo sapiens
aagtcacattagtgt

SEQ ID NO: 5106194 - DNA, 20 bp, Homo sapiens
aagtcaccactccattccca

SEQ ID NO: 5106195 - DNA, 19 bp, Homo sapiens
aagtcaccattctgcattt

SEQ ID NO: 5106196 - DNA, 23 bp, Homo sapiens
aagtcaccattctgcatttagct

SEQ ID NO: 5106197 - DNA, 16 bp, Homo sapiens
aagtcacccaaacact

SEQ ID NO: 5106198 - DNA, 22 bp, Homo sapiens
aagtcacccaaacacttctgct

SEQ ID NO: 5106199 - DNA, 14 bp, Homo sapiens
aagtcacccaggga

SEQ ID NO: 5106200 - DNA, 23 bp, Homo sapiens
aagtcacccctttctgtcccact

SEQ ID NO: 5106201 - DNA, 20 bp, Homo sapiens
aagtcaccctagccctctcc

SEQ ID NO: 5106202 - DNA, 16 bp, Homo sapiens
aagtcacctacaggac

SEQ ID NO: 5106203 - DNA, 23 bp, Homo sapiens
aagtcacctacaggactgggccg

SEQ ID NO: 5106204 - DNA, 21 bp, Homo sapiens
aagtcacggctgcgcactgtg

SEQ ID NO: 5106205 - DNA, 18 bp, Homo sapiens
aagtcacgttgttttcag

SEQ ID NO: 5106206 - DNA, 21 bp, Homo sapiens
aagtcactcacactggccaca

SEQ ID NO: 5106207 - DNA, 23 bp, Homo sapiens
aagtcactcccaagccccctcct

SEQ ID NO: 5106208 - DNA, 12 bp, Homo sapiens
aagtcactgaac

SEQ ID NO: 5106209 - DNA, 14 bp, Homo sapiens
aagtcactgaacaa

SEQ ID NO: 5106210 - DNA, 15 bp, Homo sapiens
aagtcactgaacaaa

SEQ ID NO: 5106211 - DNA, 17 bp, Homo sapiens
aagtcactgaacaaaac

SEQ ID NO: 5106212 - DNA, 14 bp, Homo sapiens
aagtcactgcacag

SEQ ID NO: 5106213 - DNA, 22 bp, Homo sapiens
aagtcactgcacagtgcatctc

SEQ ID NO: 5106214 - DNA, 15 bp, Homo sapiens
aagtcacttaatctt

SEQ ID NO: 5106215 - DNA, 16 bp, Homo sapiens
aagtcacttccagtgt

SEQ ID NO: 5106216 - DNA, 12 bp, Homo sapiens
aagtcagagaga

SEQ ID NO: 5106217 - DNA, 15 bp, Homo sapiens
aagtcagagctcagg

SEQ ID NO: 5106218 - DNA, 12 bp, Homo sapiens
aagtcagaggat

SEQ ID NO: 5106219 - DNA, 20 bp, Homo sapiens
aagtcagaggatggccagtg

SEQ ID NO: 5106220 - DNA, 23 bp, Homo sapiens
aagtcagaggatggccagtgtct

SEQ ID NO: 5106221 - DNA, 22 bp, Homo sapiens
aagtcagatctgcctaaggact

SEQ ID NO: 5106222 - DNA, 23 bp, Homo sapiens
aagtcagatctgcctaaggactt

SEQ ID NO: 5106223 - DNA, 21 bp, Homo sapiens
aagtcagatgtggtaactgtt

SEQ ID NO: 5106224 - DNA, 18 bp, Homo sapiens
aagtcagatgtttgagca

SEQ ID NO: 5106225 - DNA, 17 bp, Homo sapiens
aagtcagattgctggga

SEQ ID NO: 5106226 - DNA, 17 bp, Homo sapiens
aagtcagccacactggg

SEQ ID NO: 5106227 - DNA, 20 bp, Homo sapiens
aagtcagccacactgggcct

SEQ ID NO: 5106228 - DNA, 22 bp, Homo sapiens
aagtcagcgtgacaatatactt

SEQ ID NO: 5106229 - DNA, 15 bp, Homo sapiens
aagtcagctccagct

SEQ ID NO: 5106230 - DNA, 21 bp, Homo sapiens
aagtcaggacagcttgtatgt

SEQ ID NO: 5106231 - DNA, 15 bp, Homo sapiens
aagtcaggagccagc

SEQ ID NO: 5106232 - DNA, 14 bp, Homo sapiens
aagtcaggccaggt

SEQ ID NO: 5106233 - DNA, 18 bp, Homo sapiens
aagtcaggccattcagtc

SEQ ID NO: 5106234 - DNA, 16 bp, Homo sapiens
aagtcaggtccaattt

SEQ ID NO: 5106235 - DNA, 18 bp, Homo sapiens
aagtcagtatcatattat

SEQ ID NO: 5106236 - DNA, 16 bp, Homo sapiens
aagtcagtatggtcta

SEQ ID NO: 5106237 - DNA, 12 bp, Homo sapiens
aagtcagtcacg

SEQ ID NO: 5106238 - DNA, 23 bp, Homo sapiens
aagtcagtccaggatgctaacat

SEQ ID NO: 5106239 - DNA, 20 bp, Homo sapiens
aagtcagtgcccaactgtta

SEQ ID NO: 5106240 - DNA, 18 bp, Homo sapiens
aagtcagtgttgaatttt

SEQ ID NO: 5106241 - DNA, 15 bp, Homo sapiens
aagtcagtgttgaga

SEQ ID NO: 5106242 - DNA, 17 bp, Homo sapiens
aagtcagtgttgagatg

SEQ ID NO: 5106243 - DNA, 18 bp, Homo sapiens
aagtcagttggagaaaat

SEQ ID NO: 5106244 - DNA, 15 bp, Homo sapiens
aagtcagtttctaca

SEQ ID NO: 5106245 - DNA, 15 bp, Homo sapiens
aagtcataatgaata

SEQ ID NO: 5106246 - DNA, 17 bp, Homo sapiens
aagtcatagccataaat

SEQ ID NO: 5106247 - DNA, 14 bp, Homo sapiens
aagtcatcataaaa

SEQ ID NO: 5106248 - DNA, 18 bp, Homo sapiens
aagtcatcatgaactggc

SEQ ID NO: 5106249 - DNA, 21 bp, Homo sapiens
aagtcatcattacttgggaaa

SEQ ID NO: 5106250 - DNA, 20 bp, Homo sapiens
aagtcatctacttaataaat

SEQ ID NO: 5106251 - DNA, 13 bp, Homo sapiens
aagtcatcttgct

SEQ ID NO: 5106252 - DNA, 14 bp, Homo sapiens
aagtcatcttgcta

SEQ ID NO: 5106253 - DNA, 20 bp, Homo sapiens
aagtcatcttgctaccagta

SEQ ID NO: 5106254 - DNA, 17 bp, Homo sapiens
aagtcatgaagcccaag

SEQ ID NO: 5106255 - DNA, 13 bp, Homo sapiens
aagtcatgaagct

SEQ ID NO: 5106256 - DNA, 19 bp, Homo sapiens
aagtcatgatggagacttc

SEQ ID NO: 5106257 - DNA, 13 bp, Homo sapiens
aagtcatgatgtt

SEQ ID NO: 5106258 - DNA, 23 bp, Homo sapiens
aagtcatgatgtttttaaaatct

SEQ ID NO: 5106259 - DNA, 19 bp, Homo sapiens
aagtcatgctcccctgtgc

SEQ ID NO: 5106260 - DNA, 15 bp, Homo sapiens
aagtcatggacattc

SEQ ID NO: 5106261 - DNA, 17 bp, Homo sapiens
aagtcatggagaatctg

SEQ ID NO: 5106262 - DNA, 15 bp, Homo sapiens
aagtcatggctgtgc

SEQ ID NO: 5106263 - DNA, 20 bp, Homo sapiens
aagtcatgggaacgcagcct

SEQ ID NO: 5106264 - DNA, 19 bp, Homo sapiens
aagtcatgtaaatactgtt

SEQ ID NO: 5106265 - DNA, 13 bp, Homo sapiens
aagtcatgtatgt

SEQ ID NO: 5106266 - DNA, 14 bp, Homo sapiens
aagtcatgtgcatt

SEQ ID NO: 5106267 - DNA, 15 bp, Homo sapiens
aagtcatgtgcattt

SEQ ID NO: 5106268 - DNA, 12 bp, Homo sapiens
aagtcatgttcc

SEQ ID NO: 5106269 - DNA, 16 bp, Homo sapiens
aagtcattaaactggt

SEQ ID NO: 5106270 - DNA, 18 bp, Homo sapiens
aagtcattgctgacagag

SEQ ID NO: 5106271 - DNA, 21 bp, Homo sapiens
aagtcattgctgacagagccc

SEQ ID NO: 5106272 - DNA, 14 bp, Homo sapiens
aagtcattggcaaa

SEQ ID NO: 5106273 - DNA, 20 bp, Homo sapiens
aagtcattgtcgctcagcaa

SEQ ID NO: 5106274 - DNA, 24 bp, Homo sapiens
aagtcattgtttcccatcactgta

SEQ ID NO: 5106275 - DNA, 19 bp, Homo sapiens
aagtcattgtttttctcgc

SEQ ID NO: 5106276 - DNA, 18 bp, Homo sapiens
aagtcattttaactttat

SEQ ID NO: 5106277 - DNA, 20 bp, Homo sapiens
aagtcattttaactttatca

SEQ ID NO: 5106278 - DNA, 16 bp, Homo sapiens
aagtcattttaataac

SEQ ID NO: 5106279 - DNA, 22 bp, Homo sapiens
aagtccaaattgtttgtacagt

SEQ ID NO: 5106280 - DNA, 20 bp, Homo sapiens
aagtccaagcaacagccttt

SEQ ID NO: 5106281 - DNA, 15 bp, Homo sapiens
aagtccacacaaaga

SEQ ID NO: 5106282 - DNA, 17 bp, Homo sapiens
aagtccacagacatctt

SEQ ID NO: 5106283 - DNA, 21 bp, Homo sapiens
aagtccactgtcctccttggc

SEQ ID NO: 5106284 - DNA, 14 bp, Homo sapiens
aagtccacttatgt

SEQ ID NO: 5106285 - DNA, 18 bp, Homo sapiens
aagtccacttatgtagac

SEQ ID NO: 5106286 - DNA, 15 bp, Homo sapiens
aagtccagctctccc

SEQ ID NO: 5106287 - DNA, 21 bp, Homo sapiens
aagtccagctgggaagccctt

SEQ ID NO: 5106288 - DNA, 18 bp, Homo sapiens
aagtccaggactgggtct

SEQ ID NO: 5106289 - DNA, 13 bp, Homo sapiens
aagtccaggtcct

SEQ ID NO: 5106290 - DNA, 15 bp, Homo sapiens
aagtccaggtcctgg

SEQ ID NO: 5106291 - DNA, 17 bp, Homo sapiens
aagtccaggtcctggtg

SEQ ID NO: 5106292 - DNA, 18 bp, Homo sapiens
aagtccaggtcctggtgg

SEQ ID NO: 5106293 - DNA, 19 bp, Homo sapiens
aagtccagtgaccctggag

SEQ ID NO: 5106294 - DNA, 18 bp, Homo sapiens
aagtccatgaatgttcat

SEQ ID NO: 5106295 - DNA, 20 bp, Homo sapiens
aagtcccagagcacctcacc

SEQ ID NO: 5106296 - DNA, 19 bp, Homo sapiens
aagtcccagtatacctcat

SEQ ID NO: 5106297 - DNA, 21 bp, Homo sapiens
aagtccccaggccccaggaag

SEQ ID NO: 5106298 - DNA, 16 bp, Homo sapiens
aagtccccaggtcatg

SEQ ID NO: 5106299 - DNA, 22 bp, Homo sapiens
aagtcccccaagacctaagggt

SEQ ID NO: 5106300 - DNA, 17 bp, Homo sapiens
aagtcccccagcagaac

SEQ ID NO: 5106301 - DNA, 18 bp, Homo sapiens
aagggccagcatatatac

SEQ ID NO: 5106302 - DNA, 12 bp, Homo sapiens
aagggccagccc

SEQ ID NO: 5106303 - DNA, 13 bp, Homo sapiens
aagggccagccct

SEQ ID NO: 5106304 - DNA, 19 bp, Homo sapiens
aagggccagccctacatct

SEQ ID NO: 5106305 - DNA, 22 bp, Homo sapiens
aagggccagccctacatcttca

SEQ ID NO: 5106306 - DNA, 23 bp, Homo sapiens
aagggccagccctacatcttcag

SEQ ID NO: 5106307 - DNA, 18 bp, Homo sapiens
aagggccaggagagagat

SEQ ID NO: 5106308 - DNA, 11 bp, Homo sapiens
aagggccaggt

SEQ ID NO: 5106309 - DNA, 18 bp, Homo sapiens
aagggccaggtgcggcct

SEQ ID NO: 5106310 - DNA, 14 bp, Homo sapiens
aagggccagtcctg

SEQ ID NO: 5106311 - DNA, 14 bp, Homo sapiens
aagggccagtctgg

SEQ ID NO: 5106312 - DNA, 16 bp, Homo sapiens
aagggccatgctgaag

SEQ ID NO: 5106313 - DNA, 17 bp, Homo sapiens
aagggccatgctgaagg

SEQ ID NO: 5106314 - DNA, 19 bp, Homo sapiens
aagggcccacacctggtgg

SEQ ID NO: 5106315 - DNA, 13 bp, Homo sapiens
aagggcccagagt

SEQ ID NO: 5106316 - DNA, 16 bp, Homo sapiens
aagggcccagattcta

SEQ ID NO: 5106317 - DNA, 13 bp, Homo sapiens
aagggccccaggg

SEQ ID NO: 5106318 - DNA, 14 bp, Homo sapiens
aagggcccccacat

SEQ ID NO: 5106319 - DNA, 14 bp, Homo sapiens
aagggccctcactc

SEQ ID NO: 5106320 - DNA, 20 bp, Homo sapiens
aagggccctcactcaggaac

SEQ ID NO: 5106321 - DNA, 11 bp, Homo sapiens
aagggccctgc

SEQ ID NO: 5106322 - DNA, 17 bp, Homo sapiens
aagggccctggcacccc

SEQ ID NO: 5106323 - DNA, 16 bp, Homo sapiens
aagggccctttttcaa

SEQ ID NO: 5106324 - DNA, 22 bp, Homo sapiens
aagggccctttttcaataactg

SEQ ID NO: 5106325 - DNA, 14 bp, Homo sapiens
aagggcctgctctg

SEQ ID NO: 5106326 - DNA, 16 bp, Homo sapiens
aagggcctgctctgct

SEQ ID NO: 5106327 - DNA, 13 bp, Homo sapiens
aagggcctggcct

SEQ ID NO: 5106328 - DNA, 17 bp, Homo sapiens
aagggcctggcctgagc

SEQ ID NO: 5106329 - DNA, 14 bp, Homo sapiens
aagggccttctcca

SEQ ID NO: 5106330 - DNA, 13 bp, Homo sapiens
aagggcgggcctg

SEQ ID NO: 5106331 - DNA, 17 bp, Homo sapiens
aagggcgtggctctggg

SEQ ID NO: 5106332 - DNA, 22 bp, Homo sapiens
aagggcgtggctctgggtgggc

SEQ ID NO: 5106333 - DNA, 15 bp, Homo sapiens
aagggctaaggcctc

SEQ ID NO: 5106334 - DNA, 19 bp, Homo sapiens
aagggctagaacctggagg

SEQ ID NO: 5106335 - DNA, 17 bp, Homo sapiens
aagggctcagagctgct

SEQ ID NO: 5106336 - DNA, 19 bp, Homo sapiens
aagggctcagagctgctga

SEQ ID NO: 5106337 - DNA, 12 bp, Homo sapiens
aagggctccagc

SEQ ID NO: 5106338 - DNA, 13 bp, Homo sapiens
aagggctccagca

SEQ ID NO: 5106339 - DNA, 15 bp, Homo sapiens
aagggctcttttcct

SEQ ID NO: 5106340 - DNA, 13 bp, Homo sapiens
aagggctgaaccc

SEQ ID NO: 5106341 - DNA, 21 bp, Homo sapiens
aagggctgaaccctcagcctt

SEQ ID NO: 5106342 - DNA, 19 bp, Homo sapiens
aagggctgacttctccagg

SEQ ID NO: 5106343 - DNA, 17 bp, Homo sapiens
aagggctgcatgatgtt

SEQ ID NO: 5106344 - DNA, 11 bp, Homo sapiens
aagggctgccg

SEQ ID NO: 5106345 - DNA, 17 bp, Homo sapiens
aagggctgccgggccag

SEQ ID NO: 5106346 - DNA, 16 bp, Homo sapiens
aagggctgcttccctg

SEQ ID NO: 5106347 - DNA, 14 bp, Homo sapiens
aagggctggctgca

SEQ ID NO: 5106348 - DNA, 17 bp, Homo sapiens
aagggctgggccaccag

SEQ ID NO: 5106349 - DNA, 11 bp, Homo sapiens
aagggctgggg

SEQ ID NO: 5106350 - DNA, 18 bp, Homo sapiens
aagggctggggcggagct

SEQ ID NO: 5106351 - DNA, 15 bp, Homo sapiens
aagggctgttataat

SEQ ID NO: 5106352 - DNA, 14 bp, Homo sapiens
aagggcttactatt

SEQ ID NO: 5106353 - DNA, 17 bp, Homo sapiens
aagggcttctgcaccct

SEQ ID NO: 5106354 - DNA, 22 bp, Homo sapiens
aagggcttctgcaccctccacc

SEQ ID NO: 5106355 - DNA, 23 bp, Homo sapiens
aagggcttctgcaccctccaccc

SEQ ID NO: 5106356 - DNA, 14 bp, Homo sapiens
aagggcttgaggtg

SEQ ID NO: 5106357 - DNA, 17 bp, Homo sapiens
aagggcttggtggccaa

SEQ ID NO: 5106358 - DNA, 14 bp, Homo sapiens
aagggctttcctgt

SEQ ID NO: 5106359 - DNA, 17 bp, Homo sapiens
aaggggaaaacctcagt

SEQ ID NO: 5106360 - DNA, 19 bp, Homo sapiens
aaggggaaacgtctcccag

SEQ ID NO: 5106361 - DNA, 21 bp, Homo sapiens
aaggggaatgtgtcctcctgc

SEQ ID NO: 5106362 - DNA, 16 bp, Homo sapiens
aaggggacagctgtgt

SEQ ID NO: 5106363 - DNA, 15 bp, Homo sapiens
aaggggacattccag

SEQ ID NO: 5106364 - DNA, 15 bp, Homo sapiens
aaggggacccaagaa

SEQ ID NO: 5106365 - DNA, 16 bp, Homo sapiens
aaggggacccaagaaa

SEQ ID NO: 5106366 - DNA, 20 bp, Homo sapiens
aaggggacccccgccccctg

SEQ ID NO: 5106367 - DNA, 19 bp, Homo sapiens
aaggggactgccacctccc

SEQ ID NO: 5106368 - DNA, 19 bp, Homo sapiens
aaggggagcacaaggcctt

SEQ ID NO: 5106369 - DNA, 13 bp, Homo sapiens
aaggggagccaga

SEQ ID NO: 5106370 - DNA, 12 bp, Homo sapiens
aaggggaggaga

SEQ ID NO: 5106371 - DNA, 13 bp, Homo sapiens
aaggggaggaggg

SEQ ID NO: 5106372 - DNA, 15 bp, Homo sapiens
aaggggaggagggcg

SEQ ID NO: 5106373 - DNA, 17 bp, Homo sapiens
aaggggaggcacacttt

SEQ ID NO: 5106374 - DNA, 23 bp, Homo sapiens
aaggggaggcacactttctggca

SEQ ID NO: 5106375 - DNA, 14 bp, Homo sapiens
aaggggaggcagcc

SEQ ID NO: 5106376 - DNA, 22 bp, Homo sapiens
aaggggatctaaaaaaatgttt

SEQ ID NO: 5106377 - DNA, 16 bp, Homo sapiens
aaggggatctaaaagg

SEQ ID NO: 5106378 - DNA, 14 bp, Homo sapiens
aaggggatgggaaa

SEQ ID NO: 5106379 - DNA, 20 bp, Homo sapiens
aaggggcaaaaaaaaaaatt

SEQ ID NO: 5106380 - DNA, 13 bp, Homo sapiens
aaggggcacctgg

SEQ ID NO: 5106381 - DNA, 15 bp, Homo sapiens
aaggggcagcaggag

SEQ ID NO: 5106382 - DNA, 22 bp, Homo sapiens
aaggggcagcaggaggagtgga

SEQ ID NO: 5106383 - DNA, 16 bp, Homo sapiens
aaggggcagccctgag

SEQ ID NO: 5106384 - DNA, 18 bp, Homo sapiens
aaggggcagtctggaggg

SEQ ID NO: 5106385 - DNA, 15 bp, Homo sapiens
aaggggcatttcaca

SEQ ID NO: 5106386 - DNA, 16 bp, Homo sapiens
aaggggccagctgccc

SEQ ID NO: 5106387 - DNA, 17 bp, Homo sapiens
aaggggccagctgcccc

SEQ ID NO: 5106388 - DNA, 13 bp, Homo sapiens
aaggggccatcct

SEQ ID NO: 5106389 - DNA, 17 bp, Homo sapiens
aaggggcccaagagaga

SEQ ID NO: 5106390 - DNA, 21 bp, Homo sapiens
aaggggcccaagccccatctc

SEQ ID NO: 5106391 - DNA, 13 bp, Homo sapiens
aaggggcccacaa

SEQ ID NO: 5106392 - DNA, 22 bp, Homo sapiens
aaggggcccacaaaggggagaa

SEQ ID NO: 5106393 - DNA, 15 bp, Homo sapiens
aaggggcccagtgct

SEQ ID NO: 5106394 - DNA, 15 bp, Homo sapiens
aaggggcccgtggga

SEQ ID NO: 5106395 - DNA, 20 bp, Homo sapiens
aaggggcccttggagcgtgg

SEQ ID NO: 5106396 - DNA, 14 bp, Homo sapiens
aaggggcctgagca

SEQ ID NO: 5106397 - DNA, 14 bp, Homo sapiens
aaggggcctgcgca

SEQ ID NO: 5106398 - DNA, 20 bp, Homo sapiens
aaggggcctgggctgtgagg

SEQ ID NO: 5106399 - DNA, 19 bp, Homo sapiens
aaggggccttgctctgagc

SEQ ID NO: 5106400 - DNA, 18 bp, Homo sapiens
aaggggcgtctgttcccc

SEQ ID NO: 5106401 - DNA, 15 bp, Homo sapiens
aaggggcgtgtccct

SEQ ID NO: 5106402 - DNA, 19 bp, Homo sapiens
aaggggctagggaggacca

SEQ ID NO: 5106403 - DNA, 22 bp, Homo sapiens
aaggggctgaggacgagacccc

SEQ ID NO: 5106404 - DNA, 21 bp, Homo sapiens
aaggggctgagtgagttcaac

SEQ ID NO: 5106405 - DNA, 21 bp, Homo sapiens
aaggggctgctggggcatgtg

SEQ ID NO: 5106406 - DNA, 11 bp, Homo sapiens
aaggggctggt

SEQ ID NO: 5106407 - DNA, 23 bp, Homo sapiens
aaggggctgttcttccaggaggc

SEQ ID NO: 5106408 - DNA, 22 bp, Homo sapiens
aaggggcttctaatgacccaga

SEQ ID NO: 5106409 - DNA, 14 bp, Homo sapiens
aagggggaccatgg

SEQ ID NO: 5106410 - DNA, 19 bp, Homo sapiens
aagggggacgtttctggaa

SEQ ID NO: 5106411 - DNA, 15 bp, Homo sapiens
aagggggcaggcccc

SEQ ID NO: 5106412 - DNA, 22 bp, Homo sapiens
aagggggccgccaccctcccct

SEQ ID NO: 5106413 - DNA, 20 bp, Homo sapiens
aagggggcggggactgctgg

SEQ ID NO: 5106414 - DNA, 22 bp, Homo sapiens
aagggggcggggactgctggct

SEQ ID NO: 5106415 - DNA, 14 bp, Homo sapiens
aagggggctgctgc

SEQ ID NO: 5106416 - DNA, 15 bp, Homo sapiens
aagggggctgctgct

SEQ ID NO: 5106417 - DNA, 21 bp, Homo sapiens
aagggggctgctgctcctctc

SEQ ID NO: 5106418 - DNA, 12 bp, Homo sapiens
aagggggctggg

SEQ ID NO: 5106419 - DNA, 18 bp, Homo sapiens
aagggggggctacattat

SEQ ID NO: 5106420 - DNA, 20 bp, Homo sapiens
aagggggggctacattataa

SEQ ID NO: 5106421 - DNA, 19 bp, Homo sapiens
aagggggtagaagtagttt

SEQ ID NO: 5106422 - DNA, 18 bp, Homo sapiens
aagggggtcaaaggaaga

SEQ ID NO: 5106423 - DNA, 12 bp, Homo sapiens
aagggggtccca

SEQ ID NO: 5106424 - DNA, 21 bp, Homo sapiens
aagggggtgacctcttgcctc

SEQ ID NO: 5106425 - DNA, 13 bp, Homo sapiens
aagggggtgactg

SEQ ID NO: 5106426 - DNA, 19 bp, Homo sapiens
aagggggtgactggaagtt

SEQ ID NO: 5106427 - DNA, 22 bp, Homo sapiens
aagggggtgcaaagactctgag

SEQ ID NO: 5106428 - DNA, 16 bp, Homo sapiens
aagggggtggggggag

SEQ ID NO: 5106429 - DNA, 17 bp, Homo sapiens
aagggggtggggggagt

SEQ ID NO: 5106430 - DNA, 17 bp, Homo sapiens
aagggggtggtgtctcc

SEQ ID NO: 5106431 - DNA, 16 bp, Homo sapiens
aaggggtcctgcaggg

SEQ ID NO: 5106432 - DNA, 16 bp, Homo sapiens
aaggggtgcacccacc

SEQ ID NO: 5106433 - DNA, 17 bp, Homo sapiens
aaggggtggaagggcag

SEQ ID NO: 5106434 - DNA, 20 bp, Homo sapiens
aaggggtggccgtcctgagg

SEQ ID NO: 5106435 - DNA, 21 bp, Homo sapiens
aaggggtggccgtcctgaggg

SEQ ID NO: 5106436 - DNA, 22 bp, Homo sapiens
aaggggtgggtcagaacatgtt

SEQ ID NO: 5106437 - DNA, 16 bp, Homo sapiens
aaggggttggattgca

SEQ ID NO: 5106438 - DNA, 15 bp, Homo sapiens
aaggggttggggtga

SEQ ID NO: 5106439 - DNA, 14 bp, Homo sapiens
aaggggtttctaac

SEQ ID NO: 5106440 - DNA, 13 bp, Homo sapiens
aaggggttttctt

SEQ ID NO: 5106441 - DNA, 13 bp, Homo sapiens
aagggtaaagaag

SEQ ID NO: 5106442 - DNA, 17 bp, Homo sapiens
aagggtaaattataaat

SEQ ID NO: 5106443 - DNA, 18 bp, Homo sapiens
aagggtaaattataaatg

SEQ ID NO: 5106444 - DNA, 17 bp, Homo sapiens
aagggtaagggagaggg

SEQ ID NO: 5106445 - DNA, 23 bp, Homo sapiens
aagggtacagatccccagcccct

SEQ ID NO: 5106446 - DNA, 19 bp, Homo sapiens
aagggtaggttagatgcta

SEQ ID NO: 5106447 - DNA, 17 bp, Homo sapiens
aagggtatcaggtgctg

SEQ ID NO: 5106448 - DNA, 16 bp, Homo sapiens
aagggtatgagctgga

SEQ ID NO: 5106449 - DNA, 11 bp, Homo sapiens
aagggtcaggc

SEQ ID NO: 5106450 - DNA, 13 bp, Homo sapiens
aagggtcaggccc

SEQ ID NO: 5106451 - DNA, 17 bp, Homo sapiens
aagggtcaggcccgtca

SEQ ID NO: 5106452 - DNA, 13 bp, Homo sapiens
aagggtcaggcct

SEQ ID NO: 5106453 - DNA, 19 bp, Homo sapiens
aagggtccgtggaccagga

SEQ ID NO: 5106454 - DNA, 18 bp, Homo sapiens
aagggtcctgctttctcc

SEQ ID NO: 5106455 - DNA, 18 bp, Homo sapiens
aagggtcgaaagctctag

SEQ ID NO: 5106456 - DNA, 16 bp, Homo sapiens
aagggtctagggagag

SEQ ID NO: 5106457 - DNA, 22 bp, Homo sapiens
aagggtctagggagagaccctt

SEQ ID NO: 5106458 - DNA, 18 bp, Homo sapiens
aagggtctatcttgtaaa

SEQ ID NO: 5106459 - DNA, 24 bp, Homo sapiens
aagggtctccgaaatgctgtcttt

SEQ ID NO: 5106460 - DNA, 19 bp, Homo sapiens
aagggtcttgggaaatatg

SEQ ID NO: 5106461 - DNA, 15 bp, Homo sapiens
aagggtgaaaattat

SEQ ID NO: 5106462 - DNA, 16 bp, Homo sapiens
aagggtgaaaattatt

SEQ ID NO: 5106463 - DNA, 13 bp, Homo sapiens
aagggtgatcatc

SEQ ID NO: 5106464 - DNA, 19 bp, Homo sapiens
aagggtgatgggaaagcat

SEQ ID NO: 5106465 - DNA, 21 bp, Homo sapiens
aagggtgatgggaaagcattg

SEQ ID NO: 5106466 - DNA, 14 bp, Homo sapiens
aagggtgcaagccc

SEQ ID NO: 5106467 - DNA, 21 bp, Homo sapiens
aagggtgcctggctgggcttt

SEQ ID NO: 5106468 - DNA, 22 bp, Homo sapiens
aagggtggagagttgggggcca

SEQ ID NO: 5106469 - DNA, 20 bp, Homo sapiens
aagggtggatgacagggcag

SEQ ID NO: 5106470 - DNA, 18 bp, Homo sapiens
aagggtggatgtgctgga

SEQ ID NO: 5106471 - DNA, 21 bp, Homo sapiens
aagggtggcctgttccctaga

SEQ ID NO: 5106472 - DNA, 16 bp, Homo sapiens
aagggtgggaagcttg

SEQ ID NO: 5106473 - DNA, 23 bp, Homo sapiens
aagggtgggcatcaaagatgaga

SEQ ID NO: 5106474 - DNA, 14 bp, Homo sapiens
aagggtgggccctg

SEQ ID NO: 5106475 - DNA, 16 bp, Homo sapiens
aagggtgggccctgga

SEQ ID NO: 5106476 - DNA, 14 bp, Homo sapiens
aagggtggggagaa

SEQ ID NO: 5106477 - DNA, 20 bp, Homo sapiens
aagggtgggtttgagatgtt

SEQ ID NO: 5106478 - DNA, 16 bp, Homo sapiens
aagggtggtttggcaa

SEQ ID NO: 5106479 - DNA, 22 bp, Homo sapiens
aagggtgtaggggccacctcct

SEQ ID NO: 5106480 - DNA, 23 bp, Homo sapiens
aagggtgtaggggccacctcctc

SEQ ID NO: 5106481 - DNA, 13 bp, Homo sapiens
aagtcccccctcg

SEQ ID NO: 5106482 - DNA, 21 bp, Homo sapiens
aagtccccctcctcagccagc

SEQ ID NO: 5106483 - DNA, 22 bp, Homo sapiens
aagtccccctcctcagccagcc

SEQ ID NO: 5106484 - DNA, 21 bp, Homo sapiens
aagtccccgagtttccccaga

SEQ ID NO: 5106485 - DNA, 22 bp, Homo sapiens
aagtccctataataaaggctga

SEQ ID NO: 5106486 - DNA, 11 bp, Homo sapiens
aagtccctccc

SEQ ID NO: 5106487 - DNA, 18 bp, Homo sapiens
aagtccctccctgcctga

SEQ ID NO: 5106488 - DNA, 20 bp, Homo sapiens
aagtccctccctgcctgagg

SEQ ID NO: 5106489 - DNA, 17 bp, Homo sapiens
aagtccctgccccctcc

SEQ ID NO: 5106490 - DNA, 13 bp, Homo sapiens
aagtccctggaaa

SEQ ID NO: 5106491 - DNA, 17 bp, Homo sapiens
aagtccctgttctcagc

SEQ ID NO: 5106492 - DNA, 11 bp, Homo sapiens
aagtcccttcc

SEQ ID NO: 5106493 - DNA, 22 bp, Homo sapiens
aagtcccttcctattctcctgc

SEQ ID NO: 5106494 - DNA, 18 bp, Homo sapiens
aagtcccttcctgtcctg

SEQ ID NO: 5106495 - DNA, 15 bp, Homo sapiens
aagtcctaaagtgaa

SEQ ID NO: 5106496 - DNA, 17 bp, Homo sapiens
aagtcctacaagctaaa

SEQ ID NO: 5106497 - DNA, 20 bp, Homo sapiens
aagtcctacttttaaagaat

SEQ ID NO: 5106498 - DNA, 21 bp, Homo sapiens
aagtcctagctcctcctcctg

SEQ ID NO: 5106499 - DNA, 15 bp, Homo sapiens
aagtcctcagagctc

SEQ ID NO: 5106500 - DNA, 22 bp, Homo sapiens
aagtcctccctcctgcaggctg

SEQ ID NO: 5106501 - DNA, 21 bp, Homo sapiens
aagtcctccctgacttttctg

SEQ ID NO: 5106502 - DNA, 23 bp, Homo sapiens
aagtcctccctgacttttctgtg

SEQ ID NO: 5106503 - DNA, 18 bp, Homo sapiens
aagtcctcctagaactcc

SEQ ID NO: 5106504 - DNA, 16 bp, Homo sapiens
aagtcctcgccccccg

SEQ ID NO: 5106505 - DNA, 16 bp, Homo sapiens
aagtcctctaaacaca

SEQ ID NO: 5106506 - DNA, 15 bp, Homo sapiens
aagtcctctgctcca

SEQ ID NO: 5106507 - DNA, 18 bp, Homo sapiens
aagtcctcttttctgaga

SEQ ID NO: 5106508 - DNA, 19 bp, Homo sapiens
aagtcctgaacctttcaaa

SEQ ID NO: 5106509 - DNA, 21 bp, Homo sapiens
aagtcctgaacctttcaaaat

SEQ ID NO: 5106510 - DNA, 21 bp, Homo sapiens
aagtcctgaactcctggcttt

SEQ ID NO: 5106511 - DNA, 13 bp, Homo sapiens
aagtcctgaagag

SEQ ID NO: 5106512 - DNA, 17 bp, Homo sapiens
aagtcctgaagaggcgg

SEQ ID NO: 5106513 - DNA, 22 bp, Homo sapiens
aagtcctgaagaggcgggccag

SEQ ID NO: 5106514 - DNA, 18 bp, Homo sapiens
aagtcctgactgggctgg

SEQ ID NO: 5106515 - DNA, 20 bp, Homo sapiens
aagtcctgactgggctgggt

SEQ ID NO: 5106516 - DNA, 14 bp, Homo sapiens
aagtcctgcctttg

SEQ ID NO: 5106517 - DNA, 15 bp, Homo sapiens
aagtcctgctccttt

SEQ ID NO: 5106518 - DNA, 21 bp, Homo sapiens
aagtcctgctggatcttgcct

SEQ ID NO: 5106519 - DNA, 12 bp, Homo sapiens
aagtcctggctt

SEQ ID NO: 5106520 - DNA, 19 bp, Homo sapiens
aagtcctgtatgtctgtca

SEQ ID NO: 5106521 - DNA, 14 bp, Homo sapiens
aagtcctgtcactg

SEQ ID NO: 5106522 - DNA, 15 bp, Homo sapiens
aagtcctgtcactga

SEQ ID NO: 5106523 - DNA, 22 bp, Homo sapiens
aagtcctgtcactgagcacagt

SEQ ID NO: 5106524 - DNA, 18 bp, Homo sapiens
aagtccttacctcttccg

SEQ ID NO: 5106525 - DNA, 22 bp, Homo sapiens
aagtccttcagtgagcccctcc

SEQ ID NO: 5106526 - DNA, 17 bp, Homo sapiens
aagtccttccacctgcc

SEQ ID NO: 5106527 - DNA, 17 bp, Homo sapiens
aagtcctttcaattcca

SEQ ID NO: 5106528 - DNA, 22 bp, Homo sapiens
aagtcctttcccgatgcgtggc

SEQ ID NO: 5106529 - DNA, 18 bp, Homo sapiens
aagtcctttgagctcctg

SEQ ID NO: 5106530 - DNA, 16 bp, Homo sapiens
aagtcctttgtgaata

SEQ ID NO: 5106531 - DNA, 15 bp, Homo sapiens
aagtcgaattaatag

SEQ ID NO: 5106532 - DNA, 18 bp, Homo sapiens
aagtcgacatactcattt

SEQ ID NO: 5106533 - DNA, 20 bp, Homo sapiens
aagtcgccagtcactgctgc

SEQ ID NO: 5106534 - DNA, 21 bp, Homo sapiens
aagtcgccagtcactgctgca

SEQ ID NO: 5106535 - DNA, 15 bp, Homo sapiens
aagtcggaatgtcat

SEQ ID NO: 5106536 - DNA, 20 bp, Homo sapiens
aagtcgggaaattctgctgc

SEQ ID NO: 5106537 - DNA, 23 bp, Homo sapiens
aagtcgggaaattctgctgcttg

SEQ ID NO: 5106538 - DNA, 14 bp, Homo sapiens
aagtcggggcctgg

SEQ ID NO: 5106539 - DNA, 22 bp, Homo sapiens
aagtcgggtcaaaaataaaata

SEQ ID NO: 5106540 - DNA, 14 bp, Homo sapiens
aagtcggttagtgg

SEQ ID NO: 5106541 - DNA, 20 bp, Homo sapiens
aagtcgtccttactcctgtg

SEQ ID NO: 5106542 - DNA, 24 bp, Homo sapiens
aagtcgtccttactcctgtgggag

SEQ ID NO: 5106543 - DNA, 20 bp, Homo sapiens
aagtcgtgcactttctcggt

SEQ ID NO: 5106544 - DNA, 15 bp, Homo sapiens
aagtcgttgtgaggg

SEQ ID NO: 5106545 - DNA, 18 bp, Homo sapiens
aagtcgtttcaggacatg

SEQ ID NO: 5106546 - DNA, 19 bp, Homo sapiens
aagtctaaacaaaattgca

SEQ ID NO: 5106547 - DNA, 18 bp, Homo sapiens
aagtctaagcaagatgtt

SEQ ID NO: 5106548 - DNA, 15 bp, Homo sapiens
aagtctaatgaagag

SEQ ID NO: 5106549 - DNA, 20 bp, Homo sapiens
aagtctaatgaagagaaaaa

SEQ ID NO: 5106550 - DNA, 16 bp, Homo sapiens
aagtctaattcacagg

SEQ ID NO: 5106551 - DNA, 18 bp, Homo sapiens
aagtctacactgcctttg

SEQ ID NO: 5106552 - DNA, 22 bp, Homo sapiens
aagtctacctgccttgcctgtt

SEQ ID NO: 5106553 - DNA, 15 bp, Homo sapiens
aagtctacctgctgg

SEQ ID NO: 5106554 - DNA, 17 bp, Homo sapiens
aagtctacctgctggac

SEQ ID NO: 5106555 - DNA, 15 bp, Homo sapiens
aagtctacctgtgtt

SEQ ID NO: 5106556 - DNA, 13 bp, Homo sapiens
aagtctagaaaat

SEQ ID NO: 5106557 - DNA, 17 bp, Homo sapiens
aagtctagtcttctggt

SEQ ID NO: 5106558 - DNA, 22 bp, Homo sapiens
aagtctatctaatgacatgcct

SEQ ID NO: 5106559 - DNA, 12 bp, Homo sapiens
aagtctatgctt

SEQ ID NO: 5106560 - DNA, 23 bp, Homo sapiens
aagtctattgtttgttgtgcttg

SEQ ID NO: 5106561 - DNA, 12 bp, Homo sapiens
aagtctattttt

SEQ ID NO: 5106562 - DNA, 13 bp, Homo sapiens
aagtctcaaggta

SEQ ID NO: 5106563 - DNA, 22 bp, Homo sapiens
aagtctcaattctgaaggggaa

SEQ ID NO: 5106564 - DNA, 22 bp, Homo sapiens
aagtctcagcctgggcccctca

SEQ ID NO: 5106565 - DNA, 11 bp, Homo sapiens
aagtctcagct

SEQ ID NO: 5106566 - DNA, 20 bp, Homo sapiens
aagtctcattcgcctttgtc

SEQ ID NO: 5106567 - DNA, 15 bp, Homo sapiens
aagtctccaaagtct

SEQ ID NO: 5106568 - DNA, 12 bp, Homo sapiens
aagtctccagcc

SEQ ID NO: 5106569 - DNA, 13 bp, Homo sapiens
aagtctccagccc

SEQ ID NO: 5106570 - DNA, 12 bp, Homo sapiens
aagtctccctgc

SEQ ID NO: 5106571 - DNA, 21 bp, Homo sapiens
aagtctccctgcacagcctct

SEQ ID NO: 5106572 - DNA, 20 bp, Homo sapiens
aagtctcgtgagaatatact

SEQ ID NO: 5106573 - DNA, 13 bp, Homo sapiens
aagtctctattta

SEQ ID NO: 5106574 - DNA, 18 bp, Homo sapiens
aagtctctatttaaattc

SEQ ID NO: 5106575 - DNA, 21 bp, Homo sapiens
aagtctctcattctaggcctc

SEQ ID NO: 5106576 - DNA, 13 bp, Homo sapiens
aagtctctctgtg

SEQ ID NO: 5106577 - DNA, 18 bp, Homo sapiens
aagtctctctgtgaatac

SEQ ID NO: 5106578 - DNA, 20 bp, Homo sapiens
aagtctctctgtgaatacaa

SEQ ID NO: 5106579 - DNA, 19 bp, Homo sapiens
aagtctctgaagtgaaact

SEQ ID NO: 5106580 - DNA, 13 bp, Homo sapiens
aagtctctgctgc

SEQ ID NO: 5106581 - DNA, 15 bp, Homo sapiens
aagtctctgctgcta

SEQ ID NO: 5106582 - DNA, 16 bp, Homo sapiens
aagtctctgctggccc

SEQ ID NO: 5106583 - DNA, 19 bp, Homo sapiens
aagtctctggaatttgaaa

SEQ ID NO: 5106584 - DNA, 14 bp, Homo sapiens
aagtctctgtgtaa

SEQ ID NO: 5106585 - DNA, 16 bp, Homo sapiens
aagtctctttttcttc

SEQ ID NO: 5106586 - DNA, 15 bp, Homo sapiens
aagtctcttttttac

SEQ ID NO: 5106587 - DNA, 16 bp, Homo sapiens
aagtctcttttttaca

SEQ ID NO: 5106588 - DNA, 24 bp, Homo sapiens
aagtctgaaaatagaacttgcctt

SEQ ID NO: 5106589 - DNA, 20 bp, Homo sapiens
aagtctgactctccactcct

SEQ ID NO: 5106590 - DNA, 22 bp, Homo sapiens
aagtctgagaatgcccaactct

SEQ ID NO: 5106591 - DNA, 22 bp, Homo sapiens
aagtctgaggcacctgcatatc

SEQ ID NO: 5106592 - DNA, 16 bp, Homo sapiens
aagtctgagtagttat

SEQ ID NO: 5106593 - DNA, 13 bp, Homo sapiens
aagtctgagtggg

SEQ ID NO: 5106594 - DNA, 16 bp, Homo sapiens
aagtctgcattacatt

SEQ ID NO: 5106595 - DNA, 19 bp, Homo sapiens
aagtctgcatttcatatta

SEQ ID NO: 5106596 - DNA, 20 bp, Homo sapiens
aagtctgcatttcatattat

SEQ ID NO: 5106597 - DNA, 12 bp, Homo sapiens
aagtctgccgat

SEQ ID NO: 5106598 - DNA, 22 bp, Homo sapiens
aagtctgccgattttgtaaatg

SEQ ID NO: 5106599 - DNA, 18 bp, Homo sapiens
aagtctgccgcccacctc

SEQ ID NO: 5106600 - DNA, 14 bp, Homo sapiens
aagtctgctgctgt

SEQ ID NO: 5106601 - DNA, 15 bp, Homo sapiens
aagtctgctgctgtg

SEQ ID NO: 5106602 - DNA, 20 bp, Homo sapiens
aagtctgcttaccaaaacat

SEQ ID NO: 5106603 - DNA, 18 bp, Homo sapiens
aagtctggatctgggacc

SEQ ID NO: 5106604 - DNA, 10 bp, Homo sapiens
aagtctggca

SEQ ID NO: 5106605 - DNA, 23 bp, Homo sapiens
aagtctggcaccatgttggcctc

SEQ ID NO: 5106606 - DNA, 15 bp, Homo sapiens
aagtctggctttgct

SEQ ID NO: 5106607 - DNA, 17 bp, Homo sapiens
aagtctggctttgctct

SEQ ID NO: 5106608 - DNA, 23 bp, Homo sapiens
aagtctgggaaattctatatgat

SEQ ID NO: 5106609 - DNA, 20 bp, Homo sapiens
aagtctgtacctcaaatgaa

SEQ ID NO: 5106610 - DNA, 21 bp, Homo sapiens
aagtctgtacctcaaatgaat

SEQ ID NO: 5106611 - DNA, 22 bp, Homo sapiens
aagtctgtatggcatgacaact

SEQ ID NO: 5106612 - DNA, 12 bp, Homo sapiens
aagtctgtcatg

SEQ ID NO: 5106613 - DNA, 18 bp, Homo sapiens
aagtctgtccaaatttaa

SEQ ID NO: 5106614 - DNA, 12 bp, Homo sapiens
aagtctgtccat

SEQ ID NO: 5106615 - DNA, 16 bp, Homo sapiens
aagtctgtctgcactg

SEQ ID NO: 5106616 - DNA, 22 bp, Homo sapiens
aagtctgtctttcctgaaccat

SEQ ID NO: 5106617 - DNA, 15 bp, Homo sapiens
aagtctgtctttcta

SEQ ID NO: 5106618 - DNA, 22 bp, Homo sapiens
aagtctgtgcctggagctcctg

SEQ ID NO: 5106619 - DNA, 23 bp, Homo sapiens
aagtctgtgcctggagctcctgg

SEQ ID NO: 5106620 - DNA, 23 bp, Homo sapiens
aagtctgtgtgatgaactttctc

SEQ ID NO: 5106621 - DNA, 22 bp, Homo sapiens
aagtctgttatttattattaat

SEQ ID NO: 5106622 - DNA, 20 bp, Homo sapiens
aagtctgttgattaaagatg

SEQ ID NO: 5106623 - DNA, 13 bp, Homo sapiens
aagtctgtttact

SEQ ID NO: 5106624 - DNA, 15 bp, Homo sapiens
aagtctgttttatga

SEQ ID NO: 5106625 - DNA, 23 bp, Homo sapiens
aagtctgttttatgacttcatta

SEQ ID NO: 5106626 - DNA, 19 bp, Homo sapiens
aagtcttaaggacaaagtg

SEQ ID NO: 5106627 - DNA, 22 bp, Homo sapiens
aagtcttaaggacaaagtgcca

SEQ ID NO: 5106628 - DNA, 16 bp, Homo sapiens
aagtcttacaggaagc

SEQ ID NO: 5106629 - DNA, 17 bp, Homo sapiens
aagtcttagatgtatat

SEQ ID NO: 5106630 - DNA, 16 bp, Homo sapiens
aagtcttatcaagcag

SEQ ID NO: 5106631 - DNA, 19 bp, Homo sapiens
aagtcttcatgaaatgcta

SEQ ID NO: 5106632 - DNA, 14 bp, Homo sapiens
aagtcttccctcag

SEQ ID NO: 5106633 - DNA, 18 bp, Homo sapiens
aagtcttccctgatcaag

SEQ ID NO: 5106634 - DNA, 13 bp, Homo sapiens
aagtcttctattt

SEQ ID NO: 5106635 - DNA, 17 bp, Homo sapiens
aagtcttctatttattt

SEQ ID NO: 5106636 - DNA, 18 bp, Homo sapiens
aagtcttctcccaactca

SEQ ID NO: 5106637 - DNA, 21 bp, Homo sapiens
aagtcttctcccaactcagcc

SEQ ID NO: 5106638 - DNA, 11 bp, Homo sapiens
aagtcttcttt

SEQ ID NO: 5106639 - DNA, 21 bp, Homo sapiens
aagtcttctttcatgtaagta

SEQ ID NO: 5106640 - DNA, 16 bp, Homo sapiens
aagtcttgagaaaaag

SEQ ID NO: 5106641 - DNA, 11 bp, Homo sapiens
aagtcttgctg

SEQ ID NO: 5106642 - DNA, 12 bp, Homo sapiens
aagtcttgctgt

SEQ ID NO: 5106643 - DNA, 14 bp, Homo sapiens
aagtcttgctgtgc

SEQ ID NO: 5106644 - DNA, 16 bp, Homo sapiens
aagtcttgctgtgctt

SEQ ID NO: 5106645 - DNA, 17 bp, Homo sapiens
aagtcttggtaacaaat

SEQ ID NO: 5106646 - DNA, 10 bp, Homo sapiens
aagtcttgta

SEQ ID NO: 5106647 - DNA, 16 bp, Homo sapiens
aagtcttgtataacta

SEQ ID NO: 5106648 - DNA, 16 bp, Homo sapiens
aagtcttgtcagaatt

SEQ ID NO: 5106649 - DNA, 19 bp, Homo sapiens
aagtcttgtgactagtgct

SEQ ID NO: 5106650 - DNA, 20 bp, Homo sapiens
aagtcttgtgactagtgctg

SEQ ID NO: 5106651 - DNA, 22 bp, Homo sapiens
aagtcttgtgactagtgctgaa

SEQ ID NO: 5106652 - DNA, 23 bp, Homo sapiens
aagtcttgtgactagtgctgaag

SEQ ID NO: 5106653 - DNA, 18 bp, Homo sapiens
aagtctttaataaataac

SEQ ID NO: 5106654 - DNA, 17 bp, Homo sapiens
aagtctttaatatttta

SEQ ID NO: 5106655 - DNA, 16 bp, Homo sapiens
aagtctttcaagaatg

SEQ ID NO: 5106656 - DNA, 14 bp, Homo sapiens
aagtctttcagatg

SEQ ID NO: 5106657 - DNA, 15 bp, Homo sapiens
aagtctttcatggct

SEQ ID NO: 5106658 - DNA, 11 bp, Homo sapiens
aagtctttccc

SEQ ID NO: 5106659 - DNA, 13 bp, Homo sapiens
aagggtgtctgag

SEQ ID NO: 5106660 - DNA, 20 bp, Homo sapiens
aagggtgtgggtcagggagg

SEQ ID NO: 5106661 - DNA, 21 bp, Homo sapiens
aagggtgtgggtcagggaggg

SEQ ID NO: 5106662 - DNA, 19 bp, Homo sapiens
aagggttagacaagcctgg

SEQ ID NO: 5106663 - DNA, 14 bp, Homo sapiens
aagggttatatttt

SEQ ID NO: 5106664 - DNA, 20 bp, Homo sapiens
aagggttgcttctgagtggt

SEQ ID NO: 5106665 - DNA, 22 bp, Homo sapiens
aagggttgtgagccccttgggg

SEQ ID NO: 5106666 - DNA, 14 bp, Homo sapiens
aagggtttcgactg

SEQ ID NO: 5106667 - DNA, 19 bp, Homo sapiens
aagggtttcgactggtcca

SEQ ID NO: 5106668 - DNA, 20 bp, Homo sapiens
aagggtttgagatgtacatc

SEQ ID NO: 5106669 - DNA, 15 bp, Homo sapiens
aagggtttgtaatac

SEQ ID NO: 5106670 - DNA, 17 bp, Homo sapiens
aagggtttgtggctggg

SEQ ID NO: 5106671 - DNA, 21 bp, Homo sapiens
aagggttttccaggtgtagct

SEQ ID NO: 5106672 - DNA, 12 bp, Homo sapiens
aagggttttctt

SEQ ID NO: 5106673 - DNA, 17 bp, Homo sapiens
aaggtaaaacaaatcag

SEQ ID NO: 5106674 - DNA, 12 bp, Homo sapiens
aaggtaaaatca

SEQ ID NO: 5106675 - DNA, 16 bp, Homo sapiens
aaggtaaaatcacttc

SEQ ID NO: 5106676 - DNA, 17 bp, Homo sapiens
aaggtaaaatcacttca

SEQ ID NO: 5106677 - DNA, 19 bp, Homo sapiens
aaggtaaaatcacttcaga

SEQ ID NO: 5106678 - DNA, 12 bp, Homo sapiens
aaggtaactaac

SEQ ID NO: 5106679 - DNA, 21 bp, Homo sapiens
aaggtaagctcaggatatggc

SEQ ID NO: 5106680 - DNA, 18 bp, Homo sapiens
aaggtaataaatacacag

SEQ ID NO: 5106681 - DNA, 21 bp, Homo sapiens
aaggtaatactataaatatat

SEQ ID NO: 5106682 - DNA, 22 bp, Homo sapiens
aaggtaatactataaatatatt

SEQ ID NO: 5106683 - DNA, 12 bp, Homo sapiens
aaggtaatccta

SEQ ID NO: 5106684 - DNA, 21 bp, Homo sapiens
aaggtaatgcacatcctcatt

SEQ ID NO: 5106685 - DNA, 21 bp, Homo sapiens
aaggtaatgtagggttatatt

SEQ ID NO: 5106686 - DNA, 13 bp, Homo sapiens
aaggtaatgtgtg

SEQ ID NO: 5106687 - DNA, 14 bp, Homo sapiens
aaggtaattgtttt

SEQ ID NO: 5106688 - DNA, 17 bp, Homo sapiens
aaggtaatttcttgtgc

SEQ ID NO: 5106689 - DNA, 22 bp, Homo sapiens
aaggtaatttttttttgtaaag

SEQ ID NO: 5106690 - DNA, 14 bp, Homo sapiens
aaggtacaacagaa

SEQ ID NO: 5106691 - DNA, 17 bp, Homo sapiens
aaggtacaactgtattt

SEQ ID NO: 5106692 - DNA, 18 bp, Homo sapiens
aaggtacaactgtattta

SEQ ID NO: 5106693 - DNA, 13 bp, Homo sapiens
aaggtacatattt

SEQ ID NO: 5106694 - DNA, 21 bp, Homo sapiens
aaggtacgagtagaggtttaa

SEQ ID NO: 5106695 - DNA, 20 bp, Homo sapiens
aaggtactgaaataatgatc

SEQ ID NO: 5106696 - DNA, 19 bp, Homo sapiens
aaggtactgaaggcttctg

SEQ ID NO: 5106697 - DNA, 20 bp, Homo sapiens
aaggtactgtatgatcaaat

SEQ ID NO: 5106698 - DNA, 21 bp, Homo sapiens
aaggtactgtatgatcaaatg

SEQ ID NO: 5106699 - DNA, 12 bp, Homo sapiens
aaggtactgtgg

SEQ ID NO: 5106700 - DNA, 14 bp, Homo sapiens
aaggtacttcaaat

SEQ ID NO: 5106701 - DNA, 19 bp, Homo sapiens
aaggtactttcatatttta

SEQ ID NO: 5106702 - DNA, 17 bp, Homo sapiens
aaggtagaacctcacct

SEQ ID NO: 5106703 - DNA, 17 bp, Homo sapiens
aaggtagaatgaccttg

SEQ ID NO: 5106704 - DNA, 14 bp, Homo sapiens
aaggtagaatgttt

SEQ ID NO: 5106705 - DNA, 17 bp, Homo sapiens
aaggtagagatgtgtgt

SEQ ID NO: 5106706 - DNA, 18 bp, Homo sapiens
aaggtagagcccactgct

SEQ ID NO: 5106707 - DNA, 13 bp, Homo sapiens
aaggtagatttta

SEQ ID NO: 5106708 - DNA, 19 bp, Homo sapiens
aaggtagattttacagaga

SEQ ID NO: 5106709 - DNA, 14 bp, Homo sapiens
aaggtagccatccc

SEQ ID NO: 5106710 - DNA, 20 bp, Homo sapiens
aaggtagccctggccagagg

SEQ ID NO: 5106711 - DNA, 13 bp, Homo sapiens
aaggtaggaagag

SEQ ID NO: 5106712 - DNA, 14 bp, Homo sapiens
aaggtaggaagaga

SEQ ID NO: 5106713 - DNA, 18 bp, Homo sapiens
aaggtaggttttaaaaat

SEQ ID NO: 5106714 - DNA, 12 bp, Homo sapiens
aaggtataaata

SEQ ID NO: 5106715 - DNA, 15 bp, Homo sapiens
aaggtataataaaat

SEQ ID NO: 5106716 - DNA, 11 bp, Homo sapiens
aaggtataatt

SEQ ID NO: 5106717 - DNA, 17 bp, Homo sapiens
aaggtataattaaactt

SEQ ID NO: 5106718 - DNA, 21 bp, Homo sapiens
aaggtataattaaacttcttt

SEQ ID NO: 5106719 - DNA, 23 bp, Homo sapiens
aaggtatatcattctaaagatag

SEQ ID NO: 5106720 - DNA, 15 bp, Homo sapiens
aaggtatatgactga

SEQ ID NO: 5106721 - DNA, 20 bp, Homo sapiens
aaggtatatgttttataatt

SEQ ID NO: 5106722 - DNA, 19 bp, Homo sapiens
aaggtatcagttgcaataa

SEQ ID NO: 5106723 - DNA, 16 bp, Homo sapiens
aaggtatctttttatt

SEQ ID NO: 5106724 - DNA, 22 bp, Homo sapiens
aaggtatgtaaactttcctgta

SEQ ID NO: 5106725 - DNA, 22 bp, Homo sapiens
aaggtatgtagttacagaattc

SEQ ID NO: 5106726 - DNA, 18 bp, Homo sapiens
aaggtattccttttgtgt

SEQ ID NO: 5106727 - DNA, 13 bp, Homo sapiens
aaggtattgcaag

SEQ ID NO: 5106728 - DNA, 16 bp, Homo sapiens
aaggtatttacacata

SEQ ID NO: 5106729 - DNA, 23 bp, Homo sapiens
aaggtatttctccagttgggact

SEQ ID NO: 5106730 - DNA, 14 bp, Homo sapiens
aaggtcaaaaacaa

SEQ ID NO: 5106731 - DNA, 17 bp, Homo sapiens
aaggtcaaaactgaagc

SEQ ID NO: 5106732 - DNA, 14 bp, Homo sapiens
aaggtcaaacaggc

SEQ ID NO: 5106733 - DNA, 14 bp, Homo sapiens
aaggtcaatgtcaa

SEQ ID NO: 5106734 - DNA, 23 bp, Homo sapiens
aaggtcacataaactttataaat

SEQ ID NO: 5106735 - DNA, 16 bp, Homo sapiens
aaggtcacctgggctg

SEQ ID NO: 5106736 - DNA, 13 bp, Homo sapiens
aaggtcagaacag

SEQ ID NO: 5106737 - DNA, 22 bp, Homo sapiens
aaggtcagatttgaaaagaaca

SEQ ID NO: 5106738 - DNA, 19 bp, Homo sapiens
aaggtcagttgccatggtt

SEQ ID NO: 5106739 - DNA, 12 bp, Homo sapiens
aaggtcatctca

SEQ ID NO: 5106740 - DNA, 23 bp, Homo sapiens
aaggtcatggccacactgtgaca

SEQ ID NO: 5106741 - DNA, 17 bp, Homo sapiens
aaggtcattgtggctat

SEQ ID NO: 5106742 - DNA, 14 bp, Homo sapiens
aaggtcatttccat

SEQ ID NO: 5106743 - DNA, 20 bp, Homo sapiens
aaggtcatttccatgtatgc

SEQ ID NO: 5106744 - DNA, 17 bp, Homo sapiens
aaggtcatttcttcagt

SEQ ID NO: 5106745 - DNA, 19 bp, Homo sapiens
aaggtccacaggtctagac

SEQ ID NO: 5106746 - DNA, 20 bp, Homo sapiens
aaggtccactccctgctcca

SEQ ID NO: 5106747 - DNA, 18 bp, Homo sapiens
aaggtccaggcttgcctc

SEQ ID NO: 5106748 - DNA, 15 bp, Homo sapiens
aaggtccatgctttg

SEQ ID NO: 5106749 - DNA, 21 bp, Homo sapiens
aaggtccggtgttctaagatg

SEQ ID NO: 5106750 - DNA, 15 bp, Homo sapiens
aaggtcctagcttta

SEQ ID NO: 5106751 - DNA, 14 bp, Homo sapiens
aaggtcctctcagt

SEQ ID NO: 5106752 - DNA, 24 bp, Homo sapiens
aaggtcctgctcaactctacccct

SEQ ID NO: 5106753 - DNA, 15 bp, Homo sapiens
aaggtcctgctgtgg

SEQ ID NO: 5106754 - DNA, 17 bp, Homo sapiens
aaggtcctgtggggagc

SEQ ID NO: 5106755 - DNA, 14 bp, Homo sapiens
aaggtcgcacctcc

SEQ ID NO: 5106756 - DNA, 18 bp, Homo sapiens
aaggtcgcacctccttgg

SEQ ID NO: 5106757 - DNA, 22 bp, Homo sapiens
aaggtcggaggcttgggaccgc

SEQ ID NO: 5106758 - DNA, 17 bp, Homo sapiens
aaggtcgggacagctgt

SEQ ID NO: 5106759 - DNA, 19 bp, Homo sapiens
aaggtctaggtggaggtgg

SEQ ID NO: 5106760 - DNA, 17 bp, Homo sapiens
aaggtctataaacatga

SEQ ID NO: 5106761 - DNA, 12 bp, Homo sapiens
aaggtctattgg

SEQ ID NO: 5106762 - DNA, 21 bp, Homo sapiens
aaggtctcacactcctcctgc

SEQ ID NO: 5106763 - DNA, 22 bp, Homo sapiens
aaggtctcacactcctcctgcc

SEQ ID NO: 5106764 - DNA, 18 bp, Homo sapiens
aaggtctcagcttgtata

SEQ ID NO: 5106765 - DNA, 23 bp, Homo sapiens
aaggtctcatgctgttgctgcta

SEQ ID NO: 5106766 - DNA, 15 bp, Homo sapiens
aaggtctcattcttc

SEQ ID NO: 5106767 - DNA, 21 bp, Homo sapiens
aaggtctcatttgatattgtg

SEQ ID NO: 5106768 - DNA, 22 bp, Homo sapiens
aaggtctccttactctgagccc

SEQ ID NO: 5106769 - DNA, 23 bp, Homo sapiens
aaggtctccttactctgagccca

SEQ ID NO: 5106770 - DNA, 14 bp, Homo sapiens
aaggtctctctggc

SEQ ID NO: 5106771 - DNA, 15 bp, Homo sapiens
aaggtctctctggct

SEQ ID NO: 5106772 - DNA, 17 bp, Homo sapiens
aaggtctctctggctct

SEQ ID NO: 5106773 - DNA, 14 bp, Homo sapiens
aaggtctctctttg

SEQ ID NO: 5106774 - DNA, 15 bp, Homo sapiens
aaggtctgacagtag

SEQ ID NO: 5106775 - DNA, 14 bp, Homo sapiens
aaggtctgagccac

SEQ ID NO: 5106776 - DNA, 16 bp, Homo sapiens
aaggtctgatttgcag

SEQ ID NO: 5106777 - DNA, 19 bp, Homo sapiens
aaggtctgcactcctttat

SEQ ID NO: 5106778 - DNA, 12 bp, Homo sapiens
aaggtctgcttt

SEQ ID NO: 5106779 - DNA, 12 bp, Homo sapiens
aaggtctgggtc

SEQ ID NO: 5106780 - DNA, 18 bp, Homo sapiens
aaggtctgtttgctgttg

SEQ ID NO: 5106781 - DNA, 16 bp, Homo sapiens
aaggtctgttttgagt

SEQ ID NO: 5106782 - DNA, 19 bp, Homo sapiens
aaggtctgttttgtgtact

SEQ ID NO: 5106783 - DNA, 18 bp, Homo sapiens
aaggtctttaaaatattg

SEQ ID NO: 5106784 - DNA, 13 bp, Homo sapiens
aaggtctttgtta

SEQ ID NO: 5106785 - DNA, 12 bp, Homo sapiens
aaggtcttttga

SEQ ID NO: 5106786 - DNA, 21 bp, Homo sapiens
aaggtgaaacacacacacatt

SEQ ID NO: 5106787 - DNA, 19 bp, Homo sapiens
aaggtgaaacattttctcc

SEQ ID NO: 5106788 - DNA, 18 bp, Homo sapiens
aaggtgaaacgactcaaa

SEQ ID NO: 5106789 - DNA, 15 bp, Homo sapiens
aaggtgaagcacata

SEQ ID NO: 5106790 - DNA, 20 bp, Homo sapiens
aaggtgacacattacaaagc

SEQ ID NO: 5106791 - DNA, 17 bp, Homo sapiens
aaggtgactgtgtgtgt

SEQ ID NO: 5106792 - DNA, 21 bp, Homo sapiens
aaggtgacttcctctggtgtt

SEQ ID NO: 5106793 - DNA, 14 bp, Homo sapiens
aaggtgactttctg

SEQ ID NO: 5106794 - DNA, 14 bp, Homo sapiens
aaggtgagaaatca

SEQ ID NO: 5106795 - DNA, 17 bp, Homo sapiens
aaggtgagaaatcacaa

SEQ ID NO: 5106796 - DNA, 17 bp, Homo sapiens
aaggtgagaattaagtt

SEQ ID NO: 5106797 - DNA, 19 bp, Homo sapiens
aaggtgaggcctgtctgtg

SEQ ID NO: 5106798 - DNA, 19 bp, Homo sapiens
aaggtgataagggaaaaga

SEQ ID NO: 5106799 - DNA, 16 bp, Homo sapiens
aaggtgatatataatt

SEQ ID NO: 5106800 - DNA, 17 bp, Homo sapiens
aaggtgatgaatttacc

SEQ ID NO: 5106801 - DNA, 21 bp, Homo sapiens
aaggtgatgaatttaccatca

SEQ ID NO: 5106802 - DNA, 13 bp, Homo sapiens
aaggtgatgttgt

SEQ ID NO: 5106803 - DNA, 14 bp, Homo sapiens
aaggtgatttcaga

SEQ ID NO: 5106804 - DNA, 23 bp, Homo sapiens
aaggtgcacagacctcagagatg

SEQ ID NO: 5106805 - DNA, 11 bp, Homo sapiens
aaggtgcacat

SEQ ID NO: 5106806 - DNA, 12 bp, Homo sapiens
aaggtgcacatt

SEQ ID NO: 5106807 - DNA, 15 bp, Homo sapiens
aaggtgcactccaga

SEQ ID NO: 5106808 - DNA, 16 bp, Homo sapiens
aaggtgcactccagac

SEQ ID NO: 5106809 - DNA, 14 bp, Homo sapiens
aaggtgcaggcagg

SEQ ID NO: 5106810 - DNA, 18 bp, Homo sapiens
aaggtgcatatagaaaac

SEQ ID NO: 5106811 - DNA, 19 bp, Homo sapiens
aaggtgcatatagaaaaca

SEQ ID NO: 5106812 - DNA, 12 bp, Homo sapiens
aaggtgcatctg

SEQ ID NO: 5106813 - DNA, 13 bp, Homo sapiens
aaggtgccacttt

SEQ ID NO: 5106814 - DNA, 15 bp, Homo sapiens
aaggtgccagaagga

SEQ ID NO: 5106815 - DNA, 17 bp, Homo sapiens
aaggtgccatgtcttta

SEQ ID NO: 5106816 - DNA, 12 bp, Homo sapiens
aaggtgcccagg

SEQ ID NO: 5106817 - DNA, 13 bp, Homo sapiens
aaggtgcccagga

SEQ ID NO: 5106818 - DNA, 19 bp, Homo sapiens
aaggtgccctttagccaga

SEQ ID NO: 5106819 - DNA, 21 bp, Homo sapiens
aaggtgccgatttcatgcatt

SEQ ID NO: 5106820 - DNA, 18 bp, Homo sapiens
aaggtgccgtgagcaggc

SEQ ID NO: 5106821 - DNA, 15 bp, Homo sapiens
aaggtgcctcagact

SEQ ID NO: 5106822 - DNA, 14 bp, Homo sapiens
aaggtgcctcagtt

SEQ ID NO: 5106823 - DNA, 12 bp, Homo sapiens
aaggtgcctcat

SEQ ID NO: 5106824 - DNA, 20 bp, Homo sapiens
aaggtgcctcatagcatagc

SEQ ID NO: 5106825 - DNA, 13 bp, Homo sapiens
aaggtgcctgcca

SEQ ID NO: 5106826 - DNA, 22 bp, Homo sapiens
aaggtgcctgccatagccagga

SEQ ID NO: 5106827 - DNA, 23 bp, Homo sapiens
aaggtgcctgccatagccaggag

SEQ ID NO: 5106828 - DNA, 13 bp, Homo sapiens
aaggtgcctggcc

SEQ ID NO: 5106829 - DNA, 11 bp, Homo sapiens
aaggtgcctgt

SEQ ID NO: 5106830 - DNA, 12 bp, Homo sapiens
aaggtgctcaaa

SEQ ID NO: 5106831 - DNA, 17 bp, Homo sapiens
aaggtgctcttctcatt

SEQ ID NO: 5106832 - DNA, 13 bp, Homo sapiens
aaggtgctcttga

SEQ ID NO: 5106833 - DNA, 12 bp, Homo sapiens
aaggtgctgcca

SEQ ID NO: 5106834 - DNA, 14 bp, Homo sapiens
aaggtgctgccacc

SEQ ID NO: 5106835 - DNA, 15 bp, Homo sapiens
aaggtgctgccaccc

SEQ ID NO: 5106836 - DNA, 17 bp, Homo sapiens
aaggtgctgccacccct

SEQ ID NO: 5106837 - DNA, 16 bp, Homo sapiens
aaggtgcttgctcccc

SEQ ID NO: 5106838 - DNA, 22 bp, Homo sapiens
aaggtgcttgggcttctgcggt

SEQ ID NO: 5106839 - DNA, 15 bp, Homo sapiens
aaggtggaaaatgga

SEQ ID NO: 5106840 - DNA, 17 bp, Homo sapiens
aagtctttctctttccc

SEQ ID NO: 5106841 - DNA, 22 bp, Homo sapiens
aagtctttctctttccctggtc

SEQ ID NO: 5106842 - DNA, 23 bp, Homo sapiens
aagtctttctctttccctggtcc

SEQ ID NO: 5106843 - DNA, 14 bp, Homo sapiens
aagtcttttctgtc

SEQ ID NO: 5106844 - DNA, 22 bp, Homo sapiens
aagtcttttctgtcaccaaatt

SEQ ID NO: 5106845 - DNA, 18 bp, Homo sapiens
aagtcttttgttcgcatg

SEQ ID NO: 5106846 - DNA, 19 bp, Homo sapiens
aagtcttttttttttccaa

SEQ ID NO: 5106847 - DNA, 15 bp, Homo sapiens
aagtgaaaaaaagaa

SEQ ID NO: 5106848 - DNA, 16 bp, Homo sapiens
aagtgaaaaaaagaaa

SEQ ID NO: 5106849 - DNA, 20 bp, Homo sapiens
aagtgaaaaagacttcaaat

SEQ ID NO: 5106850 - DNA, 13 bp, Homo sapiens
aagtgaaaatctt

SEQ ID NO: 5106851 - DNA, 18 bp, Homo sapiens
aagtgaaagacatttcaa

SEQ ID NO: 5106852 - DNA, 17 bp, Homo sapiens
aagtgaaataatattga

SEQ ID NO: 5106853 - DNA, 21 bp, Homo sapiens
aagtgaaatctgtgcaataaa

SEQ ID NO: 5106854 - DNA, 11 bp, Homo sapiens
aagtgaaattt

SEQ ID NO: 5106855 - DNA, 18 bp, Homo sapiens
aagtgaaatttctagcct

SEQ ID NO: 5106856 - DNA, 16 bp, Homo sapiens
aagtgaaattttaaat

SEQ ID NO: 5106857 - DNA, 16 bp, Homo sapiens
aagtgaacaaatttca

SEQ ID NO: 5106858 - DNA, 20 bp, Homo sapiens
aagtgaacaatcagcggcat

SEQ ID NO: 5106859 - DNA, 15 bp, Homo sapiens
aagtgaacagatttt

SEQ ID NO: 5106860 - DNA, 20 bp, Homo sapiens
aagtgaacccatattttaaa

SEQ ID NO: 5106861 - DNA, 19 bp, Homo sapiens
aagtgaactaccatgcttt

SEQ ID NO: 5106862 - DNA, 17 bp, Homo sapiens
aagtgaacttgggaggg

SEQ ID NO: 5106863 - DNA, 15 bp, Homo sapiens
aagtgaacttttgta

SEQ ID NO: 5106864 - DNA, 11 bp, Homo sapiens
aagtgaagaat

SEQ ID NO: 5106865 - DNA, 13 bp, Homo sapiens
aagtgaagactgg

SEQ ID NO: 5106866 - DNA, 15 bp, Homo sapiens
aagtgaagagtcaga

SEQ ID NO: 5106867 - DNA, 16 bp, Homo sapiens
aagtgaagagtcagaa

SEQ ID NO: 5106868 - DNA, 12 bp, Homo sapiens
aagtgaagcccc

SEQ ID NO: 5106869 - DNA, 17 bp, Homo sapiens
aagtgaagccccttgtc

SEQ ID NO: 5106870 - DNA, 11 bp, Homo sapiens
aagtgaaggaa

SEQ ID NO: 5106871 - DNA, 18 bp, Homo sapiens
aagtgaaggagaaaggag

SEQ ID NO: 5106872 - DNA, 20 bp, Homo sapiens
aagtgaaggttcccaaggac

SEQ ID NO: 5106873 - DNA, 22 bp, Homo sapiens
aagtgaaggtttacaatttaca

SEQ ID NO: 5106874 - DNA, 15 bp, Homo sapiens
aagtgaataaaaatt

SEQ ID NO: 5106875 - DNA, 18 bp, Homo sapiens
aagtgaataaacttcagc

SEQ ID NO: 5106876 - DNA, 18 bp, Homo sapiens
aagtgaatacttggaagt

SEQ ID NO: 5106877 - DNA, 14 bp, Homo sapiens
aagtgaatccttaa

SEQ ID NO: 5106878 - DNA, 16 bp, Homo sapiens
aagtgaattgaagttt

SEQ ID NO: 5106879 - DNA, 16 bp, Homo sapiens
aagtgaatttatgaga

SEQ ID NO: 5106880 - DNA, 17 bp, Homo sapiens
aagtgaatttgaatact

SEQ ID NO: 5106881 - DNA, 18 bp, Homo sapiens
aagtgacaaataagatta

SEQ ID NO: 5106882 - DNA, 21 bp, Homo sapiens
aagtgacaatgcttatggaaa

SEQ ID NO: 5106883 - DNA, 12 bp, Homo sapiens
aagtgacacaga

SEQ ID NO: 5106884 - DNA, 13 bp, Homo sapiens
aagtgacacagac

SEQ ID NO: 5106885 - DNA, 15 bp, Homo sapiens
aagtgacagatgtta

SEQ ID NO: 5106886 - DNA, 15 bp, Homo sapiens
aagtgacagggaagc

SEQ ID NO: 5106887 - DNA, 22 bp, Homo sapiens
aagtgacagggaagctacaggt

SEQ ID NO: 5106888 - DNA, 23 bp, Homo sapiens
aagtgacagggaagctacaggtt

SEQ ID NO: 5106889 - DNA, 23 bp, Homo sapiens
aagtgacatgcattcacatatct

SEQ ID NO: 5106890 - DNA, 20 bp, Homo sapiens
aagtgaccagggaagtgtgt

SEQ ID NO: 5106891 - DNA, 17 bp, Homo sapiens
aagtgaccccagctcca

SEQ ID NO: 5106892 - DNA, 22 bp, Homo sapiens
aagtgaccccagctccaggcag

SEQ ID NO: 5106893 - DNA, 21 bp, Homo sapiens
aagtgaccccagggcctgtct

SEQ ID NO: 5106894 - DNA, 13 bp, Homo sapiens
aagtgactaccag

SEQ ID NO: 5106895 - DNA, 14 bp, Homo sapiens
aagtgactctcctg

SEQ ID NO: 5106896 - DNA, 15 bp, Homo sapiens
aagtgactgttgtac

SEQ ID NO: 5106897 - DNA, 23 bp, Homo sapiens
aagtgactgtttggcttataaac

SEQ ID NO: 5106898 - DNA, 20 bp, Homo sapiens
aagtgacttgaatgtacaaa

SEQ ID NO: 5106899 - DNA, 21 bp, Homo sapiens
aagtgacttgaatgtacaaag

SEQ ID NO: 5106900 - DNA, 19 bp, Homo sapiens
aagtgactttggctgcatg

SEQ ID NO: 5106901 - DNA, 14 bp, Homo sapiens
aagtgagaaaactg

SEQ ID NO: 5106902 - DNA, 12 bp, Homo sapiens
aagtgagaaaga

SEQ ID NO: 5106903 - DNA, 20 bp, Homo sapiens
aagtgagaaagaaagtaaaa

SEQ ID NO: 5106904 - DNA, 15 bp, Homo sapiens
aagtgagaagatggt

SEQ ID NO: 5106905 - DNA, 22 bp, Homo sapiens
aagtgagaagctgggcatgaac

SEQ ID NO: 5106906 - DNA, 15 bp, Homo sapiens
aagtgagacagtcca

SEQ ID NO: 5106907 - DNA, 22 bp, Homo sapiens
aagtgagacagtccagcctgga

SEQ ID NO: 5106908 - DNA, 14 bp, Homo sapiens
aagtgagacccaaa

SEQ ID NO: 5106909 - DNA, 15 bp, Homo sapiens
aagtgagagaaatga

SEQ ID NO: 5106910 - DNA, 17 bp, Homo sapiens
aagtgagagaaatgaag

SEQ ID NO: 5106911 - DNA, 15 bp, Homo sapiens
aagtgagagctgggt

SEQ ID NO: 5106912 - DNA, 14 bp, Homo sapiens
aagtgagaggggag

SEQ ID NO: 5106913 - DNA, 19 bp, Homo sapiens
aagtgagaggggagggagg

SEQ ID NO: 5106914 - DNA, 17 bp, Homo sapiens
aagtgagatgggaaggg

SEQ ID NO: 5106915 - DNA, 20 bp, Homo sapiens
aagtgagatgggaagggctt

SEQ ID NO: 5106916 - DNA, 18 bp, Homo sapiens
aagtgagcaaacctgccc

SEQ ID NO: 5106917 - DNA, 19 bp, Homo sapiens
aagtgagcaaacctgcccc

SEQ ID NO: 5106918 - DNA, 17 bp, Homo sapiens
aagtgagcactgagggt

SEQ ID NO: 5106919 - DNA, 12 bp, Homo sapiens
aagtgagcagaa

SEQ ID NO: 5106920 - DNA, 14 bp, Homo sapiens
aagtgagcagaaca

SEQ ID NO: 5106921 - DNA, 15 bp, Homo sapiens
aagtgagcagtgttg

SEQ ID NO: 5106922 - DNA, 16 bp, Homo sapiens
aagtgagcccccccct

SEQ ID NO: 5106923 - DNA, 17 bp, Homo sapiens
aagtgagctttgctgct

SEQ ID NO: 5106924 - DNA, 21 bp, Homo sapiens
aagtgagctttgctgctacag

SEQ ID NO: 5106925 - DNA, 18 bp, Homo sapiens
aagtgaggaaatcaaagt

SEQ ID NO: 5106926 - DNA, 16 bp, Homo sapiens
aagtgaggatgaaaaa

SEQ ID NO: 5106927 - DNA, 16 bp, Homo sapiens
aagtgaggccactgaa

SEQ ID NO: 5106928 - DNA, 11 bp, Homo sapiens
aagtgaggcct

SEQ ID NO: 5106929 - DNA, 22 bp, Homo sapiens
aagtgagggccgagtgagagcg

SEQ ID NO: 5106930 - DNA, 21 bp, Homo sapiens
aagtgagggctgggcagctga

SEQ ID NO: 5106931 - DNA, 18 bp, Homo sapiens
aagtgagtctggtggagg

SEQ ID NO: 5106932 - DNA, 20 bp, Homo sapiens
aagtgagtggtgtgactctt

SEQ ID NO: 5106933 - DNA, 17 bp, Homo sapiens
aagtgagtgtgctgctg

SEQ ID NO: 5106934 - DNA, 16 bp, Homo sapiens
aagtgagtttgtaaat

SEQ ID NO: 5106935 - DNA, 15 bp, Homo sapiens
aagtgataatttctg

SEQ ID NO: 5106936 - DNA, 17 bp, Homo sapiens
aagtgatatatgtattt

SEQ ID NO: 5106937 - DNA, 22 bp, Homo sapiens
aagtgatatcacctctcttcag

SEQ ID NO: 5106938 - DNA, 18 bp, Homo sapiens
aagtgatatcataaaagt

SEQ ID NO: 5106939 - DNA, 14 bp, Homo sapiens
aagtgatatggtga

SEQ ID NO: 5106940 - DNA, 22 bp, Homo sapiens
aagtgatatggtgaagggaagt

SEQ ID NO: 5106941 - DNA, 15 bp, Homo sapiens
aagtgatcagcaatg

SEQ ID NO: 5106942 - DNA, 18 bp, Homo sapiens
aagtgatcctcctgcctc

SEQ ID NO: 5106943 - DNA, 21 bp, Homo sapiens
aagtgatctgtcccctctccc

SEQ ID NO: 5106944 - DNA, 22 bp, Homo sapiens
aagtgatctgtcccctctcccc

SEQ ID NO: 5106945 - DNA, 16 bp, Homo sapiens
aagtgatctgtgttca

SEQ ID NO: 5106946 - DNA, 14 bp, Homo sapiens
aagtgatctttcaa

SEQ ID NO: 5106947 - DNA, 13 bp, Homo sapiens
aagtgatgacata

SEQ ID NO: 5106948 - DNA, 14 bp, Homo sapiens
aagtgatgacatat

SEQ ID NO: 5106949 - DNA, 16 bp, Homo sapiens
aagtgatgctgtgata

SEQ ID NO: 5106950 - DNA, 18 bp, Homo sapiens
aagtgatgggctttctct

SEQ ID NO: 5106951 - DNA, 22 bp, Homo sapiens
aagtgatgtatgttatttgatg

SEQ ID NO: 5106952 - DNA, 13 bp, Homo sapiens
aagtgatgtattt

SEQ ID NO: 5106953 - DNA, 18 bp, Homo sapiens
aagtgatgtattttcata

SEQ ID NO: 5106954 - DNA, 19 bp, Homo sapiens
aagtgatgtgatttatgca

SEQ ID NO: 5106955 - DNA, 21 bp, Homo sapiens
aagtgattaaacgtgcagact

SEQ ID NO: 5106956 - DNA, 14 bp, Homo sapiens
aagtgattcaccca

SEQ ID NO: 5106957 - DNA, 18 bp, Homo sapiens
aagtgattcactgtgctt

SEQ ID NO: 5106958 - DNA, 21 bp, Homo sapiens
aagtgattccttcttgctcag

SEQ ID NO: 5106959 - DNA, 13 bp, Homo sapiens
aagtgattctcat

SEQ ID NO: 5106960 - DNA, 19 bp, Homo sapiens
aagtgattctcatgcctca

SEQ ID NO: 5106961 - DNA, 20 bp, Homo sapiens
aagtgattctcatgcctcag

SEQ ID NO: 5106962 - DNA, 17 bp, Homo sapiens
aagtgattctcctgcct

SEQ ID NO: 5106963 - DNA, 23 bp, Homo sapiens
aagtgattctcctgcctcagcct

SEQ ID NO: 5106964 - DNA, 14 bp, Homo sapiens
aagtgattgaaaat

SEQ ID NO: 5106965 - DNA, 21 bp, Homo sapiens
aagtgattgacaactgaagag

SEQ ID NO: 5106966 - DNA, 14 bp, Homo sapiens
aagtgattgacatt

SEQ ID NO: 5106967 - DNA, 22 bp, Homo sapiens
aagtgattgacattttgtagct

SEQ ID NO: 5106968 - DNA, 18 bp, Homo sapiens
aagtgattgggacagagg

SEQ ID NO: 5106969 - DNA, 13 bp, Homo sapiens
aagtgattgtgaa

SEQ ID NO: 5106970 - DNA, 14 bp, Homo sapiens
aagtgatttataaa

SEQ ID NO: 5106971 - DNA, 15 bp, Homo sapiens
aagtgatttttggtc

SEQ ID NO: 5106972 - DNA, 21 bp, Homo sapiens
aagtgatttttggtcttctgt

SEQ ID NO: 5106973 - DNA, 13 bp, Homo sapiens
aagtgcaaacaga

SEQ ID NO: 5106974 - DNA, 20 bp, Homo sapiens
aagtgcaaacagaagtgcat

SEQ ID NO: 5106975 - DNA, 12 bp, Homo sapiens
aagtgcaaagct

SEQ ID NO: 5106976 - DNA, 19 bp, Homo sapiens
aagtgcaaaggtgtgcaaa

SEQ ID NO: 5106977 - DNA, 21 bp, Homo sapiens
aagtgcaaatactccaagctt

SEQ ID NO: 5106978 - DNA, 14 bp, Homo sapiens
aagtgcaacatttc

SEQ ID NO: 5106979 - DNA, 17 bp, Homo sapiens
aagtgcaacatttctgt

SEQ ID NO: 5106980 - DNA, 22 bp, Homo sapiens
aagtgcaataaatctgacccag

SEQ ID NO: 5106981 - DNA, 21 bp, Homo sapiens
aagtgcaatatgggcgggcag

SEQ ID NO: 5106982 - DNA, 17 bp, Homo sapiens
aagtgcaatttcccctc

SEQ ID NO: 5106983 - DNA, 18 bp, Homo sapiens
aagtgcacacagaaatat

SEQ ID NO: 5106984 - DNA, 21 bp, Homo sapiens
aagtgcacacagaaatatata

SEQ ID NO: 5106985 - DNA, 22 bp, Homo sapiens
aagtgcacacagaaatatatat

SEQ ID NO: 5106986 - DNA, 21 bp, Homo sapiens
aagtgcacacctttattcaga

SEQ ID NO: 5106987 - DNA, 22 bp, Homo sapiens
aagtgcaccaggtcactctgac

SEQ ID NO: 5106988 - DNA, 17 bp, Homo sapiens
aagtgcagaatgctcct

SEQ ID NO: 5106989 - DNA, 13 bp, Homo sapiens
aagtgcagagctt

SEQ ID NO: 5106990 - DNA, 12 bp, Homo sapiens
aagtgcaggctg

SEQ ID NO: 5106991 - DNA, 21 bp, Homo sapiens
aagtgcaggctggcaccgcct

SEQ ID NO: 5106992 - DNA, 18 bp, Homo sapiens
aagtgcatatgaaatcct

SEQ ID NO: 5106993 - DNA, 14 bp, Homo sapiens
aagtgcatgaaaaa

SEQ ID NO: 5106994 - DNA, 23 bp, Homo sapiens
aagtgcatgcattgagctgcctc

SEQ ID NO: 5106995 - DNA, 16 bp, Homo sapiens
aagtgcatgctctctg

SEQ ID NO: 5106996 - DNA, 15 bp, Homo sapiens
aagtgcatgtcacat

SEQ ID NO: 5106997 - DNA, 18 bp, Homo sapiens
aagtgcatgtcacatgcc

SEQ ID NO: 5106998 - DNA, 20 bp, Homo sapiens
aagtgcatgttaaaataatt

SEQ ID NO: 5106999 - DNA, 17 bp, Homo sapiens
aagtgcattattttatt

SEQ ID NO: 5107000 - DNA, 11 bp, Homo sapiens
aagtgcattca

SEQ ID NO: 5107001 - DNA, 20 bp, Homo sapiens
aagtgcattcaaccttacca

SEQ ID NO: 5107002 - DNA, 13 bp, Homo sapiens
aagtgcatttaag

SEQ ID NO: 5107003 - DNA, 15 bp, Homo sapiens
aagtgcatttaagga

SEQ ID NO: 5107004 - DNA, 17 bp, Homo sapiens
aagtgcatttaaggaga

SEQ ID NO: 5107005 - DNA, 19 bp, Homo sapiens
aagtgccaaaataaagtct

SEQ ID NO: 5107006 - DNA, 16 bp, Homo sapiens
aagtgccaaagaaagt

SEQ ID NO: 5107007 - DNA, 17 bp, Homo sapiens
aagtgccaaatgctctc

SEQ ID NO: 5107008 - DNA, 21 bp, Homo sapiens
aagtgccactgcccgagctgg

SEQ ID NO: 5107009 - DNA, 12 bp, Homo sapiens
aagtgccagaaa

SEQ ID NO: 5107010 - DNA, 19 bp, Homo sapiens
aagtgccagaggtgggcag

SEQ ID NO: 5107011 - DNA, 15 bp, Homo sapiens
aagtgccagggctgg

SEQ ID NO: 5107012 - DNA, 23 bp, Homo sapiens
aagtgccaggtgatctcctgtgg

SEQ ID NO: 5107013 - DNA, 21 bp, Homo sapiens
aagtgccagtcttgtgtctgc

SEQ ID NO: 5107014 - DNA, 17 bp, Homo sapiens
aagtgccatcccacatt

SEQ ID NO: 5107015 - DNA, 16 bp, Homo sapiens
aagtgccattaacaaa

SEQ ID NO: 5107016 - DNA, 20 bp, Homo sapiens
aagtgccattactactgtac

SEQ ID NO: 5107017 - DNA, 18 bp, Homo sapiens
aagtgccatttcctgtct

SEQ ID NO: 5107018 - DNA, 12 bp, Homo sapiens
aagtgcccaaag

SEQ ID NO: 5107019 - DNA, 17 bp, Homo sapiens
aagtgcccacatttgat

SEQ ID NO: 5107020 - DNA, 18 bp, Homo sapiens
aagtgcccagtggagcct

SEQ ID NO: 5107021 - DNA, 19 bp, Homo sapiens
aagtgcccagtggagcctg

SEQ ID NO: 5107022 - DNA, 20 bp, Homo sapiens
aagtgccccctcacctctcc

SEQ ID NO: 5107023 - DNA, 21 bp, Homo sapiens
aagtgccccctcacctctcca

SEQ ID NO: 5107024 - DNA, 16 bp, Homo sapiens
aagtgcccgccctgcc

SEQ ID NO: 5107025 - DNA, 18 bp, Homo sapiens
aagtgccctccaggcttt

SEQ ID NO: 5107026 - DNA, 19 bp, Homo sapiens
aagtgccgcaaattgtacc

SEQ ID NO: 5107027 - DNA, 16 bp, Homo sapiens
aagtgcctatgcaaac

SEQ ID NO: 5107028 - DNA, 21 bp, Homo sapiens
aagtgcctcaagaggaatgaa

SEQ ID NO: 5107029 - DNA, 14 bp, Homo sapiens
aagtgcctgcttag

SEQ ID NO: 5107030 - DNA, 11 bp, Homo sapiens
aagtgcctggg

SEQ ID NO: 5107031 - DNA, 14 bp, Homo sapiens
aagtgcctgggctc

SEQ ID NO: 5107032 - DNA, 20 bp, Homo sapiens
aagtgcctgggctcagcctg

SEQ ID NO: 5107033 - DNA, 23 bp, Homo sapiens
aagtgccttagcatgtgttgcag

SEQ ID NO: 5107034 - DNA, 19 bp, Homo sapiens
aagtgccttatcaaataat

SEQ ID NO: 5107035 - DNA, 12 bp, Homo sapiens
aagtgccttctc

SEQ ID NO: 5107036 - DNA, 13 bp, Homo sapiens
aagtgccttctcc

SEQ ID NO: 5107037 - DNA, 22 bp, Homo sapiens
aagtgccttctccttccccagg

SEQ ID NO: 5107038 - DNA, 21 bp, Homo sapiens
aagtgccttgagctgcctgct

SEQ ID NO: 5107039 - DNA, 13 bp, Homo sapiens
aagtgcctttcag

SEQ ID NO: 5107040 - DNA, 14 bp, Homo sapiens
aagtgcctttcagg

SEQ ID NO: 5107041 - DNA, 20 bp, Homo sapiens
aagtgcctttcaggatctat

SEQ ID NO: 5107042 - DNA, 19 bp, Homo sapiens
aagtgccttttgctgcgca

SEQ ID NO: 5107043 - DNA, 14 bp, Homo sapiens
aagtgcgctttgca

SEQ ID NO: 5107044 - DNA, 20 bp, Homo sapiens
aagtgcgtgccgtgtgagtg

SEQ ID NO: 5107045 - DNA, 15 bp, Homo sapiens
aagtgcgttctccca

SEQ ID NO: 5107046 - DNA, 17 bp, Homo sapiens
aagtgcgttctcccagc

SEQ ID NO: 5107047 - DNA, 15 bp, Homo sapiens
aagtgctaaggttct

SEQ ID NO: 5107048 - DNA, 20 bp, Homo sapiens
aagtgctacagaaagcacaa

SEQ ID NO: 5107049 - DNA, 23 bp, Homo sapiens
aagtgctatgccaagccatgtct

SEQ ID NO: 5107050 - DNA, 18 bp, Homo sapiens
aagtgctattacgaagtt

SEQ ID NO: 5107051 - DNA, 20 bp, Homo sapiens
aagtgctcaagcagcaaaat

SEQ ID NO: 5107052 - DNA, 13 bp, Homo sapiens
aagtgctccccac

SEQ ID NO: 5107053 - DNA, 16 bp, Homo sapiens
aagtgctccccacacg

SEQ ID NO: 5107054 - DNA, 13 bp, Homo sapiens
aagtgctccctgg

SEQ ID NO: 5107055 - DNA, 19 bp, Homo sapiens
aagtgctcttggctgaccc

SEQ ID NO: 5107056 - DNA, 15 bp, Homo sapiens
aagtgctctttccac

SEQ ID NO: 5107057 - DNA, 14 bp, Homo sapiens
aagtgctgaaaatg

SEQ ID NO: 5107058 - DNA, 13 bp, Homo sapiens
aagtgctgagatt

SEQ ID NO: 5107059 - DNA, 15 bp, Homo sapiens
aagtgctgcactcaa

SEQ ID NO: 5107060 - DNA, 14 bp, Homo sapiens
aagtgctgctgtgg

SEQ ID NO: 5107061 - DNA, 23 bp, Homo sapiens
aagtgctgctgtggagtgaggtg

SEQ ID NO: 5107062 - DNA, 19 bp, Homo sapiens
aagtgctggagtctcctga

SEQ ID NO: 5107063 - DNA, 18 bp, Homo sapiens
aagtgctggattgtcctt

SEQ ID NO: 5107064 - DNA, 22 bp, Homo sapiens
aagtgctggcaaccactaagaa

SEQ ID NO: 5107065 - DNA, 23 bp, Homo sapiens
aagtgctggcaaccactaagaat

SEQ ID NO: 5107066 - DNA, 11 bp, Homo sapiens
aagtgctggga

SEQ ID NO: 5107067 - DNA, 13 bp, Homo sapiens
aagtgctgggatt

SEQ ID NO: 5107068 - DNA, 17 bp, Homo sapiens
aagtgctgggattacag

SEQ ID NO: 5107069 - DNA, 22 bp, Homo sapiens
aagtgctgggattacaggtgtg

SEQ ID NO: 5107070 - DNA, 12 bp, Homo sapiens
aagtgctgtata

SEQ ID NO: 5107071 - DNA, 17 bp, Homo sapiens
aagtgctgttgggatat

SEQ ID NO: 5107072 - DNA, 17 bp, Homo sapiens
aagtgctgtttattaat

SEQ ID NO: 5107073 - DNA, 23 bp, Homo sapiens
aagtgctgtttgagggattttat

SEQ ID NO: 5107074 - DNA, 21 bp, Homo sapiens
aagtgctgtttgggcaggagt

SEQ ID NO: 5107075 - DNA, 22 bp, Homo sapiens
aagtgcttagaggttctgcctc

SEQ ID NO: 5107076 - DNA, 19 bp, Homo sapiens
aagtgcttattacatttta

SEQ ID NO: 5107077 - DNA, 22 bp, Homo sapiens
aagtgcttcacaggttttatgt

SEQ ID NO: 5107078 - DNA, 23 bp, Homo sapiens
aagtgcttcacaggttttatgtg

SEQ ID NO: 5107079 - DNA, 12 bp, Homo sapiens
aagtgcttcctt

SEQ ID NO: 5107080 - DNA, 14 bp, Homo sapiens
aagtgcttcctttt

SEQ ID NO: 5107081 - DNA, 17 bp, Homo sapiens
aagtgcttgctttttgc

SEQ ID NO: 5107082 - DNA, 22 bp, Homo sapiens
aagtgcttggaacatactgttc

SEQ ID NO: 5107083 - DNA, 15 bp, Homo sapiens
aagtgcttggttgaa

SEQ ID NO: 5107084 - DNA, 15 bp, Homo sapiens
aagtgcttgtgtaat

SEQ ID NO: 5107085 - DNA, 19 bp, Homo sapiens
aagtgcttgttttacataa

SEQ ID NO: 5107086 - DNA, 14 bp, Homo sapiens
aagtgctttaaaaa

SEQ ID NO: 5107087 - DNA, 13 bp, Homo sapiens
aagtgctttcttc

SEQ ID NO: 5107088 - DNA, 21 bp, Homo sapiens
aagtgctttgctggagtcctg

SEQ ID NO: 5107089 - DNA, 10 bp, Homo sapiens
aagtggaaaa

SEQ ID NO: 5107090 - DNA, 17 bp, Homo sapiens
aagtggaaaaagaaatt

SEQ ID NO: 5107091 - DNA, 13 bp, Homo sapiens
aagtggaaatgtt

SEQ ID NO: 5107092 - DNA, 20 bp, Homo sapiens
aagtggaacgaaaatgaaag

SEQ ID NO: 5107093 - DNA, 17 bp, Homo sapiens
aagtggaagacagagat

SEQ ID NO: 5107094 - DNA, 18 bp, Homo sapiens
aagtggaagacagagatg

SEQ ID NO: 5107095 - DNA, 12 bp, Homo sapiens
aagtggaaggaa

SEQ ID NO: 5107096 - DNA, 18 bp, Homo sapiens
aagtggacaaattttgag

SEQ ID NO: 5107097 - DNA, 16 bp, Homo sapiens
aagtggaccaggacag

SEQ ID NO: 5107098 - DNA, 22 bp, Homo sapiens
aagtggaccttaggccttcctc

SEQ ID NO: 5107099 - DNA, 16 bp, Homo sapiens
aagtggactctctgac

SEQ ID NO: 5107100 - DNA, 18 bp, Homo sapiens
aagtggactggcccctgg

SEQ ID NO: 5107101 - DNA, 14 bp, Homo sapiens
aagtggactgtatt

SEQ ID NO: 5107102 - DNA, 15 bp, Homo sapiens
aagtggacttctgaa

SEQ ID NO: 5107103 - DNA, 14 bp, Homo sapiens
aagtggagaaatga

SEQ ID NO: 5107104 - DNA, 17 bp, Homo sapiens
aagtggagaaatgaaaa

SEQ ID NO: 5107105 - DNA, 16 bp, Homo sapiens
aagtggagacagtcct

SEQ ID NO: 5107106 - DNA, 18 bp, Homo sapiens
aagtggaggttgagtgag

SEQ ID NO: 5107107 - DNA, 17 bp, Homo sapiens
aagtggatattttctta

SEQ ID NO: 5107108 - DNA, 14 bp, Homo sapiens
aagtggatgggaat

SEQ ID NO: 5107109 - DNA, 19 bp, Homo sapiens
aagtggattgtttttccct

SEQ ID NO: 5107110 - DNA, 19 bp, Homo sapiens
aagtggcaaagctgttctt

SEQ ID NO: 5107111 - DNA, 16 bp, Homo sapiens
aagtggcaagtatttg

SEQ ID NO: 5107112 - DNA, 13 bp, Homo sapiens
aagtggcacctgt

SEQ ID NO: 5107113 - DNA, 18 bp, Homo sapiens
aagtggcacctgtctgct

SEQ ID NO: 5107114 - DNA, 15 bp, Homo sapiens
aagtggcaggaggac

SEQ ID NO: 5107115 - DNA, 17 bp, Homo sapiens
aagtggcatgtgctgtg

SEQ ID NO: 5107116 - DNA, 22 bp, Homo sapiens
aagtggcatgttttgtgcattt

SEQ ID NO: 5107117 - DNA, 16 bp, Homo sapiens
aagtggccactggcat

SEQ ID NO: 5107118 - DNA, 24 bp, Homo sapiens
aagtggccctccctcagcggaggg

SEQ ID NO: 5107119 - DNA, 13 bp, Homo sapiens
aagtggcctcttt

SEQ ID NO: 5107120 - DNA, 20 bp, Homo sapiens
aagtggcgtgggagccagcc

SEQ ID NO: 5107121 - DNA, 12 bp, Homo sapiens
aagtggctgctg

SEQ ID NO: 5107122 - DNA, 14 bp, Homo sapiens
aagtggctgctgac

SEQ ID NO: 5107123 - DNA, 17 bp, Homo sapiens
aagtggctggtagaaaa

SEQ ID NO: 5107124 - DNA, 13 bp, Homo sapiens
aagtggctgtccc

SEQ ID NO: 5107125 - DNA, 20 bp, Homo sapiens
aagtggcttgtctgcagtca

SEQ ID NO: 5107126 - DNA, 16 bp, Homo sapiens
aagtgggaaagcattt

SEQ ID NO: 5107127 - DNA, 11 bp, Homo sapiens
aagtgggacag

SEQ ID NO: 5107128 - DNA, 11 bp, Homo sapiens
aagtgggagaa

SEQ ID NO: 5107129 - DNA, 15 bp, Homo sapiens
aagtgggagaagtgg

SEQ ID NO: 5107130 - DNA, 17 bp, Homo sapiens
aagtgggagcagcttct

SEQ ID NO: 5107131 - DNA, 22 bp, Homo sapiens
aagtgggagcagcttcttgggc

SEQ ID NO: 5107132 - DNA, 20 bp, Homo sapiens
aagtgggaggtcaggaaact

SEQ ID NO: 5107133 - DNA, 16 bp, Homo sapiens
aagtgggagtgggaga

SEQ ID NO: 5107134 - DNA, 17 bp, Homo sapiens
aagtgggagtgggagag

SEQ ID NO: 5107135 - DNA, 20 bp, Homo sapiens
aagtgggagtgggagaggaa

SEQ ID NO: 5107136 - DNA, 23 bp, Homo sapiens
aagtgggagtgggagaggaagcc

SEQ ID NO: 5107137 - DNA, 23 bp, Homo sapiens
aagtgggcattttgacaacatgg

SEQ ID NO: 5107138 - DNA, 21 bp, Homo sapiens
aagtgggccaggacaggcccg

SEQ ID NO: 5107139 - DNA, 18 bp, Homo sapiens
aagtgggccagtcctggt

SEQ ID NO: 5107140 - DNA, 15 bp, Homo sapiens
aagtgggcccacccg

SEQ ID NO: 5107141 - DNA, 17 bp, Homo sapiens
aagtgggctcctgacaa

SEQ ID NO: 5107142 - DNA, 12 bp, Homo sapiens
aagtgggcttga

SEQ ID NO: 5107143 - DNA, 16 bp, Homo sapiens
aagtgggcttgattct

SEQ ID NO: 5107144 - DNA, 17 bp, Homo sapiens
aagtggggagagagccc

SEQ ID NO: 5107145 - DNA, 23 bp, Homo sapiens
aagtggggcgggcttcatagaga

SEQ ID NO: 5107146 - DNA, 13 bp, Homo sapiens
aagtggggctcgc

SEQ ID NO: 5107147 - DNA, 20 bp, Homo sapiens
aagtgggggccgctggccca

SEQ ID NO: 5107148 - DNA, 23 bp, Homo sapiens
aagtgggggtggaggaccgaggc

SEQ ID NO: 5107149 - DNA, 23 bp, Homo sapiens
aagtggggtacagtaaagaggct

SEQ ID NO: 5107150 - DNA, 16 bp, Homo sapiens
aagtggggtgttcttc

SEQ ID NO: 5107151 - DNA, 19 bp, Homo sapiens
aagtgggtactttctgaaa

SEQ ID NO: 5107152 - DNA, 22 bp, Homo sapiens
aagtgggtagtgtcatttttcc

SEQ ID NO: 5107153 - DNA, 16 bp, Homo sapiens
aagtgggtggggacag

SEQ ID NO: 5107154 - DNA, 22 bp, Homo sapiens
aagtgggtggggacagaccagc

SEQ ID NO: 5107155 - DNA, 14 bp, Homo sapiens
aagtgggtgtgtgg

SEQ ID NO: 5107156 - DNA, 20 bp, Homo sapiens
aagtgggttattctggagtt

SEQ ID NO: 5107157 - DNA, 17 bp, Homo sapiens
aagtgggtttttatgaa

SEQ ID NO: 5107158 - DNA, 20 bp, Homo sapiens
aagtggtaatttttgtacat

SEQ ID NO: 5107159 - DNA, 21 bp, Homo sapiens
aagtggtactagtgtggtgtg

SEQ ID NO: 5107160 - DNA, 13 bp, Homo sapiens
aagtggtatagaa

SEQ ID NO: 5107161 - DNA, 22 bp, Homo sapiens
aagtggtccagcgtcactccag

SEQ ID NO: 5107162 - DNA, 14 bp, Homo sapiens
aagtggtctctgct

SEQ ID NO: 5107163 - DNA, 15 bp, Homo sapiens
aagtggtctctgctg

SEQ ID NO: 5107164 - DNA, 15 bp, Homo sapiens
aagtggtgctcagtt

SEQ ID NO: 5107165 - DNA, 23 bp, Homo sapiens
aagtggtggggactaagggaaga

SEQ ID NO: 5107166 - DNA, 20 bp, Homo sapiens
aagtggtgtgatcccagctc

SEQ ID NO: 5107167 - DNA, 16 bp, Homo sapiens
aagtggtgtttattgc

SEQ ID NO: 5107168 - DNA, 16 bp, Homo sapiens
aagtggttaagaatgt

SEQ ID NO: 5107169 - DNA, 20 bp, Homo sapiens
aagtggttaagaatgtatat

SEQ ID NO: 5107170 - DNA, 18 bp, Homo sapiens
aagtggttcagtctagaa

SEQ ID NO: 5107171 - DNA, 19 bp, Homo sapiens
aagtggttcagtctagaag

SEQ ID NO: 5107172 - DNA, 21 bp, Homo sapiens
aagtggttcagtctagaagaa

SEQ ID NO: 5107173 - DNA, 14 bp, Homo sapiens
aagtggttttaata

SEQ ID NO: 5107174 - DNA, 16 bp, Homo sapiens
aagtgtaaaaaatgtc

SEQ ID NO: 5107175 - DNA, 15 bp, Homo sapiens
aagtgtaaaatagaa

SEQ ID NO: 5107176 - DNA, 14 bp, Homo sapiens
aagtgtaaactaag

SEQ ID NO: 5107177 - DNA, 11 bp, Homo sapiens
aagtgtaaagc

SEQ ID NO: 5107178 - DNA, 13 bp, Homo sapiens
aagtgtaaagcat

SEQ ID NO: 5107179 - DNA, 16 bp, Homo sapiens
aagtgtaaagcattcc

SEQ ID NO: 5107180 - DNA, 20 bp, Homo sapiens
aagtgtaaagcattccaaca

SEQ ID NO: 5107181 - DNA, 21 bp, Homo sapiens
aagtgtaaagcattccaacaa

SEQ ID NO: 5107182 - DNA, 13 bp, Homo sapiens
aagtgtaaatgaa

SEQ ID NO: 5107183 - DNA, 15 bp, Homo sapiens
aagtgtaaatgttaa

SEQ ID NO: 5107184 - DNA, 14 bp, Homo sapiens
aagtgtaacagctg

SEQ ID NO: 5107185 - DNA, 21 bp, Homo sapiens
aagtgtaacagctgaggtctc

SEQ ID NO: 5107186 - DNA, 18 bp, Homo sapiens
aagtgtaacctcagtatt

SEQ ID NO: 5107187 - DNA, 18 bp, Homo sapiens
aagtgtaactatgctgtt

SEQ ID NO: 5107188 - DNA, 11 bp, Homo sapiens
aagtgtaactg

SEQ ID NO: 5107189 - DNA, 19 bp, Homo sapiens
aagtgtaagaaacacactg

SEQ ID NO: 5107190 - DNA, 18 bp, Homo sapiens
aagtgtaagttcacaact

SEQ ID NO: 5107191 - DNA, 15 bp, Homo sapiens
aagtgtaagtttgtg

SEQ ID NO: 5107192 - DNA, 12 bp, Homo sapiens
aagtgtaattag

SEQ ID NO: 5107193 - DNA, 20 bp, Homo sapiens
aagtgtacaagttgctttgt

SEQ ID NO: 5107194 - DNA, 15 bp, Homo sapiens
aagtgtacaattttc

SEQ ID NO: 5107195 - DNA, 15 bp, Homo sapiens
aagtgtacagtattt

SEQ ID NO: 5107196 - DNA, 18 bp, Homo sapiens
aagtgtacatgaagaatg

SEQ ID NO: 5107197 - DNA, 14 bp, Homo sapiens
aagtgtacatgtgt

SEQ ID NO: 5107198 - DNA, 21 bp, Homo sapiens
aagtgtacatttgatttgata

SEQ ID NO: 5107199 - DNA, 14 bp, Homo sapiens
aaggtggaaatggc

SEQ ID NO: 5107200 - DNA, 15 bp, Homo sapiens
aaggtggacctggca

SEQ ID NO: 5107201 - DNA, 16 bp, Homo sapiens
aaggtggacctggcag

SEQ ID NO: 5107202 - DNA, 16 bp, Homo sapiens
aaggtggaccttttaa

SEQ ID NO: 5107203 - DNA, 19 bp, Homo sapiens
aaggtggaccttttaaagt

SEQ ID NO: 5107204 - DNA, 23 bp, Homo sapiens
aaggtggaccttttaaagtgttt

SEQ ID NO: 5107205 - DNA, 20 bp, Homo sapiens
aaggtggacttgtctcccag

SEQ ID NO: 5107206 - DNA, 21 bp, Homo sapiens
aaggtggagagggagatgtgt

SEQ ID NO: 5107207 - DNA, 23 bp, Homo sapiens
aaggtggagagggagatgtgtga

SEQ ID NO: 5107208 - DNA, 14 bp, Homo sapiens
aaggtggagtggat

SEQ ID NO: 5107209 - DNA, 15 bp, Homo sapiens
aaggtggagtggatg

SEQ ID NO: 5107210 - DNA, 17 bp, Homo sapiens
aaggtggagtttctctg

SEQ ID NO: 5107211 - DNA, 21 bp, Homo sapiens
aaggtggattttaaaaattgg

SEQ ID NO: 5107212 - DNA, 22 bp, Homo sapiens
aaggtggattttgtttaaaaaa

SEQ ID NO: 5107213 - DNA, 16 bp, Homo sapiens
aaggtggcctctgcct

SEQ ID NO: 5107214 - DNA, 23 bp, Homo sapiens
aaggtgggaaaaaaaaaagtgtg

SEQ ID NO: 5107215 - DNA, 22 bp, Homo sapiens
aaggtgggaggatgtgaattgt

SEQ ID NO: 5107216 - DNA, 16 bp, Homo sapiens
aaggtgggggagcctg

SEQ ID NO: 5107217 - DNA, 19 bp, Homo sapiens
aaggtgggggagcctggag

SEQ ID NO: 5107218 - DNA, 20 bp, Homo sapiens
aaggtgggggagcctggagc

SEQ ID NO: 5107219 - DNA, 21 bp, Homo sapiens
aaggtgggggagcctggagcc

SEQ ID NO: 5107220 - DNA, 19 bp, Homo sapiens
aaggtgggggttggctggg

SEQ ID NO: 5107221 - DNA, 20 bp, Homo sapiens
aaggtgggggttggctgggt

SEQ ID NO: 5107222 - DNA, 21 bp, Homo sapiens
aaggtggggtctttgtgagag

SEQ ID NO: 5107223 - DNA, 22 bp, Homo sapiens
aaggtgggtccaggaaggcagc

SEQ ID NO: 5107224 - DNA, 24 bp, Homo sapiens
aaggtgggtccaggaaggcagctg

SEQ ID NO: 5107225 - DNA, 14 bp, Homo sapiens
aaggtggtaaattc

SEQ ID NO: 5107226 - DNA, 17 bp, Homo sapiens
aaggtggtaaattcaga

SEQ ID NO: 5107227 - DNA, 16 bp, Homo sapiens
aaggtggtatgtgtgt

SEQ ID NO: 5107228 - DNA, 20 bp, Homo sapiens
aaggtggtatgtgtgtgtat

SEQ ID NO: 5107229 - DNA, 12 bp, Homo sapiens
aaggtggtctgc

SEQ ID NO: 5107230 - DNA, 14 bp, Homo sapiens
aaggtggtcttgga

SEQ ID NO: 5107231 - DNA, 21 bp, Homo sapiens
aaggtggtcttggagaggagg

SEQ ID NO: 5107232 - DNA, 16 bp, Homo sapiens
aaggtggtgtgatctt

SEQ ID NO: 5107233 - DNA, 15 bp, Homo sapiens
aaggtggtgtttctg

SEQ ID NO: 5107234 - DNA, 12 bp, Homo sapiens
aaggtgtaaaac

SEQ ID NO: 5107235 - DNA, 22 bp, Homo sapiens
aaggtgtaagacttcagatttc

SEQ ID NO: 5107236 - DNA, 21 bp, Homo sapiens
aaggtgtatttaaactatctt

SEQ ID NO: 5107237 - DNA, 18 bp, Homo sapiens
aaggtgtcagaataataa

SEQ ID NO: 5107238 - DNA, 12 bp, Homo sapiens
aaggtgtccagg

SEQ ID NO: 5107239 - DNA, 15 bp, Homo sapiens
aaggtgtcctacaga

SEQ ID NO: 5107240 - DNA, 20 bp, Homo sapiens
aaggtgtctggacattcaga

SEQ ID NO: 5107241 - DNA, 15 bp, Homo sapiens
aaggtgtgagactgg

SEQ ID NO: 5107242 - DNA, 18 bp, Homo sapiens
aaggtgtgctatttgtca

SEQ ID NO: 5107243 - DNA, 22 bp, Homo sapiens
aaggtgtgctctgagccacaga

SEQ ID NO: 5107244 - DNA, 23 bp, Homo sapiens
aaggtgtggaggctcctgtggta

SEQ ID NO: 5107245 - DNA, 14 bp, Homo sapiens
aaggtgttgttaaa

SEQ ID NO: 5107246 - DNA, 14 bp, Homo sapiens
aaggtgtttaaaga

SEQ ID NO: 5107247 - DNA, 17 bp, Homo sapiens
aaggtgtttaaagagtt

SEQ ID NO: 5107248 - DNA, 14 bp, Homo sapiens
aaggtgtttcaaag

SEQ ID NO: 5107249 - DNA, 19 bp, Homo sapiens
aaggtgttttctgtgtaac

SEQ ID NO: 5107250 - DNA, 15 bp, Homo sapiens
aaggttaaaggaaaa

SEQ ID NO: 5107251 - DNA, 17 bp, Homo sapiens
aaggttaaaggaaaagc

SEQ ID NO: 5107252 - DNA, 15 bp, Homo sapiens
aaggttaacagtaaa

SEQ ID NO: 5107253 - DNA, 16 bp, Homo sapiens
aaggttaataaagtaa

SEQ ID NO: 5107254 - DNA, 17 bp, Homo sapiens
aaggttaatagcaccgg

SEQ ID NO: 5107255 - DNA, 22 bp, Homo sapiens
aaggttacatgtgagtattaat

SEQ ID NO: 5107256 - DNA, 18 bp, Homo sapiens
aaggttactcagcagcag

SEQ ID NO: 5107257 - DNA, 19 bp, Homo sapiens
aaggttactcagcagcaga

SEQ ID NO: 5107258 - DNA, 21 bp, Homo sapiens
aaggttactgggagtgtgggc

SEQ ID NO: 5107259 - DNA, 20 bp, Homo sapiens
aaggttagaggtttgtcaac

SEQ ID NO: 5107260 - DNA, 15 bp, Homo sapiens
aaggttaggtttgtc

SEQ ID NO: 5107261 - DNA, 16 bp, Homo sapiens
aaggttaggtttgtca

SEQ ID NO: 5107262 - DNA, 17 bp, Homo sapiens
aaggttatcagaaagat

SEQ ID NO: 5107263 - DNA, 15 bp, Homo sapiens
aaggttatcagtgct

SEQ ID NO: 5107264 - DNA, 15 bp, Homo sapiens
aaggttatgaaacat

SEQ ID NO: 5107265 - DNA, 16 bp, Homo sapiens
aaggttatgaaacata

SEQ ID NO: 5107266 - DNA, 20 bp, Homo sapiens
aaggttatttatttaaatgt

SEQ ID NO: 5107267 - DNA, 17 bp, Homo sapiens
aaggttcactaaagcag

SEQ ID NO: 5107268 - DNA, 21 bp, Homo sapiens
aaggttccaactgtatatatt

SEQ ID NO: 5107269 - DNA, 18 bp, Homo sapiens
aaggttcctttgttccct

SEQ ID NO: 5107270 - DNA, 12 bp, Homo sapiens
aaggttctatga

SEQ ID NO: 5107271 - DNA, 16 bp, Homo sapiens
aaggttctatgatata

SEQ ID NO: 5107272 - DNA, 12 bp, Homo sapiens
aaggttctcaga

SEQ ID NO: 5107273 - DNA, 15 bp, Homo sapiens
aaggttctcatttct

SEQ ID NO: 5107274 - DNA, 17 bp, Homo sapiens
aaggttctggtaacctg

SEQ ID NO: 5107275 - DNA, 17 bp, Homo sapiens
aaggttcttactgcttg

SEQ ID NO: 5107276 - DNA, 17 bp, Homo sapiens
aaggttcttcatccctt

SEQ ID NO: 5107277 - DNA, 20 bp, Homo sapiens
aaggttcttcatccctttcc

SEQ ID NO: 5107278 - DNA, 16 bp, Homo sapiens
aaggttcttctaaaat

SEQ ID NO: 5107279 - DNA, 16 bp, Homo sapiens
aaggttgaactttgcc

SEQ ID NO: 5107280 - DNA, 23 bp, Homo sapiens
aaggttgaactttgccaaaaaaa

SEQ ID NO: 5107281 - DNA, 20 bp, Homo sapiens
aaggttgattctcatgcact

SEQ ID NO: 5107282 - DNA, 21 bp, Homo sapiens
aaggttgcatactgagccaag

SEQ ID NO: 5107283 - DNA, 16 bp, Homo sapiens
aaggttgccaaattgc

SEQ ID NO: 5107284 - DNA, 19 bp, Homo sapiens
aaggttgccaaattgctgc

SEQ ID NO: 5107285 - DNA, 18 bp, Homo sapiens
aaggttggaactgctgcc

SEQ ID NO: 5107286 - DNA, 17 bp, Homo sapiens
aaggttggaatctttta

SEQ ID NO: 5107287 - DNA, 22 bp, Homo sapiens
aaggttggagctttgcaattct

SEQ ID NO: 5107288 - DNA, 21 bp, Homo sapiens
aaggttggtggggggtccagt

SEQ ID NO: 5107289 - DNA, 12 bp, Homo sapiens
aaggttgtacat

SEQ ID NO: 5107290 - DNA, 15 bp, Homo sapiens
aaggttgtacatagt

SEQ ID NO: 5107291 - DNA, 17 bp, Homo sapiens
aaggttgtatgtaaatc

SEQ ID NO: 5107292 - DNA, 18 bp, Homo sapiens
aaggttgtatgtaaatct

SEQ ID NO: 5107293 - DNA, 19 bp, Homo sapiens
aaggttgtatgtaaatctg

SEQ ID NO: 5107294 - DNA, 17 bp, Homo sapiens
aaggttgtattgcatat

SEQ ID NO: 5107295 - DNA, 14 bp, Homo sapiens
aaggttgtgcaggg

SEQ ID NO: 5107296 - DNA, 18 bp, Homo sapiens
aaggtttaaaactagtta

SEQ ID NO: 5107297 - DNA, 21 bp, Homo sapiens
aaggtttaaagagtctagatt

SEQ ID NO: 5107298 - DNA, 20 bp, Homo sapiens
aaggtttaaccttaaaatta

SEQ ID NO: 5107299 - DNA, 22 bp, Homo sapiens
aaggtttagaatgacaggaacc

SEQ ID NO: 5107300 - DNA, 17 bp, Homo sapiens
aaggtttatgaaaaaga

SEQ ID NO: 5107301 - DNA, 13 bp, Homo sapiens
aaggtttattgtt

SEQ ID NO: 5107302 - DNA, 20 bp, Homo sapiens
aaggtttattgttaatacaa

SEQ ID NO: 5107303 - DNA, 14 bp, Homo sapiens
aaggtttcaagact

SEQ ID NO: 5107304 - DNA, 17 bp, Homo sapiens
aaggtttcactgttcat

SEQ ID NO: 5107305 - DNA, 21 bp, Homo sapiens
aaggtttccactattatagaa

SEQ ID NO: 5107306 - DNA, 21 bp, Homo sapiens
aaggtttcccagtgagcctct

SEQ ID NO: 5107307 - DNA, 16 bp, Homo sapiens
aaggtttcgtttctgt

SEQ ID NO: 5107308 - DNA, 21 bp, Homo sapiens
aaggtttcgtttctgtataca

SEQ ID NO: 5107309 - DNA, 22 bp, Homo sapiens
aaggtttcgtttctgtatacaa

SEQ ID NO: 5107310 - DNA, 16 bp, Homo sapiens
aaggtttctggagcag

SEQ ID NO: 5107311 - DNA, 20 bp, Homo sapiens
aaggtttgatgccaaagcag

SEQ ID NO: 5107312 - DNA, 18 bp, Homo sapiens
aaggtttggaaaactaac

SEQ ID NO: 5107313 - DNA, 18 bp, Homo sapiens
aaggtttggaaggagcag

SEQ ID NO: 5107314 - DNA, 13 bp, Homo sapiens
aaggtttggtgtg

SEQ ID NO: 5107315 - DNA, 22 bp, Homo sapiens
aaggtttgttcctttgaagaat

SEQ ID NO: 5107316 - DNA, 12 bp, Homo sapiens
aaggttttaagt

SEQ ID NO: 5107317 - DNA, 23 bp, Homo sapiens
aaggttttaggttctaaagttct

SEQ ID NO: 5107318 - DNA, 22 bp, Homo sapiens
aaggttttgaaattttctgtac

SEQ ID NO: 5107319 - DNA, 21 bp, Homo sapiens
aaggttttggttatggagtct

SEQ ID NO: 5107320 - DNA, 15 bp, Homo sapiens
aaggttttgtatttt

SEQ ID NO: 5107321 - DNA, 20 bp, Homo sapiens
aaggttttgtattttttaaa

SEQ ID NO: 5107322 - DNA, 23 bp, Homo sapiens
aaggttttgtattttttaaaaca

SEQ ID NO: 5107323 - DNA, 17 bp, Homo sapiens
aaggttttgttgtgttc

SEQ ID NO: 5107324 - DNA, 12 bp, Homo sapiens
aaggtttttaaa

SEQ ID NO: 5107325 - DNA, 17 bp, Homo sapiens
aaggtttttaaaagtaa

SEQ ID NO: 5107326 - DNA, 20 bp, Homo sapiens
aaggtttttaagggccgggg

SEQ ID NO: 5107327 - DNA, 14 bp, Homo sapiens
aaggtttttgtaaa

SEQ ID NO: 5107328 - DNA, 11 bp, Homo sapiens
aaggttttttt

SEQ ID NO: 5107329 - DNA, 16 bp, Homo sapiens
aaggttttttttgtac

SEQ ID NO: 5107330 - DNA, 17 bp, Homo sapiens
aaggttttttttttaag

SEQ ID NO: 5107331 - DNA, 13 bp, Homo sapiens
aagtaaaaaaaca

SEQ ID NO: 5107332 - DNA, 14 bp, Homo sapiens
aagtaaaaaaacaa

SEQ ID NO: 5107333 - DNA, 19 bp, Homo sapiens
aagtaaaaaagttaaatgt

SEQ ID NO: 5107334 - DNA, 12 bp, Homo sapiens
aagtaaaaaata

SEQ ID NO: 5107335 - DNA, 14 bp, Homo sapiens
aagtaaaaaataac

SEQ ID NO: 5107336 - DNA, 15 bp, Homo sapiens
aagtaaaaaataact

SEQ ID NO: 5107337 - DNA, 13 bp, Homo sapiens
aagtaaaaaatat

SEQ ID NO: 5107338 - DNA, 17 bp, Homo sapiens
aagtaaaaataaactgt

SEQ ID NO: 5107339 - DNA, 23 bp, Homo sapiens
aagtaaaaattgaactgtaaact

SEQ ID NO: 5107340 - DNA, 12 bp, Homo sapiens
aagtaaaacaaa

SEQ ID NO: 5107341 - DNA, 17 bp, Homo sapiens
aagtaaaacaaacaata

SEQ ID NO: 5107342 - DNA, 20 bp, Homo sapiens
aagtaaaacaaacaatacct

SEQ ID NO: 5107343 - DNA, 15 bp, Homo sapiens
aagtaaaacaaatga

SEQ ID NO: 5107344 - DNA, 17 bp, Homo sapiens
aagtaaaacaaatgaaa

SEQ ID NO: 5107345 - DNA, 21 bp, Homo sapiens
aagtaaaacaaatgaaattta

SEQ ID NO: 5107346 - DNA, 17 bp, Homo sapiens
aagtaaaacagtcatct

SEQ ID NO: 5107347 - DNA, 17 bp, Homo sapiens
aagtaaaaccacagcag

SEQ ID NO: 5107348 - DNA, 19 bp, Homo sapiens
aagtaaaaccataaacatt

SEQ ID NO: 5107349 - DNA, 13 bp, Homo sapiens
aagtaaaagaaac

SEQ ID NO: 5107350 - DNA, 12 bp, Homo sapiens
aagtaaaatatg

SEQ ID NO: 5107351 - DNA, 16 bp, Homo sapiens
aagtaaaatatgtcca

SEQ ID NO: 5107352 - DNA, 23 bp, Homo sapiens
aagtaaaattatcctctttgtaa

SEQ ID NO: 5107353 - DNA, 13 bp, Homo sapiens
aagtaaaattgct

SEQ ID NO: 5107354 - DNA, 13 bp, Homo sapiens
aagtaaaccaaaa

SEQ ID NO: 5107355 - DNA, 13 bp, Homo sapiens
aagtaaactgccc

SEQ ID NO: 5107356 - DNA, 16 bp, Homo sapiens
aagtaaacttgtgtat

SEQ ID NO: 5107357 - DNA, 21 bp, Homo sapiens
aagtaaagccattaaatgaat

SEQ ID NO: 5107358 - DNA, 21 bp, Homo sapiens
aagtaaaggcctcctccccca

SEQ ID NO: 5107359 - DNA, 17 bp, Homo sapiens
aagtaaagtttatttca

SEQ ID NO: 5107360 - DNA, 14 bp, Homo sapiens
aagtaaagtttctg

SEQ ID NO: 5107361 - DNA, 22 bp, Homo sapiens
aagtaaatacaagactgttgtg

SEQ ID NO: 5107362 - DNA, 15 bp, Homo sapiens
aagtaaatctatctc

SEQ ID NO: 5107363 - DNA, 17 bp, Homo sapiens
aagtaaatctcttctgt

SEQ ID NO: 5107364 - DNA, 12 bp, Homo sapiens
aagtaaatgctg

SEQ ID NO: 5107365 - DNA, 18 bp, Homo sapiens
aagtaaatgtctgtggcc

SEQ ID NO: 5107366 - DNA, 16 bp, Homo sapiens
aagtaaattatgatgt

SEQ ID NO: 5107367 - DNA, 14 bp, Homo sapiens
aagtaaattatgta

SEQ ID NO: 5107368 - DNA, 13 bp, Homo sapiens
aagtaaattctgt

SEQ ID NO: 5107369 - DNA, 12 bp, Homo sapiens
aagtaacaaaaa

SEQ ID NO: 5107370 - DNA, 15 bp, Homo sapiens
aagtaacaatatgta

SEQ ID NO: 5107371 - DNA, 12 bp, Homo sapiens
aagtaacacttt

SEQ ID NO: 5107372 - DNA, 13 bp, Homo sapiens
aagtaacacttta

SEQ ID NO: 5107373 - DNA, 16 bp, Homo sapiens
aagtaacagtatgtca

SEQ ID NO: 5107374 - DNA, 19 bp, Homo sapiens
aagtaacagttgaagaaaa

SEQ ID NO: 5107375 - DNA, 13 bp, Homo sapiens
aagtaacatataa

SEQ ID NO: 5107376 - DNA, 15 bp, Homo sapiens
aagtaacatataaat

SEQ ID NO: 5107377 - DNA, 19 bp, Homo sapiens
aagtaacatcagccatttt

SEQ ID NO: 5107378 - DNA, 14 bp, Homo sapiens
aagtgtactaatta

SEQ ID NO: 5107379 - DNA, 13 bp, Homo sapiens
aagtgtagctcaa

SEQ ID NO: 5107380 - DNA, 13 bp, Homo sapiens
aagtgtaggcaga

SEQ ID NO: 5107381 - DNA, 14 bp, Homo sapiens
aagtgtaggcagac

SEQ ID NO: 5107382 - DNA, 15 bp, Homo sapiens
aagtgtaggcagaca

SEQ ID NO: 5107383 - DNA, 17 bp, Homo sapiens
aagtgtaggcagacaca

SEQ ID NO: 5107384 - DNA, 19 bp, Homo sapiens
aagtgtaggcagacacagg

SEQ ID NO: 5107385 - DNA, 14 bp, Homo sapiens
aagtgtaggccacc

SEQ ID NO: 5107386 - DNA, 23 bp, Homo sapiens
aagtgtatatcagaaaagggaag

SEQ ID NO: 5107387 - DNA, 15 bp, Homo sapiens
aagtgtatatttatt

SEQ ID NO: 5107388 - DNA, 21 bp, Homo sapiens
aagtgtatatttattcataat

SEQ ID NO: 5107389 - DNA, 14 bp, Homo sapiens
aagtgtatctcctt

SEQ ID NO: 5107390 - DNA, 19 bp, Homo sapiens
aagtgtatgagttgcattt

SEQ ID NO: 5107391 - DNA, 23 bp, Homo sapiens
aagtgtatgagttgcatttgtaa

SEQ ID NO: 5107392 - DNA, 15 bp, Homo sapiens
aagtgtattagatgt

SEQ ID NO: 5107393 - DNA, 16 bp, Homo sapiens
aagtgtattagatgtg

SEQ ID NO: 5107394 - DNA, 21 bp, Homo sapiens
aagtgtattcatattaccaga

SEQ ID NO: 5107395 - DNA, 14 bp, Homo sapiens
aagtgtatttaaaa

SEQ ID NO: 5107396 - DNA, 20 bp, Homo sapiens
aagtgtattttaaaatagag

SEQ ID NO: 5107397 - DNA, 21 bp, Homo sapiens
aagtgtcaaggggccctagga

SEQ ID NO: 5107398 - DNA, 19 bp, Homo sapiens
aagtgtcacctccttcccc

SEQ ID NO: 5107399 - DNA, 21 bp, Homo sapiens
aagtgtcacctccttccccag

SEQ ID NO: 5107400 - DNA, 23 bp, Homo sapiens
aagtgtcacctccttccccagct

SEQ ID NO: 5107401 - DNA, 23 bp, Homo sapiens
aagtgtcaccttttcttgcctga

SEQ ID NO: 5107402 - DNA, 21 bp, Homo sapiens
aagtgtcactaagaatataaa

SEQ ID NO: 5107403 - DNA, 19 bp, Homo sapiens
aagtgtcactccataaaaa

SEQ ID NO: 5107404 - DNA, 22 bp, Homo sapiens
aagtgtcatatgtaggtgtctg

SEQ ID NO: 5107405 - DNA, 24 bp, Homo sapiens
aagtgtcatatgtaggtgtctgca

SEQ ID NO: 5107406 - DNA, 12 bp, Homo sapiens
aagtgtcatgtt

SEQ ID NO: 5107407 - DNA, 15 bp, Homo sapiens
aagtgtcatttcttt

SEQ ID NO: 5107408 - DNA, 15 bp, Homo sapiens
aagtgtccgagaact

SEQ ID NO: 5107409 - DNA, 17 bp, Homo sapiens
aagtgtccgagaactaa

SEQ ID NO: 5107410 - DNA, 14 bp, Homo sapiens
aagtgtccttcttg

SEQ ID NO: 5107411 - DNA, 24 bp, Homo sapiens
aagtgtctagagtcatgtgagcct

SEQ ID NO: 5107412 - DNA, 21 bp, Homo sapiens
aagtgtctcactaaagcatga

SEQ ID NO: 5107413 - DNA, 19 bp, Homo sapiens
aagtgtctcagtccacctg

SEQ ID NO: 5107414 - DNA, 18 bp, Homo sapiens
aagtgtctcattctcaga

SEQ ID NO: 5107415 - DNA, 14 bp, Homo sapiens
aagtgtctcttgac

SEQ ID NO: 5107416 - DNA, 14 bp, Homo sapiens
aagtgtctgtgtgc

SEQ ID NO: 5107417 - DNA, 14 bp, Homo sapiens
aagtgtcttctgtt

SEQ ID NO: 5107418 - DNA, 19 bp, Homo sapiens
aagtgtcttctgttcccaa

SEQ ID NO: 5107419 - DNA, 17 bp, Homo sapiens
aagtgtcttttgacatt

SEQ ID NO: 5107420 - DNA, 16 bp, Homo sapiens
aagtgtgaatactgct

SEQ ID NO: 5107421 - DNA, 21 bp, Homo sapiens
aagtgtgaccccactgccaag

SEQ ID NO: 5107422 - DNA, 15 bp, Homo sapiens
aagtgtgagcagtga

SEQ ID NO: 5107423 - DNA, 23 bp, Homo sapiens
aagtgtgagccaccgcgcctggc

SEQ ID NO: 5107424 - DNA, 18 bp, Homo sapiens
aagtgtgagctcttccct

SEQ ID NO: 5107425 - DNA, 18 bp, Homo sapiens
aagtgtgagtaagagctg

SEQ ID NO: 5107426 - DNA, 19 bp, Homo sapiens
aagtgtgagtaagagctgg

SEQ ID NO: 5107427 - DNA, 21 bp, Homo sapiens
aagtgtgagtaagagctggtg

SEQ ID NO: 5107428 - DNA, 18 bp, Homo sapiens
aagtgtgcatattgtaca

SEQ ID NO: 5107429 - DNA, 21 bp, Homo sapiens
aagtgtgcatattgtacactt

SEQ ID NO: 5107430 - DNA, 22 bp, Homo sapiens
aagtgtgcatattgtacacttt

SEQ ID NO: 5107431 - DNA, 16 bp, Homo sapiens
aagtgtgcatggctgg

SEQ ID NO: 5107432 - DNA, 22 bp, Homo sapiens
aagtgtgcatggctggggactt

SEQ ID NO: 5107433 - DNA, 14 bp, Homo sapiens
aagtgtgcctgcta

SEQ ID NO: 5107434 - DNA, 13 bp, Homo sapiens
aagtgtgctgagg

SEQ ID NO: 5107435 - DNA, 15 bp, Homo sapiens
aagtgtgctgggcag

SEQ ID NO: 5107436 - DNA, 15 bp, Homo sapiens
aagtgtgctttataa

SEQ ID NO: 5107437 - DNA, 23 bp, Homo sapiens
aagtgtgctttatgctgaaacag

SEQ ID NO: 5107438 - DNA, 23 bp, Homo sapiens
aagtgtggctggtgtccccttcc

SEQ ID NO: 5107439 - DNA, 18 bp, Homo sapiens
aagtgtgggtctgtgtgt

SEQ ID NO: 5107440 - DNA, 20 bp, Homo sapiens
aagtgtgggtttggttagag

SEQ ID NO: 5107441 - DNA, 23 bp, Homo sapiens
aagtgtgggtttggttagaggaa

SEQ ID NO: 5107442 - DNA, 20 bp, Homo sapiens
aagtgtgtaattatgtaaat

SEQ ID NO: 5107443 - DNA, 21 bp, Homo sapiens
aagtgtgtaattatgtaaata

SEQ ID NO: 5107444 - DNA, 20 bp, Homo sapiens
aagtgtgtataaaacattaa

SEQ ID NO: 5107445 - DNA, 16 bp, Homo sapiens
aagtgtgtatatattt

SEQ ID NO: 5107446 - DNA, 17 bp, Homo sapiens
aagtgtgtatatatttt

SEQ ID NO: 5107447 - DNA, 13 bp, Homo sapiens
aagtgtgtattaa

SEQ ID NO: 5107448 - DNA, 16 bp, Homo sapiens
aagtgtgtccatcctg

SEQ ID NO: 5107449 - DNA, 21 bp, Homo sapiens
aagtgtgtccatcctgacctg

SEQ ID NO: 5107450 - DNA, 15 bp, Homo sapiens
aagtgtgtgaaacct

SEQ ID NO: 5107451 - DNA, 20 bp, Homo sapiens
aagtgtgtgtatactgtaat

SEQ ID NO: 5107452 - DNA, 17 bp, Homo sapiens
aagtgtgtgtggcagca

SEQ ID NO: 5107453 - DNA, 17 bp, Homo sapiens
aagtgtgtgtgttctgt

SEQ ID NO: 5107454 - DNA, 18 bp, Homo sapiens
aagtgtgtgtgttctgta

SEQ ID NO: 5107455 - DNA, 13 bp, Homo sapiens
aagtgtgtgtttc

SEQ ID NO: 5107456 - DNA, 21 bp, Homo sapiens
aagtgtgttcattaatgttta

SEQ ID NO: 5107457 - DNA, 13 bp, Homo sapiens
aagtgtgttctga

SEQ ID NO: 5107458 - DNA, 17 bp, Homo sapiens
aagtgtgtttccttcag

SEQ ID NO: 5107459 - DNA, 17 bp, Homo sapiens
aagtgtgtttctttcta

SEQ ID NO: 5107460 - DNA, 13 bp, Homo sapiens
aagtgtgtttgcc

SEQ ID NO: 5107461 - DNA, 21 bp, Homo sapiens
aagtgttaagtttttaatctg

SEQ ID NO: 5107462 - DNA, 17 bp, Homo sapiens
aagtgttaatacatcac

SEQ ID NO: 5107463 - DNA, 22 bp, Homo sapiens
aagtgttacctaacaatgtttt

SEQ ID NO: 5107464 - DNA, 23 bp, Homo sapiens
aagtgttagccttttttccccag

SEQ ID NO: 5107465 - DNA, 22 bp, Homo sapiens
aagtgttatttttcaaggaagg

SEQ ID NO: 5107466 - DNA, 18 bp, Homo sapiens
aagtgttcaaattaaaaa

SEQ ID NO: 5107467 - DNA, 13 bp, Homo sapiens
aagtgttcaagaa

SEQ ID NO: 5107468 - DNA, 15 bp, Homo sapiens
aagtgttcagacagt

SEQ ID NO: 5107469 - DNA, 12 bp, Homo sapiens
aagtgttcagtg

SEQ ID NO: 5107470 - DNA, 19 bp, Homo sapiens
aagtgttcagtgttgacat

SEQ ID NO: 5107471 - DNA, 12 bp, Homo sapiens
aagtgttcattg

SEQ ID NO: 5107472 - DNA, 14 bp, Homo sapiens
aagtgttcattgtt

SEQ ID NO: 5107473 - DNA, 17 bp, Homo sapiens
aagtgttcattttaagt

SEQ ID NO: 5107474 - DNA, 13 bp, Homo sapiens
aagtgttcctgtc

SEQ ID NO: 5107475 - DNA, 15 bp, Homo sapiens
aagtgttcctgtctc

SEQ ID NO: 5107476 - DNA, 16 bp, Homo sapiens
aagtgttctaaaatga

SEQ ID NO: 5107477 - DNA, 19 bp, Homo sapiens
aagtgttctaaaatgaaat

SEQ ID NO: 5107478 - DNA, 15 bp, Homo sapiens
aagtgttctctagaa

SEQ ID NO: 5107479 - DNA, 15 bp, Homo sapiens
aagtgttctgagctg

SEQ ID NO: 5107480 - DNA, 22 bp, Homo sapiens
aagtgttcttaggtttactgtg

SEQ ID NO: 5107481 - DNA, 15 bp, Homo sapiens
aagtgttgaaaaata

SEQ ID NO: 5107482 - DNA, 23 bp, Homo sapiens
aagtgttgaaaatgtatttcctg

SEQ ID NO: 5107483 - DNA, 14 bp, Homo sapiens
aagtgttgaagaag

SEQ ID NO: 5107484 - DNA, 16 bp, Homo sapiens
aagtgttgaagaagag

SEQ ID NO: 5107485 - DNA, 19 bp, Homo sapiens
aagtgttgaagaagagttt

SEQ ID NO: 5107486 - DNA, 16 bp, Homo sapiens
aagtgttgctcttgga

SEQ ID NO: 5107487 - DNA, 22 bp, Homo sapiens
aagtgttggcaaacgagacttt

SEQ ID NO: 5107488 - DNA, 20 bp, Homo sapiens
aagtgttggccatcatttca

SEQ ID NO: 5107489 - DNA, 23 bp, Homo sapiens
aagtgttggctaatgaagggaaa

SEQ ID NO: 5107490 - DNA, 16 bp, Homo sapiens
aagtgttggtctttct

SEQ ID NO: 5107491 - DNA, 17 bp, Homo sapiens
aagtgttggtctttcta

SEQ ID NO: 5107492 - DNA, 17 bp, Homo sapiens
aagtgttgtaaatattt

SEQ ID NO: 5107493 - DNA, 20 bp, Homo sapiens
aagtgttgtaaatatttatg

SEQ ID NO: 5107494 - DNA, 22 bp, Homo sapiens
aagtgttgtacaattactgtga

SEQ ID NO: 5107495 - DNA, 22 bp, Homo sapiens
aagtgttgtaccatatgtagca

SEQ ID NO: 5107496 - DNA, 15 bp, Homo sapiens
aagtgttgtcttatt

SEQ ID NO: 5107497 - DNA, 17 bp, Homo sapiens
aagtgttgtggagaaaa

SEQ ID NO: 5107498 - DNA, 19 bp, Homo sapiens
aagtgttgtggagaaaaga

SEQ ID NO: 5107499 - DNA, 23 bp, Homo sapiens
aagtgtttaattgtataaaacag

SEQ ID NO: 5107500 - DNA, 15 bp, Homo sapiens
aagtgtttagctgtc

SEQ ID NO: 5107501 - DNA, 12 bp, Homo sapiens
aagtgtttataa

SEQ ID NO: 5107502 - DNA, 17 bp, Homo sapiens
aagtgtttatgtaatag

SEQ ID NO: 5107503 - DNA, 15 bp, Homo sapiens
aagtgtttatgttgt

SEQ ID NO: 5107504 - DNA, 23 bp, Homo sapiens
aagtgtttcataaatttgagagt

SEQ ID NO: 5107505 - DNA, 20 bp, Homo sapiens
aagtgtttccttcatttctg

SEQ ID NO: 5107506 - DNA, 21 bp, Homo sapiens
aagtgtttctgttattaacaa

SEQ ID NO: 5107507 - DNA, 14 bp, Homo sapiens
aagtgtttctgttc

SEQ ID NO: 5107508 - DNA, 19 bp, Homo sapiens
aagtgttttactctttttc

SEQ ID NO: 5107509 - DNA, 20 bp, Homo sapiens
aagtgttttactctttttct

SEQ ID NO: 5107510 - DNA, 16 bp, Homo sapiens
aagtgttttagatgtt

SEQ ID NO: 5107511 - DNA, 13 bp, Homo sapiens
aagtgttttcaca

SEQ ID NO: 5107512 - DNA, 22 bp, Homo sapiens
aagtgttttctcagaacagctg

SEQ ID NO: 5107513 - DNA, 13 bp, Homo sapiens
aagtgttttctct

SEQ ID NO: 5107514 - DNA, 22 bp, Homo sapiens
aagtgttttctctgaacacatt

SEQ ID NO: 5107515 - DNA, 16 bp, Homo sapiens
aagtgttttggagaaa

SEQ ID NO: 5107516 - DNA, 18 bp, Homo sapiens
aagtgttttggtgttttg

SEQ ID NO: 5107517 - DNA, 19 bp, Homo sapiens
aagtgttttgtattttata

SEQ ID NO: 5107518 - DNA, 23 bp, Homo sapiens
aagtgttttgttctttctggagt

SEQ ID NO: 5107519 - DNA, 22 bp, Homo sapiens
aagtgtttttctttaatcaaaa

SEQ ID NO: 5107520 - DNA, 23 bp, Homo sapiens
aagtgtttttctttaatcaaaag

SEQ ID NO: 5107521 - DNA, 18 bp, Homo sapiens
aagttaaaaaaaataata

SEQ ID NO: 5107522 - DNA, 21 bp, Homo sapiens
aagttaaaaaaaataataaat

SEQ ID NO: 5107523 - DNA, 17 bp, Homo sapiens
aagttaaaaaacagctg

SEQ ID NO: 5107524 - DNA, 11 bp, Homo sapiens
aagttaaaagt

SEQ ID NO: 5107525 - DNA, 22 bp, Homo sapiens
aagttaaagagacaaatagtag

SEQ ID NO: 5107526 - DNA, 19 bp, Homo sapiens
aagttaaaggttactgttt

SEQ ID NO: 5107527 - DNA, 18 bp, Homo sapiens
aagttaaatcattttcat

SEQ ID NO: 5107528 - DNA, 12 bp, Homo sapiens
aagttaaatgta

SEQ ID NO: 5107529 - DNA, 15 bp, Homo sapiens
aagttaaatgtatca

SEQ ID NO: 5107530 - DNA, 17 bp, Homo sapiens
aagttaacaaggaatgc

SEQ ID NO: 5107531 - DNA, 17 bp, Homo sapiens
aagttaactcttcaaat

SEQ ID NO: 5107532 - DNA, 21 bp, Homo sapiens
aagttaagaatctttatagtt

SEQ ID NO: 5107533 - DNA, 21 bp, Homo sapiens
aagttaagaattgagcagttc

SEQ ID NO: 5107534 - DNA, 18 bp, Homo sapiens
aagttaagagaaacttta

SEQ ID NO: 5107535 - DNA, 19 bp, Homo sapiens
aagttaagagaaactttat

SEQ ID NO: 5107536 - DNA, 22 bp, Homo sapiens
aagttaagagaaactttataca

SEQ ID NO: 5107537 - DNA, 20 bp, Homo sapiens
aagttaagcagcctttctgt

SEQ ID NO: 5107538 - DNA, 17 bp, Homo sapiens
aagttaataagttgatg

SEQ ID NO: 5107539 - DNA, 20 bp, Homo sapiens
aagttaataagttgatgttt

SEQ ID NO: 5107540 - DNA, 24 bp, Homo sapiens
aagttaataatgtattgtaatctt

SEQ ID NO: 5107541 - DNA, 21 bp, Homo sapiens
aagttaatattggaagtgaaa

SEQ ID NO: 5107542 - DNA, 21 bp, Homo sapiens
aagttaatcagaaagaaaaaa

SEQ ID NO: 5107543 - DNA, 22 bp, Homo sapiens
aagttaatcagaaagaaaaaat

SEQ ID NO: 5107544 - DNA, 12 bp, Homo sapiens
aagttaatgaaa

SEQ ID NO: 5107545 - DNA, 15 bp, Homo sapiens
aagttaatgaaataa

SEQ ID NO: 5107546 - DNA, 22 bp, Homo sapiens
aagttaatgaaataaaatttga

SEQ ID NO: 5107547 - DNA, 22 bp, Homo sapiens
aagttaatgtatataaaaatgg

SEQ ID NO: 5107548 - DNA, 20 bp, Homo sapiens
aagttaattcacctatgtta

SEQ ID NO: 5107549 - DNA, 18 bp, Homo sapiens
aagttacaacttcctaat

SEQ ID NO: 5107550 - DNA, 15 bp, Homo sapiens
aagttacaatgtttt

SEQ ID NO: 5107551 - DNA, 21 bp, Homo sapiens
aagttacacagaaatgctgct

SEQ ID NO: 5107552 - DNA, 23 bp, Homo sapiens
aagttacacagaaatgctgctgg

SEQ ID NO: 5107553 - DNA, 19 bp, Homo sapiens
aagttacacggggttacac

SEQ ID NO: 5107554 - DNA, 16 bp, Homo sapiens
aagtaacatgcatact

SEQ ID NO: 5107555 - DNA, 22 bp, Homo sapiens
aagtaaccaactgaacgacaaa

SEQ ID NO: 5107556 - DNA, 18 bp, Homo sapiens
aagtaacccctcctggct

SEQ ID NO: 5107557 - DNA, 18 bp, Homo sapiens
aagtaacgtgctcactgt

SEQ ID NO: 5107558 - DNA, 14 bp, Homo sapiens
aagtaactcatttg

SEQ ID NO: 5107559 - DNA, 21 bp, Homo sapiens
aagtaactcatttgttaaaat

SEQ ID NO: 5107560 - DNA, 19 bp, Homo sapiens
aagtaactcccactcctaa

SEQ ID NO: 5107561 - DNA, 18 bp, Homo sapiens
aagtaactcttacctaaa

SEQ ID NO: 5107562 - DNA, 23 bp, Homo sapiens
aagtaactcttacctaaactgag

SEQ ID NO: 5107563 - DNA, 14 bp, Homo sapiens
aagtaactgaggct

SEQ ID NO: 5107564 - DNA, 18 bp, Homo sapiens
aagtaactggtgatatat

SEQ ID NO: 5107565 - DNA, 15 bp, Homo sapiens
aagtaactttattct

SEQ ID NO: 5107566 - DNA, 11 bp, Homo sapiens
aagtaagaaaa

SEQ ID NO: 5107567 - DNA, 13 bp, Homo sapiens
aagtaagaaaata

SEQ ID NO: 5107568 - DNA, 13 bp, Homo sapiens
aagtaagaaacac

SEQ ID NO: 5107569 - DNA, 13 bp, Homo sapiens
aagtaagaagaca

SEQ ID NO: 5107570 - DNA, 14 bp, Homo sapiens
aagtaagacacaaa

SEQ ID NO: 5107571 - DNA, 22 bp, Homo sapiens
aagtaagagctaagttctaagt

SEQ ID NO: 5107572 - DNA, 15 bp, Homo sapiens
aagtaagatggtttt

SEQ ID NO: 5107573 - DNA, 19 bp, Homo sapiens
aagtaagcaacagcataac

SEQ ID NO: 5107574 - DNA, 16 bp, Homo sapiens
aagtaaggaattttat

SEQ ID NO: 5107575 - DNA, 20 bp, Homo sapiens
aagtaagggaagcagaagga

SEQ ID NO: 5107576 - DNA, 12 bp, Homo sapiens
aagtaagggaat

SEQ ID NO: 5107577 - DNA, 16 bp, Homo sapiens
aagtaagtaagaaaga

SEQ ID NO: 5107578 - DNA, 17 bp, Homo sapiens
aagtaagtaagaaagaa

SEQ ID NO: 5107579 - DNA, 18 bp, Homo sapiens
aagtaagtaccactcagg

SEQ ID NO: 5107580 - DNA, 17 bp, Homo sapiens
aagtaagtctcaaggta

SEQ ID NO: 5107581 - DNA, 20 bp, Homo sapiens
aagtaagttaataatgtatt

SEQ ID NO: 5107582 - DNA, 14 bp, Homo sapiens
aagtaagttcatca

SEQ ID NO: 5107583 - DNA, 17 bp, Homo sapiens
aagtaagtttatccaaa

SEQ ID NO: 5107584 - DNA, 17 bp, Homo sapiens
aagtaagtttcattcta

SEQ ID NO: 5107585 - DNA, 21 bp, Homo sapiens
aagtaagtttcattctaaaat

SEQ ID NO: 5107586 - DNA, 14 bp, Homo sapiens
aagtaataaaattc

SEQ ID NO: 5107587 - DNA, 18 bp, Homo sapiens
aagtaataaagagaaata

SEQ ID NO: 5107588 - DNA, 19 bp, Homo sapiens
aagtaataaagagaaatat

SEQ ID NO: 5107589 - DNA, 18 bp, Homo sapiens
aagtaataaattccaata

SEQ ID NO: 5107590 - DNA, 14 bp, Homo sapiens
aagtaataactgat

SEQ ID NO: 5107591 - DNA, 15 bp, Homo sapiens
aagtaataatttgta

SEQ ID NO: 5107592 - DNA, 23 bp, Homo sapiens
aagtaatataatggaagagaaat

SEQ ID NO: 5107593 - DNA, 15 bp, Homo sapiens
aagtaatatcaaagc

SEQ ID NO: 5107594 - DNA, 15 bp, Homo sapiens
aagtaatcatctaag

SEQ ID NO: 5107595 - DNA, 23 bp, Homo sapiens
aagtaatcatgttttaatgtaga

SEQ ID NO: 5107596 - DNA, 18 bp, Homo sapiens
aagtaatcccgccaccta

SEQ ID NO: 5107597 - DNA, 19 bp, Homo sapiens
aagtaatctcacagcattt

SEQ ID NO: 5107598 - DNA, 16 bp, Homo sapiens
aagtaatctttaaact

SEQ ID NO: 5107599 - DNA, 13 bp, Homo sapiens
aagtaatcttttt

SEQ ID NO: 5107600 - DNA, 11 bp, Homo sapiens
aagtaatgaaa

SEQ ID NO: 5107601 - DNA, 12 bp, Homo sapiens
aagtaatgaatt

SEQ ID NO: 5107602 - DNA, 17 bp, Homo sapiens
aagtaatgaattttatg

SEQ ID NO: 5107603 - DNA, 19 bp, Homo sapiens
aagtaatgacttagaaact

SEQ ID NO: 5107604 - DNA, 12 bp, Homo sapiens
aagtaatgatga

SEQ ID NO: 5107605 - DNA, 21 bp, Homo sapiens
aagtaatgatgaaatctttct

SEQ ID NO: 5107606 - DNA, 23 bp, Homo sapiens
aagtaatgccacacattgtgctt

SEQ ID NO: 5107607 - DNA, 14 bp, Homo sapiens
aagtaatgcctctg

SEQ ID NO: 5107608 - DNA, 19 bp, Homo sapiens
aagtaatgtagcatgattt

SEQ ID NO: 5107609 - DNA, 14 bp, Homo sapiens
aagtaatgtggaag

SEQ ID NO: 5107610 - DNA, 13 bp, Homo sapiens
aagtaattatcgg

SEQ ID NO: 5107611 - DNA, 14 bp, Homo sapiens
aagtaattcataca

SEQ ID NO: 5107612 - DNA, 15 bp, Homo sapiens
aagtaattgcctaca

SEQ ID NO: 5107613 - DNA, 16 bp, Homo sapiens
aagtaattgtgaaaaa

SEQ ID NO: 5107614 - DNA, 12 bp, Homo sapiens
aagtaatttcaa

SEQ ID NO: 5107615 - DNA, 14 bp, Homo sapiens
aagtaatttcaaga

SEQ ID NO: 5107616 - DNA, 20 bp, Homo sapiens
aagtaatttcaagaatgttt

SEQ ID NO: 5107617 - DNA, 14 bp, Homo sapiens
aagtaatttcagtg

SEQ ID NO: 5107618 - DNA, 23 bp, Homo sapiens
aagtaatttcagtgtaaagtgtg

SEQ ID NO: 5107619 - DNA, 13 bp, Homo sapiens
aagtaatttcctg

SEQ ID NO: 5107620 - DNA, 18 bp, Homo sapiens
aagtaatttgtaaaaaag

SEQ ID NO: 5107621 - DNA, 19 bp, Homo sapiens
aagtaatttgtaaaaaaga

SEQ ID NO: 5107622 - DNA, 12 bp, Homo sapiens
aagtaattttct

SEQ ID NO: 5107623 - DNA, 19 bp, Homo sapiens
aagtaattttcttctcatt

SEQ ID NO: 5107624 - DNA, 21 bp, Homo sapiens
aagtaattttgtcacattatt

SEQ ID NO: 5107625 - DNA, 16 bp, Homo sapiens
aagtacaaaaaagttt

SEQ ID NO: 5107626 - DNA, 14 bp, Homo sapiens
aagtacaaacatga

SEQ ID NO: 5107627 - DNA, 15 bp, Homo sapiens
aagtacaaacatgaa

SEQ ID NO: 5107628 - DNA, 13 bp, Homo sapiens
aagtacaaatgaa

SEQ ID NO: 5107629 - DNA, 14 bp, Homo sapiens
aagtacacctgtgt

SEQ ID NO: 5107630 - DNA, 19 bp, Homo sapiens
aagtacactctgctgtttg

SEQ ID NO: 5107631 - DNA, 13 bp, Homo sapiens
aagtacactgttt

SEQ ID NO: 5107632 - DNA, 19 bp, Homo sapiens
aagtacactgtttcaaact

SEQ ID NO: 5107633 - DNA, 20 bp, Homo sapiens
aagtacactgtttcaaactt

SEQ ID NO: 5107634 - DNA, 22 bp, Homo sapiens
aagtacagaatagaatacattg

SEQ ID NO: 5107635 - DNA, 19 bp, Homo sapiens
aagtacagaatttgaatta

SEQ ID NO: 5107636 - DNA, 15 bp, Homo sapiens
aagtacagagaagcc

SEQ ID NO: 5107637 - DNA, 16 bp, Homo sapiens
aagtacagagaagcca

SEQ ID NO: 5107638 - DNA, 17 bp, Homo sapiens
aagtacagagaagccat

SEQ ID NO: 5107639 - DNA, 22 bp, Homo sapiens
aagtacagagaagccatcacct

SEQ ID NO: 5107640 - DNA, 14 bp, Homo sapiens
aagtacagcctgga

SEQ ID NO: 5107641 - DNA, 23 bp, Homo sapiens
aagtacatagtgaattttaaaat

SEQ ID NO: 5107642 - DNA, 21 bp, Homo sapiens
aagtacatatttattttcttt

SEQ ID NO: 5107643 - DNA, 16 bp, Homo sapiens
aagtacatcacccagt

SEQ ID NO: 5107644 - DNA, 21 bp, Homo sapiens
aagtacatctgtacatgactg

SEQ ID NO: 5107645 - DNA, 13 bp, Homo sapiens
aagtacattgctt

SEQ ID NO: 5107646 - DNA, 18 bp, Homo sapiens
aagtacattgtaaaataa

SEQ ID NO: 5107647 - DNA, 16 bp, Homo sapiens
aagtaccaatgctgtt

SEQ ID NO: 5107648 - DNA, 18 bp, Homo sapiens
aagtaccaatgggaagca

SEQ ID NO: 5107649 - DNA, 19 bp, Homo sapiens
aagtaccaatgggaagcag

SEQ ID NO: 5107650 - DNA, 18 bp, Homo sapiens
aagtaccacactgagttc

SEQ ID NO: 5107651 - DNA, 13 bp, Homo sapiens
aagtaccagaagc

SEQ ID NO: 5107652 - DNA, 20 bp, Homo sapiens
aagtaccaggccgtttgctt

SEQ ID NO: 5107653 - DNA, 21 bp, Homo sapiens
aagtaccatagaacagaactg

SEQ ID NO: 5107654 - DNA, 12 bp, Homo sapiens
aagtacccagca

SEQ ID NO: 5107655 - DNA, 20 bp, Homo sapiens
aagtacccgttcacattttt

SEQ ID NO: 5107656 - DNA, 15 bp, Homo sapiens
aagtaccctctttta

SEQ ID NO: 5107657 - DNA, 19 bp, Homo sapiens
aagtacctatattgattta

SEQ ID NO: 5107658 - DNA, 15 bp, Homo sapiens
aagtacctcagcatt

SEQ ID NO: 5107659 - DNA, 17 bp, Homo sapiens
aagtacctgtgaacagt

SEQ ID NO: 5107660 - DNA, 16 bp, Homo sapiens
aagtaccttgactttg

SEQ ID NO: 5107661 - DNA, 16 bp, Homo sapiens
aagtacctttgttaca

SEQ ID NO: 5107662 - DNA, 15 bp, Homo sapiens
aagtacgttattgtt

SEQ ID NO: 5107663 - DNA, 16 bp, Homo sapiens
aagtacgtttttgcat

SEQ ID NO: 5107664 - DNA, 13 bp, Homo sapiens
aagtactaaaact

SEQ ID NO: 5107665 - DNA, 16 bp, Homo sapiens
aagtactaaaactaga

SEQ ID NO: 5107666 - DNA, 23 bp, Homo sapiens
aagtactaaaactagataactta

SEQ ID NO: 5107667 - DNA, 19 bp, Homo sapiens
aagtactaagcgctagagg

SEQ ID NO: 5107668 - DNA, 18 bp, Homo sapiens
aagtactacacattttta

SEQ ID NO: 5107669 - DNA, 19 bp, Homo sapiens
aagtactagatgcatcact

SEQ ID NO: 5107670 - DNA, 14 bp, Homo sapiens
aagtactagctaaa

SEQ ID NO: 5107671 - DNA, 14 bp, Homo sapiens
aagtactataattt

SEQ ID NO: 5107672 - DNA, 15 bp, Homo sapiens
aagtactatctttgt

SEQ ID NO: 5107673 - DNA, 19 bp, Homo sapiens
aagtactatctttgtctaa

SEQ ID NO: 5107674 - DNA, 15 bp, Homo sapiens
aagtactatgtatca

SEQ ID NO: 5107675 - DNA, 16 bp, Homo sapiens
aagtactgagcagtga

SEQ ID NO: 5107676 - DNA, 23 bp, Homo sapiens
aagtactgagcagtgatattctt

SEQ ID NO: 5107677 - DNA, 13 bp, Homo sapiens
aagtactgcaaaa

SEQ ID NO: 5107678 - DNA, 17 bp, Homo sapiens
aagtactgctgtaaata

SEQ ID NO: 5107679 - DNA, 17 bp, Homo sapiens
aagtactggaatttatt

SEQ ID NO: 5107680 - DNA, 17 bp, Homo sapiens
aagtactggttgacttt

SEQ ID NO: 5107681 - DNA, 22 bp, Homo sapiens
aagtactgtaagaataatttat

SEQ ID NO: 5107682 - DNA, 14 bp, Homo sapiens
aagtactgtaataa

SEQ ID NO: 5107683 - DNA, 19 bp, Homo sapiens
aagtactgtaataatacct

SEQ ID NO: 5107684 - DNA, 18 bp, Homo sapiens
aagtactgtcctcaaata

SEQ ID NO: 5107685 - DNA, 16 bp, Homo sapiens
aagtactgtgtacaga

SEQ ID NO: 5107686 - DNA, 20 bp, Homo sapiens
aagtacttaactatctgttc

SEQ ID NO: 5107687 - DNA, 17 bp, Homo sapiens
aagtacttatctttatt

SEQ ID NO: 5107688 - DNA, 23 bp, Homo sapiens
aagtacttccacttgtgtatatt

SEQ ID NO: 5107689 - DNA, 18 bp, Homo sapiens
aagtacttctccaccctg

SEQ ID NO: 5107690 - DNA, 21 bp, Homo sapiens
aagtacttctccaccctgctc

SEQ ID NO: 5107691 - DNA, 14 bp, Homo sapiens
aagtacttgagtgt

SEQ ID NO: 5107692 - DNA, 18 bp, Homo sapiens
aagtacttgctctctgag

SEQ ID NO: 5107693 - DNA, 23 bp, Homo sapiens
aagtacttggcccccttcaggag

SEQ ID NO: 5107694 - DNA, 17 bp, Homo sapiens
aagtacttggtcccgtg

SEQ ID NO: 5107695 - DNA, 16 bp, Homo sapiens
aagtacttttctgttc

SEQ ID NO: 5107696 - DNA, 19 bp, Homo sapiens
aagtacttttgattatttt

SEQ ID NO: 5107697 - DNA, 20 bp, Homo sapiens
aagtacttttggtgtcatta

SEQ ID NO: 5107698 - DNA, 17 bp, Homo sapiens
aagtagaaaaaaaaata

SEQ ID NO: 5107699 - DNA, 18 bp, Homo sapiens
aagtagaaaaaaaaataa

SEQ ID NO: 5107700 - DNA, 12 bp, Homo sapiens
aagtagaaaaat

SEQ ID NO: 5107701 - DNA, 23 bp, Homo sapiens
aagtagaaaaattgtttccaaag

SEQ ID NO: 5107702 - DNA, 16 bp, Homo sapiens
aagtagaaaatttctt

SEQ ID NO: 5107703 - DNA, 18 bp, Homo sapiens
aagtagaaacaaaataca

SEQ ID NO: 5107704 - DNA, 17 bp, Homo sapiens
aagtagaactcttaaat

SEQ ID NO: 5107705 - DNA, 15 bp, Homo sapiens
aagtagaataaaaac

SEQ ID NO: 5107706 - DNA, 20 bp, Homo sapiens
aagtagaatctcttttctgg

SEQ ID NO: 5107707 - DNA, 16 bp, Homo sapiens
aagtagaattatatct

SEQ ID NO: 5107708 - DNA, 18 bp, Homo sapiens
aagtagacagttttgaga

SEQ ID NO: 5107709 - DNA, 13 bp, Homo sapiens
aagtagagaagta

SEQ ID NO: 5107710 - DNA, 17 bp, Homo sapiens
aagtagagatgaagtta

SEQ ID NO: 5107711 - DNA, 20 bp, Homo sapiens
aagtagagctagctgccact

SEQ ID NO: 5107712 - DNA, 13 bp, Homo sapiens
aagtagaggtggc

SEQ ID NO: 5107713 - DNA, 12 bp, Homo sapiens
aagtagagtata

SEQ ID NO: 5107714 - DNA, 17 bp, Homo sapiens
aagtagagtatattgaa

SEQ ID NO: 5107715 - DNA, 23 bp, Homo sapiens
aagtagagtgagttctttttcac

SEQ ID NO: 5107716 - DNA, 17 bp, Homo sapiens
aagtagatagaaagcaa

SEQ ID NO: 5107717 - DNA, 18 bp, Homo sapiens
aagtagatcatggcagca

SEQ ID NO: 5107718 - DNA, 19 bp, Homo sapiens
aagtagatctgctttctgt

SEQ ID NO: 5107719 - DNA, 19 bp, Homo sapiens
aagtagattaaaatatttg

SEQ ID NO: 5107720 - DNA, 18 bp, Homo sapiens
aagtagattcatgaaaat

SEQ ID NO: 5107721 - DNA, 21 bp, Homo sapiens
aagtagattcatgaaaatgta

SEQ ID NO: 5107722 - DNA, 18 bp, Homo sapiens
aagtagcaaccttcattt

SEQ ID NO: 5107723 - DNA, 15 bp, Homo sapiens
aagtagcagtgtgaa

SEQ ID NO: 5107724 - DNA, 11 bp, Homo sapiens
aagtagcattt

SEQ ID NO: 5107725 - DNA, 22 bp, Homo sapiens
aagtagccacctgagttcctga

SEQ ID NO: 5107726 - DNA, 22 bp, Homo sapiens
aagtagcctgatctttctagag

SEQ ID NO: 5107727 - DNA, 18 bp, Homo sapiens
aagtagctgctaccttct

SEQ ID NO: 5107728 - DNA, 13 bp, Homo sapiens
aagtagctgggat

SEQ ID NO: 5107729 - DNA, 14 bp, Homo sapiens
aagtagctgggatt

SEQ ID NO: 5107730 - DNA, 15 bp, Homo sapiens
aagtagctgggattt

SEQ ID NO: 5107731 - DNA, 21 bp, Homo sapiens
aagtagctgtcagatgtcaca

SEQ ID NO: 5107732 - DNA, 16 bp, Homo sapiens
aagtaggaaagaattt

SEQ ID NO: 5107733 - DNA, 13 bp, Homo sapiens
aagtaggaaggaa

SEQ ID NO: 5107734 - DNA, 22 bp, Homo sapiens
aagttacagtttgatacaggaa

SEQ ID NO: 5107735 - DNA, 13 bp, Homo sapiens
aagttacatacat

SEQ ID NO: 5107736 - DNA, 17 bp, Homo sapiens
aagttacatacatttaa

SEQ ID NO: 5107737 - DNA, 23 bp, Homo sapiens
aagttacatacatttaaaaaaca

SEQ ID NO: 5107738 - DNA, 15 bp, Homo sapiens
aagttacatgcataa

SEQ ID NO: 5107739 - DNA, 23 bp, Homo sapiens
aagttacatgcataaaagggtca

SEQ ID NO: 5107740 - DNA, 19 bp, Homo sapiens
aagttacatgtttgcacct

SEQ ID NO: 5107741 - DNA, 22 bp, Homo sapiens
aagttacctgttatatatctct

SEQ ID NO: 5107742 - DNA, 16 bp, Homo sapiens
aagttactaatatatc

SEQ ID NO: 5107743 - DNA, 20 bp, Homo sapiens
aagttactaatatatctgta

SEQ ID NO: 5107744 - DNA, 18 bp, Homo sapiens
aagttactaggtaacttc

SEQ ID NO: 5107745 - DNA, 16 bp, Homo sapiens
aagttactatcctggc

SEQ ID NO: 5107746 - DNA, 12 bp, Homo sapiens
aagttactgaat

SEQ ID NO: 5107747 - DNA, 15 bp, Homo sapiens
aagttactgaatgca

SEQ ID NO: 5107748 - DNA, 17 bp, Homo sapiens
aagttactgggcattct

SEQ ID NO: 5107749 - DNA, 14 bp, Homo sapiens
aagttactgtaaat

SEQ ID NO: 5107750 - DNA, 20 bp, Homo sapiens
aagttactgtaaatgccttg

SEQ ID NO: 5107751 - DNA, 15 bp, Homo sapiens
aagttacttattcta

SEQ ID NO: 5107752 - DNA, 23 bp, Homo sapiens
aagttacttcactttaattctca

SEQ ID NO: 5107753 - DNA, 12 bp, Homo sapiens
aagttacttgaa

SEQ ID NO: 5107754 - DNA, 13 bp, Homo sapiens
aagttacttgaaa

SEQ ID NO: 5107755 - DNA, 15 bp, Homo sapiens
aagttacttgaaata

SEQ ID NO: 5107756 - DNA, 13 bp, Homo sapiens
aagttactttctt

SEQ ID NO: 5107757 - DNA, 13 bp, Homo sapiens
aagttactttgta

SEQ ID NO: 5107758 - DNA, 18 bp, Homo sapiens
aagttactttgtaatttt

SEQ ID NO: 5107759 - DNA, 12 bp, Homo sapiens
aagttacttttt

SEQ ID NO: 5107760 - DNA, 19 bp, Homo sapiens
aagttactttttgtagaga

SEQ ID NO: 5107761 - DNA, 24 bp, Homo sapiens
aagttagaaggcttaagaactgct

SEQ ID NO: 5107762 - DNA, 17 bp, Homo sapiens
aagttagaatctatttt

SEQ ID NO: 5107763 - DNA, 19 bp, Homo sapiens
aagttagaatctattttct

SEQ ID NO: 5107764 - DNA, 14 bp, Homo sapiens
aagttagaattcct

SEQ ID NO: 5107765 - DNA, 22 bp, Homo sapiens
aagttagactcttcccctccct

SEQ ID NO: 5107766 - DNA, 16 bp, Homo sapiens
aagttagagataattc

SEQ ID NO: 5107767 - DNA, 16 bp, Homo sapiens
aagttagcctttatct

SEQ ID NO: 5107768 - DNA, 14 bp, Homo sapiens
aagttagctattgg

SEQ ID NO: 5107769 - DNA, 14 bp, Homo sapiens
aagttagctcagga

SEQ ID NO: 5107770 - DNA, 19 bp, Homo sapiens
aagttagggcatttttctt

SEQ ID NO: 5107771 - DNA, 23 bp, Homo sapiens
aagttagggcatttttcttggat

SEQ ID NO: 5107772 - DNA, 15 bp, Homo sapiens
aagttagggggttct

SEQ ID NO: 5107773 - DNA, 17 bp, Homo sapiens
aagttaggttataagaa

SEQ ID NO: 5107774 - DNA, 16 bp, Homo sapiens
aagttagtatcttttg

SEQ ID NO: 5107775 - DNA, 19 bp, Homo sapiens
aagttagtatcttttgata

SEQ ID NO: 5107776 - DNA, 20 bp, Homo sapiens
aagttagtatcttttgatat

SEQ ID NO: 5107777 - DNA, 11 bp, Homo sapiens
aagttagtcta

SEQ ID NO: 5107778 - DNA, 23 bp, Homo sapiens
aagttagtggaaatctgaacatt

SEQ ID NO: 5107779 - DNA, 21 bp, Homo sapiens
aagttagtgtgttgtctgtgc

SEQ ID NO: 5107780 - DNA, 21 bp, Homo sapiens
aagttagttcagtagcttatc

SEQ ID NO: 5107781 - DNA, 14 bp, Homo sapiens
aagttagtttcagt

SEQ ID NO: 5107782 - DNA, 15 bp, Homo sapiens
aagttagtttgtata

SEQ ID NO: 5107783 - DNA, 23 bp, Homo sapiens
aagttagtttgtatatattatta

SEQ ID NO: 5107784 - DNA, 12 bp, Homo sapiens
aagttataagaa

SEQ ID NO: 5107785 - DNA, 13 bp, Homo sapiens
aagttataagaaa

SEQ ID NO: 5107786 - DNA, 14 bp, Homo sapiens
aagttataagactc

SEQ ID NO: 5107787 - DNA, 12 bp, Homo sapiens
aagttataataa

SEQ ID NO: 5107788 - DNA, 14 bp, Homo sapiens
aagttataataact

SEQ ID NO: 5107789 - DNA, 17 bp, Homo sapiens
aagttataccagcaaaa

SEQ ID NO: 5107790 - DNA, 19 bp, Homo sapiens
aagttatataaagagaaaa

SEQ ID NO: 5107791 - DNA, 20 bp, Homo sapiens
aagttatataaagagaaaat

SEQ ID NO: 5107792 - DNA, 21 bp, Homo sapiens
aagttatataaagagaaaatt

SEQ ID NO: 5107793 - DNA, 16 bp, Homo sapiens
aagttatattgaatat

SEQ ID NO: 5107794 - DNA, 19 bp, Homo sapiens
aagttatattgaatatatc

SEQ ID NO: 5107795 - DNA, 12 bp, Homo sapiens
aagttatatttc

SEQ ID NO: 5107796 - DNA, 14 bp, Homo sapiens
aagttatatttcag

SEQ ID NO: 5107797 - DNA, 14 bp, Homo sapiens
aagttatatttcct

SEQ ID NO: 5107798 - DNA, 22 bp, Homo sapiens
aagttatcagacactctggctg

SEQ ID NO: 5107799 - DNA, 19 bp, Homo sapiens
aagttatcatcctattgtc

SEQ ID NO: 5107800 - DNA, 14 bp, Homo sapiens
aagttatctttgaa

SEQ ID NO: 5107801 - DNA, 18 bp, Homo sapiens
aagttatgagggtcaggg

SEQ ID NO: 5107802 - DNA, 18 bp, Homo sapiens
aagttatggcagtgatgc

SEQ ID NO: 5107803 - DNA, 15 bp, Homo sapiens
aagttatgtgtatgt

SEQ ID NO: 5107804 - DNA, 16 bp, Homo sapiens
aagttatgtgtatgtg

SEQ ID NO: 5107805 - DNA, 22 bp, Homo sapiens
aagttatgtgttaaatttagtg

SEQ ID NO: 5107806 - DNA, 16 bp, Homo sapiens
aagttattaaaaatgt

SEQ ID NO: 5107807 - DNA, 22 bp, Homo sapiens
aagttattaacgggcatgtatt

SEQ ID NO: 5107808 - DNA, 15 bp, Homo sapiens
aagttattaacttta

SEQ ID NO: 5107809 - DNA, 22 bp, Homo sapiens
aagttattaagaggtaagactt

SEQ ID NO: 5107810 - DNA, 23 bp, Homo sapiens
aagttattaagaggtaagactta

SEQ ID NO: 5107811 - DNA, 22 bp, Homo sapiens
aagttattaatcttatgtgttt

SEQ ID NO: 5107812 - DNA, 17 bp, Homo sapiens
aagttattaatttcttc

SEQ ID NO: 5107813 - DNA, 22 bp, Homo sapiens
aagttattacctctccagttcc

SEQ ID NO: 5107814 - DNA, 21 bp, Homo sapiens
aagttattcaaatttgtacag

SEQ ID NO: 5107815 - DNA, 14 bp, Homo sapiens
aagttattcagaaa

SEQ ID NO: 5107816 - DNA, 17 bp, Homo sapiens
aagttattcagaaatat

SEQ ID NO: 5107817 - DNA, 18 bp, Homo sapiens
aagttattgacaaactct

SEQ ID NO: 5107818 - DNA, 23 bp, Homo sapiens
aagttattgataagttcatacat

SEQ ID NO: 5107819 - DNA, 14 bp, Homo sapiens
aagttattgcagtt

SEQ ID NO: 5107820 - DNA, 12 bp, Homo sapiens
aagttattgctg

SEQ ID NO: 5107821 - DNA, 19 bp, Homo sapiens
aagttattgctgcataaat

SEQ ID NO: 5107822 - DNA, 11 bp, Homo sapiens
aagttattgta

SEQ ID NO: 5107823 - DNA, 20 bp, Homo sapiens
aagttattgtacagctgttt

SEQ ID NO: 5107824 - DNA, 12 bp, Homo sapiens
aagttattgtgt

SEQ ID NO: 5107825 - DNA, 24 bp, Homo sapiens
aagttattgtgttgccttagcact

SEQ ID NO: 5107826 - DNA, 21 bp, Homo sapiens
aagttatttactcctcctgct

SEQ ID NO: 5107827 - DNA, 15 bp, Homo sapiens
aagttatttactttt

SEQ ID NO: 5107828 - DNA, 19 bp, Homo sapiens
aagttatttagaaatatcc

SEQ ID NO: 5107829 - DNA, 21 bp, Homo sapiens
aagttatttagaaatatcctt

SEQ ID NO: 5107830 - DNA, 14 bp, Homo sapiens
aagttatttatgct

SEQ ID NO: 5107831 - DNA, 14 bp, Homo sapiens
aagttatttatttt

SEQ ID NO: 5107832 - DNA, 23 bp, Homo sapiens
aagttatttcataccattattat

SEQ ID NO: 5107833 - DNA, 21 bp, Homo sapiens
aagttatttccaagtttgtgt

SEQ ID NO: 5107834 - DNA, 13 bp, Homo sapiens
aagttatttcttg

SEQ ID NO: 5107835 - DNA, 17 bp, Homo sapiens
aagttatttgatctggt

SEQ ID NO: 5107836 - DNA, 12 bp, Homo sapiens
aagttattttaa

SEQ ID NO: 5107837 - DNA, 13 bp, Homo sapiens
aagttattttaaa

SEQ ID NO: 5107838 - DNA, 14 bp, Homo sapiens
aagttattttatga

SEQ ID NO: 5107839 - DNA, 15 bp, Homo sapiens
aagttattttatgac

SEQ ID NO: 5107840 - DNA, 21 bp, Homo sapiens
aagttattttatgacatgaaa

SEQ ID NO: 5107841 - DNA, 17 bp, Homo sapiens
aagttattttatttgct

SEQ ID NO: 5107842 - DNA, 18 bp, Homo sapiens
aagttatttttgtacatg

SEQ ID NO: 5107843 - DNA, 23 bp, Homo sapiens
aagttcaaattcttctgaactca

SEQ ID NO: 5107844 - DNA, 16 bp, Homo sapiens
aagttcaacatgttat

SEQ ID NO: 5107845 - DNA, 18 bp, Homo sapiens
aagttcaacttatttcat

SEQ ID NO: 5107846 - DNA, 21 bp, Homo sapiens
aagttcaagtgatctttcaat

SEQ ID NO: 5107847 - DNA, 19 bp, Homo sapiens
aagttcaatctgtttttca

SEQ ID NO: 5107848 - DNA, 13 bp, Homo sapiens
aagttcacagtag

SEQ ID NO: 5107849 - DNA, 22 bp, Homo sapiens
aagttcacagtgtttcttattc

SEQ ID NO: 5107850 - DNA, 22 bp, Homo sapiens
aagttcacattaactcaggcat

SEQ ID NO: 5107851 - DNA, 21 bp, Homo sapiens
aagttcaccagactctataaa

SEQ ID NO: 5107852 - DNA, 16 bp, Homo sapiens
aagttcaccagccctg

SEQ ID NO: 5107853 - DNA, 19 bp, Homo sapiens
aagttcaccagccctgagc

SEQ ID NO: 5107854 - DNA, 23 bp, Homo sapiens
aagttcactgtttattgaagaac

SEQ ID NO: 5107855 - DNA, 11 bp, Homo sapiens
aagttcacttt

SEQ ID NO: 5107856 - DNA, 17 bp, Homo sapiens
aagttcagagttttctg

SEQ ID NO: 5107857 - DNA, 19 bp, Homo sapiens
aagttcagagttttctggg

SEQ ID NO: 5107858 - DNA, 22 bp, Homo sapiens
aagttcagcaagtagagcagag

SEQ ID NO: 5107859 - DNA, 16 bp, Homo sapiens
aagttcagccaccctg

SEQ ID NO: 5107860 - DNA, 13 bp, Homo sapiens
aagttcagccaga

SEQ ID NO: 5107861 - DNA, 23 bp, Homo sapiens
aagttcagcccaccatctgtttg

SEQ ID NO: 5107862 - DNA, 14 bp, Homo sapiens
aagttcaggctctg

SEQ ID NO: 5107863 - DNA, 20 bp, Homo sapiens
aagttcagtttttactgagg

SEQ ID NO: 5107864 - DNA, 19 bp, Homo sapiens
aagttcatacctaagtact

SEQ ID NO: 5107865 - DNA, 16 bp, Homo sapiens
aagttcatagtttctg

SEQ ID NO: 5107866 - DNA, 17 bp, Homo sapiens
aagttcatagtttctgt

SEQ ID NO: 5107867 - DNA, 18 bp, Homo sapiens
aagttcatagtttctgta

SEQ ID NO: 5107868 - DNA, 21 bp, Homo sapiens
aagttcatagtttctgtaatt

SEQ ID NO: 5107869 - DNA, 23 bp, Homo sapiens
aagttcatcctttgactgtgctg

SEQ ID NO: 5107870 - DNA, 17 bp, Homo sapiens
aagttcattaaacagaa

SEQ ID NO: 5107871 - DNA, 22 bp, Homo sapiens
aagttcattcatactcaaagag

SEQ ID NO: 5107872 - DNA, 16 bp, Homo sapiens
aagttcattcctgtct

SEQ ID NO: 5107873 - DNA, 16 bp, Homo sapiens
aagttccaagagtcta

SEQ ID NO: 5107874 - DNA, 14 bp, Homo sapiens
aagttccaagtcca

SEQ ID NO: 5107875 - DNA, 19 bp, Homo sapiens
aagttccaagttgctaata

SEQ ID NO: 5107876 - DNA, 15 bp, Homo sapiens
aagttccactgagct

SEQ ID NO: 5107877 - DNA, 15 bp, Homo sapiens
aagttccagcagttt

SEQ ID NO: 5107878 - DNA, 17 bp, Homo sapiens
aagttccagcagtttca

SEQ ID NO: 5107879 - DNA, 19 bp, Homo sapiens
aagttccagtgttctctct

SEQ ID NO: 5107880 - DNA, 20 bp, Homo sapiens
aagttccagttttgttttga

SEQ ID NO: 5107881 - DNA, 19 bp, Homo sapiens
aagttccatatagacacca

SEQ ID NO: 5107882 - DNA, 14 bp, Homo sapiens
aagttcccaactga

SEQ ID NO: 5107883 - DNA, 13 bp, Homo sapiens
aagttcccagttg

SEQ ID NO: 5107884 - DNA, 23 bp, Homo sapiens
aagttcccattattatttctgtt

SEQ ID NO: 5107885 - DNA, 20 bp, Homo sapiens
aagttccccatccctgtcat

SEQ ID NO: 5107886 - DNA, 20 bp, Homo sapiens
aagttcccccatcagttccc

SEQ ID NO: 5107887 - DNA, 18 bp, Homo sapiens
aagttccctatttgtgaa

SEQ ID NO: 5107888 - DNA, 16 bp, Homo sapiens
aagttccctggagaaa

SEQ ID NO: 5107889 - DNA, 23 bp, Homo sapiens
aagttccctggagaaaaaaattg

SEQ ID NO: 5107890 - DNA, 18 bp, Homo sapiens
aagttcctgcactccaga

SEQ ID NO: 5107891 - DNA, 16 bp, Homo sapiens
aagttcctgctgcctg

SEQ ID NO: 5107892 - DNA, 17 bp, Homo sapiens
aagttcctgttcacctt

SEQ ID NO: 5107893 - DNA, 23 bp, Homo sapiens
aagttcctgttcaccttatgtat

SEQ ID NO: 5107894 - DNA, 20 bp, Homo sapiens
aagttccttatgtatattta

SEQ ID NO: 5107895 - DNA, 11 bp, Homo sapiens
aagttccttcc

SEQ ID NO: 5107896 - DNA, 18 bp, Homo sapiens
aagttcgaacatgtttca

SEQ ID NO: 5107897 - DNA, 11 bp, Homo sapiens
aagttctaaga

SEQ ID NO: 5107898 - DNA, 14 bp, Homo sapiens
aagttctaagattc

SEQ ID NO: 5107899 - DNA, 20 bp, Homo sapiens
aagttctaagattctaatga

SEQ ID NO: 5107900 - DNA, 16 bp, Homo sapiens
aagttctaagattctg

SEQ ID NO: 5107901 - DNA, 19 bp, Homo sapiens
aagttctaataatttctaa

SEQ ID NO: 5107902 - DNA, 21 bp, Homo sapiens
aagttctaataatttctaatg

SEQ ID NO: 5107903 - DNA, 21 bp, Homo sapiens
aagttctagagaagaggctgg

SEQ ID NO: 5107904 - DNA, 18 bp, Homo sapiens
aagttctaggcatacttt

SEQ ID NO: 5107905 - DNA, 22 bp, Homo sapiens
aagttctagtgttttcaatttt

SEQ ID NO: 5107906 - DNA, 21 bp, Homo sapiens
aagttctattggaaaaaccac

SEQ ID NO: 5107907 - DNA, 15 bp, Homo sapiens
aagttctatttaagt

SEQ ID NO: 5107908 - DNA, 19 bp, Homo sapiens
aagttctcaaagttaattc

SEQ ID NO: 5107909 - DNA, 13 bp, Homo sapiens
aagttctgaaatt

SEQ ID NO: 5107910 - DNA, 17 bp, Homo sapiens
aagttctgcaaaataca

SEQ ID NO: 5107911 - DNA, 17 bp, Homo sapiens
aagttctgcctctgatg

SEQ ID NO: 5107912 - DNA, 14 bp, Homo sapiens
aagtaggaaggaaa

SEQ ID NO: 5107913 - DNA, 15 bp, Homo sapiens
aagtaggaaggaaaa

SEQ ID NO: 5107914 - DNA, 23 bp, Homo sapiens
aagtaggactttcctaaatgttt

SEQ ID NO: 5107915 - DNA, 17 bp, Homo sapiens
aagtaggaggaaacagt

SEQ ID NO: 5107916 - DNA, 21 bp, Homo sapiens
aagtaggatgaatcatattca

SEQ ID NO: 5107917 - DNA, 17 bp, Homo sapiens
aagtaggggaagaataa

SEQ ID NO: 5107918 - DNA, 19 bp, Homo sapiens
aagtaggggaagaataatt

SEQ ID NO: 5107919 - DNA, 20 bp, Homo sapiens
aagtaggggaagaataattt

SEQ ID NO: 5107920 - DNA, 15 bp, Homo sapiens
aagtaggtatacaaa

SEQ ID NO: 5107921 - DNA, 14 bp, Homo sapiens
aagtagtaaatttt

SEQ ID NO: 5107922 - DNA, 16 bp, Homo sapiens
aagtagtaaattttgt

SEQ ID NO: 5107923 - DNA, 18 bp, Homo sapiens
aagtagtacttcttctgt

SEQ ID NO: 5107924 - DNA, 16 bp, Homo sapiens
aagtagtagtgtcttc

SEQ ID NO: 5107925 - DNA, 18 bp, Homo sapiens
aagtagtcatcaatgcaa

SEQ ID NO: 5107926 - DNA, 12 bp, Homo sapiens
aagtagtccagc

SEQ ID NO: 5107927 - DNA, 12 bp, Homo sapiens
aagtagtcctgg

SEQ ID NO: 5107928 - DNA, 13 bp, Homo sapiens
aagtagtcctggc

SEQ ID NO: 5107929 - DNA, 17 bp, Homo sapiens
aagtagtccttggcata

SEQ ID NO: 5107930 - DNA, 14 bp, Homo sapiens
aagtagtctgctca

SEQ ID NO: 5107931 - DNA, 15 bp, Homo sapiens
aagtagtggagcccc

SEQ ID NO: 5107932 - DNA, 19 bp, Homo sapiens
aagtagtgggcatttcata

SEQ ID NO: 5107933 - DNA, 16 bp, Homo sapiens
aagtagtgtcattcat

SEQ ID NO: 5107934 - DNA, 17 bp, Homo sapiens
aagtagtgttgtccagg

SEQ ID NO: 5107935 - DNA, 17 bp, Homo sapiens
aagtagttatcatgtta

SEQ ID NO: 5107936 - DNA, 18 bp, Homo sapiens
aagtagttatcatgttag

SEQ ID NO: 5107937 - DNA, 15 bp, Homo sapiens
aagtagttattttat

SEQ ID NO: 5107938 - DNA, 12 bp, Homo sapiens
aagtagttctat

SEQ ID NO: 5107939 - DNA, 16 bp, Homo sapiens
aagtagttctgtattt

SEQ ID NO: 5107940 - DNA, 19 bp, Homo sapiens
aagtagttctgtatttgaa

SEQ ID NO: 5107941 - DNA, 21 bp, Homo sapiens
aagtagttctgtatttgaaag

SEQ ID NO: 5107942 - DNA, 17 bp, Homo sapiens
aagtagttggtttgtat

SEQ ID NO: 5107943 - DNA, 19 bp, Homo sapiens
aagtagttttattttaata

SEQ ID NO: 5107944 - DNA, 18 bp, Homo sapiens
aagtataaatttgtgtaa

SEQ ID NO: 5107945 - DNA, 14 bp, Homo sapiens
aagtataaggtgct

SEQ ID NO: 5107946 - DNA, 15 bp, Homo sapiens
aagtataaggtgctc

SEQ ID NO: 5107947 - DNA, 19 bp, Homo sapiens
aagtataatctttctatag

SEQ ID NO: 5107948 - DNA, 22 bp, Homo sapiens
aagtataatgtttattaaatgc

SEQ ID NO: 5107949 - DNA, 18 bp, Homo sapiens
aagtatacaacaggagag

SEQ ID NO: 5107950 - DNA, 19 bp, Homo sapiens
aagtatacaacaggagaga

SEQ ID NO: 5107951 - DNA, 14 bp, Homo sapiens
aagtatacatgtca

SEQ ID NO: 5107952 - DNA, 16 bp, Homo sapiens
aagtatacatttagtt

SEQ ID NO: 5107953 - DNA, 14 bp, Homo sapiens
aagtatacctggct

SEQ ID NO: 5107954 - DNA, 15 bp, Homo sapiens
aagtatacctggctt

SEQ ID NO: 5107955 - DNA, 12 bp, Homo sapiens
aagtatactgta

SEQ ID NO: 5107956 - DNA, 12 bp, Homo sapiens
aagtatactttt

SEQ ID NO: 5107957 - DNA, 12 bp, Homo sapiens
aagtatagaaaa

SEQ ID NO: 5107958 - DNA, 19 bp, Homo sapiens
aagtatagaaaatcttcat

SEQ ID NO: 5107959 - DNA, 19 bp, Homo sapiens
aagtatagaaatatattta

SEQ ID NO: 5107960 - DNA, 17 bp, Homo sapiens
aagtatagagaaaagtg

SEQ ID NO: 5107961 - DNA, 14 bp, Homo sapiens
aagtatagagagaa

SEQ ID NO: 5107962 - DNA, 23 bp, Homo sapiens
aagtatagagagaagttcataca

SEQ ID NO: 5107963 - DNA, 18 bp, Homo sapiens
aagtatataatggtttca

SEQ ID NO: 5107964 - DNA, 22 bp, Homo sapiens
aagtatataatttttttatgtt

SEQ ID NO: 5107965 - DNA, 22 bp, Homo sapiens
aagtatatacagagcctgtttt

SEQ ID NO: 5107966 - DNA, 11 bp, Homo sapiens
aagtatatact

SEQ ID NO: 5107967 - DNA, 18 bp, Homo sapiens
aagtatatagtatattta

SEQ ID NO: 5107968 - DNA, 22 bp, Homo sapiens
aagtatatagtatatttatact

SEQ ID NO: 5107969 - DNA, 16 bp, Homo sapiens
aagtatatatagaatc

SEQ ID NO: 5107970 - DNA, 12 bp, Homo sapiens
aagtatatatta

SEQ ID NO: 5107971 - DNA, 16 bp, Homo sapiens
aagtatatattaggat

SEQ ID NO: 5107972 - DNA, 23 bp, Homo sapiens
aagtatatattctacacatatat

SEQ ID NO: 5107973 - DNA, 19 bp, Homo sapiens
aagtatatcagctactgta

SEQ ID NO: 5107974 - DNA, 23 bp, Homo sapiens
aagtatatcatgtaaagaaatgt

SEQ ID NO: 5107975 - DNA, 16 bp, Homo sapiens
aagtatatgtcattta

SEQ ID NO: 5107976 - DNA, 22 bp, Homo sapiens
aagtatatgtgaaaaaaatgag

SEQ ID NO: 5107977 - DNA, 21 bp, Homo sapiens
aagtatattcttattggaaat

SEQ ID NO: 5107978 - DNA, 15 bp, Homo sapiens
aagtatatttaagga

SEQ ID NO: 5107979 - DNA, 12 bp, Homo sapiens
aagtatatttgt

SEQ ID NO: 5107980 - DNA, 20 bp, Homo sapiens
aagtatatttgtaaaagcta

SEQ ID NO: 5107981 - DNA, 21 bp, Homo sapiens
aagtatatttgtaaaagctaa

SEQ ID NO: 5107982 - DNA, 14 bp, Homo sapiens
aagtatattttcct

SEQ ID NO: 5107983 - DNA, 19 bp, Homo sapiens
aagtatcaagtatagaaaa

SEQ ID NO: 5107984 - DNA, 21 bp, Homo sapiens
aagtatcaagtatagaaaatc

SEQ ID NO: 5107985 - DNA, 13 bp, Homo sapiens
aagtatcacactt

SEQ ID NO: 5107986 - DNA, 19 bp, Homo sapiens
aagtatcactctaaaaaac

SEQ ID NO: 5107987 - DNA, 20 bp, Homo sapiens
aagtatcactctaaaaaaca

SEQ ID NO: 5107988 - DNA, 23 bp, Homo sapiens
aagtatcactctaaaaaacattt

SEQ ID NO: 5107989 - DNA, 16 bp, Homo sapiens
aagtatcacttttctg

SEQ ID NO: 5107990 - DNA, 12 bp, Homo sapiens
aagtatcagaaa

SEQ ID NO: 5107991 - DNA, 13 bp, Homo sapiens
aagtatcagaaag

SEQ ID NO: 5107992 - DNA, 16 bp, Homo sapiens
aagtatcatctaaata

SEQ ID NO: 5107993 - DNA, 12 bp, Homo sapiens
aagtatcatgca

SEQ ID NO: 5107994 - DNA, 15 bp, Homo sapiens
aagtatcatgcattc

SEQ ID NO: 5107995 - DNA, 21 bp, Homo sapiens
aagtatccaattatgtgacaa

SEQ ID NO: 5107996 - DNA, 18 bp, Homo sapiens
aagtatccctactgtaat

SEQ ID NO: 5107997 - DNA, 22 bp, Homo sapiens
aagtatccctgatttattctgg

SEQ ID NO: 5107998 - DNA, 23 bp, Homo sapiens
aagtatcctgacaagttcctagg

SEQ ID NO: 5107999 - DNA, 15 bp, Homo sapiens
aagtatcctgcgacc

SEQ ID NO: 5108000 - DNA, 16 bp, Homo sapiens
aagtatccttcattgt

SEQ ID NO: 5108001 - DNA, 18 bp, Homo sapiens
aagtatctaaaagtgtca

SEQ ID NO: 5108002 - DNA, 16 bp, Homo sapiens
aagtatctaaatttgg

SEQ ID NO: 5108003 - DNA, 15 bp, Homo sapiens
aagtatctgacatct

SEQ ID NO: 5108004 - DNA, 13 bp, Homo sapiens
aagtatctgtacc

SEQ ID NO: 5108005 - DNA, 14 bp, Homo sapiens
aagtatcttcatgt

SEQ ID NO: 5108006 - DNA, 21 bp, Homo sapiens
aagtatcttctatttttatca

SEQ ID NO: 5108007 - DNA, 12 bp, Homo sapiens
aagtatctttaa

SEQ ID NO: 5108008 - DNA, 19 bp, Homo sapiens
aagtatctttaacaattgt

SEQ ID NO: 5108009 - DNA, 21 bp, Homo sapiens
aagtatgaaccacatggaact

SEQ ID NO: 5108010 - DNA, 22 bp, Homo sapiens
aagtatgaaccacatggaactt

SEQ ID NO: 5108011 - DNA, 21 bp, Homo sapiens
aagtatgaatattactctcaa

SEQ ID NO: 5108012 - DNA, 14 bp, Homo sapiens
aagtatgaatattt

SEQ ID NO: 5108013 - DNA, 15 bp, Homo sapiens
aagtatgaatctagt

SEQ ID NO: 5108014 - DNA, 23 bp, Homo sapiens
aagtatgaatctatgccaaagat

SEQ ID NO: 5108015 - DNA, 20 bp, Homo sapiens
aagtatgacccacattactt

SEQ ID NO: 5108016 - DNA, 17 bp, Homo sapiens
aagtatgagggaaaatg

SEQ ID NO: 5108017 - DNA, 21 bp, Homo sapiens
aagtatgcaatgcttcattat

SEQ ID NO: 5108018 - DNA, 18 bp, Homo sapiens
aagtatgcactaatcaat

SEQ ID NO: 5108019 - DNA, 20 bp, Homo sapiens
aagtatgcattattaaattg

SEQ ID NO: 5108020 - DNA, 12 bp, Homo sapiens
aagtatgcctta

SEQ ID NO: 5108021 - DNA, 14 bp, Homo sapiens
aagtatgccttaag

SEQ ID NO: 5108022 - DNA, 18 bp, Homo sapiens
aagtatgccttaagcaga

SEQ ID NO: 5108023 - DNA, 20 bp, Homo sapiens
aagtatgccttaagcagaac

SEQ ID NO: 5108024 - DNA, 23 bp, Homo sapiens
aagtatgccttaagcagaacaaa

SEQ ID NO: 5108025 - DNA, 17 bp, Homo sapiens
aagtatggaatattcat

SEQ ID NO: 5108026 - DNA, 18 bp, Homo sapiens
aagtatggcagtgggaga

SEQ ID NO: 5108027 - DNA, 18 bp, Homo sapiens
aagtatggtaatagcttt

SEQ ID NO: 5108028 - DNA, 16 bp, Homo sapiens
aagtatggtacatcta

SEQ ID NO: 5108029 - DNA, 16 bp, Homo sapiens
aagtatggtgtgttca

SEQ ID NO: 5108030 - DNA, 22 bp, Homo sapiens
aagtatgtatattaaaaaagag

SEQ ID NO: 5108031 - DNA, 14 bp, Homo sapiens
aagtatgtattatt

SEQ ID NO: 5108032 - DNA, 15 bp, Homo sapiens
aagtatgtcttcaaa

SEQ ID NO: 5108033 - DNA, 22 bp, Homo sapiens
aagtatgtcttcaaaatatatt

SEQ ID NO: 5108034 - DNA, 17 bp, Homo sapiens
aagtatgtgatatctga

SEQ ID NO: 5108035 - DNA, 12 bp, Homo sapiens
aagtatgttgta

SEQ ID NO: 5108036 - DNA, 15 bp, Homo sapiens
aagtatgttgtacat

SEQ ID NO: 5108037 - DNA, 16 bp, Homo sapiens
aagtatgttttagcat

SEQ ID NO: 5108038 - DNA, 17 bp, Homo sapiens
aagtatgtttttacatt

SEQ ID NO: 5108039 - DNA, 18 bp, Homo sapiens
aagtatgtttttacatta

SEQ ID NO: 5108040 - DNA, 13 bp, Homo sapiens
aagtattaaaaca

SEQ ID NO: 5108041 - DNA, 21 bp, Homo sapiens
aagtattaaaacattggatta

SEQ ID NO: 5108042 - DNA, 18 bp, Homo sapiens
aagtattaagcagttcat

SEQ ID NO: 5108043 - DNA, 22 bp, Homo sapiens
aagtattaagcagttcattcta

SEQ ID NO: 5108044 - DNA, 23 bp, Homo sapiens
aagtattacaaccatatattgag

SEQ ID NO: 5108045 - DNA, 15 bp, Homo sapiens
aagtattacatgatt

SEQ ID NO: 5108046 - DNA, 18 bp, Homo sapiens
aagtattacatgatttaa

SEQ ID NO: 5108047 - DNA, 20 bp, Homo sapiens
aagtattagacttctaaata

SEQ ID NO: 5108048 - DNA, 17 bp, Homo sapiens
aagtattatcattgctc

SEQ ID NO: 5108049 - DNA, 15 bp, Homo sapiens
aagtattatgtctct

SEQ ID NO: 5108050 - DNA, 17 bp, Homo sapiens
aagtattatgtttcttc

SEQ ID NO: 5108051 - DNA, 21 bp, Homo sapiens
aagtattcaacaatttcaata

SEQ ID NO: 5108052 - DNA, 12 bp, Homo sapiens
aagtattcaaga

SEQ ID NO: 5108053 - DNA, 16 bp, Homo sapiens
aagtattcaagtattt

SEQ ID NO: 5108054 - DNA, 16 bp, Homo sapiens
aagtattcagaaatta

SEQ ID NO: 5108055 - DNA, 19 bp, Homo sapiens
aagtattcagaaattaaaa

SEQ ID NO: 5108056 - DNA, 15 bp, Homo sapiens
aagtattccacctta

SEQ ID NO: 5108057 - DNA, 20 bp, Homo sapiens
aagtattccaccttaaatta

SEQ ID NO: 5108058 - DNA, 21 bp, Homo sapiens
aagtattccaccttaaattaa

SEQ ID NO: 5108059 - DNA, 19 bp, Homo sapiens
aagtattcctgttgctgtc

SEQ ID NO: 5108060 - DNA, 23 bp, Homo sapiens
aagtattcctgttgctgtcttca

SEQ ID NO: 5108061 - DNA, 18 bp, Homo sapiens
aagtattccttggcccag

SEQ ID NO: 5108062 - DNA, 18 bp, Homo sapiens
aagtattctcaaagatgc

SEQ ID NO: 5108063 - DNA, 13 bp, Homo sapiens
aagtattctcttt

SEQ ID NO: 5108064 - DNA, 18 bp, Homo sapiens
aagtattcttatttaatg

SEQ ID NO: 5108065 - DNA, 14 bp, Homo sapiens
aagtattcttgtta

SEQ ID NO: 5108066 - DNA, 21 bp, Homo sapiens
aagtattgagaacctggcctg

SEQ ID NO: 5108067 - DNA, 22 bp, Homo sapiens
aagtattgcagtctaaaacttc

SEQ ID NO: 5108068 - DNA, 17 bp, Homo sapiens
aagtattgccaaacatt

SEQ ID NO: 5108069 - DNA, 19 bp, Homo sapiens
aagtattgcgaatgtgcag

SEQ ID NO: 5108070 - DNA, 13 bp, Homo sapiens
aagtattggattt

SEQ ID NO: 5108071 - DNA, 15 bp, Homo sapiens
aagtattggattttt

SEQ ID NO: 5108072 - DNA, 20 bp, Homo sapiens
aagtattgtaaattatattt

SEQ ID NO: 5108073 - DNA, 21 bp, Homo sapiens
aagtattgtaaattatatttg

SEQ ID NO: 5108074 - DNA, 13 bp, Homo sapiens
aagtattgtgttt

SEQ ID NO: 5108075 - DNA, 13 bp, Homo sapiens
aagtattgtttac

SEQ ID NO: 5108076 - DNA, 16 bp, Homo sapiens
aagtatttaaactttc

SEQ ID NO: 5108077 - DNA, 19 bp, Homo sapiens
aagtatttaaactttcaat

SEQ ID NO: 5108078 - DNA, 14 bp, Homo sapiens
aagtatttaaatgt

SEQ ID NO: 5108079 - DNA, 16 bp, Homo sapiens
aagtatttaaatgttc

SEQ ID NO: 5108080 - DNA, 21 bp, Homo sapiens
aagtatttaagcctaaagatt

SEQ ID NO: 5108081 - DNA, 16 bp, Homo sapiens
aagtatttaagtgatc

SEQ ID NO: 5108082 - DNA, 17 bp, Homo sapiens
aagtatttaattagtgc

SEQ ID NO: 5108083 - DNA, 23 bp, Homo sapiens
aagtatttaattagtgctaagtg

SEQ ID NO: 5108084 - DNA, 20 bp, Homo sapiens
aagtatttacagggtggccc

SEQ ID NO: 5108085 - DNA, 19 bp, Homo sapiens
aagtatttactgactgctt

SEQ ID NO: 5108086 - DNA, 21 bp, Homo sapiens
aagtatttactttttaaaaat

SEQ ID NO: 5108087 - DNA, 11 bp, Homo sapiens
aagtatttagg

SEQ ID NO: 5108088 - DNA, 16 bp, Homo sapiens
aagtatttaggttttt

SEQ ID NO: 5108089 - DNA, 19 bp, Homo sapiens
aagtatttataaaaatata

SEQ ID NO: 5108090 - DNA, 13 bp, Homo sapiens
aagtatttatata

SEQ ID NO: 5108091 - DNA, 19 bp, Homo sapiens
aagttctgtactcaaatgt

SEQ ID NO: 5108092 - DNA, 14 bp, Homo sapiens
aagttctgttttct

SEQ ID NO: 5108093 - DNA, 9 bp, Homo sapiens
aagttctta

SEQ ID NO: 5108094 - DNA, 16 bp, Homo sapiens
aagttcttaaaaaatt

SEQ ID NO: 5108095 - DNA, 14 bp, Homo sapiens
aagttcttaaaaca

SEQ ID NO: 5108096 - DNA, 16 bp, Homo sapiens
aagttcttaaaacact

SEQ ID NO: 5108097 - DNA, 13 bp, Homo sapiens
aagttcttagata

SEQ ID NO: 5108098 - DNA, 15 bp, Homo sapiens
aagttcttattttag

SEQ ID NO: 5108099 - DNA, 18 bp, Homo sapiens
aagttcttattttagtat

SEQ ID NO: 5108100 - DNA, 18 bp, Homo sapiens
aagttcttcacctctatc

SEQ ID NO: 5108101 - DNA, 15 bp, Homo sapiens
aagttcttctccaat

SEQ ID NO: 5108102 - DNA, 18 bp, Homo sapiens
aagttgaaaaataaagtt

SEQ ID NO: 5108103 - DNA, 16 bp, Homo sapiens
aagttgaaaagtaaaa

SEQ ID NO: 5108104 - DNA, 15 bp, Homo sapiens
aagttgaaaatcata

SEQ ID NO: 5108105 - DNA, 17 bp, Homo sapiens
aagttgaaatcagaagc

SEQ ID NO: 5108106 - DNA, 13 bp, Homo sapiens
aagttgaaatgtg

SEQ ID NO: 5108107 - DNA, 14 bp, Homo sapiens
aagttgaactatga

SEQ ID NO: 5108108 - DNA, 22 bp, Homo sapiens
aagttgaactatgactggagta

SEQ ID NO: 5108109 - DNA, 17 bp, Homo sapiens
aagttgaagctaagatt

SEQ ID NO: 5108110 - DNA, 22 bp, Homo sapiens
aagttgaaggttaaaggaaaag

SEQ ID NO: 5108111 - DNA, 21 bp, Homo sapiens
aagttgaataaacataaaagc

SEQ ID NO: 5108112 - DNA, 23 bp, Homo sapiens
aagttgaattgaggggattaata

SEQ ID NO: 5108113 - DNA, 15 bp, Homo sapiens
aagttgaatttattg

SEQ ID NO: 5108114 - DNA, 17 bp, Homo sapiens
aagttgaatttattggc

SEQ ID NO: 5108115 - DNA, 24 bp, Homo sapiens
aagttgaatttattggcttttctg

SEQ ID NO: 5108116 - DNA, 17 bp, Homo sapiens
aagttgagaaggtgcct

SEQ ID NO: 5108117 - DNA, 23 bp, Homo sapiens
aagttgagagacagtaacacaat

SEQ ID NO: 5108118 - DNA, 18 bp, Homo sapiens
aagttgagatagttttca

SEQ ID NO: 5108119 - DNA, 23 bp, Homo sapiens
aagttgagatagttttcatccat

SEQ ID NO: 5108120 - DNA, 19 bp, Homo sapiens
aagttgagatgttgtgtgg

SEQ ID NO: 5108121 - DNA, 15 bp, Homo sapiens
aagttgagattttta

SEQ ID NO: 5108122 - DNA, 23 bp, Homo sapiens
aagttgagatttttaagaacttc

SEQ ID NO: 5108123 - DNA, 13 bp, Homo sapiens
aagttgagcgtgc

SEQ ID NO: 5108124 - DNA, 23 bp, Homo sapiens
aagttgagcgtgcgcactgcatg

SEQ ID NO: 5108125 - DNA, 18 bp, Homo sapiens
aagttgagctatgactta

SEQ ID NO: 5108126 - DNA, 22 bp, Homo sapiens
aagttgagggaaagagcttata

SEQ ID NO: 5108127 - DNA, 20 bp, Homo sapiens
aagttgaggggagcatgctt

SEQ ID NO: 5108128 - DNA, 19 bp, Homo sapiens
aagttgagtatcccttatc

SEQ ID NO: 5108129 - DNA, 20 bp, Homo sapiens
aagttgataggagacttgta

SEQ ID NO: 5108130 - DNA, 17 bp, Homo sapiens
aagttgatatagaacag

SEQ ID NO: 5108131 - DNA, 20 bp, Homo sapiens
aagttgatatagaacagtgc

SEQ ID NO: 5108132 - DNA, 17 bp, Homo sapiens
aagttgatctccccagc

SEQ ID NO: 5108133 - DNA, 18 bp, Homo sapiens
aagttgatggtgatgaaa

SEQ ID NO: 5108134 - DNA, 22 bp, Homo sapiens
aagttgatgtgggaagaagtaa

SEQ ID NO: 5108135 - DNA, 18 bp, Homo sapiens
aagttgattaagaaagga

SEQ ID NO: 5108136 - DNA, 21 bp, Homo sapiens
aagttgattaagaaaggaagt

SEQ ID NO: 5108137 - DNA, 14 bp, Homo sapiens
aagttgattagaaa

SEQ ID NO: 5108138 - DNA, 14 bp, Homo sapiens
aagttgattcatat

SEQ ID NO: 5108139 - DNA, 17 bp, Homo sapiens
aagttgatttcttcttc

SEQ ID NO: 5108140 - DNA, 19 bp, Homo sapiens
aagttgcaaagtggaatta

SEQ ID NO: 5108141 - DNA, 18 bp, Homo sapiens
aagttgcacggctgctga

SEQ ID NO: 5108142 - DNA, 20 bp, Homo sapiens
aagttgcactgatattttac

SEQ ID NO: 5108143 - DNA, 14 bp, Homo sapiens
aagttgcagctgtt

SEQ ID NO: 5108144 - DNA, 21 bp, Homo sapiens
aagttgcagtcagaagatctt

SEQ ID NO: 5108145 - DNA, 16 bp, Homo sapiens
aagttgcagtctcaga

SEQ ID NO: 5108146 - DNA, 17 bp, Homo sapiens
aagttgcagtgagcagg

SEQ ID NO: 5108147 - DNA, 22 bp, Homo sapiens
aagttgcagtgagcagggtggg

SEQ ID NO: 5108148 - DNA, 22 bp, Homo sapiens
aagttgcagtgagctgatatca

SEQ ID NO: 5108149 - DNA, 18 bp, Homo sapiens
aagttgcatttagaaatc

SEQ ID NO: 5108150 - DNA, 16 bp, Homo sapiens
aagttgccattattct

SEQ ID NO: 5108151 - DNA, 16 bp, Homo sapiens
aagttgcctaaatcca

SEQ ID NO: 5108152 - DNA, 18 bp, Homo sapiens
aagttgcctaaatccatt

SEQ ID NO: 5108153 - DNA, 21 bp, Homo sapiens
aagttgcctttatttgctgtt

SEQ ID NO: 5108154 - DNA, 23 bp, Homo sapiens
aagttgctaacctcaatttatgt

SEQ ID NO: 5108155 - DNA, 22 bp, Homo sapiens
aagttgctcaccgactcacctg

SEQ ID NO: 5108156 - DNA, 15 bp, Homo sapiens
aagttgctgcagatt

SEQ ID NO: 5108157 - DNA, 18 bp, Homo sapiens
aagttgctgcagattcct

SEQ ID NO: 5108158 - DNA, 12 bp, Homo sapiens
aagttgctgctt

SEQ ID NO: 5108159 - DNA, 23 bp, Homo sapiens
aagttgctgcttctcccaggcaa

SEQ ID NO: 5108160 - DNA, 19 bp, Homo sapiens
aagttgctgtaaaatttgt

SEQ ID NO: 5108161 - DNA, 23 bp, Homo sapiens
aagttgctgtaaaatttgtgtaa

SEQ ID NO: 5108162 - DNA, 16 bp, Homo sapiens
aagttgctgtgcccca

SEQ ID NO: 5108163 - DNA, 15 bp, Homo sapiens
aagttgctttcctct

SEQ ID NO: 5108164 - DNA, 14 bp, Homo sapiens
aagttgctttgtta

SEQ ID NO: 5108165 - DNA, 15 bp, Homo sapiens
aagttggaaacacta

SEQ ID NO: 5108166 - DNA, 20 bp, Homo sapiens
aagttggaaacactaaatgt

SEQ ID NO: 5108167 - DNA, 22 bp, Homo sapiens
aagttggaaacactaaatgtta

SEQ ID NO: 5108168 - DNA, 23 bp, Homo sapiens
aagttggaaacactaaatgttaa

SEQ ID NO: 5108169 - DNA, 20 bp, Homo sapiens
aagttggaaaggaaaaaaga

SEQ ID NO: 5108170 - DNA, 13 bp, Homo sapiens
aagttggaaggga

SEQ ID NO: 5108171 - DNA, 14 bp, Homo sapiens
aagttggactaaat

SEQ ID NO: 5108172 - DNA, 18 bp, Homo sapiens
aagttggactaaatgcct

SEQ ID NO: 5108173 - DNA, 18 bp, Homo sapiens
aagttggacttgttttaa

SEQ ID NO: 5108174 - DNA, 17 bp, Homo sapiens
aagttggagtgcagtgg

SEQ ID NO: 5108175 - DNA, 16 bp, Homo sapiens
aagttggctagaagaa

SEQ ID NO: 5108176 - DNA, 11 bp, Homo sapiens
aagttggctca

SEQ ID NO: 5108177 - DNA, 17 bp, Homo sapiens
aagttggcttctgtttc

SEQ ID NO: 5108178 - DNA, 19 bp, Homo sapiens
aagttgggcaatataacca

SEQ ID NO: 5108179 - DNA, 20 bp, Homo sapiens
aagttgggcttgctattctg

SEQ ID NO: 5108180 - DNA, 21 bp, Homo sapiens
aagttggggacacatgtattt

SEQ ID NO: 5108181 - DNA, 16 bp, Homo sapiens
aagttgggtgtttcca

SEQ ID NO: 5108182 - DNA, 19 bp, Homo sapiens
aagttggtattaataaaaa

SEQ ID NO: 5108183 - DNA, 20 bp, Homo sapiens
aagttggtattaataaaaag

SEQ ID NO: 5108184 - DNA, 21 bp, Homo sapiens
aagttggtattaataaaaaga

SEQ ID NO: 5108185 - DNA, 20 bp, Homo sapiens
aagttggtattttataagca

SEQ ID NO: 5108186 - DNA, 23 bp, Homo sapiens
aagttggtcttactttgtgcaaa

SEQ ID NO: 5108187 - DNA, 20 bp, Homo sapiens
aagttggtcttactttgtta

SEQ ID NO: 5108188 - DNA, 11 bp, Homo sapiens
aagttggttta

SEQ ID NO: 5108189 - DNA, 17 bp, Homo sapiens
aagttgtaaagtatgta

SEQ ID NO: 5108190 - DNA, 20 bp, Homo sapiens
aagttgtaaggattgccttt

SEQ ID NO: 5108191 - DNA, 16 bp, Homo sapiens
aagttgtaatagagaa

SEQ ID NO: 5108192 - DNA, 14 bp, Homo sapiens
aagttgtacaaatg

SEQ ID NO: 5108193 - DNA, 15 bp, Homo sapiens
aagttgtacaaatgt

SEQ ID NO: 5108194 - DNA, 18 bp, Homo sapiens
aagttgtacaaatgtatt

SEQ ID NO: 5108195 - DNA, 19 bp, Homo sapiens
aagttgtacaaatgtattt

SEQ ID NO: 5108196 - DNA, 11 bp, Homo sapiens
aagttgtacca

SEQ ID NO: 5108197 - DNA, 12 bp, Homo sapiens
aagttgtaccaa

SEQ ID NO: 5108198 - DNA, 16 bp, Homo sapiens
aagttgtaccaaaaca

SEQ ID NO: 5108199 - DNA, 17 bp, Homo sapiens
aagttgtaccaaaacat

SEQ ID NO: 5108200 - DNA, 20 bp, Homo sapiens
aagttgtactttaaaaattt

SEQ ID NO: 5108201 - DNA, 17 bp, Homo sapiens
aagttgtataaaaacat

SEQ ID NO: 5108202 - DNA, 22 bp, Homo sapiens
aagttgtatgatctgtgccttt

SEQ ID NO: 5108203 - DNA, 12 bp, Homo sapiens
aagttgtcaaag

SEQ ID NO: 5108204 - DNA, 13 bp, Homo sapiens
aagttgtctggct

SEQ ID NO: 5108205 - DNA, 15 bp, Homo sapiens
aagttgtctggcttt

SEQ ID NO: 5108206 - DNA, 15 bp, Homo sapiens
aagttgtgaaactaa

SEQ ID NO: 5108207 - DNA, 23 bp, Homo sapiens
aagttgtgaaactaaaattttct

SEQ ID NO: 5108208 - DNA, 17 bp, Homo sapiens
aagttgtgacagtcact

SEQ ID NO: 5108209 - DNA, 18 bp, Homo sapiens
aagttgtgatctgttgta

SEQ ID NO: 5108210 - DNA, 22 bp, Homo sapiens
aagttgtgattacctgctgcat

SEQ ID NO: 5108211 - DNA, 17 bp, Homo sapiens
aagttgtgcttttctgt

SEQ ID NO: 5108212 - DNA, 13 bp, Homo sapiens
aagttgtggagga

SEQ ID NO: 5108213 - DNA, 17 bp, Homo sapiens
aagttgtggaggaggtg

SEQ ID NO: 5108214 - DNA, 18 bp, Homo sapiens
aagttgtggaggaggtga

SEQ ID NO: 5108215 - DNA, 18 bp, Homo sapiens
aagttgtggatttcagtt

SEQ ID NO: 5108216 - DNA, 16 bp, Homo sapiens
aagttgtgtctgaaaa

SEQ ID NO: 5108217 - DNA, 15 bp, Homo sapiens
aagttgttaaaacat

SEQ ID NO: 5108218 - DNA, 20 bp, Homo sapiens
aagttgttactaactaaact

SEQ ID NO: 5108219 - DNA, 21 bp, Homo sapiens
aagttgttagtgatttgctat

SEQ ID NO: 5108220 - DNA, 13 bp, Homo sapiens
aagttgttattgt

SEQ ID NO: 5108221 - DNA, 14 bp, Homo sapiens
aagttgttcaacta

SEQ ID NO: 5108222 - DNA, 13 bp, Homo sapiens
aagttgttgcatt

SEQ ID NO: 5108223 - DNA, 15 bp, Homo sapiens
aagttgttgcattcc

SEQ ID NO: 5108224 - DNA, 14 bp, Homo sapiens
aagttgtttaataa

SEQ ID NO: 5108225 - DNA, 12 bp, Homo sapiens
aagttgtttata

SEQ ID NO: 5108226 - DNA, 14 bp, Homo sapiens
aagttgtttataaa

SEQ ID NO: 5108227 - DNA, 15 bp, Homo sapiens
aagttgtttataaaa

SEQ ID NO: 5108228 - DNA, 18 bp, Homo sapiens
aagttgtttatcaacttc

SEQ ID NO: 5108229 - DNA, 19 bp, Homo sapiens
aagttgtttcaaacagcat

SEQ ID NO: 5108230 - DNA, 20 bp, Homo sapiens
aagttgtttcaaacagcatc

SEQ ID NO: 5108231 - DNA, 18 bp, Homo sapiens
aagttgtttcattgattt

SEQ ID NO: 5108232 - DNA, 23 bp, Homo sapiens
aagttgtttcattgatttagtaa

SEQ ID NO: 5108233 - DNA, 12 bp, Homo sapiens
aagttgtttgag

SEQ ID NO: 5108234 - DNA, 15 bp, Homo sapiens
aagttgtttgagaaa

SEQ ID NO: 5108235 - DNA, 18 bp, Homo sapiens
aagttgttttacagctgt

SEQ ID NO: 5108236 - DNA, 17 bp, Homo sapiens
aagttgttttatctttt

SEQ ID NO: 5108237 - DNA, 16 bp, Homo sapiens
aagtttaaaaaataca

SEQ ID NO: 5108238 - DNA, 12 bp, Homo sapiens
aagtttaaaaca

SEQ ID NO: 5108239 - DNA, 14 bp, Homo sapiens
aagtttaaaaccca

SEQ ID NO: 5108240 - DNA, 20 bp, Homo sapiens
aagtttaaaacccaaacttc

SEQ ID NO: 5108241 - DNA, 14 bp, Homo sapiens
aagtttaaaatgta

SEQ ID NO: 5108242 - DNA, 17 bp, Homo sapiens
aagtttaaaatgtataa

SEQ ID NO: 5108243 - DNA, 12 bp, Homo sapiens
aagtttaaatac

SEQ ID NO: 5108244 - DNA, 23 bp, Homo sapiens
aagtttaaatctttgttaaaata

SEQ ID NO: 5108245 - DNA, 12 bp, Homo sapiens
aagtttaaatgt

SEQ ID NO: 5108246 - DNA, 20 bp, Homo sapiens
aagtttaaatgtattttaca

SEQ ID NO: 5108247 - DNA, 15 bp, Homo sapiens
aagtttaaggaatat

SEQ ID NO: 5108248 - DNA, 23 bp, Homo sapiens
aagtttaaggaatatgggagaaa

SEQ ID NO: 5108249 - DNA, 17 bp, Homo sapiens
aagtttaatattaaagc

SEQ ID NO: 5108250 - DNA, 18 bp, Homo sapiens
aagtttaatattaaagcc

SEQ ID NO: 5108251 - DNA, 20 bp, Homo sapiens
aagtttaatattaaagccat

SEQ ID NO: 5108252 - DNA, 14 bp, Homo sapiens
aagtttacaacttg

SEQ ID NO: 5108253 - DNA, 18 bp, Homo sapiens
aagtttacaagtgtatat

SEQ ID NO: 5108254 - DNA, 18 bp, Homo sapiens
aagtttacaatcaaagga

SEQ ID NO: 5108255 - DNA, 15 bp, Homo sapiens
aagtttacacttcat

SEQ ID NO: 5108256 - DNA, 18 bp, Homo sapiens
aagtttacagtaaataaa

SEQ ID NO: 5108257 - DNA, 19 bp, Homo sapiens
aagtttacagtaaataaat

SEQ ID NO: 5108258 - DNA, 22 bp, Homo sapiens
aagtttacagtaaataaattgt

SEQ ID NO: 5108259 - DNA, 22 bp, Homo sapiens
aagtttacattgtcctgtagct

SEQ ID NO: 5108260 - DNA, 23 bp, Homo sapiens
aagtttacatttttatttatgaa

SEQ ID NO: 5108261 - DNA, 16 bp, Homo sapiens
aagtttaccagaaagc

SEQ ID NO: 5108262 - DNA, 14 bp, Homo sapiens
aagtttaccatctg

SEQ ID NO: 5108263 - DNA, 18 bp, Homo sapiens
aagtttactccttctgtt

SEQ ID NO: 5108264 - DNA, 18 bp, Homo sapiens
aagtttagaaattacaag

SEQ ID NO: 5108265 - DNA, 11 bp, Homo sapiens
aagtttagaga

SEQ ID NO: 5108266 - DNA, 15 bp, Homo sapiens
aagtttaggtcgagg

SEQ ID NO: 5108267 - DNA, 20 bp, Homo sapiens
aagtttatggccttgaagtg

SEQ ID NO: 5108268 - DNA, 16 bp, Homo sapiens
aagtttatgtctaaag

SEQ ID NO: 5108269 - DNA, 14 bp, Homo sapiens
aagtttatgtctca

SEQ ID NO: 5108270 - DNA, 17 bp, Homo sapiens
aagtttattattttcaa

SEQ ID NO: 5108271 - DNA, 14 bp, Homo sapiens
aagtttattcagta

SEQ ID NO: 5108272 - DNA, 22 bp, Homo sapiens
aagtttattgtaaaagtgacat

SEQ ID NO: 5108273 - DNA, 15 bp, Homo sapiens
aagtttattgtttga

SEQ ID NO: 5108274 - DNA, 14 bp, Homo sapiens
aagtttatttcatg

SEQ ID NO: 5108275 - DNA, 18 bp, Homo sapiens
aagtttatttgagaaaat

SEQ ID NO: 5108276 - DNA, 22 bp, Homo sapiens
aagtttcaaacttactattttg

SEQ ID NO: 5108277 - DNA, 19 bp, Homo sapiens
aagtttcaagttttaaagt

SEQ ID NO: 5108278 - DNA, 20 bp, Homo sapiens
aagtttcaagttttaaagtt

SEQ ID NO: 5108279 - DNA, 22 bp, Homo sapiens
aagtttcaatgtgattctaatg

SEQ ID NO: 5108280 - DNA, 20 bp, Homo sapiens
aagtttcacaggtcaataaa

SEQ ID NO: 5108281 - DNA, 21 bp, Homo sapiens
aagtttcacaggtcaataaac

SEQ ID NO: 5108282 - DNA, 13 bp, Homo sapiens
aagtttcacctgt

SEQ ID NO: 5108283 - DNA, 14 bp, Homo sapiens
aagtttcagacagg

SEQ ID NO: 5108284 - DNA, 12 bp, Homo sapiens
aagtttcaggtg

SEQ ID NO: 5108285 - DNA, 19 bp, Homo sapiens
aagtttcaggtgacatgtg

SEQ ID NO: 5108286 - DNA, 16 bp, Homo sapiens
aagtttccaagcaaat

SEQ ID NO: 5108287 - DNA, 19 bp, Homo sapiens
aagtttccaagcaaatgtt

SEQ ID NO: 5108288 - DNA, 20 bp, Homo sapiens
aagtttccaagcaaatgtta

SEQ ID NO: 5108289 - DNA, 24 bp, Homo sapiens
aagtttccaagcaaatgttacata

SEQ ID NO: 5108290 - DNA, 19 bp, Homo sapiens
aagtttcccctctggcttg

SEQ ID NO: 5108291 - DNA, 22 bp, Homo sapiens
aagtttcccgccaggaggtcct

SEQ ID NO: 5108292 - DNA, 21 bp, Homo sapiens
aagtttcctaatcagaaattt

SEQ ID NO: 5108293 - DNA, 20 bp, Homo sapiens
aagtttccttccagcccaga

SEQ ID NO: 5108294 - DNA, 20 bp, Homo sapiens
aagtttccttggctggtgca

SEQ ID NO: 5108295 - DNA, 19 bp, Homo sapiens
aagtttccttttaattcta

SEQ ID NO: 5108296 - DNA, 17 bp, Homo sapiens
aagtttcgaggggtcct

SEQ ID NO: 5108297 - DNA, 13 bp, Homo sapiens
aagtttctaagat

SEQ ID NO: 5108298 - DNA, 16 bp, Homo sapiens
aagtttctaagattct

SEQ ID NO: 5108299 - DNA, 18 bp, Homo sapiens
aagtttctaagattctaa

SEQ ID NO: 5108300 - DNA, 19 bp, Homo sapiens
aagtttctaagattctaaa

SEQ ID NO: 5108301 - DNA, 12 bp, Homo sapiens
aagtttctagaa

SEQ ID NO: 5108302 - DNA, 19 bp, Homo sapiens
aagtttctagctagaaata

SEQ ID NO: 5108303 - DNA, 21 bp, Homo sapiens
aagtttctagctagaaatatg

SEQ ID NO: 5108304 - DNA, 17 bp, Homo sapiens
aagtttctattctgtca

SEQ ID NO: 5108305 - DNA, 15 bp, Homo sapiens
aagtttctctgcaga

SEQ ID NO: 5108306 - DNA, 17 bp, Homo sapiens
aagtttctgaatatttt

SEQ ID NO: 5108307 - DNA, 19 bp, Homo sapiens
aagtttctgccgcagccct

SEQ ID NO: 5108308 - DNA, 17 bp, Homo sapiens
aagtttctggtgccatt

SEQ ID NO: 5108309 - DNA, 15 bp, Homo sapiens
aagtttctttagaaa

SEQ ID NO: 5108310 - DNA, 22 bp, Homo sapiens
aagtttctttgaaaatagttat

SEQ ID NO: 5108311 - DNA, 20 bp, Homo sapiens
aagtttgaaaagcaatattg

SEQ ID NO: 5108312 - DNA, 17 bp, Homo sapiens
aagtttgaaatatatta

SEQ ID NO: 5108313 - DNA, 14 bp, Homo sapiens
aagtttgaatgtta

SEQ ID NO: 5108314 - DNA, 15 bp, Homo sapiens
aagtttgaatgttaa

SEQ ID NO: 5108315 - DNA, 21 bp, Homo sapiens
aagtttgaattcctaaaatta

SEQ ID NO: 5108316 - DNA, 21 bp, Homo sapiens
aagtttgacttgtataacatc

SEQ ID NO: 5108317 - DNA, 17 bp, Homo sapiens
aagtttgataaatagtg

SEQ ID NO: 5108318 - DNA, 12 bp, Homo sapiens
aagtttgatctt

SEQ ID NO: 5108319 - DNA, 16 bp, Homo sapiens
aagtttgatttcatta

SEQ ID NO: 5108320 - DNA, 15 bp, Homo sapiens
aagtttgatttttgt

SEQ ID NO: 5108321 - DNA, 11 bp, Homo sapiens
aagtttgcaac

SEQ ID NO: 5108322 - DNA, 17 bp, Homo sapiens
aagtttgcaacctttat

SEQ ID NO: 5108323 - DNA, 18 bp, Homo sapiens
aagtttgcaacctttata

SEQ ID NO: 5108324 - DNA, 19 bp, Homo sapiens
aagtttgcactatctttca

SEQ ID NO: 5108325 - DNA, 16 bp, Homo sapiens
aagtttgccctggatg

SEQ ID NO: 5108326 - DNA, 13 bp, Homo sapiens
aagtttgctaaaa

SEQ ID NO: 5108327 - DNA, 14 bp, Homo sapiens
aagtttgctagtga

SEQ ID NO: 5108328 - DNA, 16 bp, Homo sapiens
aagtttgctgaaagat

SEQ ID NO: 5108329 - DNA, 13 bp, Homo sapiens
aagtttgcttaga

SEQ ID NO: 5108330 - DNA, 16 bp, Homo sapiens
aagtttgcttgtttct

SEQ ID NO: 5108331 - DNA, 19 bp, Homo sapiens
aagtttgcttgtttcttgg

SEQ ID NO: 5108332 - DNA, 15 bp, Homo sapiens
aagtttgctttcaga

SEQ ID NO: 5108333 - DNA, 18 bp, Homo sapiens
aagtttgggctaacattt

SEQ ID NO: 5108334 - DNA, 23 bp, Homo sapiens
aagtttggtattgtaaaacattc

SEQ ID NO: 5108335 - DNA, 15 bp, Homo sapiens
aagtttgtacacttt

SEQ ID NO: 5108336 - DNA, 19 bp, Homo sapiens
aagtttgtagttgttttaa

SEQ ID NO: 5108337 - DNA, 18 bp, Homo sapiens
aagtttgtcctttaacta

SEQ ID NO: 5108338 - DNA, 19 bp, Homo sapiens
aagtttgtctacactaaaa

SEQ ID NO: 5108339 - DNA, 12 bp, Homo sapiens
aagtttgtgtca

SEQ ID NO: 5108340 - DNA, 21 bp, Homo sapiens
aagtttgtgttctgtttgtta

SEQ ID NO: 5108341 - DNA, 17 bp, Homo sapiens
aagtttgttactttgaa

SEQ ID NO: 5108342 - DNA, 18 bp, Homo sapiens
aagtttgttactttgaat

SEQ ID NO: 5108343 - DNA, 23 bp, Homo sapiens
aagtttgttagatagctgcatgt

SEQ ID NO: 5108344 - DNA, 21 bp, Homo sapiens
aagtttgttctgcagagactt

SEQ ID NO: 5108345 - DNA, 21 bp, Homo sapiens
aagttttaaacccaaaatata

SEQ ID NO: 5108346 - DNA, 13 bp, Homo sapiens
aagttttaaagtt

SEQ ID NO: 5108347 - DNA, 15 bp, Homo sapiens
aagttttaactatgc

SEQ ID NO: 5108348 - DNA, 18 bp, Homo sapiens
aagttttaacttccagtg

SEQ ID NO: 5108349 - DNA, 21 bp, Homo sapiens
aagttttaactttaatacagc

SEQ ID NO: 5108350 - DNA, 14 bp, Homo sapiens
aagttttaatgtat

SEQ ID NO: 5108351 - DNA, 11 bp, Homo sapiens
aagttttagtc

SEQ ID NO: 5108352 - DNA, 16 bp, Homo sapiens
aagttttagttaaaac

SEQ ID NO: 5108353 - DNA, 20 bp, Homo sapiens
aagttttagttaaaactcat

SEQ ID NO: 5108354 - DNA, 20 bp, Homo sapiens
aagttttatacataaacagt

SEQ ID NO: 5108355 - DNA, 14 bp, Homo sapiens
aagttttatatatt

SEQ ID NO: 5108356 - DNA, 13 bp, Homo sapiens
aagttttatatgc

SEQ ID NO: 5108357 - DNA, 16 bp, Homo sapiens
aagttttcaaattatt

SEQ ID NO: 5108358 - DNA, 23 bp, Homo sapiens
aagttttcagaacctcttcccca

SEQ ID NO: 5108359 - DNA, 11 bp, Homo sapiens
aagttttcagg

SEQ ID NO: 5108360 - DNA, 16 bp, Homo sapiens
aagttttccagtattg

SEQ ID NO: 5108361 - DNA, 16 bp, Homo sapiens
aagttttccctgaagt

SEQ ID NO: 5108362 - DNA, 22 bp, Homo sapiens
aagttttcccttgaggaaacaa

SEQ ID NO: 5108363 - DNA, 21 bp, Homo sapiens
aagttttctgtagtcatttac

SEQ ID NO: 5108364 - DNA, 15 bp, Homo sapiens
aagttttcttttact

SEQ ID NO: 5108365 - DNA, 23 bp, Homo sapiens
aagttttgagtagatattacttt

SEQ ID NO: 5108366 - DNA, 17 bp, Homo sapiens
aagttttgcacttttgt

SEQ ID NO: 5108367 - DNA, 20 bp, Homo sapiens
aagttttgccccatgataaa

SEQ ID NO: 5108368 - DNA, 20 bp, Homo sapiens
aagttttgctagtgtgcttt

SEQ ID NO: 5108369 - DNA, 17 bp, Homo sapiens
aagttttggcagccatg

SEQ ID NO: 5108370 - DNA, 14 bp, Homo sapiens
aagttttgtacaga

SEQ ID NO: 5108371 - DNA, 14 bp, Homo sapiens
aagttttgtcagaa

SEQ ID NO: 5108372 - DNA, 11 bp, Homo sapiens
aagttttgtga

SEQ ID NO: 5108373 - DNA, 13 bp, Homo sapiens
aagttttgtgaaa

SEQ ID NO: 5108374 - DNA, 14 bp, Homo sapiens
aagttttgtgaaat

SEQ ID NO: 5108375 - DNA, 18 bp, Homo sapiens
aagttttgtgaaattttt

SEQ ID NO: 5108376 - DNA, 19 bp, Homo sapiens
aagttttgtgaaatttttc

SEQ ID NO: 5108377 - DNA, 13 bp, Homo sapiens
aagttttgttctt

SEQ ID NO: 5108378 - DNA, 12 bp, Homo sapiens
aagttttgttgt

SEQ ID NO: 5108379 - DNA, 13 bp, Homo sapiens
aagttttgttgta

SEQ ID NO: 5108380 - DNA, 22 bp, Homo sapiens
aagttttgttgtacttaaatgg

SEQ ID NO: 5108381 - DNA, 16 bp, Homo sapiens
aagttttgtttcctca

SEQ ID NO: 5108382 - DNA, 14 bp, Homo sapiens
aagttttgttttcc

SEQ ID NO: 5108383 - DNA, 14 bp, Homo sapiens
aagtttttaaaaat

SEQ ID NO: 5108384 - DNA, 16 bp, Homo sapiens
aagtttttaaaaataa

SEQ ID NO: 5108385 - DNA, 18 bp, Homo sapiens
aagtttttaaaaataaag

SEQ ID NO: 5108386 - DNA, 11 bp, Homo sapiens
aagtttttaat

SEQ ID NO: 5108387 - DNA, 16 bp, Homo sapiens
aagtttttattttaaa

SEQ ID NO: 5108388 - DNA, 16 bp, Homo sapiens
aagtttttcatactgt

SEQ ID NO: 5108389 - DNA, 17 bp, Homo sapiens
aagtttttcatactgta

SEQ ID NO: 5108390 - DNA, 18 bp, Homo sapiens
aagtttttcatactgtac

SEQ ID NO: 5108391 - DNA, 14 bp, Homo sapiens
aagtttttctctca

SEQ ID NO: 5108392 - DNA, 12 bp, Homo sapiens
aagtttttctga

SEQ ID NO: 5108393 - DNA, 18 bp, Homo sapiens
aagtttttgaaatacctt

SEQ ID NO: 5108394 - DNA, 12 bp, Homo sapiens
aagtttttgctt

SEQ ID NO: 5108395 - DNA, 16 bp, Homo sapiens
aagttttttactttgg

SEQ ID NO: 5108396 - DNA, 20 bp, Homo sapiens
aagttttttatactgcactt

SEQ ID NO: 5108397 - DNA, 22 bp, Homo sapiens
aagttttttcctccctgcttaa

SEQ ID NO: 5108398 - DNA, 16 bp, Homo sapiens
aagtttttttatttct

SEQ ID NO: 5108399 - DNA, 23 bp, Homo sapiens
aagtttttttgctgctgcctctt

SEQ ID NO: 5108400 - DNA, 19 bp, Homo sapiens
aataaaaaaaaaaggatga

SEQ ID NO: 5108401 - DNA, 14 bp, Homo sapiens
aataaaaaaaaacc

SEQ ID NO: 5108402 - DNA, 15 bp, Homo sapiens
aataaaaaaaagaaa

SEQ ID NO: 5108403 - DNA, 18 bp, Homo sapiens
aataaaaaaaagaaaaaa

SEQ ID NO: 5108404 - DNA, 14 bp, Homo sapiens
aataaaaaaagaaa

SEQ ID NO: 5108405 - DNA, 14 bp, Homo sapiens
aataaaaaaataca

SEQ ID NO: 5108406 - DNA, 18 bp, Homo sapiens
aataaaaaaatacagtaa

SEQ ID NO: 5108407 - DNA, 21 bp, Homo sapiens
aataaaaaaatacagtaaagt

SEQ ID NO: 5108408 - DNA, 16 bp, Homo sapiens
aataaaaaacagaaac

SEQ ID NO: 5108409 - DNA, 17 bp, Homo sapiens
aataaaaaacatttgta

SEQ ID NO: 5108410 - DNA, 13 bp, Homo sapiens
aataaaaaagatt

SEQ ID NO: 5108411 - DNA, 14 bp, Homo sapiens
aataaaaaagcaaa

SEQ ID NO: 5108412 - DNA, 15 bp, Homo sapiens
aataaaaaagtctct

SEQ ID NO: 5108413 - DNA, 15 bp, Homo sapiens
aataaaaaatagaca

SEQ ID NO: 5108414 - DNA, 16 bp, Homo sapiens
aataaaaaatagacat

SEQ ID NO: 5108415 - DNA, 18 bp, Homo sapiens
aataaaaaatctgaagag

SEQ ID NO: 5108416 - DNA, 21 bp, Homo sapiens
aataaaaaatctgaagaggct

SEQ ID NO: 5108417 - DNA, 17 bp, Homo sapiens
aataaaaaatgaaaaga

SEQ ID NO: 5108418 - DNA, 16 bp, Homo sapiens
aataaaaaatggctga

SEQ ID NO: 5108419 - DNA, 14 bp, Homo sapiens
aataaaaaattatg

SEQ ID NO: 5108420 - DNA, 16 bp, Homo sapiens
aataaaaaattatgac

SEQ ID NO: 5108421 - DNA, 21 bp, Homo sapiens
aataaaaaattatgacaatgt

SEQ ID NO: 5108422 - DNA, 13 bp, Homo sapiens
aataaaaacaact

SEQ ID NO: 5108423 - DNA, 13 bp, Homo sapiens
aataaaaaccaga

SEQ ID NO: 5108424 - DNA, 15 bp, Homo sapiens
aataaaaaccagaat

SEQ ID NO: 5108425 - DNA, 21 bp, Homo sapiens
aataaaaacccacaaaaatgt

SEQ ID NO: 5108426 - DNA, 15 bp, Homo sapiens
aataaaaaccttcca

SEQ ID NO: 5108427 - DNA, 13 bp, Homo sapiens
aataaaaagcttt

SEQ ID NO: 5108428 - DNA, 18 bp, Homo sapiens
aataaaaagcttttgtct

SEQ ID NO: 5108429 - DNA, 11 bp, Homo sapiens
aataaaaagga

SEQ ID NO: 5108430 - DNA, 14 bp, Homo sapiens
aataaaaaggaaat

SEQ ID NO: 5108431 - DNA, 11 bp, Homo sapiens
aataaaaaggc

SEQ ID NO: 5108432 - DNA, 13 bp, Homo sapiens
aataaaaaggtga

SEQ ID NO: 5108433 - DNA, 12 bp, Homo sapiens
aataaaaaggtt

SEQ ID NO: 5108434 - DNA, 12 bp, Homo sapiens
aataaaaagtta

SEQ ID NO: 5108435 - DNA, 15 bp, Homo sapiens
aataaaaataaattc

SEQ ID NO: 5108436 - DNA, 15 bp, Homo sapiens
aataaaaatacacat

SEQ ID NO: 5108437 - DNA, 13 bp, Homo sapiens
aataaaaatagct

SEQ ID NO: 5108438 - DNA, 11 bp, Homo sapiens
aataaaaatat

SEQ ID NO: 5108439 - DNA, 16 bp, Homo sapiens
aataaaaatgctataa

SEQ ID NO: 5108440 - DNA, 13 bp, Homo sapiens
aataaaaattcta

SEQ ID NO: 5108441 - DNA, 21 bp, Homo sapiens
aataaaaattgtagcttttta

SEQ ID NO: 5108442 - DNA, 13 bp, Homo sapiens
aataaaacaaagg

SEQ ID NO: 5108443 - DNA, 11 bp, Homo sapiens
aataaaacaac

SEQ ID NO: 5108444 - DNA, 13 bp, Homo sapiens
aataaaacaagcc

SEQ ID NO: 5108445 - DNA, 15 bp, Homo sapiens
aataaaacaatgttt

SEQ ID NO: 5108446 - DNA, 21 bp, Homo sapiens
aataaaacagctgtctctaac

SEQ ID NO: 5108447 - DNA, 17 bp, Homo sapiens
aataaaacagtatctct

SEQ ID NO: 5108448 - DNA, 11 bp, Homo sapiens
aataaaacata

SEQ ID NO: 5108449 - DNA, 12 bp, Homo sapiens
aataaaacatta

SEQ ID NO: 5108450 - DNA, 20 bp, Homo sapiens
aataaaacccagcatgtaca

SEQ ID NO: 5108451 - DNA, 22 bp, Homo sapiens
aataaaacctcagctagctctg

SEQ ID NO: 5108452 - DNA, 15 bp, Homo sapiens
aagtatttatatatt

SEQ ID NO: 5108453 - DNA, 22 bp, Homo sapiens
aagtatttatatatttataact

SEQ ID NO: 5108454 - DNA, 13 bp, Homo sapiens
aagtatttcaaat

SEQ ID NO: 5108455 - DNA, 12 bp, Homo sapiens
aagtatttcatg

SEQ ID NO: 5108456 - DNA, 11 bp, Homo sapiens
aagtatttctg

SEQ ID NO: 5108457 - DNA, 14 bp, Homo sapiens
aagtatttgatgta

SEQ ID NO: 5108458 - DNA, 20 bp, Homo sapiens
aagtatttgttaatttagaa

SEQ ID NO: 5108459 - DNA, 21 bp, Homo sapiens
aagtatttgttaatttagaaa

SEQ ID NO: 5108460 - DNA, 12 bp, Homo sapiens
aagtattttaat

SEQ ID NO: 5108461 - DNA, 17 bp, Homo sapiens
aagtattttcataagta

SEQ ID NO: 5108462 - DNA, 14 bp, Homo sapiens
aagtattttcctcc

SEQ ID NO: 5108463 - DNA, 14 bp, Homo sapiens
aagtattttcctgt

SEQ ID NO: 5108464 - DNA, 13 bp, Homo sapiens
aagtattttcttt

SEQ ID NO: 5108465 - DNA, 16 bp, Homo sapiens
aagtattttgaagttt

SEQ ID NO: 5108466 - DNA, 20 bp, Homo sapiens
aagtattttgaagtttacat

SEQ ID NO: 5108467 - DNA, 19 bp, Homo sapiens
aagtatttttataaatata

SEQ ID NO: 5108468 - DNA, 19 bp, Homo sapiens
aagtatttttataatgact

SEQ ID NO: 5108469 - DNA, 22 bp, Homo sapiens
aagtatttttgattaacaatgt

SEQ ID NO: 5108470 - DNA, 24 bp, Homo sapiens
aagtatttttgattaacaatgtat

SEQ ID NO: 5108471 - DNA, 19 bp, Homo sapiens
aagtattttttcagtatta

SEQ ID NO: 5108472 - DNA, 18 bp, Homo sapiens
aagtatttttttaagtta

SEQ ID NO: 5108473 - DNA, 23 bp, Homo sapiens
aagtatttttttaagttagagaa

SEQ ID NO: 5108474 - DNA, 21 bp, Homo sapiens
aagtatttttttaatttctga

SEQ ID NO: 5108475 - DNA, 19 bp, Homo sapiens
aagtcaaaaggaacaaaaa

SEQ ID NO: 5108476 - DNA, 22 bp, Homo sapiens
aagtcaaaatatttttaaaaga

SEQ ID NO: 5108477 - DNA, 19 bp, Homo sapiens
aagtcaaacacttgtgact

SEQ ID NO: 5108478 - DNA, 13 bp, Homo sapiens
aagtcaaactact

SEQ ID NO: 5108479 - DNA, 14 bp, Homo sapiens
aagtcaaagtaaaa

SEQ ID NO: 5108480 - DNA, 22 bp, Homo sapiens
aagtcaaagtaaaacttgctgc

SEQ ID NO: 5108481 - DNA, 18 bp, Homo sapiens
aagtcaaagtgttgctgt

SEQ ID NO: 5108482 - DNA, 16 bp, Homo sapiens
aagtcaaataaatgtt

SEQ ID NO: 5108483 - DNA, 15 bp, Homo sapiens
aagtcaaatgccaaa

SEQ ID NO: 5108484 - DNA, 17 bp, Homo sapiens
aagtcaaatttacttta

SEQ ID NO: 5108485 - DNA, 20 bp, Homo sapiens
aagtcaacactatatatttt

SEQ ID NO: 5108486 - DNA, 16 bp, Homo sapiens
aagtcaacagtaaacc

SEQ ID NO: 5108487 - DNA, 17 bp, Homo sapiens
aagtcaacagtaaacca

SEQ ID NO: 5108488 - DNA, 16 bp, Homo sapiens
aagtcaacctgcctga

SEQ ID NO: 5108489 - DNA, 13 bp, Homo sapiens
aagtcaagcacat

SEQ ID NO: 5108490 - DNA, 13 bp, Homo sapiens
aagtcaaggagaa

SEQ ID NO: 5108491 - DNA, 13 bp, Homo sapiens
aagtcaaggctta

SEQ ID NO: 5108492 - DNA, 12 bp, Homo sapiens
aagtcaagtcta

SEQ ID NO: 5108493 - DNA, 21 bp, Homo sapiens
aagtcaagtgaaaaaggagga

SEQ ID NO: 5108494 - DNA, 22 bp, Homo sapiens
aagtcaataaaagagctgtctg

SEQ ID NO: 5108495 - DNA, 19 bp, Homo sapiens
aagtcaatattgattttaa

SEQ ID NO: 5108496 - DNA, 17 bp, Homo sapiens
aagtcaatcatttctca

SEQ ID NO: 5108497 - DNA, 18 bp, Homo sapiens
aagtcaatcatttctcac

SEQ ID NO: 5108498 - DNA, 17 bp, Homo sapiens
aagtcaattcagttcta

SEQ ID NO: 5108499 - DNA, 23 bp, Homo sapiens
aagtcaattccacccctcctcga

SEQ ID NO: 5108500 - DNA, 21 bp, Homo sapiens
aagtcacaacaaaaggaagac

SEQ ID NO: 5108501 - DNA, 12 bp, Homo sapiens
aagtcacacaga

SEQ ID NO: 5108502 - DNA, 12 bp, Homo sapiens
aagtcacacagc

SEQ ID NO: 5108503 - DNA, 13 bp, Homo sapiens
aagtcacacagct

SEQ ID NO: 5108504 - DNA, 15 bp, Homo sapiens
aagtcacagattctt

SEQ ID NO: 5108505 - DNA, 18 bp, Homo sapiens
aagtcacagccgtttgaa

SEQ ID NO: 5108506 - DNA, 12 bp, Homo sapiens
aagtcacagctg

SEQ ID NO: 5108507 - DNA, 17 bp, Homo sapiens
aagtcacagctgcagct

SEQ ID NO: 5108508 - DNA, 15 bp, Homo sapiens
aagtcacagggcagt

SEQ ID NO: 5108509 - DNA, 23 bp, Homo sapiens
aagtcacagggcagtacctgagg

SEQ ID NO: 5108510 - DNA, 23 bp, Homo sapiens
aagtcacatatcagaataggaag

SEQ ID NO: 5108511 - DNA, 17 bp, Homo sapiens
aagtcacatcacaggac

SEQ ID NO: 5108512 - DNA, 14 bp, Homo sapiens
aagtcacatccctg

SEQ ID NO: 5108513 - DNA, 22 bp, Homo sapiens
aagtcacatccctgtaaattgc

SEQ ID NO: 5108514 - DNA, 13 bp, Homo sapiens
aagtcaccaaaat

SEQ ID NO: 5108515 - DNA, 17 bp, Homo sapiens
aagtcaccattctgcat

SEQ ID NO: 5108516 - DNA, 20 bp, Homo sapiens
aagtcaccattctgcattta

SEQ ID NO: 5108517 - DNA, 22 bp, Homo sapiens
aagtcaccattctgcatttagc

SEQ ID NO: 5108518 - DNA, 20 bp, Homo sapiens
aagtcacccaaacacttctg

SEQ ID NO: 5108519 - DNA, 12 bp, Homo sapiens
aagtcacccagg

SEQ ID NO: 5108520 - DNA, 17 bp, Homo sapiens
aagtcacccctttctgt

SEQ ID NO: 5108521 - DNA, 22 bp, Homo sapiens
aagtcacccctttctgtcccac

SEQ ID NO: 5108522 - DNA, 21 bp, Homo sapiens
aagtcacccggcccccatgca

SEQ ID NO: 5108523 - DNA, 14 bp, Homo sapiens
aagtcaccggagct

SEQ ID NO: 5108524 - DNA, 17 bp, Homo sapiens
aagtcacctacaggact

SEQ ID NO: 5108525 - DNA, 18 bp, Homo sapiens
aagtcacctacaggactg

SEQ ID NO: 5108526 - DNA, 19 bp, Homo sapiens
aagtcaccttgtgtgttcc

SEQ ID NO: 5108527 - DNA, 18 bp, Homo sapiens
aagtcacctttctgggct

SEQ ID NO: 5108528 - DNA, 20 bp, Homo sapiens
aagtcacggtctaaacacac

SEQ ID NO: 5108529 - DNA, 20 bp, Homo sapiens
aagtcactaaatttctcagt

SEQ ID NO: 5108530 - DNA, 21 bp, Homo sapiens
aagtcactagaagtcctgctg

SEQ ID NO: 5108531 - DNA, 16 bp, Homo sapiens
aagtcactcaattgtt

SEQ ID NO: 5108532 - DNA, 21 bp, Homo sapiens
aagtcactcaattgtttttgt

SEQ ID NO: 5108533 - DNA, 18 bp, Homo sapiens
aagtcactcacactggcc

SEQ ID NO: 5108534 - DNA, 19 bp, Homo sapiens
aagtcactcacactggcca

SEQ ID NO: 5108535 - DNA, 21 bp, Homo sapiens
aagtcactgacatcagcactg

SEQ ID NO: 5108536 - DNA, 22 bp, Homo sapiens
aagtcactgacatcagcactgc

SEQ ID NO: 5108537 - DNA, 21 bp, Homo sapiens
aagtcactggccagtggctgg

SEQ ID NO: 5108538 - DNA, 13 bp, Homo sapiens
aagtcacttctcc

SEQ ID NO: 5108539 - DNA, 20 bp, Homo sapiens
aagtcagaaactaaaacaaa

SEQ ID NO: 5108540 - DNA, 18 bp, Homo sapiens
aagtcagaacagcagact

SEQ ID NO: 5108541 - DNA, 12 bp, Homo sapiens
aagtcagaagtt

SEQ ID NO: 5108542 - DNA, 13 bp, Homo sapiens
aagtcagaatttt

SEQ ID NO: 5108543 - DNA, 18 bp, Homo sapiens
aagtcagaatttttaact

SEQ ID NO: 5108544 - DNA, 18 bp, Homo sapiens
aagtcagagaaaacactt

SEQ ID NO: 5108545 - DNA, 19 bp, Homo sapiens
aagtcagagaaaacacttt

SEQ ID NO: 5108546 - DNA, 12 bp, Homo sapiens
aagtcagagaca

SEQ ID NO: 5108547 - DNA, 21 bp, Homo sapiens
aagtcagaggatggccagtgt

SEQ ID NO: 5108548 - DNA, 17 bp, Homo sapiens
aagtcagagttaaaata

SEQ ID NO: 5108549 - DNA, 21 bp, Homo sapiens
aagtcagagttaaaatatata

SEQ ID NO: 5108550 - DNA, 21 bp, Homo sapiens
aagtcagatctgcctaaggac

SEQ ID NO: 5108551 - DNA, 15 bp, Homo sapiens
aagtcagattgctgg

SEQ ID NO: 5108552 - DNA, 22 bp, Homo sapiens
aagtcagccacactgggcctgg

SEQ ID NO: 5108553 - DNA, 16 bp, Homo sapiens
aagtcagcctacataa

SEQ ID NO: 5108554 - DNA, 22 bp, Homo sapiens
aagtcagctccagctttctgcc

SEQ ID NO: 5108555 - DNA, 18 bp, Homo sapiens
aagtcagctcttctccat

SEQ ID NO: 5108556 - DNA, 19 bp, Homo sapiens
aagtcagctttgccttcca

SEQ ID NO: 5108557 - DNA, 16 bp, Homo sapiens
aagtcaggaatcatca

SEQ ID NO: 5108558 - DNA, 13 bp, Homo sapiens
aagtcaggagcca

SEQ ID NO: 5108559 - DNA, 21 bp, Homo sapiens
aagtcaggcccttattttcaa

SEQ ID NO: 5108560 - DNA, 18 bp, Homo sapiens
aagtcaggctagctgtgc

SEQ ID NO: 5108561 - DNA, 20 bp, Homo sapiens
aagtcaggctagctgtgctg

SEQ ID NO: 5108562 - DNA, 18 bp, Homo sapiens
aagtcaggtgcagtccca

SEQ ID NO: 5108563 - DNA, 14 bp, Homo sapiens
aagtcaggtggggt

SEQ ID NO: 5108564 - DNA, 17 bp, Homo sapiens
aagtcagtacccaccac

SEQ ID NO: 5108565 - DNA, 19 bp, Homo sapiens
aagtcagtcaacatttaca

SEQ ID NO: 5108566 - DNA, 21 bp, Homo sapiens
aagtcagtgcccaactgttat

SEQ ID NO: 5108567 - DNA, 18 bp, Homo sapiens
aagtcagtgggaacgtga

SEQ ID NO: 5108568 - DNA, 16 bp, Homo sapiens
aagtcagtgttgagat

SEQ ID NO: 5108569 - DNA, 17 bp, Homo sapiens
aagtcagttaacgtcac

SEQ ID NO: 5108570 - DNA, 20 bp, Homo sapiens
aagtcataaacagcatttat

SEQ ID NO: 5108571 - DNA, 14 bp, Homo sapiens
aagtcataattgca

SEQ ID NO: 5108572 - DNA, 13 bp, Homo sapiens
aagtcatcaaagt

SEQ ID NO: 5108573 - DNA, 16 bp, Homo sapiens
aagtcatcaaagtggg

SEQ ID NO: 5108574 - DNA, 13 bp, Homo sapiens
aagtcatcataaa

SEQ ID NO: 5108575 - DNA, 14 bp, Homo sapiens
aagtcatctactta

SEQ ID NO: 5108576 - DNA, 21 bp, Homo sapiens
aagtcatctatagttgatatg

SEQ ID NO: 5108577 - DNA, 13 bp, Homo sapiens
aagtcatctttga

SEQ ID NO: 5108578 - DNA, 23 bp, Homo sapiens
aagtcatctttgagataatttaa

SEQ ID NO: 5108579 - DNA, 23 bp, Homo sapiens
aagtcatgaagcccaagtgaaat

SEQ ID NO: 5108580 - DNA, 21 bp, Homo sapiens
aagtcatgaagctcagtttgg

SEQ ID NO: 5108581 - DNA, 17 bp, Homo sapiens
aagtcatgatgttttta

SEQ ID NO: 5108582 - DNA, 21 bp, Homo sapiens
aagtcatgatgtttttaaaat

SEQ ID NO: 5108583 - DNA, 19 bp, Homo sapiens
aagtcatgcaaaggctggg

SEQ ID NO: 5108584 - DNA, 20 bp, Homo sapiens
aagtcatgcaaaggctggga

SEQ ID NO: 5108585 - DNA, 21 bp, Homo sapiens
aagtcatgcgtttaatcacat

SEQ ID NO: 5108586 - DNA, 15 bp, Homo sapiens
aagtcatgctcccct

SEQ ID NO: 5108587 - DNA, 18 bp, Homo sapiens
aagtcatggacattcatg

SEQ ID NO: 5108588 - DNA, 20 bp, Homo sapiens
aagtcatggcaggtacagta

SEQ ID NO: 5108589 - DNA, 19 bp, Homo sapiens
aagtcatgggagaagaggg

SEQ ID NO: 5108590 - DNA, 17 bp, Homo sapiens
aagtcatgtatgtttct

SEQ ID NO: 5108591 - DNA, 17 bp, Homo sapiens
aagtcatgtgtgaacac

SEQ ID NO: 5108592 - DNA, 14 bp, Homo sapiens
aagtcattaaactg

SEQ ID NO: 5108593 - DNA, 17 bp, Homo sapiens
aagtcattaaactggtt

SEQ ID NO: 5108594 - DNA, 22 bp, Homo sapiens
aagtcattgctgacagagccct

SEQ ID NO: 5108595 - DNA, 12 bp, Homo sapiens
aagtcattgttt

SEQ ID NO: 5108596 - DNA, 12 bp, Homo sapiens
aagtcatttaaa

SEQ ID NO: 5108597 - DNA, 13 bp, Homo sapiens
aagtcatttcaaa

SEQ ID NO: 5108598 - DNA, 14 bp, Homo sapiens
aagtcatttgtgaa

SEQ ID NO: 5108599 - DNA, 22 bp, Homo sapiens
aagtcattttaactttatcaca

SEQ ID NO: 5108600 - DNA, 15 bp, Homo sapiens
aagtcattttaataa

SEQ ID NO: 5108601 - DNA, 15 bp, Homo sapiens
aagtcattttcatgt

SEQ ID NO: 5108602 - DNA, 17 bp, Homo sapiens
aagtcatttttgtattt

SEQ ID NO: 5108603 - DNA, 18 bp, Homo sapiens
aagtcatttttgtatttt

SEQ ID NO: 5108604 - DNA, 15 bp, Homo sapiens
aagtcattttttact

SEQ ID NO: 5108605 - DNA, 16 bp, Homo sapiens
aagtcattttttactt

SEQ ID NO: 5108606 - DNA, 19 bp, Homo sapiens
aagtcattttttacttgaa

SEQ ID NO: 5108607 - DNA, 12 bp, Homo sapiens
aagtccaaagtc

SEQ ID NO: 5108608 - DNA, 20 bp, Homo sapiens
aagtccaaattgtttgtaca

SEQ ID NO: 5108609 - DNA, 19 bp, Homo sapiens
aagtccaagcaacagcctt

SEQ ID NO: 5108610 - DNA, 17 bp, Homo sapiens
aagtccaagcataccaa

SEQ ID NO: 5108611 - DNA, 18 bp, Homo sapiens
aagtccaagcatttagat

SEQ ID NO: 5108612 - DNA, 14 bp, Homo sapiens
aagtccaataagac

SEQ ID NO: 5108613 - DNA, 15 bp, Homo sapiens
aagtccaataagaca

SEQ ID NO: 5108614 - DNA, 18 bp, Homo sapiens
aagtccaccccaattaac

SEQ ID NO: 5108615 - DNA, 14 bp, Homo sapiens
aagtccactgtcct

SEQ ID NO: 5108616 - DNA, 15 bp, Homo sapiens
aagtccactgtcctc

SEQ ID NO: 5108617 - DNA, 22 bp, Homo sapiens
aagtccacttaaataatcctct

SEQ ID NO: 5108618 - DNA, 17 bp, Homo sapiens
aagtccagctctcccct

SEQ ID NO: 5108619 - DNA, 17 bp, Homo sapiens
aagtccagctttctgca

SEQ ID NO: 5108620 - DNA, 23 bp, Homo sapiens
aagtccaggcttttttatcatgt

SEQ ID NO: 5108621 - DNA, 19 bp, Homo sapiens
aagtccaggtcctggtggg

SEQ ID NO: 5108622 - DNA, 19 bp, Homo sapiens
aagtccaggtcgggctcag

SEQ ID NO: 5108623 - DNA, 17 bp, Homo sapiens
aagtccatcaccctttc

SEQ ID NO: 5108624 - DNA, 17 bp, Homo sapiens
aagtccatctgacaaaa

SEQ ID NO: 5108625 - DNA, 16 bp, Homo sapiens
aagtccatgaatgttc

SEQ ID NO: 5108626 - DNA, 19 bp, Homo sapiens
aagtccattttttaaaaat

SEQ ID NO: 5108627 - DNA, 19 bp, Homo sapiens
aagtcccaccagggaccag

SEQ ID NO: 5108628 - DNA, 12 bp, Homo sapiens
aagtcccaccct

SEQ ID NO: 5108629 - DNA, 20 bp, Homo sapiens
aagtcccaccctcttcccat

SEQ ID NO: 5108630 - DNA, 15 bp, Homo sapiens
aataaaacctttcaa

SEQ ID NO: 5108631 - DNA, 22 bp, Homo sapiens
aataaaacctttcaaatttcac

SEQ ID NO: 5108632 - DNA, 21 bp, Homo sapiens
aataaaactaaatgtgtacac

SEQ ID NO: 5108633 - DNA, 24 bp, Homo sapiens
aataaaactatttaaaattggcac

SEQ ID NO: 5108634 - DNA, 17 bp, Homo sapiens
aataaaactgcacagtg

SEQ ID NO: 5108635 - DNA, 20 bp, Homo sapiens
aataaaactgcacagtgctg

SEQ ID NO: 5108636 - DNA, 12 bp, Homo sapiens
aataaaactgct

SEQ ID NO: 5108637 - DNA, 13 bp, Homo sapiens
aataaaactgcta

SEQ ID NO: 5108638 - DNA, 12 bp, Homo sapiens
aataaaactgtc

SEQ ID NO: 5108639 - DNA, 14 bp, Homo sapiens
aataaaacttatct

SEQ ID NO: 5108640 - DNA, 12 bp, Homo sapiens
aataaaactttt

SEQ ID NO: 5108641 - DNA, 13 bp, Homo sapiens
aataaaagaaaat

SEQ ID NO: 5108642 - DNA, 13 bp, Homo sapiens
aataaaagagaga

SEQ ID NO: 5108643 - DNA, 14 bp, Homo sapiens
aataaaagagcttt

SEQ ID NO: 5108644 - DNA, 16 bp, Homo sapiens
aataaaagataaaaga

SEQ ID NO: 5108645 - DNA, 12 bp, Homo sapiens
aataaaagcaca

SEQ ID NO: 5108646 - DNA, 13 bp, Homo sapiens
aataaaagcacaa

SEQ ID NO: 5108647 - DNA, 11 bp, Homo sapiens
aataaaagcct

SEQ ID NO: 5108648 - DNA, 12 bp, Homo sapiens
aataaaagctat

SEQ ID NO: 5108649 - DNA, 23 bp, Homo sapiens
aataaaagctattacttggcaaa

SEQ ID NO: 5108650 - DNA, 16 bp, Homo sapiens
aataaaaggaaaacca

SEQ ID NO: 5108651 - DNA, 20 bp, Homo sapiens
aataaaaggaagccaaagag

SEQ ID NO: 5108652 - DNA, 18 bp, Homo sapiens
aataaaaggactctggaa

SEQ ID NO: 5108653 - DNA, 20 bp, Homo sapiens
aataaaagtcagagctcagg

SEQ ID NO: 5108654 - DNA, 14 bp, Homo sapiens
aataaaagtgcaca

SEQ ID NO: 5108655 - DNA, 22 bp, Homo sapiens
aataaaagtttacaacttgatt

SEQ ID NO: 5108656 - DNA, 19 bp, Homo sapiens
aataaaagttttacaaagg

SEQ ID NO: 5108657 - DNA, 20 bp, Homo sapiens
aataaaagttttacaaaggg

SEQ ID NO: 5108658 - DNA, 14 bp, Homo sapiens
aataaaataacaga

SEQ ID NO: 5108659 - DNA, 12 bp, Homo sapiens
aataaaataagt

SEQ ID NO: 5108660 - DNA, 16 bp, Homo sapiens
aataaaataattatct

SEQ ID NO: 5108661 - DNA, 19 bp, Homo sapiens
aataaaatagcaattagca

SEQ ID NO: 5108662 - DNA, 14 bp, Homo sapiens
aataaaatataatt

SEQ ID NO: 5108663 - DNA, 21 bp, Homo sapiens
aataaaatataattgtttttt

SEQ ID NO: 5108664 - DNA, 20 bp, Homo sapiens
aataaaatatatcttataaa

SEQ ID NO: 5108665 - DNA, 21 bp, Homo sapiens
aataaaatatcattcagcaac

SEQ ID NO: 5108666 - DNA, 15 bp, Homo sapiens
aataaaatattttct

SEQ ID NO: 5108667 - DNA, 19 bp, Homo sapiens
aataaaatattttctgtgt

SEQ ID NO: 5108668 - DNA, 20 bp, Homo sapiens
aataaaatattttctgtgtg

SEQ ID NO: 5108669 - DNA, 13 bp, Homo sapiens
aataaaatcaatt

SEQ ID NO: 5108670 - DNA, 14 bp, Homo sapiens
aataaaatcatcac

SEQ ID NO: 5108671 - DNA, 13 bp, Homo sapiens
aataaaatgaaaa

SEQ ID NO: 5108672 - DNA, 14 bp, Homo sapiens
aataaaatgaaaaa

SEQ ID NO: 5108673 - DNA, 18 bp, Homo sapiens
aataaaatgaaagggtca

SEQ ID NO: 5108674 - DNA, 15 bp, Homo sapiens
aataaaatgaacatc

SEQ ID NO: 5108675 - DNA, 12 bp, Homo sapiens
aataaaatgatg

SEQ ID NO: 5108676 - DNA, 14 bp, Homo sapiens
aataaaatgatgta

SEQ ID NO: 5108677 - DNA, 19 bp, Homo sapiens
aataaaatgcactgaccat

SEQ ID NO: 5108678 - DNA, 15 bp, Homo sapiens
aataaaatgcattta

SEQ ID NO: 5108679 - DNA, 13 bp, Homo sapiens
aataaaatgtatc

SEQ ID NO: 5108680 - DNA, 21 bp, Homo sapiens
aataaaatgtgatttttctga

SEQ ID NO: 5108681 - DNA, 13 bp, Homo sapiens
aataaaatgtgta

SEQ ID NO: 5108682 - DNA, 16 bp, Homo sapiens
aataaaatgtttacat

SEQ ID NO: 5108683 - DNA, 21 bp, Homo sapiens
aataaaatgtttacattttct

SEQ ID NO: 5108684 - DNA, 23 bp, Homo sapiens
aataaaatgtttacattttcttt

SEQ ID NO: 5108685 - DNA, 20 bp, Homo sapiens
aataaaatgtttatttttgc

SEQ ID NO: 5108686 - DNA, 18 bp, Homo sapiens
aataaaatgtttcattat

SEQ ID NO: 5108687 - DNA, 19 bp, Homo sapiens
aataaaatgtttcattatg

SEQ ID NO: 5108688 - DNA, 15 bp, Homo sapiens
aataaaattaatgaa

SEQ ID NO: 5108689 - DNA, 14 bp, Homo sapiens
aataaaattatttg

SEQ ID NO: 5108690 - DNA, 22 bp, Homo sapiens
aataaaattcaacaaacatttg

SEQ ID NO: 5108691 - DNA, 22 bp, Homo sapiens
aataaaattcattccatttgct

SEQ ID NO: 5108692 - DNA, 15 bp, Homo sapiens
aataaaattcctatc

SEQ ID NO: 5108693 - DNA, 17 bp, Homo sapiens
aataaaattgacttaaa

SEQ ID NO: 5108694 - DNA, 12 bp, Homo sapiens
aataaaattgta

SEQ ID NO: 5108695 - DNA, 11 bp, Homo sapiens
aataaaatttg

SEQ ID NO: 5108696 - DNA, 15 bp, Homo sapiens
aataaaatttgaaac

SEQ ID NO: 5108697 - DNA, 13 bp, Homo sapiens
aataaaatttgtt

SEQ ID NO: 5108698 - DNA, 17 bp, Homo sapiens
aataaaatttgttgcat

SEQ ID NO: 5108699 - DNA, 17 bp, Homo sapiens
aataaaattttagttga

SEQ ID NO: 5108700 - DNA, 12 bp, Homo sapiens
aataaaattttt

SEQ ID NO: 5108701 - DNA, 22 bp, Homo sapiens
aataaaattttttttcatgttt

SEQ ID NO: 5108702 - DNA, 17 bp, Homo sapiens
aataaacacacagatct

SEQ ID NO: 5108703 - DNA, 12 bp, Homo sapiens
aataaacacaga

SEQ ID NO: 5108704 - DNA, 22 bp, Homo sapiens
aataaacacatagattcacctg

SEQ ID NO: 5108705 - DNA, 15 bp, Homo sapiens
aataaacactacaga

SEQ ID NO: 5108706 - DNA, 17 bp, Homo sapiens
aataaacactggctctg

SEQ ID NO: 5108707 - DNA, 19 bp, Homo sapiens
aataaacactggctctggg

SEQ ID NO: 5108708 - DNA, 21 bp, Homo sapiens
aataaacactggtgccaacca

SEQ ID NO: 5108709 - DNA, 21 bp, Homo sapiens
aataaacactgttttatagaa

SEQ ID NO: 5108710 - DNA, 13 bp, Homo sapiens
aataaacactttt

SEQ ID NO: 5108711 - DNA, 19 bp, Homo sapiens
aataaacagacaaaaacaa

SEQ ID NO: 5108712 - DNA, 15 bp, Homo sapiens
aataaacagctattt

SEQ ID NO: 5108713 - DNA, 16 bp, Homo sapiens
aataaacagctattta

SEQ ID NO: 5108714 - DNA, 17 bp, Homo sapiens
aataaacagctatttaa

SEQ ID NO: 5108715 - DNA, 11 bp, Homo sapiens
aataaacagtc

SEQ ID NO: 5108716 - DNA, 21 bp, Homo sapiens
aataaacagtgagcatatctg

SEQ ID NO: 5108717 - DNA, 14 bp, Homo sapiens
aataaacagttgtt

SEQ ID NO: 5108718 - DNA, 23 bp, Homo sapiens
aataaacatccttcaagaactct

SEQ ID NO: 5108719 - DNA, 20 bp, Homo sapiens
aataaacatctgtgtctgtg

SEQ ID NO: 5108720 - DNA, 23 bp, Homo sapiens
aataaacatgtcacaatacagta

SEQ ID NO: 5108721 - DNA, 18 bp, Homo sapiens
aataaacattaattttgt

SEQ ID NO: 5108722 - DNA, 22 bp, Homo sapiens
aataaacattaattttgtgcat

SEQ ID NO: 5108723 - DNA, 23 bp, Homo sapiens
aataaacattaattttgtgcatt

SEQ ID NO: 5108724 - DNA, 19 bp, Homo sapiens
aataaacattttttaagaa

SEQ ID NO: 5108725 - DNA, 18 bp, Homo sapiens
aataaaccacaagcatct

SEQ ID NO: 5108726 - DNA, 12 bp, Homo sapiens
aataaaccagat

SEQ ID NO: 5108727 - DNA, 18 bp, Homo sapiens
aataaaccagtgtgaacc

SEQ ID NO: 5108728 - DNA, 10 bp, Homo sapiens
aataaaccat

SEQ ID NO: 5108729 - DNA, 15 bp, Homo sapiens
aataaaccctcagag

SEQ ID NO: 5108730 - DNA, 14 bp, Homo sapiens
aataaacctgaggc

SEQ ID NO: 5108731 - DNA, 15 bp, Homo sapiens
aataaacctgaggca

SEQ ID NO: 5108732 - DNA, 15 bp, Homo sapiens
aataaacctgcactg

SEQ ID NO: 5108733 - DNA, 17 bp, Homo sapiens
aataaaccttgtttctt

SEQ ID NO: 5108734 - DNA, 17 bp, Homo sapiens
aataaacgccacctgca

SEQ ID NO: 5108735 - DNA, 19 bp, Homo sapiens
aataaacggactcagtgga

SEQ ID NO: 5108736 - DNA, 16 bp, Homo sapiens
aataaacgtcttaaat

SEQ ID NO: 5108737 - DNA, 19 bp, Homo sapiens
aataaacgtgcgcggactg

SEQ ID NO: 5108738 - DNA, 18 bp, Homo sapiens
aataaacgtgctaggaag

SEQ ID NO: 5108739 - DNA, 21 bp, Homo sapiens
aataaacgtggattttaaaaa

SEQ ID NO: 5108740 - DNA, 20 bp, Homo sapiens
aataaactactctttgattt

SEQ ID NO: 5108741 - DNA, 16 bp, Homo sapiens
aataaactagtttcca

SEQ ID NO: 5108742 - DNA, 17 bp, Homo sapiens
aataaactagtttccag

SEQ ID NO: 5108743 - DNA, 19 bp, Homo sapiens
aataaactatttgtaaagt

SEQ ID NO: 5108744 - DNA, 17 bp, Homo sapiens
aataaactcaaaactct

SEQ ID NO: 5108745 - DNA, 15 bp, Homo sapiens
aataaactctaaaca

SEQ ID NO: 5108746 - DNA, 14 bp, Homo sapiens
aataaactcttaag

SEQ ID NO: 5108747 - DNA, 14 bp, Homo sapiens
aataaactcttcaa

SEQ ID NO: 5108748 - DNA, 15 bp, Homo sapiens
aataaactcttcaag

SEQ ID NO: 5108749 - DNA, 12 bp, Homo sapiens
aataaactgaat

SEQ ID NO: 5108750 - DNA, 21 bp, Homo sapiens
aataaactgaatattttggaa

SEQ ID NO: 5108751 - DNA, 22 bp, Homo sapiens
aataaactgaatattttggaaa

SEQ ID NO: 5108752 - DNA, 18 bp, Homo sapiens
aataaactggcagctcag

SEQ ID NO: 5108753 - DNA, 23 bp, Homo sapiens
aataaactggtatgaataattgc

SEQ ID NO: 5108754 - DNA, 24 bp, Homo sapiens
aataaactggtatgaataattgca

SEQ ID NO: 5108755 - DNA, 13 bp, Homo sapiens
aataaactgtaaa

SEQ ID NO: 5108756 - DNA, 14 bp, Homo sapiens
aataaactgtttat

SEQ ID NO: 5108757 - DNA, 17 bp, Homo sapiens
aataaactgtttatata

SEQ ID NO: 5108758 - DNA, 18 bp, Homo sapiens
aataaactgttttcaagt

SEQ ID NO: 5108759 - DNA, 14 bp, Homo sapiens
aataaacttacaga

SEQ ID NO: 5108760 - DNA, 17 bp, Homo sapiens
aataaacttacagatct

SEQ ID NO: 5108761 - DNA, 17 bp, Homo sapiens
aataaacttagaataaa

SEQ ID NO: 5108762 - DNA, 21 bp, Homo sapiens
aataaacttagaataaaattg

SEQ ID NO: 5108763 - DNA, 17 bp, Homo sapiens
aataaacttattcctcc

SEQ ID NO: 5108764 - DNA, 11 bp, Homo sapiens
aataaacttct

SEQ ID NO: 5108765 - DNA, 13 bp, Homo sapiens
aataaacttctta

SEQ ID NO: 5108766 - DNA, 14 bp, Homo sapiens
aataaacttcttaa

SEQ ID NO: 5108767 - DNA, 21 bp, Homo sapiens
aataaacttggattctctaac

SEQ ID NO: 5108768 - DNA, 20 bp, Homo sapiens
aataaactttattttttaaa

SEQ ID NO: 5108769 - DNA, 12 bp, Homo sapiens
aataaactttct

SEQ ID NO: 5108770 - DNA, 15 bp, Homo sapiens
aataaactttgaata

SEQ ID NO: 5108771 - DNA, 16 bp, Homo sapiens
aataaactttgaataa

SEQ ID NO: 5108772 - DNA, 12 bp, Homo sapiens
aataaacttttt

SEQ ID NO: 5108773 - DNA, 16 bp, Homo sapiens
aataaactttttttca

SEQ ID NO: 5108774 - DNA, 17 bp, Homo sapiens
aataaacttttttttga

SEQ ID NO: 5108775 - DNA, 11 bp, Homo sapiens
aataaagaaaa

SEQ ID NO: 5108776 - DNA, 14 bp, Homo sapiens
aataaagaaaagat

SEQ ID NO: 5108777 - DNA, 15 bp, Homo sapiens
aataaagaaaagatg

SEQ ID NO: 5108778 - DNA, 16 bp, Homo sapiens
aataaagaaaagatgc

SEQ ID NO: 5108779 - DNA, 17 bp, Homo sapiens
aataaagaaaagatgca

SEQ ID NO: 5108780 - DNA, 14 bp, Homo sapiens
aataaagaaaattc

SEQ ID NO: 5108781 - DNA, 19 bp, Homo sapiens
aataaagaaaattctctca

SEQ ID NO: 5108782 - DNA, 14 bp, Homo sapiens
aataaagaaatatt

SEQ ID NO: 5108783 - DNA, 12 bp, Homo sapiens
aataaagaacat

SEQ ID NO: 5108784 - DNA, 13 bp, Homo sapiens
aataaagaacatt

SEQ ID NO: 5108785 - DNA, 21 bp, Homo sapiens
aataaagaactccttattttg

SEQ ID NO: 5108786 - DNA, 15 bp, Homo sapiens
aataaagaatacttg

SEQ ID NO: 5108787 - DNA, 17 bp, Homo sapiens
aataaagaatgccattt

SEQ ID NO: 5108788 - DNA, 12 bp, Homo sapiens
aataaagaattc

SEQ ID NO: 5108789 - DNA, 17 bp, Homo sapiens
aataaagacaaccatat

SEQ ID NO: 5108790 - DNA, 18 bp, Homo sapiens
aataaagacactggcaga

SEQ ID NO: 5108791 - DNA, 21 bp, Homo sapiens
aataaagacactggcagagag

SEQ ID NO: 5108792 - DNA, 11 bp, Homo sapiens
aataaagacag

SEQ ID NO: 5108793 - DNA, 17 bp, Homo sapiens
aataaagacttcatgtt

SEQ ID NO: 5108794 - DNA, 22 bp, Homo sapiens
aataaagacttgtgcatccctc

SEQ ID NO: 5108795 - DNA, 15 bp, Homo sapiens
aataaagagaaatat

SEQ ID NO: 5108796 - DNA, 12 bp, Homo sapiens
aataaagagctc

SEQ ID NO: 5108797 - DNA, 20 bp, Homo sapiens
aataaagagtaaatatactt

SEQ ID NO: 5108798 - DNA, 13 bp, Homo sapiens
aataaagataacc

SEQ ID NO: 5108799 - DNA, 18 bp, Homo sapiens
aataaagatacaaaatgt

SEQ ID NO: 5108800 - DNA, 17 bp, Homo sapiens
aataaagatggtccaaa

SEQ ID NO: 5108801 - DNA, 11 bp, Homo sapiens
aataaagcaat

SEQ ID NO: 5108802 - DNA, 14 bp, Homo sapiens
aataaagcaatgtg

SEQ ID NO: 5108803 - DNA, 16 bp, Homo sapiens
aataaagcaattttcc

SEQ ID NO: 5108804 - DNA, 17 bp, Homo sapiens
aataaagcaattttcct

SEQ ID NO: 5108805 - DNA, 23 bp, Homo sapiens
aataaagcaattttccttgaagc

SEQ ID NO: 5108806 - DNA, 22 bp, Homo sapiens
aataaagcacgcagttatgtta

SEQ ID NO: 5108807 - DNA, 15 bp, Homo sapiens
aataaagcactattg

SEQ ID NO: 5108808 - DNA, 21 bp, Homo sapiens
aataaagcactattgtttaga

SEQ ID NO: 5108809 - DNA, 20 bp, Homo sapiens
aataaagcagagccaaggcc

SEQ ID NO: 5108810 - DNA, 22 bp, Homo sapiens
aataaagcagagccaaggccac

SEQ ID NO: 5108811 - DNA, 12 bp, Homo sapiens
aataaagcagcc

SEQ ID NO: 5108812 - DNA, 23 bp, Homo sapiens
aagtcccaccctcttcccatgtc

SEQ ID NO: 5108813 - DNA, 20 bp, Homo sapiens
aagtcccaccggttgcttct

SEQ ID NO: 5108814 - DNA, 21 bp, Homo sapiens
aagtcccagggagctctgcat

SEQ ID NO: 5108815 - DNA, 17 bp, Homo sapiens
aagtcccatctcacctc

SEQ ID NO: 5108816 - DNA, 21 bp, Homo sapiens
aagtccccagcccctcaaccc

SEQ ID NO: 5108817 - DNA, 21 bp, Homo sapiens
aagtccccgagggcgaaggcc

SEQ ID NO: 5108818 - DNA, 23 bp, Homo sapiens
aagtccccgtcccccagaacctc

SEQ ID NO: 5108819 - DNA, 22 bp, Homo sapiens
aagtccccgtggaggttctgta

SEQ ID NO: 5108820 - DNA, 20 bp, Homo sapiens
aagtcccctctcctccacat

SEQ ID NO: 5108821 - DNA, 14 bp, Homo sapiens
aagtcccgaggcag

SEQ ID NO: 5108822 - DNA, 15 bp, Homo sapiens
aagtcccgaggcagc

SEQ ID NO: 5108823 - DNA, 19 bp, Homo sapiens
aagtcccgaggcagcaaca

SEQ ID NO: 5108824 - DNA, 19 bp, Homo sapiens
aagtccctataataaaggc

SEQ ID NO: 5108825 - DNA, 11 bp, Homo sapiens
aagtccctgag

SEQ ID NO: 5108826 - DNA, 11 bp, Homo sapiens
aagtccctgcc

SEQ ID NO: 5108827 - DNA, 22 bp, Homo sapiens
aagtccctgtaattgttgtttg

SEQ ID NO: 5108828 - DNA, 17 bp, Homo sapiens
aagtccctgtcacctct

SEQ ID NO: 5108829 - DNA, 19 bp, Homo sapiens
aagtccctgttctcagctc

SEQ ID NO: 5108830 - DNA, 16 bp, Homo sapiens
aagtccctgtttggga

SEQ ID NO: 5108831 - DNA, 17 bp, Homo sapiens
aagtccctgtttgggaa

SEQ ID NO: 5108832 - DNA, 21 bp, Homo sapiens
aagtcccttcagactggccct

SEQ ID NO: 5108833 - DNA, 13 bp, Homo sapiens
aagtcccttccta

SEQ ID NO: 5108834 - DNA, 17 bp, Homo sapiens
aagtcccttcctattct

SEQ ID NO: 5108835 - DNA, 14 bp, Homo sapiens
aagtcccttcctgc

SEQ ID NO: 5108836 - DNA, 15 bp, Homo sapiens
aagtcccttcctgct

SEQ ID NO: 5108837 - DNA, 20 bp, Homo sapiens
aagtcccttgagactcccca

SEQ ID NO: 5108838 - DNA, 22 bp, Homo sapiens
aagtccgaggcctggctctgga

SEQ ID NO: 5108839 - DNA, 18 bp, Homo sapiens
aagtccggccccagtaca

SEQ ID NO: 5108840 - DNA, 16 bp, Homo sapiens
aagtcctaacttcctg

SEQ ID NO: 5108841 - DNA, 19 bp, Homo sapiens
aagtcctacttttaaagaa

SEQ ID NO: 5108842 - DNA, 12 bp, Homo sapiens
aagtcctagccc

SEQ ID NO: 5108843 - DNA, 23 bp, Homo sapiens
aagtcctatcgactttatacaga

SEQ ID NO: 5108844 - DNA, 14 bp, Homo sapiens
aagtcctatggaaa

SEQ ID NO: 5108845 - DNA, 15 bp, Homo sapiens
aagtcctatggaaac

SEQ ID NO: 5108846 - DNA, 16 bp, Homo sapiens
aagtcctatggaaacc

SEQ ID NO: 5108847 - DNA, 13 bp, Homo sapiens
aagtcctcagagc

SEQ ID NO: 5108848 - DNA, 21 bp, Homo sapiens
aagtcctcagagctccatgct

SEQ ID NO: 5108849 - DNA, 18 bp, Homo sapiens
aagtcctccctcctgcag

SEQ ID NO: 5108850 - DNA, 12 bp, Homo sapiens
aagtcctctgct

SEQ ID NO: 5108851 - DNA, 19 bp, Homo sapiens
aagtcctgactgggctggg

SEQ ID NO: 5108852 - DNA, 22 bp, Homo sapiens
aagtcctgactgggctgggttt

SEQ ID NO: 5108853 - DNA, 19 bp, Homo sapiens
aagtcctgccaagtggttt

SEQ ID NO: 5108854 - DNA, 13 bp, Homo sapiens
aagtcctgccttt

SEQ ID NO: 5108855 - DNA, 16 bp, Homo sapiens
aagtcctgcctttggg

SEQ ID NO: 5108856 - DNA, 23 bp, Homo sapiens
aagtcctgctcctttctgcccag

SEQ ID NO: 5108857 - DNA, 13 bp, Homo sapiens
aagtcctgctttc

SEQ ID NO: 5108858 - DNA, 13 bp, Homo sapiens
aagtcctggcaca

SEQ ID NO: 5108859 - DNA, 17 bp, Homo sapiens
aagtcctgtatgtctgt

SEQ ID NO: 5108860 - DNA, 13 bp, Homo sapiens
aagtccttcagtt

SEQ ID NO: 5108861 - DNA, 13 bp, Homo sapiens
aagtcctttatgt

SEQ ID NO: 5108862 - DNA, 16 bp, Homo sapiens
aagtcctttatgtgga

SEQ ID NO: 5108863 - DNA, 17 bp, Homo sapiens
aagtcctttgtgaatat

SEQ ID NO: 5108864 - DNA, 17 bp, Homo sapiens
aagtccttttgtaaagt

SEQ ID NO: 5108865 - DNA, 21 bp, Homo sapiens
aagtcctttttttccatcttt

SEQ ID NO: 5108866 - DNA, 12 bp, Homo sapiens
aagtcgaaggat

SEQ ID NO: 5108867 - DNA, 15 bp, Homo sapiens
aagtcgagcactcta

SEQ ID NO: 5108868 - DNA, 14 bp, Homo sapiens
aagtcgaggctgca

SEQ ID NO: 5108869 - DNA, 16 bp, Homo sapiens
aagtcggaacagcaga

SEQ ID NO: 5108870 - DNA, 15 bp, Homo sapiens
aagtcggatgtcaga

SEQ ID NO: 5108871 - DNA, 13 bp, Homo sapiens
aagtcggccaggt

SEQ ID NO: 5108872 - DNA, 15 bp, Homo sapiens
aagtcgggtcaaaaa

SEQ ID NO: 5108873 - DNA, 16 bp, Homo sapiens
aagtcggttaaaatgg

SEQ ID NO: 5108874 - DNA, 22 bp, Homo sapiens
aagtcgtccttactcctgtggg

SEQ ID NO: 5108875 - DNA, 17 bp, Homo sapiens
aagtcgtgcactttctc

SEQ ID NO: 5108876 - DNA, 18 bp, Homo sapiens
aagtcgtgcactttctcg

SEQ ID NO: 5108877 - DNA, 15 bp, Homo sapiens
aagtcgttttccaaa

SEQ ID NO: 5108878 - DNA, 18 bp, Homo sapiens
aagtctaaaaagacctgg

SEQ ID NO: 5108879 - DNA, 23 bp, Homo sapiens
aagtctaaaaagacctggccttt

SEQ ID NO: 5108880 - DNA, 12 bp, Homo sapiens
aagtctaaacaa

SEQ ID NO: 5108881 - DNA, 17 bp, Homo sapiens
aagtctaaacaatgaat

SEQ ID NO: 5108882 - DNA, 17 bp, Homo sapiens
aagtctaaactgttaaa

SEQ ID NO: 5108883 - DNA, 17 bp, Homo sapiens
aagtctaaagtttacag

SEQ ID NO: 5108884 - DNA, 19 bp, Homo sapiens
aagtctaaagtttacagta

SEQ ID NO: 5108885 - DNA, 21 bp, Homo sapiens
aagtctaaagtttacagtaaa

SEQ ID NO: 5108886 - DNA, 16 bp, Homo sapiens
aagtctaaatatttcc

SEQ ID NO: 5108887 - DNA, 17 bp, Homo sapiens
aagtctaaatatttcct

SEQ ID NO: 5108888 - DNA, 17 bp, Homo sapiens
aagtctaagcaagatgt

SEQ ID NO: 5108889 - DNA, 13 bp, Homo sapiens
aagtctaatgaag

SEQ ID NO: 5108890 - DNA, 19 bp, Homo sapiens
aagtctaatgaagagaaaa

SEQ ID NO: 5108891 - DNA, 16 bp, Homo sapiens
aagtctacaaaaaggt

SEQ ID NO: 5108892 - DNA, 14 bp, Homo sapiens
aagtctacctgctg

SEQ ID NO: 5108893 - DNA, 19 bp, Homo sapiens
aagtctacctgctggacag

SEQ ID NO: 5108894 - DNA, 22 bp, Homo sapiens
aagtctacctgctggacagcct

SEQ ID NO: 5108895 - DNA, 13 bp, Homo sapiens
aagtctagtcttc

SEQ ID NO: 5108896 - DNA, 16 bp, Homo sapiens
aagtctagtcttctgg

SEQ ID NO: 5108897 - DNA, 13 bp, Homo sapiens
aagtctataaaaa

SEQ ID NO: 5108898 - DNA, 14 bp, Homo sapiens
aagtctattcaaaa

SEQ ID NO: 5108899 - DNA, 11 bp, Homo sapiens
aagtctatttt

SEQ ID NO: 5108900 - DNA, 18 bp, Homo sapiens
aagtctatttttattcct

SEQ ID NO: 5108901 - DNA, 21 bp, Homo sapiens
aagtctatttttttaactgaa

SEQ ID NO: 5108902 - DNA, 19 bp, Homo sapiens
aagtctcacatattcatca

SEQ ID NO: 5108903 - DNA, 20 bp, Homo sapiens
aagtctcacccattatctgg

SEQ ID NO: 5108904 - DNA, 13 bp, Homo sapiens
aagtctcagaaga

SEQ ID NO: 5108905 - DNA, 22 bp, Homo sapiens
aagtctcagtacacttcctgtg

SEQ ID NO: 5108906 - DNA, 20 bp, Homo sapiens
aagtctcataggttaaaaaa

SEQ ID NO: 5108907 - DNA, 21 bp, Homo sapiens
aagtctcataggttaaaaaaa

SEQ ID NO: 5108908 - DNA, 19 bp, Homo sapiens
aagtctccaagaatacaga

SEQ ID NO: 5108909 - DNA, 21 bp, Homo sapiens
aagtctccaagaatacagaaa

SEQ ID NO: 5108910 - DNA, 16 bp, Homo sapiens
aagtctccatgaagag

SEQ ID NO: 5108911 - DNA, 20 bp, Homo sapiens
aagtctcccaatatccaatt

SEQ ID NO: 5108912 - DNA, 19 bp, Homo sapiens
aagtctccccgcagccctc

SEQ ID NO: 5108913 - DNA, 21 bp, Homo sapiens
aagtctccccgcagccctctc

SEQ ID NO: 5108914 - DNA, 22 bp, Homo sapiens
aagtctccccgcagccctctcc

SEQ ID NO: 5108915 - DNA, 18 bp, Homo sapiens
aagtctccctgcacagcc

SEQ ID NO: 5108916 - DNA, 15 bp, Homo sapiens
aagtctcctgtatca

SEQ ID NO: 5108917 - DNA, 13 bp, Homo sapiens
aagtctcctgtct

SEQ ID NO: 5108918 - DNA, 20 bp, Homo sapiens
aagtctcctttactgaatgt

SEQ ID NO: 5108919 - DNA, 17 bp, Homo sapiens
aagtctcgaatgtaatt

SEQ ID NO: 5108920 - DNA, 22 bp, Homo sapiens
aagtctcgaatgtaattggaat

SEQ ID NO: 5108921 - DNA, 17 bp, Homo sapiens
aagtctctaacaatgta

SEQ ID NO: 5108922 - DNA, 14 bp, Homo sapiens
aagtctctatttaa

SEQ ID NO: 5108923 - DNA, 19 bp, Homo sapiens
aagtctctatttaaattct

SEQ ID NO: 5108924 - DNA, 20 bp, Homo sapiens
aagtctctatttaaattctt

SEQ ID NO: 5108925 - DNA, 13 bp, Homo sapiens
aagtctctctaag

SEQ ID NO: 5108926 - DNA, 22 bp, Homo sapiens
aagtctctctaagacaaatgca

SEQ ID NO: 5108927 - DNA, 23 bp, Homo sapiens
aagtctctctaagacaaatgcag

SEQ ID NO: 5108928 - DNA, 23 bp, Homo sapiens
aagtctctctgtgaatacaatta

SEQ ID NO: 5108929 - DNA, 22 bp, Homo sapiens
aagtctctgaagtgaaactgct

SEQ ID NO: 5108930 - DNA, 22 bp, Homo sapiens
aagtctctgattagttgacagt

SEQ ID NO: 5108931 - DNA, 11 bp, Homo sapiens
aagtctctgtg

SEQ ID NO: 5108932 - DNA, 13 bp, Homo sapiens
aagtctctgtgta

SEQ ID NO: 5108933 - DNA, 12 bp, Homo sapiens
aagtctcttcct

SEQ ID NO: 5108934 - DNA, 14 bp, Homo sapiens
aagtctcttcctgc

SEQ ID NO: 5108935 - DNA, 15 bp, Homo sapiens
aagtctcttcctgcc

SEQ ID NO: 5108936 - DNA, 18 bp, Homo sapiens
aagtctctttttcttcct

SEQ ID NO: 5108937 - DNA, 14 bp, Homo sapiens
aagtctctttttta

SEQ ID NO: 5108938 - DNA, 15 bp, Homo sapiens
aagtctgagttctct

SEQ ID NO: 5108939 - DNA, 15 bp, Homo sapiens
aagtctgatccctgc

SEQ ID NO: 5108940 - DNA, 18 bp, Homo sapiens
aagtctgcatttcatatt

SEQ ID NO: 5108941 - DNA, 13 bp, Homo sapiens
aagtctgctgctg

SEQ ID NO: 5108942 - DNA, 20 bp, Homo sapiens
aagtctggaaaaaaacaaaa

SEQ ID NO: 5108943 - DNA, 20 bp, Homo sapiens
aagtctggccattttggaaa

SEQ ID NO: 5108944 - DNA, 17 bp, Homo sapiens
aagtctgggatgtagaa

SEQ ID NO: 5108945 - DNA, 22 bp, Homo sapiens
aagtctgtacctcaaatgaatt

SEQ ID NO: 5108946 - DNA, 23 bp, Homo sapiens
aagtctgtccaaatttaaaatgt

SEQ ID NO: 5108947 - DNA, 13 bp, Homo sapiens
aagtctgtccttg

SEQ ID NO: 5108948 - DNA, 21 bp, Homo sapiens
aagtctgtctttctatagaaa

SEQ ID NO: 5108949 - DNA, 18 bp, Homo sapiens
aagtctgtgagtgcgtct

SEQ ID NO: 5108950 - DNA, 15 bp, Homo sapiens
aagtctgtgcctgga

SEQ ID NO: 5108951 - DNA, 16 bp, Homo sapiens
aagtctgttattgttt

SEQ ID NO: 5108952 - DNA, 17 bp, Homo sapiens
aagtctgttattgtttt

SEQ ID NO: 5108953 - DNA, 15 bp, Homo sapiens
aagtctgttatttat

SEQ ID NO: 5108954 - DNA, 21 bp, Homo sapiens
aagtctgttatttattattaa

SEQ ID NO: 5108955 - DNA, 16 bp, Homo sapiens
aagtctgtttactgca

SEQ ID NO: 5108956 - DNA, 16 bp, Homo sapiens
aagtctgttttatgac

SEQ ID NO: 5108957 - DNA, 20 bp, Homo sapiens
aagtctgttttatgacttca

SEQ ID NO: 5108958 - DNA, 18 bp, Homo sapiens
aagtcttaaaataactta

SEQ ID NO: 5108959 - DNA, 23 bp, Homo sapiens
aagtcttaaaataacttatatca

SEQ ID NO: 5108960 - DNA, 16 bp, Homo sapiens
aagtcttaacaacagc

SEQ ID NO: 5108961 - DNA, 21 bp, Homo sapiens
aagtcttaattgtgtttattt

SEQ ID NO: 5108962 - DNA, 17 bp, Homo sapiens
aagtcttacaggaagcc

SEQ ID NO: 5108963 - DNA, 16 bp, Homo sapiens
aagtcttactacagaa

SEQ ID NO: 5108964 - DNA, 15 bp, Homo sapiens
aagtcttactgtttt

SEQ ID NO: 5108965 - DNA, 17 bp, Homo sapiens
aagtcttacttaaaaaa

SEQ ID NO: 5108966 - DNA, 18 bp, Homo sapiens
aagtcttagatgtatata

SEQ ID NO: 5108967 - DNA, 19 bp, Homo sapiens
aagtcttagatgtatatat

SEQ ID NO: 5108968 - DNA, 12 bp, Homo sapiens
aagtcttatctt

SEQ ID NO: 5108969 - DNA, 13 bp, Homo sapiens
aagtcttcaaatt

SEQ ID NO: 5108970 - DNA, 16 bp, Homo sapiens
aagtcttcaaattttt

SEQ ID NO: 5108971 - DNA, 17 bp, Homo sapiens
aagtcttcaagggctgc

SEQ ID NO: 5108972 - DNA, 21 bp, Homo sapiens
aagtcttcaagggctgcttca

SEQ ID NO: 5108973 - DNA, 14 bp, Homo sapiens
aagtcttcatgaaa

SEQ ID NO: 5108974 - DNA, 16 bp, Homo sapiens
aagtcttcatgaaatg

SEQ ID NO: 5108975 - DNA, 18 bp, Homo sapiens
aagtcttcatgaaatgct

SEQ ID NO: 5108976 - DNA, 11 bp, Homo sapiens
aagtcttcctg

SEQ ID NO: 5108977 - DNA, 13 bp, Homo sapiens
aagtcttccttaa

SEQ ID NO: 5108978 - DNA, 14 bp, Homo sapiens
aagtcttccttaaa

SEQ ID NO: 5108979 - DNA, 22 bp, Homo sapiens
aagtcttccttaaatgactttt

SEQ ID NO: 5108980 - DNA, 14 bp, Homo sapiens
aagtcttctattta

SEQ ID NO: 5108981 - DNA, 23 bp, Homo sapiens
aagtcttctcccaactcagcctg

SEQ ID NO: 5108982 - DNA, 14 bp, Homo sapiens
aagtcttctttcat

SEQ ID NO: 5108983 - DNA, 16 bp, Homo sapiens
aagtcttctttcatgt

SEQ ID NO: 5108984 - DNA, 19 bp, Homo sapiens
aagtcttgagcaatgtttt

SEQ ID NO: 5108985 - DNA, 12 bp, Homo sapiens
aagtcttgcatt

SEQ ID NO: 5108986 - DNA, 17 bp, Homo sapiens
aagtcttgcctatattt

SEQ ID NO: 5108987 - DNA, 17 bp, Homo sapiens
aagtcttgctgtgcttt

SEQ ID NO: 5108988 - DNA, 19 bp, Homo sapiens
aagtcttgggtctgaattt

SEQ ID NO: 5108989 - DNA, 14 bp, Homo sapiens
aagtcttgtgacta

SEQ ID NO: 5108990 - DNA, 16 bp, Homo sapiens
aagtctttaataaata

SEQ ID NO: 5108991 - DNA, 13 bp, Homo sapiens
aagtctttaatat

SEQ ID NO: 5108992 - DNA, 11 bp, Homo sapiens
aataaagcatt

SEQ ID NO: 5108993 - DNA, 12 bp, Homo sapiens
aataaagcattc

SEQ ID NO: 5108994 - DNA, 14 bp, Homo sapiens
aataaagcattctt

SEQ ID NO: 5108995 - DNA, 18 bp, Homo sapiens
aataaagcattttgcaaa

SEQ ID NO: 5108996 - DNA, 11 bp, Homo sapiens
aataaagccac

SEQ ID NO: 5108997 - DNA, 15 bp, Homo sapiens
aataaagcctgcttt

SEQ ID NO: 5108998 - DNA, 20 bp, Homo sapiens
aataaagcctttgtatcttt

SEQ ID NO: 5108999 - DNA, 21 bp, Homo sapiens
aataaagccttttaaatcatc

SEQ ID NO: 5109000 - DNA, 13 bp, Homo sapiens
aataaagcgtcct

SEQ ID NO: 5109001 - DNA, 16 bp, Homo sapiens
aataaagctactgaat

SEQ ID NO: 5109002 - DNA, 22 bp, Homo sapiens
aataaagctactgaatttattg

SEQ ID NO: 5109003 - DNA, 23 bp, Homo sapiens
aataaagctactgaatttattgc

SEQ ID NO: 5109004 - DNA, 14 bp, Homo sapiens
aataaagctcacac

SEQ ID NO: 5109005 - DNA, 19 bp, Homo sapiens
aataaagctcctctgctcc

SEQ ID NO: 5109006 - DNA, 11 bp, Homo sapiens
aataaagctgg

SEQ ID NO: 5109007 - DNA, 17 bp, Homo sapiens
aataaagcttctctctg

SEQ ID NO: 5109008 - DNA, 19 bp, Homo sapiens
aataaagcttctctctgag

SEQ ID NO: 5109009 - DNA, 12 bp, Homo sapiens
aataaagcttgt

SEQ ID NO: 5109010 - DNA, 12 bp, Homo sapiens
aataaagctttt

SEQ ID NO: 5109011 - DNA, 15 bp, Homo sapiens
aataaagcttttgca

SEQ ID NO: 5109012 - DNA, 18 bp, Homo sapiens
aataaagcttttgcatag

SEQ ID NO: 5109013 - DNA, 16 bp, Homo sapiens
aataaagcttttggaa

SEQ ID NO: 5109014 - DNA, 17 bp, Homo sapiens
aataaagcttttggaag

SEQ ID NO: 5109015 - DNA, 13 bp, Homo sapiens
aataaaggaaata

SEQ ID NO: 5109016 - DNA, 15 bp, Homo sapiens
aataaaggaaattca

SEQ ID NO: 5109017 - DNA, 11 bp, Homo sapiens
aataaaggact

SEQ ID NO: 5109018 - DNA, 16 bp, Homo sapiens
aataaaggagaagaga

SEQ ID NO: 5109019 - DNA, 17 bp, Homo sapiens
aataaaggagaagagat

SEQ ID NO: 5109020 - DNA, 10 bp, Homo sapiens
aataaaggca

SEQ ID NO: 5109021 - DNA, 12 bp, Homo sapiens
aataaaggcagc

SEQ ID NO: 5109022 - DNA, 18 bp, Homo sapiens
aataaaggcagctgcctc

SEQ ID NO: 5109023 - DNA, 21 bp, Homo sapiens
aataaaggcagctgcctctgc

SEQ ID NO: 5109024 - DNA, 23 bp, Homo sapiens
aataaaggcagctgcctctgctc

SEQ ID NO: 5109025 - DNA, 18 bp, Homo sapiens
aataaaggcagttttcta

SEQ ID NO: 5109026 - DNA, 19 bp, Homo sapiens
aataaaggcagttttctaa

SEQ ID NO: 5109027 - DNA, 18 bp, Homo sapiens
aataaaggccacaggaga

SEQ ID NO: 5109028 - DNA, 18 bp, Homo sapiens
aataaaggctctgtgctt

SEQ ID NO: 5109029 - DNA, 18 bp, Homo sapiens
aataaaggctgaagcttt

SEQ ID NO: 5109030 - DNA, 19 bp, Homo sapiens
aataaagggaaacgaatgt

SEQ ID NO: 5109031 - DNA, 13 bp, Homo sapiens
aataaagggacca

SEQ ID NO: 5109032 - DNA, 23 bp, Homo sapiens
aataaagggagaatggtgctgtt

SEQ ID NO: 5109033 - DNA, 16 bp, Homo sapiens
aataaagggataaaga

SEQ ID NO: 5109034 - DNA, 18 bp, Homo sapiens
aataaaggtaaaatcact

SEQ ID NO: 5109035 - DNA, 20 bp, Homo sapiens
aataaaggtaaaatcacttc

SEQ ID NO: 5109036 - DNA, 13 bp, Homo sapiens
aataaaggttgtg

SEQ ID NO: 5109037 - DNA, 18 bp, Homo sapiens
aataaaggttgttttgaa

SEQ ID NO: 5109038 - DNA, 15 bp, Homo sapiens
aataaagtaaattga

SEQ ID NO: 5109039 - DNA, 16 bp, Homo sapiens
aataaagtacaagagc

SEQ ID NO: 5109040 - DNA, 14 bp, Homo sapiens
aataaagtacttga

SEQ ID NO: 5109041 - DNA, 14 bp, Homo sapiens
aataaagtagcaaa

SEQ ID NO: 5109042 - DNA, 19 bp, Homo sapiens
aataaagtaggaaagaatt

SEQ ID NO: 5109043 - DNA, 20 bp, Homo sapiens
aataaagtaggaaagaattt

SEQ ID NO: 5109044 - DNA, 16 bp, Homo sapiens
aataaagtagtgctta

SEQ ID NO: 5109045 - DNA, 15 bp, Homo sapiens
aataaagtagttatt

SEQ ID NO: 5109046 - DNA, 11 bp, Homo sapiens
aataaagtatc

SEQ ID NO: 5109047 - DNA, 19 bp, Homo sapiens
aataaagtatcatgcattc

SEQ ID NO: 5109048 - DNA, 15 bp, Homo sapiens
aataaagtatctaca

SEQ ID NO: 5109049 - DNA, 19 bp, Homo sapiens
aataaagtatttaattagt

SEQ ID NO: 5109050 - DNA, 20 bp, Homo sapiens
aataaagtatttaattagtg

SEQ ID NO: 5109051 - DNA, 21 bp, Homo sapiens
aataaagtatttaattagtgc

SEQ ID NO: 5109052 - DNA, 13 bp, Homo sapiens
aataaagtctatt

SEQ ID NO: 5109053 - DNA, 18 bp, Homo sapiens
aataaagtctcttcctcc

SEQ ID NO: 5109054 - DNA, 13 bp, Homo sapiens
aataaagtctgag

SEQ ID NO: 5109055 - DNA, 14 bp, Homo sapiens
aataaagtgaactt

SEQ ID NO: 5109056 - DNA, 17 bp, Homo sapiens
aataaagtgaactttgt

SEQ ID NO: 5109057 - DNA, 19 bp, Homo sapiens
aataaagtgaactttgttt

SEQ ID NO: 5109058 - DNA, 14 bp, Homo sapiens
aataaagtgaatac

SEQ ID NO: 5109059 - DNA, 16 bp, Homo sapiens
aataaagtgaatacat

SEQ ID NO: 5109060 - DNA, 12 bp, Homo sapiens
aataaagtgacc

SEQ ID NO: 5109061 - DNA, 18 bp, Homo sapiens
aataaagtgtaacaattg

SEQ ID NO: 5109062 - DNA, 12 bp, Homo sapiens
aataaagtgtat

SEQ ID NO: 5109063 - DNA, 13 bp, Homo sapiens
aataaagtgtttt

SEQ ID NO: 5109064 - DNA, 19 bp, Homo sapiens
aataaagtgttttcagagc

SEQ ID NO: 5109065 - DNA, 21 bp, Homo sapiens
aataaagttctgcaaaataca

SEQ ID NO: 5109066 - DNA, 15 bp, Homo sapiens
aataaagttgctttt

SEQ ID NO: 5109067 - DNA, 16 bp, Homo sapiens
aataaagttgttgcat

SEQ ID NO: 5109068 - DNA, 19 bp, Homo sapiens
aataaagttgttgcattcc

SEQ ID NO: 5109069 - DNA, 14 bp, Homo sapiens
aataaagttgtttt

SEQ ID NO: 5109070 - DNA, 20 bp, Homo sapiens
aataaagttgttttatcttt

SEQ ID NO: 5109071 - DNA, 12 bp, Homo sapiens
aataaagtttga

SEQ ID NO: 5109072 - DNA, 18 bp, Homo sapiens
aataaagtttgatcttcc

SEQ ID NO: 5109073 - DNA, 20 bp, Homo sapiens
aataaagtttgctttcagat

SEQ ID NO: 5109074 - DNA, 23 bp, Homo sapiens
aataaataaaattcatttctaca

SEQ ID NO: 5109075 - DNA, 14 bp, Homo sapiens
aataaataaacttt

SEQ ID NO: 5109076 - DNA, 17 bp, Homo sapiens
aataaataaagaagaaa

SEQ ID NO: 5109077 - DNA, 16 bp, Homo sapiens
aataaataacacttgt

SEQ ID NO: 5109078 - DNA, 16 bp, Homo sapiens
aataaataatctacat

SEQ ID NO: 5109079 - DNA, 16 bp, Homo sapiens
aataaataattttcat

SEQ ID NO: 5109080 - DNA, 22 bp, Homo sapiens
aataaataccaattatggaaat

SEQ ID NO: 5109081 - DNA, 12 bp, Homo sapiens
aataaatactgc

SEQ ID NO: 5109082 - DNA, 18 bp, Homo sapiens
aataaatagaaattttgt

SEQ ID NO: 5109083 - DNA, 15 bp, Homo sapiens
aataaatagcctctt

SEQ ID NO: 5109084 - DNA, 19 bp, Homo sapiens
aataaatagctatatccat

SEQ ID NO: 5109085 - DNA, 21 bp, Homo sapiens
aataaatagctatatccatgt

SEQ ID NO: 5109086 - DNA, 12 bp, Homo sapiens
aataaatataat

SEQ ID NO: 5109087 - DNA, 13 bp, Homo sapiens
aataaatataatt

SEQ ID NO: 5109088 - DNA, 14 bp, Homo sapiens
aataaatataattt

SEQ ID NO: 5109089 - DNA, 16 bp, Homo sapiens
aataaatatactaata

SEQ ID NO: 5109090 - DNA, 14 bp, Homo sapiens
aataaatatagttg

SEQ ID NO: 5109091 - DNA, 21 bp, Homo sapiens
aataaatatagttgtctttct

SEQ ID NO: 5109092 - DNA, 15 bp, Homo sapiens
aataaatatatacat

SEQ ID NO: 5109093 - DNA, 13 bp, Homo sapiens
aataaatatatat

SEQ ID NO: 5109094 - DNA, 16 bp, Homo sapiens
aataaatatatataaa

SEQ ID NO: 5109095 - DNA, 19 bp, Homo sapiens
aataaatatatataaacct

SEQ ID NO: 5109096 - DNA, 15 bp, Homo sapiens
aataaatatatctac

SEQ ID NO: 5109097 - DNA, 16 bp, Homo sapiens
aataaatatgaaagta

SEQ ID NO: 5109098 - DNA, 13 bp, Homo sapiens
aataaatatgcct

SEQ ID NO: 5109099 - DNA, 20 bp, Homo sapiens
aataaatatgcctctccttt

SEQ ID NO: 5109100 - DNA, 11 bp, Homo sapiens
aataaatatgt

SEQ ID NO: 5109101 - DNA, 15 bp, Homo sapiens
aataaatatgtaata

SEQ ID NO: 5109102 - DNA, 16 bp, Homo sapiens
aataaatatgtaatat

SEQ ID NO: 5109103 - DNA, 20 bp, Homo sapiens
aataaatatgtaatataaat

SEQ ID NO: 5109104 - DNA, 10 bp, Homo sapiens
aataaatatt

SEQ ID NO: 5109105 - DNA, 13 bp, Homo sapiens
aataaatattatt

SEQ ID NO: 5109106 - DNA, 22 bp, Homo sapiens
aataaatattgtattttagata

SEQ ID NO: 5109107 - DNA, 21 bp, Homo sapiens
aataaatattgtcctgtttct

SEQ ID NO: 5109108 - DNA, 17 bp, Homo sapiens
aataaatcaagaatcat

SEQ ID NO: 5109109 - DNA, 16 bp, Homo sapiens
aataaatcacagatgc

SEQ ID NO: 5109110 - DNA, 16 bp, Homo sapiens
aataaatcataaaact

SEQ ID NO: 5109111 - DNA, 15 bp, Homo sapiens
aataaatcatgttaa

SEQ ID NO: 5109112 - DNA, 21 bp, Homo sapiens
aataaatccaaaacaaacatg

SEQ ID NO: 5109113 - DNA, 17 bp, Homo sapiens
aataaatcctttacttt

SEQ ID NO: 5109114 - DNA, 15 bp, Homo sapiens
aataaatctgaccca

SEQ ID NO: 5109115 - DNA, 16 bp, Homo sapiens
aataaatctgacccag

SEQ ID NO: 5109116 - DNA, 17 bp, Homo sapiens
aataaatctgacccagt

SEQ ID NO: 5109117 - DNA, 14 bp, Homo sapiens
aataaatcttccta

SEQ ID NO: 5109118 - DNA, 20 bp, Homo sapiens
aataaatgaaacttggccag

SEQ ID NO: 5109119 - DNA, 21 bp, Homo sapiens
aataaatgaaacttggccagt

SEQ ID NO: 5109120 - DNA, 13 bp, Homo sapiens
aataaatgaccag

SEQ ID NO: 5109121 - DNA, 16 bp, Homo sapiens
aataaatgagctatgt

SEQ ID NO: 5109122 - DNA, 15 bp, Homo sapiens
aataaatgagctgtt

SEQ ID NO: 5109123 - DNA, 13 bp, Homo sapiens
aataaatgattat

SEQ ID NO: 5109124 - DNA, 19 bp, Homo sapiens
aataaatgcaatatgtatt

SEQ ID NO: 5109125 - DNA, 15 bp, Homo sapiens
aataaatgcatagag

SEQ ID NO: 5109126 - DNA, 19 bp, Homo sapiens
aataaatgcatagagcaat

SEQ ID NO: 5109127 - DNA, 13 bp, Homo sapiens
aataaatgccaac

SEQ ID NO: 5109128 - DNA, 21 bp, Homo sapiens
aataaatgccaactggtcact

SEQ ID NO: 5109129 - DNA, 21 bp, Homo sapiens
aataaatgctcatttgccaat

SEQ ID NO: 5109130 - DNA, 12 bp, Homo sapiens
aataaatgctga

SEQ ID NO: 5109131 - DNA, 13 bp, Homo sapiens
aataaatgctgaa

SEQ ID NO: 5109132 - DNA, 12 bp, Homo sapiens
aataaatgctgc

SEQ ID NO: 5109133 - DNA, 20 bp, Homo sapiens
aataaatggccagtgctgct

SEQ ID NO: 5109134 - DNA, 22 bp, Homo sapiens
aataaatggtatagcaaatgtt

SEQ ID NO: 5109135 - DNA, 20 bp, Homo sapiens
aataaatgtatcatttttgt

SEQ ID NO: 5109136 - DNA, 21 bp, Homo sapiens
aataaatgtcaccaggtactt

SEQ ID NO: 5109137 - DNA, 14 bp, Homo sapiens
aataaatgtcactt

SEQ ID NO: 5109138 - DNA, 21 bp, Homo sapiens
aataaatgtcacttcatattt

SEQ ID NO: 5109139 - DNA, 13 bp, Homo sapiens
aataaatgtcttt

SEQ ID NO: 5109140 - DNA, 11 bp, Homo sapiens
aataaatgtgt

SEQ ID NO: 5109141 - DNA, 13 bp, Homo sapiens
aataaatgtgtaa

SEQ ID NO: 5109142 - DNA, 17 bp, Homo sapiens
aataaatgtgtaaatgt

SEQ ID NO: 5109143 - DNA, 18 bp, Homo sapiens
aataaatgtgtaaatgtg

SEQ ID NO: 5109144 - DNA, 10 bp, Homo sapiens
aataaatgtt

SEQ ID NO: 5109145 - DNA, 17 bp, Homo sapiens
aataaatgttcaaactg

SEQ ID NO: 5109146 - DNA, 17 bp, Homo sapiens
aataaatgttcatgatt

SEQ ID NO: 5109147 - DNA, 13 bp, Homo sapiens
aataaatgttgct

SEQ ID NO: 5109148 - DNA, 21 bp, Homo sapiens
aataaatgtttgttatttaca

SEQ ID NO: 5109149 - DNA, 15 bp, Homo sapiens
aataaatgttttaca

SEQ ID NO: 5109150 - DNA, 21 bp, Homo sapiens
aataaattaaacatgctgtta

SEQ ID NO: 5109151 - DNA, 15 bp, Homo sapiens
aataaattaacatta

SEQ ID NO: 5109152 - DNA, 21 bp, Homo sapiens
aataaattaagatcctaaact

SEQ ID NO: 5109153 - DNA, 14 bp, Homo sapiens
aataaattaagttt

SEQ ID NO: 5109154 - DNA, 16 bp, Homo sapiens
aataaattaatatatt

SEQ ID NO: 5109155 - DNA, 17 bp, Homo sapiens
aataaattaatttttca

SEQ ID NO: 5109156 - DNA, 14 bp, Homo sapiens
aataaattagaaaa

SEQ ID NO: 5109157 - DNA, 14 bp, Homo sapiens
aataaattagttgt

SEQ ID NO: 5109158 - DNA, 16 bp, Homo sapiens
aataaattagttgtta

SEQ ID NO: 5109159 - DNA, 16 bp, Homo sapiens
aataaattatggcatt

SEQ ID NO: 5109160 - DNA, 14 bp, Homo sapiens
aataaattatttgt

SEQ ID NO: 5109161 - DNA, 12 bp, Homo sapiens
aataaattcaaa

SEQ ID NO: 5109162 - DNA, 13 bp, Homo sapiens
aataaattcaaac

SEQ ID NO: 5109163 - DNA, 20 bp, Homo sapiens
aataaattcagtattttgcc

SEQ ID NO: 5109164 - DNA, 13 bp, Homo sapiens
aataaattcatca

SEQ ID NO: 5109165 - DNA, 14 bp, Homo sapiens
aataaattctgact

SEQ ID NO: 5109166 - DNA, 15 bp, Homo sapiens
aataaattctgattc

SEQ ID NO: 5109167 - DNA, 14 bp, Homo sapiens
aataaattgaaatt

SEQ ID NO: 5109168 - DNA, 22 bp, Homo sapiens
aataaattgatttttataaata

SEQ ID NO: 5109169 - DNA, 19 bp, Homo sapiens
aataaattgctaatgttgc

SEQ ID NO: 5109170 - DNA, 17 bp, Homo sapiens
aataaattggattattt

SEQ ID NO: 5109171 - DNA, 15 bp, Homo sapiens
aataaattgtatatt

SEQ ID NO: 5109172 - DNA, 13 bp, Homo sapiens
aataaattgtttg

SEQ ID NO: 5109173 - DNA, 24 bp, Homo sapiens
aataaatttactcacagcacttgt

SEQ ID NO: 5109174 - DNA, 17 bp, Homo sapiens
aataaatttataacaat

SEQ ID NO: 5109175 - DNA, 20 bp, Homo sapiens
aataaatttatatacttttt

SEQ ID NO: 5109176 - DNA, 18 bp, Homo sapiens
aagtctttaggtctttgt

SEQ ID NO: 5109177 - DNA, 18 bp, Homo sapiens
aagtctttcagtggaatt

SEQ ID NO: 5109178 - DNA, 12 bp, Homo sapiens
aagtctttctcc

SEQ ID NO: 5109179 - DNA, 18 bp, Homo sapiens
aagtctttctctttccct

SEQ ID NO: 5109180 - DNA, 14 bp, Homo sapiens
aagtctttcttctt

SEQ ID NO: 5109181 - DNA, 17 bp, Homo sapiens
aagtctttgccttctct

SEQ ID NO: 5109182 - DNA, 19 bp, Homo sapiens
aagtcttttaaaaagtatt

SEQ ID NO: 5109183 - DNA, 15 bp, Homo sapiens
aagtctttttgaagt

SEQ ID NO: 5109184 - DNA, 21 bp, Homo sapiens
aagtcttttttttttccaaat

SEQ ID NO: 5109185 - DNA, 17 bp, Homo sapiens
aagtgaaaaaaagaaac

SEQ ID NO: 5109186 - DNA, 13 bp, Homo sapiens
aagtgaaaaacat

SEQ ID NO: 5109187 - DNA, 15 bp, Homo sapiens
aagtgaaaaacatga

SEQ ID NO: 5109188 - DNA, 12 bp, Homo sapiens
aagtgaaaaaga

SEQ ID NO: 5109189 - DNA, 21 bp, Homo sapiens
aagtgaaaaaggaggaagaga

SEQ ID NO: 5109190 - DNA, 13 bp, Homo sapiens
aagtgaaaactga

SEQ ID NO: 5109191 - DNA, 20 bp, Homo sapiens
aagtgaaacgtaattgtaca

SEQ ID NO: 5109192 - DNA, 11 bp, Homo sapiens
aagtgaaataa

SEQ ID NO: 5109193 - DNA, 16 bp, Homo sapiens
aagtgaaataatgtgt

SEQ ID NO: 5109194 - DNA, 20 bp, Homo sapiens
aagtgaaatctgtgcaataa

SEQ ID NO: 5109195 - DNA, 17 bp, Homo sapiens
aagtgaaatggatacta

SEQ ID NO: 5109196 - DNA, 13 bp, Homo sapiens
aagtgaaattaag

SEQ ID NO: 5109197 - DNA, 13 bp, Homo sapiens
aagtgaaattagt

SEQ ID NO: 5109198 - DNA, 20 bp, Homo sapiens
aagtgaaattagtattttga

SEQ ID NO: 5109199 - DNA, 21 bp, Homo sapiens
aagtgaaattagtattttgag

SEQ ID NO: 5109200 - DNA, 12 bp, Homo sapiens
aagtgaaattta

SEQ ID NO: 5109201 - DNA, 13 bp, Homo sapiens
aagtgaaatttct

SEQ ID NO: 5109202 - DNA, 15 bp, Homo sapiens
aagtgaaattttaaa

SEQ ID NO: 5109203 - DNA, 18 bp, Homo sapiens
aagtgaaattttaaaagt

SEQ ID NO: 5109204 - DNA, 18 bp, Homo sapiens
aagtgaaattttaaatgc

SEQ ID NO: 5109205 - DNA, 20 bp, Homo sapiens
aagtgaacagattttattaa

SEQ ID NO: 5109206 - DNA, 17 bp, Homo sapiens
aagtgaacttttgtaat

SEQ ID NO: 5109207 - DNA, 22 bp, Homo sapiens
aagtgaacttttgtaatttgaa

SEQ ID NO: 5109208 - DNA, 16 bp, Homo sapiens
aagtgaagaaaagtga

SEQ ID NO: 5109209 - DNA, 15 bp, Homo sapiens
aagtgaagaagccat

SEQ ID NO: 5109210 - DNA, 17 bp, Homo sapiens
aagtgaagacaatgact

SEQ ID NO: 5109211 - DNA, 13 bp, Homo sapiens
aagtgaagacaga

SEQ ID NO: 5109212 - DNA, 10 bp, Homo sapiens
aagtgaaggt

SEQ ID NO: 5109213 - DNA, 16 bp, Homo sapiens
aagtgaataaaaatta

SEQ ID NO: 5109214 - DNA, 13 bp, Homo sapiens
aagtgaataaact

SEQ ID NO: 5109215 - DNA, 16 bp, Homo sapiens
aagtgaataaacttca

SEQ ID NO: 5109216 - DNA, 17 bp, Homo sapiens
aagtgaatctgattgca

SEQ ID NO: 5109217 - DNA, 15 bp, Homo sapiens
aagtgaatgggaaag

SEQ ID NO: 5109218 - DNA, 15 bp, Homo sapiens
aagtgaattgaagtt

SEQ ID NO: 5109219 - DNA, 21 bp, Homo sapiens
aagtgaattgaagtttcaagt

SEQ ID NO: 5109220 - DNA, 13 bp, Homo sapiens
aagtgaatttata

SEQ ID NO: 5109221 - DNA, 19 bp, Homo sapiens
aagtgaatttgaatgaaaa

SEQ ID NO: 5109222 - DNA, 15 bp, Homo sapiens
aagtgaatttgcctg

SEQ ID NO: 5109223 - DNA, 15 bp, Homo sapiens
aagtgaatttttaaa

SEQ ID NO: 5109224 - DNA, 17 bp, Homo sapiens
aagtgaatttttctcta

SEQ ID NO: 5109225 - DNA, 21 bp, Homo sapiens
aagtgacaaagccagaggaga

SEQ ID NO: 5109226 - DNA, 14 bp, Homo sapiens
aagtgacaaagtta

SEQ ID NO: 5109227 - DNA, 13 bp, Homo sapiens
aagtgacaaataa

SEQ ID NO: 5109228 - DNA, 18 bp, Homo sapiens
aagtgacaagatgctctg

SEQ ID NO: 5109229 - DNA, 15 bp, Homo sapiens
aagtgacacagacat

SEQ ID NO: 5109230 - DNA, 19 bp, Homo sapiens
aagtgacacattaatgata

SEQ ID NO: 5109231 - DNA, 13 bp, Homo sapiens
aagtgacaccaat

SEQ ID NO: 5109232 - DNA, 17 bp, Homo sapiens
aagtgacaccaataaat

SEQ ID NO: 5109233 - DNA, 14 bp, Homo sapiens
aagtgacagatgtt

SEQ ID NO: 5109234 - DNA, 12 bp, Homo sapiens
aagtgacaggga

SEQ ID NO: 5109235 - DNA, 14 bp, Homo sapiens
aagtgaccagggaa

SEQ ID NO: 5109236 - DNA, 13 bp, Homo sapiens
aagtgaccccagc

SEQ ID NO: 5109237 - DNA, 19 bp, Homo sapiens
aagtgaccccagctccagg

SEQ ID NO: 5109238 - DNA, 15 bp, Homo sapiens
aagtgaccccagggc

SEQ ID NO: 5109239 - DNA, 22 bp, Homo sapiens
aagtgactaccagaaagtgagg

SEQ ID NO: 5109240 - DNA, 15 bp, Homo sapiens
aagtgactctcagcg

SEQ ID NO: 5109241 - DNA, 19 bp, Homo sapiens
aagtgactgaccatgcact

SEQ ID NO: 5109242 - DNA, 19 bp, Homo sapiens
aagtgactgttcaagagca

SEQ ID NO: 5109243 - DNA, 12 bp, Homo sapiens
aagtgactgttt

SEQ ID NO: 5109244 - DNA, 12 bp, Homo sapiens
aagtgacttatt

SEQ ID NO: 5109245 - DNA, 17 bp, Homo sapiens
aagtgacttgaatgtac

SEQ ID NO: 5109246 - DNA, 15 bp, Homo sapiens
aagtgagaaagaaag

SEQ ID NO: 5109247 - DNA, 19 bp, Homo sapiens
aagtgagaaattatgaaag

SEQ ID NO: 5109248 - DNA, 18 bp, Homo sapiens
aagtgagaataggcagcc

SEQ ID NO: 5109249 - DNA, 20 bp, Homo sapiens
aagtgagagacctctgccta

SEQ ID NO: 5109250 - DNA, 17 bp, Homo sapiens
aagtgagagagacaaga

SEQ ID NO: 5109251 - DNA, 14 bp, Homo sapiens
aagtgagagctggg

SEQ ID NO: 5109252 - DNA, 12 bp, Homo sapiens
aagtgagagggg

SEQ ID NO: 5109253 - DNA, 11 bp, Homo sapiens
aagtgagcaga

SEQ ID NO: 5109254 - DNA, 21 bp, Homo sapiens
aagtgaggaaatcaaagtgct

SEQ ID NO: 5109255 - DNA, 11 bp, Homo sapiens
aagtgaggaag

SEQ ID NO: 5109256 - DNA, 21 bp, Homo sapiens
aagtgaggaagcctaaataaa

SEQ ID NO: 5109257 - DNA, 19 bp, Homo sapiens
aagtgaggatgagacccag

SEQ ID NO: 5109258 - DNA, 16 bp, Homo sapiens
aagtgaggcaagagaa

SEQ ID NO: 5109259 - DNA, 20 bp, Homo sapiens
aagtgaggcaagagaaatga

SEQ ID NO: 5109260 - DNA, 17 bp, Homo sapiens
aagtgaggcccaaggag

SEQ ID NO: 5109261 - DNA, 16 bp, Homo sapiens
aagtgaggcctgacat

SEQ ID NO: 5109262 - DNA, 17 bp, Homo sapiens
aagtgagggctcactca

SEQ ID NO: 5109263 - DNA, 18 bp, Homo sapiens
aagtgagggctgggcagc

SEQ ID NO: 5109264 - DNA, 18 bp, Homo sapiens
aagtgaggtgacactcca

SEQ ID NO: 5109265 - DNA, 21 bp, Homo sapiens
aagtgagtactgttaagaata

SEQ ID NO: 5109266 - DNA, 17 bp, Homo sapiens
aagtgagtctggtggag

SEQ ID NO: 5109267 - DNA, 15 bp, Homo sapiens
aagtgagtggcatgt

SEQ ID NO: 5109268 - DNA, 19 bp, Homo sapiens
aagtgagtgtgctgctgta

SEQ ID NO: 5109269 - DNA, 17 bp, Homo sapiens
aagtgagtttgtaaata

SEQ ID NO: 5109270 - DNA, 14 bp, Homo sapiens
aagtgatagaaatg

SEQ ID NO: 5109271 - DNA, 14 bp, Homo sapiens
aagtgatatatgta

SEQ ID NO: 5109272 - DNA, 17 bp, Homo sapiens
aagtgatattgtcttca

SEQ ID NO: 5109273 - DNA, 14 bp, Homo sapiens
aagtgatcaataaa

SEQ ID NO: 5109274 - DNA, 23 bp, Homo sapiens
aagtgatcaataaaatgtgattt

SEQ ID NO: 5109275 - DNA, 23 bp, Homo sapiens
aagtgatcctcccacctcagcct

SEQ ID NO: 5109276 - DNA, 18 bp, Homo sapiens
aagtgatccttccacctc

SEQ ID NO: 5109277 - DNA, 10 bp, Homo sapiens
aagtgatctt

SEQ ID NO: 5109278 - DNA, 17 bp, Homo sapiens
aagtgatctttcaatat

SEQ ID NO: 5109279 - DNA, 21 bp, Homo sapiens
aagtgatgagctgaaaagtga

SEQ ID NO: 5109280 - DNA, 16 bp, Homo sapiens
aagtgatgatggatga

SEQ ID NO: 5109281 - DNA, 16 bp, Homo sapiens
aagtgatgattgtaag

SEQ ID NO: 5109282 - DNA, 19 bp, Homo sapiens
aagtgatgctgtgatacct

SEQ ID NO: 5109283 - DNA, 15 bp, Homo sapiens
aagtgatggaactcc

SEQ ID NO: 5109284 - DNA, 13 bp, Homo sapiens
aagtgatgtcaga

SEQ ID NO: 5109285 - DNA, 13 bp, Homo sapiens
aagtgatgtcatt

SEQ ID NO: 5109286 - DNA, 16 bp, Homo sapiens
aagtgatgtcatttga

SEQ ID NO: 5109287 - DNA, 17 bp, Homo sapiens
aagtgatgtgatttatg

SEQ ID NO: 5109288 - DNA, 21 bp, Homo sapiens
aagtgatgtgatttatgcatt

SEQ ID NO: 5109289 - DNA, 22 bp, Homo sapiens
aagtgatgtgtttacatttact

SEQ ID NO: 5109290 - DNA, 16 bp, Homo sapiens
aagtgattatctcttt

SEQ ID NO: 5109291 - DNA, 15 bp, Homo sapiens
aagtgattcactgtg

SEQ ID NO: 5109292 - DNA, 14 bp, Homo sapiens
aagtgattctaaga

SEQ ID NO: 5109293 - DNA, 17 bp, Homo sapiens
aagtgattctcatgcct

SEQ ID NO: 5109294 - DNA, 21 bp, Homo sapiens
aagtgattctcatgcctcagc

SEQ ID NO: 5109295 - DNA, 16 bp, Homo sapiens
aagtgattctcctgcc

SEQ ID NO: 5109296 - DNA, 20 bp, Homo sapiens
aagtgattctcctgcctcag

SEQ ID NO: 5109297 - DNA, 21 bp, Homo sapiens
aagtgattctcctgcctcagc

SEQ ID NO: 5109298 - DNA, 13 bp, Homo sapiens
aagtgattgaaag

SEQ ID NO: 5109299 - DNA, 14 bp, Homo sapiens
aagtgattgtgaag

SEQ ID NO: 5109300 - DNA, 15 bp, Homo sapiens
aagtgattgttggca

SEQ ID NO: 5109301 - DNA, 19 bp, Homo sapiens
aagtgatttagttgtggaa

SEQ ID NO: 5109302 - DNA, 17 bp, Homo sapiens
aagtgcaaacacagcat

SEQ ID NO: 5109303 - DNA, 14 bp, Homo sapiens
aagtgcaaagctgc

SEQ ID NO: 5109304 - DNA, 15 bp, Homo sapiens
aagtgcaaagctgct

SEQ ID NO: 5109305 - DNA, 19 bp, Homo sapiens
aagtgcaacatttctgtat

SEQ ID NO: 5109306 - DNA, 19 bp, Homo sapiens
aagtgcaatatgggcgggc

SEQ ID NO: 5109307 - DNA, 20 bp, Homo sapiens
aagtgcacacagaaatatat

SEQ ID NO: 5109308 - DNA, 23 bp, Homo sapiens
aagtgcacacagaaatatatata

SEQ ID NO: 5109309 - DNA, 14 bp, Homo sapiens
aagtgcacaggagc

SEQ ID NO: 5109310 - DNA, 22 bp, Homo sapiens
aagtgcacctcaaatcttctaa

SEQ ID NO: 5109311 - DNA, 15 bp, Homo sapiens
aagtgcactgcagtg

SEQ ID NO: 5109312 - DNA, 15 bp, Homo sapiens
aagtgcactttctaa

SEQ ID NO: 5109313 - DNA, 19 bp, Homo sapiens
aagtgcacttttttatgaa

SEQ ID NO: 5109314 - DNA, 17 bp, Homo sapiens
aagtgcagctcaggaga

SEQ ID NO: 5109315 - DNA, 17 bp, Homo sapiens
aagtgcagctcatgttt

SEQ ID NO: 5109316 - DNA, 13 bp, Homo sapiens
aagtgcaggctgg

SEQ ID NO: 5109317 - DNA, 20 bp, Homo sapiens
aagtgcagggaggaaaagtg

SEQ ID NO: 5109318 - DNA, 23 bp, Homo sapiens
aagtgcagtcagcagatgctgtt

SEQ ID NO: 5109319 - DNA, 16 bp, Homo sapiens
aagtgcagtcatttgt

SEQ ID NO: 5109320 - DNA, 15 bp, Homo sapiens
aagtgcatccaaagg

SEQ ID NO: 5109321 - DNA, 17 bp, Homo sapiens
aagtgcatgaaaaacca

SEQ ID NO: 5109322 - DNA, 18 bp, Homo sapiens
aagtgcatgaaaaaccat

SEQ ID NO: 5109323 - DNA, 20 bp, Homo sapiens
aagtgcatgatggtgagagc

SEQ ID NO: 5109324 - DNA, 20 bp, Homo sapiens
aagtgcatgcattgagctgc

SEQ ID NO: 5109325 - DNA, 19 bp, Homo sapiens
aagtgcatgggtcagggtg

SEQ ID NO: 5109326 - DNA, 13 bp, Homo sapiens
aagtgcatgtcac

SEQ ID NO: 5109327 - DNA, 11 bp, Homo sapiens
aagtgcatgtt

SEQ ID NO: 5109328 - DNA, 12 bp, Homo sapiens
aagtgcatgtta

SEQ ID NO: 5109329 - DNA, 16 bp, Homo sapiens
aagtgcatgttaaaat

SEQ ID NO: 5109330 - DNA, 18 bp, Homo sapiens
aagtgcattattttattg

SEQ ID NO: 5109331 - DNA, 23 bp, Homo sapiens
aagtgcattcaaccttaccaaaa

SEQ ID NO: 5109332 - DNA, 18 bp, Homo sapiens
aagtgcatttaaggagat

SEQ ID NO: 5109333 - DNA, 16 bp, Homo sapiens
aagtgcatttattgcc

SEQ ID NO: 5109334 - DNA, 17 bp, Homo sapiens
aagtgcatttctgggcc

SEQ ID NO: 5109335 - DNA, 20 bp, Homo sapiens
aagtgcatttctgggcctta

SEQ ID NO: 5109336 - DNA, 22 bp, Homo sapiens
aagtgcatttttatctgtgagt

SEQ ID NO: 5109337 - DNA, 19 bp, Homo sapiens
aagtgcatttttcttattt

SEQ ID NO: 5109338 - DNA, 16 bp, Homo sapiens
aagtgcatttttgtaa

SEQ ID NO: 5109339 - DNA, 13 bp, Homo sapiens
aagtgccaaagaa

SEQ ID NO: 5109340 - DNA, 15 bp, Homo sapiens
aagtgccaaagaaag

SEQ ID NO: 5109341 - DNA, 15 bp, Homo sapiens
aagtgccaaatgctc

SEQ ID NO: 5109342 - DNA, 21 bp, Homo sapiens
aagtgccactcattcctgtag

SEQ ID NO: 5109343 - DNA, 15 bp, Homo sapiens
aagtgccagaggtgg

SEQ ID NO: 5109344 - DNA, 20 bp, Homo sapiens
aagtgccagatcaaaattgt

SEQ ID NO: 5109345 - DNA, 18 bp, Homo sapiens
aagtgccagggctgggcc

SEQ ID NO: 5109346 - DNA, 22 bp, Homo sapiens
aagtgccaggtgatctcctgtg

SEQ ID NO: 5109347 - DNA, 15 bp, Homo sapiens
aagtgccagtatttt

SEQ ID NO: 5109348 - DNA, 22 bp, Homo sapiens
aagtgccataaccatgagcact

SEQ ID NO: 5109349 - DNA, 15 bp, Homo sapiens
aagtgccatcccaca

SEQ ID NO: 5109350 - DNA, 16 bp, Homo sapiens
aagtgccatcccacat

SEQ ID NO: 5109351 - DNA, 13 bp, Homo sapiens
aagtgccatctca

SEQ ID NO: 5109352 - DNA, 17 bp, Homo sapiens
aagtgccattaacaaat

SEQ ID NO: 5109353 - DNA, 18 bp, Homo sapiens
aagtgccattactactgt

SEQ ID NO: 5109354 - DNA, 19 bp, Homo sapiens
aagtgccattactactgta

SEQ ID NO: 5109355 - DNA, 19 bp, Homo sapiens
aagtgccatttcctgtctg

SEQ ID NO: 5109356 - DNA, 20 bp, Homo sapiens
aagtgccatttcctgtctgg

SEQ ID NO: 5109357 - DNA, 11 bp, Homo sapiens
aagtgcccaaa

SEQ ID NO: 5109358 - DNA, 22 bp, Homo sapiens
aataaatttcagcatgtgcttt

SEQ ID NO: 5109359 - DNA, 15 bp, Homo sapiens
aataaatttcccagt

SEQ ID NO: 5109360 - DNA, 18 bp, Homo sapiens
aataaattttcaaatcct

SEQ ID NO: 5109361 - DNA, 22 bp, Homo sapiens
aataaattttcaaatccttatt

SEQ ID NO: 5109362 - DNA, 15 bp, Homo sapiens
aataaattttctaaa

SEQ ID NO: 5109363 - DNA, 13 bp, Homo sapiens
aataaattttgaa

SEQ ID NO: 5109364 - DNA, 14 bp, Homo sapiens
aataaattttgaaa

SEQ ID NO: 5109365 - DNA, 14 bp, Homo sapiens
aataaattttgttt

SEQ ID NO: 5109366 - DNA, 16 bp, Homo sapiens
aataaattttgtttca

SEQ ID NO: 5109367 - DNA, 17 bp, Homo sapiens
aataacaaacgtgtttt

SEQ ID NO: 5109368 - DNA, 16 bp, Homo sapiens
aataacaacaacaaaa

SEQ ID NO: 5109369 - DNA, 18 bp, Homo sapiens
aataacaaggagatttct

SEQ ID NO: 5109370 - DNA, 16 bp, Homo sapiens
aataacaagtcgatga

SEQ ID NO: 5109371 - DNA, 13 bp, Homo sapiens
aataacaatgtta

SEQ ID NO: 5109372 - DNA, 15 bp, Homo sapiens
aataacaatgttaag

SEQ ID NO: 5109373 - DNA, 12 bp, Homo sapiens
aataacacacat

SEQ ID NO: 5109374 - DNA, 14 bp, Homo sapiens
aataacactgtatt

SEQ ID NO: 5109375 - DNA, 16 bp, Homo sapiens
aataacactgtatttt

SEQ ID NO: 5109376 - DNA, 17 bp, Homo sapiens
aataacagaaatacatc

SEQ ID NO: 5109377 - DNA, 16 bp, Homo sapiens
aataacagagctggat

SEQ ID NO: 5109378 - DNA, 13 bp, Homo sapiens
aataacagccgct

SEQ ID NO: 5109379 - DNA, 13 bp, Homo sapiens
aataacagctttc

SEQ ID NO: 5109380 - DNA, 15 bp, Homo sapiens
aataacagtgcatat

SEQ ID NO: 5109381 - DNA, 20 bp, Homo sapiens
aataacataatttgtacata

SEQ ID NO: 5109382 - DNA, 17 bp, Homo sapiens
aataacatatctaaagt

SEQ ID NO: 5109383 - DNA, 12 bp, Homo sapiens
aataacatattc

SEQ ID NO: 5109384 - DNA, 17 bp, Homo sapiens
aataacatctgaaaaga

SEQ ID NO: 5109385 - DNA, 21 bp, Homo sapiens
aataacatgatactattcaga

SEQ ID NO: 5109386 - DNA, 12 bp, Homo sapiens
aataacatgtaa

SEQ ID NO: 5109387 - DNA, 19 bp, Homo sapiens
aataacatgtaattaagta

SEQ ID NO: 5109388 - DNA, 14 bp, Homo sapiens
aataacatgtttct

SEQ ID NO: 5109389 - DNA, 20 bp, Homo sapiens
aataacattcccactgccag

SEQ ID NO: 5109390 - DNA, 12 bp, Homo sapiens
aataacattgca

SEQ ID NO: 5109391 - DNA, 15 bp, Homo sapiens
aataacattgcactt

SEQ ID NO: 5109392 - DNA, 20 bp, Homo sapiens
aataacatttaaattccaca

SEQ ID NO: 5109393 - DNA, 13 bp, Homo sapiens
aataacatttaat

SEQ ID NO: 5109394 - DNA, 23 bp, Homo sapiens
aataacatttaatttagatattt

SEQ ID NO: 5109395 - DNA, 22 bp, Homo sapiens
aataaccaagtttattcagtaa

SEQ ID NO: 5109396 - DNA, 15 bp, Homo sapiens
aataaccaatagttg

SEQ ID NO: 5109397 - DNA, 21 bp, Homo sapiens
aataaccacaaggtccactcc

SEQ ID NO: 5109398 - DNA, 14 bp, Homo sapiens
aataaccacttaaa

SEQ ID NO: 5109399 - DNA, 20 bp, Homo sapiens
aataaccatggcaagagaga

SEQ ID NO: 5109400 - DNA, 22 bp, Homo sapiens
aataaccatggcaagagagaaa

SEQ ID NO: 5109401 - DNA, 15 bp, Homo sapiens
aataacccagttact

SEQ ID NO: 5109402 - DNA, 17 bp, Homo sapiens
aataacccagttacttt

SEQ ID NO: 5109403 - DNA, 18 bp, Homo sapiens
aataaccctgaatcagag

SEQ ID NO: 5109404 - DNA, 19 bp, Homo sapiens
aataaccctgggctgtcca

SEQ ID NO: 5109405 - DNA, 16 bp, Homo sapiens
aataaccgtaaaggtt

SEQ ID NO: 5109406 - DNA, 18 bp, Homo sapiens
aataacctcaaagtgact

SEQ ID NO: 5109407 - DNA, 19 bp, Homo sapiens
aataacctctggcccttgg

SEQ ID NO: 5109408 - DNA, 21 bp, Homo sapiens
aataacctctggcccttggaa

SEQ ID NO: 5109409 - DNA, 20 bp, Homo sapiens
aataaccttattctatactt

SEQ ID NO: 5109410 - DNA, 14 bp, Homo sapiens
aataacctttttgt

SEQ ID NO: 5109411 - DNA, 15 bp, Homo sapiens
aataacgataaaaga

SEQ ID NO: 5109412 - DNA, 13 bp, Homo sapiens
aataactaaaatg

SEQ ID NO: 5109413 - DNA, 22 bp, Homo sapiens
aataactaatgctaagaaatgc

SEQ ID NO: 5109414 - DNA, 15 bp, Homo sapiens
aataactacctcctc

SEQ ID NO: 5109415 - DNA, 20 bp, Homo sapiens
aataactactgcaaaaagta

SEQ ID NO: 5109416 - DNA, 15 bp, Homo sapiens
aataactagatctcc

SEQ ID NO: 5109417 - DNA, 20 bp, Homo sapiens
aataactatataagacatta

SEQ ID NO: 5109418 - DNA, 21 bp, Homo sapiens
aataactatataagacattaa

SEQ ID NO: 5109419 - DNA, 21 bp, Homo sapiens
aataactatctcacttccaga

SEQ ID NO: 5109420 - DNA, 23 bp, Homo sapiens
aataactatgccagcaaccttgt

SEQ ID NO: 5109421 - DNA, 22 bp, Homo sapiens
aataactattttgttttaatct

SEQ ID NO: 5109422 - DNA, 18 bp, Homo sapiens
aataactcagaatattgt

SEQ ID NO: 5109423 - DNA, 17 bp, Homo sapiens
aataactcctcccaggg

SEQ ID NO: 5109424 - DNA, 22 bp, Homo sapiens
aataactcctcccagggtttta

SEQ ID NO: 5109425 - DNA, 16 bp, Homo sapiens
aataactctgattttg

SEQ ID NO: 5109426 - DNA, 19 bp, Homo sapiens
aataactctgattttgata

SEQ ID NO: 5109427 - DNA, 19 bp, Homo sapiens
aataactctgtggcattat

SEQ ID NO: 5109428 - DNA, 23 bp, Homo sapiens
aataactgaaccaaattgcactg

SEQ ID NO: 5109429 - DNA, 13 bp, Homo sapiens
aataactgaactg

SEQ ID NO: 5109430 - DNA, 14 bp, Homo sapiens
aataactgaactgt

SEQ ID NO: 5109431 - DNA, 11 bp, Homo sapiens
aataactgaat

SEQ ID NO: 5109432 - DNA, 16 bp, Homo sapiens
aataactgaatttgga

SEQ ID NO: 5109433 - DNA, 20 bp, Homo sapiens
aataactgagatattatttt

SEQ ID NO: 5109434 - DNA, 21 bp, Homo sapiens
aataactgagatattatttta

SEQ ID NO: 5109435 - DNA, 22 bp, Homo sapiens
aataactgatgagatacatttg

SEQ ID NO: 5109436 - DNA, 18 bp, Homo sapiens
aataactggaaaacagaa

SEQ ID NO: 5109437 - DNA, 21 bp, Homo sapiens
aataactggaacaaattattt

SEQ ID NO: 5109438 - DNA, 19 bp, Homo sapiens
aataacttacaagactgta

SEQ ID NO: 5109439 - DNA, 20 bp, Homo sapiens
aataacttacaagactgtaa

SEQ ID NO: 5109440 - DNA, 19 bp, Homo sapiens
aataacttcagagaagtca

SEQ ID NO: 5109441 - DNA, 21 bp, Homo sapiens
aataacttctatattttaata

SEQ ID NO: 5109442 - DNA, 15 bp, Homo sapiens
aataacttctatgtt

SEQ ID NO: 5109443 - DNA, 20 bp, Homo sapiens
aataacttctatgttggttt

SEQ ID NO: 5109444 - DNA, 12 bp, Homo sapiens
aataacttgaag

SEQ ID NO: 5109445 - DNA, 15 bp, Homo sapiens
aataacttgccattt

SEQ ID NO: 5109446 - DNA, 21 bp, Homo sapiens
aataacttgccatttctttat

SEQ ID NO: 5109447 - DNA, 19 bp, Homo sapiens
aataacttgtgttactaat

SEQ ID NO: 5109448 - DNA, 13 bp, Homo sapiens
aataactttttct

SEQ ID NO: 5109449 - DNA, 12 bp, Homo sapiens
aataactttttt

SEQ ID NO: 5109450 - DNA, 19 bp, Homo sapiens
aataagaaacagtttaaca

SEQ ID NO: 5109451 - DNA, 20 bp, Homo sapiens
aataagaaacagtttaacag

SEQ ID NO: 5109452 - DNA, 18 bp, Homo sapiens
aataagaaagaattgcag

SEQ ID NO: 5109453 - DNA, 14 bp, Homo sapiens
aataagaaatgaac

SEQ ID NO: 5109454 - DNA, 21 bp, Homo sapiens
aataagaaatgaacaaaagat

SEQ ID NO: 5109455 - DNA, 23 bp, Homo sapiens
aataagaacaagttttggcagcc

SEQ ID NO: 5109456 - DNA, 22 bp, Homo sapiens
aataagaacattaattatatgt

SEQ ID NO: 5109457 - DNA, 14 bp, Homo sapiens
aataagaacttgaa

SEQ ID NO: 5109458 - DNA, 22 bp, Homo sapiens
aataagaattaggtttctttga

SEQ ID NO: 5109459 - DNA, 16 bp, Homo sapiens
aataagaattgaatgt

SEQ ID NO: 5109460 - DNA, 13 bp, Homo sapiens
aataagacaagag

SEQ ID NO: 5109461 - DNA, 14 bp, Homo sapiens
aataagacaagaga

SEQ ID NO: 5109462 - DNA, 20 bp, Homo sapiens
aataagacaagagatctaca

SEQ ID NO: 5109463 - DNA, 21 bp, Homo sapiens
aataagacaagagatctacac

SEQ ID NO: 5109464 - DNA, 21 bp, Homo sapiens
aataagacatgcttacttttt

SEQ ID NO: 5109465 - DNA, 17 bp, Homo sapiens
aataagactcttaccta

SEQ ID NO: 5109466 - DNA, 14 bp, Homo sapiens
aataagagaaagaa

SEQ ID NO: 5109467 - DNA, 20 bp, Homo sapiens
aataagagagtcataaacct

SEQ ID NO: 5109468 - DNA, 13 bp, Homo sapiens
aataagagatttg

SEQ ID NO: 5109469 - DNA, 21 bp, Homo sapiens
aataagagccctgagcccaga

SEQ ID NO: 5109470 - DNA, 16 bp, Homo sapiens
aataagagtaaaaata

SEQ ID NO: 5109471 - DNA, 22 bp, Homo sapiens
aataagagtctccttctcttct

SEQ ID NO: 5109472 - DNA, 18 bp, Homo sapiens
aataagagtgattagagc

SEQ ID NO: 5109473 - DNA, 23 bp, Homo sapiens
aataagagttgctttgccagagc

SEQ ID NO: 5109474 - DNA, 12 bp, Homo sapiens
aataagattcta

SEQ ID NO: 5109475 - DNA, 14 bp, Homo sapiens
aataagattctaac

SEQ ID NO: 5109476 - DNA, 22 bp, Homo sapiens
aataagattggtgttcgtttcc

SEQ ID NO: 5109477 - DNA, 22 bp, Homo sapiens
aataagatttagttgagttatt

SEQ ID NO: 5109478 - DNA, 16 bp, Homo sapiens
aataagatttttcaaa

SEQ ID NO: 5109479 - DNA, 18 bp, Homo sapiens
aataagatttttcaaaat

SEQ ID NO: 5109480 - DNA, 14 bp, Homo sapiens
aataagcaaaaaga

SEQ ID NO: 5109481 - DNA, 16 bp, Homo sapiens
aataagcacttgcctg

SEQ ID NO: 5109482 - DNA, 19 bp, Homo sapiens
aataagcacttgcctggaa

SEQ ID NO: 5109483 - DNA, 21 bp, Homo sapiens
aataagcacttgcctggaata

SEQ ID NO: 5109484 - DNA, 16 bp, Homo sapiens
aataagcagaggtgga

SEQ ID NO: 5109485 - DNA, 22 bp, Homo sapiens
aataagcagaggtggaaaatga

SEQ ID NO: 5109486 - DNA, 14 bp, Homo sapiens
aataagcaggtgga

SEQ ID NO: 5109487 - DNA, 23 bp, Homo sapiens
aataagcaggtggatctatttca

SEQ ID NO: 5109488 - DNA, 18 bp, Homo sapiens
aataagcataagaccaat

SEQ ID NO: 5109489 - DNA, 22 bp, Homo sapiens
aataagcccaacaagttgaaga

SEQ ID NO: 5109490 - DNA, 14 bp, Homo sapiens
aataagccttcgaa

SEQ ID NO: 5109491 - DNA, 19 bp, Homo sapiens
aataagcgtttaatggtat

SEQ ID NO: 5109492 - DNA, 21 bp, Homo sapiens
aataagcgtttaatggtatct

SEQ ID NO: 5109493 - DNA, 19 bp, Homo sapiens
aataagctactagcaaaat

SEQ ID NO: 5109494 - DNA, 18 bp, Homo sapiens
aataagctagatacgaaa

SEQ ID NO: 5109495 - DNA, 14 bp, Homo sapiens
aataagctatttga

SEQ ID NO: 5109496 - DNA, 22 bp, Homo sapiens
aataagctcctaaattatagag

SEQ ID NO: 5109497 - DNA, 21 bp, Homo sapiens
aataagctttctcagaatgtt

SEQ ID NO: 5109498 - DNA, 23 bp, Homo sapiens
aataagctttctctcagaaatgc

SEQ ID NO: 5109499 - DNA, 15 bp, Homo sapiens
aataaggaaaaaata

SEQ ID NO: 5109500 - DNA, 19 bp, Homo sapiens
aataaggaaaagtttaata

SEQ ID NO: 5109501 - DNA, 15 bp, Homo sapiens
aataaggaatagctt

SEQ ID NO: 5109502 - DNA, 22 bp, Homo sapiens
aataaggacaagcctaacttca

SEQ ID NO: 5109503 - DNA, 19 bp, Homo sapiens
aataaggaggaggagggag

SEQ ID NO: 5109504 - DNA, 15 bp, Homo sapiens
aataaggatgacttt

SEQ ID NO: 5109505 - DNA, 13 bp, Homo sapiens
aataaggatttat

SEQ ID NO: 5109506 - DNA, 15 bp, Homo sapiens
aataaggatttattc

SEQ ID NO: 5109507 - DNA, 19 bp, Homo sapiens
aataaggatttattctcag

SEQ ID NO: 5109508 - DNA, 23 bp, Homo sapiens
aataaggatttattctcagaaca

SEQ ID NO: 5109509 - DNA, 16 bp, Homo sapiens
aataaggcacccatct

SEQ ID NO: 5109510 - DNA, 21 bp, Homo sapiens
aataaggcaggcattgaggaa

SEQ ID NO: 5109511 - DNA, 12 bp, Homo sapiens
aataaggcaggg

SEQ ID NO: 5109512 - DNA, 22 bp, Homo sapiens
aataaggcatgcgaaatgttct

SEQ ID NO: 5109513 - DNA, 16 bp, Homo sapiens
aataaggcccagagcg

SEQ ID NO: 5109514 - DNA, 15 bp, Homo sapiens
aataaggctaaccat

SEQ ID NO: 5109515 - DNA, 19 bp, Homo sapiens
aataaggggcacctgggaa

SEQ ID NO: 5109516 - DNA, 17 bp, Homo sapiens
aataaggttatgattga

SEQ ID NO: 5109517 - DNA, 14 bp, Homo sapiens
aataagtaaataca

SEQ ID NO: 5109518 - DNA, 15 bp, Homo sapiens
aataagtaacatata

SEQ ID NO: 5109519 - DNA, 13 bp, Homo sapiens
aataagtaatatc

SEQ ID NO: 5109520 - DNA, 21 bp, Homo sapiens
aataagtatatcttaagaatg

SEQ ID NO: 5109521 - DNA, 16 bp, Homo sapiens
aataagtatttataat

SEQ ID NO: 5109522 - DNA, 21 bp, Homo sapiens
aataagtcaaaaggaacaaaa

SEQ ID NO: 5109523 - DNA, 22 bp, Homo sapiens
aataagtcaaaaggaacaaaaa

SEQ ID NO: 5109524 - DNA, 15 bp, Homo sapiens
aataagtcaccattg

SEQ ID NO: 5109525 - DNA, 14 bp, Homo sapiens
aataagtcatttta

SEQ ID NO: 5109526 - DNA, 23 bp, Homo sapiens
aataagtcattttaataactaaa

SEQ ID NO: 5109527 - DNA, 21 bp, Homo sapiens
aataagtcctaaagtgaagaa

SEQ ID NO: 5109528 - DNA, 15 bp, Homo sapiens
aataagtcttcctta

SEQ ID NO: 5109529 - DNA, 15 bp, Homo sapiens
aataagtgaaatttt

SEQ ID NO: 5109530 - DNA, 22 bp, Homo sapiens
aataagtgaagaatacatcaga

SEQ ID NO: 5109531 - DNA, 17 bp, Homo sapiens
aataagtgaatctaata

SEQ ID NO: 5109532 - DNA, 19 bp, Homo sapiens
aataagtgacaaataagat

SEQ ID NO: 5109533 - DNA, 21 bp, Homo sapiens
aataagtgacaaataagatta

SEQ ID NO: 5109534 - DNA, 17 bp, Homo sapiens
aataagtgccaggatgg

SEQ ID NO: 5109535 - DNA, 18 bp, Homo sapiens
aataagtgccctctccca

SEQ ID NO: 5109536 - DNA, 14 bp, Homo sapiens
aagtgcccaaagtg

SEQ ID NO: 5109537 - DNA, 19 bp, Homo sapiens
aagtgcccaaagtggggag

SEQ ID NO: 5109538 - DNA, 12 bp, Homo sapiens
aagtgcccagcc

SEQ ID NO: 5109539 - DNA, 17 bp, Homo sapiens
aagtgcccagcccctgc

SEQ ID NO: 5109540 - DNA, 19 bp, Homo sapiens
aagtgcccagcccctgccc

SEQ ID NO: 5109541 - DNA, 15 bp, Homo sapiens
aagtgcccagtggag

SEQ ID NO: 5109542 - DNA, 16 bp, Homo sapiens
aagtgccccaccactc

SEQ ID NO: 5109543 - DNA, 18 bp, Homo sapiens
aagtgccccctcacctct

SEQ ID NO: 5109544 - DNA, 14 bp, Homo sapiens
aagtgccccctccc

SEQ ID NO: 5109545 - DNA, 12 bp, Homo sapiens
aagtgcccctgc

SEQ ID NO: 5109546 - DNA, 19 bp, Homo sapiens
aagtgcccctgctgcctcc

SEQ ID NO: 5109547 - DNA, 21 bp, Homo sapiens
aagtgcccgccctgcccctgc

SEQ ID NO: 5109548 - DNA, 12 bp, Homo sapiens
aagtgccctcca

SEQ ID NO: 5109549 - DNA, 19 bp, Homo sapiens
aagtgccctctcccaccct

SEQ ID NO: 5109550 - DNA, 16 bp, Homo sapiens
aagtgccgcaaattgt

SEQ ID NO: 5109551 - DNA, 18 bp, Homo sapiens
aagtgcctacattatcta

SEQ ID NO: 5109552 - DNA, 15 bp, Homo sapiens
aagtgcctcggacag

SEQ ID NO: 5109553 - DNA, 19 bp, Homo sapiens
aagtgcctctgattctatg

SEQ ID NO: 5109554 - DNA, 21 bp, Homo sapiens
aagtgcctctgattctatgta

SEQ ID NO: 5109555 - DNA, 14 bp, Homo sapiens
aagtgcctcttgtt

SEQ ID NO: 5109556 - DNA, 14 bp, Homo sapiens
aagtgcctgagctg

SEQ ID NO: 5109557 - DNA, 19 bp, Homo sapiens
aagtgcctgagctggggaa

SEQ ID NO: 5109558 - DNA, 14 bp, Homo sapiens
aagtgcctgccttg

SEQ ID NO: 5109559 - DNA, 13 bp, Homo sapiens
aagtgcctgctgg

SEQ ID NO: 5109560 - DNA, 16 bp, Homo sapiens
aagtgcctgcttttga

SEQ ID NO: 5109561 - DNA, 12 bp, Homo sapiens
aagtgcctggga

SEQ ID NO: 5109562 - DNA, 13 bp, Homo sapiens
aagtgcctgggct

SEQ ID NO: 5109563 - DNA, 15 bp, Homo sapiens
aagtgcctgggctca

SEQ ID NO: 5109564 - DNA, 20 bp, Homo sapiens
aagtgccttaacctagaggg

SEQ ID NO: 5109565 - DNA, 17 bp, Homo sapiens
aagtgccttagcatgtg

SEQ ID NO: 5109566 - DNA, 18 bp, Homo sapiens
aagtgccttatcaaataa

SEQ ID NO: 5109567 - DNA, 21 bp, Homo sapiens
aagtgccttatcaaataatat

SEQ ID NO: 5109568 - DNA, 23 bp, Homo sapiens
aagtgccttctccttccccagga

SEQ ID NO: 5109569 - DNA, 14 bp, Homo sapiens
aagtgccttctggg

SEQ ID NO: 5109570 - DNA, 17 bp, Homo sapiens
aagtgccttctgggctt

SEQ ID NO: 5109571 - DNA, 23 bp, Homo sapiens
aagtgcctttctgcagtttttca

SEQ ID NO: 5109572 - DNA, 23 bp, Homo sapiens
aagtgcggcactgcaaagagacg

SEQ ID NO: 5109573 - DNA, 22 bp, Homo sapiens
aagtgcgtccacgagctgttta

SEQ ID NO: 5109574 - DNA, 15 bp, Homo sapiens
aagtgcgtgaatgta

SEQ ID NO: 5109575 - DNA, 16 bp, Homo sapiens
aagtgcgtgccgtgtg

SEQ ID NO: 5109576 - DNA, 21 bp, Homo sapiens
aagtgcgtgtgtagagttaag

SEQ ID NO: 5109577 - DNA, 22 bp, Homo sapiens
aagtgcgtgtgtagagttaaga

SEQ ID NO: 5109578 - DNA, 23 bp, Homo sapiens
aagtgcgtgtgtagagttaagaa

SEQ ID NO: 5109579 - DNA, 22 bp, Homo sapiens
aagtgctaaagttttcttccca

SEQ ID NO: 5109580 - DNA, 17 bp, Homo sapiens
aagtgctaaggttctaa

SEQ ID NO: 5109581 - DNA, 17 bp, Homo sapiens
aagtgctacagaaagca

SEQ ID NO: 5109582 - DNA, 17 bp, Homo sapiens
aagtgctacataaattg

SEQ ID NO: 5109583 - DNA, 17 bp, Homo sapiens
aagtgctacctttgagt

SEQ ID NO: 5109584 - DNA, 13 bp, Homo sapiens
aagtgctattacg

SEQ ID NO: 5109585 - DNA, 19 bp, Homo sapiens
aagtgctcaagcagcaaaa

SEQ ID NO: 5109586 - DNA, 14 bp, Homo sapiens
aagtgctcagtatt

SEQ ID NO: 5109587 - DNA, 17 bp, Homo sapiens
aagtgctcatctgttgt

SEQ ID NO: 5109588 - DNA, 11 bp, Homo sapiens
aagtgctcccc

SEQ ID NO: 5109589 - DNA, 12 bp, Homo sapiens
aagtgctccctg

SEQ ID NO: 5109590 - DNA, 20 bp, Homo sapiens
aagtgctcttggctgacccc

SEQ ID NO: 5109591 - DNA, 23 bp, Homo sapiens
aagtgctcttggctgacccctct

SEQ ID NO: 5109592 - DNA, 16 bp, Homo sapiens
aagtgctgaatttaca

SEQ ID NO: 5109593 - DNA, 14 bp, Homo sapiens
aagtgctgagatta

SEQ ID NO: 5109594 - DNA, 13 bp, Homo sapiens
aagtgctgcattt

SEQ ID NO: 5109595 - DNA, 22 bp, Homo sapiens
aagtgctgcatttaaaagatac

SEQ ID NO: 5109596 - DNA, 21 bp, Homo sapiens
aagtgctgcggagcaagagga

SEQ ID NO: 5109597 - DNA, 15 bp, Homo sapiens
aagtgctgctgtgga

SEQ ID NO: 5109598 - DNA, 19 bp, Homo sapiens
aagtgctggattgtccttg

SEQ ID NO: 5109599 - DNA, 21 bp, Homo sapiens
aagtgctggcaccaccaggca

SEQ ID NO: 5109600 - DNA, 12 bp, Homo sapiens
aagtgctgggat

SEQ ID NO: 5109601 - DNA, 13 bp, Homo sapiens
aagtgctgggatg

SEQ ID NO: 5109602 - DNA, 19 bp, Homo sapiens
aagtgctgggattacaggt

SEQ ID NO: 5109603 - DNA, 21 bp, Homo sapiens
aagtgctgggattacaggtgt

SEQ ID NO: 5109604 - DNA, 13 bp, Homo sapiens
aagtgctgtaccc

SEQ ID NO: 5109605 - DNA, 15 bp, Homo sapiens
aagtgctgtataaaa

SEQ ID NO: 5109606 - DNA, 16 bp, Homo sapiens
aagtgctgtataaaat

SEQ ID NO: 5109607 - DNA, 17 bp, Homo sapiens
aagtgctgtataaaatc

SEQ ID NO: 5109608 - DNA, 23 bp, Homo sapiens
aagtgctgtataaaatcagccaa

SEQ ID NO: 5109609 - DNA, 16 bp, Homo sapiens
aagtgctgtttattaa

SEQ ID NO: 5109610 - DNA, 22 bp, Homo sapiens
aagtgctgtttattaatcttag

SEQ ID NO: 5109611 - DNA, 18 bp, Homo sapiens
aagtgctgtttgagatgt

SEQ ID NO: 5109612 - DNA, 21 bp, Homo sapiens
aagtgcttaacatttgttgaa

SEQ ID NO: 5109613 - DNA, 21 bp, Homo sapiens
aagtgcttaacgttttcttaa

SEQ ID NO: 5109614 - DNA, 13 bp, Homo sapiens
aagtgcttagaaa

SEQ ID NO: 5109615 - DNA, 14 bp, Homo sapiens
aagtgcttagaaag

SEQ ID NO: 5109616 - DNA, 23 bp, Homo sapiens
aagtgcttagaggttctgcctct

SEQ ID NO: 5109617 - DNA, 20 bp, Homo sapiens
aagtgcttattctctcatca

SEQ ID NO: 5109618 - DNA, 13 bp, Homo sapiens
aagtgcttgtata

SEQ ID NO: 5109619 - DNA, 13 bp, Homo sapiens
aagtgcttgtgta

SEQ ID NO: 5109620 - DNA, 14 bp, Homo sapiens
aagtgcttgtgtaa

SEQ ID NO: 5109621 - DNA, 14 bp, Homo sapiens
aagtgcttgtttta

SEQ ID NO: 5109622 - DNA, 21 bp, Homo sapiens
aagtgcttttaaactggagag

SEQ ID NO: 5109623 - DNA, 23 bp, Homo sapiens
aagtgcttttaaactggagaggc

SEQ ID NO: 5109624 - DNA, 13 bp, Homo sapiens
aagtggaaaaaag

SEQ ID NO: 5109625 - DNA, 14 bp, Homo sapiens
aagtggaaaaaaga

SEQ ID NO: 5109626 - DNA, 21 bp, Homo sapiens
aagtggaaaaagaaattctgt

SEQ ID NO: 5109627 - DNA, 19 bp, Homo sapiens
aagtggaaaggatcacaga

SEQ ID NO: 5109628 - DNA, 19 bp, Homo sapiens
aagtggaagacagagatgg

SEQ ID NO: 5109629 - DNA, 13 bp, Homo sapiens
aagtggaaggaaa

SEQ ID NO: 5109630 - DNA, 15 bp, Homo sapiens
aagtggaaggaaaga

SEQ ID NO: 5109631 - DNA, 18 bp, Homo sapiens
aagtggaattaaaggaat

SEQ ID NO: 5109632 - DNA, 21 bp, Homo sapiens
aagtggaatttcttgtttctc

SEQ ID NO: 5109633 - DNA, 22 bp, Homo sapiens
aagtggacagagcgcccctccc

SEQ ID NO: 5109634 - DNA, 20 bp, Homo sapiens
aagtggaccaggacaggacc

SEQ ID NO: 5109635 - DNA, 20 bp, Homo sapiens
aagtggaccttgagaccaca

SEQ ID NO: 5109636 - DNA, 22 bp, Homo sapiens
aagtggactctctgacaaagtg

SEQ ID NO: 5109637 - DNA, 15 bp, Homo sapiens
aagtggactgtattt

SEQ ID NO: 5109638 - DNA, 16 bp, Homo sapiens
aagtggagctgtctgt

SEQ ID NO: 5109639 - DNA, 14 bp, Homo sapiens
aagtggagggggtg

SEQ ID NO: 5109640 - DNA, 21 bp, Homo sapiens
aagtggatattttcttaaaac

SEQ ID NO: 5109641 - DNA, 19 bp, Homo sapiens
aagtggatgggaatttgtc

SEQ ID NO: 5109642 - DNA, 21 bp, Homo sapiens
aagtggatgggaatttgtcag

SEQ ID NO: 5109643 - DNA, 14 bp, Homo sapiens
aagtggattttgta

SEQ ID NO: 5109644 - DNA, 22 bp, Homo sapiens
aagtggcaaagctgttcttcct

SEQ ID NO: 5109645 - DNA, 15 bp, Homo sapiens
aagtggcaagctctt

SEQ ID NO: 5109646 - DNA, 22 bp, Homo sapiens
aagtggcaagctcttcattgca

SEQ ID NO: 5109647 - DNA, 22 bp, Homo sapiens
aagtggcaatctcagatgcagt

SEQ ID NO: 5109648 - DNA, 17 bp, Homo sapiens
aagtggcaggaggacag

SEQ ID NO: 5109649 - DNA, 13 bp, Homo sapiens
aagtggcagggac

SEQ ID NO: 5109650 - DNA, 14 bp, Homo sapiens
aagtggcagggacc

SEQ ID NO: 5109651 - DNA, 21 bp, Homo sapiens
aagtggcataggagtgtgtta

SEQ ID NO: 5109652 - DNA, 21 bp, Homo sapiens
aagtggcccctcgtgacctac

SEQ ID NO: 5109653 - DNA, 15 bp, Homo sapiens
aagtggccctccctc

SEQ ID NO: 5109654 - DNA, 13 bp, Homo sapiens
aagtggcctcttg

SEQ ID NO: 5109655 - DNA, 18 bp, Homo sapiens
aagtggctaattcaattt

SEQ ID NO: 5109656 - DNA, 17 bp, Homo sapiens
aagtggctccccacctg

SEQ ID NO: 5109657 - DNA, 13 bp, Homo sapiens
aagtggctggaag

SEQ ID NO: 5109658 - DNA, 23 bp, Homo sapiens
aagtggctgggtgccctctcagg

SEQ ID NO: 5109659 - DNA, 19 bp, Homo sapiens
aagtggctggtctggagtc

SEQ ID NO: 5109660 - DNA, 18 bp, Homo sapiens
aagtgggaagtgaagccc

SEQ ID NO: 5109661 - DNA, 17 bp, Homo sapiens
aagtgggagaagtggcc

SEQ ID NO: 5109662 - DNA, 12 bp, Homo sapiens
aagtgggagcag

SEQ ID NO: 5109663 - DNA, 18 bp, Homo sapiens
aagtgggagtgggagagg

SEQ ID NO: 5109664 - DNA, 23 bp, Homo sapiens
aagtgggatttggggcctcaaga

SEQ ID NO: 5109665 - DNA, 16 bp, Homo sapiens
aagtgggccagtcctg

SEQ ID NO: 5109666 - DNA, 19 bp, Homo sapiens
aagtgggcccacccggtgg

SEQ ID NO: 5109667 - DNA, 13 bp, Homo sapiens
aagtgggctcctg

SEQ ID NO: 5109668 - DNA, 14 bp, Homo sapiens
aagtgggctcctga

SEQ ID NO: 5109669 - DNA, 22 bp, Homo sapiens
aagtgggctgcagcagccggaa

SEQ ID NO: 5109670 - DNA, 11 bp, Homo sapiens
aagtgggctgg

SEQ ID NO: 5109671 - DNA, 12 bp, Homo sapiens
aagtgggctggt

SEQ ID NO: 5109672 - DNA, 19 bp, Homo sapiens
aagtgggctggtattctct

SEQ ID NO: 5109673 - DNA, 14 bp, Homo sapiens
aagtggggacagat

SEQ ID NO: 5109674 - DNA, 15 bp, Homo sapiens
aagtggggacagatt

SEQ ID NO: 5109675 - DNA, 16 bp, Homo sapiens
aagtggggacagattc

SEQ ID NO: 5109676 - DNA, 17 bp, Homo sapiens
aagtggggaccccaccc

SEQ ID NO: 5109677 - DNA, 19 bp, Homo sapiens
aagtggggagagagccctt

SEQ ID NO: 5109678 - DNA, 13 bp, Homo sapiens
aagtggggcagag

SEQ ID NO: 5109679 - DNA, 17 bp, Homo sapiens
aagtggggctaaatgaa

SEQ ID NO: 5109680 - DNA, 18 bp, Homo sapiens
aagtggggctaaatgaag

SEQ ID NO: 5109681 - DNA, 15 bp, Homo sapiens
aagtggggctctggg

SEQ ID NO: 5109682 - DNA, 13 bp, Homo sapiens
aagtgggggcagc

SEQ ID NO: 5109683 - DNA, 15 bp, Homo sapiens
aagtgggggtggagg

SEQ ID NO: 5109684 - DNA, 13 bp, Homo sapiens
aagtggggtctgg

SEQ ID NO: 5109685 - DNA, 15 bp, Homo sapiens
aagtggggtgcatcc

SEQ ID NO: 5109686 - DNA, 18 bp, Homo sapiens
aagtggggtgctctggtc

SEQ ID NO: 5109687 - DNA, 15 bp, Homo sapiens
aagtggggtgttctt

SEQ ID NO: 5109688 - DNA, 20 bp, Homo sapiens
aagtggggttgcaaccactg

SEQ ID NO: 5109689 - DNA, 15 bp, Homo sapiens
aagtgggtaccccca

SEQ ID NO: 5109690 - DNA, 17 bp, Homo sapiens
aagtgggtaggccttgg

SEQ ID NO: 5109691 - DNA, 19 bp, Homo sapiens
aagtgggtcaattccttag

SEQ ID NO: 5109692 - DNA, 14 bp, Homo sapiens
aagtgggtgagatg

SEQ ID NO: 5109693 - DNA, 21 bp, Homo sapiens
aagtgggttttttagttgaat

SEQ ID NO: 5109694 - DNA, 16 bp, Homo sapiens
aagtggtaaatactgt

SEQ ID NO: 5109695 - DNA, 17 bp, Homo sapiens
aagtggtaattgggaac

SEQ ID NO: 5109696 - DNA, 23 bp, Homo sapiens
aagtggtaatttttgtacattac

SEQ ID NO: 5109697 - DNA, 23 bp, Homo sapiens
aagtggtactagtgtggtgtgtt

SEQ ID NO: 5109698 - DNA, 19 bp, Homo sapiens
aagtggtagtaatttcctt

SEQ ID NO: 5109699 - DNA, 17 bp, Homo sapiens
aagtggtatagaaatgc

SEQ ID NO: 5109700 - DNA, 22 bp, Homo sapiens
aagtggtcctagaggccctttg

SEQ ID NO: 5109701 - DNA, 13 bp, Homo sapiens
aagtggtctctgc

SEQ ID NO: 5109702 - DNA, 13 bp, Homo sapiens
aagtggtctgaac

SEQ ID NO: 5109703 - DNA, 23 bp, Homo sapiens
aagtggtctgtggatcagcattt

SEQ ID NO: 5109704 - DNA, 15 bp, Homo sapiens
aagtggtgagcaagc

SEQ ID NO: 5109705 - DNA, 13 bp, Homo sapiens
aagtggtgctcag

SEQ ID NO: 5109706 - DNA, 17 bp, Homo sapiens
aagtggtgctcagttgt

SEQ ID NO: 5109707 - DNA, 19 bp, Homo sapiens
aagtggtgctcagttgtag

SEQ ID NO: 5109708 - DNA, 18 bp, Homo sapiens
aagtggtggtaaccctgg

SEQ ID NO: 5109709 - DNA, 21 bp, Homo sapiens
aagtggtgtgatcccagctca

SEQ ID NO: 5109710 - DNA, 13 bp, Homo sapiens
aagtggttaagaa

SEQ ID NO: 5109711 - DNA, 18 bp, Homo sapiens
aagtggttccctctctta

SEQ ID NO: 5109712 - DNA, 18 bp, Homo sapiens
aagtggttctctgccttt

SEQ ID NO: 5109713 - DNA, 14 bp, Homo sapiens
aagtgtaaaataga

SEQ ID NO: 5109714 - DNA, 17 bp, Homo sapiens
aagtgtaaacaccatag

SEQ ID NO: 5109715 - DNA, 17 bp, Homo sapiens
aagtgtaaagcattcca

SEQ ID NO: 5109716 - DNA, 16 bp, Homo sapiens
aataagtgctgtttga

SEQ ID NO: 5109717 - DNA, 22 bp, Homo sapiens
aataagtgctgtttgagatgtg

SEQ ID NO: 5109718 - DNA, 17 bp, Homo sapiens
aataagtggattttgta

SEQ ID NO: 5109719 - DNA, 13 bp, Homo sapiens
aataagtgtacat

SEQ ID NO: 5109720 - DNA, 19 bp, Homo sapiens
aataagtgtacatatgtaa

SEQ ID NO: 5109721 - DNA, 17 bp, Homo sapiens
aataagtgttgtaccat

SEQ ID NO: 5109722 - DNA, 15 bp, Homo sapiens
aataagttaaaggca

SEQ ID NO: 5109723 - DNA, 14 bp, Homo sapiens
aataagttattgca

SEQ ID NO: 5109724 - DNA, 22 bp, Homo sapiens
aataagttcaaattcttctgaa

SEQ ID NO: 5109725 - DNA, 19 bp, Homo sapiens
aataagttcatacaatcgt

SEQ ID NO: 5109726 - DNA, 15 bp, Homo sapiens
aataagttcccattt

SEQ ID NO: 5109727 - DNA, 17 bp, Homo sapiens
aataagttcctctgaag

SEQ ID NO: 5109728 - DNA, 17 bp, Homo sapiens
aataagttgactttcaa

SEQ ID NO: 5109729 - DNA, 19 bp, Homo sapiens
aataagttgactttcaaat

SEQ ID NO: 5109730 - DNA, 20 bp, Homo sapiens
aataagttgatgttttctaa

SEQ ID NO: 5109731 - DNA, 19 bp, Homo sapiens
aataagttttatacataaa

SEQ ID NO: 5109732 - DNA, 23 bp, Homo sapiens
aataagttttatacataaacagt

SEQ ID NO: 5109733 - DNA, 16 bp, Homo sapiens
aataagttttgatata

SEQ ID NO: 5109734 - DNA, 18 bp, Homo sapiens
aataagttttgatataat

SEQ ID NO: 5109735 - DNA, 17 bp, Homo sapiens
aataagtttttctttaa

SEQ ID NO: 5109736 - DNA, 13 bp, Homo sapiens
aataataaaatac

SEQ ID NO: 5109737 - DNA, 16 bp, Homo sapiens
aataataaaatacttt

SEQ ID NO: 5109738 - DNA, 12 bp, Homo sapiens
aataataaaatg

SEQ ID NO: 5109739 - DNA, 13 bp, Homo sapiens
aataataaaatgc

SEQ ID NO: 5109740 - DNA, 15 bp, Homo sapiens
aataataaaatgcaa

SEQ ID NO: 5109741 - DNA, 16 bp, Homo sapiens
aataataaaatgcaaa

SEQ ID NO: 5109742 - DNA, 21 bp, Homo sapiens
aataataaagatcatgtaaaa

SEQ ID NO: 5109743 - DNA, 18 bp, Homo sapiens
aataataaagatgctctt

SEQ ID NO: 5109744 - DNA, 16 bp, Homo sapiens
aataataaagatgtga

SEQ ID NO: 5109745 - DNA, 19 bp, Homo sapiens
aataataaagatgtgaaaa

SEQ ID NO: 5109746 - DNA, 13 bp, Homo sapiens
aataataaagcta

SEQ ID NO: 5109747 - DNA, 15 bp, Homo sapiens
aataataaaggttct

SEQ ID NO: 5109748 - DNA, 21 bp, Homo sapiens
aataataaaggttctatgata

SEQ ID NO: 5109749 - DNA, 15 bp, Homo sapiens
aataataaagtatga

SEQ ID NO: 5109750 - DNA, 16 bp, Homo sapiens
aataataaatagttct

SEQ ID NO: 5109751 - DNA, 20 bp, Homo sapiens
aataataaatgcatagagca

SEQ ID NO: 5109752 - DNA, 13 bp, Homo sapiens
aataataaattgc

SEQ ID NO: 5109753 - DNA, 14 bp, Homo sapiens
aataataaattgca

SEQ ID NO: 5109754 - DNA, 20 bp, Homo sapiens
aataataagtgatgtgctga

SEQ ID NO: 5109755 - DNA, 13 bp, Homo sapiens
aataataataaat

SEQ ID NO: 5109756 - DNA, 13 bp, Homo sapiens
aataataataaca

SEQ ID NO: 5109757 - DNA, 14 bp, Homo sapiens
aataataatataat

SEQ ID NO: 5109758 - DNA, 15 bp, Homo sapiens
aataataatatccag

SEQ ID NO: 5109759 - DNA, 18 bp, Homo sapiens
aataataatgactctaaa

SEQ ID NO: 5109760 - DNA, 11 bp, Homo sapiens
aataataatta

SEQ ID NO: 5109761 - DNA, 21 bp, Homo sapiens
aataataattaggttaacatt

SEQ ID NO: 5109762 - DNA, 17 bp, Homo sapiens
aataataattgaagaat

SEQ ID NO: 5109763 - DNA, 21 bp, Homo sapiens
aataataccccaacagatgag

SEQ ID NO: 5109764 - DNA, 21 bp, Homo sapiens
aataatacctcaatgtttgag

SEQ ID NO: 5109765 - DNA, 14 bp, Homo sapiens
aataatactaattt

SEQ ID NO: 5109766 - DNA, 20 bp, Homo sapiens
aataatactgacctacctca

SEQ ID NO: 5109767 - DNA, 16 bp, Homo sapiens
aataatactgctgaga

SEQ ID NO: 5109768 - DNA, 15 bp, Homo sapiens
aataatacttcatac

SEQ ID NO: 5109769 - DNA, 13 bp, Homo sapiens
aataatagactgt

SEQ ID NO: 5109770 - DNA, 18 bp, Homo sapiens
aataatagattgtgaata

SEQ ID NO: 5109771 - DNA, 14 bp, Homo sapiens
aataatagctaata

SEQ ID NO: 5109772 - DNA, 13 bp, Homo sapiens
aataatagtacta

SEQ ID NO: 5109773 - DNA, 19 bp, Homo sapiens
aataatagttcaggatttg

SEQ ID NO: 5109774 - DNA, 21 bp, Homo sapiens
aataatagttcaggatttggt

SEQ ID NO: 5109775 - DNA, 13 bp, Homo sapiens
aataatataaaat

SEQ ID NO: 5109776 - DNA, 12 bp, Homo sapiens
aataatatactt

SEQ ID NO: 5109777 - DNA, 13 bp, Homo sapiens
aataatatacttg

SEQ ID NO: 5109778 - DNA, 17 bp, Homo sapiens
aataatatattttctgt

SEQ ID NO: 5109779 - DNA, 16 bp, Homo sapiens
aataatatcaaaacaa

SEQ ID NO: 5109780 - DNA, 13 bp, Homo sapiens
aataatatgattt

SEQ ID NO: 5109781 - DNA, 13 bp, Homo sapiens
aataatatgcatt

SEQ ID NO: 5109782 - DNA, 13 bp, Homo sapiens
aataatatgtaca

SEQ ID NO: 5109783 - DNA, 16 bp, Homo sapiens
aataatatgtacaaat

SEQ ID NO: 5109784 - DNA, 19 bp, Homo sapiens
aataatatgtacaaataat

SEQ ID NO: 5109785 - DNA, 20 bp, Homo sapiens
aataatatgtgatgattaat

SEQ ID NO: 5109786 - DNA, 16 bp, Homo sapiens
aataatattatattgt

SEQ ID NO: 5109787 - DNA, 15 bp, Homo sapiens
aataatattcaatac

SEQ ID NO: 5109788 - DNA, 14 bp, Homo sapiens
aataatattgcctt

SEQ ID NO: 5109789 - DNA, 23 bp, Homo sapiens
aataatattgccttgatgtttct

SEQ ID NO: 5109790 - DNA, 24 bp, Homo sapiens
aataatattgccttgatgtttcta

SEQ ID NO: 5109791 - DNA, 17 bp, Homo sapiens
aataatattgtttttct

SEQ ID NO: 5109792 - DNA, 21 bp, Homo sapiens
aataatattgtttttctttct

SEQ ID NO: 5109793 - DNA, 17 bp, Homo sapiens
aataatatttcaagtgc

SEQ ID NO: 5109794 - DNA, 15 bp, Homo sapiens
aataatattttagaa

SEQ ID NO: 5109795 - DNA, 15 bp, Homo sapiens
aataatcaaaccaaa

SEQ ID NO: 5109796 - DNA, 20 bp, Homo sapiens
aataatcaaaccaaagagta

SEQ ID NO: 5109797 - DNA, 13 bp, Homo sapiens
aataatcaagagc

SEQ ID NO: 5109798 - DNA, 15 bp, Homo sapiens
aataatcaagagcct

SEQ ID NO: 5109799 - DNA, 21 bp, Homo sapiens
aataatcacgctttcctgaat

SEQ ID NO: 5109800 - DNA, 20 bp, Homo sapiens
aataatcatgtgaaatgttt

SEQ ID NO: 5109801 - DNA, 20 bp, Homo sapiens
aataatcattctttcccctc

SEQ ID NO: 5109802 - DNA, 14 bp, Homo sapiens
aataatccaccccc

SEQ ID NO: 5109803 - DNA, 14 bp, Homo sapiens
aataatccagtatt

SEQ ID NO: 5109804 - DNA, 12 bp, Homo sapiens
aataatccattc

SEQ ID NO: 5109805 - DNA, 21 bp, Homo sapiens
aataatccattccaaaataca

SEQ ID NO: 5109806 - DNA, 23 bp, Homo sapiens
aataatccctgtaatatttagct

SEQ ID NO: 5109807 - DNA, 21 bp, Homo sapiens
aataatcctaaacatatgaat

SEQ ID NO: 5109808 - DNA, 15 bp, Homo sapiens
aataatcctctatgt

SEQ ID NO: 5109809 - DNA, 19 bp, Homo sapiens
aataatccttaaactagct

SEQ ID NO: 5109810 - DNA, 21 bp, Homo sapiens
aataatcgactttttaaatgt

SEQ ID NO: 5109811 - DNA, 13 bp, Homo sapiens
aataatcggccca

SEQ ID NO: 5109812 - DNA, 19 bp, Homo sapiens
aataatctatattaaatga

SEQ ID NO: 5109813 - DNA, 15 bp, Homo sapiens
aataatctatgatga

SEQ ID NO: 5109814 - DNA, 18 bp, Homo sapiens
aataatctcatcccccca

SEQ ID NO: 5109815 - DNA, 13 bp, Homo sapiens
aataatcttatta

SEQ ID NO: 5109816 - DNA, 13 bp, Homo sapiens
aataatgaaaata

SEQ ID NO: 5109817 - DNA, 18 bp, Homo sapiens
aataatgaatgtcatgca

SEQ ID NO: 5109818 - DNA, 20 bp, Homo sapiens
aataatgacagatggtgaag

SEQ ID NO: 5109819 - DNA, 15 bp, Homo sapiens
aataatgagaaatgt

SEQ ID NO: 5109820 - DNA, 21 bp, Homo sapiens
aataatgagctattaaaactc

SEQ ID NO: 5109821 - DNA, 22 bp, Homo sapiens
aataatgagctattaaaactca

SEQ ID NO: 5109822 - DNA, 21 bp, Homo sapiens
aataatgagtctgcataaact

SEQ ID NO: 5109823 - DNA, 22 bp, Homo sapiens
aataatgagtctgcataaactt

SEQ ID NO: 5109824 - DNA, 23 bp, Homo sapiens
aataatgagtctgcataaacttc

SEQ ID NO: 5109825 - DNA, 15 bp, Homo sapiens
aataatgattcaatg

SEQ ID NO: 5109826 - DNA, 15 bp, Homo sapiens
aataatgcaaacttt

SEQ ID NO: 5109827 - DNA, 12 bp, Homo sapiens
aataatgcagta

SEQ ID NO: 5109828 - DNA, 22 bp, Homo sapiens
aataatgcctttgtaaccacaa

SEQ ID NO: 5109829 - DNA, 17 bp, Homo sapiens
aataatgctttaaaata

SEQ ID NO: 5109830 - DNA, 12 bp, Homo sapiens
aataatgctttg

SEQ ID NO: 5109831 - DNA, 23 bp, Homo sapiens
aataatgcttttctaattaatag

SEQ ID NO: 5109832 - DNA, 22 bp, Homo sapiens
aataatggaaaaaaaaaaaaga

SEQ ID NO: 5109833 - DNA, 20 bp, Homo sapiens
aataatggaattatgtataa

SEQ ID NO: 5109834 - DNA, 18 bp, Homo sapiens
aataatggagaatcactt

SEQ ID NO: 5109835 - DNA, 18 bp, Homo sapiens
aataatgggtttctttca

SEQ ID NO: 5109836 - DNA, 13 bp, Homo sapiens
aataatggtacca

SEQ ID NO: 5109837 - DNA, 20 bp, Homo sapiens
aataatggtcccatccaggc

SEQ ID NO: 5109838 - DNA, 20 bp, Homo sapiens
aataatggttactcatttta

SEQ ID NO: 5109839 - DNA, 17 bp, Homo sapiens
aataatgtaacatgatt

SEQ ID NO: 5109840 - DNA, 12 bp, Homo sapiens
aataatgtaaga

SEQ ID NO: 5109841 - DNA, 17 bp, Homo sapiens
aataatgtaagggtctg

SEQ ID NO: 5109842 - DNA, 17 bp, Homo sapiens
aataatgtaatactgta

SEQ ID NO: 5109843 - DNA, 14 bp, Homo sapiens
aataatgtatgtac

SEQ ID NO: 5109844 - DNA, 12 bp, Homo sapiens
aataatgtattg

SEQ ID NO: 5109845 - DNA, 15 bp, Homo sapiens
aataatgtattgtaa

SEQ ID NO: 5109846 - DNA, 19 bp, Homo sapiens
aataatgtcctttccctgg

SEQ ID NO: 5109847 - DNA, 18 bp, Homo sapiens
aataatgtctagattttg

SEQ ID NO: 5109848 - DNA, 12 bp, Homo sapiens
aataatgtctct

SEQ ID NO: 5109849 - DNA, 18 bp, Homo sapiens
aataatgtcttgttaata

SEQ ID NO: 5109850 - DNA, 15 bp, Homo sapiens
aataatgtgaatcat

SEQ ID NO: 5109851 - DNA, 12 bp, Homo sapiens
aataatgtgcaa

SEQ ID NO: 5109852 - DNA, 13 bp, Homo sapiens
aataatgtgcaaa

SEQ ID NO: 5109853 - DNA, 16 bp, Homo sapiens
aataatgtgggaagaa

SEQ ID NO: 5109854 - DNA, 21 bp, Homo sapiens
aataatgtgggaagaaacaaa

SEQ ID NO: 5109855 - DNA, 12 bp, Homo sapiens
aataatgttaag

SEQ ID NO: 5109856 - DNA, 14 bp, Homo sapiens
aataatgttctgtc

SEQ ID NO: 5109857 - DNA, 12 bp, Homo sapiens
aataatgtttca

SEQ ID NO: 5109858 - DNA, 21 bp, Homo sapiens
aataattaaaacaaaatcctt

SEQ ID NO: 5109859 - DNA, 13 bp, Homo sapiens
aataattaaataa

SEQ ID NO: 5109860 - DNA, 17 bp, Homo sapiens
aataattaaataaatga

SEQ ID NO: 5109861 - DNA, 19 bp, Homo sapiens
aataattacagtgcctaaa

SEQ ID NO: 5109862 - DNA, 22 bp, Homo sapiens
aataattacagtgcctaaaata

SEQ ID NO: 5109863 - DNA, 18 bp, Homo sapiens
aataattagctatatttt

SEQ ID NO: 5109864 - DNA, 22 bp, Homo sapiens
aataattaggttaacattgttg

SEQ ID NO: 5109865 - DNA, 21 bp, Homo sapiens
aataattatatgctatttcta

SEQ ID NO: 5109866 - DNA, 18 bp, Homo sapiens
aataattatccagagttt

SEQ ID NO: 5109867 - DNA, 12 bp, Homo sapiens
aataattattat

SEQ ID NO: 5109868 - DNA, 14 bp, Homo sapiens
aataattattatta

SEQ ID NO: 5109869 - DNA, 12 bp, Homo sapiens
aataattcatca

SEQ ID NO: 5109870 - DNA, 23 bp, Homo sapiens
aataattccacagtcctgaagca

SEQ ID NO: 5109871 - DNA, 21 bp, Homo sapiens
aataattctgagttttgtgtt

SEQ ID NO: 5109872 - DNA, 17 bp, Homo sapiens
aataattctgctttaga

SEQ ID NO: 5109873 - DNA, 16 bp, Homo sapiens
aataattcttttctga

SEQ ID NO: 5109874 - DNA, 23 bp, Homo sapiens
aataattcttttttattaatcac

SEQ ID NO: 5109875 - DNA, 17 bp, Homo sapiens
aataattgaacaataaa

SEQ ID NO: 5109876 - DNA, 13 bp, Homo sapiens
aataattgaagaa

SEQ ID NO: 5109877 - DNA, 15 bp, Homo sapiens
aataattgaagaatg

SEQ ID NO: 5109878 - DNA, 13 bp, Homo sapiens
aataattgacagg

SEQ ID NO: 5109879 - DNA, 20 bp, Homo sapiens
aataattgatttcaagacct

SEQ ID NO: 5109880 - DNA, 21 bp, Homo sapiens
aataattgcagaactaaactc

SEQ ID NO: 5109881 - DNA, 13 bp, Homo sapiens
aataattggcttt

SEQ ID NO: 5109882 - DNA, 22 bp, Homo sapiens
aataattgtatctacattaaaa

SEQ ID NO: 5109883 - DNA, 17 bp, Homo sapiens
aataattgtggagagga

SEQ ID NO: 5109884 - DNA, 22 bp, Homo sapiens
aataattgtggagaggagagaa

SEQ ID NO: 5109885 - DNA, 14 bp, Homo sapiens
aataattgttgttc

SEQ ID NO: 5109886 - DNA, 18 bp, Homo sapiens
aataattgttgttctgtt

SEQ ID NO: 5109887 - DNA, 22 bp, Homo sapiens
aataattgttgttctgttaact

SEQ ID NO: 5109888 - DNA, 13 bp, Homo sapiens
aataattgtttcc

SEQ ID NO: 5109889 - DNA, 22 bp, Homo sapiens
aataattgtttccaacttgtct

SEQ ID NO: 5109890 - DNA, 16 bp, Homo sapiens
aataatttaactaatt

SEQ ID NO: 5109891 - DNA, 18 bp, Homo sapiens
aataatttaactaattta

SEQ ID NO: 5109892 - DNA, 22 bp, Homo sapiens
aataatttaactaatttaaacc

SEQ ID NO: 5109893 - DNA, 23 bp, Homo sapiens
aataatttaactaatttaaacca

SEQ ID NO: 5109894 - DNA, 23 bp, Homo sapiens
aataatttaactacccttaatta

SEQ ID NO: 5109895 - DNA, 23 bp, Homo sapiens
aataatttaagccaataaataat

SEQ ID NO: 5109896 - DNA, 22 bp, Homo sapiens
aagtgtaaagcattccaacaaa

SEQ ID NO: 5109897 - DNA, 15 bp, Homo sapiens
aagtgtaaataatat

SEQ ID NO: 5109898 - DNA, 15 bp, Homo sapiens
aagtgtaaatgaagt

SEQ ID NO: 5109899 - DNA, 21 bp, Homo sapiens
aagtgtaaatgaagtacagta

SEQ ID NO: 5109900 - DNA, 17 bp, Homo sapiens
aagtgtaacagctgagg

SEQ ID NO: 5109901 - DNA, 21 bp, Homo sapiens
aagtgtaacatatgcaaacat

SEQ ID NO: 5109902 - DNA, 12 bp, Homo sapiens
aagtgtaactgg

SEQ ID NO: 5109903 - DNA, 15 bp, Homo sapiens
aagtgtaagcacttc

SEQ ID NO: 5109904 - DNA, 14 bp, Homo sapiens
aagtgtaagtttgt

SEQ ID NO: 5109905 - DNA, 16 bp, Homo sapiens
aagtgtaataatatga

SEQ ID NO: 5109906 - DNA, 16 bp, Homo sapiens
aagtgtaatagattat

SEQ ID NO: 5109907 - DNA, 16 bp, Homo sapiens
aagtgtaattagcttt

SEQ ID NO: 5109908 - DNA, 17 bp, Homo sapiens
aagtgtacaagttgctt

SEQ ID NO: 5109909 - DNA, 13 bp, Homo sapiens
aagtgtacaattt

SEQ ID NO: 5109910 - DNA, 16 bp, Homo sapiens
aagtgtacagaagaat

SEQ ID NO: 5109911 - DNA, 17 bp, Homo sapiens
aagtgtacagaagaatt

SEQ ID NO: 5109912 - DNA, 15 bp, Homo sapiens
aagtgtacatatgta

SEQ ID NO: 5109913 - DNA, 16 bp, Homo sapiens
aagtgtacatgaagaa

SEQ ID NO: 5109914 - DNA, 14 bp, Homo sapiens
aagtgtacatttta

SEQ ID NO: 5109915 - DNA, 17 bp, Homo sapiens
aagtgtactaattaaca

SEQ ID NO: 5109916 - DNA, 15 bp, Homo sapiens
aagtgtactggattt

SEQ ID NO: 5109917 - DNA, 17 bp, Homo sapiens
aagtgtagatgtagcat

SEQ ID NO: 5109918 - DNA, 18 bp, Homo sapiens
aagtgtagatgtagcatt

SEQ ID NO: 5109919 - DNA, 20 bp, Homo sapiens
aagtgtagatgtagcattgt

SEQ ID NO: 5109920 - DNA, 11 bp, Homo sapiens
aagtgtagctc

SEQ ID NO: 5109921 - DNA, 20 bp, Homo sapiens
aagtgtaggcagacacaggg

SEQ ID NO: 5109922 - DNA, 21 bp, Homo sapiens
aagtgtaggcagacacaggga

SEQ ID NO: 5109923 - DNA, 23 bp, Homo sapiens
aagtgtagggcaagggtgcctca

SEQ ID NO: 5109924 - DNA, 18 bp, Homo sapiens
aagtgtatatttattcat

SEQ ID NO: 5109925 - DNA, 19 bp, Homo sapiens
aagtgtatatttattcata

SEQ ID NO: 5109926 - DNA, 18 bp, Homo sapiens
aagtgtatgcacgtgtgc

SEQ ID NO: 5109927 - DNA, 17 bp, Homo sapiens
aagtgtattatttctgg

SEQ ID NO: 5109928 - DNA, 15 bp, Homo sapiens
aagtgtattgtaatg

SEQ ID NO: 5109929 - DNA, 13 bp, Homo sapiens
aagtgtatttgga

SEQ ID NO: 5109930 - DNA, 21 bp, Homo sapiens
aagtgtatttggaaataaagt

SEQ ID NO: 5109931 - DNA, 19 bp, Homo sapiens
aagtgtattttataaaatt

SEQ ID NO: 5109932 - DNA, 20 bp, Homo sapiens
aagtgtattttataaaatta

SEQ ID NO: 5109933 - DNA, 21 bp, Homo sapiens
aagtgtattttataaaattaa

SEQ ID NO: 5109934 - DNA, 15 bp, Homo sapiens
aagtgtatttttcaa

SEQ ID NO: 5109935 - DNA, 23 bp, Homo sapiens
aagtgtatttttgtttaatcaaa

SEQ ID NO: 5109936 - DNA, 23 bp, Homo sapiens
aagtgtatttttttactaataga

SEQ ID NO: 5109937 - DNA, 22 bp, Homo sapiens
aagtgtcaaggggccctaggaa

SEQ ID NO: 5109938 - DNA, 16 bp, Homo sapiens
aagtgtcaccttttct

SEQ ID NO: 5109939 - DNA, 14 bp, Homo sapiens
aagtgtcatttctt

SEQ ID NO: 5109940 - DNA, 22 bp, Homo sapiens
aagtgtccattgacatgtacag

SEQ ID NO: 5109941 - DNA, 17 bp, Homo sapiens
aagtgtcccttgagtga

SEQ ID NO: 5109942 - DNA, 17 bp, Homo sapiens
aagtgtcctctggctga

SEQ ID NO: 5109943 - DNA, 16 bp, Homo sapiens
aagtgtcgtctccgct

SEQ ID NO: 5109944 - DNA, 23 bp, Homo sapiens
aagtgtctaaaatacttgagaaa

SEQ ID NO: 5109945 - DNA, 18 bp, Homo sapiens
aagtgtctacatgtgcca

SEQ ID NO: 5109946 - DNA, 20 bp, Homo sapiens
aagtgtctagagtcatgtga

SEQ ID NO: 5109947 - DNA, 19 bp, Homo sapiens
aagtgtctcaaaggagctt

SEQ ID NO: 5109948 - DNA, 22 bp, Homo sapiens
aagtgtctgccagctgggccca

SEQ ID NO: 5109949 - DNA, 13 bp, Homo sapiens
aagtgtcttctgt

SEQ ID NO: 5109950 - DNA, 19 bp, Homo sapiens
aagtgtcttttgacatttt

SEQ ID NO: 5109951 - DNA, 13 bp, Homo sapiens
aagtgtgaactgg

SEQ ID NO: 5109952 - DNA, 15 bp, Homo sapiens
aagtgtgaatactgc

SEQ ID NO: 5109953 - DNA, 18 bp, Homo sapiens
aagtgtgaatactgcttg

SEQ ID NO: 5109954 - DNA, 14 bp, Homo sapiens
aagtgtgaccagtt

SEQ ID NO: 5109955 - DNA, 17 bp, Homo sapiens
aagtgtgaccccactgc

SEQ ID NO: 5109956 - DNA, 19 bp, Homo sapiens
aagtgtgaccccactgcca

SEQ ID NO: 5109957 - DNA, 14 bp, Homo sapiens
aagtgtgagcgcct

SEQ ID NO: 5109958 - DNA, 22 bp, Homo sapiens
aagtgtgattgggaataaatat

SEQ ID NO: 5109959 - DNA, 11 bp, Homo sapiens
aagtgtgcata

SEQ ID NO: 5109960 - DNA, 21 bp, Homo sapiens
aagtgtgcctgctatccagcc

SEQ ID NO: 5109961 - DNA, 20 bp, Homo sapiens
aagtgtgctgaggtgggcct

SEQ ID NO: 5109962 - DNA, 17 bp, Homo sapiens
aagtgtgctgggcagag

SEQ ID NO: 5109963 - DNA, 20 bp, Homo sapiens
aagtgtgctgggcagaggga

SEQ ID NO: 5109964 - DNA, 16 bp, Homo sapiens
aagtgtgctttataaa

SEQ ID NO: 5109965 - DNA, 19 bp, Homo sapiens
aagtgtgctttataaaaaa

SEQ ID NO: 5109966 - DNA, 21 bp, Homo sapiens
aagtgtgctttatgctgaaac

SEQ ID NO: 5109967 - DNA, 21 bp, Homo sapiens
aagtgtggaaaaatagctctg

SEQ ID NO: 5109968 - DNA, 24 bp, Homo sapiens
aagtgtggaggagaggggtggagg

SEQ ID NO: 5109969 - DNA, 20 bp, Homo sapiens
aagtgtggatgttcagaatt

SEQ ID NO: 5109970 - DNA, 19 bp, Homo sapiens
aagtgtggctggtgtcccc

SEQ ID NO: 5109971 - DNA, 17 bp, Homo sapiens
aagtgtgggctgggcgt

SEQ ID NO: 5109972 - DNA, 20 bp, Homo sapiens
aagtgtgggtctgtgtgtgt

SEQ ID NO: 5109973 - DNA, 19 bp, Homo sapiens
aagtgtggtcccaacagga

SEQ ID NO: 5109974 - DNA, 15 bp, Homo sapiens
aagtgtggtgtcttt

SEQ ID NO: 5109975 - DNA, 17 bp, Homo sapiens
aagtgtgtataaaacat

SEQ ID NO: 5109976 - DNA, 19 bp, Homo sapiens
aagtgtgtatatattttgt

SEQ ID NO: 5109977 - DNA, 21 bp, Homo sapiens
aagtgtgtatatattttgtgt

SEQ ID NO: 5109978 - DNA, 15 bp, Homo sapiens
aagtgtgtattaaaa

SEQ ID NO: 5109979 - DNA, 20 bp, Homo sapiens
aagtgtgtcaaatcaataaa

SEQ ID NO: 5109980 - DNA, 13 bp, Homo sapiens
aagtgtgtctggg

SEQ ID NO: 5109981 - DNA, 23 bp, Homo sapiens
aagtgtgtggaaggcagggacag

SEQ ID NO: 5109982 - DNA, 24 bp, Homo sapiens
aagtgtgtggaaggcagggacaga

SEQ ID NO: 5109983 - DNA, 18 bp, Homo sapiens
aagtgtgtggtagaaaca

SEQ ID NO: 5109984 - DNA, 13 bp, Homo sapiens
aagtgtgtgtgca

SEQ ID NO: 5109985 - DNA, 16 bp, Homo sapiens
aagtgtgtgtgcaatg

SEQ ID NO: 5109986 - DNA, 17 bp, Homo sapiens
aagtgtgtgtgcaatgt

SEQ ID NO: 5109987 - DNA, 16 bp, Homo sapiens
aagtgtgtgtttcttg

SEQ ID NO: 5109988 - DNA, 16 bp, Homo sapiens
aagtgtgtgtttttca

SEQ ID NO: 5109989 - DNA, 15 bp, Homo sapiens
aagtgtgttctgatg

SEQ ID NO: 5109990 - DNA, 12 bp, Homo sapiens
aagtgtgtttgc

SEQ ID NO: 5109991 - DNA, 16 bp, Homo sapiens
aagtgttaatactagt

SEQ ID NO: 5109992 - DNA, 15 bp, Homo sapiens
aagtgttagatagaa

SEQ ID NO: 5109993 - DNA, 17 bp, Homo sapiens
aagtgttcaagaaataa

SEQ ID NO: 5109994 - DNA, 19 bp, Homo sapiens
aagtgttcaagaaataaaa

SEQ ID NO: 5109995 - DNA, 13 bp, Homo sapiens
aagtgttcagtgt

SEQ ID NO: 5109996 - DNA, 14 bp, Homo sapiens
aagtgttcagtgtt

SEQ ID NO: 5109997 - DNA, 20 bp, Homo sapiens
aagtgttcagtgttgacata

SEQ ID NO: 5109998 - DNA, 21 bp, Homo sapiens
aagtgttcagtgttgacatag

SEQ ID NO: 5109999 - DNA, 20 bp, Homo sapiens
aagtgttcattgcacaatat

SEQ ID NO: 5110000 - DNA, 22 bp, Homo sapiens
aagtgttccctgagaaacccac

SEQ ID NO: 5110001 - DNA, 17 bp, Homo sapiens
aagtgttctcatgaagc

SEQ ID NO: 5110002 - DNA, 19 bp, Homo sapiens
aagtgttctcatgaagcag

SEQ ID NO: 5110003 - DNA, 23 bp, Homo sapiens
aagtgttctcatgaagcaggagg

SEQ ID NO: 5110004 - DNA, 16 bp, Homo sapiens
aagtgttctgttacaa

SEQ ID NO: 5110005 - DNA, 17 bp, Homo sapiens
aagtgttctgttacaaa

SEQ ID NO: 5110006 - DNA, 19 bp, Homo sapiens
aagtgttctgttacaaaat

SEQ ID NO: 5110007 - DNA, 16 bp, Homo sapiens
aagtgttcttaggttt

SEQ ID NO: 5110008 - DNA, 18 bp, Homo sapiens
aagtgttcttaggtttac

SEQ ID NO: 5110009 - DNA, 23 bp, Homo sapiens
aagtgttgagccatgctacagtt

SEQ ID NO: 5110010 - DNA, 19 bp, Homo sapiens
aagtgttgctgtggctcca

SEQ ID NO: 5110011 - DNA, 14 bp, Homo sapiens
aagtgttggaaaaa

SEQ ID NO: 5110012 - DNA, 20 bp, Homo sapiens
aagtgttggaaaaaatttgt

SEQ ID NO: 5110013 - DNA, 22 bp, Homo sapiens
aagtgttgggattggttaaggt

SEQ ID NO: 5110014 - DNA, 22 bp, Homo sapiens
aagtgttggtctttctaatgta

SEQ ID NO: 5110015 - DNA, 18 bp, Homo sapiens
aagtgttgtaaatattta

SEQ ID NO: 5110016 - DNA, 23 bp, Homo sapiens
aagtgttgtacaattactgtgag

SEQ ID NO: 5110017 - DNA, 20 bp, Homo sapiens
aagtgttgtaccatatgtag

SEQ ID NO: 5110018 - DNA, 15 bp, Homo sapiens
aagtgttgtgttcct

SEQ ID NO: 5110019 - DNA, 21 bp, Homo sapiens
aagtgttgtgttcctggctga

SEQ ID NO: 5110020 - DNA, 12 bp, Homo sapiens
aagtgtttaaaa

SEQ ID NO: 5110021 - DNA, 19 bp, Homo sapiens
aagtgtttatgttgtttat

SEQ ID NO: 5110022 - DNA, 21 bp, Homo sapiens
aagtgtttatttttcatattg

SEQ ID NO: 5110023 - DNA, 22 bp, Homo sapiens
aagtgtttcaaaaaattatatg

SEQ ID NO: 5110024 - DNA, 21 bp, Homo sapiens
aagtgtttccttcatttctga

SEQ ID NO: 5110025 - DNA, 19 bp, Homo sapiens
aagtgtttcgtaagacaaa

SEQ ID NO: 5110026 - DNA, 12 bp, Homo sapiens
aagtgtttctca

SEQ ID NO: 5110027 - DNA, 21 bp, Homo sapiens
aagtgtttctcaaaagaggtt

SEQ ID NO: 5110028 - DNA, 22 bp, Homo sapiens
aagtgtttctcaaaagaggtta

SEQ ID NO: 5110029 - DNA, 23 bp, Homo sapiens
aagtgtttctgttattaacaaac

SEQ ID NO: 5110030 - DNA, 20 bp, Homo sapiens
aagtgtttcttctggcttag

SEQ ID NO: 5110031 - DNA, 16 bp, Homo sapiens
aagtgttttactcttt

SEQ ID NO: 5110032 - DNA, 13 bp, Homo sapiens
aagtgttttcaga

SEQ ID NO: 5110033 - DNA, 15 bp, Homo sapiens
aagtgttttcagagc

SEQ ID NO: 5110034 - DNA, 18 bp, Homo sapiens
aagtgttttggagaaaaa

SEQ ID NO: 5110035 - DNA, 18 bp, Homo sapiens
aagtgttttgtaccagtg

SEQ ID NO: 5110036 - DNA, 14 bp, Homo sapiens
aagtgtttttacat

SEQ ID NO: 5110037 - DNA, 16 bp, Homo sapiens
aagtgtttttctttaa

SEQ ID NO: 5110038 - DNA, 17 bp, Homo sapiens
aagttaaaaaaaataat

SEQ ID NO: 5110039 - DNA, 22 bp, Homo sapiens
aagttaaaactggatggaaata

SEQ ID NO: 5110040 - DNA, 18 bp, Homo sapiens
aagttaaaagtaaaattg

SEQ ID NO: 5110041 - DNA, 19 bp, Homo sapiens
aagttaaaagtaaaattgt

SEQ ID NO: 5110042 - DNA, 13 bp, Homo sapiens
aagttaaactaaa

SEQ ID NO: 5110043 - DNA, 17 bp, Homo sapiens
aagttaaagagacaaat

SEQ ID NO: 5110044 - DNA, 22 bp, Homo sapiens
aagttaaaggcagtccagagct

SEQ ID NO: 5110045 - DNA, 19 bp, Homo sapiens
aagttaaagtcaatattga

SEQ ID NO: 5110046 - DNA, 17 bp, Homo sapiens
aagttaaagtgaataac

SEQ ID NO: 5110047 - DNA, 19 bp, Homo sapiens
aagttaaatcattttcatt

SEQ ID NO: 5110048 - DNA, 13 bp, Homo sapiens
aagttaaatgtag

SEQ ID NO: 5110049 - DNA, 14 bp, Homo sapiens
aagttaaattttat

SEQ ID NO: 5110050 - DNA, 15 bp, Homo sapiens
aagttaacaaggaat

SEQ ID NO: 5110051 - DNA, 12 bp, Homo sapiens
aagttaacatta

SEQ ID NO: 5110052 - DNA, 21 bp, Homo sapiens
aagttaacattcagtacttta

SEQ ID NO: 5110053 - DNA, 16 bp, Homo sapiens
aagttaaccagttgca

SEQ ID NO: 5110054 - DNA, 12 bp, Homo sapiens
aagttaagaatt

SEQ ID NO: 5110055 - DNA, 20 bp, Homo sapiens
aagttaagagaaactttata

SEQ ID NO: 5110056 - DNA, 18 bp, Homo sapiens
aagttaaggtatctggta

SEQ ID NO: 5110057 - DNA, 15 bp, Homo sapiens
aagttaagtgtcatt

SEQ ID NO: 5110058 - DNA, 19 bp, Homo sapiens
aagttaataacagctcctt

SEQ ID NO: 5110059 - DNA, 14 bp, Homo sapiens
aagttaatgaaata

SEQ ID NO: 5110060 - DNA, 16 bp, Homo sapiens
aagttaatgaaataaa

SEQ ID NO: 5110061 - DNA, 17 bp, Homo sapiens
aagttaatgaaataaaa

SEQ ID NO: 5110062 - DNA, 19 bp, Homo sapiens
aagttaattcacctatgtt

SEQ ID NO: 5110063 - DNA, 19 bp, Homo sapiens
aagttaattcttaaaacta

SEQ ID NO: 5110064 - DNA, 15 bp, Homo sapiens
aagttaatttaaagt

SEQ ID NO: 5110065 - DNA, 16 bp, Homo sapiens
aagttaatttaaagtt

SEQ ID NO: 5110066 - DNA, 18 bp, Homo sapiens
aagttaattttgaccaaa

SEQ ID NO: 5110067 - DNA, 19 bp, Homo sapiens
aagttacacagaaatgctg

SEQ ID NO: 5110068 - DNA, 22 bp, Homo sapiens
aagttacacagaaatgctgctg

SEQ ID NO: 5110069 - DNA, 23 bp, Homo sapiens
aagttacacctccactcagcact

SEQ ID NO: 5110070 - DNA, 23 bp, Homo sapiens
aagttacagtttgatacaggaat

SEQ ID NO: 5110071 - DNA, 16 bp, Homo sapiens
aagttacatgtttgca

SEQ ID NO: 5110072 - DNA, 23 bp, Homo sapiens
aagttacattgctggtcttgtaa

SEQ ID NO: 5110073 - DNA, 16 bp, Homo sapiens
aataatttaagttggc

SEQ ID NO: 5110074 - DNA, 20 bp, Homo sapiens
aataatttacaggttcttag

SEQ ID NO: 5110075 - DNA, 20 bp, Homo sapiens
aataatttagaaataaaaga

SEQ ID NO: 5110076 - DNA, 19 bp, Homo sapiens
aataatttagatattcata

SEQ ID NO: 5110077 - DNA, 23 bp, Homo sapiens
aataatttagatattcatacttt

SEQ ID NO: 5110078 - DNA, 13 bp, Homo sapiens
aataatttatagt

SEQ ID NO: 5110079 - DNA, 16 bp, Homo sapiens
aataatttatagtaat

SEQ ID NO: 5110080 - DNA, 14 bp, Homo sapiens
aataatttcatact

SEQ ID NO: 5110081 - DNA, 22 bp, Homo sapiens
aataatttcccaattaggaagt

SEQ ID NO: 5110082 - DNA, 14 bp, Homo sapiens
aataatttccttca

SEQ ID NO: 5110083 - DNA, 19 bp, Homo sapiens
aataatttccttcaggcag

SEQ ID NO: 5110084 - DNA, 15 bp, Homo sapiens
aataatttgaacttt

SEQ ID NO: 5110085 - DNA, 20 bp, Homo sapiens
aataatttgaatgtatttga

SEQ ID NO: 5110086 - DNA, 22 bp, Homo sapiens
aataatttgaatgtatttgatt

SEQ ID NO: 5110087 - DNA, 23 bp, Homo sapiens
aataatttgtaaatgattttaat

SEQ ID NO: 5110088 - DNA, 20 bp, Homo sapiens
aataatttgtacaatggttt

SEQ ID NO: 5110089 - DNA, 15 bp, Homo sapiens
aataattttaacaga

SEQ ID NO: 5110090 - DNA, 17 bp, Homo sapiens
aataattttaatattct

SEQ ID NO: 5110091 - DNA, 15 bp, Homo sapiens
aataattttacatgt

SEQ ID NO: 5110092 - DNA, 21 bp, Homo sapiens
aataattttattagaataatt

SEQ ID NO: 5110093 - DNA, 14 bp, Homo sapiens
aataattttccaag

SEQ ID NO: 5110094 - DNA, 15 bp, Homo sapiens
aataattttctaaga

SEQ ID NO: 5110095 - DNA, 17 bp, Homo sapiens
aataattttggaataat

SEQ ID NO: 5110096 - DNA, 14 bp, Homo sapiens
aataattttgtaat

SEQ ID NO: 5110097 - DNA, 15 bp, Homo sapiens
aataatttttaactt

SEQ ID NO: 5110098 - DNA, 16 bp, Homo sapiens
aataatttttatattt

SEQ ID NO: 5110099 - DNA, 22 bp, Homo sapiens
aataatttttcacttcaaaaca

SEQ ID NO: 5110100 - DNA, 14 bp, Homo sapiens
aataatttttgtgg

SEQ ID NO: 5110101 - DNA, 14 bp, Homo sapiens
aataattttttgca

SEQ ID NO: 5110102 - DNA, 20 bp, Homo sapiens
aataattttttgcagtcttt

SEQ ID NO: 5110103 - DNA, 14 bp, Homo sapiens
aatacaaaaaatta

SEQ ID NO: 5110104 - DNA, 14 bp, Homo sapiens
aatacaaaaagtaa

SEQ ID NO: 5110105 - DNA, 21 bp, Homo sapiens
aatacaaaaatcagccagaca

SEQ ID NO: 5110106 - DNA, 23 bp, Homo sapiens
aatacaaaaatcagccagacatg

SEQ ID NO: 5110107 - DNA, 14 bp, Homo sapiens
aatacaaaaattag

SEQ ID NO: 5110108 - DNA, 17 bp, Homo sapiens
aatacaaaaattagctg

SEQ ID NO: 5110109 - DNA, 14 bp, Homo sapiens
aatacaaaaatttg

SEQ ID NO: 5110110 - DNA, 12 bp, Homo sapiens
aatacaaaactt

SEQ ID NO: 5110111 - DNA, 23 bp, Homo sapiens
aatacaaaaggcattttatatga

SEQ ID NO: 5110112 - DNA, 16 bp, Homo sapiens
aatacaaaaggctcca

SEQ ID NO: 5110113 - DNA, 12 bp, Homo sapiens
aatacaaaataa

SEQ ID NO: 5110114 - DNA, 17 bp, Homo sapiens
aatacaaaataaaatta

SEQ ID NO: 5110115 - DNA, 20 bp, Homo sapiens
aatacaaaataaaattatgg

SEQ ID NO: 5110116 - DNA, 16 bp, Homo sapiens
aatacaaaatgtatta

SEQ ID NO: 5110117 - DNA, 20 bp, Homo sapiens
aatacaaacatatttgttaa

SEQ ID NO: 5110118 - DNA, 14 bp, Homo sapiens
aatacaaagatgac

SEQ ID NO: 5110119 - DNA, 21 bp, Homo sapiens
aatacaaaggttccattcagt

SEQ ID NO: 5110120 - DNA, 13 bp, Homo sapiens
aatacaaataata

SEQ ID NO: 5110121 - DNA, 14 bp, Homo sapiens
aatacaaatctgta

SEQ ID NO: 5110122 - DNA, 15 bp, Homo sapiens
aatacaaatctgtat

SEQ ID NO: 5110123 - DNA, 21 bp, Homo sapiens
aatacaaatctgtataaatgt

SEQ ID NO: 5110124 - DNA, 14 bp, Homo sapiens
aatacaacaaagga

SEQ ID NO: 5110125 - DNA, 17 bp, Homo sapiens
aatacaacaagaacaac

SEQ ID NO: 5110126 - DNA, 15 bp, Homo sapiens
aatacaacacagacg

SEQ ID NO: 5110127 - DNA, 18 bp, Homo sapiens
aatacaacttaaataata

SEQ ID NO: 5110128 - DNA, 22 bp, Homo sapiens
aatacaagactgccatattaaa

SEQ ID NO: 5110129 - DNA, 13 bp, Homo sapiens
aatacaagactgt

SEQ ID NO: 5110130 - DNA, 22 bp, Homo sapiens
aatacaaggtataataaaatta

SEQ ID NO: 5110131 - DNA, 20 bp, Homo sapiens
aatacaagttctatttaagt

SEQ ID NO: 5110132 - DNA, 12 bp, Homo sapiens
aatacaataaac

SEQ ID NO: 5110133 - DNA, 13 bp, Homo sapiens
aatacaataaact

SEQ ID NO: 5110134 - DNA, 21 bp, Homo sapiens
aatacaatatggacatgtaaa

SEQ ID NO: 5110135 - DNA, 15 bp, Homo sapiens
aatacaatcacatta

SEQ ID NO: 5110136 - DNA, 23 bp, Homo sapiens
aatacaatccgagctacaaagca

SEQ ID NO: 5110137 - DNA, 19 bp, Homo sapiens
aatacaatcctgtttataa

SEQ ID NO: 5110138 - DNA, 14 bp, Homo sapiens
aatacaatcttgga

SEQ ID NO: 5110139 - DNA, 14 bp, Homo sapiens
aatacaatgtacaa

SEQ ID NO: 5110140 - DNA, 15 bp, Homo sapiens
aatacaatgtacaat

SEQ ID NO: 5110141 - DNA, 17 bp, Homo sapiens
aatacaatgtacaatta

SEQ ID NO: 5110142 - DNA, 14 bp, Homo sapiens
aatacaattaaagg

SEQ ID NO: 5110143 - DNA, 22 bp, Homo sapiens
aatacaattaaaggtcctgccc

SEQ ID NO: 5110144 - DNA, 14 bp, Homo sapiens
aatacaattcaaac

SEQ ID NO: 5110145 - DNA, 16 bp, Homo sapiens
aatacaattcaaatgc

SEQ ID NO: 5110146 - DNA, 14 bp, Homo sapiens
aatacaattcacag

SEQ ID NO: 5110147 - DNA, 17 bp, Homo sapiens
aatacaattcattgtga

SEQ ID NO: 5110148 - DNA, 17 bp, Homo sapiens
aatacacaagtaaacat

SEQ ID NO: 5110149 - DNA, 14 bp, Homo sapiens
aatacacactcaaa

SEQ ID NO: 5110150 - DNA, 21 bp, Homo sapiens
aatacacagtactttattgta

SEQ ID NO: 5110151 - DNA, 20 bp, Homo sapiens
aatacacatataaaaacaat

SEQ ID NO: 5110152 - DNA, 22 bp, Homo sapiens
aatacacatataaaaacaatat

SEQ ID NO: 5110153 - DNA, 22 bp, Homo sapiens
aatacacatctctgtcagtgtg

SEQ ID NO: 5110154 - DNA, 16 bp, Homo sapiens
aatacacatgcaggac

SEQ ID NO: 5110155 - DNA, 12 bp, Homo sapiens
aatacacatttc

SEQ ID NO: 5110156 - DNA, 14 bp, Homo sapiens
aatacacatttgct

SEQ ID NO: 5110157 - DNA, 20 bp, Homo sapiens
aatacaccacctcactcctg

SEQ ID NO: 5110158 - DNA, 16 bp, Homo sapiens
aatacaccacgaattt

SEQ ID NO: 5110159 - DNA, 20 bp, Homo sapiens
aatacaccactacattctgt

SEQ ID NO: 5110160 - DNA, 22 bp, Homo sapiens
aatacaccgtttagaaaaaaca

SEQ ID NO: 5110161 - DNA, 16 bp, Homo sapiens
aatacacgaggtatga

SEQ ID NO: 5110162 - DNA, 16 bp, Homo sapiens
aatacactagttgttt

SEQ ID NO: 5110163 - DNA, 22 bp, Homo sapiens
aatacactcatggggaagcttc

SEQ ID NO: 5110164 - DNA, 23 bp, Homo sapiens
aatacactcatggggaagcttcc

SEQ ID NO: 5110165 - DNA, 19 bp, Homo sapiens
aatacactgaattgaatct

SEQ ID NO: 5110166 - DNA, 12 bp, Homo sapiens
aatacactgtga

SEQ ID NO: 5110167 - DNA, 14 bp, Homo sapiens
aatacacttgccct

SEQ ID NO: 5110168 - DNA, 14 bp, Homo sapiens
aatacagaagaaaa

SEQ ID NO: 5110169 - DNA, 21 bp, Homo sapiens
aatacagaattgactgcagtt

SEQ ID NO: 5110170 - DNA, 12 bp, Homo sapiens
aatacagataac

SEQ ID NO: 5110171 - DNA, 18 bp, Homo sapiens
aatacagataattcattt

SEQ ID NO: 5110172 - DNA, 20 bp, Homo sapiens
aatacagataattcatttgt

SEQ ID NO: 5110173 - DNA, 12 bp, Homo sapiens
aatacagatata

SEQ ID NO: 5110174 - DNA, 15 bp, Homo sapiens
aatacagatatattt

SEQ ID NO: 5110175 - DNA, 15 bp, Homo sapiens
aatacagatcatctt

SEQ ID NO: 5110176 - DNA, 13 bp, Homo sapiens
aatacagatttgt

SEQ ID NO: 5110177 - DNA, 17 bp, Homo sapiens
aatacagatttgtaaca

SEQ ID NO: 5110178 - DNA, 23 bp, Homo sapiens
aatacagattttgatagcaaagc

SEQ ID NO: 5110179 - DNA, 15 bp, Homo sapiens
aatacagcagcaaga

SEQ ID NO: 5110180 - DNA, 16 bp, Homo sapiens
aatacagcagcaagaa

SEQ ID NO: 5110181 - DNA, 21 bp, Homo sapiens
aatacagcctgaataaaccaa

SEQ ID NO: 5110182 - DNA, 17 bp, Homo sapiens
aatacagctcagtaaat

SEQ ID NO: 5110183 - DNA, 16 bp, Homo sapiens
aatacagctttctgac

SEQ ID NO: 5110184 - DNA, 16 bp, Homo sapiens
aatacaggaaacaaga

SEQ ID NO: 5110185 - DNA, 16 bp, Homo sapiens
aatacaggaaacagtt

SEQ ID NO: 5110186 - DNA, 18 bp, Homo sapiens
aatacaggaaacagttgc

SEQ ID NO: 5110187 - DNA, 23 bp, Homo sapiens
aatacaggaaacagttgcatgta

SEQ ID NO: 5110188 - DNA, 11 bp, Homo sapiens
aatacaggaac

SEQ ID NO: 5110189 - DNA, 22 bp, Homo sapiens
aatacaggagacccaacaatga

SEQ ID NO: 5110190 - DNA, 16 bp, Homo sapiens
aatacagggcatgcat

SEQ ID NO: 5110191 - DNA, 13 bp, Homo sapiens
aatacagtaaagt

SEQ ID NO: 5110192 - DNA, 18 bp, Homo sapiens
aatacagtaaagtttaaa

SEQ ID NO: 5110193 - DNA, 20 bp, Homo sapiens
aatacagtaaagtttaaaaa

SEQ ID NO: 5110194 - DNA, 15 bp, Homo sapiens
aatacagtacaggca

SEQ ID NO: 5110195 - DNA, 20 bp, Homo sapiens
aatacagtattatagacaaa

SEQ ID NO: 5110196 - DNA, 15 bp, Homo sapiens
aatacagtattctgt

SEQ ID NO: 5110197 - DNA, 16 bp, Homo sapiens
aatacagtattctgta

SEQ ID NO: 5110198 - DNA, 16 bp, Homo sapiens
aatacagtcttccaca

SEQ ID NO: 5110199 - DNA, 14 bp, Homo sapiens
aatacagttatttc

SEQ ID NO: 5110200 - DNA, 16 bp, Homo sapiens
aatacagttctgctct

SEQ ID NO: 5110201 - DNA, 21 bp, Homo sapiens
aatacagtttataaagccaag

SEQ ID NO: 5110202 - DNA, 14 bp, Homo sapiens
aatacataaaacaa

SEQ ID NO: 5110203 - DNA, 18 bp, Homo sapiens
aatacataaaacaaaagc

SEQ ID NO: 5110204 - DNA, 20 bp, Homo sapiens
aatacataaaagaatgtaca

SEQ ID NO: 5110205 - DNA, 14 bp, Homo sapiens
aatacataaagttc

SEQ ID NO: 5110206 - DNA, 16 bp, Homo sapiens
aatacataacttcagt

SEQ ID NO: 5110207 - DNA, 18 bp, Homo sapiens
aatacataacttcagtgc

SEQ ID NO: 5110208 - DNA, 22 bp, Homo sapiens
aatacataacttcagtgcaaga

SEQ ID NO: 5110209 - DNA, 12 bp, Homo sapiens
aatacatactaa

SEQ ID NO: 5110210 - DNA, 15 bp, Homo sapiens
aatacatactaatga

SEQ ID NO: 5110211 - DNA, 23 bp, Homo sapiens
aatacatactatagattctttat

SEQ ID NO: 5110212 - DNA, 14 bp, Homo sapiens
aatacatagtgaaa

SEQ ID NO: 5110213 - DNA, 16 bp, Homo sapiens
aatacatagtgaaaat

SEQ ID NO: 5110214 - DNA, 18 bp, Homo sapiens
aatacatatggatgttac

SEQ ID NO: 5110215 - DNA, 16 bp, Homo sapiens
aatacatattacaaga

SEQ ID NO: 5110216 - DNA, 14 bp, Homo sapiens
aatacatcaaaaat

SEQ ID NO: 5110217 - DNA, 19 bp, Homo sapiens
aatacatcacatcttattt

SEQ ID NO: 5110218 - DNA, 20 bp, Homo sapiens
aatacatcagaaaataaaat

SEQ ID NO: 5110219 - DNA, 14 bp, Homo sapiens
aatacatcatatgt

SEQ ID NO: 5110220 - DNA, 15 bp, Homo sapiens
aatacatcatatgtt

SEQ ID NO: 5110221 - DNA, 23 bp, Homo sapiens
aatacatcccttacctgggaaag

SEQ ID NO: 5110222 - DNA, 20 bp, Homo sapiens
aatacatcctttttctgcta

SEQ ID NO: 5110223 - DNA, 16 bp, Homo sapiens
aatacatcttgtttct

SEQ ID NO: 5110224 - DNA, 17 bp, Homo sapiens
aatacatgaagcttcat

SEQ ID NO: 5110225 - DNA, 19 bp, Homo sapiens
aatacatgaagcttcatgc

SEQ ID NO: 5110226 - DNA, 17 bp, Homo sapiens
aatacatgatgatttca

SEQ ID NO: 5110227 - DNA, 15 bp, Homo sapiens
aatacatgcatataa

SEQ ID NO: 5110228 - DNA, 21 bp, Homo sapiens
aatacatgctaagagaagtag

SEQ ID NO: 5110229 - DNA, 14 bp, Homo sapiens
aatacatgctgcta

SEQ ID NO: 5110230 - DNA, 16 bp, Homo sapiens
aatacatgtgtatatt

SEQ ID NO: 5110231 - DNA, 16 bp, Homo sapiens
aatacattaaagcagt

SEQ ID NO: 5110232 - DNA, 17 bp, Homo sapiens
aatacattaacggtgct

SEQ ID NO: 5110233 - DNA, 19 bp, Homo sapiens
aatacattaacggtgctaa

SEQ ID NO: 5110234 - DNA, 18 bp, Homo sapiens
aatacattacatgtaaat

SEQ ID NO: 5110235 - DNA, 22 bp, Homo sapiens
aatacattattggacttccatt

SEQ ID NO: 5110236 - DNA, 20 bp, Homo sapiens
aatacattccatcacagcca

SEQ ID NO: 5110237 - DNA, 20 bp, Homo sapiens
aatacattccattgttttag

SEQ ID NO: 5110238 - DNA, 22 bp, Homo sapiens
aatacattctaaatcactttaa

SEQ ID NO: 5110239 - DNA, 13 bp, Homo sapiens
aatacattctttg

SEQ ID NO: 5110240 - DNA, 14 bp, Homo sapiens
aatacattctttgc

SEQ ID NO: 5110241 - DNA, 17 bp, Homo sapiens
aatacattgaattagaa

SEQ ID NO: 5110242 - DNA, 19 bp, Homo sapiens
aatacattgtgttttccta

SEQ ID NO: 5110243 - DNA, 13 bp, Homo sapiens
aatacatttgtat

SEQ ID NO: 5110244 - DNA, 15 bp, Homo sapiens
aatacatttgtattt

SEQ ID NO: 5110245 - DNA, 20 bp, Homo sapiens
aatacatttgtatttatgtg

SEQ ID NO: 5110246 - DNA, 22 bp, Homo sapiens
aatacatttgtattttgtgatg

SEQ ID NO: 5110247 - DNA, 17 bp, Homo sapiens
aatacattttataattt

SEQ ID NO: 5110248 - DNA, 18 bp, Homo sapiens
aatacattttataatttc

SEQ ID NO: 5110249 - DNA, 15 bp, Homo sapiens
aatacattttattct

SEQ ID NO: 5110250 - DNA, 20 bp, Homo sapiens
aatacattttgtatattaac

SEQ ID NO: 5110251 - DNA, 13 bp, Homo sapiens
aataccaaatatt

SEQ ID NO: 5110252 - DNA, 14 bp, Homo sapiens
aataccaaatattt

SEQ ID NO: 5110253 - DNA, 16 bp, Homo sapiens
aagttaccttactgaa

SEQ ID NO: 5110254 - DNA, 22 bp, Homo sapiens
aagttactaatatatctgtaac

SEQ ID NO: 5110255 - DNA, 14 bp, Homo sapiens
aagttactactgat

SEQ ID NO: 5110256 - DNA, 21 bp, Homo sapiens
aagttactaggtaacttcata

SEQ ID NO: 5110257 - DNA, 14 bp, Homo sapiens
aagttactgaatgc

SEQ ID NO: 5110258 - DNA, 20 bp, Homo sapiens
aagttactggctctttgtgt

SEQ ID NO: 5110259 - DNA, 13 bp, Homo sapiens
aagttactgggca

SEQ ID NO: 5110260 - DNA, 15 bp, Homo sapiens
aagttactgtaaatg

SEQ ID NO: 5110261 - DNA, 23 bp, Homo sapiens
aagttacttaattgccagcaaat

SEQ ID NO: 5110262 - DNA, 16 bp, Homo sapiens
aagttactttgtaatt

SEQ ID NO: 5110263 - DNA, 17 bp, Homo sapiens
aagttactttgtaattt

SEQ ID NO: 5110264 - DNA, 21 bp, Homo sapiens
aagttagaaaattcagctcct

SEQ ID NO: 5110265 - DNA, 19 bp, Homo sapiens
aagttagaacatttgctgt

SEQ ID NO: 5110266 - DNA, 23 bp, Homo sapiens
aagttagaaggcttaagaactgc

SEQ ID NO: 5110267 - DNA, 16 bp, Homo sapiens
aagttagaatctattt

SEQ ID NO: 5110268 - DNA, 22 bp, Homo sapiens
aagttagaattccttcagggtg

SEQ ID NO: 5110269 - DNA, 13 bp, Homo sapiens
aagttagactctt

SEQ ID NO: 5110270 - DNA, 22 bp, Homo sapiens
aagttagagaactaaactagtt

SEQ ID NO: 5110271 - DNA, 21 bp, Homo sapiens
aagttagcctttatctaccaa

SEQ ID NO: 5110272 - DNA, 13 bp, Homo sapiens
aagttagctcagg

SEQ ID NO: 5110273 - DNA, 21 bp, Homo sapiens
aagttagctgagcgtggtggc

SEQ ID NO: 5110274 - DNA, 13 bp, Homo sapiens
aagttaggcagtc

SEQ ID NO: 5110275 - DNA, 22 bp, Homo sapiens
aagttaggtcattactaaccat

SEQ ID NO: 5110276 - DNA, 16 bp, Homo sapiens
aagttagtaggatatg

SEQ ID NO: 5110277 - DNA, 13 bp, Homo sapiens
aagttagtattaa

SEQ ID NO: 5110278 - DNA, 16 bp, Homo sapiens
aagttagtggaaatct

SEQ ID NO: 5110279 - DNA, 22 bp, Homo sapiens
aagttagtggaaatctgaacat

SEQ ID NO: 5110280 - DNA, 12 bp, Homo sapiens
aagttagttcag

SEQ ID NO: 5110281 - DNA, 18 bp, Homo sapiens
aagttagttccactgaga

SEQ ID NO: 5110282 - DNA, 18 bp, Homo sapiens
aagttagtttttaatctc

SEQ ID NO: 5110283 - DNA, 18 bp, Homo sapiens
aagttataaatcaatgtc

SEQ ID NO: 5110284 - DNA, 19 bp, Homo sapiens
aagttataaatcaatgtca

SEQ ID NO: 5110285 - DNA, 15 bp, Homo sapiens
aagttataagactct

SEQ ID NO: 5110286 - DNA, 23 bp, Homo sapiens
aagttatacacgggacagttgct

SEQ ID NO: 5110287 - DNA, 17 bp, Homo sapiens
aagttatagtatatctg

SEQ ID NO: 5110288 - DNA, 23 bp, Homo sapiens
aagttatataggttttgtttgct

SEQ ID NO: 5110289 - DNA, 13 bp, Homo sapiens
aagttatatttca

SEQ ID NO: 5110290 - DNA, 23 bp, Homo sapiens
aagttatatttcagatgtaatgt

SEQ ID NO: 5110291 - DNA, 16 bp, Homo sapiens
aagttatcatctcacc

SEQ ID NO: 5110292 - DNA, 18 bp, Homo sapiens
aagttatctgtttcctgt

SEQ ID NO: 5110293 - DNA, 13 bp, Homo sapiens
aagttatctttga

SEQ ID NO: 5110294 - DNA, 15 bp, Homo sapiens
aagttatgtatttaa

SEQ ID NO: 5110295 - DNA, 14 bp, Homo sapiens
aagttatgtgtatg

SEQ ID NO: 5110296 - DNA, 18 bp, Homo sapiens
aagttatgtgttaaattt

SEQ ID NO: 5110297 - DNA, 20 bp, Homo sapiens
aagttatgtgttaaatttag

SEQ ID NO: 5110298 - DNA, 16 bp, Homo sapiens
aagttattaaaattgt

SEQ ID NO: 5110299 - DNA, 15 bp, Homo sapiens
aagttattaacattt

SEQ ID NO: 5110300 - DNA, 21 bp, Homo sapiens
aagttattaagaggtaagact

SEQ ID NO: 5110301 - DNA, 14 bp, Homo sapiens
aagttattaatatt

SEQ ID NO: 5110302 - DNA, 18 bp, Homo sapiens
aagttattaatttcttca

SEQ ID NO: 5110303 - DNA, 20 bp, Homo sapiens
aagttattagtggtttatca

SEQ ID NO: 5110304 - DNA, 18 bp, Homo sapiens
aagttattcagaaatatc

SEQ ID NO: 5110305 - DNA, 21 bp, Homo sapiens
aagttattcttgtcattttga

SEQ ID NO: 5110306 - DNA, 14 bp, Homo sapiens
aagttattgacaaa

SEQ ID NO: 5110307 - DNA, 15 bp, Homo sapiens
aagttattgcagttt

SEQ ID NO: 5110308 - DNA, 23 bp, Homo sapiens
aagttattgcagtttatcattca

SEQ ID NO: 5110309 - DNA, 15 bp, Homo sapiens
aagttattgctgcat

SEQ ID NO: 5110310 - DNA, 22 bp, Homo sapiens
aagttattgctgcataaatttg

SEQ ID NO: 5110311 - DNA, 20 bp, Homo sapiens
aagttattgctggtgcaaag

SEQ ID NO: 5110312 - DNA, 17 bp, Homo sapiens
aagttattgtgttgcct

SEQ ID NO: 5110313 - DNA, 16 bp, Homo sapiens
aagttatttaaatctg

SEQ ID NO: 5110314 - DNA, 15 bp, Homo sapiens
aagttatttatattt

SEQ ID NO: 5110315 - DNA, 12 bp, Homo sapiens
aagttatttatg

SEQ ID NO: 5110316 - DNA, 18 bp, Homo sapiens
aagttatttatgctataa

SEQ ID NO: 5110317 - DNA, 15 bp, Homo sapiens
aagttatttcccttt

SEQ ID NO: 5110318 - DNA, 15 bp, Homo sapiens
aagttatttcttgtt

SEQ ID NO: 5110319 - DNA, 15 bp, Homo sapiens
aagttatttgttcat

SEQ ID NO: 5110320 - DNA, 10 bp, Homo sapiens
aagttatttt

SEQ ID NO: 5110321 - DNA, 13 bp, Homo sapiens
aagttattttatg

SEQ ID NO: 5110322 - DNA, 18 bp, Homo sapiens
aagttattttatttgctt

SEQ ID NO: 5110323 - DNA, 21 bp, Homo sapiens
aagttattttcagacatattt

SEQ ID NO: 5110324 - DNA, 14 bp, Homo sapiens
aagttattttctac

SEQ ID NO: 5110325 - DNA, 21 bp, Homo sapiens
aagttattttctacagtggtt

SEQ ID NO: 5110326 - DNA, 19 bp, Homo sapiens
aagttattttcttgtttaa

SEQ ID NO: 5110327 - DNA, 23 bp, Homo sapiens
aagttattttgtacatttttcag

SEQ ID NO: 5110328 - DNA, 15 bp, Homo sapiens
aagttcaagactgaa

SEQ ID NO: 5110329 - DNA, 11 bp, Homo sapiens
aagttcaagga

SEQ ID NO: 5110330 - DNA, 22 bp, Homo sapiens
aagttcaatataagcttttctt

SEQ ID NO: 5110331 - DNA, 23 bp, Homo sapiens
aagttcaatgttcagttttcctt

SEQ ID NO: 5110332 - DNA, 18 bp, Homo sapiens
aagttcaattgtgtctgt

SEQ ID NO: 5110333 - DNA, 11 bp, Homo sapiens
aagttcacaaa

SEQ ID NO: 5110334 - DNA, 12 bp, Homo sapiens
aagttcaccagc

SEQ ID NO: 5110335 - DNA, 22 bp, Homo sapiens
aagttcaccagcatggtagtgg

SEQ ID NO: 5110336 - DNA, 15 bp, Homo sapiens
aagttcaccagccct

SEQ ID NO: 5110337 - DNA, 17 bp, Homo sapiens
aagttcaccagccctga

SEQ ID NO: 5110338 - DNA, 15 bp, Homo sapiens
aagttcaccattaaa

SEQ ID NO: 5110339 - DNA, 16 bp, Homo sapiens
aagttcagaaatttaa

SEQ ID NO: 5110340 - DNA, 22 bp, Homo sapiens
aagttcagcacttgtctcattt

SEQ ID NO: 5110341 - DNA, 17 bp, Homo sapiens
aagttcagccaccgaat

SEQ ID NO: 5110342 - DNA, 19 bp, Homo sapiens
aagttcagggaagcaggca

SEQ ID NO: 5110343 - DNA, 12 bp, Homo sapiens
aagttcatacat

SEQ ID NO: 5110344 - DNA, 21 bp, Homo sapiens
aagttcatacctaagtactgt

SEQ ID NO: 5110345 - DNA, 14 bp, Homo sapiens
aagttcatagggtc

SEQ ID NO: 5110346 - DNA, 19 bp, Homo sapiens
aagttcatagtttctgtaa

SEQ ID NO: 5110347 - DNA, 20 bp, Homo sapiens
aagttcatataatttaaaga

SEQ ID NO: 5110348 - DNA, 21 bp, Homo sapiens
aagttcatattccatatttat

SEQ ID NO: 5110349 - DNA, 12 bp, Homo sapiens
aagttcatcaaa

SEQ ID NO: 5110350 - DNA, 22 bp, Homo sapiens
aagttcatcttgcagcatttac

SEQ ID NO: 5110351 - DNA, 20 bp, Homo sapiens
aagttccaagagtctaaaga

SEQ ID NO: 5110352 - DNA, 21 bp, Homo sapiens
aagttccagcagtttcatgag

SEQ ID NO: 5110353 - DNA, 17 bp, Homo sapiens
aagttccagttttgttt

SEQ ID NO: 5110354 - DNA, 16 bp, Homo sapiens
aagttccattatgaaa

SEQ ID NO: 5110355 - DNA, 18 bp, Homo sapiens
aagttcccagttggagct

SEQ ID NO: 5110356 - DNA, 19 bp, Homo sapiens
aagttcccagttggagctc

SEQ ID NO: 5110357 - DNA, 14 bp, Homo sapiens
aagttccctacttc

SEQ ID NO: 5110358 - DNA, 14 bp, Homo sapiens
aagttccctcctgc

SEQ ID NO: 5110359 - DNA, 13 bp, Homo sapiens
aagttcccttcta

SEQ ID NO: 5110360 - DNA, 22 bp, Homo sapiens
aagttccgtctcctctccagcc

SEQ ID NO: 5110361 - DNA, 18 bp, Homo sapiens
aagttcctctcccttccc

SEQ ID NO: 5110362 - DNA, 19 bp, Homo sapiens
aagttcctctcccttccct

SEQ ID NO: 5110363 - DNA, 15 bp, Homo sapiens
aagttcctgctgcct

SEQ ID NO: 5110364 - DNA, 12 bp, Homo sapiens
aagttccttaag

SEQ ID NO: 5110365 - DNA, 14 bp, Homo sapiens
aagttcctttgggt

SEQ ID NO: 5110366 - DNA, 15 bp, Homo sapiens
aagttcgaaagaaaa

SEQ ID NO: 5110367 - DNA, 12 bp, Homo sapiens
aagttctaagat

SEQ ID NO: 5110368 - DNA, 18 bp, Homo sapiens
aagttctaagattctaat

SEQ ID NO: 5110369 - DNA, 19 bp, Homo sapiens
aagttctaagattctaatg

SEQ ID NO: 5110370 - DNA, 17 bp, Homo sapiens
aagttctaagattctga

SEQ ID NO: 5110371 - DNA, 15 bp, Homo sapiens
aagttctaagttcat

SEQ ID NO: 5110372 - DNA, 17 bp, Homo sapiens
aagttctagagaagagg

SEQ ID NO: 5110373 - DNA, 20 bp, Homo sapiens
aagttctaggaaattcttga

SEQ ID NO: 5110374 - DNA, 21 bp, Homo sapiens
aagttctaggcatacttttca

SEQ ID NO: 5110375 - DNA, 23 bp, Homo sapiens
aagttctaggcatacttttcaaa

SEQ ID NO: 5110376 - DNA, 17 bp, Homo sapiens
aagttctaggcccccca

SEQ ID NO: 5110377 - DNA, 20 bp, Homo sapiens
aagttctatgaagagtatta

SEQ ID NO: 5110378 - DNA, 18 bp, Homo sapiens
aagttctatttcttgaag

SEQ ID NO: 5110379 - DNA, 16 bp, Homo sapiens
aagttctcaaagttaa

SEQ ID NO: 5110380 - DNA, 16 bp, Homo sapiens
aagttctcaatgtgaa

SEQ ID NO: 5110381 - DNA, 13 bp, Homo sapiens
aagttctcagagc

SEQ ID NO: 5110382 - DNA, 15 bp, Homo sapiens
aagttctcagagctc

SEQ ID NO: 5110383 - DNA, 16 bp, Homo sapiens
aagttctccagcttca

SEQ ID NO: 5110384 - DNA, 18 bp, Homo sapiens
aagttctccttttgaact

SEQ ID NO: 5110385 - DNA, 16 bp, Homo sapiens
aagttctctgtaatta

SEQ ID NO: 5110386 - DNA, 22 bp, Homo sapiens
aagttctctgtaattacaacta

SEQ ID NO: 5110387 - DNA, 18 bp, Homo sapiens
aagttctgaaaactgttt

SEQ ID NO: 5110388 - DNA, 16 bp, Homo sapiens
aagttctgaaatttaa

SEQ ID NO: 5110389 - DNA, 15 bp, Homo sapiens
aagttctgagtgttt

SEQ ID NO: 5110390 - DNA, 15 bp, Homo sapiens
aagttctgcctctga

SEQ ID NO: 5110391 - DNA, 19 bp, Homo sapiens
aagttctgctttctcccca

SEQ ID NO: 5110392 - DNA, 19 bp, Homo sapiens
aagttctggatgcatttct

SEQ ID NO: 5110393 - DNA, 20 bp, Homo sapiens
aagttctggatgcatttctc

SEQ ID NO: 5110394 - DNA, 22 bp, Homo sapiens
aagttctgggcagctaaaagca

SEQ ID NO: 5110395 - DNA, 12 bp, Homo sapiens
aagttctgggtg

SEQ ID NO: 5110396 - DNA, 12 bp, Homo sapiens
aagttctgtgta

SEQ ID NO: 5110397 - DNA, 17 bp, Homo sapiens
aagttctgtgtatttaa

SEQ ID NO: 5110398 - DNA, 15 bp, Homo sapiens
aagttcttagttgct

SEQ ID NO: 5110399 - DNA, 12 bp, Homo sapiens
aagttcttcaag

SEQ ID NO: 5110400 - DNA, 15 bp, Homo sapiens
aagttcttcaagagg

SEQ ID NO: 5110401 - DNA, 17 bp, Homo sapiens
aagttcttcaagaggaa

SEQ ID NO: 5110402 - DNA, 11 bp, Homo sapiens
aagttcttgga

SEQ ID NO: 5110403 - DNA, 15 bp, Homo sapiens
aagttctttcaacct

SEQ ID NO: 5110404 - DNA, 18 bp, Homo sapiens
aagttctttcccagcctc

SEQ ID NO: 5110405 - DNA, 16 bp, Homo sapiens
aagttcttttttgtac

SEQ ID NO: 5110406 - DNA, 17 bp, Homo sapiens
aagttgaaaagccaaag

SEQ ID NO: 5110407 - DNA, 13 bp, Homo sapiens
aagttgaaaatac

SEQ ID NO: 5110408 - DNA, 17 bp, Homo sapiens
aagttgaaaatacattc

SEQ ID NO: 5110409 - DNA, 18 bp, Homo sapiens
aagttgaaaatacattct

SEQ ID NO: 5110410 - DNA, 17 bp, Homo sapiens
aagttgaaattaaccat

SEQ ID NO: 5110411 - DNA, 19 bp, Homo sapiens
aagttgaaccattatactt

SEQ ID NO: 5110412 - DNA, 22 bp, Homo sapiens
aagttgaaccattatactttat

SEQ ID NO: 5110413 - DNA, 18 bp, Homo sapiens
aagttgaagctaagattt

SEQ ID NO: 5110414 - DNA, 13 bp, Homo sapiens
aagttgaatgata

SEQ ID NO: 5110415 - DNA, 14 bp, Homo sapiens
aagttgaatttatt

SEQ ID NO: 5110416 - DNA, 12 bp, Homo sapiens
aagttgaatttt

SEQ ID NO: 5110417 - DNA, 15 bp, Homo sapiens
aagttgacatttaac

SEQ ID NO: 5110418 - DNA, 16 bp, Homo sapiens
aagttgacttatagta

SEQ ID NO: 5110419 - DNA, 23 bp, Homo sapiens
aagttgacttatagtacatgata

SEQ ID NO: 5110420 - DNA, 19 bp, Homo sapiens
aagttgagaaaaatttata

SEQ ID NO: 5110421 - DNA, 19 bp, Homo sapiens
aagttgagaaggtgcctgc

SEQ ID NO: 5110422 - DNA, 15 bp, Homo sapiens
aagttgagagacagt

SEQ ID NO: 5110423 - DNA, 19 bp, Homo sapiens
aagttgagatagttttcat

SEQ ID NO: 5110424 - DNA, 19 bp, Homo sapiens
aagttgagatttttaagaa

SEQ ID NO: 5110425 - DNA, 22 bp, Homo sapiens
aagttgagcgtgcgcactgcat

SEQ ID NO: 5110426 - DNA, 16 bp, Homo sapiens
aagttgagctatgact

SEQ ID NO: 5110427 - DNA, 19 bp, Homo sapiens
aagttgagctatgacttaa

SEQ ID NO: 5110428 - DNA, 17 bp, Homo sapiens
aagttgaggattgttga

SEQ ID NO: 5110429 - DNA, 18 bp, Homo sapiens
aagttgaggattgttgaa

SEQ ID NO: 5110430 - DNA, 14 bp, Homo sapiens
aagttgaggcattt

SEQ ID NO: 5110431 - DNA, 16 bp, Homo sapiens
aagttgaggcatttgg

SEQ ID NO: 5110432 - DNA, 14 bp, Homo sapiens
aagttgaggcttat

SEQ ID NO: 5110433 - DNA, 17 bp, Homo sapiens
aagttgaggggagagga

SEQ ID NO: 5110434 - DNA, 17 bp, Homo sapiens
aagttgaggggagcatg

SEQ ID NO: 5110435 - DNA, 19 bp, Homo sapiens
aagttgaggggagcatgct

SEQ ID NO: 5110436 - DNA, 16 bp, Homo sapiens
aagttgagtatattat

SEQ ID NO: 5110437 - DNA, 18 bp, Homo sapiens
aagttgagtatattataa

SEQ ID NO: 5110438 - DNA, 21 bp, Homo sapiens
aagttgatatagaacagtgct

SEQ ID NO: 5110439 - DNA, 21 bp, Homo sapiens
aagttgattcatattgcatca

SEQ ID NO: 5110440 - DNA, 18 bp, Homo sapiens
aagttgcactgatatttt

SEQ ID NO: 5110441 - DNA, 18 bp, Homo sapiens
aagttgcagatgtattga

SEQ ID NO: 5110442 - DNA, 22 bp, Homo sapiens
aagttgcagatgtattgactgt

SEQ ID NO: 5110443 - DNA, 21 bp, Homo sapiens
aagttgcagctgttttgttga

SEQ ID NO: 5110444 - DNA, 18 bp, Homo sapiens
aagttgcagtcagaagat

SEQ ID NO: 5110445 - DNA, 16 bp, Homo sapiens
aagttgcagtgagcag

SEQ ID NO: 5110446 - DNA, 21 bp, Homo sapiens
aagttgcagtgagcagggtgg

SEQ ID NO: 5110447 - DNA, 12 bp, Homo sapiens
aagttgcattta

SEQ ID NO: 5110448 - DNA, 18 bp, Homo sapiens
aagttgcatttaatgtta

SEQ ID NO: 5110449 - DNA, 19 bp, Homo sapiens
aagttgccacattgcttca

SEQ ID NO: 5110450 - DNA, 22 bp, Homo sapiens
aagttgccacattgcttcatta

SEQ ID NO: 5110451 - DNA, 13 bp, Homo sapiens
aagttgccattat

SEQ ID NO: 5110452 - DNA, 12 bp, Homo sapiens
aagttgcctaaa

SEQ ID NO: 5110453 - DNA, 15 bp, Homo sapiens
aagttgcctaaatcc

SEQ ID NO: 5110454 - DNA, 19 bp, Homo sapiens
aagttgcctaaatccattt

SEQ ID NO: 5110455 - DNA, 20 bp, Homo sapiens
aagttgcgacggagagaaaa

SEQ ID NO: 5110456 - DNA, 22 bp, Homo sapiens
aagttgcgacggagagaaaaaa

SEQ ID NO: 5110457 - DNA, 23 bp, Homo sapiens
aagttgcgacggagagaaaaaag

SEQ ID NO: 5110458 - DNA, 20 bp, Homo sapiens
aagttgctaacctcaattta

SEQ ID NO: 5110459 - DNA, 19 bp, Homo sapiens
aagttgctgagaaatgggg

SEQ ID NO: 5110460 - DNA, 17 bp, Homo sapiens
aagttgctgtaaaattt

SEQ ID NO: 5110461 - DNA, 18 bp, Homo sapiens
aagttgctgtaaaatttg

SEQ ID NO: 5110462 - DNA, 21 bp, Homo sapiens
aagttgctgtaaaatttgtgt

SEQ ID NO: 5110463 - DNA, 16 bp, Homo sapiens
aagttgctgtcactgt

SEQ ID NO: 5110464 - DNA, 23 bp, Homo sapiens
aagttgctgtttattttttttgg

SEQ ID NO: 5110465 - DNA, 16 bp, Homo sapiens
aagttgctttgttaca

SEQ ID NO: 5110466 - DNA, 21 bp, Homo sapiens
aagttgctttgttacaataaa

SEQ ID NO: 5110467 - DNA, 21 bp, Homo sapiens
aagttggaaacactaaatgtt

SEQ ID NO: 5110468 - DNA, 17 bp, Homo sapiens
aagttggaaaggaaaaa

SEQ ID NO: 5110469 - DNA, 22 bp, Homo sapiens
aagttggaaccgtgtccagcac

SEQ ID NO: 5110470 - DNA, 23 bp, Homo sapiens
aagttggaaccgtgtccagcaca

SEQ ID NO: 5110471 - DNA, 12 bp, Homo sapiens
aagttggaagga

SEQ ID NO: 5110472 - DNA, 13 bp, Homo sapiens
aagttggaaggat

SEQ ID NO: 5110473 - DNA, 21 bp, Homo sapiens
aagttggaagggaccccagat

SEQ ID NO: 5110474 - DNA, 19 bp, Homo sapiens
aagttggaccagaggaagc

SEQ ID NO: 5110475 - DNA, 21 bp, Homo sapiens
aagttggagcaagaggggcat

SEQ ID NO: 5110476 - DNA, 17 bp, Homo sapiens
aagttggcacatttcat

SEQ ID NO: 5110477 - DNA, 19 bp, Homo sapiens
aagttggcacatttcatga

SEQ ID NO: 5110478 - DNA, 15 bp, Homo sapiens
aagttggccatgtat

SEQ ID NO: 5110479 - DNA, 22 bp, Homo sapiens
aagttggccatgtattatgaaa

SEQ ID NO: 5110480 - DNA, 16 bp, Homo sapiens
aagttggcttctgttt

SEQ ID NO: 5110481 - DNA, 19 bp, Homo sapiens
aagttggcttctgtttcta

SEQ ID NO: 5110482 - DNA, 19 bp, Homo sapiens
aagttgggatctaggagag

SEQ ID NO: 5110483 - DNA, 20 bp, Homo sapiens
aagttgggcaatataaccaa

SEQ ID NO: 5110484 - DNA, 17 bp, Homo sapiens
aagttggggtctgttct

SEQ ID NO: 5110485 - DNA, 15 bp, Homo sapiens
aagttggtattttat

SEQ ID NO: 5110486 - DNA, 23 bp, Homo sapiens
aagttggtcttactttgttaatt

SEQ ID NO: 5110487 - DNA, 16 bp, Homo sapiens
aagttggttggataag

SEQ ID NO: 5110488 - DNA, 14 bp, Homo sapiens
aagttggttttgta

SEQ ID NO: 5110489 - DNA, 22 bp, Homo sapiens
aagttggttttgtaaaattcca

SEQ ID NO: 5110490 - DNA, 17 bp, Homo sapiens
aagttgtaaaatgtcaa

SEQ ID NO: 5110491 - DNA, 12 bp, Homo sapiens
aagttgtaaacg

SEQ ID NO: 5110492 - DNA, 20 bp, Homo sapiens
aagttgtaaacgtcttttta

SEQ ID NO: 5110493 - DNA, 21 bp, Homo sapiens
aagttgtaaacgtctttttaa

SEQ ID NO: 5110494 - DNA, 22 bp, Homo sapiens
aagttgtaaacgtctttttaag

SEQ ID NO: 5110495 - DNA, 17 bp, Homo sapiens
aagttgtaaataatttt

SEQ ID NO: 5110496 - DNA, 18 bp, Homo sapiens
aagttgtaacttatattg

SEQ ID NO: 5110497 - DNA, 20 bp, Homo sapiens
aagttgtaatagagaatatt

SEQ ID NO: 5110498 - DNA, 17 bp, Homo sapiens
aagttgtacaaatgtat

SEQ ID NO: 5110499 - DNA, 23 bp, Homo sapiens
aagttgtacaaatgtattttgaa

SEQ ID NO: 5110500 - DNA, 14 bp, Homo sapiens
aagttgtacatgat

SEQ ID NO: 5110501 - DNA, 14 bp, Homo sapiens
aagttgtaccaaaa

SEQ ID NO: 5110502 - DNA, 14 bp, Homo sapiens
aagttgtactgcat

SEQ ID NO: 5110503 - DNA, 17 bp, Homo sapiens
aagttgtactgcatctt

SEQ ID NO: 5110504 - DNA, 12 bp, Homo sapiens
aagttgtacttt

SEQ ID NO: 5110505 - DNA, 15 bp, Homo sapiens
aagttgtactttaaa

SEQ ID NO: 5110506 - DNA, 21 bp, Homo sapiens
aagttgtactttaaaaattta

SEQ ID NO: 5110507 - DNA, 22 bp, Homo sapiens
aagttgtaggcataaagtcagg

SEQ ID NO: 5110508 - DNA, 13 bp, Homo sapiens
aagttgtagtgtt

SEQ ID NO: 5110509 - DNA, 21 bp, Homo sapiens
aagttgtataaaaacatgagt

SEQ ID NO: 5110510 - DNA, 22 bp, Homo sapiens
aagttgtattttaataaagatt

SEQ ID NO: 5110511 - DNA, 17 bp, Homo sapiens
aagttgtcaaagaagct

SEQ ID NO: 5110512 - DNA, 18 bp, Homo sapiens
aagttgtcaaagaagctt

SEQ ID NO: 5110513 - DNA, 15 bp, Homo sapiens
aagttgtgatctgtt

SEQ ID NO: 5110514 - DNA, 15 bp, Homo sapiens
aagttgtgcatgtat

SEQ ID NO: 5110515 - DNA, 20 bp, Homo sapiens
aagttgtgccttttatagct

SEQ ID NO: 5110516 - DNA, 14 bp, Homo sapiens
aagttgtggaggag

SEQ ID NO: 5110517 - DNA, 16 bp, Homo sapiens
aagttgtggatttcag

SEQ ID NO: 5110518 - DNA, 19 bp, Homo sapiens
aagttgtggatttcagttt

SEQ ID NO: 5110519 - DNA, 16 bp, Homo sapiens
aagttgtggtgctgac

SEQ ID NO: 5110520 - DNA, 20 bp, Homo sapiens
aagttgtggtgctgacaaag

SEQ ID NO: 5110521 - DNA, 12 bp, Homo sapiens
aagttgtgtgct

SEQ ID NO: 5110522 - DNA, 22 bp, Homo sapiens
aagttgtgttaacaatgcagta

SEQ ID NO: 5110523 - DNA, 14 bp, Homo sapiens
aagttgttaaaaca

SEQ ID NO: 5110524 - DNA, 19 bp, Homo sapiens
aagttgttaaaacatttaa

SEQ ID NO: 5110525 - DNA, 17 bp, Homo sapiens
aagttgttaactaaatt

SEQ ID NO: 5110526 - DNA, 18 bp, Homo sapiens
aagttgttcaaacattta

SEQ ID NO: 5110527 - DNA, 20 bp, Homo sapiens
aagttgttccttaagtcaga

SEQ ID NO: 5110528 - DNA, 22 bp, Homo sapiens
aagttgttctagtaacaataca

SEQ ID NO: 5110529 - DNA, 14 bp, Homo sapiens
aagttgttgcattc

SEQ ID NO: 5110530 - DNA, 16 bp, Homo sapiens
aagttgttgcattccc

SEQ ID NO: 5110531 - DNA, 20 bp, Homo sapiens
aagttgttggtttatactgt

SEQ ID NO: 5110532 - DNA, 18 bp, Homo sapiens
aagttgttgtaacctgct

SEQ ID NO: 5110533 - DNA, 14 bp, Homo sapiens
aagttgtttaactg

SEQ ID NO: 5110534 - DNA, 15 bp, Homo sapiens
aagttgtttcaaaca

SEQ ID NO: 5110535 - DNA, 20 bp, Homo sapiens
aagttgtttcagataaattt

SEQ ID NO: 5110536 - DNA, 15 bp, Homo sapiens
aagttgtttcattga

SEQ ID NO: 5110537 - DNA, 21 bp, Homo sapiens
aagttgtttgagaaattaagt

SEQ ID NO: 5110538 - DNA, 18 bp, Homo sapiens
aagttgtttgaggcaaat

SEQ ID NO: 5110539 - DNA, 13 bp, Homo sapiens
aagttgtttgcat

SEQ ID NO: 5110540 - DNA, 18 bp, Homo sapiens
aagtttaaaaaacagaaa

SEQ ID NO: 5110541 - DNA, 16 bp, Homo sapiens
aagtttaaaaatatta

SEQ ID NO: 5110542 - DNA, 19 bp, Homo sapiens
aagtttaaaacagtattta

SEQ ID NO: 5110543 - DNA, 15 bp, Homo sapiens
aagtttaaaatgtat

SEQ ID NO: 5110544 - DNA, 15 bp, Homo sapiens
aagtttaaagaagag

SEQ ID NO: 5110545 - DNA, 16 bp, Homo sapiens
aagtttaaagttgcac

SEQ ID NO: 5110546 - DNA, 11 bp, Homo sapiens
aagtttaaata

SEQ ID NO: 5110547 - DNA, 15 bp, Homo sapiens
aagtttaaataccag

SEQ ID NO: 5110548 - DNA, 19 bp, Homo sapiens
aagtttaaatattaagcat

SEQ ID NO: 5110549 - DNA, 14 bp, Homo sapiens
aagtttaaatcttt

SEQ ID NO: 5110550 - DNA, 18 bp, Homo sapiens
aagtttaacaagtattta

SEQ ID NO: 5110551 - DNA, 21 bp, Homo sapiens
aagtttaactttaaaactgta

SEQ ID NO: 5110552 - DNA, 14 bp, Homo sapiens
aagtttaaggaata

SEQ ID NO: 5110553 - DNA, 14 bp, Homo sapiens
aagtttaataaatt

SEQ ID NO: 5110554 - DNA, 17 bp, Homo sapiens
aagtttaataaatttat

SEQ ID NO: 5110555 - DNA, 16 bp, Homo sapiens
aagtttaattgtctca

SEQ ID NO: 5110556 - DNA, 21 bp, Homo sapiens
aagtttacaagtgtatatcag

SEQ ID NO: 5110557 - DNA, 15 bp, Homo sapiens
aagtttacagagatg

SEQ ID NO: 5110558 - DNA, 12 bp, Homo sapiens
aagtttacattt

SEQ ID NO: 5110559 - DNA, 16 bp, Homo sapiens
aagtttacatttttat

SEQ ID NO: 5110560 - DNA, 22 bp, Homo sapiens
aagtttacatttttatttatga

SEQ ID NO: 5110561 - DNA, 21 bp, Homo sapiens
aagtttactccttctgttttg

SEQ ID NO: 5110562 - DNA, 21 bp, Homo sapiens
aagtttagcccctgaaagcca

SEQ ID NO: 5110563 - DNA, 13 bp, Homo sapiens
aagtttagctctg

SEQ ID NO: 5110564 - DNA, 14 bp, Homo sapiens
aagtttagctctga

SEQ ID NO: 5110565 - DNA, 12 bp, Homo sapiens
aagtttataagc

SEQ ID NO: 5110566 - DNA, 13 bp, Homo sapiens
aagtttatatata

SEQ ID NO: 5110567 - DNA, 20 bp, Homo sapiens
aagtttatcagtaaataact

SEQ ID NO: 5110568 - DNA, 18 bp, Homo sapiens
aagtttatccaaatcttg

SEQ ID NO: 5110569 - DNA, 22 bp, Homo sapiens
aagtttatctttgcacaatcaa

SEQ ID NO: 5110570 - DNA, 20 bp, Homo sapiens
aagtttatgtggcacacaat

SEQ ID NO: 5110571 - DNA, 19 bp, Homo sapiens
aagtttattattttcaaag

SEQ ID NO: 5110572 - DNA, 19 bp, Homo sapiens
aagtttattcagtaaacaa

SEQ ID NO: 5110573 - DNA, 12 bp, Homo sapiens
aagtttattctc

SEQ ID NO: 5110574 - DNA, 21 bp, Homo sapiens
aagtttattgtttgatgtttt

SEQ ID NO: 5110575 - DNA, 13 bp, Homo sapiens
aagtttatttcct

SEQ ID NO: 5110576 - DNA, 13 bp, Homo sapiens
aagtttatttctc

SEQ ID NO: 5110577 - DNA, 14 bp, Homo sapiens
aagtttatttgaga

SEQ ID NO: 5110578 - DNA, 16 bp, Homo sapiens
aagtttatttgagaaa

SEQ ID NO: 5110579 - DNA, 17 bp, Homo sapiens
aagtttatttgagaaaa

SEQ ID NO: 5110580 - DNA, 22 bp, Homo sapiens
aagtttatttgagaaaatataa

SEQ ID NO: 5110581 - DNA, 20 bp, Homo sapiens
aagtttattttttctacaca

SEQ ID NO: 5110582 - DNA, 21 bp, Homo sapiens
aagtttattttttctacacag

SEQ ID NO: 5110583 - DNA, 14 bp, Homo sapiens
aagtttcaaaaatc

SEQ ID NO: 5110584 - DNA, 19 bp, Homo sapiens
aagtttcacaggtcaataa

SEQ ID NO: 5110585 - DNA, 14 bp, Homo sapiens
aagtttcaccttgg

SEQ ID NO: 5110586 - DNA, 22 bp, Homo sapiens
aagtttcaccttgggtttgtat

SEQ ID NO: 5110587 - DNA, 17 bp, Homo sapiens
aagtttcaggtgacatg

SEQ ID NO: 5110588 - DNA, 21 bp, Homo sapiens
aagtttcaggtgacatgtgaa

SEQ ID NO: 5110589 - DNA, 20 bp, Homo sapiens
aagtttcagtaatagctgaa

SEQ ID NO: 5110590 - DNA, 12 bp, Homo sapiens
aagtttcattta

SEQ ID NO: 5110591 - DNA, 22 bp, Homo sapiens
aagtttccaagcaaatgttaca

SEQ ID NO: 5110592 - DNA, 17 bp, Homo sapiens
aagtttccccaccagtg

SEQ ID NO: 5110593 - DNA, 12 bp, Homo sapiens
aagtttccttat

SEQ ID NO: 5110594 - DNA, 18 bp, Homo sapiens
aagtttccttattttcat

SEQ ID NO: 5110595 - DNA, 16 bp, Homo sapiens
aagtttccttggctgg

SEQ ID NO: 5110596 - DNA, 18 bp, Homo sapiens
aagtttccttggctggtg

SEQ ID NO: 5110597 - DNA, 19 bp, Homo sapiens
aagtttcgacttatttctt

SEQ ID NO: 5110598 - DNA, 13 bp, Homo sapiens
aagtttctaagaa

SEQ ID NO: 5110599 - DNA, 20 bp, Homo sapiens
aagtttctaagattctaaag

SEQ ID NO: 5110600 - DNA, 14 bp, Homo sapiens
aagtttctcagctc

SEQ ID NO: 5110601 - DNA, 17 bp, Homo sapiens
aagtttctcagctccca

SEQ ID NO: 5110602 - DNA, 18 bp, Homo sapiens
aagtttctcagctcccat

SEQ ID NO: 5110603 - DNA, 21 bp, Homo sapiens
aagtttctgccgcagccctgc

SEQ ID NO: 5110604 - DNA, 18 bp, Homo sapiens
aagtttcttggtctcagc

SEQ ID NO: 5110605 - DNA, 16 bp, Homo sapiens
aagtttctttgagggt

SEQ ID NO: 5110606 - DNA, 17 bp, Homo sapiens
aagtttgaaaatagtta

SEQ ID NO: 5110607 - DNA, 17 bp, Homo sapiens
aagtttgaaggaaacag

SEQ ID NO: 5110608 - DNA, 10 bp, Homo sapiens
aagtttgaat

SEQ ID NO: 5110609 - DNA, 12 bp, Homo sapiens
aagtttgacaca

SEQ ID NO: 5110610 - DNA, 15 bp, Homo sapiens
aagtttgaccagtgc

SEQ ID NO: 5110611 - DNA, 13 bp, Homo sapiens
aataccaactatt

SEQ ID NO: 5110612 - DNA, 16 bp, Homo sapiens
aataccaactatttca

SEQ ID NO: 5110613 - DNA, 12 bp, Homo sapiens
aataccaaggaa

SEQ ID NO: 5110614 - DNA, 17 bp, Homo sapiens
aataccacaaacactgt

SEQ ID NO: 5110615 - DNA, 21 bp, Homo sapiens
aataccacatcaaataagaaa

SEQ ID NO: 5110616 - DNA, 18 bp, Homo sapiens
aataccaccaacaaatat

SEQ ID NO: 5110617 - DNA, 19 bp, Homo sapiens
aataccaccaacaaatata

SEQ ID NO: 5110618 - DNA, 22 bp, Homo sapiens
aataccaccatttaaaaatgtt

SEQ ID NO: 5110619 - DNA, 23 bp, Homo sapiens
aataccaccatttaaaaatgtta

SEQ ID NO: 5110620 - DNA, 15 bp, Homo sapiens
aataccaccctacaa

SEQ ID NO: 5110621 - DNA, 18 bp, Homo sapiens
aataccactagtggaaag

SEQ ID NO: 5110622 - DNA, 20 bp, Homo sapiens
aataccactctgtaattgca

SEQ ID NO: 5110623 - DNA, 23 bp, Homo sapiens
aataccactggttaaaataaagc

SEQ ID NO: 5110624 - DNA, 12 bp, Homo sapiens
aataccagagca

SEQ ID NO: 5110625 - DNA, 22 bp, Homo sapiens
aataccagagcacagattcaag

SEQ ID NO: 5110626 - DNA, 13 bp, Homo sapiens
aataccagagcct

SEQ ID NO: 5110627 - DNA, 23 bp, Homo sapiens
aataccagagccttcaagtgcca

SEQ ID NO: 5110628 - DNA, 20 bp, Homo sapiens
aataccagtgaaccaaagag

SEQ ID NO: 5110629 - DNA, 15 bp, Homo sapiens
aataccattaaaact

SEQ ID NO: 5110630 - DNA, 21 bp, Homo sapiens
aataccattaaaactgctttt

SEQ ID NO: 5110631 - DNA, 19 bp, Homo sapiens
aataccattgaaatcagca

SEQ ID NO: 5110632 - DNA, 14 bp, Homo sapiens
aatacccagagcac

SEQ ID NO: 5110633 - DNA, 16 bp, Homo sapiens
aataccccaccagcag

SEQ ID NO: 5110634 - DNA, 18 bp, Homo sapiens
aataccccaccagcagaa

SEQ ID NO: 5110635 - DNA, 16 bp, Homo sapiens
aatacccccagagacc

SEQ ID NO: 5110636 - DNA, 16 bp, Homo sapiens
aataccccttctctgt

SEQ ID NO: 5110637 - DNA, 20 bp, Homo sapiens
aatacccgtcctctcggctg

SEQ ID NO: 5110638 - DNA, 22 bp, Homo sapiens
aataccctactgtggggagaga

SEQ ID NO: 5110639 - DNA, 21 bp, Homo sapiens
aataccctagaagaaaacccg

SEQ ID NO: 5110640 - DNA, 14 bp, Homo sapiens
aataccctgtacat

SEQ ID NO: 5110641 - DNA, 22 bp, Homo sapiens
aataccctgtctttaaaaataa

SEQ ID NO: 5110642 - DNA, 17 bp, Homo sapiens
aatacccttggcactga

SEQ ID NO: 5110643 - DNA, 17 bp, Homo sapiens
aataccgctcagtattt

SEQ ID NO: 5110644 - DNA, 18 bp, Homo sapiens
aatacctacaataaactg

SEQ ID NO: 5110645 - DNA, 20 bp, Homo sapiens
aatacctacaataaactggt

SEQ ID NO: 5110646 - DNA, 19 bp, Homo sapiens
aatacctaggcccattgct

SEQ ID NO: 5110647 - DNA, 17 bp, Homo sapiens
aatacctcaatttttgt

SEQ ID NO: 5110648 - DNA, 15 bp, Homo sapiens
aatacctcatgcttc

SEQ ID NO: 5110649 - DNA, 16 bp, Homo sapiens
aatacctcatgggaca

SEQ ID NO: 5110650 - DNA, 23 bp, Homo sapiens
aatacctcttactttgcttgaga

SEQ ID NO: 5110651 - DNA, 21 bp, Homo sapiens
aatacctcttagctgagtgga

SEQ ID NO: 5110652 - DNA, 19 bp, Homo sapiens
aatacctgacctcacagag

SEQ ID NO: 5110653 - DNA, 12 bp, Homo sapiens
aatacctgctca

SEQ ID NO: 5110654 - DNA, 19 bp, Homo sapiens
aatacctggcctcatttaa

SEQ ID NO: 5110655 - DNA, 15 bp, Homo sapiens
aatacctgtccccct

SEQ ID NO: 5110656 - DNA, 21 bp, Homo sapiens
aataccttcaaggctcttctt

SEQ ID NO: 5110657 - DNA, 22 bp, Homo sapiens
aataccttctatgtattagtgt

SEQ ID NO: 5110658 - DNA, 12 bp, Homo sapiens
aatacctttaaa

SEQ ID NO: 5110659 - DNA, 14 bp, Homo sapiens
aatacctttaaata

SEQ ID NO: 5110660 - DNA, 15 bp, Homo sapiens
aatacctttaaatat

SEQ ID NO: 5110661 - DNA, 18 bp, Homo sapiens
aatacctttaaatatcat

SEQ ID NO: 5110662 - DNA, 20 bp, Homo sapiens
aatacctttaaatatcattc

SEQ ID NO: 5110663 - DNA, 22 bp, Homo sapiens
aatacctttaaatatcattctt

SEQ ID NO: 5110664 - DNA, 21 bp, Homo sapiens
aatacctttaaatttaggtaa

SEQ ID NO: 5110665 - DNA, 13 bp, Homo sapiens
aatacctttctaa

SEQ ID NO: 5110666 - DNA, 13 bp, Homo sapiens
aatacctttgtag

SEQ ID NO: 5110667 - DNA, 16 bp, Homo sapiens
aatacgaaaatcccat

SEQ ID NO: 5110668 - DNA, 20 bp, Homo sapiens
aatacgacactgaaatatgt

SEQ ID NO: 5110669 - DNA, 18 bp, Homo sapiens
aatacgcactacatgtgg

SEQ ID NO: 5110670 - DNA, 15 bp, Homo sapiens
aatacggaagagcag

SEQ ID NO: 5110671 - DNA, 22 bp, Homo sapiens
aatacgtgccagatataactgt

SEQ ID NO: 5110672 - DNA, 16 bp, Homo sapiens
aatacgtgttcaaaaa

SEQ ID NO: 5110673 - DNA, 21 bp, Homo sapiens
aatacgttaggaggacaaaag

SEQ ID NO: 5110674 - DNA, 15 bp, Homo sapiens
aatacgtttgtgttt

SEQ ID NO: 5110675 - DNA, 18 bp, Homo sapiens
aatacgttttgtgtatat

SEQ ID NO: 5110676 - DNA, 13 bp, Homo sapiens
aatactaaaactc

SEQ ID NO: 5110677 - DNA, 13 bp, Homo sapiens
aatactaaaagca

SEQ ID NO: 5110678 - DNA, 15 bp, Homo sapiens
aatactaaaagcaaa

SEQ ID NO: 5110679 - DNA, 23 bp, Homo sapiens
aatactaaaagcaaatctacaga

SEQ ID NO: 5110680 - DNA, 14 bp, Homo sapiens
aatactaaaatatg

SEQ ID NO: 5110681 - DNA, 15 bp, Homo sapiens
aatactaaataaaca

SEQ ID NO: 5110682 - DNA, 19 bp, Homo sapiens
aatactaaatatgaaattt

SEQ ID NO: 5110683 - DNA, 15 bp, Homo sapiens
aatactaataaaata

SEQ ID NO: 5110684 - DNA, 13 bp, Homo sapiens
aatactaatgtaa

SEQ ID NO: 5110685 - DNA, 18 bp, Homo sapiens
aatactaattgagaaaca

SEQ ID NO: 5110686 - DNA, 12 bp, Homo sapiens
aatactaattta

SEQ ID NO: 5110687 - DNA, 13 bp, Homo sapiens
aatactaatttat

SEQ ID NO: 5110688 - DNA, 16 bp, Homo sapiens
aatactaatttataat

SEQ ID NO: 5110689 - DNA, 20 bp, Homo sapiens
aatactacccatagaaaact

SEQ ID NO: 5110690 - DNA, 20 bp, Homo sapiens
aatactacctataggaaagt

SEQ ID NO: 5110691 - DNA, 12 bp, Homo sapiens
aatactacctct

SEQ ID NO: 5110692 - DNA, 15 bp, Homo sapiens
aatactaccttgaaa

SEQ ID NO: 5110693 - DNA, 17 bp, Homo sapiens
aatactaccttgaaaat

SEQ ID NO: 5110694 - DNA, 17 bp, Homo sapiens
aatactactactgttat

SEQ ID NO: 5110695 - DNA, 18 bp, Homo sapiens
aatactactgtaaatgta

SEQ ID NO: 5110696 - DNA, 13 bp, Homo sapiens
aatactagccaga

SEQ ID NO: 5110697 - DNA, 16 bp, Homo sapiens
aatactagtcacccca

SEQ ID NO: 5110698 - DNA, 16 bp, Homo sapiens
aatactataaatatat

SEQ ID NO: 5110699 - DNA, 17 bp, Homo sapiens
aatactataaatatatt

SEQ ID NO: 5110700 - DNA, 13 bp, Homo sapiens
aatactatagtta

SEQ ID NO: 5110701 - DNA, 17 bp, Homo sapiens
aatactatagttatata

SEQ ID NO: 5110702 - DNA, 15 bp, Homo sapiens
aatactatccaaata

SEQ ID NO: 5110703 - DNA, 14 bp, Homo sapiens
aatactatgcagta

SEQ ID NO: 5110704 - DNA, 18 bp, Homo sapiens
aatactatgcagtatctc

SEQ ID NO: 5110705 - DNA, 20 bp, Homo sapiens
aatactatgtatgtaaaata

SEQ ID NO: 5110706 - DNA, 20 bp, Homo sapiens
aatactattctcattatgtt

SEQ ID NO: 5110707 - DNA, 15 bp, Homo sapiens
aatactatttaagat

SEQ ID NO: 5110708 - DNA, 15 bp, Homo sapiens
aatactatttttact

SEQ ID NO: 5110709 - DNA, 16 bp, Homo sapiens
aatactatttttactg

SEQ ID NO: 5110710 - DNA, 18 bp, Homo sapiens
aatactcaccaaaatata

SEQ ID NO: 5110711 - DNA, 16 bp, Homo sapiens
aatactcacctcctcc

SEQ ID NO: 5110712 - DNA, 23 bp, Homo sapiens
aatactcataatgtgaagtgtta

SEQ ID NO: 5110713 - DNA, 13 bp, Homo sapiens
aatactcatcaga

SEQ ID NO: 5110714 - DNA, 12 bp, Homo sapiens
aatactcatgtg

SEQ ID NO: 5110715 - DNA, 14 bp, Homo sapiens
aatactcatgtgta

SEQ ID NO: 5110716 - DNA, 19 bp, Homo sapiens
aatactccaagcttcaagt

SEQ ID NO: 5110717 - DNA, 23 bp, Homo sapiens
aatactccaagcttcaagtgata

SEQ ID NO: 5110718 - DNA, 13 bp, Homo sapiens
aatactctaattc

SEQ ID NO: 5110719 - DNA, 15 bp, Homo sapiens
aatactctaattcta

SEQ ID NO: 5110720 - DNA, 15 bp, Homo sapiens
aatactctacaagaa

SEQ ID NO: 5110721 - DNA, 22 bp, Homo sapiens
aatactctaccctcttagaaaa

SEQ ID NO: 5110722 - DNA, 17 bp, Homo sapiens
aatactctatttttaca

SEQ ID NO: 5110723 - DNA, 14 bp, Homo sapiens
aatactctgaaatg

SEQ ID NO: 5110724 - DNA, 17 bp, Homo sapiens
aatactctgccctctag

SEQ ID NO: 5110725 - DNA, 14 bp, Homo sapiens
aatactctgttgta

SEQ ID NO: 5110726 - DNA, 22 bp, Homo sapiens
aatactctgttgtactatggaa

SEQ ID NO: 5110727 - DNA, 17 bp, Homo sapiens
aatactcttgaaatgta

SEQ ID NO: 5110728 - DNA, 20 bp, Homo sapiens
aatactgaaatgctttagca

SEQ ID NO: 5110729 - DNA, 14 bp, Homo sapiens
aatactgaaccact

SEQ ID NO: 5110730 - DNA, 18 bp, Homo sapiens
aatactgacaatgtattt

SEQ ID NO: 5110731 - DNA, 16 bp, Homo sapiens
aatactgagaaaacct

SEQ ID NO: 5110732 - DNA, 18 bp, Homo sapiens
aatactgagatgctgggc

SEQ ID NO: 5110733 - DNA, 14 bp, Homo sapiens
aatactgattttca

SEQ ID NO: 5110734 - DNA, 16 bp, Homo sapiens
aatactgattttcaaa

SEQ ID NO: 5110735 - DNA, 17 bp, Homo sapiens
aatactgattttcaaaa

SEQ ID NO: 5110736 - DNA, 16 bp, Homo sapiens
aatactgccaaaacat

SEQ ID NO: 5110737 - DNA, 17 bp, Homo sapiens
aatactgccaaaacatt

SEQ ID NO: 5110738 - DNA, 23 bp, Homo sapiens
aatactgccaaaacatttatgac

SEQ ID NO: 5110739 - DNA, 23 bp, Homo sapiens
aatactgccagatgctgatgttc

SEQ ID NO: 5110740 - DNA, 22 bp, Homo sapiens
aatactgcctagaaaatgcaaa

SEQ ID NO: 5110741 - DNA, 13 bp, Homo sapiens
aatactgctctga

SEQ ID NO: 5110742 - DNA, 16 bp, Homo sapiens
aatactggaataattt

SEQ ID NO: 5110743 - DNA, 12 bp, Homo sapiens
aatactggactc

SEQ ID NO: 5110744 - DNA, 14 bp, Homo sapiens
aatactggactcag

SEQ ID NO: 5110745 - DNA, 15 bp, Homo sapiens
aatactggactcagg

SEQ ID NO: 5110746 - DNA, 16 bp, Homo sapiens
aatactggactcagga

SEQ ID NO: 5110747 - DNA, 20 bp, Homo sapiens
aatactggggattaccattc

SEQ ID NO: 5110748 - DNA, 20 bp, Homo sapiens
aatactggtaccttccccca

SEQ ID NO: 5110749 - DNA, 23 bp, Homo sapiens
aatactggttatcctgtgctaca

SEQ ID NO: 5110750 - DNA, 17 bp, Homo sapiens
aatactgtagaaatatt

SEQ ID NO: 5110751 - DNA, 23 bp, Homo sapiens
aatactgtattgttacagctgaa

SEQ ID NO: 5110752 - DNA, 16 bp, Homo sapiens
aatactgtattttgta

SEQ ID NO: 5110753 - DNA, 19 bp, Homo sapiens
aatactgtccagttttctt

SEQ ID NO: 5110754 - DNA, 22 bp, Homo sapiens
aatactgtccagttttcttgct

SEQ ID NO: 5110755 - DNA, 17 bp, Homo sapiens
aatactgtctgtatctt

SEQ ID NO: 5110756 - DNA, 15 bp, Homo sapiens
aatactgtgcagaat

SEQ ID NO: 5110757 - DNA, 22 bp, Homo sapiens
aatactgtgcagaataatggaa

SEQ ID NO: 5110758 - DNA, 14 bp, Homo sapiens
aatactgttattct

SEQ ID NO: 5110759 - DNA, 15 bp, Homo sapiens
aatactgttattctt

SEQ ID NO: 5110760 - DNA, 18 bp, Homo sapiens
aatactgttattctttgc

SEQ ID NO: 5110761 - DNA, 15 bp, Homo sapiens
aatactgttctatac

SEQ ID NO: 5110762 - DNA, 19 bp, Homo sapiens
aatactgttgcccttttcc

SEQ ID NO: 5110763 - DNA, 18 bp, Homo sapiens
aatacttaaaaatatgtg

SEQ ID NO: 5110764 - DNA, 21 bp, Homo sapiens
aatacttaacacgtgaatatt

SEQ ID NO: 5110765 - DNA, 22 bp, Homo sapiens
aatacttaacattgatttattt

SEQ ID NO: 5110766 - DNA, 13 bp, Homo sapiens
aatacttactgtt

SEQ ID NO: 5110767 - DNA, 14 bp, Homo sapiens
aatacttactgtta

SEQ ID NO: 5110768 - DNA, 22 bp, Homo sapiens
aatacttatatttttaataaaa

SEQ ID NO: 5110769 - DNA, 17 bp, Homo sapiens
aatacttattcattgtg

SEQ ID NO: 5110770 - DNA, 15 bp, Homo sapiens
aatacttattttcag

SEQ ID NO: 5110771 - DNA, 13 bp, Homo sapiens
aatacttccttat

SEQ ID NO: 5110772 - DNA, 23 bp, Homo sapiens
aatacttccttataaaaattcta

SEQ ID NO: 5110773 - DNA, 17 bp, Homo sapiens
aatacttctcaaacctg

SEQ ID NO: 5110774 - DNA, 23 bp, Homo sapiens
aatacttctcaaacctgtttaaa

SEQ ID NO: 5110775 - DNA, 14 bp, Homo sapiens
aatacttctcattt

SEQ ID NO: 5110776 - DNA, 19 bp, Homo sapiens
aatacttcttgtgtgtatg

SEQ ID NO: 5110777 - DNA, 21 bp, Homo sapiens
aatacttcttgtgtgtatgca

SEQ ID NO: 5110778 - DNA, 19 bp, Homo sapiens
aatacttgaaccataaaat

SEQ ID NO: 5110779 - DNA, 22 bp, Homo sapiens
aatacttgaaccataaaatgtc

SEQ ID NO: 5110780 - DNA, 14 bp, Homo sapiens
aatacttgaacttg

SEQ ID NO: 5110781 - DNA, 15 bp, Homo sapiens
aatacttgacaacat

SEQ ID NO: 5110782 - DNA, 17 bp, Homo sapiens
aatacttgactcagtga

SEQ ID NO: 5110783 - DNA, 19 bp, Homo sapiens
aatacttgagctgtatata

SEQ ID NO: 5110784 - DNA, 22 bp, Homo sapiens
aatacttgcaactaaggacaaa

SEQ ID NO: 5110785 - DNA, 10 bp, Homo sapiens
aatacttgtc

SEQ ID NO: 5110786 - DNA, 16 bp, Homo sapiens
aatactttaacttcca

SEQ ID NO: 5110787 - DNA, 15 bp, Homo sapiens
aatactttgaatgtg

SEQ ID NO: 5110788 - DNA, 23 bp, Homo sapiens
aatactttgatttttatccattt

SEQ ID NO: 5110789 - DNA, 18 bp, Homo sapiens
aatactttgcataaatta

SEQ ID NO: 5110790 - DNA, 23 bp, Homo sapiens
aagtttgatcttcctctgctaaa

SEQ ID NO: 5110791 - DNA, 22 bp, Homo sapiens
aagtttgatttttgtttttgta

SEQ ID NO: 5110792 - DNA, 11 bp, Homo sapiens
aagtttgcact

SEQ ID NO: 5110793 - DNA, 21 bp, Homo sapiens
aagtttgcactatctttcagc

SEQ ID NO: 5110794 - DNA, 20 bp, Homo sapiens
aagtttgcactcaaatctta

SEQ ID NO: 5110795 - DNA, 14 bp, Homo sapiens
aagtttgcactgta

SEQ ID NO: 5110796 - DNA, 20 bp, Homo sapiens
aagtttgcctttgtaccata

SEQ ID NO: 5110797 - DNA, 16 bp, Homo sapiens
aagtttgctaaaagaa

SEQ ID NO: 5110798 - DNA, 17 bp, Homo sapiens
aagtttgctaaaagaag

SEQ ID NO: 5110799 - DNA, 18 bp, Homo sapiens
aagtttgctaaaagaaga

SEQ ID NO: 5110800 - DNA, 15 bp, Homo sapiens
aagtttgctgtgctt

SEQ ID NO: 5110801 - DNA, 17 bp, Homo sapiens
aagtttgggctaacatt

SEQ ID NO: 5110802 - DNA, 19 bp, Homo sapiens
aagtttgggctaacattta

SEQ ID NO: 5110803 - DNA, 15 bp, Homo sapiens
aagtttggttttgac

SEQ ID NO: 5110804 - DNA, 19 bp, Homo sapiens
aagtttgtagtaaaagtgg

SEQ ID NO: 5110805 - DNA, 14 bp, Homo sapiens
aagtttgtgggggc

SEQ ID NO: 5110806 - DNA, 19 bp, Homo sapiens
aagtttgtgttctgtttgt

SEQ ID NO: 5110807 - DNA, 22 bp, Homo sapiens
aagtttgtgttctgtttgttaa

SEQ ID NO: 5110808 - DNA, 19 bp, Homo sapiens
aagtttgttactttgaata

SEQ ID NO: 5110809 - DNA, 14 bp, Homo sapiens
aagtttgttgaaaa

SEQ ID NO: 5110810 - DNA, 22 bp, Homo sapiens
aagtttgtttatgcattgcctt

SEQ ID NO: 5110811 - DNA, 16 bp, Homo sapiens
aagtttgtttttgcgt

SEQ ID NO: 5110812 - DNA, 13 bp, Homo sapiens
aagttttaatgta

SEQ ID NO: 5110813 - DNA, 14 bp, Homo sapiens
aagttttaggacaa

SEQ ID NO: 5110814 - DNA, 21 bp, Homo sapiens
aagttttaggacaaacagctc

SEQ ID NO: 5110815 - DNA, 19 bp, Homo sapiens
aagttttagggtacatgtg

SEQ ID NO: 5110816 - DNA, 15 bp, Homo sapiens
aagttttatatatta

SEQ ID NO: 5110817 - DNA, 17 bp, Homo sapiens
aagttttatatattata

SEQ ID NO: 5110818 - DNA, 23 bp, Homo sapiens
aagttttatatattatatggaaa

SEQ ID NO: 5110819 - DNA, 17 bp, Homo sapiens
aagttttatatgtagaa

SEQ ID NO: 5110820 - DNA, 13 bp, Homo sapiens
aagttttatcaag

SEQ ID NO: 5110821 - DNA, 15 bp, Homo sapiens
aagttttcaaactgc

SEQ ID NO: 5110822 - DNA, 12 bp, Homo sapiens
aagttttcagtg

SEQ ID NO: 5110823 - DNA, 13 bp, Homo sapiens
aagttttccagta

SEQ ID NO: 5110824 - DNA, 13 bp, Homo sapiens
aagttttcctgat

SEQ ID NO: 5110825 - DNA, 14 bp, Homo sapiens
aagttttcctttgt

SEQ ID NO: 5110826 - DNA, 21 bp, Homo sapiens
aagttttcctttgtaatcact

SEQ ID NO: 5110827 - DNA, 17 bp, Homo sapiens
aagttttctcttttaag

SEQ ID NO: 5110828 - DNA, 16 bp, Homo sapiens
aagttttcttgtttct

SEQ ID NO: 5110829 - DNA, 17 bp, Homo sapiens
aagttttcttgtttctg

SEQ ID NO: 5110830 - DNA, 14 bp, Homo sapiens
aagttttctttcca

SEQ ID NO: 5110831 - DNA, 13 bp, Homo sapiens
aagttttgaaaag

SEQ ID NO: 5110832 - DNA, 15 bp, Homo sapiens
aagttttgaaaagct

SEQ ID NO: 5110833 - DNA, 18 bp, Homo sapiens
aagttttgaaaagctatt

SEQ ID NO: 5110834 - DNA, 16 bp, Homo sapiens
aagttttgaaggaaac

SEQ ID NO: 5110835 - DNA, 20 bp, Homo sapiens
aagttttgacaagctggctt

SEQ ID NO: 5110836 - DNA, 20 bp, Homo sapiens
aagttttgagtagatattac

SEQ ID NO: 5110837 - DNA, 20 bp, Homo sapiens
aagttttgatacttgtaact

SEQ ID NO: 5110838 - DNA, 21 bp, Homo sapiens
aagttttgatacttgtaactt

SEQ ID NO: 5110839 - DNA, 22 bp, Homo sapiens
aagttttgatacttgtaacttt

SEQ ID NO: 5110840 - DNA, 21 bp, Homo sapiens
aagttttgattaatgtttctt

SEQ ID NO: 5110841 - DNA, 12 bp, Homo sapiens
aagttttgcaac

SEQ ID NO: 5110842 - DNA, 16 bp, Homo sapiens
aagttttggagaggga

SEQ ID NO: 5110843 - DNA, 19 bp, Homo sapiens
aagttttgtaaaagaaatc

SEQ ID NO: 5110844 - DNA, 12 bp, Homo sapiens
aagttttgtata

SEQ ID NO: 5110845 - DNA, 20 bp, Homo sapiens
aagttttgtgaaatttttca

SEQ ID NO: 5110846 - DNA, 17 bp, Homo sapiens
aagttttgtgtgtatat

SEQ ID NO: 5110847 - DNA, 18 bp, Homo sapiens
aagttttgttctgtatat

SEQ ID NO: 5110848 - DNA, 12 bp, Homo sapiens
aagtttttacaa

SEQ ID NO: 5110849 - DNA, 19 bp, Homo sapiens
aagtttttacagtgtatct

SEQ ID NO: 5110850 - DNA, 21 bp, Homo sapiens
aagtttttattttaaacattt

SEQ ID NO: 5110851 - DNA, 13 bp, Homo sapiens
aagtttttcagaa

SEQ ID NO: 5110852 - DNA, 14 bp, Homo sapiens
aagtttttcagaaa

SEQ ID NO: 5110853 - DNA, 14 bp, Homo sapiens
aagtttttcatact

SEQ ID NO: 5110854 - DNA, 19 bp, Homo sapiens
aagtttttcatactgtaca

SEQ ID NO: 5110855 - DNA, 20 bp, Homo sapiens
aagtttttcatactgtacac

SEQ ID NO: 5110856 - DNA, 11 bp, Homo sapiens
aagtttttcca

SEQ ID NO: 5110857 - DNA, 17 bp, Homo sapiens
aagtttttctaacagta

SEQ ID NO: 5110858 - DNA, 13 bp, Homo sapiens
aagtttttctctt

SEQ ID NO: 5110859 - DNA, 15 bp, Homo sapiens
aagtttttggtaatg

SEQ ID NO: 5110860 - DNA, 13 bp, Homo sapiens
aagtttttgtact

SEQ ID NO: 5110861 - DNA, 21 bp, Homo sapiens
aagtttttgtttttgttttgt

SEQ ID NO: 5110862 - DNA, 15 bp, Homo sapiens
aagttttttatatat

SEQ ID NO: 5110863 - DNA, 13 bp, Homo sapiens
aagttttttatgc

SEQ ID NO: 5110864 - DNA, 14 bp, Homo sapiens
aagttttttatgcc

SEQ ID NO: 5110865 - DNA, 15 bp, Homo sapiens
aagttttttttctgg

SEQ ID NO: 5110866 - DNA, 19 bp, Homo sapiens
aataaaaaaaaacctacaa

SEQ ID NO: 5110867 - DNA, 20 bp, Homo sapiens
aataaaaaaaagaaatgaaa

SEQ ID NO: 5110868 - DNA, 15 bp, Homo sapiens
aataaaaaaatacag

SEQ ID NO: 5110869 - DNA, 16 bp, Homo sapiens
aataaaaaacaagaaa

SEQ ID NO: 5110870 - DNA, 15 bp, Homo sapiens
aataaaaaacatttg

SEQ ID NO: 5110871 - DNA, 18 bp, Homo sapiens
aataaaaaacatttgtac

SEQ ID NO: 5110872 - DNA, 19 bp, Homo sapiens
aataaaaaacatttgtaca

SEQ ID NO: 5110873 - DNA, 23 bp, Homo sapiens
aataaaaaagaacttttgtatct

SEQ ID NO: 5110874 - DNA, 17 bp, Homo sapiens
aataaaaaagattctac

SEQ ID NO: 5110875 - DNA, 16 bp, Homo sapiens
aataaaaaatatattt

SEQ ID NO: 5110876 - DNA, 13 bp, Homo sapiens
aataaaaaatctg

SEQ ID NO: 5110877 - DNA, 19 bp, Homo sapiens
aataaaaaattatgacaat

SEQ ID NO: 5110878 - DNA, 12 bp, Homo sapiens
aataaaaacaaa

SEQ ID NO: 5110879 - DNA, 14 bp, Homo sapiens
aataaaaacaaagt

SEQ ID NO: 5110880 - DNA, 14 bp, Homo sapiens
aataaaaacaactt

SEQ ID NO: 5110881 - DNA, 23 bp, Homo sapiens
aataaaaacattgcctttgaatg

SEQ ID NO: 5110882 - DNA, 20 bp, Homo sapiens
aataaaaacattttgaagtg

SEQ ID NO: 5110883 - DNA, 21 bp, Homo sapiens
aataaaaaccaaactctgtgt

SEQ ID NO: 5110884 - DNA, 22 bp, Homo sapiens
aataaaaaccaagaagatgtct

SEQ ID NO: 5110885 - DNA, 15 bp, Homo sapiens
aataaaaaccataaa

SEQ ID NO: 5110886 - DNA, 18 bp, Homo sapiens
aataaaaacccacaaaaa

SEQ ID NO: 5110887 - DNA, 17 bp, Homo sapiens
aataaaaacttacactc

SEQ ID NO: 5110888 - DNA, 19 bp, Homo sapiens
aataaaaagaaagatactt

SEQ ID NO: 5110889 - DNA, 16 bp, Homo sapiens
aataaaaagaaagatt

SEQ ID NO: 5110890 - DNA, 14 bp, Homo sapiens
aataaaaagagaaa

SEQ ID NO: 5110891 - DNA, 22 bp, Homo sapiens
aataaaaagccaccacacactg

SEQ ID NO: 5110892 - DNA, 18 bp, Homo sapiens
aataaaaaggaaatattt

SEQ ID NO: 5110893 - DNA, 18 bp, Homo sapiens
aataaaaaggcacctata

SEQ ID NO: 5110894 - DNA, 22 bp, Homo sapiens
aataaaaagggcagccctcctt

SEQ ID NO: 5110895 - DNA, 15 bp, Homo sapiens
aataaaaagtaacac

SEQ ID NO: 5110896 - DNA, 16 bp, Homo sapiens
aataaaaagtaacaca

SEQ ID NO: 5110897 - DNA, 13 bp, Homo sapiens
aataaaaagtata

SEQ ID NO: 5110898 - DNA, 11 bp, Homo sapiens
aataaaaagtg

SEQ ID NO: 5110899 - DNA, 14 bp, Homo sapiens
aataaaaagtgaac

SEQ ID NO: 5110900 - DNA, 16 bp, Homo sapiens
aataaaaagtgaactt

SEQ ID NO: 5110901 - DNA, 20 bp, Homo sapiens
aataaaaagtgaacttttgt

SEQ ID NO: 5110902 - DNA, 13 bp, Homo sapiens
aataaaaagtgac

SEQ ID NO: 5110903 - DNA, 15 bp, Homo sapiens
aataaaaagttaaaa

SEQ ID NO: 5110904 - DNA, 12 bp, Homo sapiens
aataaaaagttc

SEQ ID NO: 5110905 - DNA, 16 bp, Homo sapiens
aataaaaataaatcta

SEQ ID NO: 5110906 - DNA, 12 bp, Homo sapiens
aataaaaataat

SEQ ID NO: 5110907 - DNA, 14 bp, Homo sapiens
aataaaaatacaca

SEQ ID NO: 5110908 - DNA, 16 bp, Homo sapiens
aataaaaatatatatt

SEQ ID NO: 5110909 - DNA, 19 bp, Homo sapiens
aataaaaatatatattact

SEQ ID NO: 5110910 - DNA, 20 bp, Homo sapiens
aataaaaatatattttcaac

SEQ ID NO: 5110911 - DNA, 22 bp, Homo sapiens
aataaaaatattgtgttgtgaa

SEQ ID NO: 5110912 - DNA, 12 bp, Homo sapiens
aataaaaatcaa

SEQ ID NO: 5110913 - DNA, 13 bp, Homo sapiens
aataaaaatcaaa

SEQ ID NO: 5110914 - DNA, 20 bp, Homo sapiens
aataaaaatcaggagcctgc

SEQ ID NO: 5110915 - DNA, 14 bp, Homo sapiens
aataaaaatgtggt

SEQ ID NO: 5110916 - DNA, 14 bp, Homo sapiens
aataaaaattatga

SEQ ID NO: 5110917 - DNA, 16 bp, Homo sapiens
aataaaaattgaaaaa

SEQ ID NO: 5110918 - DNA, 13 bp, Homo sapiens
aataaaaatttgt

SEQ ID NO: 5110919 - DNA, 16 bp, Homo sapiens
aataaaaatttgttta

SEQ ID NO: 5110920 - DNA, 11 bp, Homo sapiens
aataaaacaag

SEQ ID NO: 5110921 - DNA, 14 bp, Homo sapiens
aataaaacaagcct

SEQ ID NO: 5110922 - DNA, 15 bp, Homo sapiens
aataaaacaagcctt

SEQ ID NO: 5110923 - DNA, 13 bp, Homo sapiens
aataaaacaggac

SEQ ID NO: 5110924 - DNA, 16 bp, Homo sapiens
aataaaacagtatctc

SEQ ID NO: 5110925 - DNA, 18 bp, Homo sapiens
aataaaacagtatctctt

SEQ ID NO: 5110926 - DNA, 17 bp, Homo sapiens
aataaaacataatagaa

SEQ ID NO: 5110927 - DNA, 15 bp, Homo sapiens
aataaaacatagcaa

SEQ ID NO: 5110928 - DNA, 11 bp, Homo sapiens
aataaaacatc

SEQ ID NO: 5110929 - DNA, 13 bp, Homo sapiens
aataaaacatggc

SEQ ID NO: 5110930 - DNA, 16 bp, Homo sapiens
aataaaacatgtaata

SEQ ID NO: 5110931 - DNA, 14 bp, Homo sapiens
aataaaacattatg

SEQ ID NO: 5110932 - DNA, 12 bp, Homo sapiens
aataaaacattc

SEQ ID NO: 5110933 - DNA, 12 bp, Homo sapiens
aataaaacattt

SEQ ID NO: 5110934 - DNA, 14 bp, Homo sapiens
aataaaacatttta

SEQ ID NO: 5110935 - DNA, 23 bp, Homo sapiens
aataaaacattttaaatggacag

SEQ ID NO: 5110936 - DNA, 19 bp, Homo sapiens
aataaaaccaaagaatagt

SEQ ID NO: 5110937 - DNA, 19 bp, Homo sapiens
aataaaaccagaaagagga

SEQ ID NO: 5110938 - DNA, 13 bp, Homo sapiens
aataaaaccagct

SEQ ID NO: 5110939 - DNA, 12 bp, Homo sapiens
aataaaacccaa

SEQ ID NO: 5110940 - DNA, 15 bp, Homo sapiens
aataaaacctcagct

SEQ ID NO: 5110941 - DNA, 14 bp, Homo sapiens
aataaaacctttca

SEQ ID NO: 5110942 - DNA, 16 bp, Homo sapiens
aataaaacctttcaaa

SEQ ID NO: 5110943 - DNA, 21 bp, Homo sapiens
aataaaacctttcaaatttca

SEQ ID NO: 5110944 - DNA, 13 bp, Homo sapiens
aataaaactcact

SEQ ID NO: 5110945 - DNA, 12 bp, Homo sapiens
aataaaactgaa

SEQ ID NO: 5110946 - DNA, 12 bp, Homo sapiens
aataaaactgat

SEQ ID NO: 5110947 - DNA, 19 bp, Homo sapiens
aataaaactgatgtgaaac

SEQ ID NO: 5110948 - DNA, 18 bp, Homo sapiens
aataaaactgatgttact

SEQ ID NO: 5110949 - DNA, 23 bp, Homo sapiens
aataaaactgtttgacttctcaa

SEQ ID NO: 5110950 - DNA, 13 bp, Homo sapiens
aataaaacttcac

SEQ ID NO: 5110951 - DNA, 16 bp, Homo sapiens
aataaaacttggttct

SEQ ID NO: 5110952 - DNA, 20 bp, Homo sapiens
aataaaactttatgtactgc

SEQ ID NO: 5110953 - DNA, 13 bp, Homo sapiens
aataaaacttttc

SEQ ID NO: 5110954 - DNA, 18 bp, Homo sapiens
aataaaacttttccaatg

SEQ ID NO: 5110955 - DNA, 14 bp, Homo sapiens
aataaaacttttta

SEQ ID NO: 5110956 - DNA, 15 bp, Homo sapiens
aataaaactttttaa

SEQ ID NO: 5110957 - DNA, 14 bp, Homo sapiens
aataaaagaaatat

SEQ ID NO: 5110958 - DNA, 19 bp, Homo sapiens
aataaaagaaatgcacaat

SEQ ID NO: 5110959 - DNA, 17 bp, Homo sapiens
aataaaagaacatgctt

SEQ ID NO: 5110960 - DNA, 22 bp, Homo sapiens
aataaaagatagcaatatgaga

SEQ ID NO: 5110961 - DNA, 16 bp, Homo sapiens
aataaaagatttacat

SEQ ID NO: 5110962 - DNA, 13 bp, Homo sapiens
aataaaagccaga

SEQ ID NO: 5110963 - DNA, 13 bp, Homo sapiens
aataaaagcccag

SEQ ID NO: 5110964 - DNA, 22 bp, Homo sapiens
aataaaagctataaagtatata

SEQ ID NO: 5110965 - DNA, 14 bp, Homo sapiens
aataaaagctatta

SEQ ID NO: 5110966 - DNA, 13 bp, Homo sapiens
aataaaagctgtg

SEQ ID NO: 5110967 - DNA, 12 bp, Homo sapiens
aataaaaggaaa

SEQ ID NO: 5110968 - DNA, 13 bp, Homo sapiens
aataaaaggaaaa

SEQ ID NO: 5110969 - DNA, 16 bp, Homo sapiens
aataaaaggcattcat

SEQ ID NO: 5110970 - DNA, 19 bp, Homo sapiens
aataaaaggtggatttgag

SEQ ID NO: 5110971 - DNA, 13 bp, Homo sapiens
aataaaagtatta

SEQ ID NO: 5110972 - DNA, 16 bp, Homo sapiens
aataaaagtgctgccg

SEQ ID NO: 5110973 - DNA, 14 bp, Homo sapiens
aataaaataaaaat

SEQ ID NO: 5110974 - DNA, 19 bp, Homo sapiens
aatactttgcataaattaa

SEQ ID NO: 5110975 - DNA, 20 bp, Homo sapiens
aatactttgcataaattaat

SEQ ID NO: 5110976 - DNA, 17 bp, Homo sapiens
aatactttgtatacaag

SEQ ID NO: 5110977 - DNA, 23 bp, Homo sapiens
aatactttgtatacaagtactgg

SEQ ID NO: 5110978 - DNA, 15 bp, Homo sapiens
aatacttttactctg

SEQ ID NO: 5110979 - DNA, 22 bp, Homo sapiens
aatacttttcaggcactttaga

SEQ ID NO: 5110980 - DNA, 15 bp, Homo sapiens
aatacttttccttac

SEQ ID NO: 5110981 - DNA, 20 bp, Homo sapiens
aatacttttgcatttttcct

SEQ ID NO: 5110982 - DNA, 21 bp, Homo sapiens
aatacttttgtccaatgtggt

SEQ ID NO: 5110983 - DNA, 19 bp, Homo sapiens
aatacttttgtgtattctg

SEQ ID NO: 5110984 - DNA, 10 bp, Homo sapiens
aatacttttt

SEQ ID NO: 5110985 - DNA, 16 bp, Homo sapiens
aatactttttaaatta

SEQ ID NO: 5110986 - DNA, 17 bp, Homo sapiens
aatactttttaaattac

SEQ ID NO: 5110987 - DNA, 22 bp, Homo sapiens
aatactttttacccaaatatgt

SEQ ID NO: 5110988 - DNA, 23 bp, Homo sapiens
aatactttttacccaaatatgtt

SEQ ID NO: 5110989 - DNA, 16 bp, Homo sapiens
aatactttttcttaaa

SEQ ID NO: 5110990 - DNA, 17 bp, Homo sapiens
aatagaaaaaaagtatt

SEQ ID NO: 5110991 - DNA, 13 bp, Homo sapiens
aatagaaaactga

SEQ ID NO: 5110992 - DNA, 18 bp, Homo sapiens
aatagaaaactgaaaatc

SEQ ID NO: 5110993 - DNA, 18 bp, Homo sapiens
aatagaaaagtagacaat

SEQ ID NO: 5110994 - DNA, 14 bp, Homo sapiens
aatagaaaagttat

SEQ ID NO: 5110995 - DNA, 19 bp, Homo sapiens
aatagaaaagttattagtg

SEQ ID NO: 5110996 - DNA, 20 bp, Homo sapiens
aatagaaaatgtaataactt

SEQ ID NO: 5110997 - DNA, 21 bp, Homo sapiens
aatagaaactcaccatgtaaa

SEQ ID NO: 5110998 - DNA, 22 bp, Homo sapiens
aatagaaataaaggatgtgatt

SEQ ID NO: 5110999 - DNA, 14 bp, Homo sapiens
aatagaaataaatt

SEQ ID NO: 5111000 - DNA, 19 bp, Homo sapiens
aatagaaataaattcctaa

SEQ ID NO: 5111001 - DNA, 15 bp, Homo sapiens
aatagaaattttgta

SEQ ID NO: 5111002 - DNA, 18 bp, Homo sapiens
aatagaaattttgtaaga

SEQ ID NO: 5111003 - DNA, 20 bp, Homo sapiens
aatagaaattttgttaacat

SEQ ID NO: 5111004 - DNA, 14 bp, Homo sapiens
aatagaacaagatg

SEQ ID NO: 5111005 - DNA, 17 bp, Homo sapiens
aatagaacactgcctct

SEQ ID NO: 5111006 - DNA, 21 bp, Homo sapiens
aatagaacactgcctctgagt

SEQ ID NO: 5111007 - DNA, 17 bp, Homo sapiens
aatagaactatctgcat

SEQ ID NO: 5111008 - DNA, 13 bp, Homo sapiens
aatagaacttgtt

SEQ ID NO: 5111009 - DNA, 15 bp, Homo sapiens
aatagaagaaagaaa

SEQ ID NO: 5111010 - DNA, 19 bp, Homo sapiens
aatagaagcttcttgctcc

SEQ ID NO: 5111011 - DNA, 13 bp, Homo sapiens
aatagaaggaaac

SEQ ID NO: 5111012 - DNA, 14 bp, Homo sapiens
aatagaaggaaact

SEQ ID NO: 5111013 - DNA, 19 bp, Homo sapiens
aatagaaggaaactagctt

SEQ ID NO: 5111014 - DNA, 20 bp, Homo sapiens
aatagaaggatgtacatttc

SEQ ID NO: 5111015 - DNA, 22 bp, Homo sapiens
aatagaaggatgtacatttcca

SEQ ID NO: 5111016 - DNA, 14 bp, Homo sapiens
aatagaaggtgatg

SEQ ID NO: 5111017 - DNA, 18 bp, Homo sapiens
aatagaagtgctcccctc

SEQ ID NO: 5111018 - DNA, 19 bp, Homo sapiens
aatagaagttttcctgata

SEQ ID NO: 5111019 - DNA, 17 bp, Homo sapiens
aatagaataattctttt

SEQ ID NO: 5111020 - DNA, 16 bp, Homo sapiens
aatagaataggcaaac

SEQ ID NO: 5111021 - DNA, 17 bp, Homo sapiens
aatagaatataattatc

SEQ ID NO: 5111022 - DNA, 15 bp, Homo sapiens
aatagaatatataaa

SEQ ID NO: 5111023 - DNA, 17 bp, Homo sapiens
aatagaatccaaaccca

SEQ ID NO: 5111024 - DNA, 15 bp, Homo sapiens
aatagaatgaaaagt

SEQ ID NO: 5111025 - DNA, 16 bp, Homo sapiens
aatagaatgtaaatgt

SEQ ID NO: 5111026 - DNA, 15 bp, Homo sapiens
aatagaattgacatt

SEQ ID NO: 5111027 - DNA, 21 bp, Homo sapiens
aatagacaagttttgtttcct

SEQ ID NO: 5111028 - DNA, 13 bp, Homo sapiens
aatagacaattta

SEQ ID NO: 5111029 - DNA, 23 bp, Homo sapiens
aatagacactccccgaagtcttt

SEQ ID NO: 5111030 - DNA, 14 bp, Homo sapiens
aatagacagaaaca

SEQ ID NO: 5111031 - DNA, 18 bp, Homo sapiens
aatagacagaggtttcat

SEQ ID NO: 5111032 - DNA, 16 bp, Homo sapiens
aatagacagtaaaata

SEQ ID NO: 5111033 - DNA, 20 bp, Homo sapiens
aatagacagtatatttatag

SEQ ID NO: 5111034 - DNA, 14 bp, Homo sapiens
aatagacataaatt

SEQ ID NO: 5111035 - DNA, 21 bp, Homo sapiens
aatagacatttttttgttcca

SEQ ID NO: 5111036 - DNA, 21 bp, Homo sapiens
aatagactgtaacttccaaat

SEQ ID NO: 5111037 - DNA, 22 bp, Homo sapiens
aatagacttatatgcaggctgt

SEQ ID NO: 5111038 - DNA, 21 bp, Homo sapiens
aatagacttctcttacatttt

SEQ ID NO: 5111039 - DNA, 14 bp, Homo sapiens
aatagagaagtgtg

SEQ ID NO: 5111040 - DNA, 19 bp, Homo sapiens
aatagagatgagctttctt

SEQ ID NO: 5111041 - DNA, 16 bp, Homo sapiens
aatagagcaagaaggc

SEQ ID NO: 5111042 - DNA, 22 bp, Homo sapiens
aatagagccaactgattttgta

SEQ ID NO: 5111043 - DNA, 14 bp, Homo sapiens
aatagagcctgagg

SEQ ID NO: 5111044 - DNA, 18 bp, Homo sapiens
aatagagctccatttccc

SEQ ID NO: 5111045 - DNA, 15 bp, Homo sapiens
aatagagctgccact

SEQ ID NO: 5111046 - DNA, 19 bp, Homo sapiens
aatagagctgttcaacatc

SEQ ID NO: 5111047 - DNA, 14 bp, Homo sapiens
aatagaggaagaaa

SEQ ID NO: 5111048 - DNA, 13 bp, Homo sapiens
aatagaggagctg

SEQ ID NO: 5111049 - DNA, 21 bp, Homo sapiens
aatagagggagtagaaagctt

SEQ ID NO: 5111050 - DNA, 15 bp, Homo sapiens
aatagagtatatgca

SEQ ID NO: 5111051 - DNA, 16 bp, Homo sapiens
aatagagtatatgcac

SEQ ID NO: 5111052 - DNA, 17 bp, Homo sapiens
aatagagtatatgcact

SEQ ID NO: 5111053 - DNA, 21 bp, Homo sapiens
aatagagtatggttgattccc

SEQ ID NO: 5111054 - DNA, 23 bp, Homo sapiens
aatagagtcacagctttcccagg

SEQ ID NO: 5111055 - DNA, 14 bp, Homo sapiens
aatagagtgaatta

SEQ ID NO: 5111056 - DNA, 23 bp, Homo sapiens
aatagagtgtagtttacagaaaa

SEQ ID NO: 5111057 - DNA, 14 bp, Homo sapiens
aatagagtgttttt

SEQ ID NO: 5111058 - DNA, 20 bp, Homo sapiens
aatagataactgctctttta

SEQ ID NO: 5111059 - DNA, 16 bp, Homo sapiens
aatagatacttttgat

SEQ ID NO: 5111060 - DNA, 18 bp, Homo sapiens
aatagatatgaaagctga

SEQ ID NO: 5111061 - DNA, 19 bp, Homo sapiens
aatagatcacggcatgttt

SEQ ID NO: 5111062 - DNA, 21 bp, Homo sapiens
aatagatgacattgactattt

SEQ ID NO: 5111063 - DNA, 16 bp, Homo sapiens
aatagatgctgactgt

SEQ ID NO: 5111064 - DNA, 13 bp, Homo sapiens
aatagatggaatt

SEQ ID NO: 5111065 - DNA, 22 bp, Homo sapiens
aatagatggggcatataataaa

SEQ ID NO: 5111066 - DNA, 15 bp, Homo sapiens
aatagatgtctcaaa

SEQ ID NO: 5111067 - DNA, 12 bp, Homo sapiens
aatagatgtctt

SEQ ID NO: 5111068 - DNA, 14 bp, Homo sapiens
aatagatgtctttt

SEQ ID NO: 5111069 - DNA, 15 bp, Homo sapiens
aatagatgtgaaaat

SEQ ID NO: 5111070 - DNA, 20 bp, Homo sapiens
aatagatgtgcccttttata

SEQ ID NO: 5111071 - DNA, 21 bp, Homo sapiens
aatagattactgatgtgatat

SEQ ID NO: 5111072 - DNA, 19 bp, Homo sapiens
aatagattgctcaaatcag

SEQ ID NO: 5111073 - DNA, 22 bp, Homo sapiens
aatagattgctcaaatcaggtt

SEQ ID NO: 5111074 - DNA, 21 bp, Homo sapiens
aatagatttaccctttataga

SEQ ID NO: 5111075 - DNA, 22 bp, Homo sapiens
aatagatttaccctttatagaa

SEQ ID NO: 5111076 - DNA, 18 bp, Homo sapiens
aatagatttaggagcaga

SEQ ID NO: 5111077 - DNA, 21 bp, Homo sapiens
aatagattttctctggaaata

SEQ ID NO: 5111078 - DNA, 15 bp, Homo sapiens
aatagatttttagat

SEQ ID NO: 5111079 - DNA, 13 bp, Homo sapiens
aatagatttttga

SEQ ID NO: 5111080 - DNA, 16 bp, Homo sapiens
aatagatttttgattc

SEQ ID NO: 5111081 - DNA, 20 bp, Homo sapiens
aatagatttttgattcagct

SEQ ID NO: 5111082 - DNA, 16 bp, Homo sapiens
aatagcaaaagaagaa

SEQ ID NO: 5111083 - DNA, 14 bp, Homo sapiens
aatagcaaagaatt

SEQ ID NO: 5111084 - DNA, 18 bp, Homo sapiens
aatagcaaagaattgact

SEQ ID NO: 5111085 - DNA, 13 bp, Homo sapiens
aatagcaactttt

SEQ ID NO: 5111086 - DNA, 17 bp, Homo sapiens
aatagcaaggccagggc

SEQ ID NO: 5111087 - DNA, 21 bp, Homo sapiens
aatagcaaggctgtgcatcta

SEQ ID NO: 5111088 - DNA, 15 bp, Homo sapiens
aatagcaatattctt

SEQ ID NO: 5111089 - DNA, 18 bp, Homo sapiens
aatagcacccatatctgt

SEQ ID NO: 5111090 - DNA, 16 bp, Homo sapiens
aatagcacttaaattc

SEQ ID NO: 5111091 - DNA, 17 bp, Homo sapiens
aatagcagagagccaaa

SEQ ID NO: 5111092 - DNA, 23 bp, Homo sapiens
aatagcagccctcaattgtgaaa

SEQ ID NO: 5111093 - DNA, 15 bp, Homo sapiens
aatagcagtggcaaa

SEQ ID NO: 5111094 - DNA, 20 bp, Homo sapiens
aatagcagttataacagatg

SEQ ID NO: 5111095 - DNA, 22 bp, Homo sapiens
aatagcatacaccaaacatttc

SEQ ID NO: 5111096 - DNA, 17 bp, Homo sapiens
aatagcatactgtgtat

SEQ ID NO: 5111097 - DNA, 12 bp, Homo sapiens
aatagcatctgt

SEQ ID NO: 5111098 - DNA, 16 bp, Homo sapiens
aatagcatctgtacaa

SEQ ID NO: 5111099 - DNA, 20 bp, Homo sapiens
aatagcatctgtacaaaggg

SEQ ID NO: 5111100 - DNA, 19 bp, Homo sapiens
aatagcatgtattgtgtct

SEQ ID NO: 5111101 - DNA, 20 bp, Homo sapiens
aatagcatgtcctaatgctt

SEQ ID NO: 5111102 - DNA, 16 bp, Homo sapiens
aatagcatgttgtaga

SEQ ID NO: 5111103 - DNA, 14 bp, Homo sapiens
aatagcattatctt

SEQ ID NO: 5111104 - DNA, 19 bp, Homo sapiens
aatagcattgtttttgtca

SEQ ID NO: 5111105 - DNA, 22 bp, Homo sapiens
aatagcatttgccacttagtat

SEQ ID NO: 5111106 - DNA, 15 bp, Homo sapiens
aatagccatatttgt

SEQ ID NO: 5111107 - DNA, 20 bp, Homo sapiens
aatagcccagatcccaagag

SEQ ID NO: 5111108 - DNA, 14 bp, Homo sapiens
aatagccccagact

SEQ ID NO: 5111109 - DNA, 17 bp, Homo sapiens
aatagccctccccctca

SEQ ID NO: 5111110 - DNA, 22 bp, Homo sapiens
aatagccgaactccaggctggg

SEQ ID NO: 5111111 - DNA, 16 bp, Homo sapiens
aatagcctaaatgatg

SEQ ID NO: 5111112 - DNA, 18 bp, Homo sapiens
aatagcctaaatgatggt

SEQ ID NO: 5111113 - DNA, 17 bp, Homo sapiens
aatagcctctcctttgt

SEQ ID NO: 5111114 - DNA, 18 bp, Homo sapiens
aatagcctctcctttgta

SEQ ID NO: 5111115 - DNA, 12 bp, Homo sapiens
aatagcctggcc

SEQ ID NO: 5111116 - DNA, 13 bp, Homo sapiens
aatagcctggcca

SEQ ID NO: 5111117 - DNA, 14 bp, Homo sapiens
aatagcctgtggcc

SEQ ID NO: 5111118 - DNA, 15 bp, Homo sapiens
aatagcctttcttat

SEQ ID NO: 5111119 - DNA, 17 bp, Homo sapiens
aatagcgaatcatctca

SEQ ID NO: 5111120 - DNA, 19 bp, Homo sapiens
aatagcgctcccttttcac

SEQ ID NO: 5111121 - DNA, 16 bp, Homo sapiens
aatagctaagcatctc

SEQ ID NO: 5111122 - DNA, 18 bp, Homo sapiens
aatagctaataatgttaa

SEQ ID NO: 5111123 - DNA, 15 bp, Homo sapiens
aatagctacagctgt

SEQ ID NO: 5111124 - DNA, 14 bp, Homo sapiens
aatagctagactgg

SEQ ID NO: 5111125 - DNA, 20 bp, Homo sapiens
aatagctagactggtgactg

SEQ ID NO: 5111126 - DNA, 15 bp, Homo sapiens
aatagctagctatta

SEQ ID NO: 5111127 - DNA, 15 bp, Homo sapiens
aatagctatatccat

SEQ ID NO: 5111128 - DNA, 14 bp, Homo sapiens
aatagctattgcat

SEQ ID NO: 5111129 - DNA, 23 bp, Homo sapiens
aatagctattgcatgtaaaatgc

SEQ ID NO: 5111130 - DNA, 19 bp, Homo sapiens
aatagctatttttttccta

SEQ ID NO: 5111131 - DNA, 22 bp, Homo sapiens
aatagctcacagcacatttgtt

SEQ ID NO: 5111132 - DNA, 18 bp, Homo sapiens
aatagctccaagctgtta

SEQ ID NO: 5111133 - DNA, 20 bp, Homo sapiens
aatagctcccagatttcagt

SEQ ID NO: 5111134 - DNA, 13 bp, Homo sapiens
aatagctctactg

SEQ ID NO: 5111135 - DNA, 11 bp, Homo sapiens
aatagctcttg

SEQ ID NO: 5111136 - DNA, 17 bp, Homo sapiens
aatagctgaaaactaat

SEQ ID NO: 5111137 - DNA, 16 bp, Homo sapiens
aatagctgatagaaga

SEQ ID NO: 5111138 - DNA, 13 bp, Homo sapiens
aatagctgtgatc

SEQ ID NO: 5111139 - DNA, 18 bp, Homo sapiens
aatagctgtgtatctgtt

SEQ ID NO: 5111140 - DNA, 18 bp, Homo sapiens
aatagctgttttgtgtat

SEQ ID NO: 5111141 - DNA, 19 bp, Homo sapiens
aatagctgttttgtgtata

SEQ ID NO: 5111142 - DNA, 21 bp, Homo sapiens
aatagcttatgtacaaaactt

SEQ ID NO: 5111143 - DNA, 20 bp, Homo sapiens
aatagcttattatagaattg

SEQ ID NO: 5111144 - DNA, 18 bp, Homo sapiens
aatagcttccaataaagc

SEQ ID NO: 5111145 - DNA, 16 bp, Homo sapiens
aatagcttctgtgtgt

SEQ ID NO: 5111146 - DNA, 18 bp, Homo sapiens
aatagcttgtacacatat

SEQ ID NO: 5111147 - DNA, 21 bp, Homo sapiens
aatagcttgtacacatataca

SEQ ID NO: 5111148 - DNA, 18 bp, Homo sapiens
aatagctttactgtttct

SEQ ID NO: 5111149 - DNA, 23 bp, Homo sapiens
aatagctttactgtttctcaagt

SEQ ID NO: 5111150 - DNA, 19 bp, Homo sapiens
aatagctttagtgaattaa

SEQ ID NO: 5111151 - DNA, 17 bp, Homo sapiens
aatagctttgagatttc

SEQ ID NO: 5111152 - DNA, 12 bp, Homo sapiens
aataaaataaac

SEQ ID NO: 5111153 - DNA, 12 bp, Homo sapiens
aataaaataacc

SEQ ID NO: 5111154 - DNA, 17 bp, Homo sapiens
aataaaatactttttgt

SEQ ID NO: 5111155 - DNA, 23 bp, Homo sapiens
aataaaatagagtctggaatgct

SEQ ID NO: 5111156 - DNA, 21 bp, Homo sapiens
aataaaatagtattgaaagtg

SEQ ID NO: 5111157 - DNA, 13 bp, Homo sapiens
aataaaatatata

SEQ ID NO: 5111158 - DNA, 14 bp, Homo sapiens
aataaaatatatat

SEQ ID NO: 5111159 - DNA, 12 bp, Homo sapiens
aataaaatatca

SEQ ID NO: 5111160 - DNA, 19 bp, Homo sapiens
aataaaatatcataaagca

SEQ ID NO: 5111161 - DNA, 14 bp, Homo sapiens
aataaaatatcatt

SEQ ID NO: 5111162 - DNA, 12 bp, Homo sapiens
aataaaatatga

SEQ ID NO: 5111163 - DNA, 12 bp, Homo sapiens
aataaaatattt

SEQ ID NO: 5111164 - DNA, 11 bp, Homo sapiens
aataaaatcat

SEQ ID NO: 5111165 - DNA, 18 bp, Homo sapiens
aataaaatcatgtacatt

SEQ ID NO: 5111166 - DNA, 20 bp, Homo sapiens
aataaaatcatgtagtttgt

SEQ ID NO: 5111167 - DNA, 16 bp, Homo sapiens
aataaaatcttgaaaa

SEQ ID NO: 5111168 - DNA, 19 bp, Homo sapiens
aataaaatgaaaattgtat

SEQ ID NO: 5111169 - DNA, 16 bp, Homo sapiens
aataaaatgagttacc

SEQ ID NO: 5111170 - DNA, 12 bp, Homo sapiens
aataaaatgcaa

SEQ ID NO: 5111171 - DNA, 15 bp, Homo sapiens
aataaaatgcaaatg

SEQ ID NO: 5111172 - DNA, 21 bp, Homo sapiens
aataaaatgccatagtttgtg

SEQ ID NO: 5111173 - DNA, 14 bp, Homo sapiens
aataaaatgggttt

SEQ ID NO: 5111174 - DNA, 16 bp, Homo sapiens
aataaaatgtgaagac

SEQ ID NO: 5111175 - DNA, 14 bp, Homo sapiens
aataaaatgtgatt

SEQ ID NO: 5111176 - DNA, 18 bp, Homo sapiens
aataaaatgtgtacagtg

SEQ ID NO: 5111177 - DNA, 21 bp, Homo sapiens
aataaaatgtgtacagtgaat

SEQ ID NO: 5111178 - DNA, 13 bp, Homo sapiens
aataaaatgttta

SEQ ID NO: 5111179 - DNA, 15 bp, Homo sapiens
aataaaatgtttaca

SEQ ID NO: 5111180 - DNA, 18 bp, Homo sapiens
aataaaatgtttacattt

SEQ ID NO: 5111181 - DNA, 23 bp, Homo sapiens
aataaaattaaagctgaaaactg

SEQ ID NO: 5111182 - DNA, 12 bp, Homo sapiens
aataaaattaag

SEQ ID NO: 5111183 - DNA, 14 bp, Homo sapiens
aataaaattaagaa

SEQ ID NO: 5111184 - DNA, 13 bp, Homo sapiens
aataaaattcatt

SEQ ID NO: 5111185 - DNA, 16 bp, Homo sapiens
aataaaattcattcca

SEQ ID NO: 5111186 - DNA, 18 bp, Homo sapiens
aataaaattcattccatt

SEQ ID NO: 5111187 - DNA, 18 bp, Homo sapiens
aataaaattccctaaagc

SEQ ID NO: 5111188 - DNA, 19 bp, Homo sapiens
aataaaattccctaaagcc

SEQ ID NO: 5111189 - DNA, 14 bp, Homo sapiens
aataaaattgcact

SEQ ID NO: 5111190 - DNA, 15 bp, Homo sapiens
aataaaattgcactt

SEQ ID NO: 5111191 - DNA, 13 bp, Homo sapiens
aataaaatttaaa

SEQ ID NO: 5111192 - DNA, 14 bp, Homo sapiens
aataaaatttgttg

SEQ ID NO: 5111193 - DNA, 16 bp, Homo sapiens
aataaaatttgttgca

SEQ ID NO: 5111194 - DNA, 19 bp, Homo sapiens
aataaaattttcaaacttt

SEQ ID NO: 5111195 - DNA, 12 bp, Homo sapiens
aataaacaaaat

SEQ ID NO: 5111196 - DNA, 18 bp, Homo sapiens
aataaacacatagattca

SEQ ID NO: 5111197 - DNA, 10 bp, Homo sapiens
aataaacact

SEQ ID NO: 5111198 - DNA, 11 bp, Homo sapiens
aataaacactc

SEQ ID NO: 5111199 - DNA, 16 bp, Homo sapiens
aataaacactcttgaa

SEQ ID NO: 5111200 - DNA, 19 bp, Homo sapiens
aataaacactcttgaaaaa

SEQ ID NO: 5111201 - DNA, 21 bp, Homo sapiens
aataaacactggctctgggac

SEQ ID NO: 5111202 - DNA, 19 bp, Homo sapiens
aataaacactggtgccaac

SEQ ID NO: 5111203 - DNA, 12 bp, Homo sapiens
aataaacactgt

SEQ ID NO: 5111204 - DNA, 16 bp, Homo sapiens
aataaacagacaaaaa

SEQ ID NO: 5111205 - DNA, 22 bp, Homo sapiens
aataaacagcttcatgcctttg

SEQ ID NO: 5111206 - DNA, 23 bp, Homo sapiens
aataaacaggaattttattttgc

SEQ ID NO: 5111207 - DNA, 12 bp, Homo sapiens
aataaacaggag

SEQ ID NO: 5111208 - DNA, 13 bp, Homo sapiens
aataaacagtcac

SEQ ID NO: 5111209 - DNA, 20 bp, Homo sapiens
aataaacagtgagcatatct

SEQ ID NO: 5111210 - DNA, 13 bp, Homo sapiens
aataaacagttgt

SEQ ID NO: 5111211 - DNA, 21 bp, Homo sapiens
aataaacatctgtgtctgtgt

SEQ ID NO: 5111212 - DNA, 13 bp, Homo sapiens
aataaacattaat

SEQ ID NO: 5111213 - DNA, 21 bp, Homo sapiens
aataaaccaaacccagccact

SEQ ID NO: 5111214 - DNA, 21 bp, Homo sapiens
aataaaccaaaggacattatg

SEQ ID NO: 5111215 - DNA, 19 bp, Homo sapiens
aataaaccaatgaacgaag

SEQ ID NO: 5111216 - DNA, 12 bp, Homo sapiens
aataaaccacaa

SEQ ID NO: 5111217 - DNA, 20 bp, Homo sapiens
aataaaccacacttagtcct

SEQ ID NO: 5111218 - DNA, 13 bp, Homo sapiens
aataaaccagtgt

SEQ ID NO: 5111219 - DNA, 16 bp, Homo sapiens
aataaaccagtgtgaa

SEQ ID NO: 5111220 - DNA, 15 bp, Homo sapiens
aataaaccattggac

SEQ ID NO: 5111221 - DNA, 17 bp, Homo sapiens
aataaacctgcactgaa

SEQ ID NO: 5111222 - DNA, 21 bp, Homo sapiens
aataaacctggagatgatgat

SEQ ID NO: 5111223 - DNA, 14 bp, Homo sapiens
aataaacctgttta

SEQ ID NO: 5111224 - DNA, 14 bp, Homo sapiens
aataaaccttgttt

SEQ ID NO: 5111225 - DNA, 12 bp, Homo sapiens
aataaacgattt

SEQ ID NO: 5111226 - DNA, 21 bp, Homo sapiens
aataaacgatttaattctctt

SEQ ID NO: 5111227 - DNA, 17 bp, Homo sapiens
aataaacgcagaagagg

SEQ ID NO: 5111228 - DNA, 15 bp, Homo sapiens
aataaactagggttt

SEQ ID NO: 5111229 - DNA, 20 bp, Homo sapiens
aataaactagggttttggcc

SEQ ID NO: 5111230 - DNA, 21 bp, Homo sapiens
aataaactagggttttggcct

SEQ ID NO: 5111231 - DNA, 22 bp, Homo sapiens
aataaactagggttttggcctg

SEQ ID NO: 5111232 - DNA, 11 bp, Homo sapiens
aataaactagt

SEQ ID NO: 5111233 - DNA, 19 bp, Homo sapiens
aataaactagtttccagtg

SEQ ID NO: 5111234 - DNA, 14 bp, Homo sapiens
aataaactccttaa

SEQ ID NO: 5111235 - DNA, 18 bp, Homo sapiens
aataaactcttaagagaa

SEQ ID NO: 5111236 - DNA, 23 bp, Homo sapiens
aataaactgaatttttcttgcga

SEQ ID NO: 5111237 - DNA, 11 bp, Homo sapiens
aataaactgca

SEQ ID NO: 5111238 - DNA, 12 bp, Homo sapiens
aataaactgcaa

SEQ ID NO: 5111239 - DNA, 14 bp, Homo sapiens
aataaactgcaagt

SEQ ID NO: 5111240 - DNA, 18 bp, Homo sapiens
aataaactgcaagttcat

SEQ ID NO: 5111241 - DNA, 23 bp, Homo sapiens
aataaactgcaagttcattttaa

SEQ ID NO: 5111242 - DNA, 10 bp, Homo sapiens
aataaactgg

SEQ ID NO: 5111243 - DNA, 11 bp, Homo sapiens
aataaactggt

SEQ ID NO: 5111244 - DNA, 12 bp, Homo sapiens
aataaactgtaa

SEQ ID NO: 5111245 - DNA, 14 bp, Homo sapiens
aataaactgtaaac

SEQ ID NO: 5111246 - DNA, 13 bp, Homo sapiens
aataaactgtatt

SEQ ID NO: 5111247 - DNA, 18 bp, Homo sapiens
aataaactgtattaaatc

SEQ ID NO: 5111248 - DNA, 17 bp, Homo sapiens
aataaactgtgtttact

SEQ ID NO: 5111249 - DNA, 11 bp, Homo sapiens
aataaactgtt

SEQ ID NO: 5111250 - DNA, 15 bp, Homo sapiens
aataaactgtttata

SEQ ID NO: 5111251 - DNA, 16 bp, Homo sapiens
aataaacttaacttta

SEQ ID NO: 5111252 - DNA, 17 bp, Homo sapiens
aataaacttagaggaaa

SEQ ID NO: 5111253 - DNA, 23 bp, Homo sapiens
aataaacttgattatattgtttt

SEQ ID NO: 5111254 - DNA, 17 bp, Homo sapiens
aataaacttgtgcctcc

SEQ ID NO: 5111255 - DNA, 18 bp, Homo sapiens
aataaactttgaataaaa

SEQ ID NO: 5111256 - DNA, 21 bp, Homo sapiens
aataaactttgaataaaagaa

SEQ ID NO: 5111257 - DNA, 13 bp, Homo sapiens
aataaactttttt

SEQ ID NO: 5111258 - DNA, 20 bp, Homo sapiens
aataaacttttttttgagaa

SEQ ID NO: 5111259 - DNA, 13 bp, Homo sapiens
aataaagaaaaga

SEQ ID NO: 5111260 - DNA, 15 bp, Homo sapiens
aataaagaaattaac

SEQ ID NO: 5111261 - DNA, 17 bp, Homo sapiens
aataaagaaatttggta

SEQ ID NO: 5111262 - DNA, 19 bp, Homo sapiens
aataaagaagaaaataacc

SEQ ID NO: 5111263 - DNA, 17 bp, Homo sapiens
aataaagaagataataa

SEQ ID NO: 5111264 - DNA, 20 bp, Homo sapiens
aataaagaagtatggtaatc

SEQ ID NO: 5111265 - DNA, 14 bp, Homo sapiens
aataaagaatactt

SEQ ID NO: 5111266 - DNA, 12 bp, Homo sapiens
aataaagaatgg

SEQ ID NO: 5111267 - DNA, 17 bp, Homo sapiens
aataaagaatggaaagc

SEQ ID NO: 5111268 - DNA, 13 bp, Homo sapiens
aataaagagctca

SEQ ID NO: 5111269 - DNA, 15 bp, Homo sapiens
aataaagagttagaa

SEQ ID NO: 5111270 - DNA, 18 bp, Homo sapiens
aataaagagttagaatga

SEQ ID NO: 5111271 - DNA, 16 bp, Homo sapiens
aataaagatacaaaat

SEQ ID NO: 5111272 - DNA, 23 bp, Homo sapiens
aataaagatacaaaatgttactg

SEQ ID NO: 5111273 - DNA, 17 bp, Homo sapiens
aataaagatatttccaa

SEQ ID NO: 5111274 - DNA, 19 bp, Homo sapiens
aataaagatcatgtaaaag

SEQ ID NO: 5111275 - DNA, 20 bp, Homo sapiens
aataaagatcatgtaaaagt

SEQ ID NO: 5111276 - DNA, 15 bp, Homo sapiens
aataaagatgagttg

SEQ ID NO: 5111277 - DNA, 12 bp, Homo sapiens
aataaagatgat

SEQ ID NO: 5111278 - DNA, 16 bp, Homo sapiens
aataaagatgattgaa

SEQ ID NO: 5111279 - DNA, 16 bp, Homo sapiens
aataaagcaataagaa

SEQ ID NO: 5111280 - DNA, 13 bp, Homo sapiens
aataaagcaattt

SEQ ID NO: 5111281 - DNA, 22 bp, Homo sapiens
aataaagcaattttccttgaag

SEQ ID NO: 5111282 - DNA, 24 bp, Homo sapiens
aataaagcaattttccttgaagcc

SEQ ID NO: 5111283 - DNA, 16 bp, Homo sapiens
aataaagcagaagcaa

SEQ ID NO: 5111284 - DNA, 12 bp, Homo sapiens
aataaagcagag

SEQ ID NO: 5111285 - DNA, 13 bp, Homo sapiens
aataaagcagagc

SEQ ID NO: 5111286 - DNA, 16 bp, Homo sapiens
aataaagcagagccaa

SEQ ID NO: 5111287 - DNA, 23 bp, Homo sapiens
aataaagcagagccaaggccacc

SEQ ID NO: 5111288 - DNA, 17 bp, Homo sapiens
aataaagcagcctcatt

SEQ ID NO: 5111289 - DNA, 13 bp, Homo sapiens
aataaagcaggga

SEQ ID NO: 5111290 - DNA, 10 bp, Homo sapiens
aataaagcat

SEQ ID NO: 5111291 - DNA, 13 bp, Homo sapiens
aataaagcattct

SEQ ID NO: 5111292 - DNA, 13 bp, Homo sapiens
aataaagccacat

SEQ ID NO: 5111293 - DNA, 15 bp, Homo sapiens
aataaagccctggga

SEQ ID NO: 5111294 - DNA, 16 bp, Homo sapiens
aataaagcgtcctctc

SEQ ID NO: 5111295 - DNA, 11 bp, Homo sapiens
aataaagctac

SEQ ID NO: 5111296 - DNA, 21 bp, Homo sapiens
aataaagctactgaatttatt

SEQ ID NO: 5111297 - DNA, 14 bp, Homo sapiens
aataaagctcaagg

SEQ ID NO: 5111298 - DNA, 12 bp, Homo sapiens
aataaagctgga

SEQ ID NO: 5111299 - DNA, 13 bp, Homo sapiens
aataaagctggac

SEQ ID NO: 5111300 - DNA, 22 bp, Homo sapiens
aataaagctggacaagaagctg

SEQ ID NO: 5111301 - DNA, 22 bp, Homo sapiens
aataaagctgtgacagttctgt

SEQ ID NO: 5111302 - DNA, 22 bp, Homo sapiens
aataaagctgttctcattcctg

SEQ ID NO: 5111303 - DNA, 17 bp, Homo sapiens
aataaagcttacatagt

SEQ ID NO: 5111304 - DNA, 22 bp, Homo sapiens
aataaagcttctctctgagctg

SEQ ID NO: 5111305 - DNA, 12 bp, Homo sapiens
aataaagcttta

SEQ ID NO: 5111306 - DNA, 15 bp, Homo sapiens
aataaagcttttgga

SEQ ID NO: 5111307 - DNA, 15 bp, Homo sapiens
aataaaggaaaacaa

SEQ ID NO: 5111308 - DNA, 16 bp, Homo sapiens
aataaaggaaaacaaa

SEQ ID NO: 5111309 - DNA, 12 bp, Homo sapiens
aataaaggaaat

SEQ ID NO: 5111310 - DNA, 18 bp, Homo sapiens
aataaaggactgtaatct

SEQ ID NO: 5111311 - DNA, 18 bp, Homo sapiens
aataaaggatgtgattgt

SEQ ID NO: 5111312 - DNA, 14 bp, Homo sapiens
aataaaggcagctg

SEQ ID NO: 5111313 - DNA, 15 bp, Homo sapiens
aataaaggcagctgc

SEQ ID NO: 5111314 - DNA, 16 bp, Homo sapiens
aataaaggcagctgcc

SEQ ID NO: 5111315 - DNA, 19 bp, Homo sapiens
aataaaggcagctgcctct

SEQ ID NO: 5111316 - DNA, 20 bp, Homo sapiens
aataaaggcagctgcctctg

SEQ ID NO: 5111317 - DNA, 22 bp, Homo sapiens
aataaaggcagctgcctctgct

SEQ ID NO: 5111318 - DNA, 15 bp, Homo sapiens
aataaaggcagtttt

SEQ ID NO: 5111319 - DNA, 15 bp, Homo sapiens
aataaaggcctgcgt

SEQ ID NO: 5111320 - DNA, 14 bp, Homo sapiens
aataaaggctctgt

SEQ ID NO: 5111321 - DNA, 22 bp, Homo sapiens
aataaaggctgagtttagtttt

SEQ ID NO: 5111322 - DNA, 16 bp, Homo sapiens
aataaaggtaaaatca

SEQ ID NO: 5111323 - DNA, 19 bp, Homo sapiens
aataaaggtaaaatcactt

SEQ ID NO: 5111324 - DNA, 19 bp, Homo sapiens
aataaaggtatgaaagggt

SEQ ID NO: 5111325 - DNA, 14 bp, Homo sapiens
aataaaggttgtga

SEQ ID NO: 5111326 - DNA, 19 bp, Homo sapiens
aataaagtacgtgtttact

SEQ ID NO: 5111327 - DNA, 15 bp, Homo sapiens
aataaagtactgcaa

SEQ ID NO: 5111328 - DNA, 17 bp, Homo sapiens
aataaagtagcaaaaca

SEQ ID NO: 5111329 - DNA, 23 bp, Homo sapiens
aataaagtagcaaaacaaattca

SEQ ID NO: 5111330 - DNA, 17 bp, Homo sapiens
aataaagtaggaaagaa

SEQ ID NO: 5111331 - DNA, 12 bp, Homo sapiens
aataaagtagtt

SEQ ID NO: 5111332 - DNA, 18 bp, Homo sapiens
aataaagtatcatgcatt

SEQ ID NO: 5111333 - DNA, 14 bp, Homo sapiens
aataaagtatctac

SEQ ID NO: 5111334 - DNA, 16 bp, Homo sapiens
aataaagtatctacat

SEQ ID NO: 5111335 - DNA, 20 bp, Homo sapiens
aataaagtattccaccttaa

SEQ ID NO: 5111336 - DNA, 14 bp, Homo sapiens
aatagcttttattg

SEQ ID NO: 5111337 - DNA, 23 bp, Homo sapiens
aatagcttttattgagtaatatt

SEQ ID NO: 5111338 - DNA, 23 bp, Homo sapiens
aatagcttttcatcaattcttaa

SEQ ID NO: 5111339 - DNA, 15 bp, Homo sapiens
aatagcttttgtgtc

SEQ ID NO: 5111340 - DNA, 15 bp, Homo sapiens
aataggaaaaactga

SEQ ID NO: 5111341 - DNA, 13 bp, Homo sapiens
aataggaaaatgt

SEQ ID NO: 5111342 - DNA, 18 bp, Homo sapiens
aataggaaagactttctc

SEQ ID NO: 5111343 - DNA, 12 bp, Homo sapiens
aataggaaagca

SEQ ID NO: 5111344 - DNA, 21 bp, Homo sapiens
aataggaagaacagtacattt

SEQ ID NO: 5111345 - DNA, 11 bp, Homo sapiens
aataggaataa

SEQ ID NO: 5111346 - DNA, 19 bp, Homo sapiens
aataggaatcaccctccta

SEQ ID NO: 5111347 - DNA, 20 bp, Homo sapiens
aataggaatcattcagaaat

SEQ ID NO: 5111348 - DNA, 22 bp, Homo sapiens
aataggaatcattcagaaatgt

SEQ ID NO: 5111349 - DNA, 21 bp, Homo sapiens
aataggaatcttcactagaag

SEQ ID NO: 5111350 - DNA, 11 bp, Homo sapiens
aataggaattc

SEQ ID NO: 5111351 - DNA, 14 bp, Homo sapiens
aataggaccagagc

SEQ ID NO: 5111352 - DNA, 14 bp, Homo sapiens
aataggacttgttt

SEQ ID NO: 5111353 - DNA, 20 bp, Homo sapiens
aataggagaggatgagagcc

SEQ ID NO: 5111354 - DNA, 16 bp, Homo sapiens
aataggagtatttttg

SEQ ID NO: 5111355 - DNA, 22 bp, Homo sapiens
aataggagttgggtttggtttt

SEQ ID NO: 5111356 - DNA, 20 bp, Homo sapiens
aataggatgaatgggaaagt

SEQ ID NO: 5111357 - DNA, 15 bp, Homo sapiens
aataggatgaggttt

SEQ ID NO: 5111358 - DNA, 21 bp, Homo sapiens
aataggatgataggaaataaa

SEQ ID NO: 5111359 - DNA, 15 bp, Homo sapiens
aataggatttttaga

SEQ ID NO: 5111360 - DNA, 14 bp, Homo sapiens
aataggcactttaa

SEQ ID NO: 5111361 - DNA, 15 bp, Homo sapiens
aataggcactttaaa

SEQ ID NO: 5111362 - DNA, 14 bp, Homo sapiens
aataggcaggaagc

SEQ ID NO: 5111363 - DNA, 16 bp, Homo sapiens
aataggcattaacaca

SEQ ID NO: 5111364 - DNA, 22 bp, Homo sapiens
aataggcattaacacaaaggag

SEQ ID NO: 5111365 - DNA, 17 bp, Homo sapiens
aataggcattttaagta

SEQ ID NO: 5111366 - DNA, 13 bp, Homo sapiens
aataggccacaga

SEQ ID NO: 5111367 - DNA, 21 bp, Homo sapiens
aataggctattaaaaaagtct

SEQ ID NO: 5111368 - DNA, 21 bp, Homo sapiens
aataggctgatgggcaaaaaa

SEQ ID NO: 5111369 - DNA, 18 bp, Homo sapiens
aataggcttagagaggaa

SEQ ID NO: 5111370 - DNA, 15 bp, Homo sapiens
aatagggaatatgat

SEQ ID NO: 5111371 - DNA, 18 bp, Homo sapiens
aatagggagacagggtag

SEQ ID NO: 5111372 - DNA, 23 bp, Homo sapiens
aatagggagacagggtaggaaag

SEQ ID NO: 5111373 - DNA, 15 bp, Homo sapiens
aataggggagccaag

SEQ ID NO: 5111374 - DNA, 15 bp, Homo sapiens
aataggggatattta

SEQ ID NO: 5111375 - DNA, 15 bp, Homo sapiens
aataggggattttaa

SEQ ID NO: 5111376 - DNA, 17 bp, Homo sapiens
aatagggtagaatgatt

SEQ ID NO: 5111377 - DNA, 19 bp, Homo sapiens
aatagggtagaatgattaa

SEQ ID NO: 5111378 - DNA, 16 bp, Homo sapiens
aataggtagcctgctg

SEQ ID NO: 5111379 - DNA, 19 bp, Homo sapiens
aataggtagggggctttca

SEQ ID NO: 5111380 - DNA, 14 bp, Homo sapiens
aataggtagtttgg

SEQ ID NO: 5111381 - DNA, 17 bp, Homo sapiens
aataggtagtttggata

SEQ ID NO: 5111382 - DNA, 18 bp, Homo sapiens
aataggtagtttggatat

SEQ ID NO: 5111383 - DNA, 17 bp, Homo sapiens
aataggtcatatgttgt

SEQ ID NO: 5111384 - DNA, 11 bp, Homo sapiens
aataggtcccg

SEQ ID NO: 5111385 - DNA, 19 bp, Homo sapiens
aataggtgcagtctttgag

SEQ ID NO: 5111386 - DNA, 21 bp, Homo sapiens
aataggtggaaagagaaatga

SEQ ID NO: 5111387 - DNA, 18 bp, Homo sapiens
aataggttaaactgaagc

SEQ ID NO: 5111388 - DNA, 15 bp, Homo sapiens
aataggttaatatca

SEQ ID NO: 5111389 - DNA, 23 bp, Homo sapiens
aataggttttaaacgacttttgt

SEQ ID NO: 5111390 - DNA, 17 bp, Homo sapiens
aatagtaaactaaagta

SEQ ID NO: 5111391 - DNA, 14 bp, Homo sapiens
aatagtaatggttc

SEQ ID NO: 5111392 - DNA, 15 bp, Homo sapiens
aatagtaattcccgt

SEQ ID NO: 5111393 - DNA, 11 bp, Homo sapiens
aatagtacatg

SEQ ID NO: 5111394 - DNA, 14 bp, Homo sapiens
aatagtagaaaaat

SEQ ID NO: 5111395 - DNA, 23 bp, Homo sapiens
aatagtaggctaaaaacatttta

SEQ ID NO: 5111396 - DNA, 20 bp, Homo sapiens
aatagtatacattgtcttga

SEQ ID NO: 5111397 - DNA, 15 bp, Homo sapiens
aatagtatacatttt

SEQ ID NO: 5111398 - DNA, 22 bp, Homo sapiens
aatagtatacattttataatga

SEQ ID NO: 5111399 - DNA, 20 bp, Homo sapiens
aatagtatagaaaatggaaa

SEQ ID NO: 5111400 - DNA, 15 bp, Homo sapiens
aatagtatagaagtc

SEQ ID NO: 5111401 - DNA, 21 bp, Homo sapiens
aatagtatccagcacagattt

SEQ ID NO: 5111402 - DNA, 17 bp, Homo sapiens
aatagtatcctccaggt

SEQ ID NO: 5111403 - DNA, 14 bp, Homo sapiens
aatagtatgaaaat

SEQ ID NO: 5111404 - DNA, 15 bp, Homo sapiens
aatagtatgggaaaa

SEQ ID NO: 5111405 - DNA, 13 bp, Homo sapiens
aatagtatttatg

SEQ ID NO: 5111406 - DNA, 18 bp, Homo sapiens
aatagtatttatgaaatg

SEQ ID NO: 5111407 - DNA, 21 bp, Homo sapiens
aatagtatttctcctttgcaa

SEQ ID NO: 5111408 - DNA, 22 bp, Homo sapiens
aatagtatttgagagttctaaa

SEQ ID NO: 5111409 - DNA, 16 bp, Homo sapiens
aatagtcaaattgtgt

SEQ ID NO: 5111410 - DNA, 19 bp, Homo sapiens
aatagtcaaattgtgtgaa

SEQ ID NO: 5111411 - DNA, 18 bp, Homo sapiens
aatagtcataactagatt

SEQ ID NO: 5111412 - DNA, 18 bp, Homo sapiens
aatagtcatgtttctgca

SEQ ID NO: 5111413 - DNA, 15 bp, Homo sapiens
aatagtccaatattt

SEQ ID NO: 5111414 - DNA, 17 bp, Homo sapiens
aatagtcctccaaaaca

SEQ ID NO: 5111415 - DNA, 21 bp, Homo sapiens
aatagtcgggggaaaaaatta

SEQ ID NO: 5111416 - DNA, 17 bp, Homo sapiens
aatagtcggtgaagaaa

SEQ ID NO: 5111417 - DNA, 21 bp, Homo sapiens
aatagtctagatggctcctct

SEQ ID NO: 5111418 - DNA, 16 bp, Homo sapiens
aatagtctttgccagt

SEQ ID NO: 5111419 - DNA, 13 bp, Homo sapiens
aatagtgaaaatt

SEQ ID NO: 5111420 - DNA, 14 bp, Homo sapiens
aatagtgatttcct

SEQ ID NO: 5111421 - DNA, 19 bp, Homo sapiens
aatagtgcagaatctcata

SEQ ID NO: 5111422 - DNA, 19 bp, Homo sapiens
aatagtgcctaaagtgctg

SEQ ID NO: 5111423 - DNA, 20 bp, Homo sapiens
aatagtgcctcagcgctgcc

SEQ ID NO: 5111424 - DNA, 23 bp, Homo sapiens
aatagtgcctcagcgctgcccac

SEQ ID NO: 5111425 - DNA, 16 bp, Homo sapiens
aatagtggaacatttt

SEQ ID NO: 5111426 - DNA, 19 bp, Homo sapiens
aatagtggacatggtcaca

SEQ ID NO: 5111427 - DNA, 20 bp, Homo sapiens
aatagtggacatggtcacag

SEQ ID NO: 5111428 - DNA, 18 bp, Homo sapiens
aatagtggcataccaaat

SEQ ID NO: 5111429 - DNA, 16 bp, Homo sapiens
aatagtggtgtgattt

SEQ ID NO: 5111430 - DNA, 18 bp, Homo sapiens
aatagtgtcataaagatt

SEQ ID NO: 5111431 - DNA, 14 bp, Homo sapiens
aatagtgtcctatg

SEQ ID NO: 5111432 - DNA, 22 bp, Homo sapiens
aatagtgtcctatgcaataaaa

SEQ ID NO: 5111433 - DNA, 15 bp, Homo sapiens
aatagtgtgatgttt

SEQ ID NO: 5111434 - DNA, 13 bp, Homo sapiens
aatagtgtgttct

SEQ ID NO: 5111435 - DNA, 18 bp, Homo sapiens
aatagtgttaatcaattt

SEQ ID NO: 5111436 - DNA, 23 bp, Homo sapiens
aatagtgttattgagagagatgt

SEQ ID NO: 5111437 - DNA, 15 bp, Homo sapiens
aatagtgttctctgt

SEQ ID NO: 5111438 - DNA, 23 bp, Homo sapiens
aatagtgttgatcagatcttaca

SEQ ID NO: 5111439 - DNA, 21 bp, Homo sapiens
aatagttaaaaattaaatatt

SEQ ID NO: 5111440 - DNA, 15 bp, Homo sapiens
aatagttaaaatgct

SEQ ID NO: 5111441 - DNA, 22 bp, Homo sapiens
aatagttaagacatgatttcct

SEQ ID NO: 5111442 - DNA, 23 bp, Homo sapiens
aatagttaagacatgatttcctt

SEQ ID NO: 5111443 - DNA, 19 bp, Homo sapiens
aatagttagatctaccctg

SEQ ID NO: 5111444 - DNA, 23 bp, Homo sapiens
aatagttagatctttgtaaatgc

SEQ ID NO: 5111445 - DNA, 17 bp, Homo sapiens
aatagttattatttaat

SEQ ID NO: 5111446 - DNA, 22 bp, Homo sapiens
aatagttcaaagccaagtttat

SEQ ID NO: 5111447 - DNA, 12 bp, Homo sapiens
aatagttcaagg

SEQ ID NO: 5111448 - DNA, 19 bp, Homo sapiens
aatagttcagtagaattac

SEQ ID NO: 5111449 - DNA, 23 bp, Homo sapiens
aatagttcagtagaattaccatt

SEQ ID NO: 5111450 - DNA, 11 bp, Homo sapiens
aatagttcctg

SEQ ID NO: 5111451 - DNA, 13 bp, Homo sapiens
aatagttcctgct

SEQ ID NO: 5111452 - DNA, 14 bp, Homo sapiens
aatagttctatcct

SEQ ID NO: 5111453 - DNA, 18 bp, Homo sapiens
aatagttctatttctatc

SEQ ID NO: 5111454 - DNA, 11 bp, Homo sapiens
aatagttctgt

SEQ ID NO: 5111455 - DNA, 15 bp, Homo sapiens
aatagttctgtatat

SEQ ID NO: 5111456 - DNA, 19 bp, Homo sapiens
aatagttcttagctttgaa

SEQ ID NO: 5111457 - DNA, 22 bp, Homo sapiens
aatagttgagccagcagacatt

SEQ ID NO: 5111458 - DNA, 16 bp, Homo sapiens
aatagttgtctgtgct

SEQ ID NO: 5111459 - DNA, 17 bp, Homo sapiens
aatagttgtctgtgctt

SEQ ID NO: 5111460 - DNA, 16 bp, Homo sapiens
aatagtttaaaaatat

SEQ ID NO: 5111461 - DNA, 19 bp, Homo sapiens
aatagtttaaaaatattcc

SEQ ID NO: 5111462 - DNA, 21 bp, Homo sapiens
aatagtttaaaaatattccct

SEQ ID NO: 5111463 - DNA, 17 bp, Homo sapiens
aatagtttacttcactt

SEQ ID NO: 5111464 - DNA, 15 bp, Homo sapiens
aatagtttaggaaaa

SEQ ID NO: 5111465 - DNA, 23 bp, Homo sapiens
aatagtttaggaaaatgagagga

SEQ ID NO: 5111466 - DNA, 15 bp, Homo sapiens
aatagtttatttctg

SEQ ID NO: 5111467 - DNA, 19 bp, Homo sapiens
aatagtttattttaaaaca

SEQ ID NO: 5111468 - DNA, 23 bp, Homo sapiens
aatagtttctaaaccatgaaaag

SEQ ID NO: 5111469 - DNA, 20 bp, Homo sapiens
aatagtttctgattcactat

SEQ ID NO: 5111470 - DNA, 21 bp, Homo sapiens
aatagtttctgattcactatt

SEQ ID NO: 5111471 - DNA, 22 bp, Homo sapiens
aatagtttgaacagatatgttt

SEQ ID NO: 5111472 - DNA, 19 bp, Homo sapiens
aatagtttgaattcagtaa

SEQ ID NO: 5111473 - DNA, 14 bp, Homo sapiens
aatagtttggatat

SEQ ID NO: 5111474 - DNA, 16 bp, Homo sapiens
aatagtttgtctattt

SEQ ID NO: 5111475 - DNA, 23 bp, Homo sapiens
aatagtttgtctattttaaaata

SEQ ID NO: 5111476 - DNA, 22 bp, Homo sapiens
aatagtttgttgatctgataag

SEQ ID NO: 5111477 - DNA, 15 bp, Homo sapiens
aatagtttgtttaat

SEQ ID NO: 5111478 - DNA, 16 bp, Homo sapiens
aatagttttaaatatg

SEQ ID NO: 5111479 - DNA, 19 bp, Homo sapiens
aatagttttaaatatgaac

SEQ ID NO: 5111480 - DNA, 21 bp, Homo sapiens
aatagttttattaataaacat

SEQ ID NO: 5111481 - DNA, 13 bp, Homo sapiens
aatagttttctaa

SEQ ID NO: 5111482 - DNA, 21 bp, Homo sapiens
aatagttttctaaatgtttct

SEQ ID NO: 5111483 - DNA, 11 bp, Homo sapiens
aatataaaaaa

SEQ ID NO: 5111484 - DNA, 12 bp, Homo sapiens
aatataaaaaat

SEQ ID NO: 5111485 - DNA, 15 bp, Homo sapiens
aatataaaaaatgtt

SEQ ID NO: 5111486 - DNA, 16 bp, Homo sapiens
aatataaaaaatgtta

SEQ ID NO: 5111487 - DNA, 13 bp, Homo sapiens
aatataaaaacaa

SEQ ID NO: 5111488 - DNA, 17 bp, Homo sapiens
aatataaaaacaacaaa

SEQ ID NO: 5111489 - DNA, 16 bp, Homo sapiens
aatataaaaacatttt

SEQ ID NO: 5111490 - DNA, 17 bp, Homo sapiens
aatataaaaacattttt

SEQ ID NO: 5111491 - DNA, 16 bp, Homo sapiens
aatataaaaatgtgaa

SEQ ID NO: 5111492 - DNA, 17 bp, Homo sapiens
aatataaaaatgtgaat

SEQ ID NO: 5111493 - DNA, 17 bp, Homo sapiens
aatataaaactgaaata

SEQ ID NO: 5111494 - DNA, 18 bp, Homo sapiens
aatataaaagatatatat

SEQ ID NO: 5111495 - DNA, 19 bp, Homo sapiens
aatataaaagatatatata

SEQ ID NO: 5111496 - DNA, 22 bp, Homo sapiens
aatataaaaggcaaatgtgtac

SEQ ID NO: 5111497 - DNA, 15 bp, Homo sapiens
aatataaaatacata

SEQ ID NO: 5111498 - DNA, 14 bp, Homo sapiens
aatataaaatgttt

SEQ ID NO: 5111499 - DNA, 15 bp, Homo sapiens
aatataaaatttctg

SEQ ID NO: 5111500 - DNA, 21 bp, Homo sapiens
aatataaacaaagattcatga

SEQ ID NO: 5111501 - DNA, 17 bp, Homo sapiens
aatataaacaatgttca

SEQ ID NO: 5111502 - DNA, 14 bp, Homo sapiens
aatataaacactat

SEQ ID NO: 5111503 - DNA, 13 bp, Homo sapiens
aatataaacagca

SEQ ID NO: 5111504 - DNA, 12 bp, Homo sapiens
aatataaacatc

SEQ ID NO: 5111505 - DNA, 19 bp, Homo sapiens
aatataaactgtgagataa

SEQ ID NO: 5111506 - DNA, 23 bp, Homo sapiens
aatataaagacgttttataagca

SEQ ID NO: 5111507 - DNA, 17 bp, Homo sapiens
aatataaagcatctaaa

SEQ ID NO: 5111508 - DNA, 21 bp, Homo sapiens
aatataaagcatctaaacttt

SEQ ID NO: 5111509 - DNA, 13 bp, Homo sapiens
aatataaagctta

SEQ ID NO: 5111510 - DNA, 20 bp, Homo sapiens
aatataaagttttatatatt

SEQ ID NO: 5111511 - DNA, 17 bp, Homo sapiens
aatataaatagctaatg

SEQ ID NO: 5111512 - DNA, 16 bp, Homo sapiens
aatataaatagctgaa

SEQ ID NO: 5111513 - DNA, 14 bp, Homo sapiens
aatataaatatcac

SEQ ID NO: 5111514 - DNA, 20 bp, Homo sapiens
aatataaatatccccaggga

SEQ ID NO: 5111515 - DNA, 14 bp, Homo sapiens
aataaagtatttaa

SEQ ID NO: 5111516 - DNA, 16 bp, Homo sapiens
aataaagtatttaatt

SEQ ID NO: 5111517 - DNA, 17 bp, Homo sapiens
aataaagtcagatggaa

SEQ ID NO: 5111518 - DNA, 20 bp, Homo sapiens
aataaagtcattattaggaa

SEQ ID NO: 5111519 - DNA, 11 bp, Homo sapiens
aataaagtctc

SEQ ID NO: 5111520 - DNA, 16 bp, Homo sapiens
aataaagtctgagtgg

SEQ ID NO: 5111521 - DNA, 13 bp, Homo sapiens
aataaagtgaata

SEQ ID NO: 5111522 - DNA, 13 bp, Homo sapiens
aataaagtggaaa

SEQ ID NO: 5111523 - DNA, 23 bp, Homo sapiens
aataaagtggcatttctttatga

SEQ ID NO: 5111524 - DNA, 14 bp, Homo sapiens
aataaagtgtgtgt

SEQ ID NO: 5111525 - DNA, 16 bp, Homo sapiens
aataaagtgttttcag

SEQ ID NO: 5111526 - DNA, 17 bp, Homo sapiens
aataaagtgttttcaga

SEQ ID NO: 5111527 - DNA, 18 bp, Homo sapiens
aataaagtgttttcagag

SEQ ID NO: 5111528 - DNA, 15 bp, Homo sapiens
aataaagttaaaagt

SEQ ID NO: 5111529 - DNA, 19 bp, Homo sapiens
aataaagttaaactgatta

SEQ ID NO: 5111530 - DNA, 21 bp, Homo sapiens
aataaagttaaattgcacgtg

SEQ ID NO: 5111531 - DNA, 16 bp, Homo sapiens
aataaagttagtgtgt

SEQ ID NO: 5111532 - DNA, 21 bp, Homo sapiens
aataaagttgagcttagtttt

SEQ ID NO: 5111533 - DNA, 12 bp, Homo sapiens
aataaagttgta

SEQ ID NO: 5111534 - DNA, 15 bp, Homo sapiens
aataaagttgttgca

SEQ ID NO: 5111535 - DNA, 17 bp, Homo sapiens
aataaagttgttgcatt

SEQ ID NO: 5111536 - DNA, 18 bp, Homo sapiens
aataaagttgttgcattc

SEQ ID NO: 5111537 - DNA, 15 bp, Homo sapiens
aataaagtttgatct

SEQ ID NO: 5111538 - DNA, 19 bp, Homo sapiens
aataaagtttgatcttcct

SEQ ID NO: 5111539 - DNA, 19 bp, Homo sapiens
aataaagtttgcttagaaa

SEQ ID NO: 5111540 - DNA, 16 bp, Homo sapiens
aataaataaaaataat

SEQ ID NO: 5111541 - DNA, 13 bp, Homo sapiens
aataaataaactt

SEQ ID NO: 5111542 - DNA, 14 bp, Homo sapiens
aataaataaagaag

SEQ ID NO: 5111543 - DNA, 14 bp, Homo sapiens
aataaataaatgca

SEQ ID NO: 5111544 - DNA, 14 bp, Homo sapiens
aataaataacactt

SEQ ID NO: 5111545 - DNA, 13 bp, Homo sapiens
aataaataacagt

SEQ ID NO: 5111546 - DNA, 14 bp, Homo sapiens
aataaataagtaaa

SEQ ID NO: 5111547 - DNA, 13 bp, Homo sapiens
aataaataatatt

SEQ ID NO: 5111548 - DNA, 12 bp, Homo sapiens
aataaataattt

SEQ ID NO: 5111549 - DNA, 21 bp, Homo sapiens
aataaatacaagtttgaacag

SEQ ID NO: 5111550 - DNA, 22 bp, Homo sapiens
aataaatacacagcatgcagac

SEQ ID NO: 5111551 - DNA, 18 bp, Homo sapiens
aataaataccaaagataa

SEQ ID NO: 5111552 - DNA, 21 bp, Homo sapiens
aataaataccaattatggaaa

SEQ ID NO: 5111553 - DNA, 20 bp, Homo sapiens
aataaatacctcttagctga

SEQ ID NO: 5111554 - DNA, 23 bp, Homo sapiens
aataaatactgcagcttgagttt

SEQ ID NO: 5111555 - DNA, 16 bp, Homo sapiens
aataaatagacacttg

SEQ ID NO: 5111556 - DNA, 21 bp, Homo sapiens
aataaatagagcaattacaag

SEQ ID NO: 5111557 - DNA, 21 bp, Homo sapiens
aataaatagatttgattattt

SEQ ID NO: 5111558 - DNA, 21 bp, Homo sapiens
aataaatagctagactggtga

SEQ ID NO: 5111559 - DNA, 10 bp, Homo sapiens
aataaatagt

SEQ ID NO: 5111560 - DNA, 11 bp, Homo sapiens
aataaatataa

SEQ ID NO: 5111561 - DNA, 16 bp, Homo sapiens
aataaatataatttat

SEQ ID NO: 5111562 - DNA, 11 bp, Homo sapiens
aataaatatac

SEQ ID NO: 5111563 - DNA, 21 bp, Homo sapiens
aataaatatactaataaaaag

SEQ ID NO: 5111564 - DNA, 20 bp, Homo sapiens
aataaatatacttctgctgt

SEQ ID NO: 5111565 - DNA, 21 bp, Homo sapiens
aataaatatacttctgctgtg

SEQ ID NO: 5111566 - DNA, 11 bp, Homo sapiens
aataaatatat

SEQ ID NO: 5111567 - DNA, 22 bp, Homo sapiens
aataaatatcacagtattatct

SEQ ID NO: 5111568 - DNA, 13 bp, Homo sapiens
aataaatatgaaa

SEQ ID NO: 5111569 - DNA, 16 bp, Homo sapiens
aataaatatgcctctc

SEQ ID NO: 5111570 - DNA, 19 bp, Homo sapiens
aataaatatgcctctcctt

SEQ ID NO: 5111571 - DNA, 12 bp, Homo sapiens
aataaatatgta

SEQ ID NO: 5111572 - DNA, 16 bp, Homo sapiens
aataaatattctgcat

SEQ ID NO: 5111573 - DNA, 15 bp, Homo sapiens
aataaatattgactt

SEQ ID NO: 5111574 - DNA, 14 bp, Homo sapiens
aataaatattgtat

SEQ ID NO: 5111575 - DNA, 16 bp, Homo sapiens
aataaatattgtcttt

SEQ ID NO: 5111576 - DNA, 21 bp, Homo sapiens
aataaatattgtctttttgta

SEQ ID NO: 5111577 - DNA, 15 bp, Homo sapiens
aataaatattttaca

SEQ ID NO: 5111578 - DNA, 16 bp, Homo sapiens
aataaatattttagga

SEQ ID NO: 5111579 - DNA, 13 bp, Homo sapiens
aataaatcaaaat

SEQ ID NO: 5111580 - DNA, 18 bp, Homo sapiens
aataaatcagtgtttaca

SEQ ID NO: 5111581 - DNA, 21 bp, Homo sapiens
aataaatcattaatactcttc

SEQ ID NO: 5111582 - DNA, 16 bp, Homo sapiens
aataaatccaaaaaaa

SEQ ID NO: 5111583 - DNA, 15 bp, Homo sapiens
aataaatccaagact

SEQ ID NO: 5111584 - DNA, 22 bp, Homo sapiens
aataaatcctgtcttatttgtt

SEQ ID NO: 5111585 - DNA, 20 bp, Homo sapiens
aataaatctaaatgattatc

SEQ ID NO: 5111586 - DNA, 22 bp, Homo sapiens
aataaatctaaatgattatctt

SEQ ID NO: 5111587 - DNA, 13 bp, Homo sapiens
aataaatctatat

SEQ ID NO: 5111588 - DNA, 19 bp, Homo sapiens
aataaatctcttctttgct

SEQ ID NO: 5111589 - DNA, 21 bp, Homo sapiens
aataaatctgagcctaaatct

SEQ ID NO: 5111590 - DNA, 20 bp, Homo sapiens
aataaatctggtagaaaaat

SEQ ID NO: 5111591 - DNA, 16 bp, Homo sapiens
aataaatctttggaaa

SEQ ID NO: 5111592 - DNA, 11 bp, Homo sapiens
aataaatgaaa

SEQ ID NO: 5111593 - DNA, 22 bp, Homo sapiens
aataaatgaaacttggccagtt

SEQ ID NO: 5111594 - DNA, 14 bp, Homo sapiens
aataaatgaagaaa

SEQ ID NO: 5111595 - DNA, 17 bp, Homo sapiens
aataaatgaatgaataa

SEQ ID NO: 5111596 - DNA, 23 bp, Homo sapiens
aataaatgaatgtcacttctgga

SEQ ID NO: 5111597 - DNA, 11 bp, Homo sapiens
aataaatgacc

SEQ ID NO: 5111598 - DNA, 16 bp, Homo sapiens
aataaatgaccagttt

SEQ ID NO: 5111599 - DNA, 13 bp, Homo sapiens
aataaatgagctg

SEQ ID NO: 5111600 - DNA, 14 bp, Homo sapiens
aataaatgagctgt

SEQ ID NO: 5111601 - DNA, 17 bp, Homo sapiens
aataaatgcaatatgta

SEQ ID NO: 5111602 - DNA, 18 bp, Homo sapiens
aataaatgcatagagcaa

SEQ ID NO: 5111603 - DNA, 16 bp, Homo sapiens
aataaatgccctcttc

SEQ ID NO: 5111604 - DNA, 13 bp, Homo sapiens
aataaatgccttt

SEQ ID NO: 5111605 - DNA, 20 bp, Homo sapiens
aataaatgcctttatatttc

SEQ ID NO: 5111606 - DNA, 17 bp, Homo sapiens
aataaatgctctatttt

SEQ ID NO: 5111607 - DNA, 15 bp, Homo sapiens
aataaatgctgcttt

SEQ ID NO: 5111608 - DNA, 17 bp, Homo sapiens
aataaatgctgctttgg

SEQ ID NO: 5111609 - DNA, 14 bp, Homo sapiens
aataaatggccagt

SEQ ID NO: 5111610 - DNA, 21 bp, Homo sapiens
aataaatggccagtgctgctt

SEQ ID NO: 5111611 - DNA, 22 bp, Homo sapiens
aataaatggccagtgctgcttc

SEQ ID NO: 5111612 - DNA, 23 bp, Homo sapiens
aataaatggccagtgctgcttct

SEQ ID NO: 5111613 - DNA, 22 bp, Homo sapiens
aataaatggcccggacatgtct

SEQ ID NO: 5111614 - DNA, 17 bp, Homo sapiens
aataaatggtatagcaa

SEQ ID NO: 5111615 - DNA, 16 bp, Homo sapiens
aataaatgtcactgcc

SEQ ID NO: 5111616 - DNA, 19 bp, Homo sapiens
aataaatgtcactttttga

SEQ ID NO: 5111617 - DNA, 13 bp, Homo sapiens
aataaatgtcatt

SEQ ID NO: 5111618 - DNA, 14 bp, Homo sapiens
aataaatgtcttgc

SEQ ID NO: 5111619 - DNA, 23 bp, Homo sapiens
aataaatgtcttttttttaatgt

SEQ ID NO: 5111620 - DNA, 20 bp, Homo sapiens
aataaatgtgaaattctgtc

SEQ ID NO: 5111621 - DNA, 12 bp, Homo sapiens
aataaatgtgcc

SEQ ID NO: 5111622 - DNA, 21 bp, Homo sapiens
aataaatgtgccttcattttt

SEQ ID NO: 5111623 - DNA, 15 bp, Homo sapiens
aataaatgtgtaaat

SEQ ID NO: 5111624 - DNA, 18 bp, Homo sapiens
aataaatgtgtgttgact

SEQ ID NO: 5111625 - DNA, 11 bp, Homo sapiens
aataaatgttc

SEQ ID NO: 5111626 - DNA, 12 bp, Homo sapiens
aataaatgttca

SEQ ID NO: 5111627 - DNA, 21 bp, Homo sapiens
aataaatgttctcgttttgaa

SEQ ID NO: 5111628 - DNA, 14 bp, Homo sapiens
aataaatgtttcaa

SEQ ID NO: 5111629 - DNA, 13 bp, Homo sapiens
aataaatgtttcc

SEQ ID NO: 5111630 - DNA, 15 bp, Homo sapiens
aataaatgtttgtta

SEQ ID NO: 5111631 - DNA, 14 bp, Homo sapiens
aataaatgttttac

SEQ ID NO: 5111632 - DNA, 22 bp, Homo sapiens
aataaatgttttacaactcctg

SEQ ID NO: 5111633 - DNA, 13 bp, Homo sapiens
aataaatgttttg

SEQ ID NO: 5111634 - DNA, 21 bp, Homo sapiens
aataaattaaataaaataacc

SEQ ID NO: 5111635 - DNA, 18 bp, Homo sapiens
aataaattaatattgtat

SEQ ID NO: 5111636 - DNA, 15 bp, Homo sapiens
aataaattaattttt

SEQ ID NO: 5111637 - DNA, 16 bp, Homo sapiens
aataaattattagaga

SEQ ID NO: 5111638 - DNA, 23 bp, Homo sapiens
aataaattcaaaacctgcagtta

SEQ ID NO: 5111639 - DNA, 19 bp, Homo sapiens
aataaattcaaaccattta

SEQ ID NO: 5111640 - DNA, 14 bp, Homo sapiens
aataaattcagata

SEQ ID NO: 5111641 - DNA, 23 bp, Homo sapiens
aataaattctacctccttgtgtt

SEQ ID NO: 5111642 - DNA, 13 bp, Homo sapiens
aataaattctctc

SEQ ID NO: 5111643 - DNA, 20 bp, Homo sapiens
aataaattctgattcttcta

SEQ ID NO: 5111644 - DNA, 23 bp, Homo sapiens
aataaattgaataggtagtatca

SEQ ID NO: 5111645 - DNA, 14 bp, Homo sapiens
aataaattgatcct

SEQ ID NO: 5111646 - DNA, 14 bp, Homo sapiens
aataaattgatttg

SEQ ID NO: 5111647 - DNA, 21 bp, Homo sapiens
aataaattgcatgctgcttta

SEQ ID NO: 5111648 - DNA, 20 bp, Homo sapiens
aataaattgctaatgttgct

SEQ ID NO: 5111649 - DNA, 16 bp, Homo sapiens
aataaattgctccttg

SEQ ID NO: 5111650 - DNA, 21 bp, Homo sapiens
aataaattgcttactgatatt

SEQ ID NO: 5111651 - DNA, 17 bp, Homo sapiens
aataaattggaaatgtg

SEQ ID NO: 5111652 - DNA, 14 bp, Homo sapiens
aataaattggagtt

SEQ ID NO: 5111653 - DNA, 20 bp, Homo sapiens
aataaattggagttttaaaa

SEQ ID NO: 5111654 - DNA, 18 bp, Homo sapiens
aataaattggtgataagt

SEQ ID NO: 5111655 - DNA, 19 bp, Homo sapiens
aataaattggtgataagtg

SEQ ID NO: 5111656 - DNA, 22 bp, Homo sapiens
aataaattggtgataagtggaa

SEQ ID NO: 5111657 - DNA, 20 bp, Homo sapiens
aataaattgtaattgtaaag

SEQ ID NO: 5111658 - DNA, 18 bp, Homo sapiens
aataaattgtatattcac

SEQ ID NO: 5111659 - DNA, 19 bp, Homo sapiens
aataaatttaaacttacaa

SEQ ID NO: 5111660 - DNA, 17 bp, Homo sapiens
aataaatttactgaaat

SEQ ID NO: 5111661 - DNA, 19 bp, Homo sapiens
aataaatttataacaattg

SEQ ID NO: 5111662 - DNA, 18 bp, Homo sapiens
aataaatttatatgaaaa

SEQ ID NO: 5111663 - DNA, 13 bp, Homo sapiens
aataaatttctaa

SEQ ID NO: 5111664 - DNA, 21 bp, Homo sapiens
aataaatttctgggatattta

SEQ ID NO: 5111665 - DNA, 13 bp, Homo sapiens
aataaatttgctt

SEQ ID NO: 5111666 - DNA, 16 bp, Homo sapiens
aataaatttgtaactt

SEQ ID NO: 5111667 - DNA, 12 bp, Homo sapiens
aataaattttat

SEQ ID NO: 5111668 - DNA, 14 bp, Homo sapiens
aataaattttctaa

SEQ ID NO: 5111669 - DNA, 12 bp, Homo sapiens
aataaattttga

SEQ ID NO: 5111670 - DNA, 18 bp, Homo sapiens
aataaattttgaaaagta

SEQ ID NO: 5111671 - DNA, 20 bp, Homo sapiens
aataaattttgaaaagtaat

SEQ ID NO: 5111672 - DNA, 22 bp, Homo sapiens
aataaattttgaaaagtaatat

SEQ ID NO: 5111673 - DNA, 22 bp, Homo sapiens
aataaattttttataaaagtgt

SEQ ID NO: 5111674 - DNA, 18 bp, Homo sapiens
aataacaaatgccaaatt

SEQ ID NO: 5111675 - DNA, 22 bp, Homo sapiens
aataacaaatgccaaattaaaa

SEQ ID NO: 5111676 - DNA, 15 bp, Homo sapiens
aataacaagcatgca

SEQ ID NO: 5111677 - DNA, 13 bp, Homo sapiens
aataacaatatat

SEQ ID NO: 5111678 - DNA, 17 bp, Homo sapiens
aataacaatatatagaa

SEQ ID NO: 5111679 - DNA, 19 bp, Homo sapiens
aataacaatgtgctctcgg

SEQ ID NO: 5111680 - DNA, 15 bp, Homo sapiens
aataacacacagcta

SEQ ID NO: 5111681 - DNA, 14 bp, Homo sapiens
aataacactatatt

SEQ ID NO: 5111682 - DNA, 16 bp, Homo sapiens
aataacactatattta

SEQ ID NO: 5111683 - DNA, 22 bp, Homo sapiens
aataacactatatttatttttg

SEQ ID NO: 5111684 - DNA, 19 bp, Homo sapiens
aataacactgcagccctct

SEQ ID NO: 5111685 - DNA, 21 bp, Homo sapiens
aataacactgcagccctctcc

SEQ ID NO: 5111686 - DNA, 13 bp, Homo sapiens
aataacacttgtc

SEQ ID NO: 5111687 - DNA, 14 bp, Homo sapiens
aataacagaaatac

SEQ ID NO: 5111688 - DNA, 22 bp, Homo sapiens
aataacagatggtgctgctaat

SEQ ID NO: 5111689 - DNA, 20 bp, Homo sapiens
aataacagccgctccagagt

SEQ ID NO: 5111690 - DNA, 12 bp, Homo sapiens
aataacagctgc

SEQ ID NO: 5111691 - DNA, 16 bp, Homo sapiens
aataacagctttctta

SEQ ID NO: 5111692 - DNA, 21 bp, Homo sapiens
aataacaggcatttgttcact

SEQ ID NO: 5111693 - DNA, 17 bp, Homo sapiens
aataacataacaaataa

SEQ ID NO: 5111694 - DNA, 16 bp, Homo sapiens
aataacatacaatgac

SEQ ID NO: 5111695 - DNA, 18 bp, Homo sapiens
aatataaatcacagattt

SEQ ID NO: 5111696 - DNA, 11 bp, Homo sapiens
aatataaatga

SEQ ID NO: 5111697 - DNA, 15 bp, Homo sapiens
aatataaatgaatga

SEQ ID NO: 5111698 - DNA, 11 bp, Homo sapiens
aatataaatgc

SEQ ID NO: 5111699 - DNA, 12 bp, Homo sapiens
aatataaatgca

SEQ ID NO: 5111700 - DNA, 15 bp, Homo sapiens
aatataaatgcaaat

SEQ ID NO: 5111701 - DNA, 16 bp, Homo sapiens
aatataaatgcaaata

SEQ ID NO: 5111702 - DNA, 17 bp, Homo sapiens
aatataaatgcaaataa

SEQ ID NO: 5111703 - DNA, 19 bp, Homo sapiens
aatataaatgcaaataaca

SEQ ID NO: 5111704 - DNA, 20 bp, Homo sapiens
aatataaatgcaaataacaa

SEQ ID NO: 5111705 - DNA, 14 bp, Homo sapiens
aatataaatgcatg

SEQ ID NO: 5111706 - DNA, 23 bp, Homo sapiens
aatataaatgtactacatttgca

SEQ ID NO: 5111707 - DNA, 16 bp, Homo sapiens
aatataaatgtgtgta

SEQ ID NO: 5111708 - DNA, 13 bp, Homo sapiens
aatataaattatc

SEQ ID NO: 5111709 - DNA, 16 bp, Homo sapiens
aatataaattatctga

SEQ ID NO: 5111710 - DNA, 17 bp, Homo sapiens
aatataaattgtacatt

SEQ ID NO: 5111711 - DNA, 18 bp, Homo sapiens
aatataaattttcagaat

SEQ ID NO: 5111712 - DNA, 14 bp, Homo sapiens
aatataacacattt

SEQ ID NO: 5111713 - DNA, 13 bp, Homo sapiens
aatataacatgaa

SEQ ID NO: 5111714 - DNA, 16 bp, Homo sapiens
aatataacatgaaatg

SEQ ID NO: 5111715 - DNA, 19 bp, Homo sapiens
aatataacatgaaatgata

SEQ ID NO: 5111716 - DNA, 20 bp, Homo sapiens
aatataaccattacatgttt

SEQ ID NO: 5111717 - DNA, 13 bp, Homo sapiens
aatataactgcct

SEQ ID NO: 5111718 - DNA, 21 bp, Homo sapiens
aatataacttaaaaatgtaaa

SEQ ID NO: 5111719 - DNA, 12 bp, Homo sapiens
aatataagaaaa

SEQ ID NO: 5111720 - DNA, 18 bp, Homo sapiens
aatataagaagcaatctt

SEQ ID NO: 5111721 - DNA, 16 bp, Homo sapiens
aatataagacatttgt

SEQ ID NO: 5111722 - DNA, 14 bp, Homo sapiens
aatataagcttaaa

SEQ ID NO: 5111723 - DNA, 14 bp, Homo sapiens
aatataagtaaagt

SEQ ID NO: 5111724 - DNA, 22 bp, Homo sapiens
aatataagtctatactaatgct

SEQ ID NO: 5111725 - DNA, 16 bp, Homo sapiens
aatataagtttctttg

SEQ ID NO: 5111726 - DNA, 13 bp, Homo sapiens
aatataataaaag

SEQ ID NO: 5111727 - DNA, 22 bp, Homo sapiens
aatataataattagccaggcgt

SEQ ID NO: 5111728 - DNA, 14 bp, Homo sapiens
aatataatattata

SEQ ID NO: 5111729 - DNA, 20 bp, Homo sapiens
aatataatattatactgcta

SEQ ID NO: 5111730 - DNA, 14 bp, Homo sapiens
aatataatattgtc

SEQ ID NO: 5111731 - DNA, 19 bp, Homo sapiens
aatataatggaagagaaat

SEQ ID NO: 5111732 - DNA, 18 bp, Homo sapiens
aatataatgggctgcaaa

SEQ ID NO: 5111733 - DNA, 22 bp, Homo sapiens
aatataatgggctgcaaaatga

SEQ ID NO: 5111734 - DNA, 13 bp, Homo sapiens
aatataatgtatt

SEQ ID NO: 5111735 - DNA, 14 bp, Homo sapiens
aatataatgtattt

SEQ ID NO: 5111736 - DNA, 12 bp, Homo sapiens
aatataatgtgc

SEQ ID NO: 5111737 - DNA, 20 bp, Homo sapiens
aatataattgtgtaaacaaa

SEQ ID NO: 5111738 - DNA, 13 bp, Homo sapiens
aatataatttaac

SEQ ID NO: 5111739 - DNA, 12 bp, Homo sapiens
aatataatttat

SEQ ID NO: 5111740 - DNA, 17 bp, Homo sapiens
aatataatttataagca

SEQ ID NO: 5111741 - DNA, 21 bp, Homo sapiens
aatataatttataagcattgc

SEQ ID NO: 5111742 - DNA, 13 bp, Homo sapiens
aatatacaacttt

SEQ ID NO: 5111743 - DNA, 21 bp, Homo sapiens
aatatacaactttggaatttg

SEQ ID NO: 5111744 - DNA, 16 bp, Homo sapiens
aatatacaagtaaatt

SEQ ID NO: 5111745 - DNA, 13 bp, Homo sapiens
aatatacacacag

SEQ ID NO: 5111746 - DNA, 14 bp, Homo sapiens
aatatacacatttt

SEQ ID NO: 5111747 - DNA, 20 bp, Homo sapiens
aatatacagcatgagattgt

SEQ ID NO: 5111748 - DNA, 17 bp, Homo sapiens
aatatacagtgtgtagt

SEQ ID NO: 5111749 - DNA, 19 bp, Homo sapiens
aatatacatttgttggtaa

SEQ ID NO: 5111750 - DNA, 15 bp, Homo sapiens
aatatacattttcta

SEQ ID NO: 5111751 - DNA, 19 bp, Homo sapiens
aatatacattttctaaata

SEQ ID NO: 5111752 - DNA, 20 bp, Homo sapiens
aatatacattttctaaataa

SEQ ID NO: 5111753 - DNA, 15 bp, Homo sapiens
aatataccccaaatt

SEQ ID NO: 5111754 - DNA, 21 bp, Homo sapiens
aatataccttttgcatttctt

SEQ ID NO: 5111755 - DNA, 22 bp, Homo sapiens
aatataccttttttgttccact

SEQ ID NO: 5111756 - DNA, 10 bp, Homo sapiens
aatatactaa

SEQ ID NO: 5111757 - DNA, 17 bp, Homo sapiens
aatatactaaccatttc

SEQ ID NO: 5111758 - DNA, 20 bp, Homo sapiens
aatatactaataaaaaggtt

SEQ ID NO: 5111759 - DNA, 20 bp, Homo sapiens
aatatactcattagaattac

SEQ ID NO: 5111760 - DNA, 16 bp, Homo sapiens
aatatactcatttgga

SEQ ID NO: 5111761 - DNA, 17 bp, Homo sapiens
aatatactcatttggat

SEQ ID NO: 5111762 - DNA, 20 bp, Homo sapiens
aatatactcatttggatata

SEQ ID NO: 5111763 - DNA, 22 bp, Homo sapiens
aatatactccttaaaaatgtat

SEQ ID NO: 5111764 - DNA, 23 bp, Homo sapiens
aatatactgattttgaaaagtat

SEQ ID NO: 5111765 - DNA, 14 bp, Homo sapiens
aatatactgcatat

SEQ ID NO: 5111766 - DNA, 14 bp, Homo sapiens
aatatactgtaaag

SEQ ID NO: 5111767 - DNA, 16 bp, Homo sapiens
aatatactgtaaagaa

SEQ ID NO: 5111768 - DNA, 18 bp, Homo sapiens
aatatactgtaaagaaag

SEQ ID NO: 5111769 - DNA, 21 bp, Homo sapiens
aatatactgtaaagaaagaga

SEQ ID NO: 5111770 - DNA, 22 bp, Homo sapiens
aatatactgtaaagaaagagag

SEQ ID NO: 5111771 - DNA, 23 bp, Homo sapiens
aatatacttcactggtgtacatc

SEQ ID NO: 5111772 - DNA, 17 bp, Homo sapiens
aatatacttgtggacta

SEQ ID NO: 5111773 - DNA, 23 bp, Homo sapiens
aatatacttgtggactaaaagat

SEQ ID NO: 5111774 - DNA, 18 bp, Homo sapiens
aatatacttttacaagta

SEQ ID NO: 5111775 - DNA, 21 bp, Homo sapiens
aatatacttttacattaaaga

SEQ ID NO: 5111776 - DNA, 15 bp, Homo sapiens
aatatagaaaactaa

SEQ ID NO: 5111777 - DNA, 16 bp, Homo sapiens
aatatagaaagaaaat

SEQ ID NO: 5111778 - DNA, 22 bp, Homo sapiens
aatatagaaagttgatattcaa

SEQ ID NO: 5111779 - DNA, 21 bp, Homo sapiens
aatatagagacaggacagaat

SEQ ID NO: 5111780 - DNA, 23 bp, Homo sapiens
aatatagagacaggacagaatgt

SEQ ID NO: 5111781 - DNA, 18 bp, Homo sapiens
aatatagatgctggccag

SEQ ID NO: 5111782 - DNA, 20 bp, Homo sapiens
aatatagatgtaatttttca

SEQ ID NO: 5111783 - DNA, 13 bp, Homo sapiens
aatatagatgtta

SEQ ID NO: 5111784 - DNA, 17 bp, Homo sapiens
aatatagattaaatcat

SEQ ID NO: 5111785 - DNA, 19 bp, Homo sapiens
aatatagattaaatcatac

SEQ ID NO: 5111786 - DNA, 15 bp, Homo sapiens
aatatagattagaaa

SEQ ID NO: 5111787 - DNA, 15 bp, Homo sapiens
aatatagcatctttc

SEQ ID NO: 5111788 - DNA, 13 bp, Homo sapiens
aatatagcctgcc

SEQ ID NO: 5111789 - DNA, 23 bp, Homo sapiens
aatatagcctgcctcagtggcag

SEQ ID NO: 5111790 - DNA, 16 bp, Homo sapiens
aatatagctatcattt

SEQ ID NO: 5111791 - DNA, 18 bp, Homo sapiens
aatatagctgtacaaata

SEQ ID NO: 5111792 - DNA, 12 bp, Homo sapiens
aatatagcttaa

SEQ ID NO: 5111793 - DNA, 14 bp, Homo sapiens
aatatagcttaaaa

SEQ ID NO: 5111794 - DNA, 19 bp, Homo sapiens
aatatagctttcataacat

SEQ ID NO: 5111795 - DNA, 18 bp, Homo sapiens
aatataggaacttaaata

SEQ ID NO: 5111796 - DNA, 21 bp, Homo sapiens
aatataggaacttaaataatg

SEQ ID NO: 5111797 - DNA, 13 bp, Homo sapiens
aatataggtctct

SEQ ID NO: 5111798 - DNA, 23 bp, Homo sapiens
aatatagtaggggttgaagaaaa

SEQ ID NO: 5111799 - DNA, 21 bp, Homo sapiens
aatatagttaattgtggcttt

SEQ ID NO: 5111800 - DNA, 15 bp, Homo sapiens
aatatagttcctaag

SEQ ID NO: 5111801 - DNA, 21 bp, Homo sapiens
aatatagttcctaagaagctt

SEQ ID NO: 5111802 - DNA, 13 bp, Homo sapiens
aatatagttctgt

SEQ ID NO: 5111803 - DNA, 14 bp, Homo sapiens
aatatagttgaaag

SEQ ID NO: 5111804 - DNA, 15 bp, Homo sapiens
aatatagttgaaagt

SEQ ID NO: 5111805 - DNA, 22 bp, Homo sapiens
aatatagttgaaagtaaaaaaa

SEQ ID NO: 5111806 - DNA, 23 bp, Homo sapiens
aatatagttgaacaagatttccc

SEQ ID NO: 5111807 - DNA, 18 bp, Homo sapiens
aatatagttgtctttctt

SEQ ID NO: 5111808 - DNA, 18 bp, Homo sapiens
aatatataaaaagaaaag

SEQ ID NO: 5111809 - DNA, 14 bp, Homo sapiens
aatatataaaaata

SEQ ID NO: 5111810 - DNA, 17 bp, Homo sapiens
aatatataaaaatatat

SEQ ID NO: 5111811 - DNA, 20 bp, Homo sapiens
aatatataaaaatatatata

SEQ ID NO: 5111812 - DNA, 11 bp, Homo sapiens
aatatataaac

SEQ ID NO: 5111813 - DNA, 14 bp, Homo sapiens
aatatataaacaaa

SEQ ID NO: 5111814 - DNA, 14 bp, Homo sapiens
aatatataaacact

SEQ ID NO: 5111815 - DNA, 17 bp, Homo sapiens
aatatataaatatatat

SEQ ID NO: 5111816 - DNA, 15 bp, Homo sapiens
aatatataatatact

SEQ ID NO: 5111817 - DNA, 17 bp, Homo sapiens
aatatataatgcaacaa

SEQ ID NO: 5111818 - DNA, 21 bp, Homo sapiens
aatatataatggtttactgct

SEQ ID NO: 5111819 - DNA, 15 bp, Homo sapiens
aatatataatttaat

SEQ ID NO: 5111820 - DNA, 16 bp, Homo sapiens
aatatataatttaatg

SEQ ID NO: 5111821 - DNA, 22 bp, Homo sapiens
aatatataccagccttataagg

SEQ ID NO: 5111822 - DNA, 18 bp, Homo sapiens
aatatatacgaacaaaac

SEQ ID NO: 5111823 - DNA, 13 bp, Homo sapiens
aatatatagaatt

SEQ ID NO: 5111824 - DNA, 21 bp, Homo sapiens
aatatatagtgaaaaatgtca

SEQ ID NO: 5111825 - DNA, 12 bp, Homo sapiens
aatatatataaa

SEQ ID NO: 5111826 - DNA, 13 bp, Homo sapiens
aatatatataaac

SEQ ID NO: 5111827 - DNA, 14 bp, Homo sapiens
aatatatataaacc

SEQ ID NO: 5111828 - DNA, 15 bp, Homo sapiens
aatatatataaacct

SEQ ID NO: 5111829 - DNA, 19 bp, Homo sapiens
aatatatataaagaatata

SEQ ID NO: 5111830 - DNA, 19 bp, Homo sapiens
aatatatataaatatatat

SEQ ID NO: 5111831 - DNA, 13 bp, Homo sapiens
aatatatataata

SEQ ID NO: 5111832 - DNA, 12 bp, Homo sapiens
aatatatataca

SEQ ID NO: 5111833 - DNA, 16 bp, Homo sapiens
aatatatatacatata

SEQ ID NO: 5111834 - DNA, 19 bp, Homo sapiens
aatatatatacatatgtag

SEQ ID NO: 5111835 - DNA, 22 bp, Homo sapiens
aatatatatagtgctatatata

SEQ ID NO: 5111836 - DNA, 14 bp, Homo sapiens
aatatatatagtta

SEQ ID NO: 5111837 - DNA, 11 bp, Homo sapiens
aatatatatat

SEQ ID NO: 5111838 - DNA, 16 bp, Homo sapiens
aatatatatatatata

SEQ ID NO: 5111839 - DNA, 21 bp, Homo sapiens
aatatatatatatataaaata

SEQ ID NO: 5111840 - DNA, 19 bp, Homo sapiens
aatatatatatatatcagt

SEQ ID NO: 5111841 - DNA, 23 bp, Homo sapiens
aatatatatatatatcagtttga

SEQ ID NO: 5111842 - DNA, 16 bp, Homo sapiens
aatatatatatatatt

SEQ ID NO: 5111843 - DNA, 17 bp, Homo sapiens
aatatatatatatattt

SEQ ID NO: 5111844 - DNA, 16 bp, Homo sapiens
aatatatatatgtata

SEQ ID NO: 5111845 - DNA, 20 bp, Homo sapiens
aatatatatcactctagaaa

SEQ ID NO: 5111846 - DNA, 15 bp, Homo sapiens
aatatatatctacaa

SEQ ID NO: 5111847 - DNA, 20 bp, Homo sapiens
aatatatatctacaatatat

SEQ ID NO: 5111848 - DNA, 14 bp, Homo sapiens
aatatatatgatga

SEQ ID NO: 5111849 - DNA, 20 bp, Homo sapiens
aatatatatggaataagtgt

SEQ ID NO: 5111850 - DNA, 18 bp, Homo sapiens
aatatatatgtcaatatt

SEQ ID NO: 5111851 - DNA, 14 bp, Homo sapiens
aatatatatgtgca

SEQ ID NO: 5111852 - DNA, 17 bp, Homo sapiens
aatatatatgtgcagta

SEQ ID NO: 5111853 - DNA, 23 bp, Homo sapiens
aatatatattaagtgtgccaaat

SEQ ID NO: 5111854 - DNA, 13 bp, Homo sapiens
aatatatattata

SEQ ID NO: 5111855 - DNA, 19 bp, Homo sapiens
aatatatattatacttgta

SEQ ID NO: 5111856 - DNA, 14 bp, Homo sapiens
aatatatattatat

SEQ ID NO: 5111857 - DNA, 19 bp, Homo sapiens
aatatatattatatacata

SEQ ID NO: 5111858 - DNA, 16 bp, Homo sapiens
aatatatattatatat

SEQ ID NO: 5111859 - DNA, 18 bp, Homo sapiens
aatatatattatatatat

SEQ ID NO: 5111860 - DNA, 15 bp, Homo sapiens
aatatatattatctt

SEQ ID NO: 5111861 - DNA, 19 bp, Homo sapiens
aatatatattatcttttca

SEQ ID NO: 5111862 - DNA, 16 bp, Homo sapiens
aatatatattattctc

SEQ ID NO: 5111863 - DNA, 18 bp, Homo sapiens
aatatatattattctcat

SEQ ID NO: 5111864 - DNA, 21 bp, Homo sapiens
aatatatattattctcattta

SEQ ID NO: 5111865 - DNA, 14 bp, Homo sapiens
aatatatattctgg

SEQ ID NO: 5111866 - DNA, 17 bp, Homo sapiens
aatatatatttttcaaa

SEQ ID NO: 5111867 - DNA, 20 bp, Homo sapiens
aatatatatttttcaaatag

SEQ ID NO: 5111868 - DNA, 22 bp, Homo sapiens
aatatatcaaatccaggacttt

SEQ ID NO: 5111869 - DNA, 16 bp, Homo sapiens
aatatatcagaatctg

SEQ ID NO: 5111870 - DNA, 16 bp, Homo sapiens
aatatatcccagaaat

SEQ ID NO: 5111871 - DNA, 14 bp, Homo sapiens
aatatatcctgttt

SEQ ID NO: 5111872 - DNA, 20 bp, Homo sapiens
aatatatctaaattgaataa

SEQ ID NO: 5111873 - DNA, 14 bp, Homo sapiens
aatatatctctatt

SEQ ID NO: 5111874 - DNA, 18 bp, Homo sapiens
aatatatctgtaaagata

SEQ ID NO: 5111875 - DNA, 14 bp, Homo sapiens
aatatatctgtaac

SEQ ID NO: 5111876 - DNA, 20 bp, Homo sapiens
aatatatctgtaacactatt

SEQ ID NO: 5111877 - DNA, 21 bp, Homo sapiens
aatatatctgtaacactatta

SEQ ID NO: 5111878 - DNA, 21 bp, Homo sapiens
aatatatcttataaagtggaa

SEQ ID NO: 5111879 - DNA, 15 bp, Homo sapiens
aatatatctttgtaa

SEQ ID NO: 5111880 - DNA, 19 bp, Homo sapiens
aatatatctttgtaaatta

SEQ ID NO: 5111881 - DNA, 18 bp, Homo sapiens
aatatatgatatataaac

SEQ ID NO: 5111882 - DNA, 20 bp, Homo sapiens
aatatatgatatataaacct

SEQ ID NO: 5111883 - DNA, 18 bp, Homo sapiens
aatatatgatatttttca

SEQ ID NO: 5111884 - DNA, 20 bp, Homo sapiens
aatatatgattgtataatgt

SEQ ID NO: 5111885 - DNA, 22 bp, Homo sapiens
aatatatgattgtataatgtga

SEQ ID NO: 5111886 - DNA, 17 bp, Homo sapiens
aatatatgcctggcaca

SEQ ID NO: 5111887 - DNA, 22 bp, Homo sapiens
aatatatggaagataattttat

SEQ ID NO: 5111888 - DNA, 23 bp, Homo sapiens
aatatatggaattcctctactgc

SEQ ID NO: 5111889 - DNA, 14 bp, Homo sapiens
aatatatggcagag

SEQ ID NO: 5111890 - DNA, 21 bp, Homo sapiens
aatatatggcagagttgtaaa

SEQ ID NO: 5111891 - DNA, 23 bp, Homo sapiens
aatatatggcagagttgtaaata

SEQ ID NO: 5111892 - DNA, 19 bp, Homo sapiens
aatatatgggggaaaatta

SEQ ID NO: 5111893 - DNA, 18 bp, Homo sapiens
aatatatggtctaatgtt

SEQ ID NO: 5111894 - DNA, 13 bp, Homo sapiens
aatatatggtctg

SEQ ID NO: 5111895 - DNA, 12 bp, Homo sapiens
aatatatgtatg

SEQ ID NO: 5111896 - DNA, 14 bp, Homo sapiens
aatatatgtatgta

SEQ ID NO: 5111897 - DNA, 18 bp, Homo sapiens
aatatatgtattatttat

SEQ ID NO: 5111898 - DNA, 22 bp, Homo sapiens
aatatatgtatttttatataat

SEQ ID NO: 5111899 - DNA, 21 bp, Homo sapiens
aatatatgtctatatacacag

SEQ ID NO: 5111900 - DNA, 18 bp, Homo sapiens
aatatatgtctgataatg

SEQ ID NO: 5111901 - DNA, 13 bp, Homo sapiens
aatatatgtgaaa

SEQ ID NO: 5111902 - DNA, 13 bp, Homo sapiens
aatatatgttctg

SEQ ID NO: 5111903 - DNA, 16 bp, Homo sapiens
aatatatgttctgcaa

SEQ ID NO: 5111904 - DNA, 17 bp, Homo sapiens
aatatatgttctgcaag

SEQ ID NO: 5111905 - DNA, 11 bp, Homo sapiens
aatatatgttt

SEQ ID NO: 5111906 - DNA, 20 bp, Homo sapiens
aatatatgtttaccttttaa

SEQ ID NO: 5111907 - DNA, 13 bp, Homo sapiens
aatatatgttttg

SEQ ID NO: 5111908 - DNA, 14 bp, Homo sapiens
aatatatgttttga

SEQ ID NO: 5111909 - DNA, 20 bp, Homo sapiens
aatatatgttttgagaaaaa

SEQ ID NO: 5111910 - DNA, 16 bp, Homo sapiens
aatatatgttttgtct

SEQ ID NO: 5111911 - DNA, 16 bp, Homo sapiens
aatatattaaaaatat

SEQ ID NO: 5111912 - DNA, 19 bp, Homo sapiens
aatatattaaaaatataaa

SEQ ID NO: 5111913 - DNA, 15 bp, Homo sapiens
aatatattaccagca

SEQ ID NO: 5111914 - DNA, 13 bp, Homo sapiens
aatatattactga

SEQ ID NO: 5111915 - DNA, 16 bp, Homo sapiens
aatatattactgattt

SEQ ID NO: 5111916 - DNA, 16 bp, Homo sapiens
aatatattataatctt

SEQ ID NO: 5111917 - DNA, 13 bp, Homo sapiens
aatatattatata

SEQ ID NO: 5111918 - DNA, 19 bp, Homo sapiens
aatatattatgaaaattaa

SEQ ID NO: 5111919 - DNA, 18 bp, Homo sapiens
aatatattattacttgta

SEQ ID NO: 5111920 - DNA, 17 bp, Homo sapiens
aatatattctctttggt

SEQ ID NO: 5111921 - DNA, 14 bp, Homo sapiens
aatatattgaataa

SEQ ID NO: 5111922 - DNA, 16 bp, Homo sapiens
aatatattgaataggc

SEQ ID NO: 5111923 - DNA, 14 bp, Homo sapiens
aatatattgccaaa

SEQ ID NO: 5111924 - DNA, 22 bp, Homo sapiens
aatatattgccagtatataagc

SEQ ID NO: 5111925 - DNA, 15 bp, Homo sapiens
aatatattgtacaaa

SEQ ID NO: 5111926 - DNA, 22 bp, Homo sapiens
aatatattgtgttttaacacca

SEQ ID NO: 5111927 - DNA, 22 bp, Homo sapiens
aatatatttaaagggaaattga

SEQ ID NO: 5111928 - DNA, 13 bp, Homo sapiens
aatatatttaact

SEQ ID NO: 5111929 - DNA, 16 bp, Homo sapiens
aatatatttaactatt

SEQ ID NO: 5111930 - DNA, 20 bp, Homo sapiens
aatatatttaactatttaga

SEQ ID NO: 5111931 - DNA, 14 bp, Homo sapiens
aatatatttaatat

SEQ ID NO: 5111932 - DNA, 18 bp, Homo sapiens
aatatatttaatatattg

SEQ ID NO: 5111933 - DNA, 16 bp, Homo sapiens
aatatatttaattgtg

SEQ ID NO: 5111934 - DNA, 13 bp, Homo sapiens
aatatatttatat

SEQ ID NO: 5111935 - DNA, 18 bp, Homo sapiens
aatatatttcagacattt

SEQ ID NO: 5111936 - DNA, 17 bp, Homo sapiens
aatatatttctaaatgt

SEQ ID NO: 5111937 - DNA, 21 bp, Homo sapiens
aatatatttctaaatgtttgg

SEQ ID NO: 5111938 - DNA, 20 bp, Homo sapiens
aatatatttcttcttctaag

SEQ ID NO: 5111939 - DNA, 18 bp, Homo sapiens
aatatatttgcataatat

SEQ ID NO: 5111940 - DNA, 12 bp, Homo sapiens
aatatatttgta

SEQ ID NO: 5111941 - DNA, 14 bp, Homo sapiens
aatatatttgtaaa

SEQ ID NO: 5111942 - DNA, 19 bp, Homo sapiens
aatatatttgtaggtatac

SEQ ID NO: 5111943 - DNA, 24 bp, Homo sapiens
aatatatttgtaggtatactatgt

SEQ ID NO: 5111944 - DNA, 14 bp, Homo sapiens
aatatatttgtcac

SEQ ID NO: 5111945 - DNA, 16 bp, Homo sapiens
aatatattttaaatgt

SEQ ID NO: 5111946 - DNA, 14 bp, Homo sapiens
aatatattttaaga

SEQ ID NO: 5111947 - DNA, 16 bp, Homo sapiens
aatatattttcagtac

SEQ ID NO: 5111948 - DNA, 15 bp, Homo sapiens
aatatattttctctt

SEQ ID NO: 5111949 - DNA, 21 bp, Homo sapiens
aatatattttctgttttcttt

SEQ ID NO: 5111950 - DNA, 14 bp, Homo sapiens
aatatattttgaaa

SEQ ID NO: 5111951 - DNA, 14 bp, Homo sapiens
aatatattttgtat

SEQ ID NO: 5111952 - DNA, 19 bp, Homo sapiens
aatatattttgtttacaaa

SEQ ID NO: 5111953 - DNA, 18 bp, Homo sapiens
aatatatttttaaagcaa

SEQ ID NO: 5111954 - DNA, 15 bp, Homo sapiens
aatatatttttatat

SEQ ID NO: 5111955 - DNA, 13 bp, Homo sapiens
aatatatttttcc

SEQ ID NO: 5111956 - DNA, 18 bp, Homo sapiens
aatatatttttccctgtt

SEQ ID NO: 5111957 - DNA, 16 bp, Homo sapiens
aatatcaaaaggaaga

SEQ ID NO: 5111958 - DNA, 17 bp, Homo sapiens
aatatcaaagcatttta

SEQ ID NO: 5111959 - DNA, 21 bp, Homo sapiens
aatatcaaagtcattaaagac

SEQ ID NO: 5111960 - DNA, 14 bp, Homo sapiens
aatatcaaatgcag

SEQ ID NO: 5111961 - DNA, 22 bp, Homo sapiens
aatatcaaatgcagtatatttc

SEQ ID NO: 5111962 - DNA, 14 bp, Homo sapiens
aatatcaaattaat

SEQ ID NO: 5111963 - DNA, 17 bp, Homo sapiens
aatatcaaattaattgt

SEQ ID NO: 5111964 - DNA, 23 bp, Homo sapiens
aatatcaacaacaagttgtttca

SEQ ID NO: 5111965 - DNA, 19 bp, Homo sapiens
aatatcaagtactacattt

SEQ ID NO: 5111966 - DNA, 15 bp, Homo sapiens
aatatcaatataatg

SEQ ID NO: 5111967 - DNA, 18 bp, Homo sapiens
aatatcacactcgtcttt

SEQ ID NO: 5111968 - DNA, 19 bp, Homo sapiens
aatatcaccaaaaacctat

SEQ ID NO: 5111969 - DNA, 23 bp, Homo sapiens
aatatcaccaaaaacctattcca

SEQ ID NO: 5111970 - DNA, 17 bp, Homo sapiens
aatatcactcattaatt

SEQ ID NO: 5111971 - DNA, 20 bp, Homo sapiens
aatatcacttgtcaataaaa

SEQ ID NO: 5111972 - DNA, 22 bp, Homo sapiens
aatatcacttgtcaataaaatc

SEQ ID NO: 5111973 - DNA, 19 bp, Homo sapiens
aatatcagaatatgattca

SEQ ID NO: 5111974 - DNA, 18 bp, Homo sapiens
aatatcagctttgataat

SEQ ID NO: 5111975 - DNA, 19 bp, Homo sapiens
aatatcagtattctgacat

SEQ ID NO: 5111976 - DNA, 21 bp, Homo sapiens
aatatcagtattctgacatgt

SEQ ID NO: 5111977 - DNA, 19 bp, Homo sapiens
aatatcagttactcagccc

SEQ ID NO: 5111978 - DNA, 16 bp, Homo sapiens
aatatcataaagcatt

SEQ ID NO: 5111979 - DNA, 18 bp, Homo sapiens
aatatcataaagcatttt

SEQ ID NO: 5111980 - DNA, 22 bp, Homo sapiens
aatatcatatcatcacattgag

SEQ ID NO: 5111981 - DNA, 18 bp, Homo sapiens
aatatcatcagtattgaa

SEQ ID NO: 5111982 - DNA, 22 bp, Homo sapiens
aatatcatccccaaatgtgtct

SEQ ID NO: 5111983 - DNA, 19 bp, Homo sapiens
aatatcatctgtcattata

SEQ ID NO: 5111984 - DNA, 15 bp, Homo sapiens
aatatcatgtcttgt

SEQ ID NO: 5111985 - DNA, 20 bp, Homo sapiens
aatatcatgtcttgtgcata

SEQ ID NO: 5111986 - DNA, 14 bp, Homo sapiens
aatatcattcagca

SEQ ID NO: 5111987 - DNA, 16 bp, Homo sapiens
aatatcattcagcaac

SEQ ID NO: 5111988 - DNA, 14 bp, Homo sapiens
aatatcattttata

SEQ ID NO: 5111989 - DNA, 19 bp, Homo sapiens
aatatccaaagactgtact

SEQ ID NO: 5111990 - DNA, 20 bp, Homo sapiens
aatatccaccactttaacct

SEQ ID NO: 5111991 - DNA, 21 bp, Homo sapiens
aatatccaggtcaacagaatg

SEQ ID NO: 5111992 - DNA, 24 bp, Homo sapiens
aatatccaggtcaacagaatgaaa

SEQ ID NO: 5111993 - DNA, 18 bp, Homo sapiens
aatatccatttatctttt

SEQ ID NO: 5111994 - DNA, 16 bp, Homo sapiens
aatatcccaacattct

SEQ ID NO: 5111995 - DNA, 22 bp, Homo sapiens
aatatcccaacattctgcaatg

SEQ ID NO: 5111996 - DNA, 21 bp, Homo sapiens
aatatcccagaaaaagtaact

SEQ ID NO: 5111997 - DNA, 17 bp, Homo sapiens
aatatcccgggggtggg

SEQ ID NO: 5111998 - DNA, 19 bp, Homo sapiens
aatatccctacatgtattg

SEQ ID NO: 5111999 - DNA, 21 bp, Homo sapiens
aatatccctcatttcattatt

SEQ ID NO: 5112000 - DNA, 12 bp, Homo sapiens
aatatccctcct

SEQ ID NO: 5112001 - DNA, 23 bp, Homo sapiens
aatatccctcctgttgggagagg

SEQ ID NO: 5112002 - DNA, 19 bp, Homo sapiens
aatatcccttggacatttt

SEQ ID NO: 5112003 - DNA, 20 bp, Homo sapiens
aatatcccttggacatttta

SEQ ID NO: 5112004 - DNA, 22 bp, Homo sapiens
aatatcccttggacattttatg

SEQ ID NO: 5112005 - DNA, 14 bp, Homo sapiens
aatatcctaaacat

SEQ ID NO: 5112006 - DNA, 17 bp, Homo sapiens
aatatcctaaacatcat

SEQ ID NO: 5112007 - DNA, 14 bp, Homo sapiens
aatatcctaataaa

SEQ ID NO: 5112008 - DNA, 15 bp, Homo sapiens
aatatcctaataaaa

SEQ ID NO: 5112009 - DNA, 19 bp, Homo sapiens
aatatcctaataaaaaggt

SEQ ID NO: 5112010 - DNA, 22 bp, Homo sapiens
aatatcctttggaacaattatt

SEQ ID NO: 5112011 - DNA, 14 bp, Homo sapiens
aatatccttttaga

SEQ ID NO: 5112012 - DNA, 18 bp, Homo sapiens
aatatccttttagaagca

SEQ ID NO: 5112013 - DNA, 20 bp, Homo sapiens
aatatccttttagaagcagc

SEQ ID NO: 5112014 - DNA, 23 bp, Homo sapiens
aatatcgatcagatgactagaaa

SEQ ID NO: 5112015 - DNA, 20 bp, Homo sapiens
aatatcgctgatgcagacac

SEQ ID NO: 5112016 - DNA, 14 bp, Homo sapiens
aatatctaaagtta

SEQ ID NO: 5112017 - DNA, 16 bp, Homo sapiens
aatatctaaagttata

SEQ ID NO: 5112018 - DNA, 20 bp, Homo sapiens
aatatctaaagttatatttc

SEQ ID NO: 5112019 - DNA, 18 bp, Homo sapiens
aatatctaataaaaagtc

SEQ ID NO: 5112020 - DNA, 14 bp, Homo sapiens
aatatctattaata

SEQ ID NO: 5112021 - DNA, 16 bp, Homo sapiens
aatatctattaatata

SEQ ID NO: 5112022 - DNA, 23 bp, Homo sapiens
aatatctatttatctgtctgagc

SEQ ID NO: 5112023 - DNA, 15 bp, Homo sapiens
aatatctatttgaat

SEQ ID NO: 5112024 - DNA, 17 bp, Homo sapiens
aatatctatttgaataa

SEQ ID NO: 5112025 - DNA, 16 bp, Homo sapiens
aatatctctatttaat

SEQ ID NO: 5112026 - DNA, 21 bp, Homo sapiens
aatatctgaacatttactaca

SEQ ID NO: 5112027 - DNA, 12 bp, Homo sapiens
aatatctgaagc

SEQ ID NO: 5112028 - DNA, 17 bp, Homo sapiens
aatatctgaatatatga

SEQ ID NO: 5112029 - DNA, 17 bp, Homo sapiens
aatatctgactgaaatt

SEQ ID NO: 5112030 - DNA, 13 bp, Homo sapiens
aatatctgcagcg

SEQ ID NO: 5112031 - DNA, 21 bp, Homo sapiens
aatatctgcagcgttgcttgg

SEQ ID NO: 5112032 - DNA, 15 bp, Homo sapiens
aatatctgccccagt

SEQ ID NO: 5112033 - DNA, 17 bp, Homo sapiens
aatatctgtaatggtac

SEQ ID NO: 5112034 - DNA, 13 bp, Homo sapiens
aatatctgtattt

SEQ ID NO: 5112035 - DNA, 23 bp, Homo sapiens
aatatctgtatttaattttgaca

SEQ ID NO: 5112036 - DNA, 15 bp, Homo sapiens
aatatctgttattca

SEQ ID NO: 5112037 - DNA, 13 bp, Homo sapiens
aatatcttaggtt

SEQ ID NO: 5112038 - DNA, 17 bp, Homo sapiens
aatatcttcctttgggg

SEQ ID NO: 5112039 - DNA, 17 bp, Homo sapiens
aatatcttgaagaatat

SEQ ID NO: 5112040 - DNA, 18 bp, Homo sapiens
aatatcttgaagaatatt

SEQ ID NO: 5112041 - DNA, 17 bp, Homo sapiens
aatatcttgcttgaact

SEQ ID NO: 5112042 - DNA, 19 bp, Homo sapiens
aatatctttaaatatatat

SEQ ID NO: 5112043 - DNA, 18 bp, Homo sapiens
aatatctttctcttacct

SEQ ID NO: 5112044 - DNA, 23 bp, Homo sapiens
aatatctttgcatcatagaacag

SEQ ID NO: 5112045 - DNA, 22 bp, Homo sapiens
aatatctttgtgataatttaag

SEQ ID NO: 5112046 - DNA, 23 bp, Homo sapiens
aatatcttttatgtttgaatatg

SEQ ID NO: 5112047 - DNA, 15 bp, Homo sapiens
aatatcttttgacct

SEQ ID NO: 5112048 - DNA, 16 bp, Homo sapiens
aatatgaaaaatgtaa

SEQ ID NO: 5112049 - DNA, 14 bp, Homo sapiens
aatatgaaaactta

SEQ ID NO: 5112050 - DNA, 14 bp, Homo sapiens
aatatgaaagccta

SEQ ID NO: 5112051 - DNA, 16 bp, Homo sapiens
aatatgaaatgataaa

SEQ ID NO: 5112052 - DNA, 17 bp, Homo sapiens
aatatgaaattccagca

SEQ ID NO: 5112053 - DNA, 15 bp, Homo sapiens
aataacatatctaaa

SEQ ID NO: 5112054 - DNA, 15 bp, Homo sapiens
aataacatattcttg

SEQ ID NO: 5112055 - DNA, 18 bp, Homo sapiens
aataacatattcttgctt

SEQ ID NO: 5112056 - DNA, 13 bp, Homo sapiens
aataacatctctt

SEQ ID NO: 5112057 - DNA, 19 bp, Homo sapiens
aataacatctgaaaagaaa

SEQ ID NO: 5112058 - DNA, 16 bp, Homo sapiens
aataacatgatactat

SEQ ID NO: 5112059 - DNA, 13 bp, Homo sapiens
aataacattacct

SEQ ID NO: 5112060 - DNA, 13 bp, Homo sapiens
aataacattgcac

SEQ ID NO: 5112061 - DNA, 14 bp, Homo sapiens
aataacattgcact

SEQ ID NO: 5112062 - DNA, 11 bp, Homo sapiens
aataacattta

SEQ ID NO: 5112063 - DNA, 12 bp, Homo sapiens
aataacatttaa

SEQ ID NO: 5112064 - DNA, 14 bp, Homo sapiens
aataacatttaatt

SEQ ID NO: 5112065 - DNA, 18 bp, Homo sapiens
aataacatttaatttaga

SEQ ID NO: 5112066 - DNA, 13 bp, Homo sapiens
aataacatttgtg

SEQ ID NO: 5112067 - DNA, 21 bp, Homo sapiens
aataacattttatacaatttc

SEQ ID NO: 5112068 - DNA, 20 bp, Homo sapiens
aataaccaaatgcaatgtga

SEQ ID NO: 5112069 - DNA, 23 bp, Homo sapiens
aataaccaacccttccctgaaaa

SEQ ID NO: 5112070 - DNA, 17 bp, Homo sapiens
aataaccaatctacaat

SEQ ID NO: 5112071 - DNA, 20 bp, Homo sapiens
aataaccaattcctcatttg

SEQ ID NO: 5112072 - DNA, 16 bp, Homo sapiens
aataacccagttactt

SEQ ID NO: 5112073 - DNA, 22 bp, Homo sapiens
aataaccccattctttgcttga

SEQ ID NO: 5112074 - DNA, 18 bp, Homo sapiens
aataaccctttggttttt

SEQ ID NO: 5112075 - DNA, 16 bp, Homo sapiens
aataaccgcttggttt

SEQ ID NO: 5112076 - DNA, 18 bp, Homo sapiens
aataacctataaagtgtt

SEQ ID NO: 5112077 - DNA, 15 bp, Homo sapiens
aataacctctggccc

SEQ ID NO: 5112078 - DNA, 23 bp, Homo sapiens
aataacctctggcccttggaata

SEQ ID NO: 5112079 - DNA, 22 bp, Homo sapiens
aataacgtttaagccaaaacaa

SEQ ID NO: 5112080 - DNA, 15 bp, Homo sapiens
aataactaaaaggta

SEQ ID NO: 5112081 - DNA, 15 bp, Homo sapiens
aataactaaaatgta

SEQ ID NO: 5112082 - DNA, 21 bp, Homo sapiens
aataactaaaccacttaaaat

SEQ ID NO: 5112083 - DNA, 23 bp, Homo sapiens
aataactaaagctagttaatgtc

SEQ ID NO: 5112084 - DNA, 21 bp, Homo sapiens
aataactaagatatagaaact

SEQ ID NO: 5112085 - DNA, 21 bp, Homo sapiens
aataactaatgctaagaaatg

SEQ ID NO: 5112086 - DNA, 17 bp, Homo sapiens
aataactactgtgttcc

SEQ ID NO: 5112087 - DNA, 18 bp, Homo sapiens
aataactactgtgttcct

SEQ ID NO: 5112088 - DNA, 19 bp, Homo sapiens
aataactactgtgttcctg

SEQ ID NO: 5112089 - DNA, 22 bp, Homo sapiens
aataactagcttcttataatga

SEQ ID NO: 5112090 - DNA, 17 bp, Homo sapiens
aataactatcaggcaga

SEQ ID NO: 5112091 - DNA, 20 bp, Homo sapiens
aataactatcaggcagaaga

SEQ ID NO: 5112092 - DNA, 15 bp, Homo sapiens
aataactatctcact

SEQ ID NO: 5112093 - DNA, 14 bp, Homo sapiens
aataactatggtaa

SEQ ID NO: 5112094 - DNA, 22 bp, Homo sapiens
aataactatggtaaataactgt

SEQ ID NO: 5112095 - DNA, 11 bp, Homo sapiens
aataactattt

SEQ ID NO: 5112096 - DNA, 19 bp, Homo sapiens
aataactattttgttttaa

SEQ ID NO: 5112097 - DNA, 21 bp, Homo sapiens
aataactattttgttttaatc

SEQ ID NO: 5112098 - DNA, 14 bp, Homo sapiens
aataactccaagca

SEQ ID NO: 5112099 - DNA, 15 bp, Homo sapiens
aataactgaaccaaa

SEQ ID NO: 5112100 - DNA, 16 bp, Homo sapiens
aataactgaaccaaat

SEQ ID NO: 5112101 - DNA, 21 bp, Homo sapiens
aataactgaaccaaattgcac

SEQ ID NO: 5112102 - DNA, 16 bp, Homo sapiens
aataactgaactgttt

SEQ ID NO: 5112103 - DNA, 19 bp, Homo sapiens
aataactgaactgtttggt

SEQ ID NO: 5112104 - DNA, 16 bp, Homo sapiens
aataactgaataaaaa

SEQ ID NO: 5112105 - DNA, 18 bp, Homo sapiens
aataactgagatattatt

SEQ ID NO: 5112106 - DNA, 17 bp, Homo sapiens
aataactggaacactct

SEQ ID NO: 5112107 - DNA, 20 bp, Homo sapiens
aataactggatattctttat

SEQ ID NO: 5112108 - DNA, 22 bp, Homo sapiens
aataactgtaattatttgaatg

SEQ ID NO: 5112109 - DNA, 20 bp, Homo sapiens
aataactgtgaagtttacat

SEQ ID NO: 5112110 - DNA, 12 bp, Homo sapiens
aataactgtgta

SEQ ID NO: 5112111 - DNA, 17 bp, Homo sapiens
aataacttacaagactg

SEQ ID NO: 5112112 - DNA, 23 bp, Homo sapiens
aataacttacaagactgtaaatt

SEQ ID NO: 5112113 - DNA, 22 bp, Homo sapiens
aataacttagaatgcttcaagt

SEQ ID NO: 5112114 - DNA, 20 bp, Homo sapiens
aataacttagcttgcacatg

SEQ ID NO: 5112115 - DNA, 15 bp, Homo sapiens
aataacttcagagaa

SEQ ID NO: 5112116 - DNA, 18 bp, Homo sapiens
aataacttcagagaagtc

SEQ ID NO: 5112117 - DNA, 13 bp, Homo sapiens
aataacttcagtc

SEQ ID NO: 5112118 - DNA, 14 bp, Homo sapiens
aataacttcagtcc

SEQ ID NO: 5112119 - DNA, 19 bp, Homo sapiens
aataacttgtcctatgtca

SEQ ID NO: 5112120 - DNA, 21 bp, Homo sapiens
aataacttgtcctatgtcaat

SEQ ID NO: 5112121 - DNA, 19 bp, Homo sapiens
aataactttattgcatata

SEQ ID NO: 5112122 - DNA, 20 bp, Homo sapiens
aataactttattgcatatag

SEQ ID NO: 5112123 - DNA, 20 bp, Homo sapiens
aataactttctctgtgaaag

SEQ ID NO: 5112124 - DNA, 22 bp, Homo sapiens
aataagaaacaactctttgaga

SEQ ID NO: 5112125 - DNA, 15 bp, Homo sapiens
aataagaaagtttca

SEQ ID NO: 5112126 - DNA, 15 bp, Homo sapiens
aataagaagcaaata

SEQ ID NO: 5112127 - DNA, 23 bp, Homo sapiens
aataagaagggggagtgaaacag

SEQ ID NO: 5112128 - DNA, 14 bp, Homo sapiens
aataagaatgattt

SEQ ID NO: 5112129 - DNA, 15 bp, Homo sapiens
aataagaatttgcat

SEQ ID NO: 5112130 - DNA, 21 bp, Homo sapiens
aataagagaagctactttgtt

SEQ ID NO: 5112131 - DNA, 22 bp, Homo sapiens
aataagagcatgatttgaaaaa

SEQ ID NO: 5112132 - DNA, 23 bp, Homo sapiens
aataagataatgatgagtaactt

SEQ ID NO: 5112133 - DNA, 16 bp, Homo sapiens
aataagatacatcaca

SEQ ID NO: 5112134 - DNA, 16 bp, Homo sapiens
aataagattggtgttc

SEQ ID NO: 5112135 - DNA, 23 bp, Homo sapiens
aataagcaaaaaactgcatcgat

SEQ ID NO: 5112136 - DNA, 15 bp, Homo sapiens
aataagcaactaaat

SEQ ID NO: 5112137 - DNA, 14 bp, Homo sapiens
aataagcagcaaat

SEQ ID NO: 5112138 - DNA, 18 bp, Homo sapiens
aataagcaggtggatcta

SEQ ID NO: 5112139 - DNA, 23 bp, Homo sapiens
aataagcccaacaagttgaagaa

SEQ ID NO: 5112140 - DNA, 21 bp, Homo sapiens
aataagcccagtgctgctgta

SEQ ID NO: 5112141 - DNA, 14 bp, Homo sapiens
aataagctaaagag

SEQ ID NO: 5112142 - DNA, 17 bp, Homo sapiens
aataagctagttgaata

SEQ ID NO: 5112143 - DNA, 23 bp, Homo sapiens
aataagctagttgaatacttgaa

SEQ ID NO: 5112144 - DNA, 16 bp, Homo sapiens
aataagctatttgatg

SEQ ID NO: 5112145 - DNA, 20 bp, Homo sapiens
aataagctatttgatgtaat

SEQ ID NO: 5112146 - DNA, 21 bp, Homo sapiens
aataagctatttgatgtaata

SEQ ID NO: 5112147 - DNA, 16 bp, Homo sapiens
aataagctcagtgata

SEQ ID NO: 5112148 - DNA, 18 bp, Homo sapiens
aataagctggactagtgt

SEQ ID NO: 5112149 - DNA, 16 bp, Homo sapiens
aataagctttctcaga

SEQ ID NO: 5112150 - DNA, 11 bp, Homo sapiens
aataaggaaaa

SEQ ID NO: 5112151 - DNA, 15 bp, Homo sapiens
aataaggaaaagttt

SEQ ID NO: 5112152 - DNA, 16 bp, Homo sapiens
aataaggaagagggct

SEQ ID NO: 5112153 - DNA, 22 bp, Homo sapiens
aataaggaagagggctgagctg

SEQ ID NO: 5112154 - DNA, 16 bp, Homo sapiens
aataaggaatttcctc

SEQ ID NO: 5112155 - DNA, 21 bp, Homo sapiens
aataaggacaagcctaacttc

SEQ ID NO: 5112156 - DNA, 21 bp, Homo sapiens
aataaggacagcagctggtgc

SEQ ID NO: 5112157 - DNA, 12 bp, Homo sapiens
aataaggaggag

SEQ ID NO: 5112158 - DNA, 19 bp, Homo sapiens
aataaggatgactttagaa

SEQ ID NO: 5112159 - DNA, 16 bp, Homo sapiens
aataaggatttattct

SEQ ID NO: 5112160 - DNA, 18 bp, Homo sapiens
aataaggatttattctca

SEQ ID NO: 5112161 - DNA, 22 bp, Homo sapiens
aataaggatttattctcagaac

SEQ ID NO: 5112162 - DNA, 18 bp, Homo sapiens
aataaggcacccatctgt

SEQ ID NO: 5112163 - DNA, 20 bp, Homo sapiens
aataaggcatgcgaaatgtt

SEQ ID NO: 5112164 - DNA, 21 bp, Homo sapiens
aataaggcatgcgaaatgttc

SEQ ID NO: 5112165 - DNA, 17 bp, Homo sapiens
aataaggggcacctggg

SEQ ID NO: 5112166 - DNA, 18 bp, Homo sapiens
aataaggggcacctggga

SEQ ID NO: 5112167 - DNA, 22 bp, Homo sapiens
aataagggtttttgcataataa

SEQ ID NO: 5112168 - DNA, 22 bp, Homo sapiens
aataaggtataaggatcttttg

SEQ ID NO: 5112169 - DNA, 15 bp, Homo sapiens
aataaggttatatga

SEQ ID NO: 5112170 - DNA, 13 bp, Homo sapiens
aataaggttttaa

SEQ ID NO: 5112171 - DNA, 14 bp, Homo sapiens
aataagtaacatat

SEQ ID NO: 5112172 - DNA, 20 bp, Homo sapiens
aataagtatatcttaagaat

SEQ ID NO: 5112173 - DNA, 22 bp, Homo sapiens
aataagtatatcttaagaatgt

SEQ ID NO: 5112174 - DNA, 14 bp, Homo sapiens
aataagtattcttc

SEQ ID NO: 5112175 - DNA, 21 bp, Homo sapiens
aataagtatttctgattttgt

SEQ ID NO: 5112176 - DNA, 20 bp, Homo sapiens
aataagtcaaaataatctga

SEQ ID NO: 5112177 - DNA, 15 bp, Homo sapiens
aataagtcaacagta

SEQ ID NO: 5112178 - DNA, 15 bp, Homo sapiens
aataagtctgattta

SEQ ID NO: 5112179 - DNA, 14 bp, Homo sapiens
aataagtgaaattt

SEQ ID NO: 5112180 - DNA, 18 bp, Homo sapiens
aataagtgacaaataaga

SEQ ID NO: 5112181 - DNA, 16 bp, Homo sapiens
aataagtgctactttg

SEQ ID NO: 5112182 - DNA, 12 bp, Homo sapiens
aataagtgctgt

SEQ ID NO: 5112183 - DNA, 13 bp, Homo sapiens
aataagtgctgtt

SEQ ID NO: 5112184 - DNA, 20 bp, Homo sapiens
aataagtggattttgtattt

SEQ ID NO: 5112185 - DNA, 17 bp, Homo sapiens
aataagtggcatacttt

SEQ ID NO: 5112186 - DNA, 21 bp, Homo sapiens
aataagtgtgtggtagaaaca

SEQ ID NO: 5112187 - DNA, 21 bp, Homo sapiens
aataagtgttgtaccatatgt

SEQ ID NO: 5112188 - DNA, 23 bp, Homo sapiens
aataagtgttgtaccatatgtag

SEQ ID NO: 5112189 - DNA, 22 bp, Homo sapiens
aataagttaactattttatttt

SEQ ID NO: 5112190 - DNA, 18 bp, Homo sapiens
aataagttacttgaaata

SEQ ID NO: 5112191 - DNA, 17 bp, Homo sapiens
aataagttatgggtttt

SEQ ID NO: 5112192 - DNA, 13 bp, Homo sapiens
aataagttattgc

SEQ ID NO: 5112193 - DNA, 18 bp, Homo sapiens
aataagttattgcagttt

SEQ ID NO: 5112194 - DNA, 16 bp, Homo sapiens
aataagttcatacaat

SEQ ID NO: 5112195 - DNA, 19 bp, Homo sapiens
aataagttcattaaacaga

SEQ ID NO: 5112196 - DNA, 13 bp, Homo sapiens
aataagttcttaa

SEQ ID NO: 5112197 - DNA, 16 bp, Homo sapiens
aataagttgatgtttt

SEQ ID NO: 5112198 - DNA, 19 bp, Homo sapiens
aataagttgatgttttcta

SEQ ID NO: 5112199 - DNA, 20 bp, Homo sapiens
aataagtttgaaatatatta

SEQ ID NO: 5112200 - DNA, 19 bp, Homo sapiens
aataagtttgtgttagaaa

SEQ ID NO: 5112201 - DNA, 23 bp, Homo sapiens
aataagttttgatataatcttgg

SEQ ID NO: 5112202 - DNA, 15 bp, Homo sapiens
aataagtttttgcta

SEQ ID NO: 5112203 - DNA, 14 bp, Homo sapiens
aataataaaatcaa

SEQ ID NO: 5112204 - DNA, 21 bp, Homo sapiens
aataataaaatgcaaatgaat

SEQ ID NO: 5112205 - DNA, 13 bp, Homo sapiens
aataataaacttt

SEQ ID NO: 5112206 - DNA, 20 bp, Homo sapiens
aataataaagaatagcttta

SEQ ID NO: 5112207 - DNA, 13 bp, Homo sapiens
aataataaagatc

SEQ ID NO: 5112208 - DNA, 19 bp, Homo sapiens
aataataaagatgctcttt

SEQ ID NO: 5112209 - DNA, 14 bp, Homo sapiens
aataataaagatgt

SEQ ID NO: 5112210 - DNA, 16 bp, Homo sapiens
aataataaaggttcta

SEQ ID NO: 5112211 - DNA, 15 bp, Homo sapiens
aataataaagtactt

SEQ ID NO: 5112212 - DNA, 19 bp, Homo sapiens
aataataaagtacttgact

SEQ ID NO: 5112213 - DNA, 12 bp, Homo sapiens
aataataaatag

SEQ ID NO: 5112214 - DNA, 14 bp, Homo sapiens
aataataaatagtt

SEQ ID NO: 5112215 - DNA, 14 bp, Homo sapiens
aataataaatattg

SEQ ID NO: 5112216 - DNA, 15 bp, Homo sapiens
aataataaatattta

SEQ ID NO: 5112217 - DNA, 21 bp, Homo sapiens
aataataaatgcatagagcaa

SEQ ID NO: 5112218 - DNA, 16 bp, Homo sapiens
aataataaatgccctc

SEQ ID NO: 5112219 - DNA, 17 bp, Homo sapiens
aataataaattcatcag

SEQ ID NO: 5112220 - DNA, 18 bp, Homo sapiens
aataataaattcatcaga

SEQ ID NO: 5112221 - DNA, 14 bp, Homo sapiens
aataataataaagt

SEQ ID NO: 5112222 - DNA, 16 bp, Homo sapiens
aataataataataata

SEQ ID NO: 5112223 - DNA, 12 bp, Homo sapiens
aataataatatc

SEQ ID NO: 5112224 - DNA, 12 bp, Homo sapiens
aataataatgaa

SEQ ID NO: 5112225 - DNA, 20 bp, Homo sapiens
aataataatttttatattta

SEQ ID NO: 5112226 - DNA, 16 bp, Homo sapiens
aataatacaacaatcc

SEQ ID NO: 5112227 - DNA, 15 bp, Homo sapiens
aataatacatcttta

SEQ ID NO: 5112228 - DNA, 17 bp, Homo sapiens
aataatacattatattt

SEQ ID NO: 5112229 - DNA, 20 bp, Homo sapiens
aataatacattgaattagaa

SEQ ID NO: 5112230 - DNA, 13 bp, Homo sapiens
aataatacctcaa

SEQ ID NO: 5112231 - DNA, 11 bp, Homo sapiens
aatatgaacaa

SEQ ID NO: 5112232 - DNA, 22 bp, Homo sapiens
aatatgaacaaagaaaaaaata

SEQ ID NO: 5112233 - DNA, 15 bp, Homo sapiens
aatatgaacctattt

SEQ ID NO: 5112234 - DNA, 18 bp, Homo sapiens
aatatgaacctattttca

SEQ ID NO: 5112235 - DNA, 22 bp, Homo sapiens
aatatgaagagtttttttctgt

SEQ ID NO: 5112236 - DNA, 14 bp, Homo sapiens
aatatgaagccttt

SEQ ID NO: 5112237 - DNA, 16 bp, Homo sapiens
aatatgaagcctttgg

SEQ ID NO: 5112238 - DNA, 21 bp, Homo sapiens
aatatgaagcctttggtgaat

SEQ ID NO: 5112239 - DNA, 12 bp, Homo sapiens
aatatgaagctc

SEQ ID NO: 5112240 - DNA, 21 bp, Homo sapiens
aatatgaaggactattaattc

SEQ ID NO: 5112241 - DNA, 21 bp, Homo sapiens
aatatgaaggtttgagagcag

SEQ ID NO: 5112242 - DNA, 20 bp, Homo sapiens
aatatgaatatatacataaa

SEQ ID NO: 5112243 - DNA, 20 bp, Homo sapiens
aatatgaatctgctcacttt

SEQ ID NO: 5112244 - DNA, 12 bp, Homo sapiens
aatatgaatgaa

SEQ ID NO: 5112245 - DNA, 22 bp, Homo sapiens
aatatgaatgcccccagctggc

SEQ ID NO: 5112246 - DNA, 19 bp, Homo sapiens
aatatgaattctgttgtaa

SEQ ID NO: 5112247 - DNA, 21 bp, Homo sapiens
aatatgacacagcttgtgaat

SEQ ID NO: 5112248 - DNA, 19 bp, Homo sapiens
aatatgacagataacctaa

SEQ ID NO: 5112249 - DNA, 22 bp, Homo sapiens
aatatgacagctgtccctgtca

SEQ ID NO: 5112250 - DNA, 13 bp, Homo sapiens
aatatgaccattt

SEQ ID NO: 5112251 - DNA, 17 bp, Homo sapiens
aatatgacggaagaaca

SEQ ID NO: 5112252 - DNA, 19 bp, Homo sapiens
aatatgacggaagaacata

SEQ ID NO: 5112253 - DNA, 17 bp, Homo sapiens
aatatgactcaggagcc

SEQ ID NO: 5112254 - DNA, 20 bp, Homo sapiens
aatatgactttttataaaat

SEQ ID NO: 5112255 - DNA, 13 bp, Homo sapiens
aatatgagaatgt

SEQ ID NO: 5112256 - DNA, 21 bp, Homo sapiens
aatatgagactattatgaaat

SEQ ID NO: 5112257 - DNA, 20 bp, Homo sapiens
aatatgaggggactgcatgc

SEQ ID NO: 5112258 - DNA, 22 bp, Homo sapiens
aatatgaggggactgcatgcaa

SEQ ID NO: 5112259 - DNA, 19 bp, Homo sapiens
aatatgagtacaaatgcct

SEQ ID NO: 5112260 - DNA, 21 bp, Homo sapiens
aatatgagtacaaatgcctta

SEQ ID NO: 5112261 - DNA, 15 bp, Homo sapiens
aatatgatatatatg

SEQ ID NO: 5112262 - DNA, 20 bp, Homo sapiens
aatatgatcaggtaactttc

SEQ ID NO: 5112263 - DNA, 16 bp, Homo sapiens
aatatgatcatgtaaa

SEQ ID NO: 5112264 - DNA, 15 bp, Homo sapiens
aatatgatctgtgga

SEQ ID NO: 5112265 - DNA, 13 bp, Homo sapiens
aatatgatcttga

SEQ ID NO: 5112266 - DNA, 19 bp, Homo sapiens
aatatgattagtaaagaaa

SEQ ID NO: 5112267 - DNA, 22 bp, Homo sapiens
aatatgattagtaaagaaatga

SEQ ID NO: 5112268 - DNA, 14 bp, Homo sapiens
aatatgattattaa

SEQ ID NO: 5112269 - DNA, 20 bp, Homo sapiens
aatatgattctcctctccca

SEQ ID NO: 5112270 - DNA, 20 bp, Homo sapiens
aatatgatttgcatttttta

SEQ ID NO: 5112271 - DNA, 12 bp, Homo sapiens
aatatgatttta

SEQ ID NO: 5112272 - DNA, 20 bp, Homo sapiens
aatatgattttttaaaagaa

SEQ ID NO: 5112273 - DNA, 17 bp, Homo sapiens
aatatgcaacattgtcc

SEQ ID NO: 5112274 - DNA, 14 bp, Homo sapiens
aatatgcaacctgt

SEQ ID NO: 5112275 - DNA, 17 bp, Homo sapiens
aatatgcaagcagcttt

SEQ ID NO: 5112276 - DNA, 18 bp, Homo sapiens
aatatgcaagcagctttt

SEQ ID NO: 5112277 - DNA, 21 bp, Homo sapiens
aatatgcaaggcggtacacta

SEQ ID NO: 5112278 - DNA, 16 bp, Homo sapiens
aatatgcacacatttt

SEQ ID NO: 5112279 - DNA, 17 bp, Homo sapiens
aatatgcactaagtctc

SEQ ID NO: 5112280 - DNA, 20 bp, Homo sapiens
aatatgcagttcctgtgcct

SEQ ID NO: 5112281 - DNA, 15 bp, Homo sapiens
aatatgcatatatat

SEQ ID NO: 5112282 - DNA, 19 bp, Homo sapiens
aatatgcatatatatgtat

SEQ ID NO: 5112283 - DNA, 15 bp, Homo sapiens
aatatgcatctttga

SEQ ID NO: 5112284 - DNA, 12 bp, Homo sapiens
aatatgcatgta

SEQ ID NO: 5112285 - DNA, 15 bp, Homo sapiens
aatatgccactgacc

SEQ ID NO: 5112286 - DNA, 18 bp, Homo sapiens
aatatgccagcttggaca

SEQ ID NO: 5112287 - DNA, 18 bp, Homo sapiens
aatatgccatctatgcag

SEQ ID NO: 5112288 - DNA, 15 bp, Homo sapiens
aatatgccatttata

SEQ ID NO: 5112289 - DNA, 20 bp, Homo sapiens
aatatgcctagtaacacata

SEQ ID NO: 5112290 - DNA, 16 bp, Homo sapiens
aatatgcctctccttt

SEQ ID NO: 5112291 - DNA, 23 bp, Homo sapiens
aatatgcctgcaatctgagccag

SEQ ID NO: 5112292 - DNA, 20 bp, Homo sapiens
aatatgccttaatttagaaa

SEQ ID NO: 5112293 - DNA, 21 bp, Homo sapiens
aatatgccttaatttagaaac

SEQ ID NO: 5112294 - DNA, 14 bp, Homo sapiens
aatatgctaatttg

SEQ ID NO: 5112295 - DNA, 21 bp, Homo sapiens
aatatgctgcaacaaaatgta

SEQ ID NO: 5112296 - DNA, 19 bp, Homo sapiens
aatatgctgccaaattttg

SEQ ID NO: 5112297 - DNA, 12 bp, Homo sapiens
aatatgctgtgg

SEQ ID NO: 5112298 - DNA, 22 bp, Homo sapiens
aatatgcttaaaataagcaggt

SEQ ID NO: 5112299 - DNA, 23 bp, Homo sapiens
aatatgcttaaaataagcaggtg

SEQ ID NO: 5112300 - DNA, 11 bp, Homo sapiens
aatatgcttac

SEQ ID NO: 5112301 - DNA, 18 bp, Homo sapiens
aatatggaaccttccctc

SEQ ID NO: 5112302 - DNA, 21 bp, Homo sapiens
aatatggaaccttccctccaa

SEQ ID NO: 5112303 - DNA, 14 bp, Homo sapiens
aatatggaacttac

SEQ ID NO: 5112304 - DNA, 15 bp, Homo sapiens
aatatggaacttaca

SEQ ID NO: 5112305 - DNA, 16 bp, Homo sapiens
aatatggaacttacat

SEQ ID NO: 5112306 - DNA, 17 bp, Homo sapiens
aatatggaacttacatt

SEQ ID NO: 5112307 - DNA, 17 bp, Homo sapiens
aatatggaagtaaaggc

SEQ ID NO: 5112308 - DNA, 17 bp, Homo sapiens
aatatggacacttaata

SEQ ID NO: 5112309 - DNA, 14 bp, Homo sapiens
aatatggacagtta

SEQ ID NO: 5112310 - DNA, 12 bp, Homo sapiens
aatatggactca

SEQ ID NO: 5112311 - DNA, 22 bp, Homo sapiens
aatatggcaatagcattgttct

SEQ ID NO: 5112312 - DNA, 18 bp, Homo sapiens
aatatggcctttcttcta

SEQ ID NO: 5112313 - DNA, 20 bp, Homo sapiens
aatatggctagttttcaact

SEQ ID NO: 5112314 - DNA, 15 bp, Homo sapiens
aatatggctataaat

SEQ ID NO: 5112315 - DNA, 16 bp, Homo sapiens
aatatggggatagtct

SEQ ID NO: 5112316 - DNA, 21 bp, Homo sapiens
aatatggggatagtctgggtc

SEQ ID NO: 5112317 - DNA, 17 bp, Homo sapiens
aatatggtggccctggg

SEQ ID NO: 5112318 - DNA, 20 bp, Homo sapiens
aatatggtggccctggggaa

SEQ ID NO: 5112319 - DNA, 18 bp, Homo sapiens
aatatggtgtacattctt

SEQ ID NO: 5112320 - DNA, 22 bp, Homo sapiens
aatatggttggagagccctgga

SEQ ID NO: 5112321 - DNA, 19 bp, Homo sapiens
aatatggttttgttttcaa

SEQ ID NO: 5112322 - DNA, 22 bp, Homo sapiens
aatatgtaatttcaaaatacat

SEQ ID NO: 5112323 - DNA, 15 bp, Homo sapiens
aatatgtacaaataa

SEQ ID NO: 5112324 - DNA, 16 bp, Homo sapiens
aatatgtacatttcta

SEQ ID NO: 5112325 - DNA, 17 bp, Homo sapiens
aatatgtacatttctca

SEQ ID NO: 5112326 - DNA, 19 bp, Homo sapiens
aatatgtacatttctcagg

SEQ ID NO: 5112327 - DNA, 15 bp, Homo sapiens
aatatgtaccaagaa

SEQ ID NO: 5112328 - DNA, 19 bp, Homo sapiens
aatatgtacttttccattt

SEQ ID NO: 5112329 - DNA, 15 bp, Homo sapiens
aatatgtataacttt

SEQ ID NO: 5112330 - DNA, 15 bp, Homo sapiens
aatatgtatcctcta

SEQ ID NO: 5112331 - DNA, 11 bp, Homo sapiens
aatatgtatgc

SEQ ID NO: 5112332 - DNA, 15 bp, Homo sapiens
aatatgtattgtaaa

SEQ ID NO: 5112333 - DNA, 11 bp, Homo sapiens
aatatgtattt

SEQ ID NO: 5112334 - DNA, 17 bp, Homo sapiens
aatatgtatttgttgaa

SEQ ID NO: 5112335 - DNA, 12 bp, Homo sapiens
aatatgtatttt

SEQ ID NO: 5112336 - DNA, 18 bp, Homo sapiens
aatatgtattttatgtat

SEQ ID NO: 5112337 - DNA, 16 bp, Homo sapiens
aatatgtattttccta

SEQ ID NO: 5112338 - DNA, 11 bp, Homo sapiens
aatatgtcagt

SEQ ID NO: 5112339 - DNA, 19 bp, Homo sapiens
aatatgtccatatctaacc

SEQ ID NO: 5112340 - DNA, 16 bp, Homo sapiens
aatatgtctgcaggtt

SEQ ID NO: 5112341 - DNA, 12 bp, Homo sapiens
aatatgtctttt

SEQ ID NO: 5112342 - DNA, 13 bp, Homo sapiens
aatatgtcttttt

SEQ ID NO: 5112343 - DNA, 21 bp, Homo sapiens
aatatgtgaaaggaacatttt

SEQ ID NO: 5112344 - DNA, 11 bp, Homo sapiens
aatatgtgaag

SEQ ID NO: 5112345 - DNA, 14 bp, Homo sapiens
aatatgtgaagaaa

SEQ ID NO: 5112346 - DNA, 15 bp, Homo sapiens
aatatgtgaagaaaa

SEQ ID NO: 5112347 - DNA, 21 bp, Homo sapiens
aatatgtgaaggaccttcact

SEQ ID NO: 5112348 - DNA, 17 bp, Homo sapiens
aatatgtgacattcctg

SEQ ID NO: 5112349 - DNA, 18 bp, Homo sapiens
aatatgtgagcatgaaac

SEQ ID NO: 5112350 - DNA, 13 bp, Homo sapiens
aatatgtgattat

SEQ ID NO: 5112351 - DNA, 19 bp, Homo sapiens
aatatgtgattttttttcc

SEQ ID NO: 5112352 - DNA, 14 bp, Homo sapiens
aatatgtgccttaa

SEQ ID NO: 5112353 - DNA, 15 bp, Homo sapiens
aatatgtgccttaag

SEQ ID NO: 5112354 - DNA, 19 bp, Homo sapiens
aatatgtgctgaacattgt

SEQ ID NO: 5112355 - DNA, 13 bp, Homo sapiens
aatatgtgtaact

SEQ ID NO: 5112356 - DNA, 14 bp, Homo sapiens
aatatgtgtaactt

SEQ ID NO: 5112357 - DNA, 17 bp, Homo sapiens
aatatgtgtacacatat

SEQ ID NO: 5112358 - DNA, 14 bp, Homo sapiens
aatatgtgtttact

SEQ ID NO: 5112359 - DNA, 12 bp, Homo sapiens
aatatgttagaa

SEQ ID NO: 5112360 - DNA, 14 bp, Homo sapiens
aatatgttcaatgc

SEQ ID NO: 5112361 - DNA, 22 bp, Homo sapiens
aatatgttgactttatttctga

SEQ ID NO: 5112362 - DNA, 20 bp, Homo sapiens
aatatgtttaaaataaaatg

SEQ ID NO: 5112363 - DNA, 15 bp, Homo sapiens
aatatgtttcacaca

SEQ ID NO: 5112364 - DNA, 15 bp, Homo sapiens
aatatgtttgaggtt

SEQ ID NO: 5112365 - DNA, 16 bp, Homo sapiens
aatatgtttgtgcctt

SEQ ID NO: 5112366 - DNA, 22 bp, Homo sapiens
aatatgttttattcagcttcta

SEQ ID NO: 5112367 - DNA, 21 bp, Homo sapiens
aatatgttttttagatcaaat

SEQ ID NO: 5112368 - DNA, 22 bp, Homo sapiens
aatatgttttttagatcaaata

SEQ ID NO: 5112369 - DNA, 11 bp, Homo sapiens
aatattaaaaa

SEQ ID NO: 5112370 - DNA, 17 bp, Homo sapiens
aatattaaaaagtcttt

SEQ ID NO: 5112371 - DNA, 15 bp, Homo sapiens
aatattaaaaattaa

SEQ ID NO: 5112372 - DNA, 20 bp, Homo sapiens
aatattaaaaattaattctt

SEQ ID NO: 5112373 - DNA, 12 bp, Homo sapiens
aatattaaaaga

SEQ ID NO: 5112374 - DNA, 12 bp, Homo sapiens
aatattaaaagt

SEQ ID NO: 5112375 - DNA, 19 bp, Homo sapiens
aatattaaaagtcacaatg

SEQ ID NO: 5112376 - DNA, 13 bp, Homo sapiens
aatattaaagatt

SEQ ID NO: 5112377 - DNA, 14 bp, Homo sapiens
aatattaaagccat

SEQ ID NO: 5112378 - DNA, 22 bp, Homo sapiens
aatattaaagccatgtttatta

SEQ ID NO: 5112379 - DNA, 14 bp, Homo sapiens
aatattaaatacag

SEQ ID NO: 5112380 - DNA, 17 bp, Homo sapiens
aatattaaatacagaca

SEQ ID NO: 5112381 - DNA, 21 bp, Homo sapiens
aatattaaatctgctggagtt

SEQ ID NO: 5112382 - DNA, 15 bp, Homo sapiens
aatattaacattctt

SEQ ID NO: 5112383 - DNA, 22 bp, Homo sapiens
aatattaacctaatcaccatgt

SEQ ID NO: 5112384 - DNA, 21 bp, Homo sapiens
aatattaactgacgaagaagc

SEQ ID NO: 5112385 - DNA, 19 bp, Homo sapiens
aatattaacttttaatggt

SEQ ID NO: 5112386 - DNA, 18 bp, Homo sapiens
aatattaagaaaatattc

SEQ ID NO: 5112387 - DNA, 15 bp, Homo sapiens
aatattaagaaacaa

SEQ ID NO: 5112388 - DNA, 18 bp, Homo sapiens
aatattaagaaacaattt

SEQ ID NO: 5112389 - DNA, 13 bp, Homo sapiens
aatattaagaaag

SEQ ID NO: 5112390 - DNA, 21 bp, Homo sapiens
aatattaagcatgacagaaaa

SEQ ID NO: 5112391 - DNA, 22 bp, Homo sapiens
aatattaaggtagttattcaca

SEQ ID NO: 5112392 - DNA, 17 bp, Homo sapiens
aatattaatatgtactt

SEQ ID NO: 5112393 - DNA, 15 bp, Homo sapiens
aatattaatgccttt

SEQ ID NO: 5112394 - DNA, 24 bp, Homo sapiens
aatattaattccaggaacacatgt

SEQ ID NO: 5112395 - DNA, 21 bp, Homo sapiens
aatattaatttatatttgtct

SEQ ID NO: 5112396 - DNA, 18 bp, Homo sapiens
aatattacatgtaaagct

SEQ ID NO: 5112397 - DNA, 20 bp, Homo sapiens
aatattacatgtaaagctgt

SEQ ID NO: 5112398 - DNA, 23 bp, Homo sapiens
aatattacatgtaaagctgttaa

SEQ ID NO: 5112399 - DNA, 16 bp, Homo sapiens
aatattacattgcatt

SEQ ID NO: 5112400 - DNA, 12 bp, Homo sapiens
aatattacattt

SEQ ID NO: 5112401 - DNA, 18 bp, Homo sapiens
aatattacatttcattta

SEQ ID NO: 5112402 - DNA, 14 bp, Homo sapiens
aatattacctaatg

SEQ ID NO: 5112403 - DNA, 18 bp, Homo sapiens
aatattacctaatgaaag

SEQ ID NO: 5112404 - DNA, 17 bp, Homo sapiens
aatattaccttaagatt

SEQ ID NO: 5112405 - DNA, 19 bp, Homo sapiens
aatattactttaacatgcc

SEQ ID NO: 5112406 - DNA, 20 bp, Homo sapiens
aatattactttgtcttttca

SEQ ID NO: 5112407 - DNA, 23 bp, Homo sapiens
aatattagatgctctgagaaatt

SEQ ID NO: 5112408 - DNA, 17 bp, Homo sapiens
aatattagatgtgattt

SEQ ID NO: 5112409 - DNA, 20 bp, Homo sapiens
aatattagatgtgatttaat

SEQ ID NO: 5112410 - DNA, 14 bp, Homo sapiens
aataatagactgta

SEQ ID NO: 5112411 - DNA, 23 bp, Homo sapiens
aataatagacttatatgcaggct

SEQ ID NO: 5112412 - DNA, 21 bp, Homo sapiens
aataatagctaataataaatg

SEQ ID NO: 5112413 - DNA, 22 bp, Homo sapiens
aataataggtagggggctttca

SEQ ID NO: 5112414 - DNA, 23 bp, Homo sapiens
aataataggtagggggctttcac

SEQ ID NO: 5112415 - DNA, 15 bp, Homo sapiens
aataatagtgtgtca

SEQ ID NO: 5112416 - DNA, 19 bp, Homo sapiens
aataatagttattatttaa

SEQ ID NO: 5112417 - DNA, 16 bp, Homo sapiens
aataatatacttgtgg

SEQ ID NO: 5112418 - DNA, 14 bp, Homo sapiens
aataatatatgttt

SEQ ID NO: 5112419 - DNA, 14 bp, Homo sapiens
aataatatcaaata

SEQ ID NO: 5112420 - DNA, 20 bp, Homo sapiens
aataatatccaggtcaacag

SEQ ID NO: 5112421 - DNA, 22 bp, Homo sapiens
aataatatccatacagtcaaga

SEQ ID NO: 5112422 - DNA, 15 bp, Homo sapiens
aataatatgcattgt

SEQ ID NO: 5112423 - DNA, 18 bp, Homo sapiens
aataatatgtacaaataa

SEQ ID NO: 5112424 - DNA, 21 bp, Homo sapiens
aataatatgtgatgattaata

SEQ ID NO: 5112425 - DNA, 17 bp, Homo sapiens
aataatattatattgta

SEQ ID NO: 5112426 - DNA, 15 bp, Homo sapiens
aataatattgatttc

SEQ ID NO: 5112427 - DNA, 22 bp, Homo sapiens
aataatattgtttttctttcta

SEQ ID NO: 5112428 - DNA, 18 bp, Homo sapiens
aataatatttcaagtgcc

SEQ ID NO: 5112429 - DNA, 21 bp, Homo sapiens
aataatattttagaaaatgtt

SEQ ID NO: 5112430 - DNA, 11 bp, Homo sapiens
aataatcaaga

SEQ ID NO: 5112431 - DNA, 14 bp, Homo sapiens
aataatcaagattt

SEQ ID NO: 5112432 - DNA, 15 bp, Homo sapiens
aataatcaagatttt

SEQ ID NO: 5112433 - DNA, 23 bp, Homo sapiens
aataatcatcgaggtatgtttat

SEQ ID NO: 5112434 - DNA, 15 bp, Homo sapiens
aataatcatgtgaaa

SEQ ID NO: 5112435 - DNA, 13 bp, Homo sapiens
aataatcattgga

SEQ ID NO: 5112436 - DNA, 19 bp, Homo sapiens
aataatccagtattgctga

SEQ ID NO: 5112437 - DNA, 23 bp, Homo sapiens
aataatccattttcactaaaagt

SEQ ID NO: 5112438 - DNA, 16 bp, Homo sapiens
aataatccctgtaata

SEQ ID NO: 5112439 - DNA, 16 bp, Homo sapiens
aataatcggcccacag

SEQ ID NO: 5112440 - DNA, 20 bp, Homo sapiens
aataatctcatccccccacc

SEQ ID NO: 5112441 - DNA, 21 bp, Homo sapiens
aataatctcatccccccaccc

SEQ ID NO: 5112442 - DNA, 14 bp, Homo sapiens
aataatctcattgg

SEQ ID NO: 5112443 - DNA, 21 bp, Homo sapiens
aataatctggtgttcttgcta

SEQ ID NO: 5112444 - DNA, 14 bp, Homo sapiens
aataatcttgtttc

SEQ ID NO: 5112445 - DNA, 15 bp, Homo sapiens
aataatgaagatctt

SEQ ID NO: 5112446 - DNA, 16 bp, Homo sapiens
aataatgaataaactg

SEQ ID NO: 5112447 - DNA, 13 bp, Homo sapiens
aataatgaataat

SEQ ID NO: 5112448 - DNA, 15 bp, Homo sapiens
aataatgactctaaa

SEQ ID NO: 5112449 - DNA, 16 bp, Homo sapiens
aataatgagagcaaat

SEQ ID NO: 5112450 - DNA, 19 bp, Homo sapiens
aataatgagagcaaatgca

SEQ ID NO: 5112451 - DNA, 16 bp, Homo sapiens
aataatgagctattaa

SEQ ID NO: 5112452 - DNA, 20 bp, Homo sapiens
aataatgagctattaaaact

SEQ ID NO: 5112453 - DNA, 16 bp, Homo sapiens
aataatgattcaatgt

SEQ ID NO: 5112454 - DNA, 19 bp, Homo sapiens
aataatgattcaatgtgaa

SEQ ID NO: 5112455 - DNA, 20 bp, Homo sapiens
aataatgattcaatgtgaat

SEQ ID NO: 5112456 - DNA, 14 bp, Homo sapiens
aataatgcaaatgt

SEQ ID NO: 5112457 - DNA, 17 bp, Homo sapiens
aataatgcagtatggta

SEQ ID NO: 5112458 - DNA, 22 bp, Homo sapiens
aataatgcagtatggtacattt

SEQ ID NO: 5112459 - DNA, 23 bp, Homo sapiens
aataatgcatccagcagtacaat

SEQ ID NO: 5112460 - DNA, 16 bp, Homo sapiens
aataatgccaatgaac

SEQ ID NO: 5112461 - DNA, 17 bp, Homo sapiens
aataatgcggacacttt

SEQ ID NO: 5112462 - DNA, 11 bp, Homo sapiens
aataatgctgc

SEQ ID NO: 5112463 - DNA, 14 bp, Homo sapiens
aataatgcttcaga

SEQ ID NO: 5112464 - DNA, 17 bp, Homo sapiens
aataatgcttttctaat

SEQ ID NO: 5112465 - DNA, 23 bp, Homo sapiens
aataatggaaaaaaaaaaaagag

SEQ ID NO: 5112466 - DNA, 17 bp, Homo sapiens
aataatggaaaaatagt

SEQ ID NO: 5112467 - DNA, 20 bp, Homo sapiens
aataatggaaacattacagt

SEQ ID NO: 5112468 - DNA, 12 bp, Homo sapiens
aataatggcact

SEQ ID NO: 5112469 - DNA, 19 bp, Homo sapiens
aataatggcactgaccggt

SEQ ID NO: 5112470 - DNA, 19 bp, Homo sapiens
aataatgggcttagagcag

SEQ ID NO: 5112471 - DNA, 20 bp, Homo sapiens
aataatggtaccagataaaa

SEQ ID NO: 5112472 - DNA, 23 bp, Homo sapiens
aataatggtaccagataaaatta

SEQ ID NO: 5112473 - DNA, 13 bp, Homo sapiens
aataatgtacaga

SEQ ID NO: 5112474 - DNA, 12 bp, Homo sapiens
aataatgtactc

SEQ ID NO: 5112475 - DNA, 14 bp, Homo sapiens
aataatgtactcac

SEQ ID NO: 5112476 - DNA, 19 bp, Homo sapiens
aataatgtactcacatata

SEQ ID NO: 5112477 - DNA, 24 bp, Homo sapiens
aataatgtagttttgtgatgcatt

SEQ ID NO: 5112478 - DNA, 17 bp, Homo sapiens
aataatgtagttttgtt

SEQ ID NO: 5112479 - DNA, 19 bp, Homo sapiens
aataatgtatgtacagctg

SEQ ID NO: 5112480 - DNA, 21 bp, Homo sapiens
aataatgtctagattttgaaa

SEQ ID NO: 5112481 - DNA, 20 bp, Homo sapiens
aataatgtcttgttaatatt

SEQ ID NO: 5112482 - DNA, 23 bp, Homo sapiens
aataatgtcttgttaatattctt

SEQ ID NO: 5112483 - DNA, 20 bp, Homo sapiens
aataatgtgcaaattttgca

SEQ ID NO: 5112484 - DNA, 21 bp, Homo sapiens
aataatgtgcaaattttgcat

SEQ ID NO: 5112485 - DNA, 14 bp, Homo sapiens
aataatgtgtagtt

SEQ ID NO: 5112486 - DNA, 13 bp, Homo sapiens
aataatgttgcct

SEQ ID NO: 5112487 - DNA, 14 bp, Homo sapiens
aataatgtttcaaa

SEQ ID NO: 5112488 - DNA, 15 bp, Homo sapiens
aataattaaatctct

SEQ ID NO: 5112489 - DNA, 16 bp, Homo sapiens
aataattaaatctctt

SEQ ID NO: 5112490 - DNA, 14 bp, Homo sapiens
aataattacttaat

SEQ ID NO: 5112491 - DNA, 21 bp, Homo sapiens
aataattaggatctatgcaat

SEQ ID NO: 5112492 - DNA, 20 bp, Homo sapiens
aataattatgagtttgctta

SEQ ID NO: 5112493 - DNA, 13 bp, Homo sapiens
aataattatttca

SEQ ID NO: 5112494 - DNA, 12 bp, Homo sapiens
aataattcatat

SEQ ID NO: 5112495 - DNA, 16 bp, Homo sapiens
aataattcatatctaa

SEQ ID NO: 5112496 - DNA, 15 bp, Homo sapiens
aataattcatattct

SEQ ID NO: 5112497 - DNA, 13 bp, Homo sapiens
aataattcatcaa

SEQ ID NO: 5112498 - DNA, 14 bp, Homo sapiens
aataattctaaatc

SEQ ID NO: 5112499 - DNA, 16 bp, Homo sapiens
aataattctgctttag

SEQ ID NO: 5112500 - DNA, 17 bp, Homo sapiens
aataattcttttctgag

SEQ ID NO: 5112501 - DNA, 14 bp, Homo sapiens
aataattctttttt

SEQ ID NO: 5112502 - DNA, 14 bp, Homo sapiens
aataattgaagaat

SEQ ID NO: 5112503 - DNA, 17 bp, Homo sapiens
aataattgaagtgttcc

SEQ ID NO: 5112504 - DNA, 17 bp, Homo sapiens
aataattgagactgaaa

SEQ ID NO: 5112505 - DNA, 21 bp, Homo sapiens
aataattgatcaaattcattt

SEQ ID NO: 5112506 - DNA, 16 bp, Homo sapiens
aataattgcagaacta

SEQ ID NO: 5112507 - DNA, 22 bp, Homo sapiens
aataattgccatagaaagtata

SEQ ID NO: 5112508 - DNA, 13 bp, Homo sapiens
aataattgtatct

SEQ ID NO: 5112509 - DNA, 14 bp, Homo sapiens
aataattgtatcta

SEQ ID NO: 5112510 - DNA, 23 bp, Homo sapiens
aataattgtatctacattaaaat

SEQ ID NO: 5112511 - DNA, 21 bp, Homo sapiens
aataattgtggttgtgttctt

SEQ ID NO: 5112512 - DNA, 12 bp, Homo sapiens
aataattgtgta

SEQ ID NO: 5112513 - DNA, 20 bp, Homo sapiens
aataattgtgtacaaagtag

SEQ ID NO: 5112514 - DNA, 12 bp, Homo sapiens
aataattgttgt

SEQ ID NO: 5112515 - DNA, 22 bp, Homo sapiens
aataatttaagccaataaataa

SEQ ID NO: 5112516 - DNA, 19 bp, Homo sapiens
aataatttaagttggctag

SEQ ID NO: 5112517 - DNA, 12 bp, Homo sapiens
aataatttagac

SEQ ID NO: 5112518 - DNA, 12 bp, Homo sapiens
aataatttagat

SEQ ID NO: 5112519 - DNA, 16 bp, Homo sapiens
aataatttagatattc

SEQ ID NO: 5112520 - DNA, 16 bp, Homo sapiens
aataatttatatgcat

SEQ ID NO: 5112521 - DNA, 21 bp, Homo sapiens
aataatttattattaaggtaa

SEQ ID NO: 5112522 - DNA, 18 bp, Homo sapiens
aataatttattttgctct

SEQ ID NO: 5112523 - DNA, 23 bp, Homo sapiens
aataatttcatactgaaattatt

SEQ ID NO: 5112524 - DNA, 13 bp, Homo sapiens
aataatttctaat

SEQ ID NO: 5112525 - DNA, 12 bp, Homo sapiens
aataatttctac

SEQ ID NO: 5112526 - DNA, 22 bp, Homo sapiens
aataatttctcctcatttaata

SEQ ID NO: 5112527 - DNA, 15 bp, Homo sapiens
aataatttctctaca

SEQ ID NO: 5112528 - DNA, 14 bp, Homo sapiens
aataatttctcttg

SEQ ID NO: 5112529 - DNA, 10 bp, Homo sapiens
aataatttga

SEQ ID NO: 5112530 - DNA, 14 bp, Homo sapiens
aataatttgaactt

SEQ ID NO: 5112531 - DNA, 15 bp, Homo sapiens
aataatttgaatgta

SEQ ID NO: 5112532 - DNA, 14 bp, Homo sapiens
aataatttgcactt

SEQ ID NO: 5112533 - DNA, 14 bp, Homo sapiens
aataatttgtaaat

SEQ ID NO: 5112534 - DNA, 15 bp, Homo sapiens
aataatttgtaaatg

SEQ ID NO: 5112535 - DNA, 16 bp, Homo sapiens
aataatttgtaaatga

SEQ ID NO: 5112536 - DNA, 17 bp, Homo sapiens
aataatttgtggtgatt

SEQ ID NO: 5112537 - DNA, 23 bp, Homo sapiens
aataatttgtgtctgtgtttaat

SEQ ID NO: 5112538 - DNA, 17 bp, Homo sapiens
aataatttgttgtactt

SEQ ID NO: 5112539 - DNA, 18 bp, Homo sapiens
aataatttgttgtacttt

SEQ ID NO: 5112540 - DNA, 12 bp, Homo sapiens
aataatttgttt

SEQ ID NO: 5112541 - DNA, 12 bp, Homo sapiens
aataattttaaa

SEQ ID NO: 5112542 - DNA, 13 bp, Homo sapiens
aataattttaaaa

SEQ ID NO: 5112543 - DNA, 20 bp, Homo sapiens
aataattttaaaagttggga

SEQ ID NO: 5112544 - DNA, 17 bp, Homo sapiens
aataattttaaataacc

SEQ ID NO: 5112545 - DNA, 13 bp, Homo sapiens
aataattttaaca

SEQ ID NO: 5112546 - DNA, 21 bp, Homo sapiens
aataattttaagaaatcaaag

SEQ ID NO: 5112547 - DNA, 12 bp, Homo sapiens
aataattttaca

SEQ ID NO: 5112548 - DNA, 14 bp, Homo sapiens
aataattttatctc

SEQ ID NO: 5112549 - DNA, 22 bp, Homo sapiens
aataattttatgaactgcatgt

SEQ ID NO: 5112550 - DNA, 21 bp, Homo sapiens
aataattttcaagcaaagtat

SEQ ID NO: 5112551 - DNA, 18 bp, Homo sapiens
aataattttcattttgca

SEQ ID NO: 5112552 - DNA, 12 bp, Homo sapiens
aataattttcca

SEQ ID NO: 5112553 - DNA, 22 bp, Homo sapiens
aataattttccaagtaaagtga

SEQ ID NO: 5112554 - DNA, 12 bp, Homo sapiens
aataattttcct

SEQ ID NO: 5112555 - DNA, 18 bp, Homo sapiens
aataattttcctgtgaca

SEQ ID NO: 5112556 - DNA, 14 bp, Homo sapiens
aataattttctaag

SEQ ID NO: 5112557 - DNA, 13 bp, Homo sapiens
aataattttggaa

SEQ ID NO: 5112558 - DNA, 15 bp, Homo sapiens
aataattttgtaatg

SEQ ID NO: 5112559 - DNA, 15 bp, Homo sapiens
aataattttgtttta

SEQ ID NO: 5112560 - DNA, 22 bp, Homo sapiens
aataatttttacctaatctcca

SEQ ID NO: 5112561 - DNA, 19 bp, Homo sapiens
aataatttttatatttgaa

SEQ ID NO: 5112562 - DNA, 17 bp, Homo sapiens
aataatttttcttacac

SEQ ID NO: 5112563 - DNA, 21 bp, Homo sapiens
aataatttttgctgaattcct

SEQ ID NO: 5112564 - DNA, 20 bp, Homo sapiens
aataattttttagttaaaat

SEQ ID NO: 5112565 - DNA, 21 bp, Homo sapiens
aataattttttagttaaaatc

SEQ ID NO: 5112566 - DNA, 16 bp, Homo sapiens
aataattttttgcagt

SEQ ID NO: 5112567 - DNA, 22 bp, Homo sapiens
aataattttttgcagtcttttg

SEQ ID NO: 5112568 - DNA, 21 bp, Homo sapiens
aatacaaaaaattagccgagc

SEQ ID NO: 5112569 - DNA, 21 bp, Homo sapiens
aatacaaaaaattagccgggc

SEQ ID NO: 5112570 - DNA, 16 bp, Homo sapiens
aatacaaaaacttaga

SEQ ID NO: 5112571 - DNA, 19 bp, Homo sapiens
aatacaaaaagcaaaacaa

SEQ ID NO: 5112572 - DNA, 15 bp, Homo sapiens
aatacaaaaagccaa

SEQ ID NO: 5112573 - DNA, 18 bp, Homo sapiens
aatacaaaaatcagccag

SEQ ID NO: 5112574 - DNA, 17 bp, Homo sapiens
aatacaaacacctggac

SEQ ID NO: 5112575 - DNA, 21 bp, Homo sapiens
aatacaaacatatttgttaaa

SEQ ID NO: 5112576 - DNA, 15 bp, Homo sapiens
aatacaaacatttca

SEQ ID NO: 5112577 - DNA, 13 bp, Homo sapiens
aatacaaagatga

SEQ ID NO: 5112578 - DNA, 15 bp, Homo sapiens
aatacaaaggttcca

SEQ ID NO: 5112579 - DNA, 11 bp, Homo sapiens
aatacaaagta

SEQ ID NO: 5112580 - DNA, 14 bp, Homo sapiens
aatacaaagtaaat

SEQ ID NO: 5112581 - DNA, 18 bp, Homo sapiens
aatacaaagtggaaactt

SEQ ID NO: 5112582 - DNA, 13 bp, Homo sapiens
aatacaaatgtta

SEQ ID NO: 5112583 - DNA, 15 bp, Homo sapiens
aatacaaattggttg

SEQ ID NO: 5112584 - DNA, 22 bp, Homo sapiens
aatacaaattttgtataacttt

SEQ ID NO: 5112585 - DNA, 19 bp, Homo sapiens
aatacaacaacaacaaaaa

SEQ ID NO: 5112586 - DNA, 22 bp, Homo sapiens
aatacaacatgtagctgagttt

SEQ ID NO: 5112587 - DNA, 13 bp, Homo sapiens
aatacaaccagcc

SEQ ID NO: 5112588 - DNA, 13 bp, Homo sapiens
aatacaactttac

SEQ ID NO: 5112589 - DNA, 13 bp, Homo sapiens
aatacaagacaaa

SEQ ID NO: 5112590 - DNA, 17 bp, Homo sapiens
aatattagccaaagagg

SEQ ID NO: 5112591 - DNA, 22 bp, Homo sapiens
aatattaggcttaaaaactgaa

SEQ ID NO: 5112592 - DNA, 23 bp, Homo sapiens
aatattaggcttaaaaactgaaa

SEQ ID NO: 5112593 - DNA, 21 bp, Homo sapiens
aatattagtgacctcagcttt

SEQ ID NO: 5112594 - DNA, 17 bp, Homo sapiens
aatattagtgattctga

SEQ ID NO: 5112595 - DNA, 22 bp, Homo sapiens
aatattagtgattctgatttca

SEQ ID NO: 5112596 - DNA, 16 bp, Homo sapiens
aatattagttggcttt

SEQ ID NO: 5112597 - DNA, 22 bp, Homo sapiens
aatattataactcatttgttgt

SEQ ID NO: 5112598 - DNA, 22 bp, Homo sapiens
aatattatactaagaaaagata

SEQ ID NO: 5112599 - DNA, 18 bp, Homo sapiens
aatattatacttctttat

SEQ ID NO: 5112600 - DNA, 23 bp, Homo sapiens
aatattatataacccactgctga

SEQ ID NO: 5112601 - DNA, 21 bp, Homo sapiens
aatattatataggatattgct

SEQ ID NO: 5112602 - DNA, 13 bp, Homo sapiens
aatattatattgt

SEQ ID NO: 5112603 - DNA, 21 bp, Homo sapiens
aatattatattgtatttaacc

SEQ ID NO: 5112604 - DNA, 13 bp, Homo sapiens
aatattatatttg

SEQ ID NO: 5112605 - DNA, 19 bp, Homo sapiens
aatattatatttggatgca

SEQ ID NO: 5112606 - DNA, 20 bp, Homo sapiens
aatattatattttttctata

SEQ ID NO: 5112607 - DNA, 14 bp, Homo sapiens
aatattatcatttc

SEQ ID NO: 5112608 - DNA, 16 bp, Homo sapiens
aatattatgagatgct

SEQ ID NO: 5112609 - DNA, 20 bp, Homo sapiens
aatattatgcaaattcccag

SEQ ID NO: 5112610 - DNA, 21 bp, Homo sapiens
aatattatgcaaattcccaga

SEQ ID NO: 5112611 - DNA, 16 bp, Homo sapiens
aatattatgctgcttt

SEQ ID NO: 5112612 - DNA, 17 bp, Homo sapiens
aatattattactttatg

SEQ ID NO: 5112613 - DNA, 16 bp, Homo sapiens
aatattattcaagtgc

SEQ ID NO: 5112614 - DNA, 12 bp, Homo sapiens
aatattattggg

SEQ ID NO: 5112615 - DNA, 13 bp, Homo sapiens
aatattattgggg

SEQ ID NO: 5112616 - DNA, 16 bp, Homo sapiens
aatattatttgatatc

SEQ ID NO: 5112617 - DNA, 17 bp, Homo sapiens
aatattatttgatatct

SEQ ID NO: 5112618 - DNA, 16 bp, Homo sapiens
aatattatttttatgc

SEQ ID NO: 5112619 - DNA, 20 bp, Homo sapiens
aatattcaaaatggtttttg

SEQ ID NO: 5112620 - DNA, 15 bp, Homo sapiens
aatattcaagtaaca

SEQ ID NO: 5112621 - DNA, 14 bp, Homo sapiens
aatattcacatgtt

SEQ ID NO: 5112622 - DNA, 13 bp, Homo sapiens
aatattcactctc

SEQ ID NO: 5112623 - DNA, 17 bp, Homo sapiens
aatattcactgggccaa

SEQ ID NO: 5112624 - DNA, 17 bp, Homo sapiens
aatattcagagaaaact

SEQ ID NO: 5112625 - DNA, 19 bp, Homo sapiens
aatattcagccagcttaaa

SEQ ID NO: 5112626 - DNA, 21 bp, Homo sapiens
aatattcagccagcttaaacc

SEQ ID NO: 5112627 - DNA, 20 bp, Homo sapiens
aatattcagggtaaatagga

SEQ ID NO: 5112628 - DNA, 15 bp, Homo sapiens
aatattcagtcctgt

SEQ ID NO: 5112629 - DNA, 21 bp, Homo sapiens
aatattcagtggtgaaatctt

SEQ ID NO: 5112630 - DNA, 17 bp, Homo sapiens
aatattcatacaacaaa

SEQ ID NO: 5112631 - DNA, 18 bp, Homo sapiens
aatattcatagtttaatt

SEQ ID NO: 5112632 - DNA, 13 bp, Homo sapiens
aatattcatatta

SEQ ID NO: 5112633 - DNA, 15 bp, Homo sapiens
aatattcatgaagag

SEQ ID NO: 5112634 - DNA, 19 bp, Homo sapiens
aatattcatgcttgccatc

SEQ ID NO: 5112635 - DNA, 11 bp, Homo sapiens
aatattcatgg

SEQ ID NO: 5112636 - DNA, 19 bp, Homo sapiens
aatattcatggatggctca

SEQ ID NO: 5112637 - DNA, 16 bp, Homo sapiens
aatattcattggttaa

SEQ ID NO: 5112638 - DNA, 13 bp, Homo sapiens
aatattccagaag

SEQ ID NO: 5112639 - DNA, 16 bp, Homo sapiens
aatattccagatcttt

SEQ ID NO: 5112640 - DNA, 23 bp, Homo sapiens
aatattccagatctttcagaaat

SEQ ID NO: 5112641 - DNA, 20 bp, Homo sapiens
aatattcccctatctctaga

SEQ ID NO: 5112642 - DNA, 17 bp, Homo sapiens
aatattccctagaaact

SEQ ID NO: 5112643 - DNA, 23 bp, Homo sapiens
aatattcctacttgcagtacatc

SEQ ID NO: 5112644 - DNA, 13 bp, Homo sapiens
aatattcctttat

SEQ ID NO: 5112645 - DNA, 21 bp, Homo sapiens
aatattcctttgcatattata

SEQ ID NO: 5112646 - DNA, 13 bp, Homo sapiens
aatattctaaaaa

SEQ ID NO: 5112647 - DNA, 22 bp, Homo sapiens
aatattctacacatatcttgtt

SEQ ID NO: 5112648 - DNA, 19 bp, Homo sapiens
aatattctacacatgtaaa

SEQ ID NO: 5112649 - DNA, 21 bp, Homo sapiens
aatattctactggcctgtaat

SEQ ID NO: 5112650 - DNA, 16 bp, Homo sapiens
aatattctatgaccac

SEQ ID NO: 5112651 - DNA, 12 bp, Homo sapiens
aatattctctct

SEQ ID NO: 5112652 - DNA, 14 bp, Homo sapiens
aatattctctgtac

SEQ ID NO: 5112653 - DNA, 15 bp, Homo sapiens
aatattctctgtaca

SEQ ID NO: 5112654 - DNA, 18 bp, Homo sapiens
aatattctctgtacatat

SEQ ID NO: 5112655 - DNA, 15 bp, Homo sapiens
aatattctgtaagaa

SEQ ID NO: 5112656 - DNA, 19 bp, Homo sapiens
aatattcttgactccttgg

SEQ ID NO: 5112657 - DNA, 20 bp, Homo sapiens
aatattcttgtccacattct

SEQ ID NO: 5112658 - DNA, 21 bp, Homo sapiens
aatattcttttgtttccatgg

SEQ ID NO: 5112659 - DNA, 18 bp, Homo sapiens
aatattgaaaatgtcact

SEQ ID NO: 5112660 - DNA, 19 bp, Homo sapiens
aatattgaaaatgtcactg

SEQ ID NO: 5112661 - DNA, 21 bp, Homo sapiens
aatattgaaaatgtcactgtt

SEQ ID NO: 5112662 - DNA, 13 bp, Homo sapiens
aatattgaaaatt

SEQ ID NO: 5112663 - DNA, 14 bp, Homo sapiens
aatattgaaaattg

SEQ ID NO: 5112664 - DNA, 21 bp, Homo sapiens
aatattgaaaattgaaaagta

SEQ ID NO: 5112665 - DNA, 19 bp, Homo sapiens
aatattgaaacactgtaca

SEQ ID NO: 5112666 - DNA, 20 bp, Homo sapiens
aatattgaaaggcaaacatt

SEQ ID NO: 5112667 - DNA, 20 bp, Homo sapiens
aatattgaactcaatgatag

SEQ ID NO: 5112668 - DNA, 16 bp, Homo sapiens
aatattgaagttgttt

SEQ ID NO: 5112669 - DNA, 14 bp, Homo sapiens
aatattgaatgttt

SEQ ID NO: 5112670 - DNA, 15 bp, Homo sapiens
aatattgacatttgt

SEQ ID NO: 5112671 - DNA, 20 bp, Homo sapiens
aatattgacatttgtagttg

SEQ ID NO: 5112672 - DNA, 14 bp, Homo sapiens
aatattgacttgta

SEQ ID NO: 5112673 - DNA, 16 bp, Homo sapiens
aatattgagaaagaaa

SEQ ID NO: 5112674 - DNA, 19 bp, Homo sapiens
aatattgagaaagaaacta

SEQ ID NO: 5112675 - DNA, 15 bp, Homo sapiens
aatattgagaatcag

SEQ ID NO: 5112676 - DNA, 18 bp, Homo sapiens
aatattgagcaatatgtc

SEQ ID NO: 5112677 - DNA, 19 bp, Homo sapiens
aatattgaggctgcagcag

SEQ ID NO: 5112678 - DNA, 14 bp, Homo sapiens
aatattgaggcttt

SEQ ID NO: 5112679 - DNA, 19 bp, Homo sapiens
aatattgatgtcagtattt

SEQ ID NO: 5112680 - DNA, 21 bp, Homo sapiens
aatattgatgttaacaagagg

SEQ ID NO: 5112681 - DNA, 21 bp, Homo sapiens
aatattgattgggaaaacatt

SEQ ID NO: 5112682 - DNA, 23 bp, Homo sapiens
aatattgattgggaaaacatttg

SEQ ID NO: 5112683 - DNA, 20 bp, Homo sapiens
aatattgatttctgccttcc

SEQ ID NO: 5112684 - DNA, 17 bp, Homo sapiens
aatattgcaaaatacat

SEQ ID NO: 5112685 - DNA, 12 bp, Homo sapiens
aatattgcagtt

SEQ ID NO: 5112686 - DNA, 22 bp, Homo sapiens
aatattgcagttcatactgaat

SEQ ID NO: 5112687 - DNA, 12 bp, Homo sapiens
aatattgccttg

SEQ ID NO: 5112688 - DNA, 14 bp, Homo sapiens
aatattgccttgat

SEQ ID NO: 5112689 - DNA, 21 bp, Homo sapiens
aatattgctaaaagcatgtat

SEQ ID NO: 5112690 - DNA, 18 bp, Homo sapiens
aatattgctctaattctt

SEQ ID NO: 5112691 - DNA, 22 bp, Homo sapiens
aatattgctctaattcttttca

SEQ ID NO: 5112692 - DNA, 23 bp, Homo sapiens
aatattgctgtgtcttcattttc

SEQ ID NO: 5112693 - DNA, 17 bp, Homo sapiens
aatattgcttggactac

SEQ ID NO: 5112694 - DNA, 15 bp, Homo sapiens
aatattggtatgtaa

SEQ ID NO: 5112695 - DNA, 18 bp, Homo sapiens
aatattggtattaaagaa

SEQ ID NO: 5112696 - DNA, 23 bp, Homo sapiens
aatattggtgctatttaacattt

SEQ ID NO: 5112697 - DNA, 22 bp, Homo sapiens
aatattggtgtactgtaatgtg

SEQ ID NO: 5112698 - DNA, 15 bp, Homo sapiens
aatattggttgggat

SEQ ID NO: 5112699 - DNA, 10 bp, Homo sapiens
aatattgtaa

SEQ ID NO: 5112700 - DNA, 12 bp, Homo sapiens
aatattgtaata

SEQ ID NO: 5112701 - DNA, 20 bp, Homo sapiens
aatattgtaatatgacagat

SEQ ID NO: 5112702 - DNA, 21 bp, Homo sapiens
aatattgtaatatgacagata

SEQ ID NO: 5112703 - DNA, 17 bp, Homo sapiens
aatattgtattgctgct

SEQ ID NO: 5112704 - DNA, 19 bp, Homo sapiens
aatattgtcacaacactga

SEQ ID NO: 5112705 - DNA, 20 bp, Homo sapiens
aatattgtcatctttttcta

SEQ ID NO: 5112706 - DNA, 21 bp, Homo sapiens
aatattgtcatctttttctag

SEQ ID NO: 5112707 - DNA, 16 bp, Homo sapiens
aatattgtctgtctct

SEQ ID NO: 5112708 - DNA, 13 bp, Homo sapiens
aatattgtctttt

SEQ ID NO: 5112709 - DNA, 23 bp, Homo sapiens
aatattgtgaagaaaaataaagt

SEQ ID NO: 5112710 - DNA, 22 bp, Homo sapiens
aatattgtgcatgctagtgttg

SEQ ID NO: 5112711 - DNA, 15 bp, Homo sapiens
aatattgtggctccc

SEQ ID NO: 5112712 - DNA, 12 bp, Homo sapiens
aatattgttaaa

SEQ ID NO: 5112713 - DNA, 19 bp, Homo sapiens
aatattgttaccatgaaga

SEQ ID NO: 5112714 - DNA, 20 bp, Homo sapiens
aatattgttcctaagttctt

SEQ ID NO: 5112715 - DNA, 16 bp, Homo sapiens
aatattgttgacaact

SEQ ID NO: 5112716 - DNA, 18 bp, Homo sapiens
aatattgttgtataattt

SEQ ID NO: 5112717 - DNA, 13 bp, Homo sapiens
aatattgtttcta

SEQ ID NO: 5112718 - DNA, 15 bp, Homo sapiens
aatattgtttctgca

SEQ ID NO: 5112719 - DNA, 20 bp, Homo sapiens
aatattgtttggtaaatgtt

SEQ ID NO: 5112720 - DNA, 21 bp, Homo sapiens
aatattgtttggtaaatgttt

SEQ ID NO: 5112721 - DNA, 17 bp, Homo sapiens
aatattgttttacaata

SEQ ID NO: 5112722 - DNA, 24 bp, Homo sapiens
aatatttaaaaaaaaacattcaaa

SEQ ID NO: 5112723 - DNA, 13 bp, Homo sapiens
aatatttaaaata

SEQ ID NO: 5112724 - DNA, 12 bp, Homo sapiens
aatatttaaaca

SEQ ID NO: 5112725 - DNA, 22 bp, Homo sapiens
aatatttaaacatggttacaat

SEQ ID NO: 5112726 - DNA, 20 bp, Homo sapiens
aatatttaaagattatagct

SEQ ID NO: 5112727 - DNA, 18 bp, Homo sapiens
aatatttaacctcttttt

SEQ ID NO: 5112728 - DNA, 15 bp, Homo sapiens
aatatttaacttttt

SEQ ID NO: 5112729 - DNA, 13 bp, Homo sapiens
aatatttaagaaa

SEQ ID NO: 5112730 - DNA, 12 bp, Homo sapiens
aatatttaagac

SEQ ID NO: 5112731 - DNA, 12 bp, Homo sapiens
aatatttaagca

SEQ ID NO: 5112732 - DNA, 20 bp, Homo sapiens
aatatttaagcaataaaact

SEQ ID NO: 5112733 - DNA, 19 bp, Homo sapiens
aatatttaagtatatagta

SEQ ID NO: 5112734 - DNA, 20 bp, Homo sapiens
aatatttaagtatatagtat

SEQ ID NO: 5112735 - DNA, 17 bp, Homo sapiens
aatatttaagtgaagga

SEQ ID NO: 5112736 - DNA, 13 bp, Homo sapiens
aatatttaatctt

SEQ ID NO: 5112737 - DNA, 19 bp, Homo sapiens
aatatttaatgatgtgtca

SEQ ID NO: 5112738 - DNA, 15 bp, Homo sapiens
aatatttaatgttga

SEQ ID NO: 5112739 - DNA, 15 bp, Homo sapiens
aatatttaccaaagt

SEQ ID NO: 5112740 - DNA, 17 bp, Homo sapiens
aatatttaccttgaaaa

SEQ ID NO: 5112741 - DNA, 13 bp, Homo sapiens
aatatttactctt

SEQ ID NO: 5112742 - DNA, 14 bp, Homo sapiens
aatatttactgtta

SEQ ID NO: 5112743 - DNA, 13 bp, Homo sapiens
aatatttagaaaa

SEQ ID NO: 5112744 - DNA, 21 bp, Homo sapiens
aatatttagcataaatttaat

SEQ ID NO: 5112745 - DNA, 16 bp, Homo sapiens
aatatttagctgtaaa

SEQ ID NO: 5112746 - DNA, 12 bp, Homo sapiens
aatatttagtgt

SEQ ID NO: 5112747 - DNA, 11 bp, Homo sapiens
aatatttataa

SEQ ID NO: 5112748 - DNA, 16 bp, Homo sapiens
aatatttataaaactt

SEQ ID NO: 5112749 - DNA, 19 bp, Homo sapiens
aatatttataaaacttctc

SEQ ID NO: 5112750 - DNA, 22 bp, Homo sapiens
aatatttataaagaatgtttct

SEQ ID NO: 5112751 - DNA, 19 bp, Homo sapiens
aatatttataaatgaagat

SEQ ID NO: 5112752 - DNA, 13 bp, Homo sapiens
aatatttatagag

SEQ ID NO: 5112753 - DNA, 21 bp, Homo sapiens
aatatttatagagttcataga

SEQ ID NO: 5112754 - DNA, 23 bp, Homo sapiens
aatatttatagagttcatagaaa

SEQ ID NO: 5112755 - DNA, 15 bp, Homo sapiens
aatatttatagggct

SEQ ID NO: 5112756 - DNA, 17 bp, Homo sapiens
aatatttatatttcact

SEQ ID NO: 5112757 - DNA, 15 bp, Homo sapiens
aatatttatgtaaac

SEQ ID NO: 5112758 - DNA, 21 bp, Homo sapiens
aatatttatgtctatttaagc

SEQ ID NO: 5112759 - DNA, 12 bp, Homo sapiens
aatatttatgtt

SEQ ID NO: 5112760 - DNA, 11 bp, Homo sapiens
aatatttatta

SEQ ID NO: 5112761 - DNA, 12 bp, Homo sapiens
aatatttattaa

SEQ ID NO: 5112762 - DNA, 17 bp, Homo sapiens
aatatttattaaataaa

SEQ ID NO: 5112763 - DNA, 18 bp, Homo sapiens
aatatttattaaataaaa

SEQ ID NO: 5112764 - DNA, 22 bp, Homo sapiens
aatatttattaaataaaatcaa

SEQ ID NO: 5112765 - DNA, 15 bp, Homo sapiens
aatatttattacctc

SEQ ID NO: 5112766 - DNA, 22 bp, Homo sapiens
aatatttattcattatttgtca

SEQ ID NO: 5112767 - DNA, 16 bp, Homo sapiens
aatatttattgcttta

SEQ ID NO: 5112768 - DNA, 17 bp, Homo sapiens
aatatttattgctttat

SEQ ID NO: 5112769 - DNA, 20 bp, Homo sapiens
aatacaagactgttgtgatc

SEQ ID NO: 5112770 - DNA, 15 bp, Homo sapiens
aatacaagatacttt

SEQ ID NO: 5112771 - DNA, 22 bp, Homo sapiens
aatacaagatattatgtataaa

SEQ ID NO: 5112772 - DNA, 22 bp, Homo sapiens
aatacaagttacatacatttaa

SEQ ID NO: 5112773 - DNA, 16 bp, Homo sapiens
aatacaagttctattt

SEQ ID NO: 5112774 - DNA, 23 bp, Homo sapiens
aatacaagttctatttaagtgta

SEQ ID NO: 5112775 - DNA, 18 bp, Homo sapiens
aatacaagtttgaacagg

SEQ ID NO: 5112776 - DNA, 19 bp, Homo sapiens
aatacaagtttgaacaggc

SEQ ID NO: 5112777 - DNA, 11 bp, Homo sapiens
aatacaataaa

SEQ ID NO: 5112778 - DNA, 19 bp, Homo sapiens
aatacaatagtatgcagct

SEQ ID NO: 5112779 - DNA, 14 bp, Homo sapiens
aatacaatattaat

SEQ ID NO: 5112780 - DNA, 18 bp, Homo sapiens
aatacaatgtacaattat

SEQ ID NO: 5112781 - DNA, 13 bp, Homo sapiens
aatacaattaaag

SEQ ID NO: 5112782 - DNA, 15 bp, Homo sapiens
aatacaattattgta

SEQ ID NO: 5112783 - DNA, 13 bp, Homo sapiens
aatacaattcaaa

SEQ ID NO: 5112784 - DNA, 12 bp, Homo sapiens
aatacaattttg

SEQ ID NO: 5112785 - DNA, 17 bp, Homo sapiens
aatacaattttgtttct

SEQ ID NO: 5112786 - DNA, 22 bp, Homo sapiens
aatacaattttgtttctgtact

SEQ ID NO: 5112787 - DNA, 18 bp, Homo sapiens
aatacaatttttatttct

SEQ ID NO: 5112788 - DNA, 16 bp, Homo sapiens
aatacacaaaatcaaa

SEQ ID NO: 5112789 - DNA, 14 bp, Homo sapiens
aatacacaaatttc

SEQ ID NO: 5112790 - DNA, 15 bp, Homo sapiens
aatacacaagtaaac

SEQ ID NO: 5112791 - DNA, 19 bp, Homo sapiens
aatacacagcatgcagact

SEQ ID NO: 5112792 - DNA, 13 bp, Homo sapiens
aatacacagtact

SEQ ID NO: 5112793 - DNA, 18 bp, Homo sapiens
aatacacatataaaaaca

SEQ ID NO: 5112794 - DNA, 16 bp, Homo sapiens
aatacaccactacatt

SEQ ID NO: 5112795 - DNA, 21 bp, Homo sapiens
aatacaccactacattctgtt

SEQ ID NO: 5112796 - DNA, 21 bp, Homo sapiens
aatacacgcgtgtgctcctct

SEQ ID NO: 5112797 - DNA, 17 bp, Homo sapiens
aatacacgtgtatatga

SEQ ID NO: 5112798 - DNA, 20 bp, Homo sapiens
aatacacgtgtatatgagga

SEQ ID NO: 5112799 - DNA, 20 bp, Homo sapiens
aatacacttcttttgaacat

SEQ ID NO: 5112800 - DNA, 17 bp, Homo sapiens
aatacacttgccctgct

SEQ ID NO: 5112801 - DNA, 17 bp, Homo sapiens
aatacagaagaaaataa

SEQ ID NO: 5112802 - DNA, 15 bp, Homo sapiens
aatacagacactaag

SEQ ID NO: 5112803 - DNA, 21 bp, Homo sapiens
aatacagacactaagttatag

SEQ ID NO: 5112804 - DNA, 13 bp, Homo sapiens
aatacagaggcaa

SEQ ID NO: 5112805 - DNA, 18 bp, Homo sapiens
aatacagataaatgattc

SEQ ID NO: 5112806 - DNA, 19 bp, Homo sapiens
aatacagataattcatttg

SEQ ID NO: 5112807 - DNA, 19 bp, Homo sapiens
aatacagattttgatagca

SEQ ID NO: 5112808 - DNA, 18 bp, Homo sapiens
aatacagcaacaatttat

SEQ ID NO: 5112809 - DNA, 14 bp, Homo sapiens
aatacagcagcaag

SEQ ID NO: 5112810 - DNA, 21 bp, Homo sapiens
aatacagcagcaagaaaaaaa

SEQ ID NO: 5112811 - DNA, 17 bp, Homo sapiens
aatacagcatacttcaa

SEQ ID NO: 5112812 - DNA, 20 bp, Homo sapiens
aatacagcctgaataaacca

SEQ ID NO: 5112813 - DNA, 23 bp, Homo sapiens
aatacagcctgaataaaccaaga

SEQ ID NO: 5112814 - DNA, 14 bp, Homo sapiens
aatacagctttctg

SEQ ID NO: 5112815 - DNA, 19 bp, Homo sapiens
aatacagctttctgacctt

SEQ ID NO: 5112816 - DNA, 23 bp, Homo sapiens
aatacagggcatgcattttgcag

SEQ ID NO: 5112817 - DNA, 16 bp, Homo sapiens
aatacagggcattttg

SEQ ID NO: 5112818 - DNA, 23 bp, Homo sapiens
aatacaggtaacattataaatga

SEQ ID NO: 5112819 - DNA, 17 bp, Homo sapiens
aatacaggtttttttga

SEQ ID NO: 5112820 - DNA, 19 bp, Homo sapiens
aatacagtaaagtttaaaa

SEQ ID NO: 5112821 - DNA, 21 bp, Homo sapiens
aatacagtaaagtttaaaaaa

SEQ ID NO: 5112822 - DNA, 17 bp, Homo sapiens
aatacagtaagcatagt

SEQ ID NO: 5112823 - DNA, 21 bp, Homo sapiens
aatacagtaagctgctctatt

SEQ ID NO: 5112824 - DNA, 17 bp, Homo sapiens
aatacagtacaggcagc

SEQ ID NO: 5112825 - DNA, 18 bp, Homo sapiens
aatacagtacaggcagca

SEQ ID NO: 5112826 - DNA, 16 bp, Homo sapiens
aatacagtagtataat

SEQ ID NO: 5112827 - DNA, 23 bp, Homo sapiens
aatacagtattatagacaaaaga

SEQ ID NO: 5112828 - DNA, 20 bp, Homo sapiens
aatacagtattatttagtaa

SEQ ID NO: 5112829 - DNA, 16 bp, Homo sapiens
aatacagtatttcttt

SEQ ID NO: 5112830 - DNA, 24 bp, Homo sapiens
aatacagtatttctttgttataca

SEQ ID NO: 5112831 - DNA, 21 bp, Homo sapiens
aatacagtcttccacaaagaa

SEQ ID NO: 5112832 - DNA, 13 bp, Homo sapiens
aatacagtgcttt

SEQ ID NO: 5112833 - DNA, 16 bp, Homo sapiens
aatacagtgctttatg

SEQ ID NO: 5112834 - DNA, 16 bp, Homo sapiens
aatacagttacttaat

SEQ ID NO: 5112835 - DNA, 17 bp, Homo sapiens
aatacagttctgtcata

SEQ ID NO: 5112836 - DNA, 23 bp, Homo sapiens
aatacagtttataaagccaagaa

SEQ ID NO: 5112837 - DNA, 19 bp, Homo sapiens
aatacagtttgtcacatga

SEQ ID NO: 5112838 - DNA, 18 bp, Homo sapiens
aatacataaaagaatgta

SEQ ID NO: 5112839 - DNA, 19 bp, Homo sapiens
aatacataaaagaatgtac

SEQ ID NO: 5112840 - DNA, 17 bp, Homo sapiens
aatacataaataaaaga

SEQ ID NO: 5112841 - DNA, 21 bp, Homo sapiens
aatacataaatagtagaaaaa

SEQ ID NO: 5112842 - DNA, 22 bp, Homo sapiens
aatacataaatagtagaaaaat

SEQ ID NO: 5112843 - DNA, 19 bp, Homo sapiens
aatacatacaacctatgta

SEQ ID NO: 5112844 - DNA, 23 bp, Homo sapiens
aatacatacggtcaggtttaaca

SEQ ID NO: 5112845 - DNA, 13 bp, Homo sapiens
aatacatactaat

SEQ ID NO: 5112846 - DNA, 16 bp, Homo sapiens
aatacatagcattaaa

SEQ ID NO: 5112847 - DNA, 19 bp, Homo sapiens
aatacatagggatatgcgt

SEQ ID NO: 5112848 - DNA, 14 bp, Homo sapiens
aatacatattccat

SEQ ID NO: 5112849 - DNA, 13 bp, Homo sapiens
aatacatcaaaaa

SEQ ID NO: 5112850 - DNA, 11 bp, Homo sapiens
aatacatcaca

SEQ ID NO: 5112851 - DNA, 15 bp, Homo sapiens
aatacatcacatctt

SEQ ID NO: 5112852 - DNA, 20 bp, Homo sapiens
aatacatcacatcttattta

SEQ ID NO: 5112853 - DNA, 21 bp, Homo sapiens
aatacatcattttttgtttct

SEQ ID NO: 5112854 - DNA, 22 bp, Homo sapiens
aatacatctttatcattaaaca

SEQ ID NO: 5112855 - DNA, 13 bp, Homo sapiens
aatacatcttttt

SEQ ID NO: 5112856 - DNA, 13 bp, Homo sapiens
aatacatgcacag

SEQ ID NO: 5112857 - DNA, 17 bp, Homo sapiens
aatacatgcacagtcat

SEQ ID NO: 5112858 - DNA, 13 bp, Homo sapiens
aatacatgcatct

SEQ ID NO: 5112859 - DNA, 23 bp, Homo sapiens
aatacatgctaagagaagtagaa

SEQ ID NO: 5112860 - DNA, 20 bp, Homo sapiens
aatacatgtgtatattcctt

SEQ ID NO: 5112861 - DNA, 20 bp, Homo sapiens
aatacatgtgtggatgtgta

SEQ ID NO: 5112862 - DNA, 17 bp, Homo sapiens
aatacatgttgtaaatg

SEQ ID NO: 5112863 - DNA, 14 bp, Homo sapiens
aatacattaaagca

SEQ ID NO: 5112864 - DNA, 20 bp, Homo sapiens
aatacattacatgtaaatta

SEQ ID NO: 5112865 - DNA, 17 bp, Homo sapiens
aatacattattagaata

SEQ ID NO: 5112866 - DNA, 18 bp, Homo sapiens
aatacattattagaatat

SEQ ID NO: 5112867 - DNA, 14 bp, Homo sapiens
aatacattcaaatt

SEQ ID NO: 5112868 - DNA, 21 bp, Homo sapiens
aatacattccatcacagccag

SEQ ID NO: 5112869 - DNA, 18 bp, Homo sapiens
aatacattccattgtttt

SEQ ID NO: 5112870 - DNA, 23 bp, Homo sapiens
aatacattccattgttttagtaa

SEQ ID NO: 5112871 - DNA, 15 bp, Homo sapiens
aatacattctgcttt

SEQ ID NO: 5112872 - DNA, 18 bp, Homo sapiens
aatacattgaattagaaa

SEQ ID NO: 5112873 - DNA, 14 bp, Homo sapiens
aatacattgttcag

SEQ ID NO: 5112874 - DNA, 23 bp, Homo sapiens
aatacattgttcaggtgaataat

SEQ ID NO: 5112875 - DNA, 14 bp, Homo sapiens
aatacatttaaaac

SEQ ID NO: 5112876 - DNA, 16 bp, Homo sapiens
aatacatttaaaactt

SEQ ID NO: 5112877 - DNA, 17 bp, Homo sapiens
aatacatttaaaactta

SEQ ID NO: 5112878 - DNA, 12 bp, Homo sapiens
aatacatttaga

SEQ ID NO: 5112879 - DNA, 17 bp, Homo sapiens
aatacatttgtattttg

SEQ ID NO: 5112880 - DNA, 18 bp, Homo sapiens
aatacattttaagccttt

SEQ ID NO: 5112881 - DNA, 15 bp, Homo sapiens
aataccaaaaattag

SEQ ID NO: 5112882 - DNA, 20 bp, Homo sapiens
aataccaaaattatttcaga

SEQ ID NO: 5112883 - DNA, 17 bp, Homo sapiens
aataccaaatattttag

SEQ ID NO: 5112884 - DNA, 21 bp, Homo sapiens
aataccaaatgcctgttgtat

SEQ ID NO: 5112885 - DNA, 16 bp, Homo sapiens
aataccaacctgaaag

SEQ ID NO: 5112886 - DNA, 15 bp, Homo sapiens
aataccaactgaagt

SEQ ID NO: 5112887 - DNA, 17 bp, Homo sapiens
aataccaagactaagca

SEQ ID NO: 5112888 - DNA, 16 bp, Homo sapiens
aataccaagtatttat

SEQ ID NO: 5112889 - DNA, 14 bp, Homo sapiens
aataccacaagcct

SEQ ID NO: 5112890 - DNA, 19 bp, Homo sapiens
aataccactagtggaaagt

SEQ ID NO: 5112891 - DNA, 19 bp, Homo sapiens
aataccactctgtaattgc

SEQ ID NO: 5112892 - DNA, 21 bp, Homo sapiens
aataccactctgtaattgcaa

SEQ ID NO: 5112893 - DNA, 18 bp, Homo sapiens
aataccatgccatttaaa

SEQ ID NO: 5112894 - DNA, 20 bp, Homo sapiens
aataccattaaaactgcttt

SEQ ID NO: 5112895 - DNA, 15 bp, Homo sapiens
aataccattgaaatc

SEQ ID NO: 5112896 - DNA, 18 bp, Homo sapiens
aataccattgaaatcagc

SEQ ID NO: 5112897 - DNA, 18 bp, Homo sapiens
aataccatttagtaagaa

SEQ ID NO: 5112898 - DNA, 15 bp, Homo sapiens
aataccatttatcta

SEQ ID NO: 5112899 - DNA, 20 bp, Homo sapiens
aataccattttttaaggaaa

SEQ ID NO: 5112900 - DNA, 18 bp, Homo sapiens
aatacccaaatgtccctg

SEQ ID NO: 5112901 - DNA, 21 bp, Homo sapiens
aatacccatgtctacacagat

SEQ ID NO: 5112902 - DNA, 15 bp, Homo sapiens
aatacccccagagac

SEQ ID NO: 5112903 - DNA, 23 bp, Homo sapiens
aatacccccgtcggaatggtaac

SEQ ID NO: 5112904 - DNA, 17 bp, Homo sapiens
aataccccttctctgta

SEQ ID NO: 5112905 - DNA, 12 bp, Homo sapiens
aatacccttggc

SEQ ID NO: 5112906 - DNA, 21 bp, Homo sapiens
aatacccttgtgagagcccat

SEQ ID NO: 5112907 - DNA, 15 bp, Homo sapiens
aataccgctcagtat

SEQ ID NO: 5112908 - DNA, 18 bp, Homo sapiens
aataccgctcagtatttt

SEQ ID NO: 5112909 - DNA, 17 bp, Homo sapiens
aatacctaattgtggat

SEQ ID NO: 5112910 - DNA, 17 bp, Homo sapiens
aatacctcaatgtttga

SEQ ID NO: 5112911 - DNA, 15 bp, Homo sapiens
aatacctcatgttta

SEQ ID NO: 5112912 - DNA, 21 bp, Homo sapiens
aatacctcatgtttatgaaaa

SEQ ID NO: 5112913 - DNA, 22 bp, Homo sapiens
aatacctcatgtttatgaaaat

SEQ ID NO: 5112914 - DNA, 23 bp, Homo sapiens
aatacctcatgtttatgaaaata

SEQ ID NO: 5112915 - DNA, 15 bp, Homo sapiens
aatacctctgtgtgc

SEQ ID NO: 5112916 - DNA, 14 bp, Homo sapiens
aatacctcttagct

SEQ ID NO: 5112917 - DNA, 17 bp, Homo sapiens
aatacctcttagctgag

SEQ ID NO: 5112918 - DNA, 13 bp, Homo sapiens
aatacctcttgga

SEQ ID NO: 5112919 - DNA, 12 bp, Homo sapiens
aatacctgccct

SEQ ID NO: 5112920 - DNA, 17 bp, Homo sapiens
aatacctggcctcattt

SEQ ID NO: 5112921 - DNA, 18 bp, Homo sapiens
aatacctgtccccctgac

SEQ ID NO: 5112922 - DNA, 21 bp, Homo sapiens
aatacctgtccccctgacaac

SEQ ID NO: 5112923 - DNA, 19 bp, Homo sapiens
aataccttagtgcagttat

SEQ ID NO: 5112924 - DNA, 18 bp, Homo sapiens
aataccttctatgtatta

SEQ ID NO: 5112925 - DNA, 20 bp, Homo sapiens
aatacctttggaaaaatctt

SEQ ID NO: 5112926 - DNA, 21 bp, Homo sapiens
aatacctttggaaaaatcttg

SEQ ID NO: 5112927 - DNA, 14 bp, Homo sapiens
aatacctttgtagt

SEQ ID NO: 5112928 - DNA, 16 bp, Homo sapiens
aatacgaagccctctt

SEQ ID NO: 5112929 - DNA, 23 bp, Homo sapiens
aatacgacactgaaatatgtgaa

SEQ ID NO: 5112930 - DNA, 15 bp, Homo sapiens
aatacgcctttaaag

SEQ ID NO: 5112931 - DNA, 19 bp, Homo sapiens
aatacggaagagcaggtga

SEQ ID NO: 5112932 - DNA, 14 bp, Homo sapiens
aatacgtattacaa

SEQ ID NO: 5112933 - DNA, 20 bp, Homo sapiens
aatacgtgatctctgttaca

SEQ ID NO: 5112934 - DNA, 23 bp, Homo sapiens
aatacgtgatctctgttacaaaa

SEQ ID NO: 5112935 - DNA, 21 bp, Homo sapiens
aatacgtgccagatataactg

SEQ ID NO: 5112936 - DNA, 20 bp, Homo sapiens
aatacgtgggcattcaaatg

SEQ ID NO: 5112937 - DNA, 13 bp, Homo sapiens
aatacgtttgata

SEQ ID NO: 5112938 - DNA, 18 bp, Homo sapiens
aatactaaaagcaaatct

SEQ ID NO: 5112939 - DNA, 21 bp, Homo sapiens
aatactaaaagcaaatctaca

SEQ ID NO: 5112940 - DNA, 16 bp, Homo sapiens
aatactaaagtgtcta

SEQ ID NO: 5112941 - DNA, 13 bp, Homo sapiens
aatactaaataaa

SEQ ID NO: 5112942 - DNA, 17 bp, Homo sapiens
aatactaaatatgaaat

SEQ ID NO: 5112943 - DNA, 18 bp, Homo sapiens
aatactaaatatgaaatt

SEQ ID NO: 5112944 - DNA, 21 bp, Homo sapiens
aatactaagaccctaattctt

SEQ ID NO: 5112945 - DNA, 14 bp, Homo sapiens
aatactaataaaat

SEQ ID NO: 5112946 - DNA, 23 bp, Homo sapiens
aatatttattgctttataaataa

SEQ ID NO: 5112947 - DNA, 13 bp, Homo sapiens
aatatttatttat

SEQ ID NO: 5112948 - DNA, 19 bp, Homo sapiens
aatatttattttaataatg

SEQ ID NO: 5112949 - DNA, 16 bp, Homo sapiens
aatatttcaagacatt

SEQ ID NO: 5112950 - DNA, 16 bp, Homo sapiens
aatatttcaagtgcct

SEQ ID NO: 5112951 - DNA, 14 bp, Homo sapiens
aatatttcagataa

SEQ ID NO: 5112952 - DNA, 15 bp, Homo sapiens
aatatttcagataat

SEQ ID NO: 5112953 - DNA, 11 bp, Homo sapiens
aatatttcata

SEQ ID NO: 5112954 - DNA, 12 bp, Homo sapiens
aatatttctcta

SEQ ID NO: 5112955 - DNA, 17 bp, Homo sapiens
aatatttctgctttctt

SEQ ID NO: 5112956 - DNA, 12 bp, Homo sapiens
aatatttcttaa

SEQ ID NO: 5112957 - DNA, 19 bp, Homo sapiens
aatatttcttaatttggat

SEQ ID NO: 5112958 - DNA, 20 bp, Homo sapiens
aatatttcttcacaaaggaa

SEQ ID NO: 5112959 - DNA, 19 bp, Homo sapiens
aatatttcttttgttgtac

SEQ ID NO: 5112960 - DNA, 22 bp, Homo sapiens
aatatttcttttgttgtacttt

SEQ ID NO: 5112961 - DNA, 15 bp, Homo sapiens
aatatttcttttttc

SEQ ID NO: 5112962 - DNA, 15 bp, Homo sapiens
aatatttgaacaaaa

SEQ ID NO: 5112963 - DNA, 23 bp, Homo sapiens
aatatttgaagcagctctgcctt

SEQ ID NO: 5112964 - DNA, 14 bp, Homo sapiens
aatatttgaataat

SEQ ID NO: 5112965 - DNA, 13 bp, Homo sapiens
aatatttgaatct

SEQ ID NO: 5112966 - DNA, 16 bp, Homo sapiens
aatatttgaatcttgt

SEQ ID NO: 5112967 - DNA, 15 bp, Homo sapiens
aatatttgaatgaaa

SEQ ID NO: 5112968 - DNA, 19 bp, Homo sapiens
aatatttgactttagtgaa

SEQ ID NO: 5112969 - DNA, 14 bp, Homo sapiens
aatatttgatcact

SEQ ID NO: 5112970 - DNA, 19 bp, Homo sapiens
aatatttgcgtaaatggtt

SEQ ID NO: 5112971 - DNA, 11 bp, Homo sapiens
aatatttgctt

SEQ ID NO: 5112972 - DNA, 16 bp, Homo sapiens
aatatttgcttattta

SEQ ID NO: 5112973 - DNA, 18 bp, Homo sapiens
aatatttggttttcctgt

SEQ ID NO: 5112974 - DNA, 22 bp, Homo sapiens
aatatttgtcgatatttccatc

SEQ ID NO: 5112975 - DNA, 15 bp, Homo sapiens
aatatttgtctgtgt

SEQ ID NO: 5112976 - DNA, 20 bp, Homo sapiens
aatatttgtctgtgtgctac

SEQ ID NO: 5112977 - DNA, 23 bp, Homo sapiens
aatatttgtctgtgtgctactaa

SEQ ID NO: 5112978 - DNA, 14 bp, Homo sapiens
aatatttgtgaaag

SEQ ID NO: 5112979 - DNA, 19 bp, Homo sapiens
aatatttgtgaaagaagac

SEQ ID NO: 5112980 - DNA, 21 bp, Homo sapiens
aatatttgtgaaagtgccaaa

SEQ ID NO: 5112981 - DNA, 19 bp, Homo sapiens
aatatttgtgctttgaaaa

SEQ ID NO: 5112982 - DNA, 22 bp, Homo sapiens
aatatttgtggtttaactttgt

SEQ ID NO: 5112983 - DNA, 21 bp, Homo sapiens
aatatttgtgtgctaaacgtg

SEQ ID NO: 5112984 - DNA, 21 bp, Homo sapiens
aatatttgttcttataaacct

SEQ ID NO: 5112985 - DNA, 10 bp, Homo sapiens
aatattttaa

SEQ ID NO: 5112986 - DNA, 11 bp, Homo sapiens
aatattttaaa

SEQ ID NO: 5112987 - DNA, 15 bp, Homo sapiens
aatattttaaagaat

SEQ ID NO: 5112988 - DNA, 19 bp, Homo sapiens
aatattttaagaaagagaa

SEQ ID NO: 5112989 - DNA, 13 bp, Homo sapiens
aatattttaagca

SEQ ID NO: 5112990 - DNA, 15 bp, Homo sapiens
aatattttaagcatt

SEQ ID NO: 5112991 - DNA, 21 bp, Homo sapiens
aatattttaagcattactctt

SEQ ID NO: 5112992 - DNA, 16 bp, Homo sapiens
aatattttaagtatga

SEQ ID NO: 5112993 - DNA, 22 bp, Homo sapiens
aatattttaataaagtagttat

SEQ ID NO: 5112994 - DNA, 15 bp, Homo sapiens
aatattttaattaaa

SEQ ID NO: 5112995 - DNA, 19 bp, Homo sapiens
aatattttaccactgctgt

SEQ ID NO: 5112996 - DNA, 21 bp, Homo sapiens
aatattttaccactgctgtga

SEQ ID NO: 5112997 - DNA, 23 bp, Homo sapiens
aatattttactagtccaatcacc

SEQ ID NO: 5112998 - DNA, 19 bp, Homo sapiens
aatattttacttttacagt

SEQ ID NO: 5112999 - DNA, 18 bp, Homo sapiens
aatattttagatgttatt

SEQ ID NO: 5113000 - DNA, 10 bp, Homo sapiens
aatattttat

SEQ ID NO: 5113001 - DNA, 13 bp, Homo sapiens
aatattttatcct

SEQ ID NO: 5113002 - DNA, 17 bp, Homo sapiens
aatattttattatatat

SEQ ID NO: 5113003 - DNA, 20 bp, Homo sapiens
aatattttattcaaggtaaa

SEQ ID NO: 5113004 - DNA, 12 bp, Homo sapiens
aatattttcaac

SEQ ID NO: 5113005 - DNA, 13 bp, Homo sapiens
aatattttcagta

SEQ ID NO: 5113006 - DNA, 11 bp, Homo sapiens
aatattttcat

SEQ ID NO: 5113007 - DNA, 18 bp, Homo sapiens
aatattttcatacagcat

SEQ ID NO: 5113008 - DNA, 20 bp, Homo sapiens
aatattttcctcctgagtgc

SEQ ID NO: 5113009 - DNA, 18 bp, Homo sapiens
aatattttctacatcttt

SEQ ID NO: 5113010 - DNA, 19 bp, Homo sapiens
aatattttctacatctttt

SEQ ID NO: 5113011 - DNA, 16 bp, Homo sapiens
aatattttctgtgtaa

SEQ ID NO: 5113012 - DNA, 15 bp, Homo sapiens
aatattttcttcctt

SEQ ID NO: 5113013 - DNA, 18 bp, Homo sapiens
aatattttctttaatgct

SEQ ID NO: 5113014 - DNA, 19 bp, Homo sapiens
aatattttctttaatgctt

SEQ ID NO: 5113015 - DNA, 14 bp, Homo sapiens
aatattttcttttc

SEQ ID NO: 5113016 - DNA, 13 bp, Homo sapiens
aatattttgatct

SEQ ID NO: 5113017 - DNA, 20 bp, Homo sapiens
aatattttgatcttcaacaa

SEQ ID NO: 5113018 - DNA, 18 bp, Homo sapiens
aatattttgatgcagata

SEQ ID NO: 5113019 - DNA, 13 bp, Homo sapiens
aatattttgctaa

SEQ ID NO: 5113020 - DNA, 22 bp, Homo sapiens
aatattttgctaaaaaagcata

SEQ ID NO: 5113021 - DNA, 14 bp, Homo sapiens
aatattttgctaac

SEQ ID NO: 5113022 - DNA, 16 bp, Homo sapiens
aatattttgctaactg

SEQ ID NO: 5113023 - DNA, 14 bp, Homo sapiens
aatattttgctgct

SEQ ID NO: 5113024 - DNA, 12 bp, Homo sapiens
aatattttggaa

SEQ ID NO: 5113025 - DNA, 17 bp, Homo sapiens
aatattttgtaatattc

SEQ ID NO: 5113026 - DNA, 18 bp, Homo sapiens
aatattttgtaatattct

SEQ ID NO: 5113027 - DNA, 15 bp, Homo sapiens
aatattttgtattat

SEQ ID NO: 5113028 - DNA, 15 bp, Homo sapiens
aatattttgtatttt

SEQ ID NO: 5113029 - DNA, 19 bp, Homo sapiens
aatattttgtattttcaac

SEQ ID NO: 5113030 - DNA, 14 bp, Homo sapiens
aatattttgtcact

SEQ ID NO: 5113031 - DNA, 19 bp, Homo sapiens
aatattttgtcactgctgt

SEQ ID NO: 5113032 - DNA, 14 bp, Homo sapiens
aatattttgtctaa

SEQ ID NO: 5113033 - DNA, 19 bp, Homo sapiens
aatattttgtctaaaatgc

SEQ ID NO: 5113034 - DNA, 14 bp, Homo sapiens
aatatttttaaatg

SEQ ID NO: 5113035 - DNA, 17 bp, Homo sapiens
aatatttttaatatata

SEQ ID NO: 5113036 - DNA, 14 bp, Homo sapiens
aatatttttagata

SEQ ID NO: 5113037 - DNA, 22 bp, Homo sapiens
aatatttttatagatttgacct

SEQ ID NO: 5113038 - DNA, 16 bp, Homo sapiens
aatatttttatataca

SEQ ID NO: 5113039 - DNA, 18 bp, Homo sapiens
aatatttttatatacaga

SEQ ID NO: 5113040 - DNA, 23 bp, Homo sapiens
aatatttttatatacagaggaaa

SEQ ID NO: 5113041 - DNA, 21 bp, Homo sapiens
aatatttttatatttccttta

SEQ ID NO: 5113042 - DNA, 16 bp, Homo sapiens
aatatttttatgtgaa

SEQ ID NO: 5113043 - DNA, 21 bp, Homo sapiens
aatatttttcaaaatcaaagt

SEQ ID NO: 5113044 - DNA, 21 bp, Homo sapiens
aatatttttcaacttcttcta

SEQ ID NO: 5113045 - DNA, 20 bp, Homo sapiens
aatatttttcaattttgaaa

SEQ ID NO: 5113046 - DNA, 16 bp, Homo sapiens
aatatttttccctccg

SEQ ID NO: 5113047 - DNA, 23 bp, Homo sapiens
aatatttttccctccgggcaggg

SEQ ID NO: 5113048 - DNA, 11 bp, Homo sapiens
aatatttttgt

SEQ ID NO: 5113049 - DNA, 17 bp, Homo sapiens
aatattttttatatata

SEQ ID NO: 5113050 - DNA, 17 bp, Homo sapiens
aatattttttatttcta

SEQ ID NO: 5113051 - DNA, 12 bp, Homo sapiens
aatattttttga

SEQ ID NO: 5113052 - DNA, 14 bp, Homo sapiens
aatattttttgaag

SEQ ID NO: 5113053 - DNA, 15 bp, Homo sapiens
aatattttttgaagg

SEQ ID NO: 5113054 - DNA, 20 bp, Homo sapiens
aatattttttgaaggtttca

SEQ ID NO: 5113055 - DNA, 13 bp, Homo sapiens
aatattttttgca

SEQ ID NO: 5113056 - DNA, 14 bp, Homo sapiens
aatatttttttcct

SEQ ID NO: 5113057 - DNA, 17 bp, Homo sapiens
aatatttttttgtagat

SEQ ID NO: 5113058 - DNA, 16 bp, Homo sapiens
aatattttttttaact

SEQ ID NO: 5113059 - DNA, 18 bp, Homo sapiens
aatcaaaaacaggcaggt

SEQ ID NO: 5113060 - DNA, 14 bp, Homo sapiens
aatcaaaaactttt

SEQ ID NO: 5113061 - DNA, 13 bp, Homo sapiens
aatcaaaacacac

SEQ ID NO: 5113062 - DNA, 18 bp, Homo sapiens
aatcaaaactctcctaca

SEQ ID NO: 5113063 - DNA, 22 bp, Homo sapiens
aatcaaaagattaacaacactg

SEQ ID NO: 5113064 - DNA, 15 bp, Homo sapiens
aatcaaaagctgaaa

SEQ ID NO: 5113065 - DNA, 14 bp, Homo sapiens
aatcaaaagctgct

SEQ ID NO: 5113066 - DNA, 18 bp, Homo sapiens
aatcaaaaggcactgtga

SEQ ID NO: 5113067 - DNA, 20 bp, Homo sapiens
aatcaaaagggccaaagaac

SEQ ID NO: 5113068 - DNA, 14 bp, Homo sapiens
aatcaaaagtcctt

SEQ ID NO: 5113069 - DNA, 14 bp, Homo sapiens
aatcaaaagtgcct

SEQ ID NO: 5113070 - DNA, 18 bp, Homo sapiens
aatcaaaataaaaattaa

SEQ ID NO: 5113071 - DNA, 12 bp, Homo sapiens
aatcaaaatctc

SEQ ID NO: 5113072 - DNA, 15 bp, Homo sapiens
aatcaaaatctctcc

SEQ ID NO: 5113073 - DNA, 15 bp, Homo sapiens
aatcaaacattttga

SEQ ID NO: 5113074 - DNA, 23 bp, Homo sapiens
aatcaaacattttgaaagtctgt

SEQ ID NO: 5113075 - DNA, 22 bp, Homo sapiens
aatcaaacctttttatatttta

SEQ ID NO: 5113076 - DNA, 16 bp, Homo sapiens
aatcaaagaaaacata

SEQ ID NO: 5113077 - DNA, 24 bp, Homo sapiens
aatcaaagaaaagacttttgttga

SEQ ID NO: 5113078 - DNA, 15 bp, Homo sapiens
aatcaaagaattaca

SEQ ID NO: 5113079 - DNA, 21 bp, Homo sapiens
aatcaaaggggatatatgttt

SEQ ID NO: 5113080 - DNA, 23 bp, Homo sapiens
aatcaaaggggatatatgtttgt

SEQ ID NO: 5113081 - DNA, 18 bp, Homo sapiens
aatcaaataagtatttat

SEQ ID NO: 5113082 - DNA, 19 bp, Homo sapiens
aatcaaataagtatttata

SEQ ID NO: 5113083 - DNA, 13 bp, Homo sapiens
aatcaaataatac

SEQ ID NO: 5113084 - DNA, 16 bp, Homo sapiens
aatcaaatctgagcct

SEQ ID NO: 5113085 - DNA, 12 bp, Homo sapiens
aatcaaatgaat

SEQ ID NO: 5113086 - DNA, 18 bp, Homo sapiens
aatcaaatgaatgattaa

SEQ ID NO: 5113087 - DNA, 14 bp, Homo sapiens
aatcaaatgtaaag

SEQ ID NO: 5113088 - DNA, 16 bp, Homo sapiens
aatcaaattctgtctg

SEQ ID NO: 5113089 - DNA, 20 bp, Homo sapiens
aatcaaattctgtctgggga

SEQ ID NO: 5113090 - DNA, 20 bp, Homo sapiens
aatcaaatttgtagggtttc

SEQ ID NO: 5113091 - DNA, 17 bp, Homo sapiens
aatcaacaccttaatat

SEQ ID NO: 5113092 - DNA, 13 bp, Homo sapiens
aatcaacagaagc

SEQ ID NO: 5113093 - DNA, 14 bp, Homo sapiens
aatcaacagaattg

SEQ ID NO: 5113094 - DNA, 18 bp, Homo sapiens
aatcaacagaattgttct

SEQ ID NO: 5113095 - DNA, 13 bp, Homo sapiens
aatcaaccctctc

SEQ ID NO: 5113096 - DNA, 19 bp, Homo sapiens
aatcaaccctgcaatcact

SEQ ID NO: 5113097 - DNA, 21 bp, Homo sapiens
aatcaacctatcaaagcttca

SEQ ID NO: 5113098 - DNA, 18 bp, Homo sapiens
aatcaacctgcacttcat

SEQ ID NO: 5113099 - DNA, 23 bp, Homo sapiens
aatcaactaggtatttaagactg

SEQ ID NO: 5113100 - DNA, 16 bp, Homo sapiens
aatcaactagtatttg

SEQ ID NO: 5113101 - DNA, 14 bp, Homo sapiens
aatcaactctaata

SEQ ID NO: 5113102 - DNA, 14 bp, Homo sapiens
aatcaactgaaagt

SEQ ID NO: 5113103 - DNA, 16 bp, Homo sapiens
aatcaactgaaagtgt

SEQ ID NO: 5113104 - DNA, 18 bp, Homo sapiens
aatcaactgaaagtgttt

SEQ ID NO: 5113105 - DNA, 20 bp, Homo sapiens
aatcaactgaaagtgtttcc

SEQ ID NO: 5113106 - DNA, 14 bp, Homo sapiens
aatcaactgggctg

SEQ ID NO: 5113107 - DNA, 18 bp, Homo sapiens
aatcaacttgcttatcaa

SEQ ID NO: 5113108 - DNA, 11 bp, Homo sapiens
aatcaacttta

SEQ ID NO: 5113109 - DNA, 13 bp, Homo sapiens
aatcaacttttat

SEQ ID NO: 5113110 - DNA, 16 bp, Homo sapiens
aatcaacttttatgca

SEQ ID NO: 5113111 - DNA, 18 bp, Homo sapiens
aatcaagaatattcaaat

SEQ ID NO: 5113112 - DNA, 16 bp, Homo sapiens
aatcaagaccaaagag

SEQ ID NO: 5113113 - DNA, 14 bp, Homo sapiens
aatcaagagaaact

SEQ ID NO: 5113114 - DNA, 16 bp, Homo sapiens
aatcaagagctgccct

SEQ ID NO: 5113115 - DNA, 15 bp, Homo sapiens
aatcaagataaagga

SEQ ID NO: 5113116 - DNA, 17 bp, Homo sapiens
aatcaagataaaggaca

SEQ ID NO: 5113117 - DNA, 14 bp, Homo sapiens
aatcaagatgagat

SEQ ID NO: 5113118 - DNA, 22 bp, Homo sapiens
aatcaagatgggtgattatgaa

SEQ ID NO: 5113119 - DNA, 17 bp, Homo sapiens
aatcaagattatgatga

SEQ ID NO: 5113120 - DNA, 15 bp, Homo sapiens
aatcaagcaaaattt

SEQ ID NO: 5113121 - DNA, 16 bp, Homo sapiens
aatcaagcaagcctct

SEQ ID NO: 5113122 - DNA, 13 bp, Homo sapiens
aatcaagcctctg

SEQ ID NO: 5113123 - DNA, 23 bp, Homo sapiens
aatcaagcctttatggctgctgg

SEQ ID NO: 5113124 - DNA, 23 bp, Homo sapiens
aatcaaggatcttttggacctgg

SEQ ID NO: 5113125 - DNA, 18 bp, Homo sapiens
aatcaagggtcaggcctt

SEQ ID NO: 5113126 - DNA, 18 bp, Homo sapiens
aatcaaggttataatttt

SEQ ID NO: 5113127 - DNA, 23 bp, Homo sapiens
aatactaatgttatttcttaaaa

SEQ ID NO: 5113128 - DNA, 13 bp, Homo sapiens
aatactacccata

SEQ ID NO: 5113129 - DNA, 13 bp, Homo sapiens
aatactacctata

SEQ ID NO: 5113130 - DNA, 23 bp, Homo sapiens
aatactacctcactactacatct

SEQ ID NO: 5113131 - DNA, 22 bp, Homo sapiens
aatactacctctgaatgttaca

SEQ ID NO: 5113132 - DNA, 14 bp, Homo sapiens
aatactaccttgaa

SEQ ID NO: 5113133 - DNA, 15 bp, Homo sapiens
aatactactcctgta

SEQ ID NO: 5113134 - DNA, 13 bp, Homo sapiens
aatactactgtaa

SEQ ID NO: 5113135 - DNA, 15 bp, Homo sapiens
aatactactgtaaat

SEQ ID NO: 5113136 - DNA, 17 bp, Homo sapiens
aatactactgtaaatgt

SEQ ID NO: 5113137 - DNA, 21 bp, Homo sapiens
aatactagaatggtagcacta

SEQ ID NO: 5113138 - DNA, 14 bp, Homo sapiens
aatactagccagag

SEQ ID NO: 5113139 - DNA, 19 bp, Homo sapiens
aatactagggagaaggttt

SEQ ID NO: 5113140 - DNA, 17 bp, Homo sapiens
aatactagttgtgacct

SEQ ID NO: 5113141 - DNA, 18 bp, Homo sapiens
aatactataaatatattg

SEQ ID NO: 5113142 - DNA, 22 bp, Homo sapiens
aatactataaatatattgtata

SEQ ID NO: 5113143 - DNA, 17 bp, Homo sapiens
aatactatatatacaat

SEQ ID NO: 5113144 - DNA, 14 bp, Homo sapiens
aatactatattaaa

SEQ ID NO: 5113145 - DNA, 19 bp, Homo sapiens
aatactatccatgtaataa

SEQ ID NO: 5113146 - DNA, 22 bp, Homo sapiens
aatactattggagagaaaaaat

SEQ ID NO: 5113147 - DNA, 21 bp, Homo sapiens
aatactatttaagatgtgaaa

SEQ ID NO: 5113148 - DNA, 17 bp, Homo sapiens
aatactatttttactgc

SEQ ID NO: 5113149 - DNA, 13 bp, Homo sapiens
aatactcaaatga

SEQ ID NO: 5113150 - DNA, 20 bp, Homo sapiens
aatactcaaatgagtaacat

SEQ ID NO: 5113151 - DNA, 15 bp, Homo sapiens
aatactcacattttg

SEQ ID NO: 5113152 - DNA, 16 bp, Homo sapiens
aatactcaccaaaata

SEQ ID NO: 5113153 - DNA, 23 bp, Homo sapiens
aatactcagggaaagcatttaaa

SEQ ID NO: 5113154 - DNA, 18 bp, Homo sapiens
aatactcataatgtgaag

SEQ ID NO: 5113155 - DNA, 19 bp, Homo sapiens
aatactcatcagagcagct

SEQ ID NO: 5113156 - DNA, 14 bp, Homo sapiens
aatactcatgaatg

SEQ ID NO: 5113157 - DNA, 15 bp, Homo sapiens
aatactcatgaatga

SEQ ID NO: 5113158 - DNA, 12 bp, Homo sapiens
aatactccaaag

SEQ ID NO: 5113159 - DNA, 15 bp, Homo sapiens
aatactccaaagatg

SEQ ID NO: 5113160 - DNA, 22 bp, Homo sapiens
aatactccaagcttcaagtgat

SEQ ID NO: 5113161 - DNA, 16 bp, Homo sapiens
aatactctaattctaa

SEQ ID NO: 5113162 - DNA, 20 bp, Homo sapiens
aatactctagcctgggccag

SEQ ID NO: 5113163 - DNA, 13 bp, Homo sapiens
aatactctgccct

SEQ ID NO: 5113164 - DNA, 13 bp, Homo sapiens
aatactcttccca

SEQ ID NO: 5113165 - DNA, 13 bp, Homo sapiens
aatactcttgaaa

SEQ ID NO: 5113166 - DNA, 18 bp, Homo sapiens
aatactcttgaaaggcca

SEQ ID NO: 5113167 - DNA, 15 bp, Homo sapiens
aatactcttgaaatg

SEQ ID NO: 5113168 - DNA, 20 bp, Homo sapiens
aatactcttggtcacctcaa

SEQ ID NO: 5113169 - DNA, 15 bp, Homo sapiens
aatactgaacatctg

SEQ ID NO: 5113170 - DNA, 19 bp, Homo sapiens
aatactgaatttctttgat

SEQ ID NO: 5113171 - DNA, 13 bp, Homo sapiens
aatactgaatttt

SEQ ID NO: 5113172 - DNA, 20 bp, Homo sapiens
aatactgatggaagcacaca

SEQ ID NO: 5113173 - DNA, 20 bp, Homo sapiens
aatactgattttcaaaaaaa

SEQ ID NO: 5113174 - DNA, 11 bp, Homo sapiens
aatactgcact

SEQ ID NO: 5113175 - DNA, 20 bp, Homo sapiens
aatactgccaaaacatttat

SEQ ID NO: 5113176 - DNA, 17 bp, Homo sapiens
aatactgccagatgctg

SEQ ID NO: 5113177 - DNA, 19 bp, Homo sapiens
aatactgccagatgctgat

SEQ ID NO: 5113178 - DNA, 20 bp, Homo sapiens
aatactgccagatgctgatg

SEQ ID NO: 5113179 - DNA, 22 bp, Homo sapiens
aatactgccggtcacccaggct

SEQ ID NO: 5113180 - DNA, 23 bp, Homo sapiens
aatactgctacagcaatttctaa

SEQ ID NO: 5113181 - DNA, 13 bp, Homo sapiens
aatactgctgaga

SEQ ID NO: 5113182 - DNA, 15 bp, Homo sapiens
aatactgctgagata

SEQ ID NO: 5113183 - DNA, 21 bp, Homo sapiens
aatactgctgagatacataca

SEQ ID NO: 5113184 - DNA, 19 bp, Homo sapiens
aatactgcttaattgctga

SEQ ID NO: 5113185 - DNA, 19 bp, Homo sapiens
aatactggactcaggaact

SEQ ID NO: 5113186 - DNA, 20 bp, Homo sapiens
aatactggactcaggaactt

SEQ ID NO: 5113187 - DNA, 21 bp, Homo sapiens
aatactggactcaggaacttt

SEQ ID NO: 5113188 - DNA, 13 bp, Homo sapiens
aatactgggttct

SEQ ID NO: 5113189 - DNA, 19 bp, Homo sapiens
aatactggtaccttccccc

SEQ ID NO: 5113190 - DNA, 21 bp, Homo sapiens
aatactggtaccttcccccag

SEQ ID NO: 5113191 - DNA, 13 bp, Homo sapiens
aatactgtacata

SEQ ID NO: 5113192 - DNA, 14 bp, Homo sapiens
aatactgtacatag

SEQ ID NO: 5113193 - DNA, 15 bp, Homo sapiens
aatactgtacataga

SEQ ID NO: 5113194 - DNA, 19 bp, Homo sapiens
aatactgtacatagatgta

SEQ ID NO: 5113195 - DNA, 22 bp, Homo sapiens
aatactgtacatagatgtatca

SEQ ID NO: 5113196 - DNA, 12 bp, Homo sapiens
aatactgtattg

SEQ ID NO: 5113197 - DNA, 17 bp, Homo sapiens
aatactgtcaaacaata

SEQ ID NO: 5113198 - DNA, 21 bp, Homo sapiens
aatactgtgttaccttttaaa

SEQ ID NO: 5113199 - DNA, 17 bp, Homo sapiens
aatactgttattctttg

SEQ ID NO: 5113200 - DNA, 21 bp, Homo sapiens
aatactgtttcactaatactt

SEQ ID NO: 5113201 - DNA, 12 bp, Homo sapiens
aatactgtttga

SEQ ID NO: 5113202 - DNA, 14 bp, Homo sapiens
aatacttaaatgtt

SEQ ID NO: 5113203 - DNA, 15 bp, Homo sapiens
aatacttaaatgtta

SEQ ID NO: 5113204 - DNA, 18 bp, Homo sapiens
aatacttaaatgttatgt

SEQ ID NO: 5113205 - DNA, 20 bp, Homo sapiens
aatacttaaatgttatgtat

SEQ ID NO: 5113206 - DNA, 18 bp, Homo sapiens
aatacttaacattgattt

SEQ ID NO: 5113207 - DNA, 16 bp, Homo sapiens
aatacttacattctct

SEQ ID NO: 5113208 - DNA, 17 bp, Homo sapiens
aatacttagcaaaaagt

SEQ ID NO: 5113209 - DNA, 23 bp, Homo sapiens
aatacttattcattgtggttatt

SEQ ID NO: 5113210 - DNA, 14 bp, Homo sapiens
aatacttccagaag

SEQ ID NO: 5113211 - DNA, 15 bp, Homo sapiens
aatacttccagaagt

SEQ ID NO: 5113212 - DNA, 17 bp, Homo sapiens
aatacttccttataaaa

SEQ ID NO: 5113213 - DNA, 13 bp, Homo sapiens
aatacttcttgtg

SEQ ID NO: 5113214 - DNA, 19 bp, Homo sapiens
aatacttctttgttattat

SEQ ID NO: 5113215 - DNA, 23 bp, Homo sapiens
aatacttctttgttattataaca

SEQ ID NO: 5113216 - DNA, 14 bp, Homo sapiens
aatacttcttttta

SEQ ID NO: 5113217 - DNA, 18 bp, Homo sapiens
aatacttgaacttgcctc

SEQ ID NO: 5113218 - DNA, 19 bp, Homo sapiens
aatacttgaacttgcctct

SEQ ID NO: 5113219 - DNA, 20 bp, Homo sapiens
aatacttgaacttgcctctt

SEQ ID NO: 5113220 - DNA, 15 bp, Homo sapiens
aatacttgaacttgt

SEQ ID NO: 5113221 - DNA, 19 bp, Homo sapiens
aatacttgacaacattttt

SEQ ID NO: 5113222 - DNA, 18 bp, Homo sapiens
aatacttgacctctgtga

SEQ ID NO: 5113223 - DNA, 13 bp, Homo sapiens
aatacttgcaact

SEQ ID NO: 5113224 - DNA, 18 bp, Homo sapiens
aatacttgcaactaagga

SEQ ID NO: 5113225 - DNA, 23 bp, Homo sapiens
aatacttgcaactaaggacaaat

SEQ ID NO: 5113226 - DNA, 13 bp, Homo sapiens
aatacttgcagtt

SEQ ID NO: 5113227 - DNA, 17 bp, Homo sapiens
aatacttggagggccca

SEQ ID NO: 5113228 - DNA, 15 bp, Homo sapiens
aatactttaaaggaa

SEQ ID NO: 5113229 - DNA, 15 bp, Homo sapiens
aatactttgcttcat

SEQ ID NO: 5113230 - DNA, 22 bp, Homo sapiens
aatactttgtcctaagagattt

SEQ ID NO: 5113231 - DNA, 17 bp, Homo sapiens
aatactttgtgtctttt

SEQ ID NO: 5113232 - DNA, 20 bp, Homo sapiens
aatacttttactctgcctac

SEQ ID NO: 5113233 - DNA, 23 bp, Homo sapiens
aatacttttcaggcactttagaa

SEQ ID NO: 5113234 - DNA, 14 bp, Homo sapiens
aatacttttccaca

SEQ ID NO: 5113235 - DNA, 14 bp, Homo sapiens
aatacttttcctta

SEQ ID NO: 5113236 - DNA, 16 bp, Homo sapiens
aatacttttccttaat

SEQ ID NO: 5113237 - DNA, 20 bp, Homo sapiens
aatacttttccttaccttta

SEQ ID NO: 5113238 - DNA, 16 bp, Homo sapiens
aatactttttctaatg

SEQ ID NO: 5113239 - DNA, 17 bp, Homo sapiens
aatactttttctaatga

SEQ ID NO: 5113240 - DNA, 16 bp, Homo sapiens
aatagaaaaaaagaaa

SEQ ID NO: 5113241 - DNA, 17 bp, Homo sapiens
aatagaaaacaggaaaa

SEQ ID NO: 5113242 - DNA, 20 bp, Homo sapiens
aatagaaaactgaaaatcta

SEQ ID NO: 5113243 - DNA, 13 bp, Homo sapiens
aatagaaaactgt

SEQ ID NO: 5113244 - DNA, 15 bp, Homo sapiens
aatagaaaatggtcc

SEQ ID NO: 5113245 - DNA, 17 bp, Homo sapiens
aatagaaaattaaaata

SEQ ID NO: 5113246 - DNA, 21 bp, Homo sapiens
aatagaaacgtaaactatgac

SEQ ID NO: 5113247 - DNA, 14 bp, Homo sapiens
aatagaaagaaact

SEQ ID NO: 5113248 - DNA, 15 bp, Homo sapiens
aatagaaagaagcca

SEQ ID NO: 5113249 - DNA, 18 bp, Homo sapiens
aatagaaagtcagatgac

SEQ ID NO: 5113250 - DNA, 19 bp, Homo sapiens
aatagaaagttgcaaggca

SEQ ID NO: 5113251 - DNA, 13 bp, Homo sapiens
aatagaaatagct

SEQ ID NO: 5113252 - DNA, 17 bp, Homo sapiens
aatagaaatggggaact

SEQ ID NO: 5113253 - DNA, 22 bp, Homo sapiens
aatagaaatttgcccctggcaa

SEQ ID NO: 5113254 - DNA, 23 bp, Homo sapiens
aatagaaatttgcccctggcaaa

SEQ ID NO: 5113255 - DNA, 16 bp, Homo sapiens
aatagaaattttgtaa

SEQ ID NO: 5113256 - DNA, 17 bp, Homo sapiens
aatagaaattttgtaag

SEQ ID NO: 5113257 - DNA, 17 bp, Homo sapiens
aatagaacaaggctgag

SEQ ID NO: 5113258 - DNA, 22 bp, Homo sapiens
aatagaacagtttacttggaaa

SEQ ID NO: 5113259 - DNA, 20 bp, Homo sapiens
aatagaaccatgttggttgc

SEQ ID NO: 5113260 - DNA, 22 bp, Homo sapiens
aatagaactatctgcattatct

SEQ ID NO: 5113261 - DNA, 13 bp, Homo sapiens
aatagaagaagag

SEQ ID NO: 5113262 - DNA, 22 bp, Homo sapiens
aatagaagcccaaattcatata

SEQ ID NO: 5113263 - DNA, 22 bp, Homo sapiens
aatagaagctaaggtttagata

SEQ ID NO: 5113264 - DNA, 13 bp, Homo sapiens
aatagaaggtgat

SEQ ID NO: 5113265 - DNA, 19 bp, Homo sapiens
aatagaagtgctcccctct

SEQ ID NO: 5113266 - DNA, 15 bp, Homo sapiens
aatagaataaataca

SEQ ID NO: 5113267 - DNA, 13 bp, Homo sapiens
aatagaataattc

SEQ ID NO: 5113268 - DNA, 15 bp, Homo sapiens
aatagaatacatttt

SEQ ID NO: 5113269 - DNA, 12 bp, Homo sapiens
aatagaatacct

SEQ ID NO: 5113270 - DNA, 13 bp, Homo sapiens
aatagaatatagc

SEQ ID NO: 5113271 - DNA, 15 bp, Homo sapiens
aatagaatatagcat

SEQ ID NO: 5113272 - DNA, 16 bp, Homo sapiens
aatagaatatagcatc

SEQ ID NO: 5113273 - DNA, 22 bp, Homo sapiens
aatagaatatagcatctttcat

SEQ ID NO: 5113274 - DNA, 13 bp, Homo sapiens
aatagaatgataa

SEQ ID NO: 5113275 - DNA, 21 bp, Homo sapiens
aatagaattgacattgaaatc

SEQ ID NO: 5113276 - DNA, 14 bp, Homo sapiens
aatagaatttccta

SEQ ID NO: 5113277 - DNA, 18 bp, Homo sapiens
aatagacaaaaagtatat

SEQ ID NO: 5113278 - DNA, 23 bp, Homo sapiens
aatagacaactcttccatttatt

SEQ ID NO: 5113279 - DNA, 15 bp, Homo sapiens
aatagacacatacat

SEQ ID NO: 5113280 - DNA, 16 bp, Homo sapiens
aatagacagcatgaga

SEQ ID NO: 5113281 - DNA, 19 bp, Homo sapiens
aatagacagtaaaatacta

SEQ ID NO: 5113282 - DNA, 15 bp, Homo sapiens
aatagacagtatatt

SEQ ID NO: 5113283 - DNA, 16 bp, Homo sapiens
aatagacataaattgt

SEQ ID NO: 5113284 - DNA, 19 bp, Homo sapiens
aatagacataaattgtaat

SEQ ID NO: 5113285 - DNA, 13 bp, Homo sapiens
aatagacatcaaa

SEQ ID NO: 5113286 - DNA, 15 bp, Homo sapiens
aatagacatcaaact

SEQ ID NO: 5113287 - DNA, 15 bp, Homo sapiens
aatagacatgtagtt

SEQ ID NO: 5113288 - DNA, 13 bp, Homo sapiens
aatagacattttt

SEQ ID NO: 5113289 - DNA, 18 bp, Homo sapiens
aatagacccacaagaggc

SEQ ID NO: 5113290 - DNA, 16 bp, Homo sapiens
aatagactaaatgaaa

SEQ ID NO: 5113291 - DNA, 23 bp, Homo sapiens
aatagactgaagagaccacagca

SEQ ID NO: 5113292 - DNA, 15 bp, Homo sapiens
aatagacttctctta

SEQ ID NO: 5113293 - DNA, 17 bp, Homo sapiens
aatagacttctcttaca

SEQ ID NO: 5113294 - DNA, 17 bp, Homo sapiens
aatagactttgtatgaa

SEQ ID NO: 5113295 - DNA, 17 bp, Homo sapiens
aatagagaagtaaaaaa

SEQ ID NO: 5113296 - DNA, 18 bp, Homo sapiens
aatagagactgtagattg

SEQ ID NO: 5113297 - DNA, 11 bp, Homo sapiens
aatagagagag

SEQ ID NO: 5113298 - DNA, 16 bp, Homo sapiens
aatagagatgaatcag

SEQ ID NO: 5113299 - DNA, 18 bp, Homo sapiens
aatagagatgagctttct

SEQ ID NO: 5113300 - DNA, 22 bp, Homo sapiens
aatagagcaaaattgatgtgtt

SEQ ID NO: 5113301 - DNA, 18 bp, Homo sapiens
aatagagccaactgattt

SEQ ID NO: 5113302 - DNA, 16 bp, Homo sapiens
aatagagcctgaggga

SEQ ID NO: 5113303 - DNA, 16 bp, Homo sapiens
aatagagctgccactg

SEQ ID NO: 5113304 - DNA, 18 bp, Homo sapiens
aatagagctgccactggg

SEQ ID NO: 5113305 - DNA, 18 bp, Homo sapiens
aatagaggtctgtaaaga

SEQ ID NO: 5113306 - DNA, 12 bp, Homo sapiens
aatagagtactt

SEQ ID NO: 5113307 - DNA, 17 bp, Homo sapiens
aatcaagtattataaac

SEQ ID NO: 5113308 - DNA, 12 bp, Homo sapiens
aatcaagtgcat

SEQ ID NO: 5113309 - DNA, 15 bp, Homo sapiens
aatcaagtgcatttc

SEQ ID NO: 5113310 - DNA, 18 bp, Homo sapiens
aatcaagtgcatttctgg

SEQ ID NO: 5113311 - DNA, 22 bp, Homo sapiens
aatcaagttgtaacttatattg

SEQ ID NO: 5113312 - DNA, 20 bp, Homo sapiens
aatcaagtttccaagcaaat

SEQ ID NO: 5113313 - DNA, 12 bp, Homo sapiens
aatcaataaaaa

SEQ ID NO: 5113314 - DNA, 16 bp, Homo sapiens
aatcaataaaaatctt

SEQ ID NO: 5113315 - DNA, 15 bp, Homo sapiens
aatcaataaagaaaa

SEQ ID NO: 5113316 - DNA, 12 bp, Homo sapiens
aatcaataatag

SEQ ID NO: 5113317 - DNA, 19 bp, Homo sapiens
aatcaatacactagttgtt

SEQ ID NO: 5113318 - DNA, 14 bp, Homo sapiens
aatcaatacagctt

SEQ ID NO: 5113319 - DNA, 13 bp, Homo sapiens
aatcaatactttg

SEQ ID NO: 5113320 - DNA, 21 bp, Homo sapiens
aatcaatactttgaacacaaa

SEQ ID NO: 5113321 - DNA, 19 bp, Homo sapiens
aatcaatagtgcaactgtt

SEQ ID NO: 5113322 - DNA, 12 bp, Homo sapiens
aatcaatagttg

SEQ ID NO: 5113323 - DNA, 16 bp, Homo sapiens
aatcaatataatctga

SEQ ID NO: 5113324 - DNA, 16 bp, Homo sapiens
aatcaatatcccaaca

SEQ ID NO: 5113325 - DNA, 18 bp, Homo sapiens
aatcaatatcccaacatt

SEQ ID NO: 5113326 - DNA, 20 bp, Homo sapiens
aatcaatatcccaacattct

SEQ ID NO: 5113327 - DNA, 15 bp, Homo sapiens
aatcaatatttaaga

SEQ ID NO: 5113328 - DNA, 16 bp, Homo sapiens
aatcaatcaatggtgc

SEQ ID NO: 5113329 - DNA, 21 bp, Homo sapiens
aatcaatcatgtcagtctgct

SEQ ID NO: 5113330 - DNA, 21 bp, Homo sapiens
aatcaatctgcagtttaacaa

SEQ ID NO: 5113331 - DNA, 16 bp, Homo sapiens
aatcaatcttgcatgt

SEQ ID NO: 5113332 - DNA, 21 bp, Homo sapiens
aatcaatctttaacaacctct

SEQ ID NO: 5113333 - DNA, 21 bp, Homo sapiens
aatcaatgaaaaatgtaattt

SEQ ID NO: 5113334 - DNA, 16 bp, Homo sapiens
aatcaatgaatattga

SEQ ID NO: 5113335 - DNA, 22 bp, Homo sapiens
aatcaatgctataactatgttg

SEQ ID NO: 5113336 - DNA, 19 bp, Homo sapiens
aatcaatggtgcaaaaaaa

SEQ ID NO: 5113337 - DNA, 21 bp, Homo sapiens
aatcaattctgatacagcctt

SEQ ID NO: 5113338 - DNA, 14 bp, Homo sapiens
aatcaatttaaatg

SEQ ID NO: 5113339 - DNA, 15 bp, Homo sapiens
aatcaatttaaatgt

SEQ ID NO: 5113340 - DNA, 13 bp, Homo sapiens
aatcacaaaaaca

SEQ ID NO: 5113341 - DNA, 17 bp, Homo sapiens
aatcacaaaaacaaaaa

SEQ ID NO: 5113342 - DNA, 16 bp, Homo sapiens
aatcacaaaagtatat

SEQ ID NO: 5113343 - DNA, 21 bp, Homo sapiens
aatcacaaaagtatattcaaa

SEQ ID NO: 5113344 - DNA, 19 bp, Homo sapiens
aatcacaaactcatccatt

SEQ ID NO: 5113345 - DNA, 20 bp, Homo sapiens
aatcacaatgagaaaaataa

SEQ ID NO: 5113346 - DNA, 16 bp, Homo sapiens
aatcacaattctctga

SEQ ID NO: 5113347 - DNA, 16 bp, Homo sapiens
aatcacacctctgggc

SEQ ID NO: 5113348 - DNA, 17 bp, Homo sapiens
aatcacacgactgtcat

SEQ ID NO: 5113349 - DNA, 13 bp, Homo sapiens
aatcacactcaaa

SEQ ID NO: 5113350 - DNA, 19 bp, Homo sapiens
aatcacactcaaactttgt

SEQ ID NO: 5113351 - DNA, 17 bp, Homo sapiens
aatcacactctaagttc

SEQ ID NO: 5113352 - DNA, 16 bp, Homo sapiens
aatcacagaaaattta

SEQ ID NO: 5113353 - DNA, 13 bp, Homo sapiens
aatcacagaatca

SEQ ID NO: 5113354 - DNA, 21 bp, Homo sapiens
aatcacagatgcatatagaca

SEQ ID NO: 5113355 - DNA, 22 bp, Homo sapiens
aatcacagatgggtattaaact

SEQ ID NO: 5113356 - DNA, 20 bp, Homo sapiens
aatcacagcccaaaatttga

SEQ ID NO: 5113357 - DNA, 22 bp, Homo sapiens
aatcacagctcaagcattctgt

SEQ ID NO: 5113358 - DNA, 13 bp, Homo sapiens
aatcacagctcac

SEQ ID NO: 5113359 - DNA, 13 bp, Homo sapiens
aatcacaggaaaa

SEQ ID NO: 5113360 - DNA, 12 bp, Homo sapiens
aatcacaggctg

SEQ ID NO: 5113361 - DNA, 13 bp, Homo sapiens
aatcacaggctgg

SEQ ID NO: 5113362 - DNA, 21 bp, Homo sapiens
aatcacaggctgggctgggca

SEQ ID NO: 5113363 - DNA, 21 bp, Homo sapiens
aatcacagggaatggccacaa

SEQ ID NO: 5113364 - DNA, 16 bp, Homo sapiens
aatcacagtgttgcat

SEQ ID NO: 5113365 - DNA, 13 bp, Homo sapiens
aatcacatcctgg

SEQ ID NO: 5113366 - DNA, 16 bp, Homo sapiens
aatcacatcctggcct

SEQ ID NO: 5113367 - DNA, 14 bp, Homo sapiens
aatcaccaattaaa

SEQ ID NO: 5113368 - DNA, 17 bp, Homo sapiens
aatcaccaattaaaaac

SEQ ID NO: 5113369 - DNA, 18 bp, Homo sapiens
aatcaccatagggctggg

SEQ ID NO: 5113370 - DNA, 21 bp, Homo sapiens
aatcaccatgtaacaaccaga

SEQ ID NO: 5113371 - DNA, 15 bp, Homo sapiens
aatcaccatgtaagc

SEQ ID NO: 5113372 - DNA, 16 bp, Homo sapiens
aatcaccatgtaagca

SEQ ID NO: 5113373 - DNA, 17 bp, Homo sapiens
aatcacccaatcccagt

SEQ ID NO: 5113374 - DNA, 15 bp, Homo sapiens
aatcacccccaggac

SEQ ID NO: 5113375 - DNA, 15 bp, Homo sapiens
aatcacccctctgcc

SEQ ID NO: 5113376 - DNA, 20 bp, Homo sapiens
aatcacccctctgcccctgc

SEQ ID NO: 5113377 - DNA, 16 bp, Homo sapiens
aatcaccctaccaact

SEQ ID NO: 5113378 - DNA, 19 bp, Homo sapiens
aatcacctgaaccccagag

SEQ ID NO: 5113379 - DNA, 22 bp, Homo sapiens
aatcacctgaaccccagaggca

SEQ ID NO: 5113380 - DNA, 17 bp, Homo sapiens
aatcaccttttctaaaa

SEQ ID NO: 5113381 - DNA, 18 bp, Homo sapiens
aatcacgagatcttcctt

SEQ ID NO: 5113382 - DNA, 20 bp, Homo sapiens
aatcacgctttttgaaaaag

SEQ ID NO: 5113383 - DNA, 20 bp, Homo sapiens
aatcacgtaaagctagaaat

SEQ ID NO: 5113384 - DNA, 21 bp, Homo sapiens
aatcacgtaaagctagaaatg

SEQ ID NO: 5113385 - DNA, 20 bp, Homo sapiens
aatcacgttgctggtggttt

SEQ ID NO: 5113386 - DNA, 21 bp, Homo sapiens
aatcacgttgctggtggtttt

SEQ ID NO: 5113387 - DNA, 16 bp, Homo sapiens
aatcactaaactttat

SEQ ID NO: 5113388 - DNA, 16 bp, Homo sapiens
aatcactaaatatcta

SEQ ID NO: 5113389 - DNA, 23 bp, Homo sapiens
aatcactaaatatctagtgctaa

SEQ ID NO: 5113390 - DNA, 22 bp, Homo sapiens
aatcactaacattatattgcaa

SEQ ID NO: 5113391 - DNA, 16 bp, Homo sapiens
aatcactaggtaactt

SEQ ID NO: 5113392 - DNA, 19 bp, Homo sapiens
aatcactaggtaacttatt

SEQ ID NO: 5113393 - DNA, 18 bp, Homo sapiens
aatcactagtcaagaaaa

SEQ ID NO: 5113394 - DNA, 20 bp, Homo sapiens
aatcactagtcaagaaaaat

SEQ ID NO: 5113395 - DNA, 14 bp, Homo sapiens
aatcactattctta

SEQ ID NO: 5113396 - DNA, 16 bp, Homo sapiens
aatcactcagagcagt

SEQ ID NO: 5113397 - DNA, 18 bp, Homo sapiens
aatcactcattctatgaa

SEQ ID NO: 5113398 - DNA, 20 bp, Homo sapiens
aatcactcatttatttccat

SEQ ID NO: 5113399 - DNA, 18 bp, Homo sapiens
aatcactctaattaattg

SEQ ID NO: 5113400 - DNA, 14 bp, Homo sapiens
aatcactctgagtc

SEQ ID NO: 5113401 - DNA, 12 bp, Homo sapiens
aatcactcttgt

SEQ ID NO: 5113402 - DNA, 21 bp, Homo sapiens
aatcactgaggcatttttact

SEQ ID NO: 5113403 - DNA, 11 bp, Homo sapiens
aatcactgcac

SEQ ID NO: 5113404 - DNA, 13 bp, Homo sapiens
aatcactgcagcc

SEQ ID NO: 5113405 - DNA, 18 bp, Homo sapiens
aatcactgcagcccagga

SEQ ID NO: 5113406 - DNA, 11 bp, Homo sapiens
aatcactgcca

SEQ ID NO: 5113407 - DNA, 13 bp, Homo sapiens
aatcactgctcca

SEQ ID NO: 5113408 - DNA, 15 bp, Homo sapiens
aatcactgctccagg

SEQ ID NO: 5113409 - DNA, 16 bp, Homo sapiens
aatcactgctccaggc

SEQ ID NO: 5113410 - DNA, 17 bp, Homo sapiens
aatcactgggcccagag

SEQ ID NO: 5113411 - DNA, 18 bp, Homo sapiens
aatcactgggcccagagg

SEQ ID NO: 5113412 - DNA, 13 bp, Homo sapiens
aatcactgtgaaa

SEQ ID NO: 5113413 - DNA, 23 bp, Homo sapiens
aatcactgtgaaatttcatgatt

SEQ ID NO: 5113414 - DNA, 14 bp, Homo sapiens
aatcactgtgctat

SEQ ID NO: 5113415 - DNA, 21 bp, Homo sapiens
aatcactgtgcttaatttaaa

SEQ ID NO: 5113416 - DNA, 20 bp, Homo sapiens
aatcactgtggggaaacaat

SEQ ID NO: 5113417 - DNA, 19 bp, Homo sapiens
aatcactgtgtatatttga

SEQ ID NO: 5113418 - DNA, 23 bp, Homo sapiens
aatcactgtgtatatttgattta

SEQ ID NO: 5113419 - DNA, 19 bp, Homo sapiens
aatcactgttgagttctga

SEQ ID NO: 5113420 - DNA, 13 bp, Homo sapiens
aatcactgttgct

SEQ ID NO: 5113421 - DNA, 11 bp, Homo sapiens
aatcactgttt

SEQ ID NO: 5113422 - DNA, 19 bp, Homo sapiens
aatcactgtttagaacaca

SEQ ID NO: 5113423 - DNA, 16 bp, Homo sapiens
aatcactgtttttaga

SEQ ID NO: 5113424 - DNA, 15 bp, Homo sapiens
aatcacttaaaggca

SEQ ID NO: 5113425 - DNA, 13 bp, Homo sapiens
aatcacttcagat

SEQ ID NO: 5113426 - DNA, 14 bp, Homo sapiens
aatcacttcagatc

SEQ ID NO: 5113427 - DNA, 19 bp, Homo sapiens
aatcacttcattgttttaa

SEQ ID NO: 5113428 - DNA, 23 bp, Homo sapiens
aatcacttgaacccgggggacag

SEQ ID NO: 5113429 - DNA, 16 bp, Homo sapiens
aatcacttgtaaataa

SEQ ID NO: 5113430 - DNA, 17 bp, Homo sapiens
aatcacttgtaaataaa

SEQ ID NO: 5113431 - DNA, 21 bp, Homo sapiens
aatcacttgtaaataaataga

SEQ ID NO: 5113432 - DNA, 19 bp, Homo sapiens
aatcactttacctgcaggc

SEQ ID NO: 5113433 - DNA, 22 bp, Homo sapiens
aatcactttacctgcaggctcc

SEQ ID NO: 5113434 - DNA, 13 bp, Homo sapiens
aatcactttgtct

SEQ ID NO: 5113435 - DNA, 16 bp, Homo sapiens
aatcactttgtctaac

SEQ ID NO: 5113436 - DNA, 11 bp, Homo sapiens
aatcagaaaac

SEQ ID NO: 5113437 - DNA, 14 bp, Homo sapiens
aatcagaaaaccca

SEQ ID NO: 5113438 - DNA, 14 bp, Homo sapiens
aatcagaaaagtaa

SEQ ID NO: 5113439 - DNA, 20 bp, Homo sapiens
aatcagaaaagtaattttgt

SEQ ID NO: 5113440 - DNA, 22 bp, Homo sapiens
aatcagaaaagtaattttgtca

SEQ ID NO: 5113441 - DNA, 18 bp, Homo sapiens
aatcagaaagaaaaaatt

SEQ ID NO: 5113442 - DNA, 19 bp, Homo sapiens
aatcagaaagaaaaaattt

SEQ ID NO: 5113443 - DNA, 22 bp, Homo sapiens
aatcagaaagaaaaaattttat

SEQ ID NO: 5113444 - DNA, 17 bp, Homo sapiens
aatcagaaagtaacaat

SEQ ID NO: 5113445 - DNA, 14 bp, Homo sapiens
aatcagaaattttt

SEQ ID NO: 5113446 - DNA, 12 bp, Homo sapiens
aatcagaactca

SEQ ID NO: 5113447 - DNA, 12 bp, Homo sapiens
aatcagaagaaa

SEQ ID NO: 5113448 - DNA, 15 bp, Homo sapiens
aatcagaagcacaaa

SEQ ID NO: 5113449 - DNA, 21 bp, Homo sapiens
aatcagaagtgcaaaggtgtg

SEQ ID NO: 5113450 - DNA, 17 bp, Homo sapiens
aatcagaataaagttgt

SEQ ID NO: 5113451 - DNA, 14 bp, Homo sapiens
aatcagaatggaag

SEQ ID NO: 5113452 - DNA, 14 bp, Homo sapiens
aatcagacacaatt

SEQ ID NO: 5113453 - DNA, 15 bp, Homo sapiens
aatcagacagcagga

SEQ ID NO: 5113454 - DNA, 18 bp, Homo sapiens
aatcagaccaaggaacaa

SEQ ID NO: 5113455 - DNA, 20 bp, Homo sapiens
aatcagaccctaccccacca

SEQ ID NO: 5113456 - DNA, 17 bp, Homo sapiens
aatcagactatgaagtt

SEQ ID NO: 5113457 - DNA, 17 bp, Homo sapiens
aatcagactcatctaca

SEQ ID NO: 5113458 - DNA, 20 bp, Homo sapiens
aatcagactcttggggaagc

SEQ ID NO: 5113459 - DNA, 12 bp, Homo sapiens
aatcagagaaaa

SEQ ID NO: 5113460 - DNA, 14 bp, Homo sapiens
aatcagagaaaact

SEQ ID NO: 5113461 - DNA, 17 bp, Homo sapiens
aatcagagaaaactgtt

SEQ ID NO: 5113462 - DNA, 21 bp, Homo sapiens
aatcagagaccaggccctggc

SEQ ID NO: 5113463 - DNA, 16 bp, Homo sapiens
aatcagagagcctaga

SEQ ID NO: 5113464 - DNA, 20 bp, Homo sapiens
aatcagagagcctagaacat

SEQ ID NO: 5113465 - DNA, 22 bp, Homo sapiens
aatcagagagcctagaacatcc

SEQ ID NO: 5113466 - DNA, 23 bp, Homo sapiens
aatcagagattattcaacagaga

SEQ ID NO: 5113467 - DNA, 15 bp, Homo sapiens
aatcagaggcagaga

SEQ ID NO: 5113468 - DNA, 16 bp, Homo sapiens
aatcagagtggccaat

SEQ ID NO: 5113469 - DNA, 14 bp, Homo sapiens
aatcagatagatat

SEQ ID NO: 5113470 - DNA, 16 bp, Homo sapiens
aatcagatggtgtcat

SEQ ID NO: 5113471 - DNA, 17 bp, Homo sapiens
aatcagatggtgtcatt

SEQ ID NO: 5113472 - DNA, 18 bp, Homo sapiens
aatcagattgcttaaaag

SEQ ID NO: 5113473 - DNA, 18 bp, Homo sapiens
aatcagattttcctgtgg

SEQ ID NO: 5113474 - DNA, 18 bp, Homo sapiens
aatcagcaaacacaataa

SEQ ID NO: 5113475 - DNA, 19 bp, Homo sapiens
aatcagcaaacacaataag

SEQ ID NO: 5113476 - DNA, 12 bp, Homo sapiens
aatcagcactct

SEQ ID NO: 5113477 - DNA, 15 bp, Homo sapiens
aatcagcactctgta

SEQ ID NO: 5113478 - DNA, 17 bp, Homo sapiens
aatcagcactctgtaaa

SEQ ID NO: 5113479 - DNA, 15 bp, Homo sapiens
aatcagcactgaaaa

SEQ ID NO: 5113480 - DNA, 16 bp, Homo sapiens
aatcagcactgaaaat

SEQ ID NO: 5113481 - DNA, 22 bp, Homo sapiens
aatcagcatcgtgggcactgct

SEQ ID NO: 5113482 - DNA, 12 bp, Homo sapiens
aatcagcattct

SEQ ID NO: 5113483 - DNA, 18 bp, Homo sapiens
aatcagcatttttcttta

SEQ ID NO: 5113484 - DNA, 15 bp, Homo sapiens
aatcagccaagtttt

SEQ ID NO: 5113485 - DNA, 17 bp, Homo sapiens
aatcagccaagttttat

SEQ ID NO: 5113486 - DNA, 13 bp, Homo sapiens
aatcagcccccag

SEQ ID NO: 5113487 - DNA, 19 bp, Homo sapiens
aatagagtacttaatatac

SEQ ID NO: 5113488 - DNA, 20 bp, Homo sapiens
aatagagtcacagctttccc

SEQ ID NO: 5113489 - DNA, 18 bp, Homo sapiens
aatagagttggagtttta

SEQ ID NO: 5113490 - DNA, 22 bp, Homo sapiens
aatagagtttgctattagagca

SEQ ID NO: 5113491 - DNA, 20 bp, Homo sapiens
aatagataaggtttcctgct

SEQ ID NO: 5113492 - DNA, 14 bp, Homo sapiens
aatagatacttttg

SEQ ID NO: 5113493 - DNA, 21 bp, Homo sapiens
aatagatatccacttgagaca

SEQ ID NO: 5113494 - DNA, 19 bp, Homo sapiens
aatagatatgaaagctgat

SEQ ID NO: 5113495 - DNA, 19 bp, Homo sapiens
aatagatgacattgactat

SEQ ID NO: 5113496 - DNA, 17 bp, Homo sapiens
aatagatgagtcctgtt

SEQ ID NO: 5113497 - DNA, 11 bp, Homo sapiens
aatagatggac

SEQ ID NO: 5113498 - DNA, 22 bp, Homo sapiens
aatagatggacagtttgtttcc

SEQ ID NO: 5113499 - DNA, 21 bp, Homo sapiens
aatagatggggcatataataa

SEQ ID NO: 5113500 - DNA, 15 bp, Homo sapiens
aatagatgtcttcat

SEQ ID NO: 5113501 - DNA, 16 bp, Homo sapiens
aatagatgtcttttat

SEQ ID NO: 5113502 - DNA, 16 bp, Homo sapiens
aatagatgtgatcact

SEQ ID NO: 5113503 - DNA, 16 bp, Homo sapiens
aatagatgtggtcctt

SEQ ID NO: 5113504 - DNA, 15 bp, Homo sapiens
aatagattcagagaa

SEQ ID NO: 5113505 - DNA, 17 bp, Homo sapiens
aatagattcagagaaat

SEQ ID NO: 5113506 - DNA, 11 bp, Homo sapiens
aatagattctc

SEQ ID NO: 5113507 - DNA, 20 bp, Homo sapiens
aatagattcttaaagtggct

SEQ ID NO: 5113508 - DNA, 23 bp, Homo sapiens
aatagatttcagctatgcagaaa

SEQ ID NO: 5113509 - DNA, 17 bp, Homo sapiens
aatagatttttgattca

SEQ ID NO: 5113510 - DNA, 20 bp, Homo sapiens
aatagcaaaagaagaagttt

SEQ ID NO: 5113511 - DNA, 17 bp, Homo sapiens
aatagcaacatgcttca

SEQ ID NO: 5113512 - DNA, 17 bp, Homo sapiens
aatagcaacttttgtgt

SEQ ID NO: 5113513 - DNA, 20 bp, Homo sapiens
aatagcaagagtgtgaaatc

SEQ ID NO: 5113514 - DNA, 13 bp, Homo sapiens
aatagcaaggcca

SEQ ID NO: 5113515 - DNA, 16 bp, Homo sapiens
aatagcaaggccaggg

SEQ ID NO: 5113516 - DNA, 12 bp, Homo sapiens
aatagcaataac

SEQ ID NO: 5113517 - DNA, 16 bp, Homo sapiens
aatagcaatagcatgg

SEQ ID NO: 5113518 - DNA, 22 bp, Homo sapiens
aatagcacagccagacttgctt

SEQ ID NO: 5113519 - DNA, 20 bp, Homo sapiens
aatagcactttcattgccag

SEQ ID NO: 5113520 - DNA, 13 bp, Homo sapiens
aatagcacttttt

SEQ ID NO: 5113521 - DNA, 23 bp, Homo sapiens
aatagcagaaaaaccaacatcta

SEQ ID NO: 5113522 - DNA, 16 bp, Homo sapiens
aatagcagagagccaa

SEQ ID NO: 5113523 - DNA, 18 bp, Homo sapiens
aatagcagagagccaaat

SEQ ID NO: 5113524 - DNA, 14 bp, Homo sapiens
aatagcagcctttc

SEQ ID NO: 5113525 - DNA, 19 bp, Homo sapiens
aatagcagtggcaaaatat

SEQ ID NO: 5113526 - DNA, 20 bp, Homo sapiens
aatagcagtggcaaaatatt

SEQ ID NO: 5113527 - DNA, 15 bp, Homo sapiens
aatagcatactgtgt

SEQ ID NO: 5113528 - DNA, 19 bp, Homo sapiens
aatagcatactgtgtatgt

SEQ ID NO: 5113529 - DNA, 15 bp, Homo sapiens
aatagcatctgctct

SEQ ID NO: 5113530 - DNA, 14 bp, Homo sapiens
aatagcatgtattg

SEQ ID NO: 5113531 - DNA, 18 bp, Homo sapiens
aatagcatgttgtagata

SEQ ID NO: 5113532 - DNA, 15 bp, Homo sapiens
aatagcattatctta

SEQ ID NO: 5113533 - DNA, 21 bp, Homo sapiens
aatagcattatcttatcattt

SEQ ID NO: 5113534 - DNA, 19 bp, Homo sapiens
aatagcattgttcttctcc

SEQ ID NO: 5113535 - DNA, 18 bp, Homo sapiens
aatagcatttggaaacca

SEQ ID NO: 5113536 - DNA, 21 bp, Homo sapiens
aatagccaacacccatctgtt

SEQ ID NO: 5113537 - DNA, 20 bp, Homo sapiens
aatagccacaattatataaa

SEQ ID NO: 5113538 - DNA, 22 bp, Homo sapiens
aatagccacatttggaatactt

SEQ ID NO: 5113539 - DNA, 19 bp, Homo sapiens
aatagccaccttgattttc

SEQ ID NO: 5113540 - DNA, 16 bp, Homo sapiens
aatagccccagactgg

SEQ ID NO: 5113541 - DNA, 21 bp, Homo sapiens
aatagccccatctctcctgct

SEQ ID NO: 5113542 - DNA, 16 bp, Homo sapiens
aatagcctaaaagatt

SEQ ID NO: 5113543 - DNA, 20 bp, Homo sapiens
aatagcctaaaagattttgt

SEQ ID NO: 5113544 - DNA, 15 bp, Homo sapiens
aatagcctaaatgat

SEQ ID NO: 5113545 - DNA, 14 bp, Homo sapiens
aatagcctggccac

SEQ ID NO: 5113546 - DNA, 20 bp, Homo sapiens
aatagcgatgtgcaggaaga

SEQ ID NO: 5113547 - DNA, 14 bp, Homo sapiens
aatagcggccctgg

SEQ ID NO: 5113548 - DNA, 15 bp, Homo sapiens
aatagcggccctgga

SEQ ID NO: 5113549 - DNA, 17 bp, Homo sapiens
aatagcgtgggatagat

SEQ ID NO: 5113550 - DNA, 22 bp, Homo sapiens
aatagctaatttatttccccag

SEQ ID NO: 5113551 - DNA, 23 bp, Homo sapiens
aatagctaatttatttccccagg

SEQ ID NO: 5113552 - DNA, 21 bp, Homo sapiens
aatagctagactggtgactga

SEQ ID NO: 5113553 - DNA, 18 bp, Homo sapiens
aatagctataaatagtga

SEQ ID NO: 5113554 - DNA, 22 bp, Homo sapiens
aatagctataaatagtgaaaat

SEQ ID NO: 5113555 - DNA, 21 bp, Homo sapiens
aatagctatatccatgtactg

SEQ ID NO: 5113556 - DNA, 20 bp, Homo sapiens
aatagctattgcatgtaaaa

SEQ ID NO: 5113557 - DNA, 17 bp, Homo sapiens
aatagctgccttcaagg

SEQ ID NO: 5113558 - DNA, 14 bp, Homo sapiens
aatagctgggacta

SEQ ID NO: 5113559 - DNA, 15 bp, Homo sapiens
aatagctgtagtttt

SEQ ID NO: 5113560 - DNA, 17 bp, Homo sapiens
aatagctgtcataaaat

SEQ ID NO: 5113561 - DNA, 19 bp, Homo sapiens
aatagctgtcataaaatga

SEQ ID NO: 5113562 - DNA, 22 bp, Homo sapiens
aatagctgtgatcagtgatttt

SEQ ID NO: 5113563 - DNA, 16 bp, Homo sapiens
aatagctgtgtatctg

SEQ ID NO: 5113564 - DNA, 17 bp, Homo sapiens
aatagctgtgtatctgt

SEQ ID NO: 5113565 - DNA, 16 bp, Homo sapiens
aatagctgttttgtgt

SEQ ID NO: 5113566 - DNA, 20 bp, Homo sapiens
aatagctgttttgtgtatat

SEQ ID NO: 5113567 - DNA, 16 bp, Homo sapiens
aatagcttatgaaaag

SEQ ID NO: 5113568 - DNA, 14 bp, Homo sapiens
aatagcttgtatag

SEQ ID NO: 5113569 - DNA, 14 bp, Homo sapiens
aatagcttgtttct

SEQ ID NO: 5113570 - DNA, 15 bp, Homo sapiens
aatagctttaatgat

SEQ ID NO: 5113571 - DNA, 19 bp, Homo sapiens
aatagctttgtatttttgt

SEQ ID NO: 5113572 - DNA, 15 bp, Homo sapiens
aatagcttttattga

SEQ ID NO: 5113573 - DNA, 18 bp, Homo sapiens
aatagcttttcacttctt

SEQ ID NO: 5113574 - DNA, 21 bp, Homo sapiens
aatagcttttcacttcttaag

SEQ ID NO: 5113575 - DNA, 14 bp, Homo sapiens
aatagcttttcctg

SEQ ID NO: 5113576 - DNA, 16 bp, Homo sapiens
aataggaaaaactgat

SEQ ID NO: 5113577 - DNA, 16 bp, Homo sapiens
aataggaaagatttaa

SEQ ID NO: 5113578 - DNA, 23 bp, Homo sapiens
aataggaaagatttaatgttaca

SEQ ID NO: 5113579 - DNA, 22 bp, Homo sapiens
aataggaagaacagtacatttt

SEQ ID NO: 5113580 - DNA, 10 bp, Homo sapiens
aataggaatt

SEQ ID NO: 5113581 - DNA, 12 bp, Homo sapiens
aataggaattca

SEQ ID NO: 5113582 - DNA, 16 bp, Homo sapiens
aataggaattggtttc

SEQ ID NO: 5113583 - DNA, 15 bp, Homo sapiens
aataggacttgtttt

SEQ ID NO: 5113584 - DNA, 13 bp, Homo sapiens
aataggagaaaat

SEQ ID NO: 5113585 - DNA, 23 bp, Homo sapiens
aataggagaaagcttaatatatt

SEQ ID NO: 5113586 - DNA, 19 bp, Homo sapiens
aataggatgaatgggaaag

SEQ ID NO: 5113587 - DNA, 23 bp, Homo sapiens
aataggattgcttcaattaaaat

SEQ ID NO: 5113588 - DNA, 14 bp, Homo sapiens
aataggatttgcac

SEQ ID NO: 5113589 - DNA, 15 bp, Homo sapiens
aataggcaaattaat

SEQ ID NO: 5113590 - DNA, 23 bp, Homo sapiens
aataggcagggggccctgcccca

SEQ ID NO: 5113591 - DNA, 18 bp, Homo sapiens
aataggcattaaatgcaa

SEQ ID NO: 5113592 - DNA, 20 bp, Homo sapiens
aataggcattaaatgcaaaa

SEQ ID NO: 5113593 - DNA, 14 bp, Homo sapiens
aataggcattttaa

SEQ ID NO: 5113594 - DNA, 14 bp, Homo sapiens
aataggcctattta

SEQ ID NO: 5113595 - DNA, 19 bp, Homo sapiens
aataggcggggcttgcctt

SEQ ID NO: 5113596 - DNA, 20 bp, Homo sapiens
aataggctattaaaaaagtc

SEQ ID NO: 5113597 - DNA, 18 bp, Homo sapiens
aataggctttagaagaga

SEQ ID NO: 5113598 - DNA, 16 bp, Homo sapiens
aataggctttttagga

SEQ ID NO: 5113599 - DNA, 18 bp, Homo sapiens
aataggctttttaggaac

SEQ ID NO: 5113600 - DNA, 18 bp, Homo sapiens
aatagggactatctatct

SEQ ID NO: 5113601 - DNA, 15 bp, Homo sapiens
aatagggatccactt

SEQ ID NO: 5113602 - DNA, 19 bp, Homo sapiens
aatagggcccatgggaggg

SEQ ID NO: 5113603 - DNA, 20 bp, Homo sapiens
aatagggcccatgggaggga

SEQ ID NO: 5113604 - DNA, 16 bp, Homo sapiens
aataggggatatttaa

SEQ ID NO: 5113605 - DNA, 15 bp, Homo sapiens
aatagggtagaatga

SEQ ID NO: 5113606 - DNA, 16 bp, Homo sapiens
aatagggtagaatgat

SEQ ID NO: 5113607 - DNA, 19 bp, Homo sapiens
aatagggtatattttccta

SEQ ID NO: 5113608 - DNA, 20 bp, Homo sapiens
aatagggtatattttcctat

SEQ ID NO: 5113609 - DNA, 19 bp, Homo sapiens
aataggtagagtcattcat

SEQ ID NO: 5113610 - DNA, 15 bp, Homo sapiens
aataggtagtttgga

SEQ ID NO: 5113611 - DNA, 13 bp, Homo sapiens
aataggtatatag

SEQ ID NO: 5113612 - DNA, 14 bp, Homo sapiens
aataggtatataga

SEQ ID NO: 5113613 - DNA, 15 bp, Homo sapiens
aataggtatcaaaat

SEQ ID NO: 5113614 - DNA, 18 bp, Homo sapiens
aataggtcatatgttgtg

SEQ ID NO: 5113615 - DNA, 12 bp, Homo sapiens
aataggtctgga

SEQ ID NO: 5113616 - DNA, 14 bp, Homo sapiens
aataggtgcaaaaa

SEQ ID NO: 5113617 - DNA, 15 bp, Homo sapiens
aataggtgcaaacaa

SEQ ID NO: 5113618 - DNA, 16 bp, Homo sapiens
aataggtgtgatttcc

SEQ ID NO: 5113619 - DNA, 16 bp, Homo sapiens
aataggttaatatcaa

SEQ ID NO: 5113620 - DNA, 17 bp, Homo sapiens
aataggtttgtaaaatg

SEQ ID NO: 5113621 - DNA, 13 bp, Homo sapiens
aataggttttaaa

SEQ ID NO: 5113622 - DNA, 23 bp, Homo sapiens
aataggttttccctgttctggac

SEQ ID NO: 5113623 - DNA, 14 bp, Homo sapiens
aatagtaaactaaa

SEQ ID NO: 5113624 - DNA, 23 bp, Homo sapiens
aatagtaaataatgattcaatgt

SEQ ID NO: 5113625 - DNA, 20 bp, Homo sapiens
aatagtaagcctccctcctc

SEQ ID NO: 5113626 - DNA, 14 bp, Homo sapiens
aatagtaatataat

SEQ ID NO: 5113627 - DNA, 15 bp, Homo sapiens
aatagtaatataata

SEQ ID NO: 5113628 - DNA, 16 bp, Homo sapiens
aatagtaatataatac

SEQ ID NO: 5113629 - DNA, 13 bp, Homo sapiens
aatagtaatgttt

SEQ ID NO: 5113630 - DNA, 15 bp, Homo sapiens
aatagtaatttgtaa

SEQ ID NO: 5113631 - DNA, 16 bp, Homo sapiens
aatagtaatttgtaaa

SEQ ID NO: 5113632 - DNA, 21 bp, Homo sapiens
aatagtaatttgtaaagttgg

SEQ ID NO: 5113633 - DNA, 13 bp, Homo sapiens
aatagtagatgtg

SEQ ID NO: 5113634 - DNA, 22 bp, Homo sapiens
aatagtagatgtggcctttgaa

SEQ ID NO: 5113635 - DNA, 18 bp, Homo sapiens
aatagtaggctaaaaaca

SEQ ID NO: 5113636 - DNA, 15 bp, Homo sapiens
aatagtatacattgt

SEQ ID NO: 5113637 - DNA, 21 bp, Homo sapiens
aatagtatagaaaatggaaaa

SEQ ID NO: 5113638 - DNA, 21 bp, Homo sapiens
aatagtatatctaatggctgt

SEQ ID NO: 5113639 - DNA, 20 bp, Homo sapiens
aatagtatatgcatttttaa

SEQ ID NO: 5113640 - DNA, 22 bp, Homo sapiens
aatagtatccagcacagatttg

SEQ ID NO: 5113641 - DNA, 23 bp, Homo sapiens
aatagtatcctccaggtttttca

SEQ ID NO: 5113642 - DNA, 18 bp, Homo sapiens
aatagtatgaaaatggaa

SEQ ID NO: 5113643 - DNA, 23 bp, Homo sapiens
aatagtatgagtaatgcttaagg

SEQ ID NO: 5113644 - DNA, 13 bp, Homo sapiens
aatagtattgctg

SEQ ID NO: 5113645 - DNA, 15 bp, Homo sapiens
aatagtatttcccat

SEQ ID NO: 5113646 - DNA, 15 bp, Homo sapiens
aatagtatttgagag

SEQ ID NO: 5113647 - DNA, 20 bp, Homo sapiens
aatagtatttgagagttcta

SEQ ID NO: 5113648 - DNA, 17 bp, Homo sapiens
aatagtcaagaaaaatt

SEQ ID NO: 5113649 - DNA, 14 bp, Homo sapiens
aatagtcatacctg

SEQ ID NO: 5113650 - DNA, 16 bp, Homo sapiens
aatagtcatatgtgaa

SEQ ID NO: 5113651 - DNA, 13 bp, Homo sapiens
aatagtcatgttt

SEQ ID NO: 5113652 - DNA, 22 bp, Homo sapiens
aatagtccccatcagcaccatg

SEQ ID NO: 5113653 - DNA, 15 bp, Homo sapiens
aatagtcctaaaaag

SEQ ID NO: 5113654 - DNA, 19 bp, Homo sapiens
aatagtcctccaaaacaca

SEQ ID NO: 5113655 - DNA, 22 bp, Homo sapiens
aatagtcgtgaatcttgttcaa

SEQ ID NO: 5113656 - DNA, 14 bp, Homo sapiens
aatagtctagatgg

SEQ ID NO: 5113657 - DNA, 19 bp, Homo sapiens
aatagtctctctgcaagac

SEQ ID NO: 5113658 - DNA, 16 bp, Homo sapiens
aatagtctgattttaa

SEQ ID NO: 5113659 - DNA, 22 bp, Homo sapiens
aatagtcttttgcatgtcgcac

SEQ ID NO: 5113660 - DNA, 19 bp, Homo sapiens
aatagtgaaaattttattg

SEQ ID NO: 5113661 - DNA, 21 bp, Homo sapiens
aatagtgaaaattttattgaa

SEQ ID NO: 5113662 - DNA, 13 bp, Homo sapiens
aatagtgaaatga

SEQ ID NO: 5113663 - DNA, 15 bp, Homo sapiens
aatagtgatttttgt

SEQ ID NO: 5113664 - DNA, 20 bp, Homo sapiens
aatagtgcaacatctctgaa

SEQ ID NO: 5113665 - DNA, 23 bp, Homo sapiens
aatcagcctcatgactttatagt

SEQ ID NO: 5113666 - DNA, 12 bp, Homo sapiens
aatcagcctctt

SEQ ID NO: 5113667 - DNA, 13 bp, Homo sapiens
aatcagcctgctc

SEQ ID NO: 5113668 - DNA, 19 bp, Homo sapiens
aatcagcctgctccagctg

SEQ ID NO: 5113669 - DNA, 15 bp, Homo sapiens
aatcagcgccctgga

SEQ ID NO: 5113670 - DNA, 17 bp, Homo sapiens
aatcagctattttgtga

SEQ ID NO: 5113671 - DNA, 23 bp, Homo sapiens
aatcagctccttttccgttctgt

SEQ ID NO: 5113672 - DNA, 12 bp, Homo sapiens
aatcagctctcc

SEQ ID NO: 5113673 - DNA, 16 bp, Homo sapiens
aatcagctctcctggc

SEQ ID NO: 5113674 - DNA, 11 bp, Homo sapiens
aatcagctgct

SEQ ID NO: 5113675 - DNA, 12 bp, Homo sapiens
aatcagctgctt

SEQ ID NO: 5113676 - DNA, 17 bp, Homo sapiens
aatcagctgctttgtta

SEQ ID NO: 5113677 - DNA, 15 bp, Homo sapiens
aatcagctggacata

SEQ ID NO: 5113678 - DNA, 22 bp, Homo sapiens
aatcagctggacatactgctgg

SEQ ID NO: 5113679 - DNA, 20 bp, Homo sapiens
aatcagctgttgcaggcagt

SEQ ID NO: 5113680 - DNA, 22 bp, Homo sapiens
aatcagctgttgcaggcagtgt

SEQ ID NO: 5113681 - DNA, 17 bp, Homo sapiens
aatcaggaaaggctgta

SEQ ID NO: 5113682 - DNA, 15 bp, Homo sapiens
aatcaggagcctgct

SEQ ID NO: 5113683 - DNA, 19 bp, Homo sapiens
aatcaggaggagattaaca

SEQ ID NO: 5113684 - DNA, 18 bp, Homo sapiens
aatcaggattttagtgct

SEQ ID NO: 5113685 - DNA, 18 bp, Homo sapiens
aatcaggcatttttccaa

SEQ ID NO: 5113686 - DNA, 14 bp, Homo sapiens
aatcaggctttgtc

SEQ ID NO: 5113687 - DNA, 15 bp, Homo sapiens
aatcaggcttttgtt

SEQ ID NO: 5113688 - DNA, 17 bp, Homo sapiens
aatcagggaccagcttt

SEQ ID NO: 5113689 - DNA, 18 bp, Homo sapiens
aatcagggaccagcttta

SEQ ID NO: 5113690 - DNA, 12 bp, Homo sapiens
aatcagggagca

SEQ ID NO: 5113691 - DNA, 22 bp, Homo sapiens
aatcagggttagtattgtccag

SEQ ID NO: 5113692 - DNA, 17 bp, Homo sapiens
aatcaggtaagatcata

SEQ ID NO: 5113693 - DNA, 20 bp, Homo sapiens
aatcaggtagaccatattct

SEQ ID NO: 5113694 - DNA, 22 bp, Homo sapiens
aatcaggtagaccatattctaa

SEQ ID NO: 5113695 - DNA, 15 bp, Homo sapiens
aatcaggtagacttt

SEQ ID NO: 5113696 - DNA, 20 bp, Homo sapiens
aatcaggtagacttttaata

SEQ ID NO: 5113697 - DNA, 19 bp, Homo sapiens
aatcaggttgttaatgttg

SEQ ID NO: 5113698 - DNA, 14 bp, Homo sapiens
aatcagtaaacact

SEQ ID NO: 5113699 - DNA, 11 bp, Homo sapiens
aatcagtaatt

SEQ ID NO: 5113700 - DNA, 16 bp, Homo sapiens
aatcagtagaaagcta

SEQ ID NO: 5113701 - DNA, 21 bp, Homo sapiens
aatcagtagaaagctaaagtg

SEQ ID NO: 5113702 - DNA, 21 bp, Homo sapiens
aatcagtagacctgattttca

SEQ ID NO: 5113703 - DNA, 18 bp, Homo sapiens
aatcagtaggaccaggcc

SEQ ID NO: 5113704 - DNA, 14 bp, Homo sapiens
aatcagtataaaca

SEQ ID NO: 5113705 - DNA, 15 bp, Homo sapiens
aatcagtatattttc

SEQ ID NO: 5113706 - DNA, 15 bp, Homo sapiens
aatcagtatttcctt

SEQ ID NO: 5113707 - DNA, 18 bp, Homo sapiens
aatcagtatttccttcca

SEQ ID NO: 5113708 - DNA, 13 bp, Homo sapiens
aatcagtattttt

SEQ ID NO: 5113709 - DNA, 13 bp, Homo sapiens
aatcagtcccctc

SEQ ID NO: 5113710 - DNA, 14 bp, Homo sapiens
aatcagtcccctcc

SEQ ID NO: 5113711 - DNA, 18 bp, Homo sapiens
aatcagtcctttgattcc

SEQ ID NO: 5113712 - DNA, 15 bp, Homo sapiens
aatcagtcttccttg

SEQ ID NO: 5113713 - DNA, 19 bp, Homo sapiens
aatcagtgggcaggataaa

SEQ ID NO: 5113714 - DNA, 24 bp, Homo sapiens
aatcagtgggcaggataaactgaa

SEQ ID NO: 5113715 - DNA, 21 bp, Homo sapiens
aatcagtgtagccccaagaag

SEQ ID NO: 5113716 - DNA, 14 bp, Homo sapiens
aatcagtgtgaatg

SEQ ID NO: 5113717 - DNA, 14 bp, Homo sapiens
aatcagtgtgtcta

SEQ ID NO: 5113718 - DNA, 17 bp, Homo sapiens
aatcagtgtgtctaaat

SEQ ID NO: 5113719 - DNA, 22 bp, Homo sapiens
aatcagtgtgtctaaatttgaa

SEQ ID NO: 5113720 - DNA, 17 bp, Homo sapiens
aatcagtgttaaattca

SEQ ID NO: 5113721 - DNA, 18 bp, Homo sapiens
aatcagtgtttaaataaa

SEQ ID NO: 5113722 - DNA, 15 bp, Homo sapiens
aatcagttagttttt

SEQ ID NO: 5113723 - DNA, 22 bp, Homo sapiens
aatcagttatacagttataaaa

SEQ ID NO: 5113724 - DNA, 17 bp, Homo sapiens
aatcagttcattagaaa

SEQ ID NO: 5113725 - DNA, 20 bp, Homo sapiens
aatcagttcattagaaatat

SEQ ID NO: 5113726 - DNA, 21 bp, Homo sapiens
aatcagttgcgcgttctgaaa

SEQ ID NO: 5113727 - DNA, 18 bp, Homo sapiens
aatcagtttattaaatct

SEQ ID NO: 5113728 - DNA, 19 bp, Homo sapiens
aatcagtttattaaatctg

SEQ ID NO: 5113729 - DNA, 23 bp, Homo sapiens
aatcagtttattaaatctgaatt

SEQ ID NO: 5113730 - DNA, 20 bp, Homo sapiens
aatcagtttccactacattc

SEQ ID NO: 5113731 - DNA, 14 bp, Homo sapiens
aatcagttttcctc

SEQ ID NO: 5113732 - DNA, 22 bp, Homo sapiens
aatcagttttggaatctaagct

SEQ ID NO: 5113733 - DNA, 12 bp, Homo sapiens
aatcagttttgt

SEQ ID NO: 5113734 - DNA, 20 bp, Homo sapiens
aatcagtttttaaaatattt

SEQ ID NO: 5113735 - DNA, 13 bp, Homo sapiens
aatcagtttttca

SEQ ID NO: 5113736 - DNA, 17 bp, Homo sapiens
aatcataaactgtgtgc

SEQ ID NO: 5113737 - DNA, 14 bp, Homo sapiens
aatcataaagtcag

SEQ ID NO: 5113738 - DNA, 22 bp, Homo sapiens
aatcataaatactgctgtataa

SEQ ID NO: 5113739 - DNA, 14 bp, Homo sapiens
aatcataacatagt

SEQ ID NO: 5113740 - DNA, 13 bp, Homo sapiens
aatcataatcatc

SEQ ID NO: 5113741 - DNA, 21 bp, Homo sapiens
aatcataatgtattatttaaa

SEQ ID NO: 5113742 - DNA, 19 bp, Homo sapiens
aatcatacaaactctcacc

SEQ ID NO: 5113743 - DNA, 20 bp, Homo sapiens
aatcatacaaactctcacca

SEQ ID NO: 5113744 - DNA, 20 bp, Homo sapiens
aatcatactcctatgcttta

SEQ ID NO: 5113745 - DNA, 16 bp, Homo sapiens
aatcatagctgtctga

SEQ ID NO: 5113746 - DNA, 22 bp, Homo sapiens
aatcataggcaccttttactgt

SEQ ID NO: 5113747 - DNA, 23 bp, Homo sapiens
aatcataggcaccttttactgtg

SEQ ID NO: 5113748 - DNA, 17 bp, Homo sapiens
aatcatagtgccataga

SEQ ID NO: 5113749 - DNA, 19 bp, Homo sapiens
aatcatagttactgtgtaa

SEQ ID NO: 5113750 - DNA, 12 bp, Homo sapiens
aatcatataaat

SEQ ID NO: 5113751 - DNA, 23 bp, Homo sapiens
aatcatatagaccaattgaagca

SEQ ID NO: 5113752 - DNA, 13 bp, Homo sapiens
aatcatatataat

SEQ ID NO: 5113753 - DNA, 20 bp, Homo sapiens
aatcatatgggatactgctg

SEQ ID NO: 5113754 - DNA, 13 bp, Homo sapiens
aatcatatgtgat

SEQ ID NO: 5113755 - DNA, 20 bp, Homo sapiens
aatcatattaaaattacaga

SEQ ID NO: 5113756 - DNA, 13 bp, Homo sapiens
aatcatatttgaa

SEQ ID NO: 5113757 - DNA, 14 bp, Homo sapiens
aatcatatttgaaa

SEQ ID NO: 5113758 - DNA, 14 bp, Homo sapiens
aatcatcaagaagg

SEQ ID NO: 5113759 - DNA, 23 bp, Homo sapiens
aatcatcaccacaccgtgagcag

SEQ ID NO: 5113760 - DNA, 22 bp, Homo sapiens
aatcatcagaaaggaaaaacaa

SEQ ID NO: 5113761 - DNA, 20 bp, Homo sapiens
aatcatccccatcctccaga

SEQ ID NO: 5113762 - DNA, 17 bp, Homo sapiens
aatcatccctattctgt

SEQ ID NO: 5113763 - DNA, 23 bp, Homo sapiens
aatcatccctattctgtgtttta

SEQ ID NO: 5113764 - DNA, 15 bp, Homo sapiens
aatcatcccttaata

SEQ ID NO: 5113765 - DNA, 12 bp, Homo sapiens
aatcatcctcat

SEQ ID NO: 5113766 - DNA, 13 bp, Homo sapiens
aatcatcctgaat

SEQ ID NO: 5113767 - DNA, 16 bp, Homo sapiens
aatcatcgaaaattca

SEQ ID NO: 5113768 - DNA, 17 bp, Homo sapiens
aatcatcgaaaattcat

SEQ ID NO: 5113769 - DNA, 12 bp, Homo sapiens
aatcatctattg

SEQ ID NO: 5113770 - DNA, 13 bp, Homo sapiens
aatcatctatttt

SEQ ID NO: 5113771 - DNA, 23 bp, Homo sapiens
aatcatctattttgatgcagcat

SEQ ID NO: 5113772 - DNA, 18 bp, Homo sapiens
aatcatctcctttgcaga

SEQ ID NO: 5113773 - DNA, 20 bp, Homo sapiens
aatcatctgcagttcttttt

SEQ ID NO: 5113774 - DNA, 16 bp, Homo sapiens
aatcatctgcattcct

SEQ ID NO: 5113775 - DNA, 18 bp, Homo sapiens
aatcatctgtgtgaaaat

SEQ ID NO: 5113776 - DNA, 15 bp, Homo sapiens
aatcatcttctccca

SEQ ID NO: 5113777 - DNA, 16 bp, Homo sapiens
aatcatgaaatatgca

SEQ ID NO: 5113778 - DNA, 20 bp, Homo sapiens
aatcatgaagatatttttcc

SEQ ID NO: 5113779 - DNA, 18 bp, Homo sapiens
aatcatgaagtaaattga

SEQ ID NO: 5113780 - DNA, 20 bp, Homo sapiens
aatcatgaagtaaattgaaa

SEQ ID NO: 5113781 - DNA, 19 bp, Homo sapiens
aatcatgaatatttcaaaa

SEQ ID NO: 5113782 - DNA, 17 bp, Homo sapiens
aatcatgaattagtttt

SEQ ID NO: 5113783 - DNA, 23 bp, Homo sapiens
aatcatgacttatcccattttca

SEQ ID NO: 5113784 - DNA, 22 bp, Homo sapiens
aatcatgagaaaaactgttctt

SEQ ID NO: 5113785 - DNA, 13 bp, Homo sapiens
aatcatgagcctg

SEQ ID NO: 5113786 - DNA, 17 bp, Homo sapiens
aatcatgagcctgctgg

SEQ ID NO: 5113787 - DNA, 18 bp, Homo sapiens
aatcatgagcctgctgga

SEQ ID NO: 5113788 - DNA, 15 bp, Homo sapiens
aatcatgagcctgtt

SEQ ID NO: 5113789 - DNA, 20 bp, Homo sapiens
aatcatgagcctgtttattg

SEQ ID NO: 5113790 - DNA, 23 bp, Homo sapiens
aatcatgatctgactttaattgt

SEQ ID NO: 5113791 - DNA, 16 bp, Homo sapiens
aatcatgctgttctct

SEQ ID NO: 5113792 - DNA, 20 bp, Homo sapiens
aatcatgctgttctctttgc

SEQ ID NO: 5113793 - DNA, 22 bp, Homo sapiens
aatcatgctgttctctttgctg

SEQ ID NO: 5113794 - DNA, 19 bp, Homo sapiens
aatcatggcctcttgaaga

SEQ ID NO: 5113795 - DNA, 23 bp, Homo sapiens
aatcatggctcactgcagccttg

SEQ ID NO: 5113796 - DNA, 14 bp, Homo sapiens
aatcatggctctta

SEQ ID NO: 5113797 - DNA, 17 bp, Homo sapiens
aatcatgggaattttaa

SEQ ID NO: 5113798 - DNA, 23 bp, Homo sapiens
aatcatgggcattgctggactga

SEQ ID NO: 5113799 - DNA, 21 bp, Homo sapiens
aatcatggggtggaataaagg

SEQ ID NO: 5113800 - DNA, 12 bp, Homo sapiens
aatcatgtaaat

SEQ ID NO: 5113801 - DNA, 19 bp, Homo sapiens
aatcatgtacatttctgaa

SEQ ID NO: 5113802 - DNA, 23 bp, Homo sapiens
aatcatgtagtatcaaatattag

SEQ ID NO: 5113803 - DNA, 23 bp, Homo sapiens
aatcatgtccatcccttttcctg

SEQ ID NO: 5113804 - DNA, 12 bp, Homo sapiens
aatcatgtctgt

SEQ ID NO: 5113805 - DNA, 15 bp, Homo sapiens
aatcatgtgtgttaa

SEQ ID NO: 5113806 - DNA, 13 bp, Homo sapiens
aatcatgttatga

SEQ ID NO: 5113807 - DNA, 12 bp, Homo sapiens
aatcatgttctg

SEQ ID NO: 5113808 - DNA, 12 bp, Homo sapiens
aatcatgttgtt

SEQ ID NO: 5113809 - DNA, 19 bp, Homo sapiens
aatcatgtttattttgagt

SEQ ID NO: 5113810 - DNA, 18 bp, Homo sapiens
aatcatgttttttctgca

SEQ ID NO: 5113811 - DNA, 22 bp, Homo sapiens
aatcattaaagtgctttcagaa

SEQ ID NO: 5113812 - DNA, 17 bp, Homo sapiens
aatcattaagacaactg

SEQ ID NO: 5113813 - DNA, 17 bp, Homo sapiens
aatcattaagtgacttt

SEQ ID NO: 5113814 - DNA, 17 bp, Homo sapiens
aatcattatctcacttt

SEQ ID NO: 5113815 - DNA, 13 bp, Homo sapiens
aatcattatgttt

SEQ ID NO: 5113816 - DNA, 12 bp, Homo sapiens
aatcattcaaaa

SEQ ID NO: 5113817 - DNA, 18 bp, Homo sapiens
aatcattcaatatctgac

SEQ ID NO: 5113818 - DNA, 22 bp, Homo sapiens
aatcattccccccgtgaagtct

SEQ ID NO: 5113819 - DNA, 15 bp, Homo sapiens
aatcattctcgattt

SEQ ID NO: 5113820 - DNA, 17 bp, Homo sapiens
aatcattctcgatttaa

SEQ ID NO: 5113821 - DNA, 14 bp, Homo sapiens
aatcattctgtaaa

SEQ ID NO: 5113822 - DNA, 17 bp, Homo sapiens
aatcattcttactaaaa

SEQ ID NO: 5113823 - DNA, 18 bp, Homo sapiens
aatcattcttactaaaaa

SEQ ID NO: 5113824 - DNA, 23 bp, Homo sapiens
aatcattctttcccctcagagct

SEQ ID NO: 5113825 - DNA, 14 bp, Homo sapiens
aatcattgaagtat

SEQ ID NO: 5113826 - DNA, 20 bp, Homo sapiens
aatcattgaagtatattctt

SEQ ID NO: 5113827 - DNA, 12 bp, Homo sapiens
aatcattgacta

SEQ ID NO: 5113828 - DNA, 19 bp, Homo sapiens
aatcattgcttatgtcaaa

SEQ ID NO: 5113829 - DNA, 14 bp, Homo sapiens
aatcattgctttga

SEQ ID NO: 5113830 - DNA, 15 bp, Homo sapiens
aatcattgtacagtt

SEQ ID NO: 5113831 - DNA, 22 bp, Homo sapiens
aatcattgtacagtttgtttac

SEQ ID NO: 5113832 - DNA, 14 bp, Homo sapiens
aatcattgtatgtg

SEQ ID NO: 5113833 - DNA, 17 bp, Homo sapiens
aatcattgtcaaaatta

SEQ ID NO: 5113834 - DNA, 17 bp, Homo sapiens
aatcattgtccagagct

SEQ ID NO: 5113835 - DNA, 15 bp, Homo sapiens
aatcattgtgcttaa

SEQ ID NO: 5113836 - DNA, 17 bp, Homo sapiens
aatcattgttataaaga

SEQ ID NO: 5113837 - DNA, 12 bp, Homo sapiens
aatcattgttgc

SEQ ID NO: 5113838 - DNA, 20 bp, Homo sapiens
aatcattgttttgaatatta

SEQ ID NO: 5113839 - DNA, 16 bp, Homo sapiens
aatcatttaaatatta

SEQ ID NO: 5113840 - DNA, 17 bp, Homo sapiens
aatcatttatcttatct

SEQ ID NO: 5113841 - DNA, 12 bp, Homo sapiens
aatcatttcagt

SEQ ID NO: 5113842 - DNA, 21 bp, Homo sapiens
aatcatttcagtatcatctcc

SEQ ID NO: 5113843 - DNA, 20 bp, Homo sapiens
aatcatttctatttctcctc

SEQ ID NO: 5113844 - DNA, 20 bp, Homo sapiens
aatagtgcttaaaaatcatt

SEQ ID NO: 5113845 - DNA, 13 bp, Homo sapiens
aatagtgcttttt

SEQ ID NO: 5113846 - DNA, 21 bp, Homo sapiens
aatagtggatctcagttttta

SEQ ID NO: 5113847 - DNA, 16 bp, Homo sapiens
aatagtggcataccaa

SEQ ID NO: 5113848 - DNA, 22 bp, Homo sapiens
aatagtggctttcatttcttat

SEQ ID NO: 5113849 - DNA, 22 bp, Homo sapiens
aatagtggtgtgatttggggat

SEQ ID NO: 5113850 - DNA, 13 bp, Homo sapiens
aatagtggttaac

SEQ ID NO: 5113851 - DNA, 15 bp, Homo sapiens
aatagtgtaagaact

SEQ ID NO: 5113852 - DNA, 20 bp, Homo sapiens
aatagtgtcatataaactca

SEQ ID NO: 5113853 - DNA, 19 bp, Homo sapiens
aatagtgtcctatgcaata

SEQ ID NO: 5113854 - DNA, 15 bp, Homo sapiens
aatagtgtgaaatat

SEQ ID NO: 5113855 - DNA, 16 bp, Homo sapiens
aatagtgtgaaatata

SEQ ID NO: 5113856 - DNA, 17 bp, Homo sapiens
aatagtgtgaaatatat

SEQ ID NO: 5113857 - DNA, 12 bp, Homo sapiens
aatagtgtggaa

SEQ ID NO: 5113858 - DNA, 22 bp, Homo sapiens
aatagtgtggaaattaagaaga

SEQ ID NO: 5113859 - DNA, 15 bp, Homo sapiens
aatagtgtgttctga

SEQ ID NO: 5113860 - DNA, 21 bp, Homo sapiens
aatagtgtgttctgattagaa

SEQ ID NO: 5113861 - DNA, 23 bp, Homo sapiens
aatagtgtgttctgattagaaat

SEQ ID NO: 5113862 - DNA, 15 bp, Homo sapiens
aatagtgttaatcaa

SEQ ID NO: 5113863 - DNA, 16 bp, Homo sapiens
aatagtgttaatcaat

SEQ ID NO: 5113864 - DNA, 17 bp, Homo sapiens
aatagtgttaatcaatt

SEQ ID NO: 5113865 - DNA, 22 bp, Homo sapiens
aatagtgttaatcaatttaaac

SEQ ID NO: 5113866 - DNA, 22 bp, Homo sapiens
aatagtgttattgagagagatg

SEQ ID NO: 5113867 - DNA, 20 bp, Homo sapiens
aatagtgttgaggaggggag

SEQ ID NO: 5113868 - DNA, 15 bp, Homo sapiens
aatagtgttgatcag

SEQ ID NO: 5113869 - DNA, 13 bp, Homo sapiens
aatagttaatata

SEQ ID NO: 5113870 - DNA, 18 bp, Homo sapiens
aatagttactccagtgcc

SEQ ID NO: 5113871 - DNA, 19 bp, Homo sapiens
aatagttagatctttgtaa

SEQ ID NO: 5113872 - DNA, 21 bp, Homo sapiens
aatagttatcttttaattaca

SEQ ID NO: 5113873 - DNA, 13 bp, Homo sapiens
aatagttattatt

SEQ ID NO: 5113874 - DNA, 14 bp, Homo sapiens
aatagttattattt

SEQ ID NO: 5113875 - DNA, 19 bp, Homo sapiens
aatagttattttaatacct

SEQ ID NO: 5113876 - DNA, 16 bp, Homo sapiens
aatagttcaaactgca

SEQ ID NO: 5113877 - DNA, 22 bp, Homo sapiens
aatagttcagtagaattaccat

SEQ ID NO: 5113878 - DNA, 23 bp, Homo sapiens
aatagttccagataaaaacaata

SEQ ID NO: 5113879 - DNA, 22 bp, Homo sapiens
aatagttctatccttttgcctg

SEQ ID NO: 5113880 - DNA, 14 bp, Homo sapiens
aatagttctgtata

SEQ ID NO: 5113881 - DNA, 18 bp, Homo sapiens
aatagttgagccagcaga

SEQ ID NO: 5113882 - DNA, 21 bp, Homo sapiens
aatagttgagccagcagacat

SEQ ID NO: 5113883 - DNA, 14 bp, Homo sapiens
aatagttgagcccc

SEQ ID NO: 5113884 - DNA, 18 bp, Homo sapiens
aatagttgccaatctaaa

SEQ ID NO: 5113885 - DNA, 13 bp, Homo sapiens
aatagttggctag

SEQ ID NO: 5113886 - DNA, 23 bp, Homo sapiens
aatagttgtaggggaaatcaagg

SEQ ID NO: 5113887 - DNA, 16 bp, Homo sapiens
aatagttgtcagaata

SEQ ID NO: 5113888 - DNA, 17 bp, Homo sapiens
aatagttgtcagaatat

SEQ ID NO: 5113889 - DNA, 19 bp, Homo sapiens
aatagtttacatgtagtag

SEQ ID NO: 5113890 - DNA, 16 bp, Homo sapiens
aatagtttaggaaaat

SEQ ID NO: 5113891 - DNA, 20 bp, Homo sapiens
aatagtttaggaaaatgaga

SEQ ID NO: 5113892 - DNA, 16 bp, Homo sapiens
aatagtttaggagaaa

SEQ ID NO: 5113893 - DNA, 20 bp, Homo sapiens
aatagtttcaaatgagttta

SEQ ID NO: 5113894 - DNA, 19 bp, Homo sapiens
aatagtttgtctattttaa

SEQ ID NO: 5113895 - DNA, 17 bp, Homo sapiens
aatagttttaaatatga

SEQ ID NO: 5113896 - DNA, 19 bp, Homo sapiens
aatagttttagattatttt

SEQ ID NO: 5113897 - DNA, 13 bp, Homo sapiens
aatagttttatgc

SEQ ID NO: 5113898 - DNA, 22 bp, Homo sapiens
aatagttttattaataaacatt

SEQ ID NO: 5113899 - DNA, 22 bp, Homo sapiens
aatagttttctaaatgtttctt

SEQ ID NO: 5113900 - DNA, 14 bp, Homo sapiens
aatagttttttctt

SEQ ID NO: 5113901 - DNA, 16 bp, Homo sapiens
aatataaaaaatcatg

SEQ ID NO: 5113902 - DNA, 13 bp, Homo sapiens
aatataaaaataa

SEQ ID NO: 5113903 - DNA, 15 bp, Homo sapiens
aatataaaaatgtga

SEQ ID NO: 5113904 - DNA, 22 bp, Homo sapiens
aatataaaacaaataaaaaata

SEQ ID NO: 5113905 - DNA, 14 bp, Homo sapiens
aatataaaactgaa

SEQ ID NO: 5113906 - DNA, 13 bp, Homo sapiens
aatataaaataca

SEQ ID NO: 5113907 - DNA, 18 bp, Homo sapiens
aatataaaatacataaaa

SEQ ID NO: 5113908 - DNA, 13 bp, Homo sapiens
aatataaaatagt

SEQ ID NO: 5113909 - DNA, 16 bp, Homo sapiens
aatataaaatgtttca

SEQ ID NO: 5113910 - DNA, 23 bp, Homo sapiens
aatataaacaaagattcatgatt

SEQ ID NO: 5113911 - DNA, 13 bp, Homo sapiens
aatataaactgtg

SEQ ID NO: 5113912 - DNA, 17 bp, Homo sapiens
aatataaactgtgagat

SEQ ID NO: 5113913 - DNA, 13 bp, Homo sapiens
aatataaacttaa

SEQ ID NO: 5113914 - DNA, 17 bp, Homo sapiens
aatataaacttgtgtat

SEQ ID NO: 5113915 - DNA, 11 bp, Homo sapiens
aatataaagac

SEQ ID NO: 5113916 - DNA, 18 bp, Homo sapiens
aatataaagacgttttat

SEQ ID NO: 5113917 - DNA, 16 bp, Homo sapiens
aatataaagcatctaa

SEQ ID NO: 5113918 - DNA, 15 bp, Homo sapiens
aatataaagttttat

SEQ ID NO: 5113919 - DNA, 18 bp, Homo sapiens
aatataaatagctgaaaa

SEQ ID NO: 5113920 - DNA, 20 bp, Homo sapiens
aatataaatagctgaaaact

SEQ ID NO: 5113921 - DNA, 15 bp, Homo sapiens
aatataaatatcaca

SEQ ID NO: 5113922 - DNA, 17 bp, Homo sapiens
aatataaatcacagatt

SEQ ID NO: 5113923 - DNA, 19 bp, Homo sapiens
aatataaatcacagatttc

SEQ ID NO: 5113924 - DNA, 21 bp, Homo sapiens
aatataaatcacagatttcca

SEQ ID NO: 5113925 - DNA, 19 bp, Homo sapiens
aatataaatgaatgaaata

SEQ ID NO: 5113926 - DNA, 18 bp, Homo sapiens
aatataaatgcaaataac

SEQ ID NO: 5113927 - DNA, 15 bp, Homo sapiens
aatataaatgcatga

SEQ ID NO: 5113928 - DNA, 16 bp, Homo sapiens
aatataaatgcatgat

SEQ ID NO: 5113929 - DNA, 17 bp, Homo sapiens
aatataaatgcatgatt

SEQ ID NO: 5113930 - DNA, 17 bp, Homo sapiens
aatataaatgtactaca

SEQ ID NO: 5113931 - DNA, 12 bp, Homo sapiens
aatataaatgtg

SEQ ID NO: 5113932 - DNA, 13 bp, Homo sapiens
aatataaatgtgt

SEQ ID NO: 5113933 - DNA, 19 bp, Homo sapiens
aatataaattgtacatttt

SEQ ID NO: 5113934 - DNA, 16 bp, Homo sapiens
aatataaatttaagca

SEQ ID NO: 5113935 - DNA, 17 bp, Homo sapiens
aatataaatttaagcaa

SEQ ID NO: 5113936 - DNA, 18 bp, Homo sapiens
aatataaatttaagcaaa

SEQ ID NO: 5113937 - DNA, 20 bp, Homo sapiens
aatataaatttaagcaaacg

SEQ ID NO: 5113938 - DNA, 19 bp, Homo sapiens
aatataacaagtataatta

SEQ ID NO: 5113939 - DNA, 18 bp, Homo sapiens
aatataacaatatatgat

SEQ ID NO: 5113940 - DNA, 15 bp, Homo sapiens
aatataacacatttt

SEQ ID NO: 5113941 - DNA, 16 bp, Homo sapiens
aatataacatgaaagt

SEQ ID NO: 5113942 - DNA, 12 bp, Homo sapiens
aatataacatgt

SEQ ID NO: 5113943 - DNA, 18 bp, Homo sapiens
aatataaccaatgtttaa

SEQ ID NO: 5113944 - DNA, 16 bp, Homo sapiens
aatataaccattacat

SEQ ID NO: 5113945 - DNA, 21 bp, Homo sapiens
aatataaccattacatgttta

SEQ ID NO: 5113946 - DNA, 14 bp, Homo sapiens
aatataactgtctt

SEQ ID NO: 5113947 - DNA, 20 bp, Homo sapiens
aatataagaaaagtaatgaa

SEQ ID NO: 5113948 - DNA, 13 bp, Homo sapiens
aatataagaagca

SEQ ID NO: 5113949 - DNA, 13 bp, Homo sapiens
aatataagaataa

SEQ ID NO: 5113950 - DNA, 22 bp, Homo sapiens
aatataagaataaaatgttgaa

SEQ ID NO: 5113951 - DNA, 14 bp, Homo sapiens
aatataagacattt

SEQ ID NO: 5113952 - DNA, 17 bp, Homo sapiens
aatataagacatttgtt

SEQ ID NO: 5113953 - DNA, 13 bp, Homo sapiens
aatataagatttt

SEQ ID NO: 5113954 - DNA, 20 bp, Homo sapiens
aatataagcttaaaataagt

SEQ ID NO: 5113955 - DNA, 18 bp, Homo sapiens
aatataaggaaagcaata

SEQ ID NO: 5113956 - DNA, 19 bp, Homo sapiens
aatataaggaaagcaataa

SEQ ID NO: 5113957 - DNA, 21 bp, Homo sapiens
aatataaggaaagcaataaat

SEQ ID NO: 5113958 - DNA, 23 bp, Homo sapiens
aatataaggaaagcaataaatga

SEQ ID NO: 5113959 - DNA, 19 bp, Homo sapiens
aatataaggactttttgat

SEQ ID NO: 5113960 - DNA, 16 bp, Homo sapiens
aatataagtaaagtga

SEQ ID NO: 5113961 - DNA, 14 bp, Homo sapiens
aatataagtttctt

SEQ ID NO: 5113962 - DNA, 15 bp, Homo sapiens
aatataagtttcttt

SEQ ID NO: 5113963 - DNA, 14 bp, Homo sapiens
aatataataaaaga

SEQ ID NO: 5113964 - DNA, 16 bp, Homo sapiens
aatataataaaagtta

SEQ ID NO: 5113965 - DNA, 14 bp, Homo sapiens
aatataataatgat

SEQ ID NO: 5113966 - DNA, 14 bp, Homo sapiens
aatataatactgta

SEQ ID NO: 5113967 - DNA, 21 bp, Homo sapiens
aatataatgagtcacaaaata

SEQ ID NO: 5113968 - DNA, 23 bp, Homo sapiens
aatataatggaagagaaatctca

SEQ ID NO: 5113969 - DNA, 15 bp, Homo sapiens
aatataatgtatttt

SEQ ID NO: 5113970 - DNA, 18 bp, Homo sapiens
aatataatgtattttctt

SEQ ID NO: 5113971 - DNA, 12 bp, Homo sapiens
aatataatgttg

SEQ ID NO: 5113972 - DNA, 11 bp, Homo sapiens
aatataattat

SEQ ID NO: 5113973 - DNA, 15 bp, Homo sapiens
aatataattgggatt

SEQ ID NO: 5113974 - DNA, 20 bp, Homo sapiens
aatataatttaacagaagtt

SEQ ID NO: 5113975 - DNA, 20 bp, Homo sapiens
aatataatttataagcattg

SEQ ID NO: 5113976 - DNA, 14 bp, Homo sapiens
aatatacaaacatg

SEQ ID NO: 5113977 - DNA, 20 bp, Homo sapiens
aatatacaaacatgtggcaa

SEQ ID NO: 5113978 - DNA, 19 bp, Homo sapiens
aatatacaagtaaattctg

SEQ ID NO: 5113979 - DNA, 20 bp, Homo sapiens
aatatacaagtaaattctgt

SEQ ID NO: 5113980 - DNA, 18 bp, Homo sapiens
aatatacaatttcttgaa

SEQ ID NO: 5113981 - DNA, 23 bp, Homo sapiens
aatatacagcatgagattgtaca

SEQ ID NO: 5113982 - DNA, 12 bp, Homo sapiens
aatatacagttt

SEQ ID NO: 5113983 - DNA, 22 bp, Homo sapiens
aatatacatagtctttgtttac

SEQ ID NO: 5113984 - DNA, 18 bp, Homo sapiens
aatatacatgtttatgta

SEQ ID NO: 5113985 - DNA, 20 bp, Homo sapiens
aatatacatgtttatgtaaa

SEQ ID NO: 5113986 - DNA, 18 bp, Homo sapiens
aatatacattcaaactta

SEQ ID NO: 5113987 - DNA, 12 bp, Homo sapiens
aatatacatttg

SEQ ID NO: 5113988 - DNA, 16 bp, Homo sapiens
aatatacattttctaa

SEQ ID NO: 5113989 - DNA, 17 bp, Homo sapiens
aatatacattttctaaa

SEQ ID NO: 5113990 - DNA, 18 bp, Homo sapiens
aatatacattttctaaat

SEQ ID NO: 5113991 - DNA, 17 bp, Homo sapiens
aatataccccaaattgt

SEQ ID NO: 5113992 - DNA, 19 bp, Homo sapiens
aatataccccttagtgttt

SEQ ID NO: 5113993 - DNA, 14 bp, Homo sapiens
aatatacctggttt

SEQ ID NO: 5113994 - DNA, 16 bp, Homo sapiens
aatatacctggtttac

SEQ ID NO: 5113995 - DNA, 20 bp, Homo sapiens
aatataccttaacaggctga

SEQ ID NO: 5113996 - DNA, 14 bp, Homo sapiens
aatataccttattt

SEQ ID NO: 5113997 - DNA, 19 bp, Homo sapiens
aatatacgaaaagccagct

SEQ ID NO: 5113998 - DNA, 22 bp, Homo sapiens
aatatactaaaccaactctaat

SEQ ID NO: 5113999 - DNA, 14 bp, Homo sapiens
aatatactaataaa

SEQ ID NO: 5114000 - DNA, 15 bp, Homo sapiens
aatatactaataaaa

SEQ ID NO: 5114001 - DNA, 17 bp, Homo sapiens
aatatactaataaaaag

SEQ ID NO: 5114002 - DNA, 18 bp, Homo sapiens
aatatactaataaaaagg

SEQ ID NO: 5114003 - DNA, 19 bp, Homo sapiens
aatatactaataaaaaggt

SEQ ID NO: 5114004 - DNA, 17 bp, Homo sapiens
aatatactatatttatg

SEQ ID NO: 5114005 - DNA, 11 bp, Homo sapiens
aatatactcag

SEQ ID NO: 5114006 - DNA, 15 bp, Homo sapiens
aatatactcatttgg

SEQ ID NO: 5114007 - DNA, 18 bp, Homo sapiens
aatatactgattttgaaa

SEQ ID NO: 5114008 - DNA, 19 bp, Homo sapiens
aatatactgattttgaaaa

SEQ ID NO: 5114009 - DNA, 13 bp, Homo sapiens
aatatactgtaaa

SEQ ID NO: 5114010 - DNA, 19 bp, Homo sapiens
aatatactgtcttgtctca

SEQ ID NO: 5114011 - DNA, 20 bp, Homo sapiens
aatatacttagatcctggta

SEQ ID NO: 5114012 - DNA, 16 bp, Homo sapiens
aatatacttctgctgt

SEQ ID NO: 5114013 - DNA, 13 bp, Homo sapiens
aatatacttgtgg

SEQ ID NO: 5114014 - DNA, 19 bp, Homo sapiens
aatatactttactttttcc

SEQ ID NO: 5114015 - DNA, 21 bp, Homo sapiens
aatatactttactttttccat

SEQ ID NO: 5114016 - DNA, 11 bp, Homo sapiens
aatatactttt

SEQ ID NO: 5114017 - DNA, 16 bp, Homo sapiens
aatatactttttttgt

SEQ ID NO: 5114018 - DNA, 18 bp, Homo sapiens
aatatactttttttgtta

SEQ ID NO: 5114019 - DNA, 21 bp, Homo sapiens
aatatagaaaaaaacattcta

SEQ ID NO: 5114020 - DNA, 20 bp, Homo sapiens
aatatagaaaactaatctaa

SEQ ID NO: 5114021 - DNA, 21 bp, Homo sapiens
aatatagaaaactaatctaaa

SEQ ID NO: 5114022 - DNA, 22 bp, Homo sapiens
aatatagaaacacgaactttag

SEQ ID NO: 5114023 - DNA, 12 bp, Homo sapiens
aatcatttgaga

SEQ ID NO: 5114024 - DNA, 22 bp, Homo sapiens
aatcatttgggttaatatggct

SEQ ID NO: 5114025 - DNA, 20 bp, Homo sapiens
aatcatttggttaagttttt

SEQ ID NO: 5114026 - DNA, 18 bp, Homo sapiens
aatcatttgttcaaagct

SEQ ID NO: 5114027 - DNA, 17 bp, Homo sapiens
aatcatttgtttaaaaa

SEQ ID NO: 5114028 - DNA, 15 bp, Homo sapiens
aatcattttaattat

SEQ ID NO: 5114029 - DNA, 17 bp, Homo sapiens
aatcattttaattatta

SEQ ID NO: 5114030 - DNA, 20 bp, Homo sapiens
aatcattttaattattattc

SEQ ID NO: 5114031 - DNA, 20 bp, Homo sapiens
aatcattttacccttggctc

SEQ ID NO: 5114032 - DNA, 18 bp, Homo sapiens
aatcattttagaattaaa

SEQ ID NO: 5114033 - DNA, 20 bp, Homo sapiens
aatcattttgagtttgcctc

SEQ ID NO: 5114034 - DNA, 19 bp, Homo sapiens
aatcattttgcctcttttc

SEQ ID NO: 5114035 - DNA, 19 bp, Homo sapiens
aatcatttttcactgtaca

SEQ ID NO: 5114036 - DNA, 14 bp, Homo sapiens
aatcatttttgtag

SEQ ID NO: 5114037 - DNA, 21 bp, Homo sapiens
aatcattttttatatatatgc

SEQ ID NO: 5114038 - DNA, 15 bp, Homo sapiens
aatccaaaagaaaaa

SEQ ID NO: 5114039 - DNA, 13 bp, Homo sapiens
aatccaaactact

SEQ ID NO: 5114040 - DNA, 14 bp, Homo sapiens
aatccaaactgctg

SEQ ID NO: 5114041 - DNA, 20 bp, Homo sapiens
aatccaaactgctgtctctt

SEQ ID NO: 5114042 - DNA, 20 bp, Homo sapiens
aatccaaagaactatgtaaa

SEQ ID NO: 5114043 - DNA, 22 bp, Homo sapiens
aatccaaatctgtcctctgtag

SEQ ID NO: 5114044 - DNA, 16 bp, Homo sapiens
aatccaaatgcattca

SEQ ID NO: 5114045 - DNA, 20 bp, Homo sapiens
aatccaaattccctctggag

SEQ ID NO: 5114046 - DNA, 17 bp, Homo sapiens
aatccaaatttctcatg

SEQ ID NO: 5114047 - DNA, 18 bp, Homo sapiens
aatccaaccattttcatt

SEQ ID NO: 5114048 - DNA, 17 bp, Homo sapiens
aatccaacccatgcatg

SEQ ID NO: 5114049 - DNA, 12 bp, Homo sapiens
aatccaactcca

SEQ ID NO: 5114050 - DNA, 11 bp, Homo sapiens
aatccaagact

SEQ ID NO: 5114051 - DNA, 17 bp, Homo sapiens
aatccaagcctccacag

SEQ ID NO: 5114052 - DNA, 18 bp, Homo sapiens
aatccaagcctccacagc

SEQ ID NO: 5114053 - DNA, 22 bp, Homo sapiens
aatccaagcctccacagcgagg

SEQ ID NO: 5114054 - DNA, 23 bp, Homo sapiens
aatccaagcctccacagcgaggg

SEQ ID NO: 5114055 - DNA, 18 bp, Homo sapiens
aatccaagctaatttcta

SEQ ID NO: 5114056 - DNA, 13 bp, Homo sapiens
aatccaagctccc

SEQ ID NO: 5114057 - DNA, 17 bp, Homo sapiens
aatccaagctccctgcc

SEQ ID NO: 5114058 - DNA, 23 bp, Homo sapiens
aatccaagtagataggaagaaag

SEQ ID NO: 5114059 - DNA, 22 bp, Homo sapiens
aatccaataaaaacattttgaa

SEQ ID NO: 5114060 - DNA, 15 bp, Homo sapiens
aatccaatattgtaa

SEQ ID NO: 5114061 - DNA, 17 bp, Homo sapiens
aatccaatattgtaatc

SEQ ID NO: 5114062 - DNA, 19 bp, Homo sapiens
aatccaatcaatttaaatg

SEQ ID NO: 5114063 - DNA, 16 bp, Homo sapiens
aatccaattaatgatt

SEQ ID NO: 5114064 - DNA, 20 bp, Homo sapiens
aatccacaaagccgtgcctt

SEQ ID NO: 5114065 - DNA, 13 bp, Homo sapiens
aatccacagccaa

SEQ ID NO: 5114066 - DNA, 22 bp, Homo sapiens
aatccacccccaggtgcagccc

SEQ ID NO: 5114067 - DNA, 19 bp, Homo sapiens
aatccacctggtggccctg

SEQ ID NO: 5114068 - DNA, 16 bp, Homo sapiens
aatccaccttcaggcc

SEQ ID NO: 5114069 - DNA, 17 bp, Homo sapiens
aatccacgctcatcttg

SEQ ID NO: 5114070 - DNA, 14 bp, Homo sapiens
aatccactaacact

SEQ ID NO: 5114071 - DNA, 16 bp, Homo sapiens
aatccactaacacttt

SEQ ID NO: 5114072 - DNA, 14 bp, Homo sapiens
aatccactctcagg

SEQ ID NO: 5114073 - DNA, 20 bp, Homo sapiens
aatccagaaacttgttcttc

SEQ ID NO: 5114074 - DNA, 18 bp, Homo sapiens
aatccagaaggaagctcg

SEQ ID NO: 5114075 - DNA, 22 bp, Homo sapiens
aatccagaattgaccttttgac

SEQ ID NO: 5114076 - DNA, 19 bp, Homo sapiens
aatccagacccggctgcgt

SEQ ID NO: 5114077 - DNA, 18 bp, Homo sapiens
aatccagactttcttttt

SEQ ID NO: 5114078 - DNA, 20 bp, Homo sapiens
aatccagactttctttttct

SEQ ID NO: 5114079 - DNA, 23 bp, Homo sapiens
aatccagagagcttaaattgtca

SEQ ID NO: 5114080 - DNA, 20 bp, Homo sapiens
aatccagcaggtcacactgg

SEQ ID NO: 5114081 - DNA, 12 bp, Homo sapiens
aatccagcccca

SEQ ID NO: 5114082 - DNA, 22 bp, Homo sapiens
aatccagccccatagaaaacaa

SEQ ID NO: 5114083 - DNA, 21 bp, Homo sapiens
aatccagccttcttcccccag

SEQ ID NO: 5114084 - DNA, 18 bp, Homo sapiens
aatccagcggttctcaaa

SEQ ID NO: 5114085 - DNA, 18 bp, Homo sapiens
aatccagctccctagact

SEQ ID NO: 5114086 - DNA, 23 bp, Homo sapiens
aatccagctgggctagaggctga

SEQ ID NO: 5114087 - DNA, 19 bp, Homo sapiens
aatccaggaccctgccagg

SEQ ID NO: 5114088 - DNA, 21 bp, Homo sapiens
aatccaggtacgcacagacag

SEQ ID NO: 5114089 - DNA, 22 bp, Homo sapiens
aatccaggtctcgggtccgatt

SEQ ID NO: 5114090 - DNA, 15 bp, Homo sapiens
aatccagtagggaaa

SEQ ID NO: 5114091 - DNA, 17 bp, Homo sapiens
aatccagtgcttccaca

SEQ ID NO: 5114092 - DNA, 16 bp, Homo sapiens
aatccagtggtgggta

SEQ ID NO: 5114093 - DNA, 17 bp, Homo sapiens
aatccagtggtgggtaa

SEQ ID NO: 5114094 - DNA, 19 bp, Homo sapiens
aatccagtgtgcacccctc

SEQ ID NO: 5114095 - DNA, 20 bp, Homo sapiens
aatccagtgtgcacccctcc

SEQ ID NO: 5114096 - DNA, 13 bp, Homo sapiens
aatccagttataa

SEQ ID NO: 5114097 - DNA, 15 bp, Homo sapiens
aatccagtttctttc

SEQ ID NO: 5114098 - DNA, 17 bp, Homo sapiens
aatccatactgtagaca

SEQ ID NO: 5114099 - DNA, 23 bp, Homo sapiens
aatccatactgtagacactctga

SEQ ID NO: 5114100 - DNA, 17 bp, Homo sapiens
aatccatagatttattt

SEQ ID NO: 5114101 - DNA, 13 bp, Homo sapiens
aatccatatcagc

SEQ ID NO: 5114102 - DNA, 19 bp, Homo sapiens
aatccatcagcaatgcttc

SEQ ID NO: 5114103 - DNA, 19 bp, Homo sapiens
aatccatctttgtagaaga

SEQ ID NO: 5114104 - DNA, 21 bp, Homo sapiens
aatccatgatcaaaatgcata

SEQ ID NO: 5114105 - DNA, 15 bp, Homo sapiens
aatccatgcttcact

SEQ ID NO: 5114106 - DNA, 14 bp, Homo sapiens
aatccatgggtctg

SEQ ID NO: 5114107 - DNA, 14 bp, Homo sapiens
aatccatgtgacca

SEQ ID NO: 5114108 - DNA, 20 bp, Homo sapiens
aatccatgtgaccattctgc

SEQ ID NO: 5114109 - DNA, 15 bp, Homo sapiens
aatccatgtgctgct

SEQ ID NO: 5114110 - DNA, 19 bp, Homo sapiens
aatccatgtgctgctgtgg

SEQ ID NO: 5114111 - DNA, 13 bp, Homo sapiens
aatccatgtgtcc

SEQ ID NO: 5114112 - DNA, 14 bp, Homo sapiens
aatccatgtgtccc

SEQ ID NO: 5114113 - DNA, 19 bp, Homo sapiens
aatccatgttagtttttac

SEQ ID NO: 5114114 - DNA, 17 bp, Homo sapiens
aatccattgtttaaaga

SEQ ID NO: 5114115 - DNA, 22 bp, Homo sapiens
aatccatttagcactatttaaa

SEQ ID NO: 5114116 - DNA, 17 bp, Homo sapiens
aatccatttcaggactc

SEQ ID NO: 5114117 - DNA, 14 bp, Homo sapiens
aatccatttggaaa

SEQ ID NO: 5114118 - DNA, 18 bp, Homo sapiens
aatccatttggaaatctt

SEQ ID NO: 5114119 - DNA, 22 bp, Homo sapiens
aatccatttggaaatctttaaa

SEQ ID NO: 5114120 - DNA, 15 bp, Homo sapiens
aatccatttggcaga

SEQ ID NO: 5114121 - DNA, 12 bp, Homo sapiens
aatccattttag

SEQ ID NO: 5114122 - DNA, 22 bp, Homo sapiens
aatccattttaggtgataaaat

SEQ ID NO: 5114123 - DNA, 17 bp, Homo sapiens
aatccattttcactaaa

SEQ ID NO: 5114124 - DNA, 19 bp, Homo sapiens
aatccattttctaaactgt

SEQ ID NO: 5114125 - DNA, 23 bp, Homo sapiens
aatccattttctaaactgttttc

SEQ ID NO: 5114126 - DNA, 22 bp, Homo sapiens
aatcccaaagtgccttctgagc

SEQ ID NO: 5114127 - DNA, 18 bp, Homo sapiens
aatcccaaatttgattga

SEQ ID NO: 5114128 - DNA, 21 bp, Homo sapiens
aatcccaaatttgattgattt

SEQ ID NO: 5114129 - DNA, 19 bp, Homo sapiens
aatcccaacacttttggga

SEQ ID NO: 5114130 - DNA, 14 bp, Homo sapiens
aatcccaagtaaaa

SEQ ID NO: 5114131 - DNA, 15 bp, Homo sapiens
aatcccaatctttct

SEQ ID NO: 5114132 - DNA, 15 bp, Homo sapiens
aatcccaatgtttga

SEQ ID NO: 5114133 - DNA, 14 bp, Homo sapiens
aatcccaattctgt

SEQ ID NO: 5114134 - DNA, 19 bp, Homo sapiens
aatcccacttagcagggac

SEQ ID NO: 5114135 - DNA, 12 bp, Homo sapiens
aatcccagcact

SEQ ID NO: 5114136 - DNA, 13 bp, Homo sapiens
aatcccagcgcac

SEQ ID NO: 5114137 - DNA, 13 bp, Homo sapiens
aatcccagctact

SEQ ID NO: 5114138 - DNA, 18 bp, Homo sapiens
aatcccagctactcagga

SEQ ID NO: 5114139 - DNA, 20 bp, Homo sapiens
aatcccagctactcaggaga

SEQ ID NO: 5114140 - DNA, 15 bp, Homo sapiens
aatcccagctccgct

SEQ ID NO: 5114141 - DNA, 22 bp, Homo sapiens
aatcccagggcaaatgtttaca

SEQ ID NO: 5114142 - DNA, 13 bp, Homo sapiens
aatcccagggctg

SEQ ID NO: 5114143 - DNA, 14 bp, Homo sapiens
aatcccagggctgg

SEQ ID NO: 5114144 - DNA, 18 bp, Homo sapiens
aatcccagggctggctct

SEQ ID NO: 5114145 - DNA, 22 bp, Homo sapiens
aatcccagttcatgttgctcag

SEQ ID NO: 5114146 - DNA, 18 bp, Homo sapiens
aatcccagttcttcctgc

SEQ ID NO: 5114147 - DNA, 22 bp, Homo sapiens
aatcccagttcttcctgcaacc

SEQ ID NO: 5114148 - DNA, 20 bp, Homo sapiens
aatcccatctattctctgcc

SEQ ID NO: 5114149 - DNA, 14 bp, Homo sapiens
aatcccattattca

SEQ ID NO: 5114150 - DNA, 21 bp, Homo sapiens
aatcccattattcaaagttgc

SEQ ID NO: 5114151 - DNA, 13 bp, Homo sapiens
aatcccatttctt

SEQ ID NO: 5114152 - DNA, 17 bp, Homo sapiens
aatccccaagctggcag

SEQ ID NO: 5114153 - DNA, 22 bp, Homo sapiens
aatccccaagtgcctgcttttg

SEQ ID NO: 5114154 - DNA, 15 bp, Homo sapiens
aatccccagatattt

SEQ ID NO: 5114155 - DNA, 15 bp, Homo sapiens
aatccccagtaaaat

SEQ ID NO: 5114156 - DNA, 16 bp, Homo sapiens
aatccccagtaaaatt

SEQ ID NO: 5114157 - DNA, 23 bp, Homo sapiens
aatccccagttcgcctggagccc

SEQ ID NO: 5114158 - DNA, 12 bp, Homo sapiens
aatcccccaggg

SEQ ID NO: 5114159 - DNA, 16 bp, Homo sapiens
aatccccccttcagaa

SEQ ID NO: 5114160 - DNA, 22 bp, Homo sapiens
aatcccccgactccctccccag

SEQ ID NO: 5114161 - DNA, 21 bp, Homo sapiens
aatccccgtgctcacagtagc

SEQ ID NO: 5114162 - DNA, 21 bp, Homo sapiens
aatcccctccctgtcaaagct

SEQ ID NO: 5114163 - DNA, 11 bp, Homo sapiens
aatcccctcct

SEQ ID NO: 5114164 - DNA, 18 bp, Homo sapiens
aatccccttctcatcact

SEQ ID NO: 5114165 - DNA, 13 bp, Homo sapiens
aatccccttctcc

SEQ ID NO: 5114166 - DNA, 15 bp, Homo sapiens
aatccccttctcccc

SEQ ID NO: 5114167 - DNA, 20 bp, Homo sapiens
aatccccttctcccctgcac

SEQ ID NO: 5114168 - DNA, 21 bp, Homo sapiens
aatcccgtgcccctttccttc

SEQ ID NO: 5114169 - DNA, 21 bp, Homo sapiens
aatccctatgttgctataaga

SEQ ID NO: 5114170 - DNA, 23 bp, Homo sapiens
aatccctatgttgctataagaaa

SEQ ID NO: 5114171 - DNA, 15 bp, Homo sapiens
aatccctatgtttgt

SEQ ID NO: 5114172 - DNA, 10 bp, Homo sapiens
aatccctctc

SEQ ID NO: 5114173 - DNA, 22 bp, Homo sapiens
aatccctctggcccacacagat

SEQ ID NO: 5114174 - DNA, 12 bp, Homo sapiens
aatccctgaccc

SEQ ID NO: 5114175 - DNA, 13 bp, Homo sapiens
aatccctgctcac

SEQ ID NO: 5114176 - DNA, 23 bp, Homo sapiens
aatccctggttttaagtatcaat

SEQ ID NO: 5114177 - DNA, 20 bp, Homo sapiens
aatccctgtgttaatttaag

SEQ ID NO: 5114178 - DNA, 13 bp, Homo sapiens
aatccctgtttaa

SEQ ID NO: 5114179 - DNA, 22 bp, Homo sapiens
aatcccttaacagttgtattta

SEQ ID NO: 5114180 - DNA, 20 bp, Homo sapiens
aatcccttaatctatgtgca

SEQ ID NO: 5114181 - DNA, 19 bp, Homo sapiens
aatcccttcacagtcccag

SEQ ID NO: 5114182 - DNA, 11 bp, Homo sapiens
aatcccttcat

SEQ ID NO: 5114183 - DNA, 17 bp, Homo sapiens
aatcccttcctctccca

SEQ ID NO: 5114184 - DNA, 13 bp, Homo sapiens
aatccctttcagt

SEQ ID NO: 5114185 - DNA, 12 bp, Homo sapiens
aatccgaacctc

SEQ ID NO: 5114186 - DNA, 15 bp, Homo sapiens
aatccgccagtgttt

SEQ ID NO: 5114187 - DNA, 21 bp, Homo sapiens
aatccgcctgcagaggacaga

SEQ ID NO: 5114188 - DNA, 13 bp, Homo sapiens
aatccgctctctt

SEQ ID NO: 5114189 - DNA, 15 bp, Homo sapiens
aatccgctctcttcc

SEQ ID NO: 5114190 - DNA, 18 bp, Homo sapiens
aatccgctctcttcctgc

SEQ ID NO: 5114191 - DNA, 23 bp, Homo sapiens
aatccgggacacctgggccgggc

SEQ ID NO: 5114192 - DNA, 14 bp, Homo sapiens
aatccgtattgaat

SEQ ID NO: 5114193 - DNA, 23 bp, Homo sapiens
aatccgttcatagaaattgtgtt

SEQ ID NO: 5114194 - DNA, 14 bp, Homo sapiens
aatcctaagacaca

SEQ ID NO: 5114195 - DNA, 15 bp, Homo sapiens
aatcctaagacacaa

SEQ ID NO: 5114196 - DNA, 17 bp, Homo sapiens
aatcctaagacacaaat

SEQ ID NO: 5114197 - DNA, 14 bp, Homo sapiens
aatcctacatacag

SEQ ID NO: 5114198 - DNA, 15 bp, Homo sapiens
aatcctacctgtttt

SEQ ID NO: 5114199 - DNA, 14 bp, Homo sapiens
aatcctaccttgct

SEQ ID NO: 5114200 - DNA, 17 bp, Homo sapiens
aatcctaccttttgata

SEQ ID NO: 5114201 - DNA, 19 bp, Homo sapiens
aatatagaaagttgatatt

SEQ ID NO: 5114202 - DNA, 18 bp, Homo sapiens
aatatagacattctcaca

SEQ ID NO: 5114203 - DNA, 19 bp, Homo sapiens
aatatagacattctcacat

SEQ ID NO: 5114204 - DNA, 20 bp, Homo sapiens
aatatagacattctcacata

SEQ ID NO: 5114205 - DNA, 14 bp, Homo sapiens
aatatagagatatt

SEQ ID NO: 5114206 - DNA, 18 bp, Homo sapiens
aatatagagatatttttg

SEQ ID NO: 5114207 - DNA, 20 bp, Homo sapiens
aatatagagatatttttgta

SEQ ID NO: 5114208 - DNA, 21 bp, Homo sapiens
aatatagagatatttttgtac

SEQ ID NO: 5114209 - DNA, 21 bp, Homo sapiens
aatatagatcagttataagta

SEQ ID NO: 5114210 - DNA, 22 bp, Homo sapiens
aatatagatgtaatttttcaaa

SEQ ID NO: 5114211 - DNA, 15 bp, Homo sapiens
aatatagcctgcctc

SEQ ID NO: 5114212 - DNA, 13 bp, Homo sapiens
aatatagctattt

SEQ ID NO: 5114213 - DNA, 15 bp, Homo sapiens
aatatagctattttt

SEQ ID NO: 5114214 - DNA, 16 bp, Homo sapiens
aatatagctgtacaaa

SEQ ID NO: 5114215 - DNA, 13 bp, Homo sapiens
aatatagcttaaa

SEQ ID NO: 5114216 - DNA, 20 bp, Homo sapiens
aatataggaacttaaataat

SEQ ID NO: 5114217 - DNA, 21 bp, Homo sapiens
aatataggataagaaataaga

SEQ ID NO: 5114218 - DNA, 23 bp, Homo sapiens
aatatagggtttgtttgctgctt

SEQ ID NO: 5114219 - DNA, 22 bp, Homo sapiens
aatataggtcctgtgttaaaca

SEQ ID NO: 5114220 - DNA, 21 bp, Homo sapiens
aatatagtgttgtgttacaat

SEQ ID NO: 5114221 - DNA, 14 bp, Homo sapiens
aatatagttctgat

SEQ ID NO: 5114222 - DNA, 20 bp, Homo sapiens
aatatagttctgtgtagaga

SEQ ID NO: 5114223 - DNA, 17 bp, Homo sapiens
aatatagttgaacaaga

SEQ ID NO: 5114224 - DNA, 22 bp, Homo sapiens
aatatagttgaacaagatttcc

SEQ ID NO: 5114225 - DNA, 22 bp, Homo sapiens
aatatagttgtctttctttgct

SEQ ID NO: 5114226 - DNA, 21 bp, Homo sapiens
aatatataaaaagaaaagata

SEQ ID NO: 5114227 - DNA, 16 bp, Homo sapiens
aatatataaaaatata

SEQ ID NO: 5114228 - DNA, 14 bp, Homo sapiens
aatatataaaagaa

SEQ ID NO: 5114229 - DNA, 16 bp, Homo sapiens
aatatataaaagaaat

SEQ ID NO: 5114230 - DNA, 13 bp, Homo sapiens
aatatataaacaa

SEQ ID NO: 5114231 - DNA, 13 bp, Homo sapiens
aatatataaacac

SEQ ID NO: 5114232 - DNA, 19 bp, Homo sapiens
aatatataaacgatatatg

SEQ ID NO: 5114233 - DNA, 14 bp, Homo sapiens
aatatataaatata

SEQ ID NO: 5114234 - DNA, 16 bp, Homo sapiens
aatatataataaatgg

SEQ ID NO: 5114235 - DNA, 19 bp, Homo sapiens
aatatataatggtttactg

SEQ ID NO: 5114236 - DNA, 20 bp, Homo sapiens
aatatataatttaatgtaaa

SEQ ID NO: 5114237 - DNA, 13 bp, Homo sapiens
aatatatacattt

SEQ ID NO: 5114238 - DNA, 15 bp, Homo sapiens
aatatatagaattca

SEQ ID NO: 5114239 - DNA, 14 bp, Homo sapiens
aatatatagcattt

SEQ ID NO: 5114240 - DNA, 16 bp, Homo sapiens
aatatatagtgaaaaa

SEQ ID NO: 5114241 - DNA, 22 bp, Homo sapiens
aatatatagtgggtacatcaag

SEQ ID NO: 5114242 - DNA, 10 bp, Homo sapiens
aatatatata

SEQ ID NO: 5114243 - DNA, 13 bp, Homo sapiens
aatatatataaag

SEQ ID NO: 5114244 - DNA, 22 bp, Homo sapiens
aatatatataaagaatatatat

SEQ ID NO: 5114245 - DNA, 13 bp, Homo sapiens
aatatatataaat

SEQ ID NO: 5114246 - DNA, 16 bp, Homo sapiens
aatatatataaataaa

SEQ ID NO: 5114247 - DNA, 16 bp, Homo sapiens
aatatatataaatata

SEQ ID NO: 5114248 - DNA, 12 bp, Homo sapiens
aatatatataat

SEQ ID NO: 5114249 - DNA, 14 bp, Homo sapiens
aatatatatacata

SEQ ID NO: 5114250 - DNA, 17 bp, Homo sapiens
aatatatatacatatgt

SEQ ID NO: 5114251 - DNA, 16 bp, Homo sapiens
aatatatatataaaat

SEQ ID NO: 5114252 - DNA, 13 bp, Homo sapiens
aatatatatatat

SEQ ID NO: 5114253 - DNA, 19 bp, Homo sapiens
aatatatatatatatttaa

SEQ ID NO: 5114254 - DNA, 13 bp, Homo sapiens
aatatatatattt

SEQ ID NO: 5114255 - DNA, 16 bp, Homo sapiens
aatatatatcactcta

SEQ ID NO: 5114256 - DNA, 20 bp, Homo sapiens
aatatatatctatctatttg

SEQ ID NO: 5114257 - DNA, 22 bp, Homo sapiens
aatatatatctatctatttgag

SEQ ID NO: 5114258 - DNA, 17 bp, Homo sapiens
aatatatatctgctgtc

SEQ ID NO: 5114259 - DNA, 13 bp, Homo sapiens
aatatatatgaat

SEQ ID NO: 5114260 - DNA, 16 bp, Homo sapiens
aatatatatgtagcca

SEQ ID NO: 5114261 - DNA, 15 bp, Homo sapiens
aatatatatgtcaat

SEQ ID NO: 5114262 - DNA, 11 bp, Homo sapiens
aatatatatta

SEQ ID NO: 5114263 - DNA, 17 bp, Homo sapiens
aatatatattaaaattg

SEQ ID NO: 5114264 - DNA, 21 bp, Homo sapiens
aatatatattatacttgtaat

SEQ ID NO: 5114265 - DNA, 18 bp, Homo sapiens
aatatatattatatacat

SEQ ID NO: 5114266 - DNA, 19 bp, Homo sapiens
aatatatattatatatatc

SEQ ID NO: 5114267 - DNA, 20 bp, Homo sapiens
aatatatattatatatatct

SEQ ID NO: 5114268 - DNA, 13 bp, Homo sapiens
aatatatattatc

SEQ ID NO: 5114269 - DNA, 20 bp, Homo sapiens
aatatatattattctcattt

SEQ ID NO: 5114270 - DNA, 13 bp, Homo sapiens
aatatatattctg

SEQ ID NO: 5114271 - DNA, 15 bp, Homo sapiens
aatatatatttatca

SEQ ID NO: 5114272 - DNA, 15 bp, Homo sapiens
aatatatattttaag

SEQ ID NO: 5114273 - DNA, 19 bp, Homo sapiens
aatatatattttaaggttg

SEQ ID NO: 5114274 - DNA, 13 bp, Homo sapiens
aatatatattttg

SEQ ID NO: 5114275 - DNA, 15 bp, Homo sapiens
aatatatatttttca

SEQ ID NO: 5114276 - DNA, 18 bp, Homo sapiens
aatatatatttttcaaat

SEQ ID NO: 5114277 - DNA, 19 bp, Homo sapiens
aatatatatttttcaaata

SEQ ID NO: 5114278 - DNA, 21 bp, Homo sapiens
aatatatatttttcaaataga

SEQ ID NO: 5114279 - DNA, 21 bp, Homo sapiens
aatatatcagaatctgtgtga

SEQ ID NO: 5114280 - DNA, 16 bp, Homo sapiens
aatatatcctgtgtac

SEQ ID NO: 5114281 - DNA, 19 bp, Homo sapiens
aatatatcctgtttgtatt

SEQ ID NO: 5114282 - DNA, 17 bp, Homo sapiens
aatatatctttgtaaat

SEQ ID NO: 5114283 - DNA, 23 bp, Homo sapiens
aatatatgacttcctagggatct

SEQ ID NO: 5114284 - DNA, 14 bp, Homo sapiens
aatatatgatatat

SEQ ID NO: 5114285 - DNA, 18 bp, Homo sapiens
aatatatgattctagtgt

SEQ ID NO: 5114286 - DNA, 23 bp, Homo sapiens
aatatatgattgtataatgtgat

SEQ ID NO: 5114287 - DNA, 16 bp, Homo sapiens
aatatatgatttgcat

SEQ ID NO: 5114288 - DNA, 21 bp, Homo sapiens
aatatatgcctggcacagctt

SEQ ID NO: 5114289 - DNA, 13 bp, Homo sapiens
aatatatgcctta

SEQ ID NO: 5114290 - DNA, 23 bp, Homo sapiens
aatatatgccttactattgtatt

SEQ ID NO: 5114291 - DNA, 16 bp, Homo sapiens
aatatatggaagataa

SEQ ID NO: 5114292 - DNA, 20 bp, Homo sapiens
aatatatggaagataatttt

SEQ ID NO: 5114293 - DNA, 17 bp, Homo sapiens
aatatatggcatttgca

SEQ ID NO: 5114294 - DNA, 23 bp, Homo sapiens
aatatatgggggaaaattatttt

SEQ ID NO: 5114295 - DNA, 16 bp, Homo sapiens
aatatatgtaaattat

SEQ ID NO: 5114296 - DNA, 20 bp, Homo sapiens
aatatatgtaatatatacat

SEQ ID NO: 5114297 - DNA, 21 bp, Homo sapiens
aatatatgtaatatatacata

SEQ ID NO: 5114298 - DNA, 14 bp, Homo sapiens
aatatatgtatata

SEQ ID NO: 5114299 - DNA, 15 bp, Homo sapiens
aatatatgtatatat

SEQ ID NO: 5114300 - DNA, 22 bp, Homo sapiens
aatatatgtatatatattctca

SEQ ID NO: 5114301 - DNA, 23 bp, Homo sapiens
aatatatgtattttttgaatcta

SEQ ID NO: 5114302 - DNA, 14 bp, Homo sapiens
aatatatgtctgat

SEQ ID NO: 5114303 - DNA, 17 bp, Homo sapiens
aatatatgtgtgcctat

SEQ ID NO: 5114304 - DNA, 12 bp, Homo sapiens
aatatatgttct

SEQ ID NO: 5114305 - DNA, 20 bp, Homo sapiens
aatatatgttctgcaagaat

SEQ ID NO: 5114306 - DNA, 22 bp, Homo sapiens
aatatatgttctgcaagaatta

SEQ ID NO: 5114307 - DNA, 23 bp, Homo sapiens
aatatatgtttaccttttaatta

SEQ ID NO: 5114308 - DNA, 14 bp, Homo sapiens
aatatatgtttggc

SEQ ID NO: 5114309 - DNA, 23 bp, Homo sapiens
aatatatgttttaaatatagaat

SEQ ID NO: 5114310 - DNA, 15 bp, Homo sapiens
aatatatgttttgag

SEQ ID NO: 5114311 - DNA, 17 bp, Homo sapiens
aatatatgttttgagaa

SEQ ID NO: 5114312 - DNA, 18 bp, Homo sapiens
aatatatgttttgagaaa

SEQ ID NO: 5114313 - DNA, 19 bp, Homo sapiens
aatatatgttttgagaaaa

SEQ ID NO: 5114314 - DNA, 15 bp, Homo sapiens
aatatattaaaaata

SEQ ID NO: 5114315 - DNA, 22 bp, Homo sapiens
aatatattaccagcaagaataa

SEQ ID NO: 5114316 - DNA, 12 bp, Homo sapiens
aatatattactg

SEQ ID NO: 5114317 - DNA, 13 bp, Homo sapiens
aatatattataat

SEQ ID NO: 5114318 - DNA, 16 bp, Homo sapiens
aatatattatgaaaat

SEQ ID NO: 5114319 - DNA, 17 bp, Homo sapiens
aatatattatgaaaatt

SEQ ID NO: 5114320 - DNA, 21 bp, Homo sapiens
aatatattcagcctggcttca

SEQ ID NO: 5114321 - DNA, 23 bp, Homo sapiens
aatatattcctgagatttcctcc

SEQ ID NO: 5114322 - DNA, 13 bp, Homo sapiens
aatatattgaaca

SEQ ID NO: 5114323 - DNA, 13 bp, Homo sapiens
aatatattgaact

SEQ ID NO: 5114324 - DNA, 18 bp, Homo sapiens
aatatattgaacttttgt

SEQ ID NO: 5114325 - DNA, 23 bp, Homo sapiens
aatatattgaacttttgtactga

SEQ ID NO: 5114326 - DNA, 21 bp, Homo sapiens
aatatattgaagtaagttcat

SEQ ID NO: 5114327 - DNA, 23 bp, Homo sapiens
aatatattgaataggcattaaat

SEQ ID NO: 5114328 - DNA, 14 bp, Homo sapiens
aatatattgtacaa

SEQ ID NO: 5114329 - DNA, 17 bp, Homo sapiens
aatatattgtatatttg

SEQ ID NO: 5114330 - DNA, 23 bp, Homo sapiens
aatatattgtgttttaacaccaa

SEQ ID NO: 5114331 - DNA, 15 bp, Homo sapiens
aatatatttaaaggg

SEQ ID NO: 5114332 - DNA, 14 bp, Homo sapiens
aatatatttaacta

SEQ ID NO: 5114333 - DNA, 20 bp, Homo sapiens
aatatatttaagataattat

SEQ ID NO: 5114334 - DNA, 19 bp, Homo sapiens
aatatatttaatacctttg

SEQ ID NO: 5114335 - DNA, 14 bp, Homo sapiens
aatatatttaatga

SEQ ID NO: 5114336 - DNA, 15 bp, Homo sapiens
aatatatttaattgt

SEQ ID NO: 5114337 - DNA, 17 bp, Homo sapiens
aatatatttaggccagg

SEQ ID NO: 5114338 - DNA, 21 bp, Homo sapiens
aatatatttataaggaaattt

SEQ ID NO: 5114339 - DNA, 13 bp, Homo sapiens
aatatatttcaga

SEQ ID NO: 5114340 - DNA, 19 bp, Homo sapiens
aatatatttctaaatgttt

SEQ ID NO: 5114341 - DNA, 12 bp, Homo sapiens
aatatatttctt

SEQ ID NO: 5114342 - DNA, 15 bp, Homo sapiens
aatatatttgtcact

SEQ ID NO: 5114343 - DNA, 19 bp, Homo sapiens
aatatatttgtcatatgct

SEQ ID NO: 5114344 - DNA, 12 bp, Homo sapiens
aatatattttag

SEQ ID NO: 5114345 - DNA, 19 bp, Homo sapiens
aatatattttatcttggta

SEQ ID NO: 5114346 - DNA, 14 bp, Homo sapiens
aatatattttatga

SEQ ID NO: 5114347 - DNA, 23 bp, Homo sapiens
aatatattttctttctagtttgt

SEQ ID NO: 5114348 - DNA, 16 bp, Homo sapiens
aatatattttgtatgc

SEQ ID NO: 5114349 - DNA, 20 bp, Homo sapiens
aatatattttgtatgcaagc

SEQ ID NO: 5114350 - DNA, 17 bp, Homo sapiens
aatatatttttactgct

SEQ ID NO: 5114351 - DNA, 15 bp, Homo sapiens
aatatatttttagac

SEQ ID NO: 5114352 - DNA, 19 bp, Homo sapiens
aatatatttttatatttag

SEQ ID NO: 5114353 - DNA, 16 bp, Homo sapiens
aatatcaaaagaaaat

SEQ ID NO: 5114354 - DNA, 12 bp, Homo sapiens
aatatcaaaagg

SEQ ID NO: 5114355 - DNA, 14 bp, Homo sapiens
aatatcaaaaggaa

SEQ ID NO: 5114356 - DNA, 24 bp, Homo sapiens
aatatcaaagagaagatgcctgtt

SEQ ID NO: 5114357 - DNA, 14 bp, Homo sapiens
aatatcaaagtcat

SEQ ID NO: 5114358 - DNA, 20 bp, Homo sapiens
aatatcaaagtcattaaaga

SEQ ID NO: 5114359 - DNA, 15 bp, Homo sapiens
aatatcaaataaaat

SEQ ID NO: 5114360 - DNA, 16 bp, Homo sapiens
aatatcaaataaaata

SEQ ID NO: 5114361 - DNA, 14 bp, Homo sapiens
aatatcaaataata

SEQ ID NO: 5114362 - DNA, 21 bp, Homo sapiens
aatatcaaatgcagtatattt

SEQ ID NO: 5114363 - DNA, 16 bp, Homo sapiens
aatatcaacaacaagt

SEQ ID NO: 5114364 - DNA, 14 bp, Homo sapiens
aatatcaactctga

SEQ ID NO: 5114365 - DNA, 14 bp, Homo sapiens
aatatcaagaatag

SEQ ID NO: 5114366 - DNA, 19 bp, Homo sapiens
aatatcaagaatagttgtc

SEQ ID NO: 5114367 - DNA, 14 bp, Homo sapiens
aatatcaatatggt

SEQ ID NO: 5114368 - DNA, 14 bp, Homo sapiens
aatatcacagtatt

SEQ ID NO: 5114369 - DNA, 23 bp, Homo sapiens
aatatcacagtattatctgtgtt

SEQ ID NO: 5114370 - DNA, 16 bp, Homo sapiens
aatatcactcattaat

SEQ ID NO: 5114371 - DNA, 12 bp, Homo sapiens
aatatcacttaa

SEQ ID NO: 5114372 - DNA, 15 bp, Homo sapiens
aatatcacttgtcaa

SEQ ID NO: 5114373 - DNA, 20 bp, Homo sapiens
aatatcactttgtattctct

SEQ ID NO: 5114374 - DNA, 13 bp, Homo sapiens
aatatcagacaag

SEQ ID NO: 5114375 - DNA, 18 bp, Homo sapiens
aatatcagacaagcacta

SEQ ID NO: 5114376 - DNA, 22 bp, Homo sapiens
aatatcagacaagcactatttt

SEQ ID NO: 5114377 - DNA, 15 bp, Homo sapiens
aatatcagactagtg

SEQ ID NO: 5114378 - DNA, 20 bp, Homo sapiens
aatatcagcaagtctcttta

SEQ ID NO: 5114379 - DNA, 19 bp, Homo sapiens
aatatcagtagaaactcta

SEQ ID NO: 5114380 - DNA, 17 bp, Homo sapiens
aatcctactaataaacc

SEQ ID NO: 5114381 - DNA, 20 bp, Homo sapiens
aatcctagaaccaagcttca

SEQ ID NO: 5114382 - DNA, 14 bp, Homo sapiens
aatcctagactgct

SEQ ID NO: 5114383 - DNA, 19 bp, Homo sapiens
aatcctagacttgaaagtt

SEQ ID NO: 5114384 - DNA, 20 bp, Homo sapiens
aatcctagacttgaaagttt

SEQ ID NO: 5114385 - DNA, 14 bp, Homo sapiens
aatcctagagtctt

SEQ ID NO: 5114386 - DNA, 16 bp, Homo sapiens
aatcctagtttgctgt

SEQ ID NO: 5114387 - DNA, 14 bp, Homo sapiens
aatcctatatctgt

SEQ ID NO: 5114388 - DNA, 18 bp, Homo sapiens
aatcctatatctgtttgt

SEQ ID NO: 5114389 - DNA, 19 bp, Homo sapiens
aatcctatatctgtttgta

SEQ ID NO: 5114390 - DNA, 20 bp, Homo sapiens
aatcctatctggggagctcc

SEQ ID NO: 5114391 - DNA, 22 bp, Homo sapiens
aatcctatctggggagctcctg

SEQ ID NO: 5114392 - DNA, 21 bp, Homo sapiens
aatcctatgcatggtttcagc

SEQ ID NO: 5114393 - DNA, 18 bp, Homo sapiens
aatcctatgtcatttcta

SEQ ID NO: 5114394 - DNA, 24 bp, Homo sapiens
aatcctattaaaacacagctttac

SEQ ID NO: 5114395 - DNA, 16 bp, Homo sapiens
aatcctcaacactatt

SEQ ID NO: 5114396 - DNA, 20 bp, Homo sapiens
aatcctcagtttttgtgaaa

SEQ ID NO: 5114397 - DNA, 20 bp, Homo sapiens
aatcctccccgctctgccgc

SEQ ID NO: 5114398 - DNA, 18 bp, Homo sapiens
aatcctccctacttccaa

SEQ ID NO: 5114399 - DNA, 22 bp, Homo sapiens
aatcctcccttcccaggaggtg

SEQ ID NO: 5114400 - DNA, 9 bp, Homo sapiens
aatcctcct

SEQ ID NO: 5114401 - DNA, 19 bp, Homo sapiens
aatcctcctacctcagcct

SEQ ID NO: 5114402 - DNA, 13 bp, Homo sapiens
aatcctcctccag

SEQ ID NO: 5114403 - DNA, 23 bp, Homo sapiens
aatcctcctgagtgatcccattt

SEQ ID NO: 5114404 - DNA, 16 bp, Homo sapiens
aatcctcctgcctcag

SEQ ID NO: 5114405 - DNA, 17 bp, Homo sapiens
aatcctctatgtggttg

SEQ ID NO: 5114406 - DNA, 20 bp, Homo sapiens
aatcctctcacctcagcctc

SEQ ID NO: 5114407 - DNA, 18 bp, Homo sapiens
aatcctctctctgtgtta

SEQ ID NO: 5114408 - DNA, 15 bp, Homo sapiens
aatcctcttcctctg

SEQ ID NO: 5114409 - DNA, 19 bp, Homo sapiens
aatcctcttctaaaatagc

SEQ ID NO: 5114410 - DNA, 20 bp, Homo sapiens
aatcctgaactttctccctc

SEQ ID NO: 5114411 - DNA, 21 bp, Homo sapiens
aatcctgaggggatatcccta

SEQ ID NO: 5114412 - DNA, 16 bp, Homo sapiens
aatcctgattcatatt

SEQ ID NO: 5114413 - DNA, 15 bp, Homo sapiens
aatcctgccactgtt

SEQ ID NO: 5114414 - DNA, 11 bp, Homo sapiens
aatcctgcccc

SEQ ID NO: 5114415 - DNA, 12 bp, Homo sapiens
aatcctgccccc

SEQ ID NO: 5114416 - DNA, 11 bp, Homo sapiens
aatcctgcctc

SEQ ID NO: 5114417 - DNA, 12 bp, Homo sapiens
aatcctgctgcc

SEQ ID NO: 5114418 - DNA, 15 bp, Homo sapiens
aatcctggaagattt

SEQ ID NO: 5114419 - DNA, 17 bp, Homo sapiens
aatcctggaaggacaca

SEQ ID NO: 5114420 - DNA, 21 bp, Homo sapiens
aatcctggagagggtattttt

SEQ ID NO: 5114421 - DNA, 12 bp, Homo sapiens
aatcctggcagc

SEQ ID NO: 5114422 - DNA, 16 bp, Homo sapiens
aatcctggcagcccag

SEQ ID NO: 5114423 - DNA, 16 bp, Homo sapiens
aatcctggctctgatt

SEQ ID NO: 5114424 - DNA, 18 bp, Homo sapiens
aatcctgggcatccccag

SEQ ID NO: 5114425 - DNA, 11 bp, Homo sapiens
aatcctgggcc

SEQ ID NO: 5114426 - DNA, 12 bp, Homo sapiens
aatcctgggccc

SEQ ID NO: 5114427 - DNA, 11 bp, Homo sapiens
aatcctgtacc

SEQ ID NO: 5114428 - DNA, 20 bp, Homo sapiens
aatcctgtaggaaggtactg

SEQ ID NO: 5114429 - DNA, 23 bp, Homo sapiens
aatcctgtaggaaggtactgtat

SEQ ID NO: 5114430 - DNA, 18 bp, Homo sapiens
aatcctgtatataaaata

SEQ ID NO: 5114431 - DNA, 12 bp, Homo sapiens
aatcctgtcaat

SEQ ID NO: 5114432 - DNA, 19 bp, Homo sapiens
aatcctgtcgattagactg

SEQ ID NO: 5114433 - DNA, 22 bp, Homo sapiens
aatcctgttgaaaagccatgtt

SEQ ID NO: 5114434 - DNA, 19 bp, Homo sapiens
aatcctgtttataatctga

SEQ ID NO: 5114435 - DNA, 15 bp, Homo sapiens
aatccttaacatttc

SEQ ID NO: 5114436 - DNA, 15 bp, Homo sapiens
aatccttaataacta

SEQ ID NO: 5114437 - DNA, 20 bp, Homo sapiens
aatccttactaagtaggtga

SEQ ID NO: 5114438 - DNA, 13 bp, Homo sapiens
aatccttacttcc

SEQ ID NO: 5114439 - DNA, 15 bp, Homo sapiens
aatccttacttccag

SEQ ID NO: 5114440 - DNA, 12 bp, Homo sapiens
aatccttatgca

SEQ ID NO: 5114441 - DNA, 23 bp, Homo sapiens
aatccttatgcatgaaatgaatg

SEQ ID NO: 5114442 - DNA, 20 bp, Homo sapiens
aatccttcagcaatccttaa

SEQ ID NO: 5114443 - DNA, 20 bp, Homo sapiens
aatccttccatttcttctgc

SEQ ID NO: 5114444 - DNA, 17 bp, Homo sapiens
aatccttccctgctctt

SEQ ID NO: 5114445 - DNA, 20 bp, Homo sapiens
aatccttcctaaacccaatg

SEQ ID NO: 5114446 - DNA, 18 bp, Homo sapiens
aatccttcgtcctaacat

SEQ ID NO: 5114447 - DNA, 21 bp, Homo sapiens
aatccttctaactaaactaaa

SEQ ID NO: 5114448 - DNA, 20 bp, Homo sapiens
aatccttctagtttcccaca

SEQ ID NO: 5114449 - DNA, 22 bp, Homo sapiens
aatccttctcattacccacccg

SEQ ID NO: 5114450 - DNA, 20 bp, Homo sapiens
aatccttgaaggtatatcta

SEQ ID NO: 5114451 - DNA, 19 bp, Homo sapiens
aatccttgataatatattg

SEQ ID NO: 5114452 - DNA, 23 bp, Homo sapiens
aatccttggctgaattaaaatgg

SEQ ID NO: 5114453 - DNA, 12 bp, Homo sapiens
aatcctttgtac

SEQ ID NO: 5114454 - DNA, 13 bp, Homo sapiens
aatcctttgtgaa

SEQ ID NO: 5114455 - DNA, 19 bp, Homo sapiens
aatccttttcccataaata

SEQ ID NO: 5114456 - DNA, 22 bp, Homo sapiens
aatccttttcccataaataaaa

SEQ ID NO: 5114457 - DNA, 14 bp, Homo sapiens
aatccttttcctta

SEQ ID NO: 5114458 - DNA, 17 bp, Homo sapiens
aatcgaagtgtttatgt

SEQ ID NO: 5114459 - DNA, 12 bp, Homo sapiens
aatcgacatcct

SEQ ID NO: 5114460 - DNA, 19 bp, Homo sapiens
aatcgagagtgtgctctcc

SEQ ID NO: 5114461 - DNA, 19 bp, Homo sapiens
aatcgaggaaccagagcca

SEQ ID NO: 5114462 - DNA, 22 bp, Homo sapiens
aatcgaggtgtgggccagagat

SEQ ID NO: 5114463 - DNA, 21 bp, Homo sapiens
aatcgagtgccgcatctcaca

SEQ ID NO: 5114464 - DNA, 13 bp, Homo sapiens
aatcgatccatgt

SEQ ID NO: 5114465 - DNA, 15 bp, Homo sapiens
aatcgatccatgttt

SEQ ID NO: 5114466 - DNA, 16 bp, Homo sapiens
aatcgatccatgtttt

SEQ ID NO: 5114467 - DNA, 17 bp, Homo sapiens
aatcgatctgtactgta

SEQ ID NO: 5114468 - DNA, 14 bp, Homo sapiens
aatcgatgaatgta

SEQ ID NO: 5114469 - DNA, 14 bp, Homo sapiens
aatcgattggcttt

SEQ ID NO: 5114470 - DNA, 14 bp, Homo sapiens
aatcgcaagttaac

SEQ ID NO: 5114471 - DNA, 22 bp, Homo sapiens
aatcgcatcccggctgaccctg

SEQ ID NO: 5114472 - DNA, 17 bp, Homo sapiens
aatcgccataggccaag

SEQ ID NO: 5114473 - DNA, 16 bp, Homo sapiens
aatcgccttatgagaa

SEQ ID NO: 5114474 - DNA, 23 bp, Homo sapiens
aatcgctccaccttgcagctctc

SEQ ID NO: 5114475 - DNA, 22 bp, Homo sapiens
aatcgcttatatgtccttgggt

SEQ ID NO: 5114476 - DNA, 12 bp, Homo sapiens
aatcgcttctct

SEQ ID NO: 5114477 - DNA, 19 bp, Homo sapiens
aatcgcttgaacccaggag

SEQ ID NO: 5114478 - DNA, 17 bp, Homo sapiens
aatcgcttgaacctggg

SEQ ID NO: 5114479 - DNA, 21 bp, Homo sapiens
aatcgcttgaacctgggaagt

SEQ ID NO: 5114480 - DNA, 11 bp, Homo sapiens
aatcggactgc

SEQ ID NO: 5114481 - DNA, 13 bp, Homo sapiens
aatcggactgcca

SEQ ID NO: 5114482 - DNA, 16 bp, Homo sapiens
aatcggactgccaaat

SEQ ID NO: 5114483 - DNA, 18 bp, Homo sapiens
aatcggagcgaagcagag

SEQ ID NO: 5114484 - DNA, 21 bp, Homo sapiens
aatcggatctggggctctggg

SEQ ID NO: 5114485 - DNA, 23 bp, Homo sapiens
aatcggcaacagggcttctcttt

SEQ ID NO: 5114486 - DNA, 21 bp, Homo sapiens
aatcggctacccctcgactca

SEQ ID NO: 5114487 - DNA, 16 bp, Homo sapiens
aatcgggaaggatggg

SEQ ID NO: 5114488 - DNA, 22 bp, Homo sapiens
aatcgggctaaggtccctgggg

SEQ ID NO: 5114489 - DNA, 19 bp, Homo sapiens
aatcggggtataataggct

SEQ ID NO: 5114490 - DNA, 23 bp, Homo sapiens
aatcgggtccagagaccacacca

SEQ ID NO: 5114491 - DNA, 22 bp, Homo sapiens
aatcgtccctatatcagggcct

SEQ ID NO: 5114492 - DNA, 22 bp, Homo sapiens
aatcgtcttaagttttttatgc

SEQ ID NO: 5114493 - DNA, 14 bp, Homo sapiens
aatcgtgatattga

SEQ ID NO: 5114494 - DNA, 22 bp, Homo sapiens
aatcgtgtgccatggatctgat

SEQ ID NO: 5114495 - DNA, 16 bp, Homo sapiens
aatcgttatgtgtgta

SEQ ID NO: 5114496 - DNA, 20 bp, Homo sapiens
aatcgttctgctggccaaga

SEQ ID NO: 5114497 - DNA, 18 bp, Homo sapiens
aatcgtttaatgtttata

SEQ ID NO: 5114498 - DNA, 17 bp, Homo sapiens
aatcgtttttgctgcag

SEQ ID NO: 5114499 - DNA, 17 bp, Homo sapiens
aatctaaaaatcctttt

SEQ ID NO: 5114500 - DNA, 19 bp, Homo sapiens
aatctaaaaattgaactac

SEQ ID NO: 5114501 - DNA, 21 bp, Homo sapiens
aatctaaaaattttgcatttc

SEQ ID NO: 5114502 - DNA, 12 bp, Homo sapiens
aatctaaaatgt

SEQ ID NO: 5114503 - DNA, 12 bp, Homo sapiens
aatctaaaattt

SEQ ID NO: 5114504 - DNA, 14 bp, Homo sapiens
aatctaaaatttaa

SEQ ID NO: 5114505 - DNA, 18 bp, Homo sapiens
aatctaaaatttaaaatt

SEQ ID NO: 5114506 - DNA, 19 bp, Homo sapiens
aatctaaacctctctaggg

SEQ ID NO: 5114507 - DNA, 13 bp, Homo sapiens
aatctaaactgta

SEQ ID NO: 5114508 - DNA, 19 bp, Homo sapiens
aatctaaatagatactttt

SEQ ID NO: 5114509 - DNA, 14 bp, Homo sapiens
aatctaaatctatt

SEQ ID NO: 5114510 - DNA, 17 bp, Homo sapiens
aatctaaatctatttat

SEQ ID NO: 5114511 - DNA, 13 bp, Homo sapiens
aatctaaatggaa

SEQ ID NO: 5114512 - DNA, 19 bp, Homo sapiens
aatctaaatttcttttgct

SEQ ID NO: 5114513 - DNA, 14 bp, Homo sapiens
aatctaacaatgga

SEQ ID NO: 5114514 - DNA, 14 bp, Homo sapiens
aatctaagctgttt

SEQ ID NO: 5114515 - DNA, 13 bp, Homo sapiens
aatctaaggataa

SEQ ID NO: 5114516 - DNA, 12 bp, Homo sapiens
aatctaagggaa

SEQ ID NO: 5114517 - DNA, 14 bp, Homo sapiens
aatctaagtatatg

SEQ ID NO: 5114518 - DNA, 17 bp, Homo sapiens
aatctaagtgatataaa

SEQ ID NO: 5114519 - DNA, 17 bp, Homo sapiens
aatctaagtgggagaca

SEQ ID NO: 5114520 - DNA, 12 bp, Homo sapiens
aatctaataaaa

SEQ ID NO: 5114521 - DNA, 16 bp, Homo sapiens
aatctaatctgaactg

SEQ ID NO: 5114522 - DNA, 17 bp, Homo sapiens
aatctaatgacattcaa

SEQ ID NO: 5114523 - DNA, 17 bp, Homo sapiens
aatctaatgtaagaaaa

SEQ ID NO: 5114524 - DNA, 23 bp, Homo sapiens
aatctaatgtgagtgtgaagctt

SEQ ID NO: 5114525 - DNA, 22 bp, Homo sapiens
aatctaattagaattctctggg

SEQ ID NO: 5114526 - DNA, 19 bp, Homo sapiens
aatctacactccagtgaga

SEQ ID NO: 5114527 - DNA, 22 bp, Homo sapiens
aatctacagatcctttttccat

SEQ ID NO: 5114528 - DNA, 16 bp, Homo sapiens
aatctacatgtgtttg

SEQ ID NO: 5114529 - DNA, 18 bp, Homo sapiens
aatctacattataataaa

SEQ ID NO: 5114530 - DNA, 20 bp, Homo sapiens
aatctacattataataaaat

SEQ ID NO: 5114531 - DNA, 14 bp, Homo sapiens
aatctacatttgtt

SEQ ID NO: 5114532 - DNA, 15 bp, Homo sapiens
aatctacatttgttt

SEQ ID NO: 5114533 - DNA, 16 bp, Homo sapiens
aatctacccaaaggat

SEQ ID NO: 5114534 - DNA, 17 bp, Homo sapiens
aatctaccttctgtagt

SEQ ID NO: 5114535 - DNA, 13 bp, Homo sapiens
aatctacgtcttt

SEQ ID NO: 5114536 - DNA, 17 bp, Homo sapiens
aatctactaattccaca

SEQ ID NO: 5114537 - DNA, 17 bp, Homo sapiens
aatctactcaaagcatg

SEQ ID NO: 5114538 - DNA, 17 bp, Homo sapiens
aatctactcttaaatat

SEQ ID NO: 5114539 - DNA, 13 bp, Homo sapiens
aatctactgcatt

SEQ ID NO: 5114540 - DNA, 12 bp, Homo sapiens
aatctactgtat

SEQ ID NO: 5114541 - DNA, 14 bp, Homo sapiens
aatctagaaaatga

SEQ ID NO: 5114542 - DNA, 17 bp, Homo sapiens
aatctagaaaatgaaaa

SEQ ID NO: 5114543 - DNA, 15 bp, Homo sapiens
aatctagaaaattga

SEQ ID NO: 5114544 - DNA, 21 bp, Homo sapiens
aatctagaaatgttcacaagg

SEQ ID NO: 5114545 - DNA, 13 bp, Homo sapiens
aatctagaagaaa

SEQ ID NO: 5114546 - DNA, 16 bp, Homo sapiens
aatctagacaatatac

SEQ ID NO: 5114547 - DNA, 12 bp, Homo sapiens
aatctagacata

SEQ ID NO: 5114548 - DNA, 14 bp, Homo sapiens
aatctagaggaaaa

SEQ ID NO: 5114549 - DNA, 15 bp, Homo sapiens
aatctagaggagggg

SEQ ID NO: 5114550 - DNA, 12 bp, Homo sapiens
aatctagagttt

SEQ ID NO: 5114551 - DNA, 21 bp, Homo sapiens
aatctagataggtgcttttaa

SEQ ID NO: 5114552 - DNA, 20 bp, Homo sapiens
aatctagatcaattaattct

SEQ ID NO: 5114553 - DNA, 18 bp, Homo sapiens
aatctagccgatggaaaa

SEQ ID NO: 5114554 - DNA, 18 bp, Homo sapiens
aatctaggaaaatatttt

SEQ ID NO: 5114555 - DNA, 21 bp, Homo sapiens
aatctaggatgggaacaagga

SEQ ID NO: 5114556 - DNA, 13 bp, Homo sapiens
aatctagtatttg

SEQ ID NO: 5114557 - DNA, 20 bp, Homo sapiens
aatctagtgggttgaccttt

SEQ ID NO: 5114558 - DNA, 15 bp, Homo sapiens
aatctagtttacaga

SEQ ID NO: 5114559 - DNA, 17 bp, Homo sapiens
aatctataaacaatgaa

SEQ ID NO: 5114560 - DNA, 15 bp, Homo sapiens
aatatcagtattctg

SEQ ID NO: 5114561 - DNA, 15 bp, Homo sapiens
aatatcagttacagt

SEQ ID NO: 5114562 - DNA, 18 bp, Homo sapiens
aatatcagttacagtggc

SEQ ID NO: 5114563 - DNA, 22 bp, Homo sapiens
aatatcagttacagtggcagta

SEQ ID NO: 5114564 - DNA, 17 bp, Homo sapiens
aatatcatatgtatcta

SEQ ID NO: 5114565 - DNA, 16 bp, Homo sapiens
aatatcatcagtattg

SEQ ID NO: 5114566 - DNA, 15 bp, Homo sapiens
aatatcatctgtcat

SEQ ID NO: 5114567 - DNA, 13 bp, Homo sapiens
aatatcatgtgat

SEQ ID NO: 5114568 - DNA, 14 bp, Homo sapiens
aatatcatgtgatt

SEQ ID NO: 5114569 - DNA, 22 bp, Homo sapiens
aatatcatgtgtagatattatg

SEQ ID NO: 5114570 - DNA, 23 bp, Homo sapiens
aatatcatgtgtagatattatgt

SEQ ID NO: 5114571 - DNA, 12 bp, Homo sapiens
aatatcattact

SEQ ID NO: 5114572 - DNA, 13 bp, Homo sapiens
aatatcattacta

SEQ ID NO: 5114573 - DNA, 17 bp, Homo sapiens
aatatcattactaactt

SEQ ID NO: 5114574 - DNA, 22 bp, Homo sapiens
aatatcattatagcatgtaata

SEQ ID NO: 5114575 - DNA, 13 bp, Homo sapiens
aatatcattcagc

SEQ ID NO: 5114576 - DNA, 11 bp, Homo sapiens
aatatcattct

SEQ ID NO: 5114577 - DNA, 21 bp, Homo sapiens
aatatcattctttgtatctta

SEQ ID NO: 5114578 - DNA, 16 bp, Homo sapiens
aatatcatttactctt

SEQ ID NO: 5114579 - DNA, 12 bp, Homo sapiens
aatatcatttta

SEQ ID NO: 5114580 - DNA, 13 bp, Homo sapiens
aatatcattttat

SEQ ID NO: 5114581 - DNA, 18 bp, Homo sapiens
aatatcattttatagaaa

SEQ ID NO: 5114582 - DNA, 19 bp, Homo sapiens
aatatcattttatagaaaa

SEQ ID NO: 5114583 - DNA, 19 bp, Homo sapiens
aatatcattttcctgggag

SEQ ID NO: 5114584 - DNA, 16 bp, Homo sapiens
aatatccaaagactgt

SEQ ID NO: 5114585 - DNA, 20 bp, Homo sapiens
aatatccaaagactgtactg

SEQ ID NO: 5114586 - DNA, 16 bp, Homo sapiens
aatatccaatgaagaa

SEQ ID NO: 5114587 - DNA, 17 bp, Homo sapiens
aatatccaatgaagaag

SEQ ID NO: 5114588 - DNA, 20 bp, Homo sapiens
aatatccaattgctgcttgt

SEQ ID NO: 5114589 - DNA, 18 bp, Homo sapiens
aatatccactgcaatact

SEQ ID NO: 5114590 - DNA, 23 bp, Homo sapiens
aatatccagccagtacagtattt

SEQ ID NO: 5114591 - DNA, 22 bp, Homo sapiens
aatatccaggtgtgcccctcca

SEQ ID NO: 5114592 - DNA, 17 bp, Homo sapiens
aatatcccaacattctg

SEQ ID NO: 5114593 - DNA, 22 bp, Homo sapiens
aatatcccagaaaaagtaactc

SEQ ID NO: 5114594 - DNA, 14 bp, Homo sapiens
aatatcccagagaa

SEQ ID NO: 5114595 - DNA, 19 bp, Homo sapiens
aatatcccagagaacaatc

SEQ ID NO: 5114596 - DNA, 16 bp, Homo sapiens
aatatccctacatgta

SEQ ID NO: 5114597 - DNA, 17 bp, Homo sapiens
aatatccctacatgtat

SEQ ID NO: 5114598 - DNA, 17 bp, Homo sapiens
aatatccctcatttcat

SEQ ID NO: 5114599 - DNA, 22 bp, Homo sapiens
aatatccctcctgttgggagag

SEQ ID NO: 5114600 - DNA, 17 bp, Homo sapiens
aatatccctcttgtaag

SEQ ID NO: 5114601 - DNA, 18 bp, Homo sapiens
aatatccctcttgtaagt

SEQ ID NO: 5114602 - DNA, 17 bp, Homo sapiens
aatatcccttactttaa

SEQ ID NO: 5114603 - DNA, 19 bp, Homo sapiens
aatatccgtgaagggattt

SEQ ID NO: 5114604 - DNA, 15 bp, Homo sapiens
aatatcctaaacatc

SEQ ID NO: 5114605 - DNA, 14 bp, Homo sapiens
aatatcctatactg

SEQ ID NO: 5114606 - DNA, 13 bp, Homo sapiens
aatatcctcaatt

SEQ ID NO: 5114607 - DNA, 19 bp, Homo sapiens
aatatcctccactttcagg

SEQ ID NO: 5114608 - DNA, 14 bp, Homo sapiens
aatatcctgtaact

SEQ ID NO: 5114609 - DNA, 14 bp, Homo sapiens
aatatcctgtaata

SEQ ID NO: 5114610 - DNA, 15 bp, Homo sapiens
aatatcctgtaataa

SEQ ID NO: 5114611 - DNA, 22 bp, Homo sapiens
aatatccttgatgtacagattt

SEQ ID NO: 5114612 - DNA, 16 bp, Homo sapiens
aatatcctttggaaca

SEQ ID NO: 5114613 - DNA, 15 bp, Homo sapiens
aatatcgatataaat

SEQ ID NO: 5114614 - DNA, 12 bp, Homo sapiens
aatatctaaagt

SEQ ID NO: 5114615 - DNA, 15 bp, Homo sapiens
aatatctaaagttat

SEQ ID NO: 5114616 - DNA, 15 bp, Homo sapiens
aatatctaaataatg

SEQ ID NO: 5114617 - DNA, 16 bp, Homo sapiens
aatatctaaataatgg

SEQ ID NO: 5114618 - DNA, 18 bp, Homo sapiens
aatatctaagcaagtgaa

SEQ ID NO: 5114619 - DNA, 22 bp, Homo sapiens
aatatctaatatatatgaataa

SEQ ID NO: 5114620 - DNA, 18 bp, Homo sapiens
aatatctacctgccctct

SEQ ID NO: 5114621 - DNA, 21 bp, Homo sapiens
aatatctagtaatatatttaa

SEQ ID NO: 5114622 - DNA, 19 bp, Homo sapiens
aatatctagtgctaaacct

SEQ ID NO: 5114623 - DNA, 21 bp, Homo sapiens
aatatctatattctatacaca

SEQ ID NO: 5114624 - DNA, 19 bp, Homo sapiens
aatatctatttatctgtct

SEQ ID NO: 5114625 - DNA, 21 bp, Homo sapiens
aatatctatttgaataaatta

SEQ ID NO: 5114626 - DNA, 23 bp, Homo sapiens
aatatctatttgaataaattatg

SEQ ID NO: 5114627 - DNA, 16 bp, Homo sapiens
aatatctccgtcaact

SEQ ID NO: 5114628 - DNA, 21 bp, Homo sapiens
aatatctcctccaatgtcctg

SEQ ID NO: 5114629 - DNA, 23 bp, Homo sapiens
aatatctctatttaattttgaca

SEQ ID NO: 5114630 - DNA, 17 bp, Homo sapiens
aatatctgaaaatgtat

SEQ ID NO: 5114631 - DNA, 19 bp, Homo sapiens
aatatctgaaaatgtatgt

SEQ ID NO: 5114632 - DNA, 20 bp, Homo sapiens
aatatctgaaaatgtatgtg

SEQ ID NO: 5114633 - DNA, 20 bp, Homo sapiens
aatatctgacagttactctt

SEQ ID NO: 5114634 - DNA, 21 bp, Homo sapiens
aatatctgagaagtgtatata

SEQ ID NO: 5114635 - DNA, 15 bp, Homo sapiens
aatatctgagaattg

SEQ ID NO: 5114636 - DNA, 23 bp, Homo sapiens
aatatctgagaattgcaaaacta

SEQ ID NO: 5114637 - DNA, 20 bp, Homo sapiens
aatatctgcaatctttgcca

SEQ ID NO: 5114638 - DNA, 13 bp, Homo sapiens
aatatctgctgta

SEQ ID NO: 5114639 - DNA, 16 bp, Homo sapiens
aatatctgctgtatgt

SEQ ID NO: 5114640 - DNA, 15 bp, Homo sapiens
aatatctggcactgt

SEQ ID NO: 5114641 - DNA, 18 bp, Homo sapiens
aatatctggttatatcat

SEQ ID NO: 5114642 - DNA, 17 bp, Homo sapiens
aatatctgtgaaggact

SEQ ID NO: 5114643 - DNA, 23 bp, Homo sapiens
aatatctgtgaggtgctgatgag

SEQ ID NO: 5114644 - DNA, 23 bp, Homo sapiens
aatatctgttattcaaatttgat

SEQ ID NO: 5114645 - DNA, 22 bp, Homo sapiens
aatatctgttcccagcccctcc

SEQ ID NO: 5114646 - DNA, 13 bp, Homo sapiens
aatatcttaccag

SEQ ID NO: 5114647 - DNA, 16 bp, Homo sapiens
aatatcttcacattgt

SEQ ID NO: 5114648 - DNA, 18 bp, Homo sapiens
aatatcttcagctctttt

SEQ ID NO: 5114649 - DNA, 18 bp, Homo sapiens
aatatcttgctggattaa

SEQ ID NO: 5114650 - DNA, 15 bp, Homo sapiens
aatatcttggcctaa

SEQ ID NO: 5114651 - DNA, 23 bp, Homo sapiens
aatatctttcacatgcattttag

SEQ ID NO: 5114652 - DNA, 14 bp, Homo sapiens
aatatctttgcatc

SEQ ID NO: 5114653 - DNA, 20 bp, Homo sapiens
aatatctttgtgataattta

SEQ ID NO: 5114654 - DNA, 14 bp, Homo sapiens
aatatcttttatgt

SEQ ID NO: 5114655 - DNA, 18 bp, Homo sapiens
aatatcttttatgtttga

SEQ ID NO: 5114656 - DNA, 21 bp, Homo sapiens
aatatcttttatgtttgaata

SEQ ID NO: 5114657 - DNA, 17 bp, Homo sapiens
aatatcttttcttctcc

SEQ ID NO: 5114658 - DNA, 19 bp, Homo sapiens
aatatgaaaaatgtaaata

SEQ ID NO: 5114659 - DNA, 18 bp, Homo sapiens
aatatgaaactcatctgt

SEQ ID NO: 5114660 - DNA, 15 bp, Homo sapiens
aatatgaaatgataa

SEQ ID NO: 5114661 - DNA, 20 bp, Homo sapiens
aatatgaaattccagcaata

SEQ ID NO: 5114662 - DNA, 20 bp, Homo sapiens
aatatgaaattttttttcat

SEQ ID NO: 5114663 - DNA, 21 bp, Homo sapiens
aatatgaaccctttgtttctt

SEQ ID NO: 5114664 - DNA, 16 bp, Homo sapiens
aatatgaacctatttt

SEQ ID NO: 5114665 - DNA, 19 bp, Homo sapiens
aatatgaacggtgagcatt

SEQ ID NO: 5114666 - DNA, 14 bp, Homo sapiens
aatatgaatctata

SEQ ID NO: 5114667 - DNA, 18 bp, Homo sapiens
aatatgaatgagaatgtg

SEQ ID NO: 5114668 - DNA, 21 bp, Homo sapiens
aatatgaatgagaatgtgcca

SEQ ID NO: 5114669 - DNA, 12 bp, Homo sapiens
aatatgaatgcc

SEQ ID NO: 5114670 - DNA, 18 bp, Homo sapiens
aatatgaatgtcacattt

SEQ ID NO: 5114671 - DNA, 21 bp, Homo sapiens
aatatgacaaacatcattgtt

SEQ ID NO: 5114672 - DNA, 22 bp, Homo sapiens
aatatgacaatctaccaactgt

SEQ ID NO: 5114673 - DNA, 16 bp, Homo sapiens
aatatgaccttaagga

SEQ ID NO: 5114674 - DNA, 18 bp, Homo sapiens
aatatgaccttaaggaaa

SEQ ID NO: 5114675 - DNA, 22 bp, Homo sapiens
aatatgaccttaaggaaaagta

SEQ ID NO: 5114676 - DNA, 16 bp, Homo sapiens
aatatgactcaggagc

SEQ ID NO: 5114677 - DNA, 19 bp, Homo sapiens
aatatgactttttataaaa

SEQ ID NO: 5114678 - DNA, 18 bp, Homo sapiens
aatatgagaaatacagaa

SEQ ID NO: 5114679 - DNA, 22 bp, Homo sapiens
aatatgagaaatacagaagaaa

SEQ ID NO: 5114680 - DNA, 11 bp, Homo sapiens
aatatgagaat

SEQ ID NO: 5114681 - DNA, 15 bp, Homo sapiens
aatatgagaatgtat

SEQ ID NO: 5114682 - DNA, 17 bp, Homo sapiens
aatatgagagaactatt

SEQ ID NO: 5114683 - DNA, 14 bp, Homo sapiens
aatatgagcttcaa

SEQ ID NO: 5114684 - DNA, 16 bp, Homo sapiens
aatatgagtacaaatg

SEQ ID NO: 5114685 - DNA, 19 bp, Homo sapiens
aatatgatcacttcatact

SEQ ID NO: 5114686 - DNA, 14 bp, Homo sapiens
aatatgatgacaat

SEQ ID NO: 5114687 - DNA, 17 bp, Homo sapiens
aatatgatgactgtttt

SEQ ID NO: 5114688 - DNA, 14 bp, Homo sapiens
aatatgatgagatt

SEQ ID NO: 5114689 - DNA, 20 bp, Homo sapiens
aatatgatgagattcactta

SEQ ID NO: 5114690 - DNA, 16 bp, Homo sapiens
aatatgatgttaaaaa

SEQ ID NO: 5114691 - DNA, 18 bp, Homo sapiens
aatatgattaaaaatatc

SEQ ID NO: 5114692 - DNA, 18 bp, Homo sapiens
aatatgattagtaaagaa

SEQ ID NO: 5114693 - DNA, 19 bp, Homo sapiens
aatatgattcactatttaa

SEQ ID NO: 5114694 - DNA, 21 bp, Homo sapiens
aatatgattctagtacataat

SEQ ID NO: 5114695 - DNA, 19 bp, Homo sapiens
aatatgattctcctctccc

SEQ ID NO: 5114696 - DNA, 19 bp, Homo sapiens
aatatgattgcactaaata

SEQ ID NO: 5114697 - DNA, 14 bp, Homo sapiens
aatatgatttgcat

SEQ ID NO: 5114698 - DNA, 16 bp, Homo sapiens
aatatgatttgcattt

SEQ ID NO: 5114699 - DNA, 17 bp, Homo sapiens
aatatgatttgcatttt

SEQ ID NO: 5114700 - DNA, 14 bp, Homo sapiens
aatatgcaaagtct

SEQ ID NO: 5114701 - DNA, 18 bp, Homo sapiens
aatatgcaaagtctaggt

SEQ ID NO: 5114702 - DNA, 15 bp, Homo sapiens
aatatgcaacctgtg

SEQ ID NO: 5114703 - DNA, 13 bp, Homo sapiens
aatatgcaagcag

SEQ ID NO: 5114704 - DNA, 14 bp, Homo sapiens
aatatgcaagcagc

SEQ ID NO: 5114705 - DNA, 20 bp, Homo sapiens
aatatgcaaggcggtacact

SEQ ID NO: 5114706 - DNA, 15 bp, Homo sapiens
aatatgcaatttgtt

SEQ ID NO: 5114707 - DNA, 22 bp, Homo sapiens
aatatgcacacattttttaaat

SEQ ID NO: 5114708 - DNA, 19 bp, Homo sapiens
aatatgcactttccctaga

SEQ ID NO: 5114709 - DNA, 22 bp, Homo sapiens
aatatgcagtgatatggcagaa

SEQ ID NO: 5114710 - DNA, 17 bp, Homo sapiens
aatatgcatatatatgt

SEQ ID NO: 5114711 - DNA, 18 bp, Homo sapiens
aatatgcatatatatgta

SEQ ID NO: 5114712 - DNA, 21 bp, Homo sapiens
aatatgcatatatatgtatat

SEQ ID NO: 5114713 - DNA, 23 bp, Homo sapiens
aatatgcatatatatgtatattt

SEQ ID NO: 5114714 - DNA, 17 bp, Homo sapiens
aatatgcatcccacagc

SEQ ID NO: 5114715 - DNA, 18 bp, Homo sapiens
aatatgcatcccacagcc

SEQ ID NO: 5114716 - DNA, 22 bp, Homo sapiens
aatatgcatctttgagaatatt

SEQ ID NO: 5114717 - DNA, 19 bp, Homo sapiens
aatatgccactgaccgatt

SEQ ID NO: 5114718 - DNA, 15 bp, Homo sapiens
aatatgccagcttgg

SEQ ID NO: 5114719 - DNA, 12 bp, Homo sapiens
aatatgccagtg

SEQ ID NO: 5114720 - DNA, 23 bp, Homo sapiens
aatatgcctctcctttgtatatt

SEQ ID NO: 5114721 - DNA, 21 bp, Homo sapiens
aatatgcctgctatttgaagt

SEQ ID NO: 5114722 - DNA, 17 bp, Homo sapiens
aatatgccttaatttag

SEQ ID NO: 5114723 - DNA, 17 bp, Homo sapiens
aatatgcctttttgaag

SEQ ID NO: 5114724 - DNA, 13 bp, Homo sapiens
aatatgctctcat

SEQ ID NO: 5114725 - DNA, 14 bp, Homo sapiens
aatatgctgccaaa

SEQ ID NO: 5114726 - DNA, 16 bp, Homo sapiens
aatatgctggctggag

SEQ ID NO: 5114727 - DNA, 17 bp, Homo sapiens
aatatgctgtggggcat

SEQ ID NO: 5114728 - DNA, 22 bp, Homo sapiens
aatatgctgttatgtccagaaa

SEQ ID NO: 5114729 - DNA, 19 bp, Homo sapiens
aatatgcttaaaataagca

SEQ ID NO: 5114730 - DNA, 12 bp, Homo sapiens
aatatgctttac

SEQ ID NO: 5114731 - DNA, 14 bp, Homo sapiens
aatatggaaatctt

SEQ ID NO: 5114732 - DNA, 22 bp, Homo sapiens
aatatggaaatcttttacattt

SEQ ID NO: 5114733 - DNA, 18 bp, Homo sapiens
aatatggaactgtaataa

SEQ ID NO: 5114734 - DNA, 14 bp, Homo sapiens
aatatggaacttct

SEQ ID NO: 5114735 - DNA, 15 bp, Homo sapiens
aatatggacaagagg

SEQ ID NO: 5114736 - DNA, 17 bp, Homo sapiens
aatatggacatgtaaaa

SEQ ID NO: 5114737 - DNA, 17 bp, Homo sapiens
aatatggactcagtttt

SEQ ID NO: 5114738 - DNA, 14 bp, Homo sapiens
aatctataaagaag

SEQ ID NO: 5114739 - DNA, 17 bp, Homo sapiens
aatctataaagaaggat

SEQ ID NO: 5114740 - DNA, 18 bp, Homo sapiens
aatctataacataaagaa

SEQ ID NO: 5114741 - DNA, 20 bp, Homo sapiens
aatctataagtagtaaatca

SEQ ID NO: 5114742 - DNA, 23 bp, Homo sapiens
aatctatagaaagtgttctgtta

SEQ ID NO: 5114743 - DNA, 14 bp, Homo sapiens
aatctatattaaag

SEQ ID NO: 5114744 - DNA, 15 bp, Homo sapiens
aatctatatttgtct

SEQ ID NO: 5114745 - DNA, 15 bp, Homo sapiens
aatctatatttttgt

SEQ ID NO: 5114746 - DNA, 20 bp, Homo sapiens
aatctatctgcttatgcagt

SEQ ID NO: 5114747 - DNA, 20 bp, Homo sapiens
aatctatgaagtatataatg

SEQ ID NO: 5114748 - DNA, 15 bp, Homo sapiens
aatctatgattccag

SEQ ID NO: 5114749 - DNA, 17 bp, Homo sapiens
aatctatgccaaagatc

SEQ ID NO: 5114750 - DNA, 21 bp, Homo sapiens
aatctatgctggtgaaaacaa

SEQ ID NO: 5114751 - DNA, 19 bp, Homo sapiens
aatctatggcttatttcta

SEQ ID NO: 5114752 - DNA, 13 bp, Homo sapiens
aatctatggcttt

SEQ ID NO: 5114753 - DNA, 22 bp, Homo sapiens
aatctattaatagctgccttaa

SEQ ID NO: 5114754 - DNA, 16 bp, Homo sapiens
aatctattatactgta

SEQ ID NO: 5114755 - DNA, 17 bp, Homo sapiens
aatctattatactgtat

SEQ ID NO: 5114756 - DNA, 18 bp, Homo sapiens
aatctattatactgtatt

SEQ ID NO: 5114757 - DNA, 12 bp, Homo sapiens
aatctattcaga

SEQ ID NO: 5114758 - DNA, 18 bp, Homo sapiens
aatctattcagacaagca

SEQ ID NO: 5114759 - DNA, 18 bp, Homo sapiens
aatctattcctgtaaata

SEQ ID NO: 5114760 - DNA, 13 bp, Homo sapiens
aatctattctgtg

SEQ ID NO: 5114761 - DNA, 15 bp, Homo sapiens
aatctatttaaaaaa

SEQ ID NO: 5114762 - DNA, 23 bp, Homo sapiens
aatctatttaaaaaactgtataa

SEQ ID NO: 5114763 - DNA, 12 bp, Homo sapiens
aatctatttaag

SEQ ID NO: 5114764 - DNA, 23 bp, Homo sapiens
aatctatttacataaaatgggtg

SEQ ID NO: 5114765 - DNA, 16 bp, Homo sapiens
aatctatttattaata

SEQ ID NO: 5114766 - DNA, 18 bp, Homo sapiens
aatctatttattaatatt

SEQ ID NO: 5114767 - DNA, 16 bp, Homo sapiens
aatctatttattggac

SEQ ID NO: 5114768 - DNA, 23 bp, Homo sapiens
aatctatttcacttattttggct

SEQ ID NO: 5114769 - DNA, 20 bp, Homo sapiens
aatctattttctatgtacta

SEQ ID NO: 5114770 - DNA, 21 bp, Homo sapiens
aatctattttctatgtactag

SEQ ID NO: 5114771 - DNA, 13 bp, Homo sapiens
aatctatttttcc

SEQ ID NO: 5114772 - DNA, 23 bp, Homo sapiens
aatctcaaaagatctcctgtgca

SEQ ID NO: 5114773 - DNA, 12 bp, Homo sapiens
aatctcaaaatt

SEQ ID NO: 5114774 - DNA, 17 bp, Homo sapiens
aatctcaaaggagaaaa

SEQ ID NO: 5114775 - DNA, 18 bp, Homo sapiens
aatctcaaaggagaaaaa

SEQ ID NO: 5114776 - DNA, 15 bp, Homo sapiens
aatctcaaataacta

SEQ ID NO: 5114777 - DNA, 22 bp, Homo sapiens
aatctcaacatgtctcctactg

SEQ ID NO: 5114778 - DNA, 17 bp, Homo sapiens
aatctcaatacagcctg

SEQ ID NO: 5114779 - DNA, 16 bp, Homo sapiens
aatctcaatatttcag

SEQ ID NO: 5114780 - DNA, 22 bp, Homo sapiens
aatctcaattgaaagcttttaa

SEQ ID NO: 5114781 - DNA, 15 bp, Homo sapiens
aatctcaatttaaga

SEQ ID NO: 5114782 - DNA, 16 bp, Homo sapiens
aatctcacacagctgg

SEQ ID NO: 5114783 - DNA, 15 bp, Homo sapiens
aatctcacatataca

SEQ ID NO: 5114784 - DNA, 18 bp, Homo sapiens
aatctcacgctgccattt

SEQ ID NO: 5114785 - DNA, 13 bp, Homo sapiens
aatctcacttcat

SEQ ID NO: 5114786 - DNA, 21 bp, Homo sapiens
aatctcagaaccttgtcccag

SEQ ID NO: 5114787 - DNA, 13 bp, Homo sapiens
aatctcagagaca

SEQ ID NO: 5114788 - DNA, 18 bp, Homo sapiens
aatctcagattcttcact

SEQ ID NO: 5114789 - DNA, 22 bp, Homo sapiens
aatctcagcaatgattactctt

SEQ ID NO: 5114790 - DNA, 14 bp, Homo sapiens
aatctcagtgcttt

SEQ ID NO: 5114791 - DNA, 21 bp, Homo sapiens
aatctcagttgattttctgga

SEQ ID NO: 5114792 - DNA, 23 bp, Homo sapiens
aatctcatacaagccatttactt

SEQ ID NO: 5114793 - DNA, 18 bp, Homo sapiens
aatctcatacctctgacc

SEQ ID NO: 5114794 - DNA, 13 bp, Homo sapiens
aatctcatccccc

SEQ ID NO: 5114795 - DNA, 19 bp, Homo sapiens
aatctcatccccccacccg

SEQ ID NO: 5114796 - DNA, 17 bp, Homo sapiens
aatctcatctcagtgaa

SEQ ID NO: 5114797 - DNA, 15 bp, Homo sapiens
aatctcatgctgtgt

SEQ ID NO: 5114798 - DNA, 23 bp, Homo sapiens
aatctcattactgcttcattttt

SEQ ID NO: 5114799 - DNA, 11 bp, Homo sapiens
aatctcattat

SEQ ID NO: 5114800 - DNA, 17 bp, Homo sapiens
aatctcattgcttacaa

SEQ ID NO: 5114801 - DNA, 12 bp, Homo sapiens
aatctcatttgg

SEQ ID NO: 5114802 - DNA, 21 bp, Homo sapiens
aatctccaagacctggtgtgc

SEQ ID NO: 5114803 - DNA, 22 bp, Homo sapiens
aatctccaccagtcatttttca

SEQ ID NO: 5114804 - DNA, 18 bp, Homo sapiens
aatctccacccaatgaat

SEQ ID NO: 5114805 - DNA, 19 bp, Homo sapiens
aatctccacccaatgaatg

SEQ ID NO: 5114806 - DNA, 20 bp, Homo sapiens
aatctccacccaatgaatga

SEQ ID NO: 5114807 - DNA, 16 bp, Homo sapiens
aatctccacttttttc

SEQ ID NO: 5114808 - DNA, 19 bp, Homo sapiens
aatctccagggctgcccct

SEQ ID NO: 5114809 - DNA, 16 bp, Homo sapiens
aatctcccagcccacc

SEQ ID NO: 5114810 - DNA, 18 bp, Homo sapiens
aatctcccattttggaat

SEQ ID NO: 5114811 - DNA, 17 bp, Homo sapiens
aatctcctaacaaaaga

SEQ ID NO: 5114812 - DNA, 14 bp, Homo sapiens
aatctcctattttt

SEQ ID NO: 5114813 - DNA, 18 bp, Homo sapiens
aatctcctctaaaacaac

SEQ ID NO: 5114814 - DNA, 19 bp, Homo sapiens
aatctcctctttgtgaaat

SEQ ID NO: 5114815 - DNA, 21 bp, Homo sapiens
aatctcctttggaaggtgaca

SEQ ID NO: 5114816 - DNA, 15 bp, Homo sapiens
aatctcggctcactg

SEQ ID NO: 5114817 - DNA, 14 bp, Homo sapiens
aatctcgttcccaa

SEQ ID NO: 5114818 - DNA, 18 bp, Homo sapiens
aatctcgttcccaaagaa

SEQ ID NO: 5114819 - DNA, 18 bp, Homo sapiens
aatctcgttgaggccaag

SEQ ID NO: 5114820 - DNA, 17 bp, Homo sapiens
aatctcgtttagtgcca

SEQ ID NO: 5114821 - DNA, 18 bp, Homo sapiens
aatctcgtttcaaaaaca

SEQ ID NO: 5114822 - DNA, 15 bp, Homo sapiens
aatctctacaaaccc

SEQ ID NO: 5114823 - DNA, 20 bp, Homo sapiens
aatctctacgactaatcacc

SEQ ID NO: 5114824 - DNA, 20 bp, Homo sapiens
aatctctagcctctttgtgt

SEQ ID NO: 5114825 - DNA, 15 bp, Homo sapiens
aatctctatctcttt

SEQ ID NO: 5114826 - DNA, 22 bp, Homo sapiens
aatctctatgccctgttaaatg

SEQ ID NO: 5114827 - DNA, 21 bp, Homo sapiens
aatctctatttgagaagttct

SEQ ID NO: 5114828 - DNA, 18 bp, Homo sapiens
aatctctcagagccctca

SEQ ID NO: 5114829 - DNA, 15 bp, Homo sapiens
aatctctccaccttc

SEQ ID NO: 5114830 - DNA, 19 bp, Homo sapiens
aatctctccaccttccaaa

SEQ ID NO: 5114831 - DNA, 16 bp, Homo sapiens
aatctctccactttca

SEQ ID NO: 5114832 - DNA, 16 bp, Homo sapiens
aatctctccattcccg

SEQ ID NO: 5114833 - DNA, 18 bp, Homo sapiens
aatctctccctcctcagt

SEQ ID NO: 5114834 - DNA, 15 bp, Homo sapiens
aatctctcctctctc

SEQ ID NO: 5114835 - DNA, 17 bp, Homo sapiens
aatctctctgcagctgc

SEQ ID NO: 5114836 - DNA, 18 bp, Homo sapiens
aatctctctgcagctgcc

SEQ ID NO: 5114837 - DNA, 12 bp, Homo sapiens
aatctctgatta

SEQ ID NO: 5114838 - DNA, 13 bp, Homo sapiens
aatctctgcctct

SEQ ID NO: 5114839 - DNA, 11 bp, Homo sapiens
aatctctgctc

SEQ ID NO: 5114840 - DNA, 17 bp, Homo sapiens
aatctctgctctctatg

SEQ ID NO: 5114841 - DNA, 13 bp, Homo sapiens
aatctctgtgact

SEQ ID NO: 5114842 - DNA, 13 bp, Homo sapiens
aatctctgttact

SEQ ID NO: 5114843 - DNA, 21 bp, Homo sapiens
aatctctgttctgctcccaga

SEQ ID NO: 5114844 - DNA, 23 bp, Homo sapiens
aatctctgttctgtttggcactt

SEQ ID NO: 5114845 - DNA, 17 bp, Homo sapiens
aatctcttaaactctct

SEQ ID NO: 5114846 - DNA, 15 bp, Homo sapiens
aatctcttattctaa

SEQ ID NO: 5114847 - DNA, 20 bp, Homo sapiens
aatctcttcactaccctgat

SEQ ID NO: 5114848 - DNA, 11 bp, Homo sapiens
aatctcttctg

SEQ ID NO: 5114849 - DNA, 16 bp, Homo sapiens
aatctcttctgtgttt

SEQ ID NO: 5114850 - DNA, 16 bp, Homo sapiens
aatctcttgcttgtca

SEQ ID NO: 5114851 - DNA, 18 bp, Homo sapiens
aatctcttgtcattctca

SEQ ID NO: 5114852 - DNA, 20 bp, Homo sapiens
aatctcttgtcattctcatc

SEQ ID NO: 5114853 - DNA, 20 bp, Homo sapiens
aatctctttttgctttcgaa

SEQ ID NO: 5114854 - DNA, 20 bp, Homo sapiens
aatctgaaaccctccttctg

SEQ ID NO: 5114855 - DNA, 14 bp, Homo sapiens
aatctgaaagcccg

SEQ ID NO: 5114856 - DNA, 22 bp, Homo sapiens
aatctgaaattcaaaatgctct

SEQ ID NO: 5114857 - DNA, 14 bp, Homo sapiens
aatctgaaattcta

SEQ ID NO: 5114858 - DNA, 19 bp, Homo sapiens
aatctgaactctaagcaga

SEQ ID NO: 5114859 - DNA, 23 bp, Homo sapiens
aatctgaactgaccttgaatctt

SEQ ID NO: 5114860 - DNA, 13 bp, Homo sapiens
aatctgaagaaag

SEQ ID NO: 5114861 - DNA, 18 bp, Homo sapiens
aatctgaagaaagttatt

SEQ ID NO: 5114862 - DNA, 17 bp, Homo sapiens
aatctgaagattgttta

SEQ ID NO: 5114863 - DNA, 24 bp, Homo sapiens
aatctgaagtggttcagtctagaa

SEQ ID NO: 5114864 - DNA, 22 bp, Homo sapiens
aatctgaatcctgttaaatttt

SEQ ID NO: 5114865 - DNA, 12 bp, Homo sapiens
aatctgaatgta

SEQ ID NO: 5114866 - DNA, 15 bp, Homo sapiens
aatctgaatgtaatt

SEQ ID NO: 5114867 - DNA, 14 bp, Homo sapiens
aatctgaatttcta

SEQ ID NO: 5114868 - DNA, 16 bp, Homo sapiens
aatctgaatttctaaa

SEQ ID NO: 5114869 - DNA, 19 bp, Homo sapiens
aatctgaattttaaaacat

SEQ ID NO: 5114870 - DNA, 19 bp, Homo sapiens
aatctgaattttgcaatgt

SEQ ID NO: 5114871 - DNA, 13 bp, Homo sapiens
aatctgacccagt

SEQ ID NO: 5114872 - DNA, 15 bp, Homo sapiens
aatctgacccagtgc

SEQ ID NO: 5114873 - DNA, 17 bp, Homo sapiens
aatctgacccagtgccc

SEQ ID NO: 5114874 - DNA, 20 bp, Homo sapiens
aatctgagatctccctccag

SEQ ID NO: 5114875 - DNA, 23 bp, Homo sapiens
aatctgagcacgctaccaaatct

SEQ ID NO: 5114876 - DNA, 15 bp, Homo sapiens
aatctgaggcatcct

SEQ ID NO: 5114877 - DNA, 17 bp, Homo sapiens
aatctgaggcatcctct

SEQ ID NO: 5114878 - DNA, 18 bp, Homo sapiens
aatctgaggcatcctctg

SEQ ID NO: 5114879 - DNA, 15 bp, Homo sapiens
aatctgagggaaatg

SEQ ID NO: 5114880 - DNA, 22 bp, Homo sapiens
aatctgagggaaatgttttgta

SEQ ID NO: 5114881 - DNA, 16 bp, Homo sapiens
aatctgagggagctga

SEQ ID NO: 5114882 - DNA, 16 bp, Homo sapiens
aatctgataccaaaga

SEQ ID NO: 5114883 - DNA, 14 bp, Homo sapiens
aatctgatacttag

SEQ ID NO: 5114884 - DNA, 17 bp, Homo sapiens
aatctgataggaaaaga

SEQ ID NO: 5114885 - DNA, 13 bp, Homo sapiens
aatctgatcaatt

SEQ ID NO: 5114886 - DNA, 17 bp, Homo sapiens
aatctgatcaatttgaa

SEQ ID NO: 5114887 - DNA, 21 bp, Homo sapiens
aatctgatcccataaagaaag

SEQ ID NO: 5114888 - DNA, 22 bp, Homo sapiens
aatctgatcccataaagaaagt

SEQ ID NO: 5114889 - DNA, 21 bp, Homo sapiens
aatctgatcgttctttctagc

SEQ ID NO: 5114890 - DNA, 13 bp, Homo sapiens
aatctgatgaaaa

SEQ ID NO: 5114891 - DNA, 16 bp, Homo sapiens
aatctgatggccttaa

SEQ ID NO: 5114892 - DNA, 17 bp, Homo sapiens
aatctgatggccttaat

SEQ ID NO: 5114893 - DNA, 18 bp, Homo sapiens
aatctgatggccttaatt

SEQ ID NO: 5114894 - DNA, 22 bp, Homo sapiens
aatctgatggccttaatttcct

SEQ ID NO: 5114895 - DNA, 17 bp, Homo sapiens
aatctgatggcttctcc

SEQ ID NO: 5114896 - DNA, 15 bp, Homo sapiens
aatctgatgggcctg

SEQ ID NO: 5114897 - DNA, 20 bp, Homo sapiens
aatctgatgggcctggctgg

SEQ ID NO: 5114898 - DNA, 12 bp, Homo sapiens
aatctgatgtat

SEQ ID NO: 5114899 - DNA, 15 bp, Homo sapiens
aatctgatgtataat

SEQ ID NO: 5114900 - DNA, 17 bp, Homo sapiens
aatctgattcagcatca

SEQ ID NO: 5114901 - DNA, 20 bp, Homo sapiens
aatctgatttaatgttttct

SEQ ID NO: 5114902 - DNA, 21 bp, Homo sapiens
aatctgatttaatgttttctg

SEQ ID NO: 5114903 - DNA, 14 bp, Homo sapiens
aatctgatttcatt

SEQ ID NO: 5114904 - DNA, 21 bp, Homo sapiens
aatctgattttcaaaaatcat

SEQ ID NO: 5114905 - DNA, 20 bp, Homo sapiens
aatctgcaaaatgtagaaat

SEQ ID NO: 5114906 - DNA, 16 bp, Homo sapiens
aatctgcaaagcatgt

SEQ ID NO: 5114907 - DNA, 19 bp, Homo sapiens
aatctgcaaagcatgtttt

SEQ ID NO: 5114908 - DNA, 14 bp, Homo sapiens
aatctgcagaagga

SEQ ID NO: 5114909 - DNA, 23 bp, Homo sapiens
aatctgcagaaggaaaaatgtgt

SEQ ID NO: 5114910 - DNA, 17 bp, Homo sapiens
aatctgcagcacattga

SEQ ID NO: 5114911 - DNA, 17 bp, Homo sapiens
aatctgcagtttgtgaa

SEQ ID NO: 5114912 - DNA, 21 bp, Homo sapiens
aatctgcagtttgtgaacttc

SEQ ID NO: 5114913 - DNA, 18 bp, Homo sapiens
aatctgcattttaacaag

SEQ ID NO: 5114914 - DNA, 15 bp, Homo sapiens
aatctgccaagagag

SEQ ID NO: 5114915 - DNA, 14 bp, Homo sapiens
aatctgccacctgc

SEQ ID NO: 5114916 - DNA, 16 bp, Homo sapiens
aatctgccacctgcac

SEQ ID NO: 5114917 - DNA, 15 bp, Homo sapiens
aatatggactgctca

SEQ ID NO: 5114918 - DNA, 14 bp, Homo sapiens
aatatggatttctt

SEQ ID NO: 5114919 - DNA, 18 bp, Homo sapiens
aatatggctataaatata

SEQ ID NO: 5114920 - DNA, 13 bp, Homo sapiens
aatatgggagaaa

SEQ ID NO: 5114921 - DNA, 16 bp, Homo sapiens
aatatgggaggaacaa

SEQ ID NO: 5114922 - DNA, 22 bp, Homo sapiens
aatatggggcattaatattctt

SEQ ID NO: 5114923 - DNA, 14 bp, Homo sapiens
aatatggtgtattt

SEQ ID NO: 5114924 - DNA, 17 bp, Homo sapiens
aatatggtgtcttgata

SEQ ID NO: 5114925 - DNA, 23 bp, Homo sapiens
aatatggttggagagccctggat

SEQ ID NO: 5114926 - DNA, 20 bp, Homo sapiens
aatatggttttgttttcaat

SEQ ID NO: 5114927 - DNA, 16 bp, Homo sapiens
aatatgtaaactttaa

SEQ ID NO: 5114928 - DNA, 19 bp, Homo sapiens
aatatgtaagaacacattt

SEQ ID NO: 5114929 - DNA, 18 bp, Homo sapiens
aatatgtaatacttaaat

SEQ ID NO: 5114930 - DNA, 14 bp, Homo sapiens
aatatgtaatgctt

SEQ ID NO: 5114931 - DNA, 17 bp, Homo sapiens
aatatgtaatgcttcca

SEQ ID NO: 5114932 - DNA, 15 bp, Homo sapiens
aatatgtaatttcaa

SEQ ID NO: 5114933 - DNA, 22 bp, Homo sapiens
aatatgtacaaataatattgcc

SEQ ID NO: 5114934 - DNA, 13 bp, Homo sapiens
aatatgtacattt

SEQ ID NO: 5114935 - DNA, 19 bp, Homo sapiens
aatatgtacatttctaagt

SEQ ID NO: 5114936 - DNA, 18 bp, Homo sapiens
aatatgtacatttctcag

SEQ ID NO: 5114937 - DNA, 18 bp, Homo sapiens
aatatgtacttttccatt

SEQ ID NO: 5114938 - DNA, 12 bp, Homo sapiens
aatatgtagcct

SEQ ID NO: 5114939 - DNA, 21 bp, Homo sapiens
aatatgtattttatgtatgtt

SEQ ID NO: 5114940 - DNA, 17 bp, Homo sapiens
aatatgtattttcctaa

SEQ ID NO: 5114941 - DNA, 16 bp, Homo sapiens
aatatgtcaaaaaggg

SEQ ID NO: 5114942 - DNA, 18 bp, Homo sapiens
aatatgtcacctggcaca

SEQ ID NO: 5114943 - DNA, 13 bp, Homo sapiens
aatatgtcagatg

SEQ ID NO: 5114944 - DNA, 20 bp, Homo sapiens
aatatgtcatcatgcttatg

SEQ ID NO: 5114945 - DNA, 12 bp, Homo sapiens
aatatgtcctgg

SEQ ID NO: 5114946 - DNA, 13 bp, Homo sapiens
aatatgtcctggg

SEQ ID NO: 5114947 - DNA, 17 bp, Homo sapiens
aatatgtcgtagaattc

SEQ ID NO: 5114948 - DNA, 20 bp, Homo sapiens
aatatgtctgccacagagag

SEQ ID NO: 5114949 - DNA, 15 bp, Homo sapiens
aatatgtcttcataa

SEQ ID NO: 5114950 - DNA, 18 bp, Homo sapiens
aatatgtgaaaatgatta

SEQ ID NO: 5114951 - DNA, 14 bp, Homo sapiens
aatatgtgaagttt

SEQ ID NO: 5114952 - DNA, 15 bp, Homo sapiens
aatatgtgaagtttt

SEQ ID NO: 5114953 - DNA, 16 bp, Homo sapiens
aatatgtgaagttttc

SEQ ID NO: 5114954 - DNA, 16 bp, Homo sapiens
aatatgtgagattttt

SEQ ID NO: 5114955 - DNA, 19 bp, Homo sapiens
aatatgtgagattttttat

SEQ ID NO: 5114956 - DNA, 21 bp, Homo sapiens
aatatgtgagtgccttttgca

SEQ ID NO: 5114957 - DNA, 17 bp, Homo sapiens
aatatgtgattatcatt

SEQ ID NO: 5114958 - DNA, 18 bp, Homo sapiens
aatatgtgccttctagaa

SEQ ID NO: 5114959 - DNA, 18 bp, Homo sapiens
aatatgtgctgaacattg

SEQ ID NO: 5114960 - DNA, 21 bp, Homo sapiens
aatatgtggtccatctctgaa

SEQ ID NO: 5114961 - DNA, 23 bp, Homo sapiens
aatatgtggtccatctctgaaaa

SEQ ID NO: 5114962 - DNA, 14 bp, Homo sapiens
aatatgttaaagtt

SEQ ID NO: 5114963 - DNA, 17 bp, Homo sapiens
aatatgttaaagtttaa

SEQ ID NO: 5114964 - DNA, 21 bp, Homo sapiens
aatatgttaacctcagtgtca

SEQ ID NO: 5114965 - DNA, 21 bp, Homo sapiens
aatatgttagaatcaaatact

SEQ ID NO: 5114966 - DNA, 13 bp, Homo sapiens
aatatgttcttta

SEQ ID NO: 5114967 - DNA, 20 bp, Homo sapiens
aatatgttctttaaaaatat

SEQ ID NO: 5114968 - DNA, 15 bp, Homo sapiens
aatatgttgacttta

SEQ ID NO: 5114969 - DNA, 22 bp, Homo sapiens
aatatgttgatgaaaaatagca

SEQ ID NO: 5114970 - DNA, 20 bp, Homo sapiens
aatatgttgatttttatcag

SEQ ID NO: 5114971 - DNA, 23 bp, Homo sapiens
aatatgttggggtttttttaaga

SEQ ID NO: 5114972 - DNA, 15 bp, Homo sapiens
aatatgtttaaaata

SEQ ID NO: 5114973 - DNA, 23 bp, Homo sapiens
aatatgtttagttttacatttta

SEQ ID NO: 5114974 - DNA, 23 bp, Homo sapiens
aatatgtttggaatattccacta

SEQ ID NO: 5114975 - DNA, 21 bp, Homo sapiens
aatattaaaaaacttcatgta

SEQ ID NO: 5114976 - DNA, 13 bp, Homo sapiens
aatattaaaaagt

SEQ ID NO: 5114977 - DNA, 19 bp, Homo sapiens
aatattaaaaagtctttta

SEQ ID NO: 5114978 - DNA, 21 bp, Homo sapiens
aatattaaaaagtcttttaaa

SEQ ID NO: 5114979 - DNA, 14 bp, Homo sapiens
aatattaaaaatta

SEQ ID NO: 5114980 - DNA, 15 bp, Homo sapiens
aatattaaaagagac

SEQ ID NO: 5114981 - DNA, 13 bp, Homo sapiens
aatattaaagata

SEQ ID NO: 5114982 - DNA, 19 bp, Homo sapiens
aatattaaagattctcttt

SEQ ID NO: 5114983 - DNA, 11 bp, Homo sapiens
aatattaaagc

SEQ ID NO: 5114984 - DNA, 12 bp, Homo sapiens
aatattaaagcc

SEQ ID NO: 5114985 - DNA, 13 bp, Homo sapiens
aatattaaagcca

SEQ ID NO: 5114986 - DNA, 20 bp, Homo sapiens
aatattaaagccatgtttat

SEQ ID NO: 5114987 - DNA, 21 bp, Homo sapiens
aatattaaagtcagaatatta

SEQ ID NO: 5114988 - DNA, 19 bp, Homo sapiens
aatattaaagtctgagaaa

SEQ ID NO: 5114989 - DNA, 19 bp, Homo sapiens
aatattaaatacagacact

SEQ ID NO: 5114990 - DNA, 20 bp, Homo sapiens
aatattaaatacagacacta

SEQ ID NO: 5114991 - DNA, 16 bp, Homo sapiens
aatattaactactgta

SEQ ID NO: 5114992 - DNA, 16 bp, Homo sapiens
aatattaacttttaat

SEQ ID NO: 5114993 - DNA, 21 bp, Homo sapiens
aatattaagcacattattgta

SEQ ID NO: 5114994 - DNA, 23 bp, Homo sapiens
aatattaagcacattattgtaga

SEQ ID NO: 5114995 - DNA, 13 bp, Homo sapiens
aatattaagcatg

SEQ ID NO: 5114996 - DNA, 13 bp, Homo sapiens
aatattaatatgt

SEQ ID NO: 5114997 - DNA, 16 bp, Homo sapiens
aatattaatatgtact

SEQ ID NO: 5114998 - DNA, 20 bp, Homo sapiens
aatattaatcccagccctac

SEQ ID NO: 5114999 - DNA, 22 bp, Homo sapiens
aatattaatgcctttaaagtat

SEQ ID NO: 5115000 - DNA, 22 bp, Homo sapiens
aatattaattataataaaggtc

SEQ ID NO: 5115001 - DNA, 13 bp, Homo sapiens
aatattacattgc

SEQ ID NO: 5115002 - DNA, 14 bp, Homo sapiens
aatattacatttca

SEQ ID NO: 5115003 - DNA, 16 bp, Homo sapiens
aatattacatttcatt

SEQ ID NO: 5115004 - DNA, 21 bp, Homo sapiens
aatattacatttcatttatac

SEQ ID NO: 5115005 - DNA, 13 bp, Homo sapiens
aatattaccaaaa

SEQ ID NO: 5115006 - DNA, 22 bp, Homo sapiens
aatattaccatcttaatcttta

SEQ ID NO: 5115007 - DNA, 19 bp, Homo sapiens
aatattacctaatgaaagt

SEQ ID NO: 5115008 - DNA, 20 bp, Homo sapiens
aatattactcctatttttgt

SEQ ID NO: 5115009 - DNA, 21 bp, Homo sapiens
aatattactgatcttaccttt

SEQ ID NO: 5115010 - DNA, 21 bp, Homo sapiens
aatattactggataaattgta

SEQ ID NO: 5115011 - DNA, 13 bp, Homo sapiens
aatattagatgct

SEQ ID NO: 5115012 - DNA, 20 bp, Homo sapiens
aatattagatgctctgagaa

SEQ ID NO: 5115013 - DNA, 12 bp, Homo sapiens
aatattagatgt

SEQ ID NO: 5115014 - DNA, 14 bp, Homo sapiens
aatattagtgattc

SEQ ID NO: 5115015 - DNA, 15 bp, Homo sapiens
aatattagtgcagtt

SEQ ID NO: 5115016 - DNA, 18 bp, Homo sapiens
aatattagttaatggatt

SEQ ID NO: 5115017 - DNA, 21 bp, Homo sapiens
aatattagttgtatataaaat

SEQ ID NO: 5115018 - DNA, 14 bp, Homo sapiens
aatattatatagga

SEQ ID NO: 5115019 - DNA, 22 bp, Homo sapiens
aatattatataggatattgcta

SEQ ID NO: 5115020 - DNA, 17 bp, Homo sapiens
aatattatatttggatg

SEQ ID NO: 5115021 - DNA, 22 bp, Homo sapiens
aatattatattttttctataaa

SEQ ID NO: 5115022 - DNA, 20 bp, Homo sapiens
aatattatcatttctccttt

SEQ ID NO: 5115023 - DNA, 11 bp, Homo sapiens
aatattatctt

SEQ ID NO: 5115024 - DNA, 20 bp, Homo sapiens
aatattatctttgtaattat

SEQ ID NO: 5115025 - DNA, 18 bp, Homo sapiens
aatattatgaaatttcac

SEQ ID NO: 5115026 - DNA, 14 bp, Homo sapiens
aatattatgagatg

SEQ ID NO: 5115027 - DNA, 18 bp, Homo sapiens
aatattatgagatgctgg

SEQ ID NO: 5115028 - DNA, 12 bp, Homo sapiens
aatattatgcaa

SEQ ID NO: 5115029 - DNA, 14 bp, Homo sapiens
aatattatgtgttt

SEQ ID NO: 5115030 - DNA, 15 bp, Homo sapiens
aatattatgttatga

SEQ ID NO: 5115031 - DNA, 18 bp, Homo sapiens
aatattatgttatgaaaa

SEQ ID NO: 5115032 - DNA, 11 bp, Homo sapiens
aatattattat

SEQ ID NO: 5115033 - DNA, 13 bp, Homo sapiens
aatattattatga

SEQ ID NO: 5115034 - DNA, 16 bp, Homo sapiens
aatattattcctcaaa

SEQ ID NO: 5115035 - DNA, 14 bp, Homo sapiens
aatattattgaact

SEQ ID NO: 5115036 - DNA, 16 bp, Homo sapiens
aatattcaagtaacac

SEQ ID NO: 5115037 - DNA, 14 bp, Homo sapiens
aatattcaataaag

SEQ ID NO: 5115038 - DNA, 16 bp, Homo sapiens
aatattcaataaagct

SEQ ID NO: 5115039 - DNA, 16 bp, Homo sapiens
aatattcaataagaag

SEQ ID NO: 5115040 - DNA, 16 bp, Homo sapiens
aatattcacatgttct

SEQ ID NO: 5115041 - DNA, 11 bp, Homo sapiens
aatattcactc

SEQ ID NO: 5115042 - DNA, 15 bp, Homo sapiens
aatattcagaatctt

SEQ ID NO: 5115043 - DNA, 16 bp, Homo sapiens
aatattcagccagctt

SEQ ID NO: 5115044 - DNA, 24 bp, Homo sapiens
aatattcagccagcttaaacccat

SEQ ID NO: 5115045 - DNA, 18 bp, Homo sapiens
aatattcatgaagagttg

SEQ ID NO: 5115046 - DNA, 15 bp, Homo sapiens
aatattcattttact

SEQ ID NO: 5115047 - DNA, 17 bp, Homo sapiens
aatattccaagcttcat

SEQ ID NO: 5115048 - DNA, 16 bp, Homo sapiens
aatattccagaagaac

SEQ ID NO: 5115049 - DNA, 18 bp, Homo sapiens
aatattccagatctttca

SEQ ID NO: 5115050 - DNA, 22 bp, Homo sapiens
aatattccagatctttcagaaa

SEQ ID NO: 5115051 - DNA, 21 bp, Homo sapiens
aatattcccttttaggtgagg

SEQ ID NO: 5115052 - DNA, 19 bp, Homo sapiens
aatattcctccaaatctct

SEQ ID NO: 5115053 - DNA, 12 bp, Homo sapiens
aatattcctgaa

SEQ ID NO: 5115054 - DNA, 15 bp, Homo sapiens
aatattcctgaatga

SEQ ID NO: 5115055 - DNA, 15 bp, Homo sapiens
aatattcctgcattt

SEQ ID NO: 5115056 - DNA, 23 bp, Homo sapiens
aatattcctggacttacaaaatg

SEQ ID NO: 5115057 - DNA, 19 bp, Homo sapiens
aatattccttatttaagac

SEQ ID NO: 5115058 - DNA, 20 bp, Homo sapiens
aatattcctttgcatattat

SEQ ID NO: 5115059 - DNA, 14 bp, Homo sapiens
aatattctaaaaaa

SEQ ID NO: 5115060 - DNA, 21 bp, Homo sapiens
aatattctacacatatcttgt

SEQ ID NO: 5115061 - DNA, 21 bp, Homo sapiens
aatattctacacatgtaaaat

SEQ ID NO: 5115062 - DNA, 13 bp, Homo sapiens
aatattctagaac

SEQ ID NO: 5115063 - DNA, 10 bp, Homo sapiens
aatattctgt

SEQ ID NO: 5115064 - DNA, 14 bp, Homo sapiens
aatattctgtaact

SEQ ID NO: 5115065 - DNA, 23 bp, Homo sapiens
aatattctgtaactattgggtga

SEQ ID NO: 5115066 - DNA, 21 bp, Homo sapiens
aatattcttgtccacattcta

SEQ ID NO: 5115067 - DNA, 14 bp, Homo sapiens
aatattctttcaat

SEQ ID NO: 5115068 - DNA, 16 bp, Homo sapiens
aatattcttttgtttc

SEQ ID NO: 5115069 - DNA, 17 bp, Homo sapiens
aatattcttttgtttcc

SEQ ID NO: 5115070 - DNA, 20 bp, Homo sapiens
aatattgaaaattgaaaagt

SEQ ID NO: 5115071 - DNA, 22 bp, Homo sapiens
aatattgaactcaatgatagca

SEQ ID NO: 5115072 - DNA, 15 bp, Homo sapiens
aatattgaagttgtt

SEQ ID NO: 5115073 - DNA, 18 bp, Homo sapiens
aatattgacaagtgtctt

SEQ ID NO: 5115074 - DNA, 21 bp, Homo sapiens
aatattgactcaaaccatatt

SEQ ID NO: 5115075 - DNA, 14 bp, Homo sapiens
aatattgactttgt

SEQ ID NO: 5115076 - DNA, 15 bp, Homo sapiens
aatattgactttgtc

SEQ ID NO: 5115077 - DNA, 16 bp, Homo sapiens
aatattgactttgtct

SEQ ID NO: 5115078 - DNA, 14 bp, Homo sapiens
aatattgagcaata

SEQ ID NO: 5115079 - DNA, 19 bp, Homo sapiens
aatattgagcagaattcat

SEQ ID NO: 5115080 - DNA, 22 bp, Homo sapiens
aatattgaggctttgtgttgta

SEQ ID NO: 5115081 - DNA, 15 bp, Homo sapiens
aatattgatctgtat

SEQ ID NO: 5115082 - DNA, 16 bp, Homo sapiens
aatattgatctgtatt

SEQ ID NO: 5115083 - DNA, 22 bp, Homo sapiens
aatattgattgggaaaacattt

SEQ ID NO: 5115084 - DNA, 13 bp, Homo sapiens
aatattgcaaaat

SEQ ID NO: 5115085 - DNA, 20 bp, Homo sapiens
aatattgcaaaatacatgaa

SEQ ID NO: 5115086 - DNA, 23 bp, Homo sapiens
aatattgccaatgctacagtaat

SEQ ID NO: 5115087 - DNA, 19 bp, Homo sapiens
aatattgccttgatgtttc

SEQ ID NO: 5115088 - DNA, 19 bp, Homo sapiens
aatattgctaaaagcatgt

SEQ ID NO: 5115089 - DNA, 20 bp, Homo sapiens
aatattgctaaaagcatgta

SEQ ID NO: 5115090 - DNA, 23 bp, Homo sapiens
aatattgctaaaagcatgtatag

SEQ ID NO: 5115091 - DNA, 22 bp, Homo sapiens
aatattgctccatgatgactta

SEQ ID NO: 5115092 - DNA, 21 bp, Homo sapiens
aatattgctgatggtgcaatg

SEQ ID NO: 5115093 - DNA, 22 bp, Homo sapiens
aatattgctgatggtgcaatga

SEQ ID NO: 5115094 - DNA, 19 bp, Homo sapiens
aatattgcttcaatttcaa

SEQ ID NO: 5115095 - DNA, 22 bp, Homo sapiens
aatattgcttcttgtgttttac

SEQ ID NO: 5115096 - DNA, 17 bp, Homo sapiens
aatctgccacctgcaca

SEQ ID NO: 5115097 - DNA, 19 bp, Homo sapiens
aatctgccacctgcacagg

SEQ ID NO: 5115098 - DNA, 12 bp, Homo sapiens
aatctgcctggg

SEQ ID NO: 5115099 - DNA, 15 bp, Homo sapiens
aatctgcctgtatct

SEQ ID NO: 5115100 - DNA, 15 bp, Homo sapiens
aatctgcctttgttt

SEQ ID NO: 5115101 - DNA, 21 bp, Homo sapiens
aatctgcctttgtttctaaag

SEQ ID NO: 5115102 - DNA, 14 bp, Homo sapiens
aatctgctcacttt

SEQ ID NO: 5115103 - DNA, 20 bp, Homo sapiens
aatctgctcactttaaacct

SEQ ID NO: 5115104 - DNA, 20 bp, Homo sapiens
aatctgctcagcaggcccta

SEQ ID NO: 5115105 - DNA, 18 bp, Homo sapiens
aatctgctgatctctgta

SEQ ID NO: 5115106 - DNA, 22 bp, Homo sapiens
aatctgctgatctctgtagaat

SEQ ID NO: 5115107 - DNA, 18 bp, Homo sapiens
aatctgctgcaccttgta

SEQ ID NO: 5115108 - DNA, 11 bp, Homo sapiens
aatctgctgtt

SEQ ID NO: 5115109 - DNA, 21 bp, Homo sapiens
aatctgctgttgccatagccc

SEQ ID NO: 5115110 - DNA, 21 bp, Homo sapiens
aatctgcttcatccaatgtga

SEQ ID NO: 5115111 - DNA, 19 bp, Homo sapiens
aatctgctttagtttcaca

SEQ ID NO: 5115112 - DNA, 12 bp, Homo sapiens
aatctgctttca

SEQ ID NO: 5115113 - DNA, 22 bp, Homo sapiens
aatctgctttgttaatgaaaat

SEQ ID NO: 5115114 - DNA, 18 bp, Homo sapiens
aatctgcttttcctctgc

SEQ ID NO: 5115115 - DNA, 16 bp, Homo sapiens
aatctggaaatctgtt

SEQ ID NO: 5115116 - DNA, 21 bp, Homo sapiens
aatctggaaatctgttttgta

SEQ ID NO: 5115117 - DNA, 15 bp, Homo sapiens
aatctggaagaaaaa

SEQ ID NO: 5115118 - DNA, 22 bp, Homo sapiens
aatctggaccccatctgtgaat

SEQ ID NO: 5115119 - DNA, 24 bp, Homo sapiens
aatctggaccccatctgtgaataa

SEQ ID NO: 5115120 - DNA, 23 bp, Homo sapiens
aatctggacttatttttggactt

SEQ ID NO: 5115121 - DNA, 20 bp, Homo sapiens
aatctggagaactatacctg

SEQ ID NO: 5115122 - DNA, 15 bp, Homo sapiens
aatctggagaccagg

SEQ ID NO: 5115123 - DNA, 19 bp, Homo sapiens
aatctggagagctagaacc

SEQ ID NO: 5115124 - DNA, 14 bp, Homo sapiens
aatctggagtgagg

SEQ ID NO: 5115125 - DNA, 19 bp, Homo sapiens
aatctggatgcctcattat

SEQ ID NO: 5115126 - DNA, 21 bp, Homo sapiens
aatctggatgcctcattatgt

SEQ ID NO: 5115127 - DNA, 14 bp, Homo sapiens
aatctggcccttac

SEQ ID NO: 5115128 - DNA, 21 bp, Homo sapiens
aatctggctcactgcagcctc

SEQ ID NO: 5115129 - DNA, 19 bp, Homo sapiens
aatctggctcctcctggaa

SEQ ID NO: 5115130 - DNA, 14 bp, Homo sapiens
aatctggctcctgt

SEQ ID NO: 5115131 - DNA, 19 bp, Homo sapiens
aatctggctcctgtttcca

SEQ ID NO: 5115132 - DNA, 21 bp, Homo sapiens
aatctggcttctggccaggaa

SEQ ID NO: 5115133 - DNA, 23 bp, Homo sapiens
aatctggcttctggccaggaagc

SEQ ID NO: 5115134 - DNA, 21 bp, Homo sapiens
aatctgggactgtgcctggct

SEQ ID NO: 5115135 - DNA, 22 bp, Homo sapiens
aatctgggactgtgcctggctc

SEQ ID NO: 5115136 - DNA, 15 bp, Homo sapiens
aatctgggactttca

SEQ ID NO: 5115137 - DNA, 16 bp, Homo sapiens
aatctgggagcagggc

SEQ ID NO: 5115138 - DNA, 23 bp, Homo sapiens
aatctgggagcagggcataggaa

SEQ ID NO: 5115139 - DNA, 16 bp, Homo sapiens
aatctgggccagaatt

SEQ ID NO: 5115140 - DNA, 17 bp, Homo sapiens
aatctgggccagaattt

SEQ ID NO: 5115141 - DNA, 21 bp, Homo sapiens
aatctgggtggtaactgccag

SEQ ID NO: 5115142 - DNA, 22 bp, Homo sapiens
aatctgggtggtaactgccagc

SEQ ID NO: 5115143 - DNA, 20 bp, Homo sapiens
aatctggtaatggtgtccca

SEQ ID NO: 5115144 - DNA, 19 bp, Homo sapiens
aatctggtccatatttaca

SEQ ID NO: 5115145 - DNA, 17 bp, Homo sapiens
aatctggtgttcttgct

SEQ ID NO: 5115146 - DNA, 21 bp, Homo sapiens
aatctgtaaactgtgtattcc

SEQ ID NO: 5115147 - DNA, 23 bp, Homo sapiens
aatctgtaaactgtgtattccaa

SEQ ID NO: 5115148 - DNA, 17 bp, Homo sapiens
aatctgtaacccccaag

SEQ ID NO: 5115149 - DNA, 11 bp, Homo sapiens
aatctgtaatt

SEQ ID NO: 5115150 - DNA, 13 bp, Homo sapiens
aatctgtacaatg

SEQ ID NO: 5115151 - DNA, 14 bp, Homo sapiens
aatctgtacatgtt

SEQ ID NO: 5115152 - DNA, 19 bp, Homo sapiens
aatctgtacattttgttgt

SEQ ID NO: 5115153 - DNA, 14 bp, Homo sapiens
aatctgtacttttt

SEQ ID NO: 5115154 - DNA, 20 bp, Homo sapiens
aatctgtacttttttcaaat

SEQ ID NO: 5115155 - DNA, 21 bp, Homo sapiens
aatctgtacttttttcaaata

SEQ ID NO: 5115156 - DNA, 19 bp, Homo sapiens
aatctgtataaatgtctat

SEQ ID NO: 5115157 - DNA, 21 bp, Homo sapiens
aatctgtataaatgtctatta

SEQ ID NO: 5115158 - DNA, 20 bp, Homo sapiens
aatctgtatctgtagtgaga

SEQ ID NO: 5115159 - DNA, 18 bp, Homo sapiens
aatctgtattctgtttgc

SEQ ID NO: 5115160 - DNA, 12 bp, Homo sapiens
aatctgtcaaaa

SEQ ID NO: 5115161 - DNA, 13 bp, Homo sapiens
aatctgtcaagag

SEQ ID NO: 5115162 - DNA, 21 bp, Homo sapiens
aatctgtccaaaggaggctgg

SEQ ID NO: 5115163 - DNA, 15 bp, Homo sapiens
aatctgtccagacaa

SEQ ID NO: 5115164 - DNA, 22 bp, Homo sapiens
aatctgtccagacaagccctgc

SEQ ID NO: 5115165 - DNA, 15 bp, Homo sapiens
aatctgtcctctgta

SEQ ID NO: 5115166 - DNA, 21 bp, Homo sapiens
aatctgtcctgtggcatgcaa

SEQ ID NO: 5115167 - DNA, 14 bp, Homo sapiens
aatctgtctcccca

SEQ ID NO: 5115168 - DNA, 11 bp, Homo sapiens
aatctgtctgc

SEQ ID NO: 5115169 - DNA, 22 bp, Homo sapiens
aatctgtctttagaatcgcttt

SEQ ID NO: 5115170 - DNA, 13 bp, Homo sapiens
aatctgtgaactt

SEQ ID NO: 5115171 - DNA, 19 bp, Homo sapiens
aatctgtgaacttgaaatt

SEQ ID NO: 5115172 - DNA, 21 bp, Homo sapiens
aatctgtgaacttgaaatttg

SEQ ID NO: 5115173 - DNA, 22 bp, Homo sapiens
aatctgtgaacttgaaatttga

SEQ ID NO: 5115174 - DNA, 23 bp, Homo sapiens
aatctgtgaagcctttatctatg

SEQ ID NO: 5115175 - DNA, 21 bp, Homo sapiens
aatctgtgacctgtcagaata

SEQ ID NO: 5115176 - DNA, 17 bp, Homo sapiens
aatctgtgagtgaaagt

SEQ ID NO: 5115177 - DNA, 18 bp, Homo sapiens
aatctgtgagtgaaagtt

SEQ ID NO: 5115178 - DNA, 14 bp, Homo sapiens
aatctgtgcaataa

SEQ ID NO: 5115179 - DNA, 12 bp, Homo sapiens
aatctgtgcctg

SEQ ID NO: 5115180 - DNA, 16 bp, Homo sapiens
aatctgtgctctttca

SEQ ID NO: 5115181 - DNA, 12 bp, Homo sapiens
aatctgtgctgg

SEQ ID NO: 5115182 - DNA, 17 bp, Homo sapiens
aatctgtgggtctggga

SEQ ID NO: 5115183 - DNA, 17 bp, Homo sapiens
aatctgtgtacaaagaa

SEQ ID NO: 5115184 - DNA, 20 bp, Homo sapiens
aatctgtgtacaaagaaata

SEQ ID NO: 5115185 - DNA, 17 bp, Homo sapiens
aatctgtgtatattatt

SEQ ID NO: 5115186 - DNA, 20 bp, Homo sapiens
aatctgtgtatattatttgg

SEQ ID NO: 5115187 - DNA, 21 bp, Homo sapiens
aatctgtgtgcatatttgtta

SEQ ID NO: 5115188 - DNA, 15 bp, Homo sapiens
aatctgttagcatta

SEQ ID NO: 5115189 - DNA, 12 bp, Homo sapiens
aatctgttatcc

SEQ ID NO: 5115190 - DNA, 14 bp, Homo sapiens
aatctgttatccca

SEQ ID NO: 5115191 - DNA, 23 bp, Homo sapiens
aatctgttatgtactagtgttct

SEQ ID NO: 5115192 - DNA, 11 bp, Homo sapiens
aatctgttgcc

SEQ ID NO: 5115193 - DNA, 17 bp, Homo sapiens
aatctgttgttccaaat

SEQ ID NO: 5115194 - DNA, 23 bp, Homo sapiens
aatctgtttcaacagatgaccgt

SEQ ID NO: 5115195 - DNA, 19 bp, Homo sapiens
aatctgtttctatgtccaa

SEQ ID NO: 5115196 - DNA, 20 bp, Homo sapiens
aatctgtttctatgtccaaa

SEQ ID NO: 5115197 - DNA, 18 bp, Homo sapiens
aatctgtttctctgctgt

SEQ ID NO: 5115198 - DNA, 23 bp, Homo sapiens
aatctgtttctctgctgtcaact

SEQ ID NO: 5115199 - DNA, 15 bp, Homo sapiens
aatctgtttgtgcaa

SEQ ID NO: 5115200 - DNA, 20 bp, Homo sapiens
aatctgtttgtttggcactg

SEQ ID NO: 5115201 - DNA, 13 bp, Homo sapiens
aatctgttttgta

SEQ ID NO: 5115202 - DNA, 15 bp, Homo sapiens
aatctgtttttctaa

SEQ ID NO: 5115203 - DNA, 15 bp, Homo sapiens
aatcttaaaagtgta

SEQ ID NO: 5115204 - DNA, 20 bp, Homo sapiens
aatcttaaacaatgtataaa

SEQ ID NO: 5115205 - DNA, 23 bp, Homo sapiens
aatcttaaacaatgtataaagat

SEQ ID NO: 5115206 - DNA, 20 bp, Homo sapiens
aatcttaaacataataaatc

SEQ ID NO: 5115207 - DNA, 18 bp, Homo sapiens
aatcttaaatcagaataa

SEQ ID NO: 5115208 - DNA, 20 bp, Homo sapiens
aatcttaaatcagaataaat

SEQ ID NO: 5115209 - DNA, 13 bp, Homo sapiens
aatcttaacattt

SEQ ID NO: 5115210 - DNA, 14 bp, Homo sapiens
aatcttaagaggat

SEQ ID NO: 5115211 - DNA, 21 bp, Homo sapiens
aatcttaatactgttattctt

SEQ ID NO: 5115212 - DNA, 14 bp, Homo sapiens
aatcttaatgttcc

SEQ ID NO: 5115213 - DNA, 14 bp, Homo sapiens
aatcttacagctgg

SEQ ID NO: 5115214 - DNA, 23 bp, Homo sapiens
aatcttaccaggttcacttaaaa

SEQ ID NO: 5115215 - DNA, 15 bp, Homo sapiens
aatcttactttgtaa

SEQ ID NO: 5115216 - DNA, 16 bp, Homo sapiens
aatcttactttgtaaa

SEQ ID NO: 5115217 - DNA, 13 bp, Homo sapiens
aatcttagcatgc

SEQ ID NO: 5115218 - DNA, 15 bp, Homo sapiens
aatcttagcttttaa

SEQ ID NO: 5115219 - DNA, 18 bp, Homo sapiens
aatcttagtatagtagaa

SEQ ID NO: 5115220 - DNA, 23 bp, Homo sapiens
aatcttagtatagtagaaagaca

SEQ ID NO: 5115221 - DNA, 14 bp, Homo sapiens
aatcttataaaaag

SEQ ID NO: 5115222 - DNA, 17 bp, Homo sapiens
aatcttataattgttct

SEQ ID NO: 5115223 - DNA, 16 bp, Homo sapiens
aatcttataatttaaa

SEQ ID NO: 5115224 - DNA, 19 bp, Homo sapiens
aatcttataatttaaaata

SEQ ID NO: 5115225 - DNA, 19 bp, Homo sapiens
aatcttatagttctaggca

SEQ ID NO: 5115226 - DNA, 15 bp, Homo sapiens
aatcttatattccat

SEQ ID NO: 5115227 - DNA, 20 bp, Homo sapiens
aatcttatcttttggcttct

SEQ ID NO: 5115228 - DNA, 17 bp, Homo sapiens
aatcttatgtttccaag

SEQ ID NO: 5115229 - DNA, 13 bp, Homo sapiens
aatcttattaaag

SEQ ID NO: 5115230 - DNA, 20 bp, Homo sapiens
aatcttattaaagtttcaaa

SEQ ID NO: 5115231 - DNA, 20 bp, Homo sapiens
aatcttattccgagcattcc

SEQ ID NO: 5115232 - DNA, 21 bp, Homo sapiens
aatcttattccgagcattcca

SEQ ID NO: 5115233 - DNA, 13 bp, Homo sapiens
aatcttatttttc

SEQ ID NO: 5115234 - DNA, 15 bp, Homo sapiens
aatcttatttttcct

SEQ ID NO: 5115235 - DNA, 17 bp, Homo sapiens
aatcttatttttcctgt

SEQ ID NO: 5115236 - DNA, 21 bp, Homo sapiens
aatcttatttttcctgtcctg

SEQ ID NO: 5115237 - DNA, 21 bp, Homo sapiens
aatcttcacaatatccaatga

SEQ ID NO: 5115238 - DNA, 20 bp, Homo sapiens
aatcttcaccatctttctga

SEQ ID NO: 5115239 - DNA, 14 bp, Homo sapiens
aatcttcacctcag

SEQ ID NO: 5115240 - DNA, 21 bp, Homo sapiens
aatcttcacgacaatgttgag

SEQ ID NO: 5115241 - DNA, 19 bp, Homo sapiens
aatcttcactgaatatcat

SEQ ID NO: 5115242 - DNA, 14 bp, Homo sapiens
aatcttcactttct

SEQ ID NO: 5115243 - DNA, 21 bp, Homo sapiens
aatcttcactttcttaagcaa

SEQ ID NO: 5115244 - DNA, 15 bp, Homo sapiens
aatcttcagctggtg

SEQ ID NO: 5115245 - DNA, 20 bp, Homo sapiens
aatcttcagctggtggatgg

SEQ ID NO: 5115246 - DNA, 14 bp, Homo sapiens
aatcttcaggtgaa

SEQ ID NO: 5115247 - DNA, 19 bp, Homo sapiens
aatcttcagtattttctcc

SEQ ID NO: 5115248 - DNA, 23 bp, Homo sapiens
aatcttcatggaattcacaaagt

SEQ ID NO: 5115249 - DNA, 10 bp, Homo sapiens
aatcttcctc

SEQ ID NO: 5115250 - DNA, 14 bp, Homo sapiens
aatcttccttttat

SEQ ID NO: 5115251 - DNA, 17 bp, Homo sapiens
aatcttctcatctttta

SEQ ID NO: 5115252 - DNA, 21 bp, Homo sapiens
aatcttctcatcttttatcta

SEQ ID NO: 5115253 - DNA, 15 bp, Homo sapiens
aatcttctctcttga

SEQ ID NO: 5115254 - DNA, 17 bp, Homo sapiens
aatcttctctcttgatt

SEQ ID NO: 5115255 - DNA, 22 bp, Homo sapiens
aatcttctctcttgattgattt

SEQ ID NO: 5115256 - DNA, 13 bp, Homo sapiens
aatcttctttttc

SEQ ID NO: 5115257 - DNA, 19 bp, Homo sapiens
aatcttctttttcaggctc

SEQ ID NO: 5115258 - DNA, 17 bp, Homo sapiens
aatcttgaaattaagaa

SEQ ID NO: 5115259 - DNA, 17 bp, Homo sapiens
aatcttgaatgtttgtg

SEQ ID NO: 5115260 - DNA, 15 bp, Homo sapiens
aatcttgaatttctg

SEQ ID NO: 5115261 - DNA, 16 bp, Homo sapiens
aatcttgaatttctgc

SEQ ID NO: 5115262 - DNA, 22 bp, Homo sapiens
aatcttgacacggtgaaatcca

SEQ ID NO: 5115263 - DNA, 18 bp, Homo sapiens
aatcttgactttctgatt

SEQ ID NO: 5115264 - DNA, 21 bp, Homo sapiens
aatcttgaggaataaatgcct

SEQ ID NO: 5115265 - DNA, 23 bp, Homo sapiens
aatcttgaggaataaatgccttt

SEQ ID NO: 5115266 - DNA, 21 bp, Homo sapiens
aatcttgcagttttgtaagcc

SEQ ID NO: 5115267 - DNA, 14 bp, Homo sapiens
aatcttgctccaat

SEQ ID NO: 5115268 - DNA, 18 bp, Homo sapiens
aatcttgctccaataaag

SEQ ID NO: 5115269 - DNA, 13 bp, Homo sapiens
aatcttgctctgc

SEQ ID NO: 5115270 - DNA, 14 bp, Homo sapiens
aatcttgctgctta

SEQ ID NO: 5115271 - DNA, 12 bp, Homo sapiens
aatcttgctgtt

SEQ ID NO: 5115272 - DNA, 15 bp, Homo sapiens
aatcttgctttcttt

SEQ ID NO: 5115273 - DNA, 19 bp, Homo sapiens
aatattggtaattaaaaga

SEQ ID NO: 5115274 - DNA, 20 bp, Homo sapiens
aatattggtaattaaaagac

SEQ ID NO: 5115275 - DNA, 19 bp, Homo sapiens
aatattggtattaaagaat

SEQ ID NO: 5115276 - DNA, 17 bp, Homo sapiens
aatattggttagtattt

SEQ ID NO: 5115277 - DNA, 21 bp, Homo sapiens
aatattggttgggatgacttg

SEQ ID NO: 5115278 - DNA, 13 bp, Homo sapiens
aatattggtttgt

SEQ ID NO: 5115279 - DNA, 17 bp, Homo sapiens
aatattgtaaatactgg

SEQ ID NO: 5115280 - DNA, 21 bp, Homo sapiens
aatattgtaaatactggactc

SEQ ID NO: 5115281 - DNA, 19 bp, Homo sapiens
aatattgtaaatgctatta

SEQ ID NO: 5115282 - DNA, 17 bp, Homo sapiens
aatattgtaatatgaca

SEQ ID NO: 5115283 - DNA, 13 bp, Homo sapiens
aatattgtacagt

SEQ ID NO: 5115284 - DNA, 15 bp, Homo sapiens
aatattgtacagttt

SEQ ID NO: 5115285 - DNA, 15 bp, Homo sapiens
aatattgtattgtta

SEQ ID NO: 5115286 - DNA, 22 bp, Homo sapiens
aatattgtattgttagatgttt

SEQ ID NO: 5115287 - DNA, 22 bp, Homo sapiens
aatattgtatttgagaaaataa

SEQ ID NO: 5115288 - DNA, 16 bp, Homo sapiens
aatattgtattttaga

SEQ ID NO: 5115289 - DNA, 21 bp, Homo sapiens
aatattgtcatgtttattcta

SEQ ID NO: 5115290 - DNA, 16 bp, Homo sapiens
aatattgtcattcctg

SEQ ID NO: 5115291 - DNA, 9 bp, Homo sapiens
aatattgtg

SEQ ID NO: 5115292 - DNA, 12 bp, Homo sapiens
aatattgtgctt

SEQ ID NO: 5115293 - DNA, 16 bp, Homo sapiens
aatattgtgttccttt

SEQ ID NO: 5115294 - DNA, 15 bp, Homo sapiens
aatattgttcctaag

SEQ ID NO: 5115295 - DNA, 18 bp, Homo sapiens
aatattgttcctaagttc

SEQ ID NO: 5115296 - DNA, 24 bp, Homo sapiens
aatattgttcctaagttcttagat

SEQ ID NO: 5115297 - DNA, 13 bp, Homo sapiens
aatattgttctct

SEQ ID NO: 5115298 - DNA, 14 bp, Homo sapiens
aatattgtttctgc

SEQ ID NO: 5115299 - DNA, 22 bp, Homo sapiens
aatattgtttggtaaatgtttc

SEQ ID NO: 5115300 - DNA, 23 bp, Homo sapiens
aatattgtttggtaaatgtttct

SEQ ID NO: 5115301 - DNA, 18 bp, Homo sapiens
aatattgttttacaatag

SEQ ID NO: 5115302 - DNA, 18 bp, Homo sapiens
aatattgtttttctttct

SEQ ID NO: 5115303 - DNA, 17 bp, Homo sapiens
aatatttaaaaatgtct

SEQ ID NO: 5115304 - DNA, 14 bp, Homo sapiens
aatatttaaacagc

SEQ ID NO: 5115305 - DNA, 19 bp, Homo sapiens
aatatttaaacagcagtgt

SEQ ID NO: 5115306 - DNA, 15 bp, Homo sapiens
aatatttaaagatta

SEQ ID NO: 5115307 - DNA, 19 bp, Homo sapiens
aatatttaacctcttttta

SEQ ID NO: 5115308 - DNA, 19 bp, Homo sapiens
aatatttaagaaaagcact

SEQ ID NO: 5115309 - DNA, 20 bp, Homo sapiens
aatatttaagaaaagcactt

SEQ ID NO: 5115310 - DNA, 17 bp, Homo sapiens
aatatttaagtatatag

SEQ ID NO: 5115311 - DNA, 18 bp, Homo sapiens
aatatttaagtatatagt

SEQ ID NO: 5115312 - DNA, 20 bp, Homo sapiens
aatatttaagtgaaggagaa

SEQ ID NO: 5115313 - DNA, 23 bp, Homo sapiens
aatatttaagtttgttgctgtca

SEQ ID NO: 5115314 - DNA, 19 bp, Homo sapiens
aatatttacaatgtattaa

SEQ ID NO: 5115315 - DNA, 18 bp, Homo sapiens
aatatttacataaagact

SEQ ID NO: 5115316 - DNA, 16 bp, Homo sapiens
aatatttacattttgc

SEQ ID NO: 5115317 - DNA, 19 bp, Homo sapiens
aatatttactaactaaata

SEQ ID NO: 5115318 - DNA, 20 bp, Homo sapiens
aatatttactaactaaatac

SEQ ID NO: 5115319 - DNA, 15 bp, Homo sapiens
aatatttactcatca

SEQ ID NO: 5115320 - DNA, 17 bp, Homo sapiens
aatatttactctttgca

SEQ ID NO: 5115321 - DNA, 21 bp, Homo sapiens
aatatttactgttagaattct

SEQ ID NO: 5115322 - DNA, 22 bp, Homo sapiens
aatatttactgttagaattctt

SEQ ID NO: 5115323 - DNA, 14 bp, Homo sapiens
aatatttagcaaat

SEQ ID NO: 5115324 - DNA, 20 bp, Homo sapiens
aatatttagcaaataatttc

SEQ ID NO: 5115325 - DNA, 20 bp, Homo sapiens
aatatttagcataaatttaa

SEQ ID NO: 5115326 - DNA, 22 bp, Homo sapiens
aatatttaggagtctattttgt

SEQ ID NO: 5115327 - DNA, 18 bp, Homo sapiens
aatatttaggcaagagaa

SEQ ID NO: 5115328 - DNA, 20 bp, Homo sapiens
aatatttataattaaagaaa

SEQ ID NO: 5115329 - DNA, 15 bp, Homo sapiens
aatatttatactata

SEQ ID NO: 5115330 - DNA, 13 bp, Homo sapiens
aatatttatgaag

SEQ ID NO: 5115331 - DNA, 23 bp, Homo sapiens
aatatttatgacctcaacaaaga

SEQ ID NO: 5115332 - DNA, 15 bp, Homo sapiens
aatatttatgcagaa

SEQ ID NO: 5115333 - DNA, 20 bp, Homo sapiens
aatatttatgcagaaggtat

SEQ ID NO: 5115334 - DNA, 19 bp, Homo sapiens
aatatttatgtctatttaa

SEQ ID NO: 5115335 - DNA, 13 bp, Homo sapiens
aatatttatgtgt

SEQ ID NO: 5115336 - DNA, 14 bp, Homo sapiens
aatatttatgttta

SEQ ID NO: 5115337 - DNA, 12 bp, Homo sapiens
aatatttattac

SEQ ID NO: 5115338 - DNA, 13 bp, Homo sapiens
aatatttattacc

SEQ ID NO: 5115339 - DNA, 16 bp, Homo sapiens
aatatttattacctct

SEQ ID NO: 5115340 - DNA, 12 bp, Homo sapiens
aatatttattat

SEQ ID NO: 5115341 - DNA, 15 bp, Homo sapiens
aatatttattatgag

SEQ ID NO: 5115342 - DNA, 14 bp, Homo sapiens
aatatttattcatt

SEQ ID NO: 5115343 - DNA, 12 bp, Homo sapiens
aatatttattgc

SEQ ID NO: 5115344 - DNA, 21 bp, Homo sapiens
aatatttattgctttataaat

SEQ ID NO: 5115345 - DNA, 14 bp, Homo sapiens
aatatttattgtat

SEQ ID NO: 5115346 - DNA, 18 bp, Homo sapiens
aatatttattttaataat

SEQ ID NO: 5115347 - DNA, 19 bp, Homo sapiens
aatatttattttcttcccc

SEQ ID NO: 5115348 - DNA, 18 bp, Homo sapiens
aatatttcaagtgcctag

SEQ ID NO: 5115349 - DNA, 20 bp, Homo sapiens
aatatttcataaattaacaa

SEQ ID NO: 5115350 - DNA, 23 bp, Homo sapiens
aatatttccatatggattttcta

SEQ ID NO: 5115351 - DNA, 12 bp, Homo sapiens
aatatttcctga

SEQ ID NO: 5115352 - DNA, 13 bp, Homo sapiens
aatatttcctttt

SEQ ID NO: 5115353 - DNA, 18 bp, Homo sapiens
aatatttctattgaattc

SEQ ID NO: 5115354 - DNA, 11 bp, Homo sapiens
aatatttctga

SEQ ID NO: 5115355 - DNA, 19 bp, Homo sapiens
aatatttcttaagtataaa

SEQ ID NO: 5115356 - DNA, 14 bp, Homo sapiens
aatatttcttcaaa

SEQ ID NO: 5115357 - DNA, 15 bp, Homo sapiens
aatatttcttcaaat

SEQ ID NO: 5115358 - DNA, 16 bp, Homo sapiens
aatatttcttcaagtg

SEQ ID NO: 5115359 - DNA, 22 bp, Homo sapiens
aatatttcttcacaaaggaact

SEQ ID NO: 5115360 - DNA, 11 bp, Homo sapiens
aatatttgaat

SEQ ID NO: 5115361 - DNA, 12 bp, Homo sapiens
aatatttgaatc

SEQ ID NO: 5115362 - DNA, 23 bp, Homo sapiens
aatatttgaatgtatgcttcata

SEQ ID NO: 5115363 - DNA, 14 bp, Homo sapiens
aatatttgaattgc

SEQ ID NO: 5115364 - DNA, 22 bp, Homo sapiens
aatatttgacttgcatgaagag

SEQ ID NO: 5115365 - DNA, 20 bp, Homo sapiens
aatatttgagaataagttca

SEQ ID NO: 5115366 - DNA, 14 bp, Homo sapiens
aatatttgcacatg

SEQ ID NO: 5115367 - DNA, 23 bp, Homo sapiens
aatatttgcacatgggattgcta

SEQ ID NO: 5115368 - DNA, 22 bp, Homo sapiens
aatatttgctcaatatgatctt

SEQ ID NO: 5115369 - DNA, 13 bp, Homo sapiens
aatatttggaatt

SEQ ID NO: 5115370 - DNA, 21 bp, Homo sapiens
aatatttggtctctatttcat

SEQ ID NO: 5115371 - DNA, 14 bp, Homo sapiens
aatatttgtacata

SEQ ID NO: 5115372 - DNA, 17 bp, Homo sapiens
aatatttgtctgtgtgc

SEQ ID NO: 5115373 - DNA, 17 bp, Homo sapiens
aatatttgtgacaaaaa

SEQ ID NO: 5115374 - DNA, 17 bp, Homo sapiens
aatatttgtgctttgaa

SEQ ID NO: 5115375 - DNA, 14 bp, Homo sapiens
aatatttgttttaa

SEQ ID NO: 5115376 - DNA, 16 bp, Homo sapiens
aatattttaaaatcag

SEQ ID NO: 5115377 - DNA, 13 bp, Homo sapiens
aatattttaaaga

SEQ ID NO: 5115378 - DNA, 14 bp, Homo sapiens
aatattttaacttt

SEQ ID NO: 5115379 - DNA, 15 bp, Homo sapiens
aatattttaagaaag

SEQ ID NO: 5115380 - DNA, 16 bp, Homo sapiens
aatattttaagaaaga

SEQ ID NO: 5115381 - DNA, 18 bp, Homo sapiens
aatattttaagaaagaga

SEQ ID NO: 5115382 - DNA, 11 bp, Homo sapiens
aatattttaat

SEQ ID NO: 5115383 - DNA, 16 bp, Homo sapiens
aatattttaattaaaa

SEQ ID NO: 5115384 - DNA, 20 bp, Homo sapiens
aatattttaatttttaaatg

SEQ ID NO: 5115385 - DNA, 15 bp, Homo sapiens
aatattttacataca

SEQ ID NO: 5115386 - DNA, 14 bp, Homo sapiens
aatattttacccaa

SEQ ID NO: 5115387 - DNA, 19 bp, Homo sapiens
aatattttagaaaatgttt

SEQ ID NO: 5115388 - DNA, 22 bp, Homo sapiens
aatattttagaaaatgtttgga

SEQ ID NO: 5115389 - DNA, 21 bp, Homo sapiens
aatattttaggtgtaaaataa

SEQ ID NO: 5115390 - DNA, 18 bp, Homo sapiens
aatattttatattaaaat

SEQ ID NO: 5115391 - DNA, 22 bp, Homo sapiens
aatattttatcctgtattcttg

SEQ ID NO: 5115392 - DNA, 23 bp, Homo sapiens
aatattttatcttttagctagaa

SEQ ID NO: 5115393 - DNA, 12 bp, Homo sapiens
aatattttatgg

SEQ ID NO: 5115394 - DNA, 14 bp, Homo sapiens
aatattttattcaa

SEQ ID NO: 5115395 - DNA, 14 bp, Homo sapiens
aatattttattcta

SEQ ID NO: 5115396 - DNA, 23 bp, Homo sapiens
aatattttatttgaaaaaagtta

SEQ ID NO: 5115397 - DNA, 16 bp, Homo sapiens
aatattttcagcctac

SEQ ID NO: 5115398 - DNA, 17 bp, Homo sapiens
aatattttcattataca

SEQ ID NO: 5115399 - DNA, 13 bp, Homo sapiens
aatattttccaaa

SEQ ID NO: 5115400 - DNA, 14 bp, Homo sapiens
aatattttcctgcc

SEQ ID NO: 5115401 - DNA, 13 bp, Homo sapiens
aatattttctatt

SEQ ID NO: 5115402 - DNA, 16 bp, Homo sapiens
aatattttctatttta

SEQ ID NO: 5115403 - DNA, 19 bp, Homo sapiens
aatattttctctgtacttt

SEQ ID NO: 5115404 - DNA, 15 bp, Homo sapiens
aatattttctgggtt

SEQ ID NO: 5115405 - DNA, 14 bp, Homo sapiens
aatattttctgtgt

SEQ ID NO: 5115406 - DNA, 15 bp, Homo sapiens
aatattttctgtgta

SEQ ID NO: 5115407 - DNA, 19 bp, Homo sapiens
aatattttctgtgtgttcc

SEQ ID NO: 5115408 - DNA, 20 bp, Homo sapiens
aatattttctgtgtgttcct

SEQ ID NO: 5115409 - DNA, 16 bp, Homo sapiens
aatattttcttaatta

SEQ ID NO: 5115410 - DNA, 16 bp, Homo sapiens
aatattttgaatcaat

SEQ ID NO: 5115411 - DNA, 20 bp, Homo sapiens
aatattttgaatcaataata

SEQ ID NO: 5115412 - DNA, 23 bp, Homo sapiens
aatattttgacttgttgagggta

SEQ ID NO: 5115413 - DNA, 11 bp, Homo sapiens
aatattttgat

SEQ ID NO: 5115414 - DNA, 14 bp, Homo sapiens
aatattttgataat

SEQ ID NO: 5115415 - DNA, 16 bp, Homo sapiens
aatattttgataataa

SEQ ID NO: 5115416 - DNA, 22 bp, Homo sapiens
aatattttgataataatattgt

SEQ ID NO: 5115417 - DNA, 18 bp, Homo sapiens
aatattttgcaagctctg

SEQ ID NO: 5115418 - DNA, 14 bp, Homo sapiens
aatattttgccttt

SEQ ID NO: 5115419 - DNA, 21 bp, Homo sapiens
aatattttgctaaaaaagcat

SEQ ID NO: 5115420 - DNA, 20 bp, Homo sapiens
aatattttgctgctgaattt

SEQ ID NO: 5115421 - DNA, 15 bp, Homo sapiens
aatattttggaaact

SEQ ID NO: 5115422 - DNA, 21 bp, Homo sapiens
aatattttggaaactgctaaa

SEQ ID NO: 5115423 - DNA, 20 bp, Homo sapiens
aatattttgtaatattctgt

SEQ ID NO: 5115424 - DNA, 21 bp, Homo sapiens
aatattttgtatattatgttt

SEQ ID NO: 5115425 - DNA, 16 bp, Homo sapiens
aatattttgtattatt

SEQ ID NO: 5115426 - DNA, 11 bp, Homo sapiens
aatattttgtc

SEQ ID NO: 5115427 - DNA, 15 bp, Homo sapiens
aatattttgtcactg

SEQ ID NO: 5115428 - DNA, 17 bp, Homo sapiens
aatattttgtcactgct

SEQ ID NO: 5115429 - DNA, 13 bp, Homo sapiens
aatattttgtcta

SEQ ID NO: 5115430 - DNA, 16 bp, Homo sapiens
aatattttgtctaaaa

SEQ ID NO: 5115431 - DNA, 14 bp, Homo sapiens
aatattttgttctt

SEQ ID NO: 5115432 - DNA, 14 bp, Homo sapiens
aatatttttaaaag

SEQ ID NO: 5115433 - DNA, 15 bp, Homo sapiens
aatatttttaaaaga

SEQ ID NO: 5115434 - DNA, 20 bp, Homo sapiens
aatatttttagactatttct

SEQ ID NO: 5115435 - DNA, 20 bp, Homo sapiens
aatatttttatatttccttt

SEQ ID NO: 5115436 - DNA, 11 bp, Homo sapiens
aatatttttca

SEQ ID NO: 5115437 - DNA, 12 bp, Homo sapiens
aatatttttcaa

SEQ ID NO: 5115438 - DNA, 13 bp, Homo sapiens
aatatttttcaaa

SEQ ID NO: 5115439 - DNA, 14 bp, Homo sapiens
aatatttttcaaaa

SEQ ID NO: 5115440 - DNA, 19 bp, Homo sapiens
aatatttttcaaaatcaaa

SEQ ID NO: 5115441 - DNA, 22 bp, Homo sapiens
aatatttttcaaaatcaaagtt

SEQ ID NO: 5115442 - DNA, 23 bp, Homo sapiens
aatatttttgaaaggcatgttcc

SEQ ID NO: 5115443 - DNA, 23 bp, Homo sapiens
aatatttttggcattcctctaat

SEQ ID NO: 5115444 - DNA, 16 bp, Homo sapiens
aatatttttggggcat

SEQ ID NO: 5115445 - DNA, 23 bp, Homo sapiens
aatatttttggggcatcctggat

SEQ ID NO: 5115446 - DNA, 20 bp, Homo sapiens
aatatttttgtatttctcta

SEQ ID NO: 5115447 - DNA, 13 bp, Homo sapiens
aatatttttgtca

SEQ ID NO: 5115448 - DNA, 19 bp, Homo sapiens
aatattttttatatataca

SEQ ID NO: 5115449 - DNA, 21 bp, Homo sapiens
aatattttttatttctaagta

SEQ ID NO: 5115450 - DNA, 18 bp, Homo sapiens
aatattttttcttttcta

SEQ ID NO: 5115451 - DNA, 13 bp, Homo sapiens
aatattttttgag

SEQ ID NO: 5115452 - DNA, 16 bp, Homo sapiens
aatattttttgcaagt

SEQ ID NO: 5115453 - DNA, 20 bp, Homo sapiens
aatcttggccctattcatta

SEQ ID NO: 5115454 - DNA, 16 bp, Homo sapiens
aatcttggcttcttaa

SEQ ID NO: 5115455 - DNA, 14 bp, Homo sapiens
aatcttgggtgggt

SEQ ID NO: 5115456 - DNA, 16 bp, Homo sapiens
aatcttggtgtaactt

SEQ ID NO: 5115457 - DNA, 19 bp, Homo sapiens
aatcttggttgatgccaaa

SEQ ID NO: 5115458 - DNA, 20 bp, Homo sapiens
aatcttggtttggtacagtt

SEQ ID NO: 5115459 - DNA, 19 bp, Homo sapiens
aatcttgtaggtcattgca

SEQ ID NO: 5115460 - DNA, 13 bp, Homo sapiens
aatcttgtatttg

SEQ ID NO: 5115461 - DNA, 18 bp, Homo sapiens
aatcttgtccaagttgtt

SEQ ID NO: 5115462 - DNA, 14 bp, Homo sapiens
aatcttgtccacag

SEQ ID NO: 5115463 - DNA, 12 bp, Homo sapiens
aatcttgtctta

SEQ ID NO: 5115464 - DNA, 19 bp, Homo sapiens
aatcttgtgaaaataattg

SEQ ID NO: 5115465 - DNA, 18 bp, Homo sapiens
aatcttgtgctagaatac

SEQ ID NO: 5115466 - DNA, 15 bp, Homo sapiens
aatcttgtgttaact

SEQ ID NO: 5115467 - DNA, 20 bp, Homo sapiens
aatcttgtgttaacttgcct

SEQ ID NO: 5115468 - DNA, 21 bp, Homo sapiens
aatcttgttaaattgcttatt

SEQ ID NO: 5115469 - DNA, 20 bp, Homo sapiens
aatcttgttaatgtcattgc

SEQ ID NO: 5115470 - DNA, 21 bp, Homo sapiens
aatcttgttactgctgattct

SEQ ID NO: 5115471 - DNA, 18 bp, Homo sapiens
aatcttgttggttcacca

SEQ ID NO: 5115472 - DNA, 14 bp, Homo sapiens
aatcttgtttatag

SEQ ID NO: 5115473 - DNA, 20 bp, Homo sapiens
aatcttgtttatagcaaaaa

SEQ ID NO: 5115474 - DNA, 14 bp, Homo sapiens
aatcttgtttccaa

SEQ ID NO: 5115475 - DNA, 16 bp, Homo sapiens
aatcttgtttctgaaa

SEQ ID NO: 5115476 - DNA, 19 bp, Homo sapiens
aatcttgtttctgaaaaga

SEQ ID NO: 5115477 - DNA, 18 bp, Homo sapiens
aatcttgtttgttactgt

SEQ ID NO: 5115478 - DNA, 20 bp, Homo sapiens
aatcttgtttgttactgtca

SEQ ID NO: 5115479 - DNA, 18 bp, Homo sapiens
aatcttgttttaagcaaa

SEQ ID NO: 5115480 - DNA, 22 bp, Homo sapiens
aatcttgttttaagcaaatgca

SEQ ID NO: 5115481 - DNA, 23 bp, Homo sapiens
aatcttgttttgtttgcttccat

SEQ ID NO: 5115482 - DNA, 19 bp, Homo sapiens
aatctttaaaaaaaaaatt

SEQ ID NO: 5115483 - DNA, 15 bp, Homo sapiens
aatctttaaaccaat

SEQ ID NO: 5115484 - DNA, 21 bp, Homo sapiens
aatctttaacaacctctgagc

SEQ ID NO: 5115485 - DNA, 13 bp, Homo sapiens
aatctttaattaa

SEQ ID NO: 5115486 - DNA, 14 bp, Homo sapiens
aatctttatactgg

SEQ ID NO: 5115487 - DNA, 22 bp, Homo sapiens
aatctttattatgcattcttat

SEQ ID NO: 5115488 - DNA, 14 bp, Homo sapiens
aatctttattgaga

SEQ ID NO: 5115489 - DNA, 13 bp, Homo sapiens
aatctttatttta

SEQ ID NO: 5115490 - DNA, 18 bp, Homo sapiens
aatctttcaacttatttc

SEQ ID NO: 5115491 - DNA, 21 bp, Homo sapiens
aatctttcaccaagtaaattt

SEQ ID NO: 5115492 - DNA, 16 bp, Homo sapiens
aatctttcacttgaaa

SEQ ID NO: 5115493 - DNA, 19 bp, Homo sapiens
aatctttcagcctgcttct

SEQ ID NO: 5115494 - DNA, 17 bp, Homo sapiens
aatctttcatacatata

SEQ ID NO: 5115495 - DNA, 19 bp, Homo sapiens
aatctttcatacatatata

SEQ ID NO: 5115496 - DNA, 15 bp, Homo sapiens
aatctttcatgtctt

SEQ ID NO: 5115497 - DNA, 16 bp, Homo sapiens
aatctttcatgtcttg

SEQ ID NO: 5115498 - DNA, 11 bp, Homo sapiens
aatctttccag

SEQ ID NO: 5115499 - DNA, 20 bp, Homo sapiens
aatctttccttgtctctcat

SEQ ID NO: 5115500 - DNA, 17 bp, Homo sapiens
aatctttcggtctcctt

SEQ ID NO: 5115501 - DNA, 15 bp, Homo sapiens
aatctttctatataa

SEQ ID NO: 5115502 - DNA, 17 bp, Homo sapiens
aatctttctttacctga

SEQ ID NO: 5115503 - DNA, 14 bp, Homo sapiens
aatctttctttctt

SEQ ID NO: 5115504 - DNA, 16 bp, Homo sapiens
aatctttctttcttag

SEQ ID NO: 5115505 - DNA, 19 bp, Homo sapiens
aatctttctttcttagaaa

SEQ ID NO: 5115506 - DNA, 22 bp, Homo sapiens
aatctttctttcttagaaattt

SEQ ID NO: 5115507 - DNA, 14 bp, Homo sapiens
aatctttgaaagac

SEQ ID NO: 5115508 - DNA, 16 bp, Homo sapiens
aatctttgaaagactt

SEQ ID NO: 5115509 - DNA, 16 bp, Homo sapiens
aatctttgctgaagaa

SEQ ID NO: 5115510 - DNA, 13 bp, Homo sapiens
aatctttgctgta

SEQ ID NO: 5115511 - DNA, 18 bp, Homo sapiens
aatctttgtaccaaaatt

SEQ ID NO: 5115512 - DNA, 20 bp, Homo sapiens
aatctttgtaccaaaatttt

SEQ ID NO: 5115513 - DNA, 15 bp, Homo sapiens
aatctttgtataaat

SEQ ID NO: 5115514 - DNA, 17 bp, Homo sapiens
aatctttgtgaacattc

SEQ ID NO: 5115515 - DNA, 16 bp, Homo sapiens
aatctttgttaaaata

SEQ ID NO: 5115516 - DNA, 13 bp, Homo sapiens
aatcttttaaaaa

SEQ ID NO: 5115517 - DNA, 21 bp, Homo sapiens
aatcttttaaaaattcaaatg

SEQ ID NO: 5115518 - DNA, 16 bp, Homo sapiens
aatcttttaaattgca

SEQ ID NO: 5115519 - DNA, 15 bp, Homo sapiens
aatcttttacatttt

SEQ ID NO: 5115520 - DNA, 14 bp, Homo sapiens
aatcttttactgtg

SEQ ID NO: 5115521 - DNA, 22 bp, Homo sapiens
aatcttttataatgattcataa

SEQ ID NO: 5115522 - DNA, 18 bp, Homo sapiens
aatcttttcacaaataaa

SEQ ID NO: 5115523 - DNA, 14 bp, Homo sapiens
aatcttttctgaat

SEQ ID NO: 5115524 - DNA, 22 bp, Homo sapiens
aatcttttgtagtttgtattaa

SEQ ID NO: 5115525 - DNA, 13 bp, Homo sapiens
aatctttttctcc

SEQ ID NO: 5115526 - DNA, 15 bp, Homo sapiens
aatctttttgcttct

SEQ ID NO: 5115527 - DNA, 20 bp, Homo sapiens
aatctttttgcttctacttt

SEQ ID NO: 5115528 - DNA, 20 bp, Homo sapiens
aatctttttttaataatttc

SEQ ID NO: 5115529 - DNA, 22 bp, Homo sapiens
aatctttttttaataatttcat

SEQ ID NO: 5115530 - DNA, 23 bp, Homo sapiens
aatctttttttaataatttcatc

SEQ ID NO: 5115531 - DNA, 20 bp, Homo sapiens
aatcttttttttatataaat

SEQ ID NO: 5115532 - DNA, 17 bp, Homo sapiens
aatgaaaaaaaaaaaca

SEQ ID NO: 5115533 - DNA, 18 bp, Homo sapiens
aatgaaaaacaaaaagct

SEQ ID NO: 5115534 - DNA, 15 bp, Homo sapiens
aatgaaaaacaacca

SEQ ID NO: 5115535 - DNA, 13 bp, Homo sapiens
aatgaaaaacaca

SEQ ID NO: 5115536 - DNA, 21 bp, Homo sapiens
aatgaaaaatagtgtctttgt

SEQ ID NO: 5115537 - DNA, 23 bp, Homo sapiens
aatgaaaaatctcaattgaaagc

SEQ ID NO: 5115538 - DNA, 19 bp, Homo sapiens
aatgaaaaattccactcaa

SEQ ID NO: 5115539 - DNA, 21 bp, Homo sapiens
aatgaaaaatttaagcattgt

SEQ ID NO: 5115540 - DNA, 20 bp, Homo sapiens
aatgaaaacaaaattccatt

SEQ ID NO: 5115541 - DNA, 13 bp, Homo sapiens
aatgaaaacagtg

SEQ ID NO: 5115542 - DNA, 18 bp, Homo sapiens
aatgaaaacagtgtgtaa

SEQ ID NO: 5115543 - DNA, 12 bp, Homo sapiens
aatgaaaacctt

SEQ ID NO: 5115544 - DNA, 13 bp, Homo sapiens
aatgaaaactttt

SEQ ID NO: 5115545 - DNA, 21 bp, Homo sapiens
aatgaaaagaaaatgtgccat

SEQ ID NO: 5115546 - DNA, 13 bp, Homo sapiens
aatgaaaagagaa

SEQ ID NO: 5115547 - DNA, 14 bp, Homo sapiens
aatgaaaagagaat

SEQ ID NO: 5115548 - DNA, 14 bp, Homo sapiens
aatgaaaagcaata

SEQ ID NO: 5115549 - DNA, 14 bp, Homo sapiens
aatgaaaagtttag

SEQ ID NO: 5115550 - DNA, 14 bp, Homo sapiens
aatgaaaataactg

SEQ ID NO: 5115551 - DNA, 17 bp, Homo sapiens
aatgaaaataactgaac

SEQ ID NO: 5115552 - DNA, 14 bp, Homo sapiens
aatgaaaataagaa

SEQ ID NO: 5115553 - DNA, 14 bp, Homo sapiens
aatgaaaatgaata

SEQ ID NO: 5115554 - DNA, 15 bp, Homo sapiens
aatgaaaatgtaact

SEQ ID NO: 5115555 - DNA, 12 bp, Homo sapiens
aatgaaaatgtc

SEQ ID NO: 5115556 - DNA, 17 bp, Homo sapiens
aatgaaaattgtattat

SEQ ID NO: 5115557 - DNA, 20 bp, Homo sapiens
aatgaaaatttcacttgaaa

SEQ ID NO: 5115558 - DNA, 17 bp, Homo sapiens
aatgaaaattttaagaa

SEQ ID NO: 5115559 - DNA, 23 bp, Homo sapiens
aatgaaacaaagagttcaagaaa

SEQ ID NO: 5115560 - DNA, 13 bp, Homo sapiens
aatgaaacaagca

SEQ ID NO: 5115561 - DNA, 15 bp, Homo sapiens
aatgaaacaagcagg

SEQ ID NO: 5115562 - DNA, 16 bp, Homo sapiens
aatgaaacaccttctc

SEQ ID NO: 5115563 - DNA, 19 bp, Homo sapiens
aatgaaacactcagttgtt

SEQ ID NO: 5115564 - DNA, 14 bp, Homo sapiens
aatgaaacagatga

SEQ ID NO: 5115565 - DNA, 23 bp, Homo sapiens
aatgaaacagggaaaatgaagct

SEQ ID NO: 5115566 - DNA, 17 bp, Homo sapiens
aatgaaacattttgtca

SEQ ID NO: 5115567 - DNA, 17 bp, Homo sapiens
aatgaaaccaaagccag

SEQ ID NO: 5115568 - DNA, 13 bp, Homo sapiens
aatgaaaccacat

SEQ ID NO: 5115569 - DNA, 19 bp, Homo sapiens
aatgaaacccccacacaca

SEQ ID NO: 5115570 - DNA, 15 bp, Homo sapiens
aatgaaaccttcctc

SEQ ID NO: 5115571 - DNA, 23 bp, Homo sapiens
aatgaaaccttcctcttgagggt

SEQ ID NO: 5115572 - DNA, 19 bp, Homo sapiens
aatgaaagaaaattgagtt

SEQ ID NO: 5115573 - DNA, 13 bp, Homo sapiens
aatgaaagaaact

SEQ ID NO: 5115574 - DNA, 15 bp, Homo sapiens
aatgaaagagaaaat

SEQ ID NO: 5115575 - DNA, 13 bp, Homo sapiens
aatgaaagatgat

SEQ ID NO: 5115576 - DNA, 12 bp, Homo sapiens
aatgaaagatta

SEQ ID NO: 5115577 - DNA, 15 bp, Homo sapiens
aatgaaagattaaac

SEQ ID NO: 5115578 - DNA, 15 bp, Homo sapiens
aatgaaagcatgtgg

SEQ ID NO: 5115579 - DNA, 21 bp, Homo sapiens
aatgaaaggagtttaaaaaca

SEQ ID NO: 5115580 - DNA, 23 bp, Homo sapiens
aatgaaaggagtttaaaaacatt

SEQ ID NO: 5115581 - DNA, 13 bp, Homo sapiens
aatgaaagggaaa

SEQ ID NO: 5115582 - DNA, 21 bp, Homo sapiens
aatgaaagggaaagtcagctt

SEQ ID NO: 5115583 - DNA, 17 bp, Homo sapiens
aatgaaaggtactatat

SEQ ID NO: 5115584 - DNA, 17 bp, Homo sapiens
aatgaaagtataactga

SEQ ID NO: 5115585 - DNA, 19 bp, Homo sapiens
aatgaaagtcttgtgacta

SEQ ID NO: 5115586 - DNA, 13 bp, Homo sapiens
aatgaaagtgact

SEQ ID NO: 5115587 - DNA, 15 bp, Homo sapiens
aatgaaagtttgcac

SEQ ID NO: 5115588 - DNA, 11 bp, Homo sapiens
aatgaaataaa

SEQ ID NO: 5115589 - DNA, 21 bp, Homo sapiens
aatgaaataatgtacatctgg

SEQ ID NO: 5115590 - DNA, 17 bp, Homo sapiens
aatgaaataccaactat

SEQ ID NO: 5115591 - DNA, 12 bp, Homo sapiens
aatgaaatactt

SEQ ID NO: 5115592 - DNA, 16 bp, Homo sapiens
aatgaaatacttgaca

SEQ ID NO: 5115593 - DNA, 22 bp, Homo sapiens
aatgaaatacttgacaacattt

SEQ ID NO: 5115594 - DNA, 19 bp, Homo sapiens
aatgaaataggagggaaac

SEQ ID NO: 5115595 - DNA, 22 bp, Homo sapiens
aatgaaatagttattttaatac

SEQ ID NO: 5115596 - DNA, 19 bp, Homo sapiens
aatgaaatataaactgtga

SEQ ID NO: 5115597 - DNA, 21 bp, Homo sapiens
aatgaaatataaactgtgaga

SEQ ID NO: 5115598 - DNA, 13 bp, Homo sapiens
aatgaaatatttg

SEQ ID NO: 5115599 - DNA, 18 bp, Homo sapiens
aatgaaatcaaatgtatg

SEQ ID NO: 5115600 - DNA, 21 bp, Homo sapiens
aatgaaatccgtgaagtcaca

SEQ ID NO: 5115601 - DNA, 15 bp, Homo sapiens
aatgaaatctatttt

SEQ ID NO: 5115602 - DNA, 14 bp, Homo sapiens
aatgaaatgcattt

SEQ ID NO: 5115603 - DNA, 17 bp, Homo sapiens
aatgaaatgccaaagga

SEQ ID NO: 5115604 - DNA, 21 bp, Homo sapiens
aatgaaatgccaaaggaagtt

SEQ ID NO: 5115605 - DNA, 19 bp, Homo sapiens
aatgaaatgctctcctttc

SEQ ID NO: 5115606 - DNA, 14 bp, Homo sapiens
aatgaaatgtatgt

SEQ ID NO: 5115607 - DNA, 15 bp, Homo sapiens
aatgaaatgtatgtg

SEQ ID NO: 5115608 - DNA, 20 bp, Homo sapiens
aatgaaattaaaaataaaat

SEQ ID NO: 5115609 - DNA, 20 bp, Homo sapiens
aatgaaattaacacaaagga

SEQ ID NO: 5115610 - DNA, 22 bp, Homo sapiens
aatgaaattaacacaaaggaag

SEQ ID NO: 5115611 - DNA, 13 bp, Homo sapiens
aatgaaatttaaa

SEQ ID NO: 5115612 - DNA, 17 bp, Homo sapiens
aatgaaatttaattaca

SEQ ID NO: 5115613 - DNA, 18 bp, Homo sapiens
aatgaaatttaattacaa

SEQ ID NO: 5115614 - DNA, 19 bp, Homo sapiens
aatgaaatttgcaaaatca

SEQ ID NO: 5115615 - DNA, 14 bp, Homo sapiens
aatgaaattttacc

SEQ ID NO: 5115616 - DNA, 16 bp, Homo sapiens
aatgaaattttaccaa

SEQ ID NO: 5115617 - DNA, 18 bp, Homo sapiens
aatgaacaaaagattgga

SEQ ID NO: 5115618 - DNA, 14 bp, Homo sapiens
aatgaacaaaatta

SEQ ID NO: 5115619 - DNA, 16 bp, Homo sapiens
aatgaacaaagaccaa

SEQ ID NO: 5115620 - DNA, 14 bp, Homo sapiens
aatgaacaagagaa

SEQ ID NO: 5115621 - DNA, 18 bp, Homo sapiens
aatgaacaagagaagcat

SEQ ID NO: 5115622 - DNA, 22 bp, Homo sapiens
aatgaacaagagaagcattctc

SEQ ID NO: 5115623 - DNA, 14 bp, Homo sapiens
aatgaacacaaatt

SEQ ID NO: 5115624 - DNA, 21 bp, Homo sapiens
aatgaacagaatttatgactc

SEQ ID NO: 5115625 - DNA, 15 bp, Homo sapiens
aatgaacagcagaaa

SEQ ID NO: 5115626 - DNA, 16 bp, Homo sapiens
aatgaacataatgaac

SEQ ID NO: 5115627 - DNA, 21 bp, Homo sapiens
aatgaacatccctttttcaat

SEQ ID NO: 5115628 - DNA, 17 bp, Homo sapiens
aatgaacatctcttgaa

SEQ ID NO: 5115629 - DNA, 14 bp, Homo sapiens
aatgaacattttgt

SEQ ID NO: 5115630 - DNA, 18 bp, Homo sapiens
aatgaaccataaattcaa

SEQ ID NO: 5115631 - DNA, 22 bp, Homo sapiens
aatgaaccatggcacctttgag

SEQ ID NO: 5115632 - DNA, 13 bp, Homo sapiens
aatgaacccaaga

SEQ ID NO: 5115633 - DNA, 13 bp, Homo sapiens
aatattttttgct

SEQ ID NO: 5115634 - DNA, 15 bp, Homo sapiens
aatatttttttcctt

SEQ ID NO: 5115635 - DNA, 17 bp, Homo sapiens
aatattttttttaactg

SEQ ID NO: 5115636 - DNA, 13 bp, Homo sapiens
aatcaaaaaatta

SEQ ID NO: 5115637 - DNA, 14 bp, Homo sapiens
aatcaaaaaattat

SEQ ID NO: 5115638 - DNA, 16 bp, Homo sapiens
aatcaaaaaattatct

SEQ ID NO: 5115639 - DNA, 15 bp, Homo sapiens
aatcaaaaacttttc

SEQ ID NO: 5115640 - DNA, 14 bp, Homo sapiens
aatcaaaaattgaa

SEQ ID NO: 5115641 - DNA, 17 bp, Homo sapiens
aatcaaaaattgaagag

SEQ ID NO: 5115642 - DNA, 14 bp, Homo sapiens
aatcaaaacaagtg

SEQ ID NO: 5115643 - DNA, 20 bp, Homo sapiens
aatcaaaactttcgttgtta

SEQ ID NO: 5115644 - DNA, 19 bp, Homo sapiens
aatcaaaagctgcttgact

SEQ ID NO: 5115645 - DNA, 18 bp, Homo sapiens
aatcaaaagggccaaaga

SEQ ID NO: 5115646 - DNA, 19 bp, Homo sapiens
aatcaaaagggccaaagaa

SEQ ID NO: 5115647 - DNA, 18 bp, Homo sapiens
aatcaaaaggtaatgcac

SEQ ID NO: 5115648 - DNA, 23 bp, Homo sapiens
aatcaaaaggtaatgcacatcct

SEQ ID NO: 5115649 - DNA, 20 bp, Homo sapiens
aatcaaaagtccttagaatg

SEQ ID NO: 5115650 - DNA, 19 bp, Homo sapiens
aatcaaaagtgcctcaaga

SEQ ID NO: 5115651 - DNA, 16 bp, Homo sapiens
aatcaaaataatactt

SEQ ID NO: 5115652 - DNA, 22 bp, Homo sapiens
aatcaaaataatacttcataca

SEQ ID NO: 5115653 - DNA, 21 bp, Homo sapiens
aatcaaacaagtgagtagctc

SEQ ID NO: 5115654 - DNA, 17 bp, Homo sapiens
aatcaaacacaacacaa

SEQ ID NO: 5115655 - DNA, 14 bp, Homo sapiens
aatcaaactttcag

SEQ ID NO: 5115656 - DNA, 15 bp, Homo sapiens
aatcaaactttcagc

SEQ ID NO: 5115657 - DNA, 13 bp, Homo sapiens
aatcaaagaaaac

SEQ ID NO: 5115658 - DNA, 18 bp, Homo sapiens
aatcaaagaattacagta

SEQ ID NO: 5115659 - DNA, 16 bp, Homo sapiens
aatcaaagacatggaa

SEQ ID NO: 5115660 - DNA, 16 bp, Homo sapiens
aatcaaagacatttca

SEQ ID NO: 5115661 - DNA, 13 bp, Homo sapiens
aatcaaagcaagg

SEQ ID NO: 5115662 - DNA, 19 bp, Homo sapiens
aatcaaagcaagggctcca

SEQ ID NO: 5115663 - DNA, 16 bp, Homo sapiens
aatcaaagcaatgcat

SEQ ID NO: 5115664 - DNA, 22 bp, Homo sapiens
aatcaaagcaatgcattttgga

SEQ ID NO: 5115665 - DNA, 22 bp, Homo sapiens
aatcaaagccggcctgagaaac

SEQ ID NO: 5115666 - DNA, 15 bp, Homo sapiens
aatcaaagctacctt

SEQ ID NO: 5115667 - DNA, 18 bp, Homo sapiens
aatcaaagctaccttttt

SEQ ID NO: 5115668 - DNA, 19 bp, Homo sapiens
aatcaaaggggatatatgt

SEQ ID NO: 5115669 - DNA, 23 bp, Homo sapiens
aatcaaagtagaaactactaatt

SEQ ID NO: 5115670 - DNA, 13 bp, Homo sapiens
aatcaaagtgcta

SEQ ID NO: 5115671 - DNA, 17 bp, Homo sapiens
aatcaaagttatggttt

SEQ ID NO: 5115672 - DNA, 22 bp, Homo sapiens
aatcaaataaaaattctagatt

SEQ ID NO: 5115673 - DNA, 14 bp, Homo sapiens
aatcaaataagtat

SEQ ID NO: 5115674 - DNA, 15 bp, Homo sapiens
aatcaaataagtatt

SEQ ID NO: 5115675 - DNA, 16 bp, Homo sapiens
aatcaaataagtattt

SEQ ID NO: 5115676 - DNA, 22 bp, Homo sapiens
aatcaaatatgcaaagcactga

SEQ ID NO: 5115677 - DNA, 18 bp, Homo sapiens
aatcaaatcttacaaaat

SEQ ID NO: 5115678 - DNA, 23 bp, Homo sapiens
aatcaaatgaatgattaaattat

SEQ ID NO: 5115679 - DNA, 23 bp, Homo sapiens
aatcaaatgattcatttttctgt

SEQ ID NO: 5115680 - DNA, 15 bp, Homo sapiens
aatcaaatgatttca

SEQ ID NO: 5115681 - DNA, 17 bp, Homo sapiens
aatcaaatgatttcata

SEQ ID NO: 5115682 - DNA, 20 bp, Homo sapiens
aatcaaatgtggctgtatcc

SEQ ID NO: 5115683 - DNA, 16 bp, Homo sapiens
aatcaacactaccagc

SEQ ID NO: 5115684 - DNA, 14 bp, Homo sapiens
aatcaacagaagca

SEQ ID NO: 5115685 - DNA, 17 bp, Homo sapiens
aatcaacagaagtatca

SEQ ID NO: 5115686 - DNA, 17 bp, Homo sapiens
aatcaacagatgatagt

SEQ ID NO: 5115687 - DNA, 18 bp, Homo sapiens
aatcaacagcatgtctac

SEQ ID NO: 5115688 - DNA, 15 bp, Homo sapiens
aatcaacagggcagc

SEQ ID NO: 5115689 - DNA, 12 bp, Homo sapiens
aatcaaccaaag

SEQ ID NO: 5115690 - DNA, 20 bp, Homo sapiens
aatcaaccctctcctgtctg

SEQ ID NO: 5115691 - DNA, 21 bp, Homo sapiens
aatcaaccctgcaatcacttt

SEQ ID NO: 5115692 - DNA, 14 bp, Homo sapiens
aatcaacctgcact

SEQ ID NO: 5115693 - DNA, 22 bp, Homo sapiens
aatcaactaggtatttaagact

SEQ ID NO: 5115694 - DNA, 15 bp, Homo sapiens
aatcaactcatcatt

SEQ ID NO: 5115695 - DNA, 17 bp, Homo sapiens
aatcaactgaaagtgtt

SEQ ID NO: 5115696 - DNA, 21 bp, Homo sapiens
aatcaacttgcttatcaactt

SEQ ID NO: 5115697 - DNA, 18 bp, Homo sapiens
aatcaacttgtcacaaag

SEQ ID NO: 5115698 - DNA, 16 bp, Homo sapiens
aatcaacttgtgtact

SEQ ID NO: 5115699 - DNA, 10 bp, Homo sapiens
aatcaacttt

SEQ ID NO: 5115700 - DNA, 15 bp, Homo sapiens
aatcaactttactgt

SEQ ID NO: 5115701 - DNA, 16 bp, Homo sapiens
aatcaactttactgta

SEQ ID NO: 5115702 - DNA, 18 bp, Homo sapiens
aatcaactttccttaaaa

SEQ ID NO: 5115703 - DNA, 15 bp, Homo sapiens
aatcaacttttctga

SEQ ID NO: 5115704 - DNA, 18 bp, Homo sapiens
aatcaactttttattgcc

SEQ ID NO: 5115705 - DNA, 14 bp, Homo sapiens
aatcaagaaacaaa

SEQ ID NO: 5115706 - DNA, 13 bp, Homo sapiens
aatcaagaatcat

SEQ ID NO: 5115707 - DNA, 12 bp, Homo sapiens
aatcaagacact

SEQ ID NO: 5115708 - DNA, 19 bp, Homo sapiens
aatcaagaccaaagagcct

SEQ ID NO: 5115709 - DNA, 15 bp, Homo sapiens
aatcaagagaaactt

SEQ ID NO: 5115710 - DNA, 19 bp, Homo sapiens
aatcaagagccttaaaaca

SEQ ID NO: 5115711 - DNA, 22 bp, Homo sapiens
aatcaagagccttaaaacatca

SEQ ID NO: 5115712 - DNA, 13 bp, Homo sapiens
aatcaagagctgc

SEQ ID NO: 5115713 - DNA, 16 bp, Homo sapiens
aatcaagagtctctcc

SEQ ID NO: 5115714 - DNA, 23 bp, Homo sapiens
aatcaagagtctctccagcctca

SEQ ID NO: 5115715 - DNA, 11 bp, Homo sapiens
aatcaagataa

SEQ ID NO: 5115716 - DNA, 12 bp, Homo sapiens
aatcaagataaa

SEQ ID NO: 5115717 - DNA, 17 bp, Homo sapiens
aatcaagcaaaatttct

SEQ ID NO: 5115718 - DNA, 19 bp, Homo sapiens
aatcaagcaaaatttctgt

SEQ ID NO: 5115719 - DNA, 20 bp, Homo sapiens
aatcaagcaaaatttctgta

SEQ ID NO: 5115720 - DNA, 20 bp, Homo sapiens
aatcaagcctttatggctgc

SEQ ID NO: 5115721 - DNA, 12 bp, Homo sapiens
aatcaaggaaag

SEQ ID NO: 5115722 - DNA, 23 bp, Homo sapiens
aatcaaggaaaggctcatttaaa

SEQ ID NO: 5115723 - DNA, 15 bp, Homo sapiens
aatcaaggaatcctg

SEQ ID NO: 5115724 - DNA, 18 bp, Homo sapiens
aatcaaggagtcttctaa

SEQ ID NO: 5115725 - DNA, 23 bp, Homo sapiens
aatcaagggcaaaaagtctacat

SEQ ID NO: 5115726 - DNA, 15 bp, Homo sapiens
aatcaagtaatgaat

SEQ ID NO: 5115727 - DNA, 22 bp, Homo sapiens
aatcaagtacctatattgattt

SEQ ID NO: 5115728 - DNA, 23 bp, Homo sapiens
aatcaagtacctatattgattta

SEQ ID NO: 5115729 - DNA, 15 bp, Homo sapiens
aatcaagtattttgt

SEQ ID NO: 5115730 - DNA, 14 bp, Homo sapiens
aatcaagtgcacct

SEQ ID NO: 5115731 - DNA, 23 bp, Homo sapiens
aatcaagttggcttctaatcaaa

SEQ ID NO: 5115732 - DNA, 23 bp, Homo sapiens
aatcaagttttaagtgaaagtga

SEQ ID NO: 5115733 - DNA, 18 bp, Homo sapiens
aatcaataaaaaacaaat

SEQ ID NO: 5115734 - DNA, 20 bp, Homo sapiens
aatcaataaaaaacaaatat

SEQ ID NO: 5115735 - DNA, 13 bp, Homo sapiens
aatcaataaacga

SEQ ID NO: 5115736 - DNA, 17 bp, Homo sapiens
aatcaataacagccgct

SEQ ID NO: 5115737 - DNA, 23 bp, Homo sapiens
aatcaataacagccgctccagag

SEQ ID NO: 5115738 - DNA, 12 bp, Homo sapiens
aatcaataatat

SEQ ID NO: 5115739 - DNA, 20 bp, Homo sapiens
aatcaatacactagttgttt

SEQ ID NO: 5115740 - DNA, 17 bp, Homo sapiens
aatcaatatcccaacat

SEQ ID NO: 5115741 - DNA, 22 bp, Homo sapiens
aatcaatatcccaacattctgc

SEQ ID NO: 5115742 - DNA, 12 bp, Homo sapiens
aatcaatcaatg

SEQ ID NO: 5115743 - DNA, 14 bp, Homo sapiens
aatcaatcaatggt

SEQ ID NO: 5115744 - DNA, 22 bp, Homo sapiens
aatcaatccagcggttctcaaa

SEQ ID NO: 5115745 - DNA, 20 bp, Homo sapiens
aatcaatctatcaattacag

SEQ ID NO: 5115746 - DNA, 22 bp, Homo sapiens
aatcaatgaatattgaagtttc

SEQ ID NO: 5115747 - DNA, 22 bp, Homo sapiens
aatcaatgcaagagtgattgca

SEQ ID NO: 5115748 - DNA, 17 bp, Homo sapiens
aatcaatggtgcaaaaa

SEQ ID NO: 5115749 - DNA, 17 bp, Homo sapiens
aatcaatgtcacttaaa

SEQ ID NO: 5115750 - DNA, 13 bp, Homo sapiens
aatcaatgtgaca

SEQ ID NO: 5115751 - DNA, 23 bp, Homo sapiens
aatcaatgttcacgcaacttgaa

SEQ ID NO: 5115752 - DNA, 14 bp, Homo sapiens
aatcaattaaaagt

SEQ ID NO: 5115753 - DNA, 15 bp, Homo sapiens
aatcaattctagtca

SEQ ID NO: 5115754 - DNA, 20 bp, Homo sapiens
aatcaatttaaacccatttt

SEQ ID NO: 5115755 - DNA, 22 bp, Homo sapiens
aatcaatttaaaggaaagttct

SEQ ID NO: 5115756 - DNA, 20 bp, Homo sapiens
aatcaatttaaatgtttact

SEQ ID NO: 5115757 - DNA, 19 bp, Homo sapiens
aatcaatttctcaatagtt

SEQ ID NO: 5115758 - DNA, 23 bp, Homo sapiens
aatcacaaaaacaaaaaaactat

SEQ ID NO: 5115759 - DNA, 14 bp, Homo sapiens
aatcacaaaaattt

SEQ ID NO: 5115760 - DNA, 15 bp, Homo sapiens
aatcacaaacatatg

SEQ ID NO: 5115761 - DNA, 14 bp, Homo sapiens
aatcacaagtaaag

SEQ ID NO: 5115762 - DNA, 13 bp, Homo sapiens
aatcacaatacat

SEQ ID NO: 5115763 - DNA, 19 bp, Homo sapiens
aatcacaattttcctgtgg

SEQ ID NO: 5115764 - DNA, 17 bp, Homo sapiens
aatcacaatttttaatg

SEQ ID NO: 5115765 - DNA, 15 bp, Homo sapiens
aatcacagaaaattt

SEQ ID NO: 5115766 - DNA, 19 bp, Homo sapiens
aatcacagaaaatttaact

SEQ ID NO: 5115767 - DNA, 12 bp, Homo sapiens
aatcacagccaa

SEQ ID NO: 5115768 - DNA, 15 bp, Homo sapiens
aatcacagctcactg

SEQ ID NO: 5115769 - DNA, 21 bp, Homo sapiens
aatcacagcttgtattttgtg

SEQ ID NO: 5115770 - DNA, 20 bp, Homo sapiens
aatcacaggcttctgagcac

SEQ ID NO: 5115771 - DNA, 21 bp, Homo sapiens
aatcacagggaggattgaaaa

SEQ ID NO: 5115772 - DNA, 23 bp, Homo sapiens
aatcacagtactttccagcagtc

SEQ ID NO: 5115773 - DNA, 17 bp, Homo sapiens
aatcacagttgtgttcc

SEQ ID NO: 5115774 - DNA, 20 bp, Homo sapiens
aatcacataatttgttttgt

SEQ ID NO: 5115775 - DNA, 23 bp, Homo sapiens
aatcacatattttaaaatttgtt

SEQ ID NO: 5115776 - DNA, 11 bp, Homo sapiens
aatcacatcct

SEQ ID NO: 5115777 - DNA, 18 bp, Homo sapiens
aatcacatgaattattac

SEQ ID NO: 5115778 - DNA, 19 bp, Homo sapiens
aatcacattcgagtgtttc

SEQ ID NO: 5115779 - DNA, 21 bp, Homo sapiens
aatcacattttaagtgcttca

SEQ ID NO: 5115780 - DNA, 16 bp, Homo sapiens
aatcaccaattaaaaa

SEQ ID NO: 5115781 - DNA, 13 bp, Homo sapiens
aatcaccatgtaa

SEQ ID NO: 5115782 - DNA, 19 bp, Homo sapiens
aatcaccatgtaagcactc

SEQ ID NO: 5115783 - DNA, 19 bp, Homo sapiens
aatcacccctctgcccctg

SEQ ID NO: 5115784 - DNA, 13 bp, Homo sapiens
aatcaccctccta

SEQ ID NO: 5115785 - DNA, 15 bp, Homo sapiens
aatcaccctgactgt

SEQ ID NO: 5115786 - DNA, 15 bp, Homo sapiens
aatcaccgaaaacgt

SEQ ID NO: 5115787 - DNA, 14 bp, Homo sapiens
aatcacctcccacc

SEQ ID NO: 5115788 - DNA, 13 bp, Homo sapiens
aatcacctggagg

SEQ ID NO: 5115789 - DNA, 12 bp, Homo sapiens
aatcacctggct

SEQ ID NO: 5115790 - DNA, 13 bp, Homo sapiens
aatcacctggctg

SEQ ID NO: 5115791 - DNA, 22 bp, Homo sapiens
aatcacctggtattatttttct

SEQ ID NO: 5115792 - DNA, 23 bp, Homo sapiens
aatcacctttccaaggccccacc

SEQ ID NO: 5115793 - DNA, 16 bp, Homo sapiens
aatcaccttttctaaa

SEQ ID NO: 5115794 - DNA, 20 bp, Homo sapiens
aatcacgagatcttccttcc

SEQ ID NO: 5115795 - DNA, 17 bp, Homo sapiens
aatcacgaggtcaggag

SEQ ID NO: 5115796 - DNA, 14 bp, Homo sapiens
aatcacgctttttg

SEQ ID NO: 5115797 - DNA, 15 bp, Homo sapiens
aatcacgctttttga

SEQ ID NO: 5115798 - DNA, 17 bp, Homo sapiens
aatcacgctttttgaaa

SEQ ID NO: 5115799 - DNA, 14 bp, Homo sapiens
aatcactaaacttt

SEQ ID NO: 5115800 - DNA, 15 bp, Homo sapiens
aatcactaaatatct

SEQ ID NO: 5115801 - DNA, 18 bp, Homo sapiens
aatcactaaatatctagt

SEQ ID NO: 5115802 - DNA, 16 bp, Homo sapiens
aatcactaacattata

SEQ ID NO: 5115803 - DNA, 13 bp, Homo sapiens
aatcactactgta

SEQ ID NO: 5115804 - DNA, 17 bp, Homo sapiens
aatcactactgtatgta

SEQ ID NO: 5115805 - DNA, 20 bp, Homo sapiens
aatcactactgtatgtaata

SEQ ID NO: 5115806 - DNA, 18 bp, Homo sapiens
aatcactatgatttctga

SEQ ID NO: 5115807 - DNA, 17 bp, Homo sapiens
aatcactcatttatttc

SEQ ID NO: 5115808 - DNA, 22 bp, Homo sapiens
aatcactcatttatttccatat

SEQ ID NO: 5115809 - DNA, 16 bp, Homo sapiens
aatcactccaaccctg

SEQ ID NO: 5115810 - DNA, 20 bp, Homo sapiens
aatcactctaattaattgta

SEQ ID NO: 5115811 - DNA, 14 bp, Homo sapiens
aatcactgaaacaa

SEQ ID NO: 5115812 - DNA, 17 bp, Homo sapiens
aatgaacccctggctcc

SEQ ID NO: 5115813 - DNA, 21 bp, Homo sapiens
aatgaacccctggctccttca

SEQ ID NO: 5115814 - DNA, 16 bp, Homo sapiens
aatgaaccctcctcct

SEQ ID NO: 5115815 - DNA, 17 bp, Homo sapiens
aatgaaccctcctcctt

SEQ ID NO: 5115816 - DNA, 18 bp, Homo sapiens
aatgaaccgctgaatatg

SEQ ID NO: 5115817 - DNA, 17 bp, Homo sapiens
aatgaaccgtttacagt

SEQ ID NO: 5115818 - DNA, 19 bp, Homo sapiens
aatgaaccgtttacagtgt

SEQ ID NO: 5115819 - DNA, 18 bp, Homo sapiens
aatgaactaactgccatg

SEQ ID NO: 5115820 - DNA, 15 bp, Homo sapiens
aatgaactctttccc

SEQ ID NO: 5115821 - DNA, 17 bp, Homo sapiens
aatgaactctttcccca

SEQ ID NO: 5115822 - DNA, 18 bp, Homo sapiens
aatgaactgatttttatt

SEQ ID NO: 5115823 - DNA, 15 bp, Homo sapiens
aatgaactgcttttc

SEQ ID NO: 5115824 - DNA, 19 bp, Homo sapiens
aatgaactgtatattattg

SEQ ID NO: 5115825 - DNA, 13 bp, Homo sapiens
aatgaactgtatt

SEQ ID NO: 5115826 - DNA, 19 bp, Homo sapiens
aatgaactgtattattgca

SEQ ID NO: 5115827 - DNA, 14 bp, Homo sapiens
aatgaactgtgaca

SEQ ID NO: 5115828 - DNA, 12 bp, Homo sapiens
aatgaactgtgg

SEQ ID NO: 5115829 - DNA, 15 bp, Homo sapiens
aatgaactgtggaat

SEQ ID NO: 5115830 - DNA, 16 bp, Homo sapiens
aatgaactgtggaatt

SEQ ID NO: 5115831 - DNA, 17 bp, Homo sapiens
aatgaactgtggaattt

SEQ ID NO: 5115832 - DNA, 14 bp, Homo sapiens
aatgaacttccatt

SEQ ID NO: 5115833 - DNA, 14 bp, Homo sapiens
aatgaactttaaaa

SEQ ID NO: 5115834 - DNA, 15 bp, Homo sapiens
aatgaactttcagca

SEQ ID NO: 5115835 - DNA, 15 bp, Homo sapiens
aatgaacttttacag

SEQ ID NO: 5115836 - DNA, 14 bp, Homo sapiens
aatgaagaaagtca

SEQ ID NO: 5115837 - DNA, 22 bp, Homo sapiens
aatgaagaaagtcaaaaaatta

SEQ ID NO: 5115838 - DNA, 23 bp, Homo sapiens
aatgaagaaagtcaaaaaattat

SEQ ID NO: 5115839 - DNA, 17 bp, Homo sapiens
aatgaagaagacaaagt

SEQ ID NO: 5115840 - DNA, 19 bp, Homo sapiens
aatgaagaagacaaagtct

SEQ ID NO: 5115841 - DNA, 15 bp, Homo sapiens
aatgaagaattcaga

SEQ ID NO: 5115842 - DNA, 21 bp, Homo sapiens
aatgaagacccagtgtaaaga

SEQ ID NO: 5115843 - DNA, 20 bp, Homo sapiens
aatgaagacctaaatgacct

SEQ ID NO: 5115844 - DNA, 20 bp, Homo sapiens
aatgaagagctgttgatggg

SEQ ID NO: 5115845 - DNA, 16 bp, Homo sapiens
aatgaagataaatgct

SEQ ID NO: 5115846 - DNA, 21 bp, Homo sapiens
aatgaagataaatgctttaaa

SEQ ID NO: 5115847 - DNA, 23 bp, Homo sapiens
aatgaagataaatgctttaaata

SEQ ID NO: 5115848 - DNA, 17 bp, Homo sapiens
aatgaagatactgaaat

SEQ ID NO: 5115849 - DNA, 21 bp, Homo sapiens
aatgaagatctttgttttttg

SEQ ID NO: 5115850 - DNA, 17 bp, Homo sapiens
aatgaagcaaacacaca

SEQ ID NO: 5115851 - DNA, 23 bp, Homo sapiens
aatgaagcaaatgtcatgctgcc

SEQ ID NO: 5115852 - DNA, 15 bp, Homo sapiens
aatgaagcagcttta

SEQ ID NO: 5115853 - DNA, 15 bp, Homo sapiens
aatgaagcatgtagc

SEQ ID NO: 5115854 - DNA, 15 bp, Homo sapiens
aatgaagccttagcc

SEQ ID NO: 5115855 - DNA, 14 bp, Homo sapiens
aatgaagcttgtgt

SEQ ID NO: 5115856 - DNA, 22 bp, Homo sapiens
aatgaagcttgtgtatccatta

SEQ ID NO: 5115857 - DNA, 17 bp, Homo sapiens
aatgaaggaaaacctca

SEQ ID NO: 5115858 - DNA, 22 bp, Homo sapiens
aatgaaggaaataaaaaagtct

SEQ ID NO: 5115859 - DNA, 22 bp, Homo sapiens
aatgaaggcgggcctgcaagcc

SEQ ID NO: 5115860 - DNA, 23 bp, Homo sapiens
aatgaaggctgaatcaaagacat

SEQ ID NO: 5115861 - DNA, 18 bp, Homo sapiens
aatgaaggtgtgctacag

SEQ ID NO: 5115862 - DNA, 17 bp, Homo sapiens
aatgaaggttttcattt

SEQ ID NO: 5115863 - DNA, 21 bp, Homo sapiens
aatgaagtatttcatgtaata

SEQ ID NO: 5115864 - DNA, 16 bp, Homo sapiens
aatgaagtatttctca

SEQ ID NO: 5115865 - DNA, 16 bp, Homo sapiens
aatgaagtctctgaag

SEQ ID NO: 5115866 - DNA, 23 bp, Homo sapiens
aatgaagtctctgaagtgaaact

SEQ ID NO: 5115867 - DNA, 15 bp, Homo sapiens
aatgaagtttgaatg

SEQ ID NO: 5115868 - DNA, 21 bp, Homo sapiens
aatgaagtttgaatgttaaat

SEQ ID NO: 5115869 - DNA, 14 bp, Homo sapiens
aatgaataaactga

SEQ ID NO: 5115870 - DNA, 16 bp, Homo sapiens
aatgaataaactgaat

SEQ ID NO: 5115871 - DNA, 15 bp, Homo sapiens
aatgaataataatta

SEQ ID NO: 5115872 - DNA, 21 bp, Homo sapiens
aatgaataataattatccaga

SEQ ID NO: 5115873 - DNA, 15 bp, Homo sapiens
aatgaataatggaaa

SEQ ID NO: 5115874 - DNA, 21 bp, Homo sapiens
aatgaataatttattattaag

SEQ ID NO: 5115875 - DNA, 13 bp, Homo sapiens
aatgaatacctta

SEQ ID NO: 5115876 - DNA, 13 bp, Homo sapiens
aatgaatactgaa

SEQ ID NO: 5115877 - DNA, 20 bp, Homo sapiens
aatgaatactttataaagga

SEQ ID NO: 5115878 - DNA, 13 bp, Homo sapiens
aatgaatactttc

SEQ ID NO: 5115879 - DNA, 17 bp, Homo sapiens
aatgaatagaggggcat

SEQ ID NO: 5115880 - DNA, 23 bp, Homo sapiens
aatgaatagcttgtttctgtcaa

SEQ ID NO: 5115881 - DNA, 14 bp, Homo sapiens
aatgaatatctatt

SEQ ID NO: 5115882 - DNA, 21 bp, Homo sapiens
aatgaatatctgctttaatat

SEQ ID NO: 5115883 - DNA, 19 bp, Homo sapiens
aatgaatattgaagtttca

SEQ ID NO: 5115884 - DNA, 16 bp, Homo sapiens
aatgaatattgtaaat

SEQ ID NO: 5115885 - DNA, 18 bp, Homo sapiens
aatgaatcctacacacct

SEQ ID NO: 5115886 - DNA, 22 bp, Homo sapiens
aatgaatctttgactgaagccg

SEQ ID NO: 5115887 - DNA, 12 bp, Homo sapiens
aatgaatgaaat

SEQ ID NO: 5115888 - DNA, 18 bp, Homo sapiens
aatgaatgaaatataaac

SEQ ID NO: 5115889 - DNA, 14 bp, Homo sapiens
aatgaatgaataac

SEQ ID NO: 5115890 - DNA, 15 bp, Homo sapiens
aatgaatgaatgaat

SEQ ID NO: 5115891 - DNA, 12 bp, Homo sapiens
aatgaatgacct

SEQ ID NO: 5115892 - DNA, 15 bp, Homo sapiens
aatgaatgattaaat

SEQ ID NO: 5115893 - DNA, 18 bp, Homo sapiens
aatgaatgcaaaattgtt

SEQ ID NO: 5115894 - DNA, 14 bp, Homo sapiens
aatgaatgcttaaa

SEQ ID NO: 5115895 - DNA, 19 bp, Homo sapiens
aatgaatggactcaaactg

SEQ ID NO: 5115896 - DNA, 21 bp, Homo sapiens
aatgaatgggatattttgaaa

SEQ ID NO: 5115897 - DNA, 13 bp, Homo sapiens
aatgaatggggag

SEQ ID NO: 5115898 - DNA, 17 bp, Homo sapiens
aatgaatgtaaaagaca

SEQ ID NO: 5115899 - DNA, 14 bp, Homo sapiens
aatgaatgtatatt

SEQ ID NO: 5115900 - DNA, 14 bp, Homo sapiens
aatgaatgtcagtg

SEQ ID NO: 5115901 - DNA, 21 bp, Homo sapiens
aatgaatgtcagtgtgactga

SEQ ID NO: 5115902 - DNA, 12 bp, Homo sapiens
aatgaatgtcta

SEQ ID NO: 5115903 - DNA, 23 bp, Homo sapiens
aatgaatgtttacactctttgta

SEQ ID NO: 5115904 - DNA, 13 bp, Homo sapiens
aatgaattaagaa

SEQ ID NO: 5115905 - DNA, 20 bp, Homo sapiens
aatgaattaagaaagattaa

SEQ ID NO: 5115906 - DNA, 14 bp, Homo sapiens
aatgaattataaca

SEQ ID NO: 5115907 - DNA, 14 bp, Homo sapiens
aatgaattcacccc

SEQ ID NO: 5115908 - DNA, 15 bp, Homo sapiens
aatgaattcacccct

SEQ ID NO: 5115909 - DNA, 17 bp, Homo sapiens
aatgaattcctagaatt

SEQ ID NO: 5115910 - DNA, 23 bp, Homo sapiens
aatgaattcctatatacctaata

SEQ ID NO: 5115911 - DNA, 14 bp, Homo sapiens
aatgaattctaaac

SEQ ID NO: 5115912 - DNA, 14 bp, Homo sapiens
aatgaattcttcaa

SEQ ID NO: 5115913 - DNA, 15 bp, Homo sapiens
aatgaattcttcaac

SEQ ID NO: 5115914 - DNA, 23 bp, Homo sapiens
aatgaattctttaaggagatgga

SEQ ID NO: 5115915 - DNA, 13 bp, Homo sapiens
aatgaattgaaaa

SEQ ID NO: 5115916 - DNA, 18 bp, Homo sapiens
aatgaattgaaattttat

SEQ ID NO: 5115917 - DNA, 13 bp, Homo sapiens
aatgaattgcctt

SEQ ID NO: 5115918 - DNA, 20 bp, Homo sapiens
aatgaatttatcattttagt

SEQ ID NO: 5115919 - DNA, 14 bp, Homo sapiens
aatgaatttatctg

SEQ ID NO: 5115920 - DNA, 19 bp, Homo sapiens
aatgaatttatctgaatat

SEQ ID NO: 5115921 - DNA, 17 bp, Homo sapiens
aatgaatttatctttac

SEQ ID NO: 5115922 - DNA, 11 bp, Homo sapiens
aatgaatttgg

SEQ ID NO: 5115923 - DNA, 17 bp, Homo sapiens
aatgaattttccacgca

SEQ ID NO: 5115924 - DNA, 22 bp, Homo sapiens
aatgaattttccacgcagttct

SEQ ID NO: 5115925 - DNA, 12 bp, Homo sapiens
aatgacaaaaga

SEQ ID NO: 5115926 - DNA, 18 bp, Homo sapiens
aatgacaaaagatacaaa

SEQ ID NO: 5115927 - DNA, 15 bp, Homo sapiens
aatgacaaagccatt

SEQ ID NO: 5115928 - DNA, 17 bp, Homo sapiens
aatgacaacagaaaaac

SEQ ID NO: 5115929 - DNA, 15 bp, Homo sapiens
aatgacaacagaagc

SEQ ID NO: 5115930 - DNA, 22 bp, Homo sapiens
aatgacaagtgacttatttgct

SEQ ID NO: 5115931 - DNA, 17 bp, Homo sapiens
aatgacaattgtgaaca

SEQ ID NO: 5115932 - DNA, 24 bp, Homo sapiens
aatgacacactgcggtgtctgcag

SEQ ID NO: 5115933 - DNA, 19 bp, Homo sapiens
aatgacacggtaggccaag

SEQ ID NO: 5115934 - DNA, 16 bp, Homo sapiens
aatgacactgtttcct

SEQ ID NO: 5115935 - DNA, 17 bp, Homo sapiens
aatgacactgtttcctg

SEQ ID NO: 5115936 - DNA, 19 bp, Homo sapiens
aatgacactgtttcctgat

SEQ ID NO: 5115937 - DNA, 17 bp, Homo sapiens
aatgacacttgtcccca

SEQ ID NO: 5115938 - DNA, 15 bp, Homo sapiens
aatgacagaaatgac

SEQ ID NO: 5115939 - DNA, 13 bp, Homo sapiens
aatgacagagagt

SEQ ID NO: 5115940 - DNA, 20 bp, Homo sapiens
aatgacagagagttctggtg

SEQ ID NO: 5115941 - DNA, 16 bp, Homo sapiens
aatgacagataaatcc

SEQ ID NO: 5115942 - DNA, 16 bp, Homo sapiens
aatgacagattctgac

SEQ ID NO: 5115943 - DNA, 17 bp, Homo sapiens
aatgacagattctgaca

SEQ ID NO: 5115944 - DNA, 21 bp, Homo sapiens
aatgacagccgctgatgtctg

SEQ ID NO: 5115945 - DNA, 15 bp, Homo sapiens
aatgacagccttgca

SEQ ID NO: 5115946 - DNA, 15 bp, Homo sapiens
aatgacaggcctgtc

SEQ ID NO: 5115947 - DNA, 17 bp, Homo sapiens
aatgacagtttcagaga

SEQ ID NO: 5115948 - DNA, 17 bp, Homo sapiens
aatgacataaaaagaag

SEQ ID NO: 5115949 - DNA, 22 bp, Homo sapiens
aatgacataaaaagaagccttc

SEQ ID NO: 5115950 - DNA, 17 bp, Homo sapiens
aatgacataccttgctt

SEQ ID NO: 5115951 - DNA, 21 bp, Homo sapiens
aatgacatctacgaagccaca

SEQ ID NO: 5115952 - DNA, 22 bp, Homo sapiens
aatgacatctcaggggccagag

SEQ ID NO: 5115953 - DNA, 20 bp, Homo sapiens
aatgacatctttttaaagct

SEQ ID NO: 5115954 - DNA, 19 bp, Homo sapiens
aatgacatgcactgaccct

SEQ ID NO: 5115955 - DNA, 18 bp, Homo sapiens
aatgacattattaaagtt

SEQ ID NO: 5115956 - DNA, 18 bp, Homo sapiens
aatgaccaagaaaaagaa

SEQ ID NO: 5115957 - DNA, 19 bp, Homo sapiens
aatgaccacacctgcctct

SEQ ID NO: 5115958 - DNA, 21 bp, Homo sapiens
aatgaccagtaattgtgaaaa

SEQ ID NO: 5115959 - DNA, 15 bp, Homo sapiens
aatgaccatgttata

SEQ ID NO: 5115960 - DNA, 17 bp, Homo sapiens
aatgacccttttgtgtc

SEQ ID NO: 5115961 - DNA, 17 bp, Homo sapiens
aatgacctcagatcttt

SEQ ID NO: 5115962 - DNA, 20 bp, Homo sapiens
aatgacctgccctggcccca

SEQ ID NO: 5115963 - DNA, 18 bp, Homo sapiens
aatgaccttgtaatgtaa

SEQ ID NO: 5115964 - DNA, 13 bp, Homo sapiens
aatgacctttcaa

SEQ ID NO: 5115965 - DNA, 15 bp, Homo sapiens
aatgacctttcaata

SEQ ID NO: 5115966 - DNA, 18 bp, Homo sapiens
aatgacctttcaatagga

SEQ ID NO: 5115967 - DNA, 21 bp, Homo sapiens
aatgacgtgtgtggctgggac

SEQ ID NO: 5115968 - DNA, 13 bp, Homo sapiens
aatgactaagcca

SEQ ID NO: 5115969 - DNA, 16 bp, Homo sapiens
aatgactaagccaagc

SEQ ID NO: 5115970 - DNA, 18 bp, Homo sapiens
aatgactaattcttgcat

SEQ ID NO: 5115971 - DNA, 20 bp, Homo sapiens
aatgactaattcttgcatat

SEQ ID NO: 5115972 - DNA, 21 bp, Homo sapiens
aatgactatataatttatttc

SEQ ID NO: 5115973 - DNA, 15 bp, Homo sapiens
aatgactattgtaat

SEQ ID NO: 5115974 - DNA, 17 bp, Homo sapiens
aatgactattgtaatgc

SEQ ID NO: 5115975 - DNA, 15 bp, Homo sapiens
aatgactcaaagtct

SEQ ID NO: 5115976 - DNA, 16 bp, Homo sapiens
aatgactcaaagtctg

SEQ ID NO: 5115977 - DNA, 17 bp, Homo sapiens
aatgactccactgtttt

SEQ ID NO: 5115978 - DNA, 16 bp, Homo sapiens
aatgactccaggaaga

SEQ ID NO: 5115979 - DNA, 21 bp, Homo sapiens
aatgactccaggaagaaggtg

SEQ ID NO: 5115980 - DNA, 17 bp, Homo sapiens
aatgactcgttacctgc

SEQ ID NO: 5115981 - DNA, 20 bp, Homo sapiens
aatgactctaaagaaacaga

SEQ ID NO: 5115982 - DNA, 20 bp, Homo sapiens
aatgactctaaatagcccag

SEQ ID NO: 5115983 - DNA, 23 bp, Homo sapiens
aatgactctggaaccatcctctg

SEQ ID NO: 5115984 - DNA, 20 bp, Homo sapiens
aatgactgagatttgtaaat

SEQ ID NO: 5115985 - DNA, 14 bp, Homo sapiens
aatgactggctaca

SEQ ID NO: 5115986 - DNA, 13 bp, Homo sapiens
aatgactggctcc

SEQ ID NO: 5115987 - DNA, 14 bp, Homo sapiens
aatgactggctcct

SEQ ID NO: 5115988 - DNA, 19 bp, Homo sapiens
aatgactggggagggctgc

SEQ ID NO: 5115989 - DNA, 15 bp, Homo sapiens
aatgactgtgctcac

SEQ ID NO: 5115990 - DNA, 15 bp, Homo sapiens
aatgacttagaaaca

SEQ ID NO: 5115991 - DNA, 17 bp, Homo sapiens
aatcactgcactgcatg

SEQ ID NO: 5115992 - DNA, 22 bp, Homo sapiens
aatcactgcactgcatgcaaac

SEQ ID NO: 5115993 - DNA, 21 bp, Homo sapiens
aatcactggctaccgaagtaa

SEQ ID NO: 5115994 - DNA, 22 bp, Homo sapiens
aatcactggctaccgaagtaaa

SEQ ID NO: 5115995 - DNA, 13 bp, Homo sapiens
aatcactgggccc

SEQ ID NO: 5115996 - DNA, 14 bp, Homo sapiens
aatcactgggccca

SEQ ID NO: 5115997 - DNA, 15 bp, Homo sapiens
aatcactgggcccag

SEQ ID NO: 5115998 - DNA, 16 bp, Homo sapiens
aatcactgggcccaga

SEQ ID NO: 5115999 - DNA, 17 bp, Homo sapiens
aatcactgtattttcat

SEQ ID NO: 5116000 - DNA, 16 bp, Homo sapiens
aatcactgtgaaattt

SEQ ID NO: 5116001 - DNA, 18 bp, Homo sapiens
aatcactgtgaaatttca

SEQ ID NO: 5116002 - DNA, 22 bp, Homo sapiens
aatcactgtgaaatttcatgat

SEQ ID NO: 5116003 - DNA, 17 bp, Homo sapiens
aatcactgtgcttaatt

SEQ ID NO: 5116004 - DNA, 16 bp, Homo sapiens
aatcactgtgtatatt

SEQ ID NO: 5116005 - DNA, 17 bp, Homo sapiens
aatcactgtgtatattt

SEQ ID NO: 5116006 - DNA, 18 bp, Homo sapiens
aatcactgtgtatatttg

SEQ ID NO: 5116007 - DNA, 21 bp, Homo sapiens
aatcactgtgtatatttgatt

SEQ ID NO: 5116008 - DNA, 22 bp, Homo sapiens
aatcactgtgtatatttgattt

SEQ ID NO: 5116009 - DNA, 22 bp, Homo sapiens
aatcactgttgagttctgattg

SEQ ID NO: 5116010 - DNA, 19 bp, Homo sapiens
aatcactgttgctttgaaa

SEQ ID NO: 5116011 - DNA, 16 bp, Homo sapiens
aatcacttgattcata

SEQ ID NO: 5116012 - DNA, 13 bp, Homo sapiens
aatcacttggggt

SEQ ID NO: 5116013 - DNA, 13 bp, Homo sapiens
aatcacttgtaaa

SEQ ID NO: 5116014 - DNA, 15 bp, Homo sapiens
aatcacttgtaaata

SEQ ID NO: 5116015 - DNA, 21 bp, Homo sapiens
aatcactttacctgcaggctc

SEQ ID NO: 5116016 - DNA, 15 bp, Homo sapiens
aatcacttttctaga

SEQ ID NO: 5116017 - DNA, 12 bp, Homo sapiens
aatcacttttgg

SEQ ID NO: 5116018 - DNA, 15 bp, Homo sapiens
aatcagaaaaattaa

SEQ ID NO: 5116019 - DNA, 19 bp, Homo sapiens
aatcagaaaagtaattttg

SEQ ID NO: 5116020 - DNA, 13 bp, Homo sapiens
aatcagaaagaca

SEQ ID NO: 5116021 - DNA, 13 bp, Homo sapiens
aatcagaaagtaa

SEQ ID NO: 5116022 - DNA, 17 bp, Homo sapiens
aatcagaacaaaacttc

SEQ ID NO: 5116023 - DNA, 19 bp, Homo sapiens
aatcagaacagatgctgag

SEQ ID NO: 5116024 - DNA, 22 bp, Homo sapiens
aatcagaagctataagagaact

SEQ ID NO: 5116025 - DNA, 17 bp, Homo sapiens
aatcagaagtttcctgg

SEQ ID NO: 5116026 - DNA, 18 bp, Homo sapiens
aatcagaataaagttgta

SEQ ID NO: 5116027 - DNA, 19 bp, Homo sapiens
aatcagaataaagttgtat

SEQ ID NO: 5116028 - DNA, 15 bp, Homo sapiens
aatcagaataaatta

SEQ ID NO: 5116029 - DNA, 18 bp, Homo sapiens
aatcagaatcatggagaa

SEQ ID NO: 5116030 - DNA, 19 bp, Homo sapiens
aatcagaatgaaccctcct

SEQ ID NO: 5116031 - DNA, 17 bp, Homo sapiens
aatcagaattggcataa

SEQ ID NO: 5116032 - DNA, 16 bp, Homo sapiens
aatcagaatttttaga

SEQ ID NO: 5116033 - DNA, 12 bp, Homo sapiens
aatcagacacaa

SEQ ID NO: 5116034 - DNA, 20 bp, Homo sapiens
aatcagacacaattagagaa

SEQ ID NO: 5116035 - DNA, 14 bp, Homo sapiens
aatcagacagcagg

SEQ ID NO: 5116036 - DNA, 11 bp, Homo sapiens
aatcagagaat

SEQ ID NO: 5116037 - DNA, 18 bp, Homo sapiens
aatcagagaccaggccct

SEQ ID NO: 5116038 - DNA, 20 bp, Homo sapiens
aatcagagaccttccagaaa

SEQ ID NO: 5116039 - DNA, 17 bp, Homo sapiens
aatcagagagcaaggca

SEQ ID NO: 5116040 - DNA, 24 bp, Homo sapiens
aatcagagcagtgattctctcttc

SEQ ID NO: 5116041 - DNA, 16 bp, Homo sapiens
aatcagagcccaggga

SEQ ID NO: 5116042 - DNA, 20 bp, Homo sapiens
aatcagagctggcagcctcc

SEQ ID NO: 5116043 - DNA, 15 bp, Homo sapiens
aatcagagtagaaat

SEQ ID NO: 5116044 - DNA, 17 bp, Homo sapiens
aatcagagtatctgaag

SEQ ID NO: 5116045 - DNA, 20 bp, Homo sapiens
aatcagagtctataacagaa

SEQ ID NO: 5116046 - DNA, 19 bp, Homo sapiens
aatcagagttaccattatt

SEQ ID NO: 5116047 - DNA, 21 bp, Homo sapiens
aatcagatagatattcctatt

SEQ ID NO: 5116048 - DNA, 15 bp, Homo sapiens
aatcagatcatttca

SEQ ID NO: 5116049 - DNA, 15 bp, Homo sapiens
aatcagatctttatt

SEQ ID NO: 5116050 - DNA, 21 bp, Homo sapiens
aatcagatgaattgataaaag

SEQ ID NO: 5116051 - DNA, 12 bp, Homo sapiens
aatcagatgctg

SEQ ID NO: 5116052 - DNA, 21 bp, Homo sapiens
aatcagatggtgtcatttagt

SEQ ID NO: 5116053 - DNA, 17 bp, Homo sapiens
aatcagattgcttaaaa

SEQ ID NO: 5116054 - DNA, 20 bp, Homo sapiens
aatcagattgcttaaaagca

SEQ ID NO: 5116055 - DNA, 16 bp, Homo sapiens
aatcagcaaacacaat

SEQ ID NO: 5116056 - DNA, 13 bp, Homo sapiens
aatcagcactgaa

SEQ ID NO: 5116057 - DNA, 17 bp, Homo sapiens
aatcagcactgaaaata

SEQ ID NO: 5116058 - DNA, 19 bp, Homo sapiens
aatcagcatatgtgtaaag

SEQ ID NO: 5116059 - DNA, 15 bp, Homo sapiens
aatcagcatgacaaa

SEQ ID NO: 5116060 - DNA, 16 bp, Homo sapiens
aatcagcatgacaaaa

SEQ ID NO: 5116061 - DNA, 21 bp, Homo sapiens
aatcagcatgacaaaaataac

SEQ ID NO: 5116062 - DNA, 22 bp, Homo sapiens
aatcagcatgacaaaaataaca

SEQ ID NO: 5116063 - DNA, 14 bp, Homo sapiens
aatcagcatttagt

SEQ ID NO: 5116064 - DNA, 15 bp, Homo sapiens
aatcagccagtctca

SEQ ID NO: 5116065 - DNA, 17 bp, Homo sapiens
aatcagcccagtgcaaa

SEQ ID NO: 5116066 - DNA, 12 bp, Homo sapiens
aatcagccccca

SEQ ID NO: 5116067 - DNA, 17 bp, Homo sapiens
aatcagcctacaggcct

SEQ ID NO: 5116068 - DNA, 23 bp, Homo sapiens
aatcagcctaggggtcagggacc

SEQ ID NO: 5116069 - DNA, 21 bp, Homo sapiens
aatcagcctcatgactttata

SEQ ID NO: 5116070 - DNA, 18 bp, Homo sapiens
aatcagcctgctccagct

SEQ ID NO: 5116071 - DNA, 11 bp, Homo sapiens
aatcagctccc

SEQ ID NO: 5116072 - DNA, 11 bp, Homo sapiens
aatcagctcct

SEQ ID NO: 5116073 - DNA, 20 bp, Homo sapiens
aatcagctccttcctggaga

SEQ ID NO: 5116074 - DNA, 21 bp, Homo sapiens
aatcagctccttttccgttct

SEQ ID NO: 5116075 - DNA, 18 bp, Homo sapiens
aatcagctctcctggctc

SEQ ID NO: 5116076 - DNA, 19 bp, Homo sapiens
aatcagctctcctggctcc

SEQ ID NO: 5116077 - DNA, 22 bp, Homo sapiens
aatcagctgcaatccatttatt

SEQ ID NO: 5116078 - DNA, 13 bp, Homo sapiens
aatcagctgcttt

SEQ ID NO: 5116079 - DNA, 16 bp, Homo sapiens
aatcagctgctttgtt

SEQ ID NO: 5116080 - DNA, 18 bp, Homo sapiens
aatcagctgctttgttac

SEQ ID NO: 5116081 - DNA, 19 bp, Homo sapiens
aatcagcttttgttctaga

SEQ ID NO: 5116082 - DNA, 20 bp, Homo sapiens
aatcagcttttgttctagac

SEQ ID NO: 5116083 - DNA, 12 bp, Homo sapiens
aatcaggaaaaa

SEQ ID NO: 5116084 - DNA, 16 bp, Homo sapiens
aatcaggaaaaatgag

SEQ ID NO: 5116085 - DNA, 18 bp, Homo sapiens
aatcaggaatattttcca

SEQ ID NO: 5116086 - DNA, 21 bp, Homo sapiens
aatcaggaggagattaacaca

SEQ ID NO: 5116087 - DNA, 23 bp, Homo sapiens
aatcaggaggagattaacacact

SEQ ID NO: 5116088 - DNA, 16 bp, Homo sapiens
aatcaggattttagtg

SEQ ID NO: 5116089 - DNA, 12 bp, Homo sapiens
aatcaggcaagg

SEQ ID NO: 5116090 - DNA, 16 bp, Homo sapiens
aatcaggcaaggagga

SEQ ID NO: 5116091 - DNA, 14 bp, Homo sapiens
aatcaggcagcctt

SEQ ID NO: 5116092 - DNA, 21 bp, Homo sapiens
aatcaggcatgtgtcccttcc

SEQ ID NO: 5116093 - DNA, 14 bp, Homo sapiens
aatcaggcattttt

SEQ ID NO: 5116094 - DNA, 21 bp, Homo sapiens
aatcaggcatttttccaaagg

SEQ ID NO: 5116095 - DNA, 17 bp, Homo sapiens
aatcagggaaactaatt

SEQ ID NO: 5116096 - DNA, 19 bp, Homo sapiens
aatcagggaaactaattgt

SEQ ID NO: 5116097 - DNA, 13 bp, Homo sapiens
aatcagggaccag

SEQ ID NO: 5116098 - DNA, 13 bp, Homo sapiens
aatcaggggccag

SEQ ID NO: 5116099 - DNA, 14 bp, Homo sapiens
aatcaggggccaga

SEQ ID NO: 5116100 - DNA, 16 bp, Homo sapiens
aatcagggttagtatt

SEQ ID NO: 5116101 - DNA, 21 bp, Homo sapiens
aatcagggttagtattgtcca

SEQ ID NO: 5116102 - DNA, 23 bp, Homo sapiens
aatcaggtaaaatagtcatgatt

SEQ ID NO: 5116103 - DNA, 18 bp, Homo sapiens
aatcaggtcctgctcagc

SEQ ID NO: 5116104 - DNA, 16 bp, Homo sapiens
aatcaggtggcttttg

SEQ ID NO: 5116105 - DNA, 15 bp, Homo sapiens
aatcaggtgttttaa

SEQ ID NO: 5116106 - DNA, 18 bp, Homo sapiens
aatcaggttttcttttaa

SEQ ID NO: 5116107 - DNA, 14 bp, Homo sapiens
aatcagtaagaggt

SEQ ID NO: 5116108 - DNA, 14 bp, Homo sapiens
aatcagtaatctgt

SEQ ID NO: 5116109 - DNA, 21 bp, Homo sapiens
aatcagtagcttaagaaaaaa

SEQ ID NO: 5116110 - DNA, 19 bp, Homo sapiens
aatcagtaggaccaggcca

SEQ ID NO: 5116111 - DNA, 15 bp, Homo sapiens
aatcagtataaacaa

SEQ ID NO: 5116112 - DNA, 14 bp, Homo sapiens
aatcagtataattc

SEQ ID NO: 5116113 - DNA, 17 bp, Homo sapiens
aatcagtataattctgt

SEQ ID NO: 5116114 - DNA, 14 bp, Homo sapiens
aatcagtatcagaa

SEQ ID NO: 5116115 - DNA, 15 bp, Homo sapiens
aatcagtatcagaat

SEQ ID NO: 5116116 - DNA, 16 bp, Homo sapiens
aatcagtatcagaata

SEQ ID NO: 5116117 - DNA, 21 bp, Homo sapiens
aatcagtcagtgcaaatgtca

SEQ ID NO: 5116118 - DNA, 22 bp, Homo sapiens
aatcagtcatgtgtaatatgca

SEQ ID NO: 5116119 - DNA, 17 bp, Homo sapiens
aatcagtgacatctgat

SEQ ID NO: 5116120 - DNA, 21 bp, Homo sapiens
aatcagtgactgaaaccattt

SEQ ID NO: 5116121 - DNA, 17 bp, Homo sapiens
aatcagtgatgggagta

SEQ ID NO: 5116122 - DNA, 16 bp, Homo sapiens
aatcagtggaactcaa

SEQ ID NO: 5116123 - DNA, 20 bp, Homo sapiens
aatcagtgggttaattttgg

SEQ ID NO: 5116124 - DNA, 16 bp, Homo sapiens
aatcagtgtagcccca

SEQ ID NO: 5116125 - DNA, 18 bp, Homo sapiens
aatcagtgtgtctaaatt

SEQ ID NO: 5116126 - DNA, 13 bp, Homo sapiens
aatcagtgttaaa

SEQ ID NO: 5116127 - DNA, 15 bp, Homo sapiens
aatcagtgtttaaat

SEQ ID NO: 5116128 - DNA, 21 bp, Homo sapiens
aatcagtgtttaaataaagac

SEQ ID NO: 5116129 - DNA, 19 bp, Homo sapiens
aatcagtgtttgattgccc

SEQ ID NO: 5116130 - DNA, 20 bp, Homo sapiens
aatcagttatattctttaaa

SEQ ID NO: 5116131 - DNA, 16 bp, Homo sapiens
aatcagttgtgaatac

SEQ ID NO: 5116132 - DNA, 20 bp, Homo sapiens
aatcagttgtgaatacattc

SEQ ID NO: 5116133 - DNA, 19 bp, Homo sapiens
aatcagttttgtgtacagt

SEQ ID NO: 5116134 - DNA, 22 bp, Homo sapiens
aatcagtttttgttcttaaaaa

SEQ ID NO: 5116135 - DNA, 18 bp, Homo sapiens
aatcataaactgtgtgca

SEQ ID NO: 5116136 - DNA, 13 bp, Homo sapiens
aatcataaagtca

SEQ ID NO: 5116137 - DNA, 21 bp, Homo sapiens
aatcataacatagttgaaaaa

SEQ ID NO: 5116138 - DNA, 15 bp, Homo sapiens
aatcataagtatttg

SEQ ID NO: 5116139 - DNA, 16 bp, Homo sapiens
aatcataagtatttgg

SEQ ID NO: 5116140 - DNA, 15 bp, Homo sapiens
aatcataatgtatta

SEQ ID NO: 5116141 - DNA, 17 bp, Homo sapiens
aatcataatgtattatt

SEQ ID NO: 5116142 - DNA, 19 bp, Homo sapiens
aatcataatgtattattta

SEQ ID NO: 5116143 - DNA, 21 bp, Homo sapiens
aatcatacaaatactatccaa

SEQ ID NO: 5116144 - DNA, 15 bp, Homo sapiens
aatcataccagttgt

SEQ ID NO: 5116145 - DNA, 16 bp, Homo sapiens
aatcataccagttgtt

SEQ ID NO: 5116146 - DNA, 19 bp, Homo sapiens
aatcatactcctatgcttt

SEQ ID NO: 5116147 - DNA, 16 bp, Homo sapiens
aatcatactgcctact

SEQ ID NO: 5116148 - DNA, 16 bp, Homo sapiens
aatcatactttgccaa

SEQ ID NO: 5116149 - DNA, 20 bp, Homo sapiens
aatcatagctggttcacact

SEQ ID NO: 5116150 - DNA, 19 bp, Homo sapiens
aatcatagtactctttgta

SEQ ID NO: 5116151 - DNA, 22 bp, Homo sapiens
aatcatagtactctttgtagca

SEQ ID NO: 5116152 - DNA, 15 bp, Homo sapiens
aatcatagtatatga

SEQ ID NO: 5116153 - DNA, 16 bp, Homo sapiens
aatcatagttactgtg

SEQ ID NO: 5116154 - DNA, 18 bp, Homo sapiens
aatcatataaatagaatg

SEQ ID NO: 5116155 - DNA, 22 bp, Homo sapiens
aatcatataaatagaatgtaaa

SEQ ID NO: 5116156 - DNA, 21 bp, Homo sapiens
aatcatataataaatgtacat

SEQ ID NO: 5116157 - DNA, 15 bp, Homo sapiens
aatcatatagaccaa

SEQ ID NO: 5116158 - DNA, 22 bp, Homo sapiens
aatcatatcaacttaattctgt

SEQ ID NO: 5116159 - DNA, 14 bp, Homo sapiens
aatcatatgattct

SEQ ID NO: 5116160 - DNA, 22 bp, Homo sapiens
aatcatatgtgtctttatagat

SEQ ID NO: 5116161 - DNA, 22 bp, Homo sapiens
aatcatattaaaattacagatg

SEQ ID NO: 5116162 - DNA, 19 bp, Homo sapiens
aatcatattaatacaatga

SEQ ID NO: 5116163 - DNA, 14 bp, Homo sapiens
aatcatattaatta

SEQ ID NO: 5116164 - DNA, 15 bp, Homo sapiens
aatcatattaattat

SEQ ID NO: 5116165 - DNA, 13 bp, Homo sapiens
aatcatattctca

SEQ ID NO: 5116166 - DNA, 22 bp, Homo sapiens
aatcatattctcatggctttgt

SEQ ID NO: 5116167 - DNA, 19 bp, Homo sapiens
aatcatattgagaataatt

SEQ ID NO: 5116168 - DNA, 22 bp, Homo sapiens
aatcatatttgaaaaccatatt

SEQ ID NO: 5116169 - DNA, 16 bp, Homo sapiens
aatcatcaaaaagaaa

SEQ ID NO: 5116170 - DNA, 17 bp, Homo sapiens
aatgacttagaaacaat

SEQ ID NO: 5116171 - DNA, 15 bp, Homo sapiens
aatgacttagaaact

SEQ ID NO: 5116172 - DNA, 18 bp, Homo sapiens
aatgacttatattcttag

SEQ ID NO: 5116173 - DNA, 15 bp, Homo sapiens
aatgacttattgatt

SEQ ID NO: 5116174 - DNA, 21 bp, Homo sapiens
aatgacttattgattaagtat

SEQ ID NO: 5116175 - DNA, 19 bp, Homo sapiens
aatgacttattgtggataa

SEQ ID NO: 5116176 - DNA, 14 bp, Homo sapiens
aatgacttatttct

SEQ ID NO: 5116177 - DNA, 20 bp, Homo sapiens
aatgacttatttctgctctg

SEQ ID NO: 5116178 - DNA, 23 bp, Homo sapiens
aatgacttatttctgctctggaa

SEQ ID NO: 5116179 - DNA, 14 bp, Homo sapiens
aatgacttcatttc

SEQ ID NO: 5116180 - DNA, 20 bp, Homo sapiens
aatgacttcatttctgatgt

SEQ ID NO: 5116181 - DNA, 14 bp, Homo sapiens
aatgacttccatat

SEQ ID NO: 5116182 - DNA, 21 bp, Homo sapiens
aatgacttccccaatatcttg

SEQ ID NO: 5116183 - DNA, 19 bp, Homo sapiens
aatgacttctccaggcaga

SEQ ID NO: 5116184 - DNA, 20 bp, Homo sapiens
aatgacttgcagatgaaaaa

SEQ ID NO: 5116185 - DNA, 21 bp, Homo sapiens
aatgacttgtacaaacagtat

SEQ ID NO: 5116186 - DNA, 13 bp, Homo sapiens
aatgactttatta

SEQ ID NO: 5116187 - DNA, 19 bp, Homo sapiens
aatgactttatttttctaa

SEQ ID NO: 5116188 - DNA, 14 bp, Homo sapiens
aatgactttcataa

SEQ ID NO: 5116189 - DNA, 16 bp, Homo sapiens
aatgactttcataata

SEQ ID NO: 5116190 - DNA, 14 bp, Homo sapiens
aatgactttgaact

SEQ ID NO: 5116191 - DNA, 18 bp, Homo sapiens
aatgacttttaaaatttg

SEQ ID NO: 5116192 - DNA, 15 bp, Homo sapiens
aatgacttttcttaa

SEQ ID NO: 5116193 - DNA, 16 bp, Homo sapiens
aatgacttttgaatta

SEQ ID NO: 5116194 - DNA, 17 bp, Homo sapiens
aatgacttttgaattac

SEQ ID NO: 5116195 - DNA, 16 bp, Homo sapiens
aatgactttttgaatg

SEQ ID NO: 5116196 - DNA, 15 bp, Homo sapiens
aatgagaaaatggct

SEQ ID NO: 5116197 - DNA, 20 bp, Homo sapiens
aatgagaaaatggctttaat

SEQ ID NO: 5116198 - DNA, 18 bp, Homo sapiens
aatgagaaaggacagagc

SEQ ID NO: 5116199 - DNA, 15 bp, Homo sapiens
aatgagaaattgtgc

SEQ ID NO: 5116200 - DNA, 19 bp, Homo sapiens
aatgagaaattgtgccaaa

SEQ ID NO: 5116201 - DNA, 17 bp, Homo sapiens
aatgagaacatgttggt

SEQ ID NO: 5116202 - DNA, 21 bp, Homo sapiens
aatgagaacatgttggtattt

SEQ ID NO: 5116203 - DNA, 15 bp, Homo sapiens
aatgagaacatttac

SEQ ID NO: 5116204 - DNA, 14 bp, Homo sapiens
aatgagaaccaaca

SEQ ID NO: 5116205 - DNA, 14 bp, Homo sapiens
aatgagaacttcaa

SEQ ID NO: 5116206 - DNA, 17 bp, Homo sapiens
aatgagaaggaatttga

SEQ ID NO: 5116207 - DNA, 17 bp, Homo sapiens
aatgagaagtaaattat

SEQ ID NO: 5116208 - DNA, 15 bp, Homo sapiens
aatgagaatagaaac

SEQ ID NO: 5116209 - DNA, 18 bp, Homo sapiens
aatgagaatctgtgcagt

SEQ ID NO: 5116210 - DNA, 16 bp, Homo sapiens
aatgagaatgtgccat

SEQ ID NO: 5116211 - DNA, 15 bp, Homo sapiens
aatgagaatttaagc

SEQ ID NO: 5116212 - DNA, 13 bp, Homo sapiens
aatgagacagcag

SEQ ID NO: 5116213 - DNA, 22 bp, Homo sapiens
aatgagacagcagtcttatgct

SEQ ID NO: 5116214 - DNA, 14 bp, Homo sapiens
aatgagaccccttt

SEQ ID NO: 5116215 - DNA, 15 bp, Homo sapiens
aatgagaccccttta

SEQ ID NO: 5116216 - DNA, 22 bp, Homo sapiens
aatgagacccctttaaactgtc

SEQ ID NO: 5116217 - DNA, 20 bp, Homo sapiens
aatgagactttaaaagcatt

SEQ ID NO: 5116218 - DNA, 18 bp, Homo sapiens
aatgagagaataagtcat

SEQ ID NO: 5116219 - DNA, 23 bp, Homo sapiens
aatgagagaataagtcatgttcc

SEQ ID NO: 5116220 - DNA, 19 bp, Homo sapiens
aatgagagcgacacagacg

SEQ ID NO: 5116221 - DNA, 17 bp, Homo sapiens
aatgagaggcatttccc

SEQ ID NO: 5116222 - DNA, 17 bp, Homo sapiens
aatgagaggttcctaag

SEQ ID NO: 5116223 - DNA, 17 bp, Homo sapiens
aatgagagtgcactgct

SEQ ID NO: 5116224 - DNA, 21 bp, Homo sapiens
aatgagatagaagatgtttgc

SEQ ID NO: 5116225 - DNA, 17 bp, Homo sapiens
aatgagatcaggctctg

SEQ ID NO: 5116226 - DNA, 16 bp, Homo sapiens
aatgagatgcatgatt

SEQ ID NO: 5116227 - DNA, 18 bp, Homo sapiens
aatgagattaattccttt

SEQ ID NO: 5116228 - DNA, 15 bp, Homo sapiens
aatgagattgaattt

SEQ ID NO: 5116229 - DNA, 16 bp, Homo sapiens
aatgagattgaatttc

SEQ ID NO: 5116230 - DNA, 17 bp, Homo sapiens
aatgagatttctttgaa

SEQ ID NO: 5116231 - DNA, 14 bp, Homo sapiens
aatgagcacctcca

SEQ ID NO: 5116232 - DNA, 17 bp, Homo sapiens
aatgagcagttagaaat

SEQ ID NO: 5116233 - DNA, 21 bp, Homo sapiens
aatgagcatctcaaatgtttt

SEQ ID NO: 5116234 - DNA, 16 bp, Homo sapiens
aatgagcattctgcag

SEQ ID NO: 5116235 - DNA, 17 bp, Homo sapiens
aatgagccatcactaga

SEQ ID NO: 5116236 - DNA, 11 bp, Homo sapiens
aatgagccctg

SEQ ID NO: 5116237 - DNA, 15 bp, Homo sapiens
aatgagccctggctc

SEQ ID NO: 5116238 - DNA, 12 bp, Homo sapiens
aatgagcctggc

SEQ ID NO: 5116239 - DNA, 18 bp, Homo sapiens
aatgagctagtgtcttat

SEQ ID NO: 5116240 - DNA, 19 bp, Homo sapiens
aatgagctattaaaactca

SEQ ID NO: 5116241 - DNA, 12 bp, Homo sapiens
aatgagctcctg

SEQ ID NO: 5116242 - DNA, 13 bp, Homo sapiens
aatgagctcctgc

SEQ ID NO: 5116243 - DNA, 17 bp, Homo sapiens
aatgagcttaatgtctt

SEQ ID NO: 5116244 - DNA, 17 bp, Homo sapiens
aatgagcttgattaaat

SEQ ID NO: 5116245 - DNA, 16 bp, Homo sapiens
aatgagcttgtaaata

SEQ ID NO: 5116246 - DNA, 12 bp, Homo sapiens
aatgagctttct

SEQ ID NO: 5116247 - DNA, 22 bp, Homo sapiens
aatgagctttctgaacagctgg

SEQ ID NO: 5116248 - DNA, 23 bp, Homo sapiens
aatgaggaaaaaatggtataaaa

SEQ ID NO: 5116249 - DNA, 19 bp, Homo sapiens
aatgaggaaaattcttaaa

SEQ ID NO: 5116250 - DNA, 19 bp, Homo sapiens
aatgaggaacaatcacaaa

SEQ ID NO: 5116251 - DNA, 16 bp, Homo sapiens
aatgaggacttcaagc

SEQ ID NO: 5116252 - DNA, 14 bp, Homo sapiens
aatgaggagacaca

SEQ ID NO: 5116253 - DNA, 19 bp, Homo sapiens
aatgaggagagaaaatata

SEQ ID NO: 5116254 - DNA, 17 bp, Homo sapiens
aatgaggaggattgctt

SEQ ID NO: 5116255 - DNA, 21 bp, Homo sapiens
aatgaggcacatgacagtggt

SEQ ID NO: 5116256 - DNA, 15 bp, Homo sapiens
aatgaggcttgctga

SEQ ID NO: 5116257 - DNA, 15 bp, Homo sapiens
aatgagggaaacaaa

SEQ ID NO: 5116258 - DNA, 19 bp, Homo sapiens
aatgagggcgtgaaacaca

SEQ ID NO: 5116259 - DNA, 22 bp, Homo sapiens
aatgagggcgtgaaacacaata

SEQ ID NO: 5116260 - DNA, 13 bp, Homo sapiens
aatgagggctgag

SEQ ID NO: 5116261 - DNA, 23 bp, Homo sapiens
aatgaggggaagccattttccag

SEQ ID NO: 5116262 - DNA, 15 bp, Homo sapiens
aatgagggggctcag

SEQ ID NO: 5116263 - DNA, 18 bp, Homo sapiens
aatgagggtctcactgct

SEQ ID NO: 5116264 - DNA, 23 bp, Homo sapiens
aatgaggtagctgacacagaaaa

SEQ ID NO: 5116265 - DNA, 15 bp, Homo sapiens
aatgaggtcagcatg

SEQ ID NO: 5116266 - DNA, 19 bp, Homo sapiens
aatgaggtgcacacaataa

SEQ ID NO: 5116267 - DNA, 23 bp, Homo sapiens
aatgaggtgggaggtggaagaag

SEQ ID NO: 5116268 - DNA, 18 bp, Homo sapiens
aatgaggttatgagaaaa

SEQ ID NO: 5116269 - DNA, 19 bp, Homo sapiens
aatgaggttatgagaaaaa

SEQ ID NO: 5116270 - DNA, 22 bp, Homo sapiens
aatgaggtttttccaaacttag

SEQ ID NO: 5116271 - DNA, 17 bp, Homo sapiens
aatgagtaaaaactaga

SEQ ID NO: 5116272 - DNA, 12 bp, Homo sapiens
aatgagtaacat

SEQ ID NO: 5116273 - DNA, 17 bp, Homo sapiens
aatgagtatatgtaaca

SEQ ID NO: 5116274 - DNA, 14 bp, Homo sapiens
aatgagtcaatcag

SEQ ID NO: 5116275 - DNA, 21 bp, Homo sapiens
aatgagtcatttgtttaaaca

SEQ ID NO: 5116276 - DNA, 15 bp, Homo sapiens
aatgagtctgcataa

SEQ ID NO: 5116277 - DNA, 20 bp, Homo sapiens
aatgagtctgtaattttacg

SEQ ID NO: 5116278 - DNA, 19 bp, Homo sapiens
aatgagtgaagtattgctg

SEQ ID NO: 5116279 - DNA, 18 bp, Homo sapiens
aatgagtggccagcgcca

SEQ ID NO: 5116280 - DNA, 14 bp, Homo sapiens
aatgagtgtgaagg

SEQ ID NO: 5116281 - DNA, 12 bp, Homo sapiens
aatgagttacct

SEQ ID NO: 5116282 - DNA, 19 bp, Homo sapiens
aatgagttacctacatttt

SEQ ID NO: 5116283 - DNA, 22 bp, Homo sapiens
aatgagttgctggaaaatcata

SEQ ID NO: 5116284 - DNA, 14 bp, Homo sapiens
aatgagttgtgaaa

SEQ ID NO: 5116285 - DNA, 18 bp, Homo sapiens
aatgagtttaaaaaaata

SEQ ID NO: 5116286 - DNA, 21 bp, Homo sapiens
aatgagtttaaaaaaataaca

SEQ ID NO: 5116287 - DNA, 22 bp, Homo sapiens
aatgagtttaaaaaaataacat

SEQ ID NO: 5116288 - DNA, 19 bp, Homo sapiens
aatgagtttcttagacttt

SEQ ID NO: 5116289 - DNA, 14 bp, Homo sapiens
aatgagttttacaa

SEQ ID NO: 5116290 - DNA, 23 bp, Homo sapiens
aatgagttttacaaattcctttc

SEQ ID NO: 5116291 - DNA, 12 bp, Homo sapiens
aatgataaaaca

SEQ ID NO: 5116292 - DNA, 13 bp, Homo sapiens
aatgataaaacac

SEQ ID NO: 5116293 - DNA, 14 bp, Homo sapiens
aatgataaaacacc

SEQ ID NO: 5116294 - DNA, 14 bp, Homo sapiens
aatgataaaataaa

SEQ ID NO: 5116295 - DNA, 15 bp, Homo sapiens
aatgataaaatccca

SEQ ID NO: 5116296 - DNA, 14 bp, Homo sapiens
aatgataaagactt

SEQ ID NO: 5116297 - DNA, 16 bp, Homo sapiens
aatgataactggaaac

SEQ ID NO: 5116298 - DNA, 14 bp, Homo sapiens
aatgataacttgtt

SEQ ID NO: 5116299 - DNA, 15 bp, Homo sapiens
aatgataagcaggaa

SEQ ID NO: 5116300 - DNA, 20 bp, Homo sapiens
aatgataatattgtggtgcc

SEQ ID NO: 5116301 - DNA, 18 bp, Homo sapiens
aatgataatcccaccacc

SEQ ID NO: 5116302 - DNA, 15 bp, Homo sapiens
aatgatactgattat

SEQ ID NO: 5116303 - DNA, 19 bp, Homo sapiens
aatgatagaactgtactgt

SEQ ID NO: 5116304 - DNA, 13 bp, Homo sapiens
aatgatagaactt

SEQ ID NO: 5116305 - DNA, 15 bp, Homo sapiens
aatgatagcccagaa

SEQ ID NO: 5116306 - DNA, 18 bp, Homo sapiens
aatgatagtaagaaaagt

SEQ ID NO: 5116307 - DNA, 21 bp, Homo sapiens
aatgatagtgttttgtacttg

SEQ ID NO: 5116308 - DNA, 20 bp, Homo sapiens
aatgatataggaaaatacat

SEQ ID NO: 5116309 - DNA, 21 bp, Homo sapiens
aatgatataggaaaatacatt

SEQ ID NO: 5116310 - DNA, 17 bp, Homo sapiens
aatgatatatggataat

SEQ ID NO: 5116311 - DNA, 15 bp, Homo sapiens
aatgatatccagtaa

SEQ ID NO: 5116312 - DNA, 15 bp, Homo sapiens
aatgatatctatatt

SEQ ID NO: 5116313 - DNA, 22 bp, Homo sapiens
aatgatatctatattctaaaga

SEQ ID NO: 5116314 - DNA, 15 bp, Homo sapiens
aatgatatgctagaa

SEQ ID NO: 5116315 - DNA, 15 bp, Homo sapiens
aatgatcaaagtttt

SEQ ID NO: 5116316 - DNA, 16 bp, Homo sapiens
aatgatcaaattttga

SEQ ID NO: 5116317 - DNA, 21 bp, Homo sapiens
aatgatcacatctaaagcttt

SEQ ID NO: 5116318 - DNA, 13 bp, Homo sapiens
aatgatcagactt

SEQ ID NO: 5116319 - DNA, 17 bp, Homo sapiens
aatgatcagcatctgtg

SEQ ID NO: 5116320 - DNA, 21 bp, Homo sapiens
aatgatcagctatatactatt

SEQ ID NO: 5116321 - DNA, 16 bp, Homo sapiens
aatgatcataagtcta

SEQ ID NO: 5116322 - DNA, 22 bp, Homo sapiens
aatgatcattgaaagtaaaaaa

SEQ ID NO: 5116323 - DNA, 16 bp, Homo sapiens
aatgatccccagctgt

SEQ ID NO: 5116324 - DNA, 19 bp, Homo sapiens
aatgatccccagctgttta

SEQ ID NO: 5116325 - DNA, 15 bp, Homo sapiens
aatgatcctcagtgc

SEQ ID NO: 5116326 - DNA, 11 bp, Homo sapiens
aatgatcctgc

SEQ ID NO: 5116327 - DNA, 17 bp, Homo sapiens
aatgatccttatgatgt

SEQ ID NO: 5116328 - DNA, 18 bp, Homo sapiens
aatgatcgaaaaaataat

SEQ ID NO: 5116329 - DNA, 23 bp, Homo sapiens
aatgatcgaaaaaataattattt

SEQ ID NO: 5116330 - DNA, 13 bp, Homo sapiens
aatgatctaggtt

SEQ ID NO: 5116331 - DNA, 14 bp, Homo sapiens
aatgatctaggttt

SEQ ID NO: 5116332 - DNA, 19 bp, Homo sapiens
aatgatctaggtttaactc

SEQ ID NO: 5116333 - DNA, 23 bp, Homo sapiens
aatgatctagttcagaaggaagc

SEQ ID NO: 5116334 - DNA, 12 bp, Homo sapiens
aatgatctattc

SEQ ID NO: 5116335 - DNA, 14 bp, Homo sapiens
aatgatctattgct

SEQ ID NO: 5116336 - DNA, 21 bp, Homo sapiens
aatgatctcggatgaccaaac

SEQ ID NO: 5116337 - DNA, 23 bp, Homo sapiens
aatgatctcggatgaccaaacca

SEQ ID NO: 5116338 - DNA, 22 bp, Homo sapiens
aatgatctctctgaatcctaag

SEQ ID NO: 5116339 - DNA, 16 bp, Homo sapiens
aatgatctcttctttt

SEQ ID NO: 5116340 - DNA, 20 bp, Homo sapiens
aatgatctggtggttattta

SEQ ID NO: 5116341 - DNA, 16 bp, Homo sapiens
aatgatcttccaaata

SEQ ID NO: 5116342 - DNA, 17 bp, Homo sapiens
aatgatcttttcaagtt

SEQ ID NO: 5116343 - DNA, 18 bp, Homo sapiens
aatgatgacccactaaag

SEQ ID NO: 5116344 - DNA, 19 bp, Homo sapiens
aatgatgacccactaaaga

SEQ ID NO: 5116345 - DNA, 15 bp, Homo sapiens
aatgatgacttgagc

SEQ ID NO: 5116346 - DNA, 15 bp, Homo sapiens
aatgatgagcattta

SEQ ID NO: 5116347 - DNA, 16 bp, Homo sapiens
aatgatgataatcatc

SEQ ID NO: 5116348 - DNA, 20 bp, Homo sapiens
aatgatgatgggaattgtgt

SEQ ID NO: 5116349 - DNA, 20 bp, Homo sapiens
aatgatgattaaacacctga

SEQ ID NO: 5116350 - DNA, 18 bp, Homo sapiens
aatcatcaagaagggctg

SEQ ID NO: 5116351 - DNA, 20 bp, Homo sapiens
aatcatccatccttgccaat

SEQ ID NO: 5116352 - DNA, 18 bp, Homo sapiens
aatcatccctccttgcct

SEQ ID NO: 5116353 - DNA, 19 bp, Homo sapiens
aatcatccctccttgccta

SEQ ID NO: 5116354 - DNA, 18 bp, Homo sapiens
aatcatcctcatgccttt

SEQ ID NO: 5116355 - DNA, 24 bp, Homo sapiens
aatcatcggagtcagccaggagct

SEQ ID NO: 5116356 - DNA, 14 bp, Homo sapiens
aatcatctaagtca

SEQ ID NO: 5116357 - DNA, 15 bp, Homo sapiens
aatcatctataaaga

SEQ ID NO: 5116358 - DNA, 18 bp, Homo sapiens
aatcatctataaagaaga

SEQ ID NO: 5116359 - DNA, 12 bp, Homo sapiens
aatcatctattt

SEQ ID NO: 5116360 - DNA, 15 bp, Homo sapiens
aatcatctattttga

SEQ ID NO: 5116361 - DNA, 19 bp, Homo sapiens
aatcatctattttgatgca

SEQ ID NO: 5116362 - DNA, 18 bp, Homo sapiens
aatcatctgcattcctga

SEQ ID NO: 5116363 - DNA, 14 bp, Homo sapiens
aatcatcttctctt

SEQ ID NO: 5116364 - DNA, 13 bp, Homo sapiens
aatcatctttgtt

SEQ ID NO: 5116365 - DNA, 17 bp, Homo sapiens
aatcatgaaatatgcat

SEQ ID NO: 5116366 - DNA, 22 bp, Homo sapiens
aatcatgaacagctctgagatc

SEQ ID NO: 5116367 - DNA, 19 bp, Homo sapiens
aatcatgaatctttgtttc

SEQ ID NO: 5116368 - DNA, 12 bp, Homo sapiens
aatcatgaatta

SEQ ID NO: 5116369 - DNA, 21 bp, Homo sapiens
aatcatgagaaaaactgttct

SEQ ID NO: 5116370 - DNA, 16 bp, Homo sapiens
aatcatgagcctgctg

SEQ ID NO: 5116371 - DNA, 14 bp, Homo sapiens
aatcatgagcctgt

SEQ ID NO: 5116372 - DNA, 18 bp, Homo sapiens
aatcatgagcctgtttat

SEQ ID NO: 5116373 - DNA, 21 bp, Homo sapiens
aatcatgagcctgtttattgc

SEQ ID NO: 5116374 - DNA, 22 bp, Homo sapiens
aatcatgagcctgtttattgcc

SEQ ID NO: 5116375 - DNA, 19 bp, Homo sapiens
aatcatgagtacctcaaag

SEQ ID NO: 5116376 - DNA, 18 bp, Homo sapiens
aatcatgagtcagacatt

SEQ ID NO: 5116377 - DNA, 22 bp, Homo sapiens
aatcatgatctgactttaattg

SEQ ID NO: 5116378 - DNA, 17 bp, Homo sapiens
aatcatgccagtatttt

SEQ ID NO: 5116379 - DNA, 18 bp, Homo sapiens
aatcatggaatggttata

SEQ ID NO: 5116380 - DNA, 15 bp, Homo sapiens
aatcatggatttatt

SEQ ID NO: 5116381 - DNA, 23 bp, Homo sapiens
aatcatggatttattttttgtaa

SEQ ID NO: 5116382 - DNA, 18 bp, Homo sapiens
aatcatggctcttagaaa

SEQ ID NO: 5116383 - DNA, 21 bp, Homo sapiens
aatcatggctgattgcagcct

SEQ ID NO: 5116384 - DNA, 15 bp, Homo sapiens
aatcatgggttcctc

SEQ ID NO: 5116385 - DNA, 18 bp, Homo sapiens
aatcatggtcaagttccc

SEQ ID NO: 5116386 - DNA, 20 bp, Homo sapiens
aatcatggtcaagttcccaa

SEQ ID NO: 5116387 - DNA, 17 bp, Homo sapiens
aatcatgtatgttatga

SEQ ID NO: 5116388 - DNA, 13 bp, Homo sapiens
aatcatgtatttt

SEQ ID NO: 5116389 - DNA, 14 bp, Homo sapiens
aatcatgtattttg

SEQ ID NO: 5116390 - DNA, 19 bp, Homo sapiens
aatcatgtccatacacttt

SEQ ID NO: 5116391 - DNA, 15 bp, Homo sapiens
aatcatgtccatccc

SEQ ID NO: 5116392 - DNA, 15 bp, Homo sapiens
aatcatgtgaacccg

SEQ ID NO: 5116393 - DNA, 19 bp, Homo sapiens
aatcatgtgggtgagccag

SEQ ID NO: 5116394 - DNA, 13 bp, Homo sapiens
aatcatgtgtgtt

SEQ ID NO: 5116395 - DNA, 22 bp, Homo sapiens
aatcatgttgatcatgtacttt

SEQ ID NO: 5116396 - DNA, 13 bp, Homo sapiens
aatcatgtttctt

SEQ ID NO: 5116397 - DNA, 12 bp, Homo sapiens
aatcatgtttta

SEQ ID NO: 5116398 - DNA, 21 bp, Homo sapiens
aatcattaatttcaaaattta

SEQ ID NO: 5116399 - DNA, 17 bp, Homo sapiens
aatcattaggtgtgact

SEQ ID NO: 5116400 - DNA, 23 bp, Homo sapiens
aatcattaggtgtgactgaattt

SEQ ID NO: 5116401 - DNA, 14 bp, Homo sapiens
aatcattatgtttc

SEQ ID NO: 5116402 - DNA, 20 bp, Homo sapiens
aatcattatttattaaattt

SEQ ID NO: 5116403 - DNA, 22 bp, Homo sapiens
aatcattatttattaaattttt

SEQ ID NO: 5116404 - DNA, 12 bp, Homo sapiens
aatcattatttg

SEQ ID NO: 5116405 - DNA, 18 bp, Homo sapiens
aatcattcaaaactttca

SEQ ID NO: 5116406 - DNA, 14 bp, Homo sapiens
aatcattcagaaat

SEQ ID NO: 5116407 - DNA, 16 bp, Homo sapiens
aatcattccagtgcta

SEQ ID NO: 5116408 - DNA, 14 bp, Homo sapiens
aatcattccttaga

SEQ ID NO: 5116409 - DNA, 23 bp, Homo sapiens
aatcattgaagtatattcttatt

SEQ ID NO: 5116410 - DNA, 19 bp, Homo sapiens
aatcattgactaaagccat

SEQ ID NO: 5116411 - DNA, 16 bp, Homo sapiens
aatcattgtacagttt

SEQ ID NO: 5116412 - DNA, 20 bp, Homo sapiens
aatcattgtacagtttgttt

SEQ ID NO: 5116413 - DNA, 16 bp, Homo sapiens
aatcattgtcagagat

SEQ ID NO: 5116414 - DNA, 15 bp, Homo sapiens
aatcattgtccagag

SEQ ID NO: 5116415 - DNA, 20 bp, Homo sapiens
aatcattgtgcttaataata

SEQ ID NO: 5116416 - DNA, 18 bp, Homo sapiens
aatcattgttttgaatat

SEQ ID NO: 5116417 - DNA, 19 bp, Homo sapiens
aatcattgttttgaatatt

SEQ ID NO: 5116418 - DNA, 20 bp, Homo sapiens
aatcatttatctggattttt

SEQ ID NO: 5116419 - DNA, 14 bp, Homo sapiens
aatcatttatctta

SEQ ID NO: 5116420 - DNA, 19 bp, Homo sapiens
aatcatttatcttatctag

SEQ ID NO: 5116421 - DNA, 13 bp, Homo sapiens
aatcatttattca

SEQ ID NO: 5116422 - DNA, 21 bp, Homo sapiens
aatcatttccagcaaaatata

SEQ ID NO: 5116423 - DNA, 22 bp, Homo sapiens
aatcatttccagcaaaatatat

SEQ ID NO: 5116424 - DNA, 16 bp, Homo sapiens
aatcatttctcactgt

SEQ ID NO: 5116425 - DNA, 22 bp, Homo sapiens
aatcatttctgcatcagctgct

SEQ ID NO: 5116426 - DNA, 14 bp, Homo sapiens
aatcatttgctttt

SEQ ID NO: 5116427 - DNA, 14 bp, Homo sapiens
aatcatttggttaa

SEQ ID NO: 5116428 - DNA, 17 bp, Homo sapiens
aatcatttggttaaatc

SEQ ID NO: 5116429 - DNA, 11 bp, Homo sapiens
aatcatttgtt

SEQ ID NO: 5116430 - DNA, 14 bp, Homo sapiens
aatcatttgtttac

SEQ ID NO: 5116431 - DNA, 15 bp, Homo sapiens
aatcattttaaattc

SEQ ID NO: 5116432 - DNA, 22 bp, Homo sapiens
aatcattttaattattattctt

SEQ ID NO: 5116433 - DNA, 13 bp, Homo sapiens
aatcattttagaa

SEQ ID NO: 5116434 - DNA, 12 bp, Homo sapiens
aatcattttata

SEQ ID NO: 5116435 - DNA, 13 bp, Homo sapiens
aatcattttcatt

SEQ ID NO: 5116436 - DNA, 18 bp, Homo sapiens
aatcattttcattcctaa

SEQ ID NO: 5116437 - DNA, 16 bp, Homo sapiens
aatcattttccttttt

SEQ ID NO: 5116438 - DNA, 12 bp, Homo sapiens
aatcattttgat

SEQ ID NO: 5116439 - DNA, 14 bp, Homo sapiens
aatcattttgatgt

SEQ ID NO: 5116440 - DNA, 16 bp, Homo sapiens
aatcattttgggaaat

SEQ ID NO: 5116441 - DNA, 16 bp, Homo sapiens
aatcatttttcactgt

SEQ ID NO: 5116442 - DNA, 13 bp, Homo sapiens
aatcatttttgta

SEQ ID NO: 5116443 - DNA, 19 bp, Homo sapiens
aatcattttttatatatat

SEQ ID NO: 5116444 - DNA, 22 bp, Homo sapiens
aatccaaaaagctctgaaaaca

SEQ ID NO: 5116445 - DNA, 17 bp, Homo sapiens
aatccaaaacttctctt

SEQ ID NO: 5116446 - DNA, 16 bp, Homo sapiens
aatccaaaagaaaaac

SEQ ID NO: 5116447 - DNA, 16 bp, Homo sapiens
aatccaaaagacaaaa

SEQ ID NO: 5116448 - DNA, 20 bp, Homo sapiens
aatccaaaatagtcatgttt

SEQ ID NO: 5116449 - DNA, 16 bp, Homo sapiens
aatccaaactgctgtc

SEQ ID NO: 5116450 - DNA, 21 bp, Homo sapiens
aatccaaacttggatttttga

SEQ ID NO: 5116451 - DNA, 10 bp, Homo sapiens
aatccaaaga

SEQ ID NO: 5116452 - DNA, 15 bp, Homo sapiens
aatccaaagaactat

SEQ ID NO: 5116453 - DNA, 11 bp, Homo sapiens
aatccaaagat

SEQ ID NO: 5116454 - DNA, 16 bp, Homo sapiens
aatccaaatattgtta

SEQ ID NO: 5116455 - DNA, 21 bp, Homo sapiens
aatccaaatattgttaaggga

SEQ ID NO: 5116456 - DNA, 17 bp, Homo sapiens
aatccaaatctgtcctc

SEQ ID NO: 5116457 - DNA, 19 bp, Homo sapiens
aatccaaatctgtcctctg

SEQ ID NO: 5116458 - DNA, 13 bp, Homo sapiens
aatccaaatggcg

SEQ ID NO: 5116459 - DNA, 20 bp, Homo sapiens
aatccaaatggcgtctggaa

SEQ ID NO: 5116460 - DNA, 19 bp, Homo sapiens
aatccaaatgtgaaagatg

SEQ ID NO: 5116461 - DNA, 15 bp, Homo sapiens
aatccaaattccctc

SEQ ID NO: 5116462 - DNA, 15 bp, Homo sapiens
aatccaaatttctca

SEQ ID NO: 5116463 - DNA, 22 bp, Homo sapiens
aatccaagatattttaaaatct

SEQ ID NO: 5116464 - DNA, 23 bp, Homo sapiens
aatccaagcgaggtcaacagaga

SEQ ID NO: 5116465 - DNA, 14 bp, Homo sapiens
aatccaagctccct

SEQ ID NO: 5116466 - DNA, 19 bp, Homo sapiens
aatccaagctccctgcccc

SEQ ID NO: 5116467 - DNA, 22 bp, Homo sapiens
aatccaagggttgagagccagt

SEQ ID NO: 5116468 - DNA, 19 bp, Homo sapiens
aatccaatactgcccaagg

SEQ ID NO: 5116469 - DNA, 19 bp, Homo sapiens
aatccaatattttgccttt

SEQ ID NO: 5116470 - DNA, 23 bp, Homo sapiens
aatccaatcaatttaaatgttta

SEQ ID NO: 5116471 - DNA, 15 bp, Homo sapiens
aatccaatgaaatga

SEQ ID NO: 5116472 - DNA, 17 bp, Homo sapiens
aatccaatgcactgatg

SEQ ID NO: 5116473 - DNA, 21 bp, Homo sapiens
aatccacaaagccgtgccttt

SEQ ID NO: 5116474 - DNA, 13 bp, Homo sapiens
aatccacacatca

SEQ ID NO: 5116475 - DNA, 14 bp, Homo sapiens
aatccacagtattg

SEQ ID NO: 5116476 - DNA, 19 bp, Homo sapiens
aatccacagtattgttctt

SEQ ID NO: 5116477 - DNA, 13 bp, Homo sapiens
aatccacataaaa

SEQ ID NO: 5116478 - DNA, 15 bp, Homo sapiens
aatccacatctttac

SEQ ID NO: 5116479 - DNA, 16 bp, Homo sapiens
aatccacatttctaaa

SEQ ID NO: 5116480 - DNA, 23 bp, Homo sapiens
aatccacccagcccactaactga

SEQ ID NO: 5116481 - DNA, 12 bp, Homo sapiens
aatccacccatc

SEQ ID NO: 5116482 - DNA, 23 bp, Homo sapiens
aatccacccatcctaccaatgca

SEQ ID NO: 5116483 - DNA, 11 bp, Homo sapiens
aatccacctcg

SEQ ID NO: 5116484 - DNA, 18 bp, Homo sapiens
aatccaccttcaggcccc

SEQ ID NO: 5116485 - DNA, 18 bp, Homo sapiens
aatccactcccaggcagc

SEQ ID NO: 5116486 - DNA, 15 bp, Homo sapiens
aatccactctcagga

SEQ ID NO: 5116487 - DNA, 17 bp, Homo sapiens
aatccagaaagaaaaaa

SEQ ID NO: 5116488 - DNA, 18 bp, Homo sapiens
aatccagagaagcgctgt

SEQ ID NO: 5116489 - DNA, 18 bp, Homo sapiens
aatccagagagcttaaat

SEQ ID NO: 5116490 - DNA, 22 bp, Homo sapiens
aatccagatctgggattatgta

SEQ ID NO: 5116491 - DNA, 22 bp, Homo sapiens
aatccagcattgttgagctgtc

SEQ ID NO: 5116492 - DNA, 19 bp, Homo sapiens
aatccagccccatagaaaa

SEQ ID NO: 5116493 - DNA, 12 bp, Homo sapiens
aatccagctccc

SEQ ID NO: 5116494 - DNA, 13 bp, Homo sapiens
aatccagctccct

SEQ ID NO: 5116495 - DNA, 23 bp, Homo sapiens
aatccaggactttgttaacttca

SEQ ID NO: 5116496 - DNA, 17 bp, Homo sapiens
aatccaggaggcagtgg

SEQ ID NO: 5116497 - DNA, 16 bp, Homo sapiens
aatccaggcacagctg

SEQ ID NO: 5116498 - DNA, 17 bp, Homo sapiens
aatccaggcagatccag

SEQ ID NO: 5116499 - DNA, 18 bp, Homo sapiens
aatccaggcagatccagg

SEQ ID NO: 5116500 - DNA, 22 bp, Homo sapiens
aatccaggcagatccaggacta

SEQ ID NO: 5116501 - DNA, 14 bp, Homo sapiens
aatccaggctgttc

SEQ ID NO: 5116502 - DNA, 17 bp, Homo sapiens
aatccaggctgttctca

SEQ ID NO: 5116503 - DNA, 20 bp, Homo sapiens
aatccaggtacgcacagaca

SEQ ID NO: 5116504 - DNA, 16 bp, Homo sapiens
aatccaggtgggagag

SEQ ID NO: 5116505 - DNA, 17 bp, Homo sapiens
aatccaggtgggagaga

SEQ ID NO: 5116506 - DNA, 22 bp, Homo sapiens
aatccaggtgggagagacactc

SEQ ID NO: 5116507 - DNA, 23 bp, Homo sapiens
aatccagtgcttccacagagatt

SEQ ID NO: 5116508 - DNA, 14 bp, Homo sapiens
aatccagtggtggg

SEQ ID NO: 5116509 - DNA, 18 bp, Homo sapiens
aatccagtggtgggtaat

SEQ ID NO: 5116510 - DNA, 22 bp, Homo sapiens
aatccataaactaagagaaact

SEQ ID NO: 5116511 - DNA, 15 bp, Homo sapiens
aatccataaatgtgt

SEQ ID NO: 5116512 - DNA, 13 bp, Homo sapiens
aatccatacattt

SEQ ID NO: 5116513 - DNA, 22 bp, Homo sapiens
aatccatactgtagacactctg

SEQ ID NO: 5116514 - DNA, 17 bp, Homo sapiens
aatccatatcagctctg

SEQ ID NO: 5116515 - DNA, 15 bp, Homo sapiens
aatccatcagcaatg

SEQ ID NO: 5116516 - DNA, 17 bp, Homo sapiens
aatccatccatgtactt

SEQ ID NO: 5116517 - DNA, 21 bp, Homo sapiens
aatccatcctgcaaaggccct

SEQ ID NO: 5116518 - DNA, 17 bp, Homo sapiens
aatccatcctgctcttc

SEQ ID NO: 5116519 - DNA, 13 bp, Homo sapiens
aatccatcgattt

SEQ ID NO: 5116520 - DNA, 21 bp, Homo sapiens
aatccatctaaatacctgccc

SEQ ID NO: 5116521 - DNA, 23 bp, Homo sapiens
aatccatctaaatacctgccctg

SEQ ID NO: 5116522 - DNA, 22 bp, Homo sapiens
aatccatgatcaaaatgcatac

SEQ ID NO: 5116523 - DNA, 22 bp, Homo sapiens
aatccatgccataagcaggagt

SEQ ID NO: 5116524 - DNA, 15 bp, Homo sapiens
aatccatgcttgggt

SEQ ID NO: 5116525 - DNA, 21 bp, Homo sapiens
aatccatggacctatgacagg

SEQ ID NO: 5116526 - DNA, 16 bp, Homo sapiens
aatccatgggtctggc

SEQ ID NO: 5116527 - DNA, 16 bp, Homo sapiens
aatccatgtaaggtat

SEQ ID NO: 5116528 - DNA, 21 bp, Homo sapiens
aatccattcacaagcctcctg

SEQ ID NO: 5116529 - DNA, 15 bp, Homo sapiens
aatgatgattatgga

SEQ ID NO: 5116530 - DNA, 20 bp, Homo sapiens
aatgatgattcaatcatttt

SEQ ID NO: 5116531 - DNA, 14 bp, Homo sapiens
aatgatgcaaccaa

SEQ ID NO: 5116532 - DNA, 12 bp, Homo sapiens
aatgatgcacat

SEQ ID NO: 5116533 - DNA, 13 bp, Homo sapiens
aatgatgcacatt

SEQ ID NO: 5116534 - DNA, 15 bp, Homo sapiens
aatgatgccaaaata

SEQ ID NO: 5116535 - DNA, 17 bp, Homo sapiens
aatgatgccctgctcca

SEQ ID NO: 5116536 - DNA, 15 bp, Homo sapiens
aatgatggaagttca

SEQ ID NO: 5116537 - DNA, 12 bp, Homo sapiens
aatgatggaatt

SEQ ID NO: 5116538 - DNA, 22 bp, Homo sapiens
aatgatggacccaatgcacaca

SEQ ID NO: 5116539 - DNA, 22 bp, Homo sapiens
aatgatggatcaccattatatt

SEQ ID NO: 5116540 - DNA, 18 bp, Homo sapiens
aatgatggatttaacagc

SEQ ID NO: 5116541 - DNA, 14 bp, Homo sapiens
aatgatggcagagg

SEQ ID NO: 5116542 - DNA, 21 bp, Homo sapiens
aatgatggcagtggtttgaaa

SEQ ID NO: 5116543 - DNA, 20 bp, Homo sapiens
aatgatggcccattctactt

SEQ ID NO: 5116544 - DNA, 21 bp, Homo sapiens
aatgatggcccattctacttg

SEQ ID NO: 5116545 - DNA, 12 bp, Homo sapiens
aatgatggtaaa

SEQ ID NO: 5116546 - DNA, 23 bp, Homo sapiens
aatgatgtatgttgaagcctttg

SEQ ID NO: 5116547 - DNA, 15 bp, Homo sapiens
aatgatgtgcaaaac

SEQ ID NO: 5116548 - DNA, 21 bp, Homo sapiens
aatgatgtgtacccaaacgtg

SEQ ID NO: 5116549 - DNA, 12 bp, Homo sapiens
aatgatgtgtca

SEQ ID NO: 5116550 - DNA, 12 bp, Homo sapiens
aatgatgttata

SEQ ID NO: 5116551 - DNA, 19 bp, Homo sapiens
aatgatgttatacatcaat

SEQ ID NO: 5116552 - DNA, 14 bp, Homo sapiens
aatgatgttgataa

SEQ ID NO: 5116553 - DNA, 16 bp, Homo sapiens
aatgatgttgataatt

SEQ ID NO: 5116554 - DNA, 14 bp, Homo sapiens
aatgatgttttaaa

SEQ ID NO: 5116555 - DNA, 22 bp, Homo sapiens
aatgatgttttaaaaaaatttg

SEQ ID NO: 5116556 - DNA, 20 bp, Homo sapiens
aatgattaagggacatttct

SEQ ID NO: 5116557 - DNA, 23 bp, Homo sapiens
aatgattaagggacatttctata

SEQ ID NO: 5116558 - DNA, 17 bp, Homo sapiens
aatgattaatcaaaggc

SEQ ID NO: 5116559 - DNA, 12 bp, Homo sapiens
aatgattaatta

SEQ ID NO: 5116560 - DNA, 13 bp, Homo sapiens
aatgattaattaa

SEQ ID NO: 5116561 - DNA, 13 bp, Homo sapiens
aatgattagaagt

SEQ ID NO: 5116562 - DNA, 14 bp, Homo sapiens
aatgattatagata

SEQ ID NO: 5116563 - DNA, 16 bp, Homo sapiens
aatgattatagataaa

SEQ ID NO: 5116564 - DNA, 19 bp, Homo sapiens
aatgattatagataaatat

SEQ ID NO: 5116565 - DNA, 18 bp, Homo sapiens
aatgattatattcacaga

SEQ ID NO: 5116566 - DNA, 21 bp, Homo sapiens
aatgattatattcacagactg

SEQ ID NO: 5116567 - DNA, 21 bp, Homo sapiens
aatgattatgaattacatttg

SEQ ID NO: 5116568 - DNA, 22 bp, Homo sapiens
aatgattatgattagttatgtc

SEQ ID NO: 5116569 - DNA, 14 bp, Homo sapiens
aatgattattttca

SEQ ID NO: 5116570 - DNA, 15 bp, Homo sapiens
aatgattcaatgtga

SEQ ID NO: 5116571 - DNA, 20 bp, Homo sapiens
aatgattcagggttatttga

SEQ ID NO: 5116572 - DNA, 13 bp, Homo sapiens
aatgattcagtgt

SEQ ID NO: 5116573 - DNA, 19 bp, Homo sapiens
aatgattcataacaatgta

SEQ ID NO: 5116574 - DNA, 13 bp, Homo sapiens
aatgattcatctt

SEQ ID NO: 5116575 - DNA, 11 bp, Homo sapiens
aatgattccaa

SEQ ID NO: 5116576 - DNA, 12 bp, Homo sapiens
aatgattcttcc

SEQ ID NO: 5116577 - DNA, 12 bp, Homo sapiens
aatgattgatta

SEQ ID NO: 5116578 - DNA, 14 bp, Homo sapiens
aatgattgtaaaat

SEQ ID NO: 5116579 - DNA, 13 bp, Homo sapiens
aatgattgtcttt

SEQ ID NO: 5116580 - DNA, 18 bp, Homo sapiens
aatgattgtttaaaggtt

SEQ ID NO: 5116581 - DNA, 14 bp, Homo sapiens
aatgatttaaattt

SEQ ID NO: 5116582 - DNA, 20 bp, Homo sapiens
aatgatttaagcattttact

SEQ ID NO: 5116583 - DNA, 13 bp, Homo sapiens
aatgatttagtgt

SEQ ID NO: 5116584 - DNA, 16 bp, Homo sapiens
aatgatttcaaaatga

SEQ ID NO: 5116585 - DNA, 13 bp, Homo sapiens
aatgatttcatat

SEQ ID NO: 5116586 - DNA, 16 bp, Homo sapiens
aatgatttcatattga

SEQ ID NO: 5116587 - DNA, 16 bp, Homo sapiens
aatgatttcattcaat

SEQ ID NO: 5116588 - DNA, 19 bp, Homo sapiens
aatgatttccacaaacaga

SEQ ID NO: 5116589 - DNA, 20 bp, Homo sapiens
aatgatttcctctgtaatct

SEQ ID NO: 5116590 - DNA, 15 bp, Homo sapiens
aatgatttgctcttt

SEQ ID NO: 5116591 - DNA, 13 bp, Homo sapiens
aatgattttggaa

SEQ ID NO: 5116592 - DNA, 13 bp, Homo sapiens
aatgatttttaaa

SEQ ID NO: 5116593 - DNA, 17 bp, Homo sapiens
aatgatttttctttaca

SEQ ID NO: 5116594 - DNA, 12 bp, Homo sapiens
aatgcaaaaaaa

SEQ ID NO: 5116595 - DNA, 15 bp, Homo sapiens
aatgcaaaaaagaaa

SEQ ID NO: 5116596 - DNA, 14 bp, Homo sapiens
aatgcaaaaaatct

SEQ ID NO: 5116597 - DNA, 17 bp, Homo sapiens
aatgcaaaatgaaataa

SEQ ID NO: 5116598 - DNA, 12 bp, Homo sapiens
aatgcaaaccat

SEQ ID NO: 5116599 - DNA, 14 bp, Homo sapiens
aatgcaaaccatca

SEQ ID NO: 5116600 - DNA, 16 bp, Homo sapiens
aatgcaaaccatcatt

SEQ ID NO: 5116601 - DNA, 21 bp, Homo sapiens
aatgcaaagatgaaggtctgt

SEQ ID NO: 5116602 - DNA, 13 bp, Homo sapiens
aatgcaaataaca

SEQ ID NO: 5116603 - DNA, 14 bp, Homo sapiens
aatgcaaataacaa

SEQ ID NO: 5116604 - DNA, 16 bp, Homo sapiens
aatgcaaataacaaat

SEQ ID NO: 5116605 - DNA, 16 bp, Homo sapiens
aatgcaaatattgcta

SEQ ID NO: 5116606 - DNA, 18 bp, Homo sapiens
aatgcaaatgaatcattg

SEQ ID NO: 5116607 - DNA, 18 bp, Homo sapiens
aatgcaaattaaaacata

SEQ ID NO: 5116608 - DNA, 15 bp, Homo sapiens
aatgcaaattaaagg

SEQ ID NO: 5116609 - DNA, 14 bp, Homo sapiens
aatgcaaattctca

SEQ ID NO: 5116610 - DNA, 15 bp, Homo sapiens
aatgcaacaacatgt

SEQ ID NO: 5116611 - DNA, 18 bp, Homo sapiens
aatgcaacaacatgtata

SEQ ID NO: 5116612 - DNA, 14 bp, Homo sapiens
aatgcaacatgtgt

SEQ ID NO: 5116613 - DNA, 21 bp, Homo sapiens
aatgcaaccagaattgtcctc

SEQ ID NO: 5116614 - DNA, 13 bp, Homo sapiens
aatgcaaccattt

SEQ ID NO: 5116615 - DNA, 20 bp, Homo sapiens
aatgcaactacccaaaacaa

SEQ ID NO: 5116616 - DNA, 20 bp, Homo sapiens
aatgcaactctaactctgag

SEQ ID NO: 5116617 - DNA, 19 bp, Homo sapiens
aatgcaagaatctcagaca

SEQ ID NO: 5116618 - DNA, 21 bp, Homo sapiens
aatgcaagattttccacaaga

SEQ ID NO: 5116619 - DNA, 15 bp, Homo sapiens
aatgcaagcaaagta

SEQ ID NO: 5116620 - DNA, 17 bp, Homo sapiens
aatgcaagctagtggct

SEQ ID NO: 5116621 - DNA, 22 bp, Homo sapiens
aatgcaagtgtttgaagtctgc

SEQ ID NO: 5116622 - DNA, 15 bp, Homo sapiens
aatgcaataaagagt

SEQ ID NO: 5116623 - DNA, 14 bp, Homo sapiens
aatgcaataactct

SEQ ID NO: 5116624 - DNA, 16 bp, Homo sapiens
aatgcaataactctgg

SEQ ID NO: 5116625 - DNA, 18 bp, Homo sapiens
aatgcaataactctggga

SEQ ID NO: 5116626 - DNA, 16 bp, Homo sapiens
aatgcaataagattta

SEQ ID NO: 5116627 - DNA, 16 bp, Homo sapiens
aatgcaataattttac

SEQ ID NO: 5116628 - DNA, 16 bp, Homo sapiens
aatgcaatagaagtgc

SEQ ID NO: 5116629 - DNA, 23 bp, Homo sapiens
aatgcaatagaagtgctcccctc

SEQ ID NO: 5116630 - DNA, 16 bp, Homo sapiens
aatgcaatattaatgc

SEQ ID NO: 5116631 - DNA, 14 bp, Homo sapiens
aatgcaatatttgt

SEQ ID NO: 5116632 - DNA, 13 bp, Homo sapiens
aatgcaatcaatt

SEQ ID NO: 5116633 - DNA, 21 bp, Homo sapiens
aatgcaatgataaataaagtc

SEQ ID NO: 5116634 - DNA, 16 bp, Homo sapiens
aatgcaatgcatctga

SEQ ID NO: 5116635 - DNA, 22 bp, Homo sapiens
aatgcaattgtcttgtaccttg

SEQ ID NO: 5116636 - DNA, 18 bp, Homo sapiens
aatgcaatttaaaattat

SEQ ID NO: 5116637 - DNA, 19 bp, Homo sapiens
aatgcacaaacagaggccg

SEQ ID NO: 5116638 - DNA, 20 bp, Homo sapiens
aatgcacaaacagaggccgc

SEQ ID NO: 5116639 - DNA, 17 bp, Homo sapiens
aatgcacaatgtcttgg

SEQ ID NO: 5116640 - DNA, 13 bp, Homo sapiens
aatgcacaattta

SEQ ID NO: 5116641 - DNA, 15 bp, Homo sapiens
aatgcacaatttaga

SEQ ID NO: 5116642 - DNA, 18 bp, Homo sapiens
aatgcacaatttagaaaa

SEQ ID NO: 5116643 - DNA, 24 bp, Homo sapiens
aatgcacacacacagagatatgca

SEQ ID NO: 5116644 - DNA, 22 bp, Homo sapiens
aatgcacacagcggctgcctcc

SEQ ID NO: 5116645 - DNA, 21 bp, Homo sapiens
aatgcacaccaaaaaaatact

SEQ ID NO: 5116646 - DNA, 13 bp, Homo sapiens
aatgcacactagc

SEQ ID NO: 5116647 - DNA, 18 bp, Homo sapiens
aatgcacagttctatttg

SEQ ID NO: 5116648 - DNA, 20 bp, Homo sapiens
aatgcacagttctatttgct

SEQ ID NO: 5116649 - DNA, 21 bp, Homo sapiens
aatgcacagttctatttgcta

SEQ ID NO: 5116650 - DNA, 19 bp, Homo sapiens
aatgcacatatagacacat

SEQ ID NO: 5116651 - DNA, 16 bp, Homo sapiens
aatgcacatccattcc

SEQ ID NO: 5116652 - DNA, 17 bp, Homo sapiens
aatgcacatccattccc

SEQ ID NO: 5116653 - DNA, 12 bp, Homo sapiens
aatgcacatcct

SEQ ID NO: 5116654 - DNA, 18 bp, Homo sapiens
aatgcacatcctcattca

SEQ ID NO: 5116655 - DNA, 21 bp, Homo sapiens
aatgcacattggaagctccca

SEQ ID NO: 5116656 - DNA, 17 bp, Homo sapiens
aatgcacatttcagaaa

SEQ ID NO: 5116657 - DNA, 19 bp, Homo sapiens
aatgcaccaatcttgttta

SEQ ID NO: 5116658 - DNA, 23 bp, Homo sapiens
aatgcaccaatcttgtttatagc

SEQ ID NO: 5116659 - DNA, 20 bp, Homo sapiens
aatgcacccatcagcactct

SEQ ID NO: 5116660 - DNA, 16 bp, Homo sapiens
aatgcacctaaagaaa

SEQ ID NO: 5116661 - DNA, 14 bp, Homo sapiens
aatgcacctcccca

SEQ ID NO: 5116662 - DNA, 16 bp, Homo sapiens
aatgcacctccccaaa

SEQ ID NO: 5116663 - DNA, 18 bp, Homo sapiens
aatgcacctcttgttact

SEQ ID NO: 5116664 - DNA, 11 bp, Homo sapiens
aatgcacggcc

SEQ ID NO: 5116665 - DNA, 13 bp, Homo sapiens
aatgcacggcctc

SEQ ID NO: 5116666 - DNA, 18 bp, Homo sapiens
aatgcacgtttcaaagct

SEQ ID NO: 5116667 - DNA, 16 bp, Homo sapiens
aatgcacttctattta

SEQ ID NO: 5116668 - DNA, 16 bp, Homo sapiens
aatgcactttgttctg

SEQ ID NO: 5116669 - DNA, 20 bp, Homo sapiens
aatgcactttgttctggctc

SEQ ID NO: 5116670 - DNA, 20 bp, Homo sapiens
aatgcacttttatgaagttt

SEQ ID NO: 5116671 - DNA, 21 bp, Homo sapiens
aatgcacttttatgaagtttt

SEQ ID NO: 5116672 - DNA, 15 bp, Homo sapiens
aatgcagaaatcacg

SEQ ID NO: 5116673 - DNA, 15 bp, Homo sapiens
aatgcagaagtattc

SEQ ID NO: 5116674 - DNA, 23 bp, Homo sapiens
aatgcagaatacttgactcattt

SEQ ID NO: 5116675 - DNA, 14 bp, Homo sapiens
aatgcagaattgct

SEQ ID NO: 5116676 - DNA, 13 bp, Homo sapiens
aatgcagacacac

SEQ ID NO: 5116677 - DNA, 16 bp, Homo sapiens
aatgcagacacacaac

SEQ ID NO: 5116678 - DNA, 17 bp, Homo sapiens
aatgcagacacacaaca

SEQ ID NO: 5116679 - DNA, 14 bp, Homo sapiens
aatgcagacattta

SEQ ID NO: 5116680 - DNA, 18 bp, Homo sapiens
aatgcagaggaggagaaa

SEQ ID NO: 5116681 - DNA, 20 bp, Homo sapiens
aatgcagattcctgggcctg

SEQ ID NO: 5116682 - DNA, 14 bp, Homo sapiens
aatgcagcactgct

SEQ ID NO: 5116683 - DNA, 23 bp, Homo sapiens
aatgcagcactgctgcctcagct

SEQ ID NO: 5116684 - DNA, 19 bp, Homo sapiens
aatgcagcaggaaggaaca

SEQ ID NO: 5116685 - DNA, 15 bp, Homo sapiens
aatgcagcccaccag

SEQ ID NO: 5116686 - DNA, 12 bp, Homo sapiens
aatgcagcccat

SEQ ID NO: 5116687 - DNA, 20 bp, Homo sapiens
aatgcagcttcaggtgagcc

SEQ ID NO: 5116688 - DNA, 16 bp, Homo sapiens
aatgcagcttgtgtgc

SEQ ID NO: 5116689 - DNA, 22 bp, Homo sapiens
aatgcagggattgctgccactt

SEQ ID NO: 5116690 - DNA, 22 bp, Homo sapiens
aatgcagtacaggacatatatt

SEQ ID NO: 5116691 - DNA, 18 bp, Homo sapiens
aatgcagtactaacattt

SEQ ID NO: 5116692 - DNA, 18 bp, Homo sapiens
aatgcagtataaaatgta

SEQ ID NO: 5116693 - DNA, 19 bp, Homo sapiens
aatgcagtataaaatgtaa

SEQ ID NO: 5116694 - DNA, 14 bp, Homo sapiens
aatgcagtatatag

SEQ ID NO: 5116695 - DNA, 19 bp, Homo sapiens
aatgcagtatggtacattt

SEQ ID NO: 5116696 - DNA, 22 bp, Homo sapiens
aatgcagtcagtgtttctttta

SEQ ID NO: 5116697 - DNA, 15 bp, Homo sapiens
aatgcagtcatgcaa

SEQ ID NO: 5116698 - DNA, 18 bp, Homo sapiens
aatgcagtccagaataag

SEQ ID NO: 5116699 - DNA, 21 bp, Homo sapiens
aatgcagtccagtgagaaatt

SEQ ID NO: 5116700 - DNA, 19 bp, Homo sapiens
aatgcagtctgtccaggct

SEQ ID NO: 5116701 - DNA, 16 bp, Homo sapiens
aatgcagtgacacaat

SEQ ID NO: 5116702 - DNA, 20 bp, Homo sapiens
aatgcagttgtggtgtgcca

SEQ ID NO: 5116703 - DNA, 16 bp, Homo sapiens
aatgcagtttcttcat

SEQ ID NO: 5116704 - DNA, 15 bp, Homo sapiens
aatgcagttttaaga

SEQ ID NO: 5116705 - DNA, 13 bp, Homo sapiens
aatgcataaataa

SEQ ID NO: 5116706 - DNA, 20 bp, Homo sapiens
aatgcataaatgcataattt

SEQ ID NO: 5116707 - DNA, 17 bp, Homo sapiens
aatgcataatgtcttta

SEQ ID NO: 5116708 - DNA, 17 bp, Homo sapiens
aatgcataatttatggt

SEQ ID NO: 5116709 - DNA, 18 bp, Homo sapiens
aatgcatacaataaaaga

SEQ ID NO: 5116710 - DNA, 18 bp, Homo sapiens
aatccattccaaaataca

SEQ ID NO: 5116711 - DNA, 13 bp, Homo sapiens
aatccatttagca

SEQ ID NO: 5116712 - DNA, 24 bp, Homo sapiens
aatccatttcaggactctctccag

SEQ ID NO: 5116713 - DNA, 15 bp, Homo sapiens
aatccatttggaaat

SEQ ID NO: 5116714 - DNA, 14 bp, Homo sapiens
aatccattttaaca

SEQ ID NO: 5116715 - DNA, 23 bp, Homo sapiens
aatccattttcactaaaagtgtg

SEQ ID NO: 5116716 - DNA, 13 bp, Homo sapiens
aatccattttcta

SEQ ID NO: 5116717 - DNA, 22 bp, Homo sapiens
aatccattttctaaactgtttt

SEQ ID NO: 5116718 - DNA, 14 bp, Homo sapiens
aatccattttttag

SEQ ID NO: 5116719 - DNA, 21 bp, Homo sapiens
aatcccaaaccattactgagg

SEQ ID NO: 5116720 - DNA, 22 bp, Homo sapiens
aatcccaaatcctatttaaaga

SEQ ID NO: 5116721 - DNA, 19 bp, Homo sapiens
aatcccaaattcactttat

SEQ ID NO: 5116722 - DNA, 22 bp, Homo sapiens
aatcccaatctttctatataaa

SEQ ID NO: 5116723 - DNA, 18 bp, Homo sapiens
aatcccacccacatgtga

SEQ ID NO: 5116724 - DNA, 19 bp, Homo sapiens
aatcccacctagcccagga

SEQ ID NO: 5116725 - DNA, 14 bp, Homo sapiens
aatcccactgtatg

SEQ ID NO: 5116726 - DNA, 18 bp, Homo sapiens
aatcccacttagcaggga

SEQ ID NO: 5116727 - DNA, 21 bp, Homo sapiens
aatcccacttagcagggacag

SEQ ID NO: 5116728 - DNA, 18 bp, Homo sapiens
aatcccacttatcaaatc

SEQ ID NO: 5116729 - DNA, 19 bp, Homo sapiens
aatcccacttcagtgcacc

SEQ ID NO: 5116730 - DNA, 17 bp, Homo sapiens
aatcccagactgacaga

SEQ ID NO: 5116731 - DNA, 14 bp, Homo sapiens
aatcccagcaattt

SEQ ID NO: 5116732 - DNA, 13 bp, Homo sapiens
aatcccagcactt

SEQ ID NO: 5116733 - DNA, 16 bp, Homo sapiens
aatcccagcactttgg

SEQ ID NO: 5116734 - DNA, 21 bp, Homo sapiens
aatcccagcattttgagaggc

SEQ ID NO: 5116735 - DNA, 19 bp, Homo sapiens
aatcccagccccctgacca

SEQ ID NO: 5116736 - DNA, 11 bp, Homo sapiens
aatcccagcta

SEQ ID NO: 5116737 - DNA, 12 bp, Homo sapiens
aatcccagctcc

SEQ ID NO: 5116738 - DNA, 13 bp, Homo sapiens
aatcccagctccg

SEQ ID NO: 5116739 - DNA, 14 bp, Homo sapiens
aatcccagctccgc

SEQ ID NO: 5116740 - DNA, 21 bp, Homo sapiens
aatcccagggaaggacttgga

SEQ ID NO: 5116741 - DNA, 17 bp, Homo sapiens
aatcccagtactttgga

SEQ ID NO: 5116742 - DNA, 22 bp, Homo sapiens
aatcccatctattctctgcctt

SEQ ID NO: 5116743 - DNA, 16 bp, Homo sapiens
aatcccattattcaaa

SEQ ID NO: 5116744 - DNA, 18 bp, Homo sapiens
aatcccattcataacttt

SEQ ID NO: 5116745 - DNA, 20 bp, Homo sapiens
aatcccattcataactttca

SEQ ID NO: 5116746 - DNA, 11 bp, Homo sapiens
aatccccagcc

SEQ ID NO: 5116747 - DNA, 17 bp, Homo sapiens
aatccccagtaaaattg

SEQ ID NO: 5116748 - DNA, 21 bp, Homo sapiens
aatccccagtaaaattgccat

SEQ ID NO: 5116749 - DNA, 19 bp, Homo sapiens
aatccccataatgcttctt

SEQ ID NO: 5116750 - DNA, 22 bp, Homo sapiens
aatccccatgcctgtggctgcg

SEQ ID NO: 5116751 - DNA, 20 bp, Homo sapiens
aatcccccagcgcttagaaa

SEQ ID NO: 5116752 - DNA, 14 bp, Homo sapiens
aatcccccaggaga

SEQ ID NO: 5116753 - DNA, 13 bp, Homo sapiens
aatcccccaggga

SEQ ID NO: 5116754 - DNA, 23 bp, Homo sapiens
aatccccccttcagaacagaggc

SEQ ID NO: 5116755 - DNA, 20 bp, Homo sapiens
aatccccgacccccctaccc

SEQ ID NO: 5116756 - DNA, 14 bp, Homo sapiens
aatcccctaaaata

SEQ ID NO: 5116757 - DNA, 14 bp, Homo sapiens
aatcccctcattca

SEQ ID NO: 5116758 - DNA, 19 bp, Homo sapiens
aatcccctcattcaggaaa

SEQ ID NO: 5116759 - DNA, 17 bp, Homo sapiens
aatccccttatgacttg

SEQ ID NO: 5116760 - DNA, 14 bp, Homo sapiens
aatccccttctccc

SEQ ID NO: 5116761 - DNA, 16 bp, Homo sapiens
aatcccgattcaccct

SEQ ID NO: 5116762 - DNA, 14 bp, Homo sapiens
aatcccggctccag

SEQ ID NO: 5116763 - DNA, 19 bp, Homo sapiens
aatcccggtttcagaagct

SEQ ID NO: 5116764 - DNA, 23 bp, Homo sapiens
aatccctagactttaggctttca

SEQ ID NO: 5116765 - DNA, 23 bp, Homo sapiens
aatccctagggctggcagaaagg

SEQ ID NO: 5116766 - DNA, 19 bp, Homo sapiens
aatccctcaccttctgagt

SEQ ID NO: 5116767 - DNA, 15 bp, Homo sapiens
aatccctctccaact

SEQ ID NO: 5116768 - DNA, 22 bp, Homo sapiens
aatccctcttcctccaaagcct

SEQ ID NO: 5116769 - DNA, 21 bp, Homo sapiens
aatccctgccactgggctctg

SEQ ID NO: 5116770 - DNA, 18 bp, Homo sapiens
aatccctgctcactgcag

SEQ ID NO: 5116771 - DNA, 14 bp, Homo sapiens
aatccctgcttttt

SEQ ID NO: 5116772 - DNA, 22 bp, Homo sapiens
aatccctgctttttgtgttttt

SEQ ID NO: 5116773 - DNA, 21 bp, Homo sapiens
aatccctgggcattgctttcc

SEQ ID NO: 5116774 - DNA, 12 bp, Homo sapiens
aatccctgttca

SEQ ID NO: 5116775 - DNA, 17 bp, Homo sapiens
aatccctgttcattgta

SEQ ID NO: 5116776 - DNA, 14 bp, Homo sapiens
aatccctgtttaat

SEQ ID NO: 5116777 - DNA, 13 bp, Homo sapiens
aatcccttaaaat

SEQ ID NO: 5116778 - DNA, 14 bp, Homo sapiens
aatcccttaaaatt

SEQ ID NO: 5116779 - DNA, 19 bp, Homo sapiens
aatcccttaatctatgtgc

SEQ ID NO: 5116780 - DNA, 19 bp, Homo sapiens
aatccctttattaccccct

SEQ ID NO: 5116781 - DNA, 15 bp, Homo sapiens
aatccctttcagttt

SEQ ID NO: 5116782 - DNA, 13 bp, Homo sapiens
aatccctttgcac

SEQ ID NO: 5116783 - DNA, 19 bp, Homo sapiens
aatccgaacctcctctgtg

SEQ ID NO: 5116784 - DNA, 20 bp, Homo sapiens
aatccgaagggaattaaaaa

SEQ ID NO: 5116785 - DNA, 14 bp, Homo sapiens
aatccgctctcttc

SEQ ID NO: 5116786 - DNA, 15 bp, Homo sapiens
aatccgtacttgggt

SEQ ID NO: 5116787 - DNA, 18 bp, Homo sapiens
aatccgtagttattttgc

SEQ ID NO: 5116788 - DNA, 13 bp, Homo sapiens
aatccgtgtgtgt

SEQ ID NO: 5116789 - DNA, 16 bp, Homo sapiens
aatcctaaaaaacact

SEQ ID NO: 5116790 - DNA, 16 bp, Homo sapiens
aatcctaacacattat

SEQ ID NO: 5116791 - DNA, 19 bp, Homo sapiens
aatcctaatttctcctccc

SEQ ID NO: 5116792 - DNA, 18 bp, Homo sapiens
aatcctaccaacctctga

SEQ ID NO: 5116793 - DNA, 17 bp, Homo sapiens
aatcctacctcaaaatt

SEQ ID NO: 5116794 - DNA, 17 bp, Homo sapiens
aatcctaccttgctttt

SEQ ID NO: 5116795 - DNA, 21 bp, Homo sapiens
aatcctaccttgcttttgctt

SEQ ID NO: 5116796 - DNA, 14 bp, Homo sapiens
aatcctaccttttg

SEQ ID NO: 5116797 - DNA, 23 bp, Homo sapiens
aatcctaccttttgataaaatgt

SEQ ID NO: 5116798 - DNA, 18 bp, Homo sapiens
aatcctactaataaacca

SEQ ID NO: 5116799 - DNA, 15 bp, Homo sapiens
aatcctagccattga

SEQ ID NO: 5116800 - DNA, 21 bp, Homo sapiens
aatcctagccccgagacacca

SEQ ID NO: 5116801 - DNA, 16 bp, Homo sapiens
aatcctagctgtgtgc

SEQ ID NO: 5116802 - DNA, 22 bp, Homo sapiens
aatcctatatagaatgctgcac

SEQ ID NO: 5116803 - DNA, 21 bp, Homo sapiens
aatcctatctggggagctcct

SEQ ID NO: 5116804 - DNA, 15 bp, Homo sapiens
aatcctatgcatggt

SEQ ID NO: 5116805 - DNA, 18 bp, Homo sapiens
aatcctatgcatggtttc

SEQ ID NO: 5116806 - DNA, 22 bp, Homo sapiens
aatcctatgcatggtttcagca

SEQ ID NO: 5116807 - DNA, 14 bp, Homo sapiens
aatcctatgtgatt

SEQ ID NO: 5116808 - DNA, 20 bp, Homo sapiens
aatcctatgtgattttaact

SEQ ID NO: 5116809 - DNA, 13 bp, Homo sapiens
aatcctatttaaa

SEQ ID NO: 5116810 - DNA, 13 bp, Homo sapiens
aatcctcaaatca

SEQ ID NO: 5116811 - DNA, 14 bp, Homo sapiens
aatcctccccacca

SEQ ID NO: 5116812 - DNA, 16 bp, Homo sapiens
aatcctccccgctctg

SEQ ID NO: 5116813 - DNA, 15 bp, Homo sapiens
aatcctccctggaga

SEQ ID NO: 5116814 - DNA, 21 bp, Homo sapiens
aatcctcctgagtagctggga

SEQ ID NO: 5116815 - DNA, 19 bp, Homo sapiens
aatcctcctgcctcagcct

SEQ ID NO: 5116816 - DNA, 19 bp, Homo sapiens
aatcctctattaattactg

SEQ ID NO: 5116817 - DNA, 14 bp, Homo sapiens
aatcctctcttcct

SEQ ID NO: 5116818 - DNA, 11 bp, Homo sapiens
aatcctctggc

SEQ ID NO: 5116819 - DNA, 20 bp, Homo sapiens
aatcctctggggttcatcta

SEQ ID NO: 5116820 - DNA, 20 bp, Homo sapiens
aatcctctgttaatgtggac

SEQ ID NO: 5116821 - DNA, 13 bp, Homo sapiens
aatcctctgttta

SEQ ID NO: 5116822 - DNA, 14 bp, Homo sapiens
aatcctcttcctct

SEQ ID NO: 5116823 - DNA, 12 bp, Homo sapiens
aatcctgaagaa

SEQ ID NO: 5116824 - DNA, 17 bp, Homo sapiens
aatcctgattcctctct

SEQ ID NO: 5116825 - DNA, 14 bp, Homo sapiens
aatcctgcaatgaa

SEQ ID NO: 5116826 - DNA, 12 bp, Homo sapiens
aatcctgcctct

SEQ ID NO: 5116827 - DNA, 14 bp, Homo sapiens
aatcctgcctctcc

SEQ ID NO: 5116828 - DNA, 17 bp, Homo sapiens
aatcctgctctaaaata

SEQ ID NO: 5116829 - DNA, 14 bp, Homo sapiens
aatcctggaagaca

SEQ ID NO: 5116830 - DNA, 23 bp, Homo sapiens
aatcctggaagacaacccaggca

SEQ ID NO: 5116831 - DNA, 18 bp, Homo sapiens
aatcctggacagctccgc

SEQ ID NO: 5116832 - DNA, 22 bp, Homo sapiens
aatcctggcaagaaagcttgag

SEQ ID NO: 5116833 - DNA, 13 bp, Homo sapiens
aatcctggcagcc

SEQ ID NO: 5116834 - DNA, 11 bp, Homo sapiens
aatcctggctg

SEQ ID NO: 5116835 - DNA, 21 bp, Homo sapiens
aatcctgggcatccccagccc

SEQ ID NO: 5116836 - DNA, 21 bp, Homo sapiens
aatcctggggaacatagaact

SEQ ID NO: 5116837 - DNA, 18 bp, Homo sapiens
aatcctggtaattaaaag

SEQ ID NO: 5116838 - DNA, 12 bp, Homo sapiens
aatcctggttcc

SEQ ID NO: 5116839 - DNA, 19 bp, Homo sapiens
aatcctggtttgtaatgtt

SEQ ID NO: 5116840 - DNA, 21 bp, Homo sapiens
aatcctgtcgattagactgga

SEQ ID NO: 5116841 - DNA, 19 bp, Homo sapiens
aatcctgtcggtctccagt

SEQ ID NO: 5116842 - DNA, 21 bp, Homo sapiens
aatcctgtgtggtttagtgta

SEQ ID NO: 5116843 - DNA, 22 bp, Homo sapiens
aatcctgtgtggtttagtgtaa

SEQ ID NO: 5116844 - DNA, 23 bp, Homo sapiens
aatcctgtgtggtttagtgtaaa

SEQ ID NO: 5116845 - DNA, 20 bp, Homo sapiens
aatcctgttaaattttctct

SEQ ID NO: 5116846 - DNA, 14 bp, Homo sapiens
aatcctgttgaaaa

SEQ ID NO: 5116847 - DNA, 14 bp, Homo sapiens
aatcctgtttataa

SEQ ID NO: 5116848 - DNA, 22 bp, Homo sapiens
aatcctgttttacagctgcctt

SEQ ID NO: 5116849 - DNA, 21 bp, Homo sapiens
aatccttaacatttctctcca

SEQ ID NO: 5116850 - DNA, 23 bp, Homo sapiens
aatccttactaagtaggtgatga

SEQ ID NO: 5116851 - DNA, 19 bp, Homo sapiens
aatccttactatcctatta

SEQ ID NO: 5116852 - DNA, 16 bp, Homo sapiens
aatccttacttccagc

SEQ ID NO: 5116853 - DNA, 17 bp, Homo sapiens
aatccttacttccagca

SEQ ID NO: 5116854 - DNA, 20 bp, Homo sapiens
aatccttacttccagcaaaa

SEQ ID NO: 5116855 - DNA, 12 bp, Homo sapiens
aatccttagaat

SEQ ID NO: 5116856 - DNA, 14 bp, Homo sapiens
aatccttagaatgg

SEQ ID NO: 5116857 - DNA, 20 bp, Homo sapiens
aatccttagatctggcatgt

SEQ ID NO: 5116858 - DNA, 18 bp, Homo sapiens
aatccttatctataaaag

SEQ ID NO: 5116859 - DNA, 15 bp, Homo sapiens
aatccttatttatat

SEQ ID NO: 5116860 - DNA, 19 bp, Homo sapiens
aatccttcagcaatcctta

SEQ ID NO: 5116861 - DNA, 21 bp, Homo sapiens
aatccttccattccacacaga

SEQ ID NO: 5116862 - DNA, 21 bp, Homo sapiens
aatccttccatttcttctgca

SEQ ID NO: 5116863 - DNA, 14 bp, Homo sapiens
aatccttctaatct

SEQ ID NO: 5116864 - DNA, 13 bp, Homo sapiens
aatccttctagtt

SEQ ID NO: 5116865 - DNA, 14 bp, Homo sapiens
aatccttctagttt

SEQ ID NO: 5116866 - DNA, 15 bp, Homo sapiens
aatccttgaaggtat

SEQ ID NO: 5116867 - DNA, 17 bp, Homo sapiens
aatccttgcttatgaca

SEQ ID NO: 5116868 - DNA, 21 bp, Homo sapiens
aatccttggctgaattaaaat

SEQ ID NO: 5116869 - DNA, 22 bp, Homo sapiens
aatccttgtgacttacaatttg

SEQ ID NO: 5116870 - DNA, 15 bp, Homo sapiens
aatcctttctgcccc

SEQ ID NO: 5116871 - DNA, 22 bp, Homo sapiens
aatcctttgttttctgactaat

SEQ ID NO: 5116872 - DNA, 12 bp, Homo sapiens
aatccttttgta

SEQ ID NO: 5116873 - DNA, 14 bp, Homo sapiens
aatcgaaatgaatt

SEQ ID NO: 5116874 - DNA, 16 bp, Homo sapiens
aatcgaaatgaattta

SEQ ID NO: 5116875 - DNA, 22 bp, Homo sapiens
aatcgaagcaaaagtaatcact

SEQ ID NO: 5116876 - DNA, 20 bp, Homo sapiens
aatcgagatttgggagctga

SEQ ID NO: 5116877 - DNA, 17 bp, Homo sapiens
aatcgaggaaccagagc

SEQ ID NO: 5116878 - DNA, 17 bp, Homo sapiens
aatcgaggcagaaagat

SEQ ID NO: 5116879 - DNA, 20 bp, Homo sapiens
aatcgaggcagaaagataca

SEQ ID NO: 5116880 - DNA, 16 bp, Homo sapiens
aatcgagtctacctct

SEQ ID NO: 5116881 - DNA, 20 bp, Homo sapiens
aatcgagtgagacaaaattt

SEQ ID NO: 5116882 - DNA, 13 bp, Homo sapiens
aatcgatggggga

SEQ ID NO: 5116883 - DNA, 20 bp, Homo sapiens
aatcgatgggggatgcttca

SEQ ID NO: 5116884 - DNA, 21 bp, Homo sapiens
aatcgatgggggatgcttcat

SEQ ID NO: 5116885 - DNA, 13 bp, Homo sapiens
aatcgattggctt

SEQ ID NO: 5116886 - DNA, 15 bp, Homo sapiens
aatcgcaaggcctgt

SEQ ID NO: 5116887 - DNA, 20 bp, Homo sapiens
aatcgcattaatgaaatacc

SEQ ID NO: 5116888 - DNA, 24 bp, Homo sapiens
aatcgccaggactggtgaatataa

SEQ ID NO: 5116889 - DNA, 19 bp, Homo sapiens
aatgcatacaataaaagag

SEQ ID NO: 5116890 - DNA, 19 bp, Homo sapiens
aatgcatactgttgataca

SEQ ID NO: 5116891 - DNA, 23 bp, Homo sapiens
aatgcatactgttgatacaaacc

SEQ ID NO: 5116892 - DNA, 17 bp, Homo sapiens
aatgcatagagccctgg

SEQ ID NO: 5116893 - DNA, 14 bp, Homo sapiens
aatgcatatatgaa

SEQ ID NO: 5116894 - DNA, 18 bp, Homo sapiens
aatgcatatcctgagcca

SEQ ID NO: 5116895 - DNA, 13 bp, Homo sapiens
aatgcatatctgt

SEQ ID NO: 5116896 - DNA, 17 bp, Homo sapiens
aatgcatatctgtttat

SEQ ID NO: 5116897 - DNA, 17 bp, Homo sapiens
aatgcatatttataaga

SEQ ID NO: 5116898 - DNA, 15 bp, Homo sapiens
aatgcatatttctat

SEQ ID NO: 5116899 - DNA, 16 bp, Homo sapiens
aatgcatatttctatg

SEQ ID NO: 5116900 - DNA, 15 bp, Homo sapiens
aatgcatcaatcctg

SEQ ID NO: 5116901 - DNA, 15 bp, Homo sapiens
aatgcatcaggtcct

SEQ ID NO: 5116902 - DNA, 18 bp, Homo sapiens
aatgcatcatcatagaaa

SEQ ID NO: 5116903 - DNA, 21 bp, Homo sapiens
aatgcatccagcagtacaata

SEQ ID NO: 5116904 - DNA, 19 bp, Homo sapiens
aatgcatctagattatgga

SEQ ID NO: 5116905 - DNA, 14 bp, Homo sapiens
aatgcatctgaaag

SEQ ID NO: 5116906 - DNA, 15 bp, Homo sapiens
aatgcatctgtcctc

SEQ ID NO: 5116907 - DNA, 14 bp, Homo sapiens
aatgcatctttgat

SEQ ID NO: 5116908 - DNA, 18 bp, Homo sapiens
aatgcatctttgatgtgt

SEQ ID NO: 5116909 - DNA, 21 bp, Homo sapiens
aatgcatgaacaagttttaat

SEQ ID NO: 5116910 - DNA, 16 bp, Homo sapiens
aatgcatgctttccat

SEQ ID NO: 5116911 - DNA, 20 bp, Homo sapiens
aatgcatgtaaggtcttctt

SEQ ID NO: 5116912 - DNA, 13 bp, Homo sapiens
aatgcatgtctta

SEQ ID NO: 5116913 - DNA, 14 bp, Homo sapiens
aatgcatgtcttaa

SEQ ID NO: 5116914 - DNA, 15 bp, Homo sapiens
aatgcatgtcttaaa

SEQ ID NO: 5116915 - DNA, 20 bp, Homo sapiens
aatgcatgtcttaaatgctc

SEQ ID NO: 5116916 - DNA, 13 bp, Homo sapiens
aatgcatgtgatt

SEQ ID NO: 5116917 - DNA, 14 bp, Homo sapiens
aatgcatgtgattg

SEQ ID NO: 5116918 - DNA, 16 bp, Homo sapiens
aatgcatgttctgtgt

SEQ ID NO: 5116919 - DNA, 13 bp, Homo sapiens
aatgcattaaaaa

SEQ ID NO: 5116920 - DNA, 18 bp, Homo sapiens
aatgcattaataaaaatc

SEQ ID NO: 5116921 - DNA, 22 bp, Homo sapiens
aatgcattaataaaaatcaact

SEQ ID NO: 5116922 - DNA, 21 bp, Homo sapiens
aatgcattaccttctgttcct

SEQ ID NO: 5116923 - DNA, 13 bp, Homo sapiens
aatgcattattga

SEQ ID NO: 5116924 - DNA, 22 bp, Homo sapiens
aatgcattattgacgaactggc

SEQ ID NO: 5116925 - DNA, 14 bp, Homo sapiens
aatgcattatttag

SEQ ID NO: 5116926 - DNA, 17 bp, Homo sapiens
aatgcattattttgaat

SEQ ID NO: 5116927 - DNA, 19 bp, Homo sapiens
aatgcattattttgtcata

SEQ ID NO: 5116928 - DNA, 14 bp, Homo sapiens
aatgcattctggag

SEQ ID NO: 5116929 - DNA, 19 bp, Homo sapiens
aatgcattcttctctgttg

SEQ ID NO: 5116930 - DNA, 21 bp, Homo sapiens
aatgcattgatattgtgaaca

SEQ ID NO: 5116931 - DNA, 12 bp, Homo sapiens
aatgcattgtat

SEQ ID NO: 5116932 - DNA, 17 bp, Homo sapiens
aatgcattgtcttgtgg

SEQ ID NO: 5116933 - DNA, 14 bp, Homo sapiens
aatgcattgttgta

SEQ ID NO: 5116934 - DNA, 16 bp, Homo sapiens
aatgcattgttgtaaa

SEQ ID NO: 5116935 - DNA, 16 bp, Homo sapiens
aatgcatttaaaatac

SEQ ID NO: 5116936 - DNA, 20 bp, Homo sapiens
aatgcatttaaactcatttg

SEQ ID NO: 5116937 - DNA, 21 bp, Homo sapiens
aatgcatttaaactcatttga

SEQ ID NO: 5116938 - DNA, 12 bp, Homo sapiens
aatgcatttact

SEQ ID NO: 5116939 - DNA, 15 bp, Homo sapiens
aatgcatttatagat

SEQ ID NO: 5116940 - DNA, 18 bp, Homo sapiens
aatgcatttatagatcat

SEQ ID NO: 5116941 - DNA, 23 bp, Homo sapiens
aatgcatttatagatcatttcta

SEQ ID NO: 5116942 - DNA, 15 bp, Homo sapiens
aatgcattttcaaga

SEQ ID NO: 5116943 - DNA, 19 bp, Homo sapiens
aatgcattttcttcagaat

SEQ ID NO: 5116944 - DNA, 23 bp, Homo sapiens
aatgcattttgctgcctttatta

SEQ ID NO: 5116945 - DNA, 18 bp, Homo sapiens
aatgcattttgtttggta

SEQ ID NO: 5116946 - DNA, 20 bp, Homo sapiens
aatgcattttgtttggtatt

SEQ ID NO: 5116947 - DNA, 18 bp, Homo sapiens
aatgccaaaaacaaaatg

SEQ ID NO: 5116948 - DNA, 16 bp, Homo sapiens
aatgccaaaaatgtgc

SEQ ID NO: 5116949 - DNA, 11 bp, Homo sapiens
aatgccaaaac

SEQ ID NO: 5116950 - DNA, 13 bp, Homo sapiens
aatgccaaaggaa

SEQ ID NO: 5116951 - DNA, 16 bp, Homo sapiens
aatgccaaattaaaaa

SEQ ID NO: 5116952 - DNA, 17 bp, Homo sapiens
aatgccaaattaaaaaa

SEQ ID NO: 5116953 - DNA, 23 bp, Homo sapiens
aatgccaacttgtccttttgtac

SEQ ID NO: 5116954 - DNA, 22 bp, Homo sapiens
aatgccaagggggtgactggaa

SEQ ID NO: 5116955 - DNA, 21 bp, Homo sapiens
aatgccaagggtaaacaagcc

SEQ ID NO: 5116956 - DNA, 17 bp, Homo sapiens
aatgccaagtgcctgct

SEQ ID NO: 5116957 - DNA, 17 bp, Homo sapiens
aatgccaatatgacaca

SEQ ID NO: 5116958 - DNA, 20 bp, Homo sapiens
aatgccaatatgacacagct

SEQ ID NO: 5116959 - DNA, 14 bp, Homo sapiens
aatgccaatgaaca

SEQ ID NO: 5116960 - DNA, 15 bp, Homo sapiens
aatgccacagccaag

SEQ ID NO: 5116961 - DNA, 16 bp, Homo sapiens
aatgccacagccaagc

SEQ ID NO: 5116962 - DNA, 19 bp, Homo sapiens
aatgccacagccaagccca

SEQ ID NO: 5116963 - DNA, 22 bp, Homo sapiens
aatgccactgccttcgcttctt

SEQ ID NO: 5116964 - DNA, 19 bp, Homo sapiens
aatgccactgggacagctg

SEQ ID NO: 5116965 - DNA, 15 bp, Homo sapiens
aatgccagaaacagt

SEQ ID NO: 5116966 - DNA, 22 bp, Homo sapiens
aatgccagacttctaaaataaa

SEQ ID NO: 5116967 - DNA, 22 bp, Homo sapiens
aatgccagagacggaagccttt

SEQ ID NO: 5116968 - DNA, 13 bp, Homo sapiens
aatgccagagcca

SEQ ID NO: 5116969 - DNA, 11 bp, Homo sapiens
aatgccagccc

SEQ ID NO: 5116970 - DNA, 19 bp, Homo sapiens
aatgccagggcctgctgag

SEQ ID NO: 5116971 - DNA, 23 bp, Homo sapiens
aatgccagtaacgcgtcttcctg

SEQ ID NO: 5116972 - DNA, 21 bp, Homo sapiens
aatgccagtggtggaggtggg

SEQ ID NO: 5116973 - DNA, 17 bp, Homo sapiens
aatgccataaaattgca

SEQ ID NO: 5116974 - DNA, 14 bp, Homo sapiens
aatgccataataca

SEQ ID NO: 5116975 - DNA, 15 bp, Homo sapiens
aatgccatcagcccc

SEQ ID NO: 5116976 - DNA, 18 bp, Homo sapiens
aatgccatcagcccctgg

SEQ ID NO: 5116977 - DNA, 17 bp, Homo sapiens
aatgccatcctcaaaca

SEQ ID NO: 5116978 - DNA, 21 bp, Homo sapiens
aatgccatcctcaaacactgc

SEQ ID NO: 5116979 - DNA, 13 bp, Homo sapiens
aatgccatgaaca

SEQ ID NO: 5116980 - DNA, 15 bp, Homo sapiens
aatgccatgaacaaa

SEQ ID NO: 5116981 - DNA, 22 bp, Homo sapiens
aatgccatgaacaaattcttta

SEQ ID NO: 5116982 - DNA, 17 bp, Homo sapiens
aatgccatgactgctca

SEQ ID NO: 5116983 - DNA, 21 bp, Homo sapiens
aatgccatgactgctcaggcc

SEQ ID NO: 5116984 - DNA, 21 bp, Homo sapiens
aatgccatttagaatctagaa

SEQ ID NO: 5116985 - DNA, 15 bp, Homo sapiens
aatgccatttagcaa

SEQ ID NO: 5116986 - DNA, 20 bp, Homo sapiens
aatgcccaaaagaggtgtca

SEQ ID NO: 5116987 - DNA, 13 bp, Homo sapiens
aatgcccaaggat

SEQ ID NO: 5116988 - DNA, 11 bp, Homo sapiens
aatgcccagcc

SEQ ID NO: 5116989 - DNA, 12 bp, Homo sapiens
aatgcccagccc

SEQ ID NO: 5116990 - DNA, 14 bp, Homo sapiens
aatgcccagcccct

SEQ ID NO: 5116991 - DNA, 23 bp, Homo sapiens
aatgcccagccccttctgaccca

SEQ ID NO: 5116992 - DNA, 14 bp, Homo sapiens
aatgcccatttttg

SEQ ID NO: 5116993 - DNA, 16 bp, Homo sapiens
aatgccccaaactttc

SEQ ID NO: 5116994 - DNA, 16 bp, Homo sapiens
aatgccccagtgttat

SEQ ID NO: 5116995 - DNA, 18 bp, Homo sapiens
aatgcccccagctggccc

SEQ ID NO: 5116996 - DNA, 14 bp, Homo sapiens
aatgccccctcccc

SEQ ID NO: 5116997 - DNA, 15 bp, Homo sapiens
aatgccccctcccct

SEQ ID NO: 5116998 - DNA, 16 bp, Homo sapiens
aatgcccctcccagat

SEQ ID NO: 5116999 - DNA, 15 bp, Homo sapiens
aatgcccctgttcat

SEQ ID NO: 5117000 - DNA, 19 bp, Homo sapiens
aatgcccctgttcatgttt

SEQ ID NO: 5117001 - DNA, 16 bp, Homo sapiens
aatgccctacatctta

SEQ ID NO: 5117002 - DNA, 22 bp, Homo sapiens
aatgccctcaggggacttgaat

SEQ ID NO: 5117003 - DNA, 12 bp, Homo sapiens
aatgccctgcca

SEQ ID NO: 5117004 - DNA, 12 bp, Homo sapiens
aatgccctgcct

SEQ ID NO: 5117005 - DNA, 19 bp, Homo sapiens
aatgccctgccttgctgcc

SEQ ID NO: 5117006 - DNA, 23 bp, Homo sapiens
aatgccctgccttgctgccttca

SEQ ID NO: 5117007 - DNA, 17 bp, Homo sapiens
aatgccctgcggctctg

SEQ ID NO: 5117008 - DNA, 15 bp, Homo sapiens
aatgccctgctggcc

SEQ ID NO: 5117009 - DNA, 12 bp, Homo sapiens
aatgccctgtcc

SEQ ID NO: 5117010 - DNA, 22 bp, Homo sapiens
aatgccctgtccctagctcaca

SEQ ID NO: 5117011 - DNA, 16 bp, Homo sapiens
aatgcccttaatgtga

SEQ ID NO: 5117012 - DNA, 14 bp, Homo sapiens
aatgcccttcactg

SEQ ID NO: 5117013 - DNA, 17 bp, Homo sapiens
aatgcccttcactgtca

SEQ ID NO: 5117014 - DNA, 19 bp, Homo sapiens
aatgcccttcactttctcc

SEQ ID NO: 5117015 - DNA, 21 bp, Homo sapiens
aatgccgaatttggtacacat

SEQ ID NO: 5117016 - DNA, 15 bp, Homo sapiens
aatgccgcctgtcaa

SEQ ID NO: 5117017 - DNA, 18 bp, Homo sapiens
aatgccgcctgtcaataa

SEQ ID NO: 5117018 - DNA, 20 bp, Homo sapiens
aatgccgcgaactgggttct

SEQ ID NO: 5117019 - DNA, 18 bp, Homo sapiens
aatgccgcgatgggtcag

SEQ ID NO: 5117020 - DNA, 23 bp, Homo sapiens
aatgccgcgatgggtcaggtagg

SEQ ID NO: 5117021 - DNA, 16 bp, Homo sapiens
aatgccgctgtctctg

SEQ ID NO: 5117022 - DNA, 15 bp, Homo sapiens
aatgcctaataaaca

SEQ ID NO: 5117023 - DNA, 17 bp, Homo sapiens
aatgcctacagctgtct

SEQ ID NO: 5117024 - DNA, 19 bp, Homo sapiens
aatgcctagagatatttca

SEQ ID NO: 5117025 - DNA, 24 bp, Homo sapiens
aatgcctagtttttagtaatctgt

SEQ ID NO: 5117026 - DNA, 14 bp, Homo sapiens
aatgcctcagctat

SEQ ID NO: 5117027 - DNA, 18 bp, Homo sapiens
aatgcctcataaattaat

SEQ ID NO: 5117028 - DNA, 13 bp, Homo sapiens
aatgcctcctgtg

SEQ ID NO: 5117029 - DNA, 20 bp, Homo sapiens
aatgcctcgagccatagagc

SEQ ID NO: 5117030 - DNA, 13 bp, Homo sapiens
aatgcctctccca

SEQ ID NO: 5117031 - DNA, 20 bp, Homo sapiens
aatgcctctccttaaatgct

SEQ ID NO: 5117032 - DNA, 22 bp, Homo sapiens
aatgcctctccttaaatgcttc

SEQ ID NO: 5117033 - DNA, 19 bp, Homo sapiens
aatgcctgccaaattttag

SEQ ID NO: 5117034 - DNA, 13 bp, Homo sapiens
aatgcctgctttt

SEQ ID NO: 5117035 - DNA, 20 bp, Homo sapiens
aatgcctgctttttggaaag

SEQ ID NO: 5117036 - DNA, 13 bp, Homo sapiens
aatgcctggagac

SEQ ID NO: 5117037 - DNA, 18 bp, Homo sapiens
aatgcctggagacagata

SEQ ID NO: 5117038 - DNA, 14 bp, Homo sapiens
aatgcctgtgaagc

SEQ ID NO: 5117039 - DNA, 19 bp, Homo sapiens
aatgcctgtgccaataaaa

SEQ ID NO: 5117040 - DNA, 18 bp, Homo sapiens
aatgccttaattaaagaa

SEQ ID NO: 5117041 - DNA, 17 bp, Homo sapiens
aatgccttactttgtat

SEQ ID NO: 5117042 - DNA, 21 bp, Homo sapiens
aatgccttactttgtatgata

SEQ ID NO: 5117043 - DNA, 22 bp, Homo sapiens
aatgccttagaaatgtaaactg

SEQ ID NO: 5117044 - DNA, 15 bp, Homo sapiens
aatgccttatttttg

SEQ ID NO: 5117045 - DNA, 22 bp, Homo sapiens
aatgccttatttttgaattctt

SEQ ID NO: 5117046 - DNA, 23 bp, Homo sapiens
aatgccttatttttgaattcttt

SEQ ID NO: 5117047 - DNA, 19 bp, Homo sapiens
aatgccttcatgaatcttt

SEQ ID NO: 5117048 - DNA, 13 bp, Homo sapiens
aatgccttgaact

SEQ ID NO: 5117049 - DNA, 18 bp, Homo sapiens
aatgccttgttgtattcc

SEQ ID NO: 5117050 - DNA, 13 bp, Homo sapiens
aatgcctttcaaa

SEQ ID NO: 5117051 - DNA, 12 bp, Homo sapiens
aatgcctttgag

SEQ ID NO: 5117052 - DNA, 17 bp, Homo sapiens
aatgcctttgagacagt

SEQ ID NO: 5117053 - DNA, 18 bp, Homo sapiens
aatgcctttgagacagtt

SEQ ID NO: 5117054 - DNA, 20 bp, Homo sapiens
aatgcctttgagacagtttc

SEQ ID NO: 5117055 - DNA, 23 bp, Homo sapiens
aatgcctttgagacagtttctta

SEQ ID NO: 5117056 - DNA, 16 bp, Homo sapiens
aatgccttttgaatac

SEQ ID NO: 5117057 - DNA, 16 bp, Homo sapiens
aatgcgacaagtagtt

SEQ ID NO: 5117058 - DNA, 21 bp, Homo sapiens
aatgcgacaagtagttcatga

SEQ ID NO: 5117059 - DNA, 17 bp, Homo sapiens
aatgcgcaggctggccc

SEQ ID NO: 5117060 - DNA, 18 bp, Homo sapiens
aatgcgcaggctggccct

SEQ ID NO: 5117061 - DNA, 20 bp, Homo sapiens
aatgcgcaggctggccctgc

SEQ ID NO: 5117062 - DNA, 21 bp, Homo sapiens
aatgcgcaggctggccctgcc

SEQ ID NO: 5117063 - DNA, 19 bp, Homo sapiens
aatgcgctcttcaccagga

SEQ ID NO: 5117064 - DNA, 19 bp, Homo sapiens
aatgcggcccactttcctg

SEQ ID NO: 5117065 - DNA, 16 bp, Homo sapiens
aatgcggccttttcat

SEQ ID NO: 5117066 - DNA, 15 bp, Homo sapiens
aatgcgggggagcag

SEQ ID NO: 5117067 - DNA, 16 bp, Homo sapiens
aatgcgggggagcagg

SEQ ID NO: 5117068 - DNA, 14 bp, Homo sapiens
aatcgcttaaagat

SEQ ID NO: 5117069 - DNA, 21 bp, Homo sapiens
aatcgctttcctaaaacagta

SEQ ID NO: 5117070 - DNA, 20 bp, Homo sapiens
aatcggactgccaaattctc

SEQ ID NO: 5117071 - DNA, 22 bp, Homo sapiens
aatcggatctggggctctggga

SEQ ID NO: 5117072 - DNA, 16 bp, Homo sapiens
aatcggcgacggagca

SEQ ID NO: 5117073 - DNA, 15 bp, Homo sapiens
aatcggggtataata

SEQ ID NO: 5117074 - DNA, 16 bp, Homo sapiens
aatcggtgcagcggtg

SEQ ID NO: 5117075 - DNA, 15 bp, Homo sapiens
aatcggttcatcaat

SEQ ID NO: 5117076 - DNA, 20 bp, Homo sapiens
aatcgtattacataaaacac

SEQ ID NO: 5117077 - DNA, 21 bp, Homo sapiens
aatcgtggcacgtattgctgt

SEQ ID NO: 5117078 - DNA, 23 bp, Homo sapiens
aatcgtggcacgtattgctgtgt

SEQ ID NO: 5117079 - DNA, 15 bp, Homo sapiens
aatcgttatgtgtgt

SEQ ID NO: 5117080 - DNA, 13 bp, Homo sapiens
aatcgttctgctg

SEQ ID NO: 5117081 - DNA, 16 bp, Homo sapiens
aatcgttctgctggcc

SEQ ID NO: 5117082 - DNA, 16 bp, Homo sapiens
aatcgtttaatgttta

SEQ ID NO: 5117083 - DNA, 19 bp, Homo sapiens
aatcgtttaatgtttatac

SEQ ID NO: 5117084 - DNA, 15 bp, Homo sapiens
aatcgtttctcagaa

SEQ ID NO: 5117085 - DNA, 17 bp, Homo sapiens
aatctaaaaaagcacta

SEQ ID NO: 5117086 - DNA, 23 bp, Homo sapiens
aatctaaaacaaaatctgaactc

SEQ ID NO: 5117087 - DNA, 19 bp, Homo sapiens
aatctaaaagctctgttcc

SEQ ID NO: 5117088 - DNA, 23 bp, Homo sapiens
aatctaaaatgattgtgcctctg

SEQ ID NO: 5117089 - DNA, 14 bp, Homo sapiens
aatctaaaatggca

SEQ ID NO: 5117090 - DNA, 17 bp, Homo sapiens
aatctaaaatttaaaat

SEQ ID NO: 5117091 - DNA, 21 bp, Homo sapiens
aatctaaacctctctagggga

SEQ ID NO: 5117092 - DNA, 20 bp, Homo sapiens
aatctaaaccttacatgtgt

SEQ ID NO: 5117093 - DNA, 18 bp, Homo sapiens
aatctaaatagatacttt

SEQ ID NO: 5117094 - DNA, 23 bp, Homo sapiens
aatctaaatagatacttttgata

SEQ ID NO: 5117095 - DNA, 15 bp, Homo sapiens
aatctaaatctattt

SEQ ID NO: 5117096 - DNA, 15 bp, Homo sapiens
aatctaaatggaacc

SEQ ID NO: 5117097 - DNA, 15 bp, Homo sapiens
aatctaaattaaaaa

SEQ ID NO: 5117098 - DNA, 14 bp, Homo sapiens
aatctaaattaact

SEQ ID NO: 5117099 - DNA, 20 bp, Homo sapiens
aatctaaatttcttttgcta

SEQ ID NO: 5117100 - DNA, 17 bp, Homo sapiens
aatctaacaataatatt

SEQ ID NO: 5117101 - DNA, 19 bp, Homo sapiens
aatctaacaataatatttc

SEQ ID NO: 5117102 - DNA, 23 bp, Homo sapiens
aatctaacaataatatttcaagt

SEQ ID NO: 5117103 - DNA, 17 bp, Homo sapiens
aatctaacacatttcat

SEQ ID NO: 5117104 - DNA, 15 bp, Homo sapiens
aatctaacattatta

SEQ ID NO: 5117105 - DNA, 14 bp, Homo sapiens
aatctaactacaag

SEQ ID NO: 5117106 - DNA, 16 bp, Homo sapiens
aatctaagctgtttgc

SEQ ID NO: 5117107 - DNA, 17 bp, Homo sapiens
aatctaagctgtttgcc

SEQ ID NO: 5117108 - DNA, 13 bp, Homo sapiens
aatctaagggaaa

SEQ ID NO: 5117109 - DNA, 18 bp, Homo sapiens
aatctaatatccccaaat

SEQ ID NO: 5117110 - DNA, 16 bp, Homo sapiens
aatctaatattaaaaa

SEQ ID NO: 5117111 - DNA, 12 bp, Homo sapiens
aatctaatctct

SEQ ID NO: 5117112 - DNA, 19 bp, Homo sapiens
aatctaatctcttattcta

SEQ ID NO: 5117113 - DNA, 13 bp, Homo sapiens
aatctaatgacat

SEQ ID NO: 5117114 - DNA, 17 bp, Homo sapiens
aatctacaaacttttat

SEQ ID NO: 5117115 - DNA, 16 bp, Homo sapiens
aatctacacacggtgc

SEQ ID NO: 5117116 - DNA, 16 bp, Homo sapiens
aatctacaccaatgaa

SEQ ID NO: 5117117 - DNA, 13 bp, Homo sapiens
aatctacactgcc

SEQ ID NO: 5117118 - DNA, 14 bp, Homo sapiens
aatctacactgcct

SEQ ID NO: 5117119 - DNA, 13 bp, Homo sapiens
aatctacaggcct

SEQ ID NO: 5117120 - DNA, 22 bp, Homo sapiens
aatctacattataataaaattt

SEQ ID NO: 5117121 - DNA, 12 bp, Homo sapiens
aatctacatttg

SEQ ID NO: 5117122 - DNA, 17 bp, Homo sapiens
aatctacccaaaggata

SEQ ID NO: 5117123 - DNA, 16 bp, Homo sapiens
aatctaccttctgtag

SEQ ID NO: 5117124 - DNA, 18 bp, Homo sapiens
aatctacgatgttaaaac

SEQ ID NO: 5117125 - DNA, 15 bp, Homo sapiens
aatctactagaacct

SEQ ID NO: 5117126 - DNA, 16 bp, Homo sapiens
aatctactgagccacg

SEQ ID NO: 5117127 - DNA, 14 bp, Homo sapiens
aatctactgcattt

SEQ ID NO: 5117128 - DNA, 15 bp, Homo sapiens
aatctactgcattta

SEQ ID NO: 5117129 - DNA, 18 bp, Homo sapiens
aatctactggaaatgtag

SEQ ID NO: 5117130 - DNA, 23 bp, Homo sapiens
aatctactgtatcaataaaattc

SEQ ID NO: 5117131 - DNA, 12 bp, Homo sapiens
aatctacttaac

SEQ ID NO: 5117132 - DNA, 13 bp, Homo sapiens
aatctagaaaatg

SEQ ID NO: 5117133 - DNA, 14 bp, Homo sapiens
aatctagaagaaat

SEQ ID NO: 5117134 - DNA, 15 bp, Homo sapiens
aatctagaagaaatg

SEQ ID NO: 5117135 - DNA, 18 bp, Homo sapiens
aatctagaagaaatgaaa

SEQ ID NO: 5117136 - DNA, 19 bp, Homo sapiens
aatctagaagaaatgaaat

SEQ ID NO: 5117137 - DNA, 20 bp, Homo sapiens
aatctagaagaaatgaaatt

SEQ ID NO: 5117138 - DNA, 21 bp, Homo sapiens
aatctagaagaaatgaaattt

SEQ ID NO: 5117139 - DNA, 22 bp, Homo sapiens
aatctagaagatgtgtaaacag

SEQ ID NO: 5117140 - DNA, 13 bp, Homo sapiens
aatctagacaata

SEQ ID NO: 5117141 - DNA, 16 bp, Homo sapiens
aatctagacattcttt

SEQ ID NO: 5117142 - DNA, 20 bp, Homo sapiens
aatctagacattcttttaat

SEQ ID NO: 5117143 - DNA, 19 bp, Homo sapiens
aatctagagctatgcacac

SEQ ID NO: 5117144 - DNA, 19 bp, Homo sapiens
aatctagaggaaaagaaag

SEQ ID NO: 5117145 - DNA, 21 bp, Homo sapiens
aatctagaggaaaagaaagaa

SEQ ID NO: 5117146 - DNA, 13 bp, Homo sapiens
aatctagagttta

SEQ ID NO: 5117147 - DNA, 21 bp, Homo sapiens
aatctagatcaattaattctt

SEQ ID NO: 5117148 - DNA, 16 bp, Homo sapiens
aatctaggaaaatatt

SEQ ID NO: 5117149 - DNA, 18 bp, Homo sapiens
aatctaggaaattagttg

SEQ ID NO: 5117150 - DNA, 16 bp, Homo sapiens
aatctaggatgtgatg

SEQ ID NO: 5117151 - DNA, 17 bp, Homo sapiens
aatctaggatgtgatga

SEQ ID NO: 5117152 - DNA, 16 bp, Homo sapiens
aatctaggccacccca

SEQ ID NO: 5117153 - DNA, 19 bp, Homo sapiens
aatctaggcgaaagtaatg

SEQ ID NO: 5117154 - DNA, 17 bp, Homo sapiens
aatctaggtgtggctgt

SEQ ID NO: 5117155 - DNA, 23 bp, Homo sapiens
aatctagtatttgtatcctggca

SEQ ID NO: 5117156 - DNA, 17 bp, Homo sapiens
aatctagtttacagaaa

SEQ ID NO: 5117157 - DNA, 18 bp, Homo sapiens
aatctagtttacagaaaa

SEQ ID NO: 5117158 - DNA, 19 bp, Homo sapiens
aatctagtttacagaaaaa

SEQ ID NO: 5117159 - DNA, 21 bp, Homo sapiens
aatctagttttttttgtaaac

SEQ ID NO: 5117160 - DNA, 23 bp, Homo sapiens
aatctagttttttttgtaaactg

SEQ ID NO: 5117161 - DNA, 12 bp, Homo sapiens
aatctataaaag

SEQ ID NO: 5117162 - DNA, 21 bp, Homo sapiens
aatctataacataaagaataa

SEQ ID NO: 5117163 - DNA, 20 bp, Homo sapiens
aatctatagttcactgacac

SEQ ID NO: 5117164 - DNA, 18 bp, Homo sapiens
aatctatattaaagtgtt

SEQ ID NO: 5117165 - DNA, 17 bp, Homo sapiens
aatctatattaaatgag

SEQ ID NO: 5117166 - DNA, 18 bp, Homo sapiens
aatctatatttgtcttcc

SEQ ID NO: 5117167 - DNA, 19 bp, Homo sapiens
aatctatatttgtcttccg

SEQ ID NO: 5117168 - DNA, 23 bp, Homo sapiens
aatctatcactaaaaatttttac

SEQ ID NO: 5117169 - DNA, 13 bp, Homo sapiens
aatctatctatat

SEQ ID NO: 5117170 - DNA, 15 bp, Homo sapiens
aatctatctatataa

SEQ ID NO: 5117171 - DNA, 23 bp, Homo sapiens
aatctatctctatataaaaaata

SEQ ID NO: 5117172 - DNA, 14 bp, Homo sapiens
aatctatgaagtat

SEQ ID NO: 5117173 - DNA, 17 bp, Homo sapiens
aatctatgaagtatata

SEQ ID NO: 5117174 - DNA, 19 bp, Homo sapiens
aatctatgaagtatataat

SEQ ID NO: 5117175 - DNA, 17 bp, Homo sapiens
aatctatgatatattta

SEQ ID NO: 5117176 - DNA, 18 bp, Homo sapiens
aatctatgccaaagatca

SEQ ID NO: 5117177 - DNA, 20 bp, Homo sapiens
aatctatgccaaagatcact

SEQ ID NO: 5117178 - DNA, 21 bp, Homo sapiens
aatctatggtcgggagacagc

SEQ ID NO: 5117179 - DNA, 15 bp, Homo sapiens
aatctatgtgtttct

SEQ ID NO: 5117180 - DNA, 21 bp, Homo sapiens
aatctatgtgtttctgtaaca

SEQ ID NO: 5117181 - DNA, 22 bp, Homo sapiens
aatctatgtgtttctgtaacaa

SEQ ID NO: 5117182 - DNA, 14 bp, Homo sapiens
aatctattagattt

SEQ ID NO: 5117183 - DNA, 17 bp, Homo sapiens
aatctattagattttag

SEQ ID NO: 5117184 - DNA, 18 bp, Homo sapiens
aatctattagattttaga

SEQ ID NO: 5117185 - DNA, 19 bp, Homo sapiens
aatctattcagacaagcaa

SEQ ID NO: 5117186 - DNA, 21 bp, Homo sapiens
aatctattcctgtaaataaga

SEQ ID NO: 5117187 - DNA, 23 bp, Homo sapiens
aatctattcctgtaaataagagt

SEQ ID NO: 5117188 - DNA, 21 bp, Homo sapiens
aatctattgggattttctaca

SEQ ID NO: 5117189 - DNA, 18 bp, Homo sapiens
aatctattgggttcatta

SEQ ID NO: 5117190 - DNA, 11 bp, Homo sapiens
aatctatttaa

SEQ ID NO: 5117191 - DNA, 20 bp, Homo sapiens
aatctatttaaaaaactgta

SEQ ID NO: 5117192 - DNA, 21 bp, Homo sapiens
aatctatttaaaaaactgtat

SEQ ID NO: 5117193 - DNA, 12 bp, Homo sapiens
aatctatttcta

SEQ ID NO: 5117194 - DNA, 13 bp, Homo sapiens
aatctattttcta

SEQ ID NO: 5117195 - DNA, 17 bp, Homo sapiens
aatctattttctatgta

SEQ ID NO: 5117196 - DNA, 19 bp, Homo sapiens
aatctattttctatgtact

SEQ ID NO: 5117197 - DNA, 19 bp, Homo sapiens
aatctattttctcattgct

SEQ ID NO: 5117198 - DNA, 22 bp, Homo sapiens
aatctatttttaaaatcataac

SEQ ID NO: 5117199 - DNA, 20 bp, Homo sapiens
aatctcaaaatatcctaaga

SEQ ID NO: 5117200 - DNA, 16 bp, Homo sapiens
aatctcaaaggagaaa

SEQ ID NO: 5117201 - DNA, 20 bp, Homo sapiens
aatctcaaaggagaaaaaaa

SEQ ID NO: 5117202 - DNA, 16 bp, Homo sapiens
aatctcaaataggcta

SEQ ID NO: 5117203 - DNA, 16 bp, Homo sapiens
aatctcaaatttctaa

SEQ ID NO: 5117204 - DNA, 18 bp, Homo sapiens
aatctcaaatttctaaat

SEQ ID NO: 5117205 - DNA, 21 bp, Homo sapiens
aatctcaaggaatctttaagc

SEQ ID NO: 5117206 - DNA, 16 bp, Homo sapiens
aatctcaatcctgcag

SEQ ID NO: 5117207 - DNA, 13 bp, Homo sapiens
aatctcaatgcaa

SEQ ID NO: 5117208 - DNA, 14 bp, Homo sapiens
aatctcaatttgag

SEQ ID NO: 5117209 - DNA, 13 bp, Homo sapiens
aatctcacacagc

SEQ ID NO: 5117210 - DNA, 17 bp, Homo sapiens
aatctcacacagctggg

SEQ ID NO: 5117211 - DNA, 15 bp, Homo sapiens
aatctcacagcattt

SEQ ID NO: 5117212 - DNA, 14 bp, Homo sapiens
aatctcactgtatt

SEQ ID NO: 5117213 - DNA, 15 bp, Homo sapiens
aatctcacttcatca

SEQ ID NO: 5117214 - DNA, 15 bp, Homo sapiens
aatctcagatactta

SEQ ID NO: 5117215 - DNA, 16 bp, Homo sapiens
aatctcagcaaagcta

SEQ ID NO: 5117216 - DNA, 17 bp, Homo sapiens
aatctcagcaaagctac

SEQ ID NO: 5117217 - DNA, 19 bp, Homo sapiens
aatctcagcaaagctacag

SEQ ID NO: 5117218 - DNA, 17 bp, Homo sapiens
aatctcagctcactgtg

SEQ ID NO: 5117219 - DNA, 21 bp, Homo sapiens
aatctcagttgtttgcttctt

SEQ ID NO: 5117220 - DNA, 17 bp, Homo sapiens
aatctcataattggaat

SEQ ID NO: 5117221 - DNA, 18 bp, Homo sapiens
aatctcataatttataca

SEQ ID NO: 5117222 - DNA, 19 bp, Homo sapiens
aatctcatacctctgacca

SEQ ID NO: 5117223 - DNA, 22 bp, Homo sapiens
aatctcatcccaacaaacttta

SEQ ID NO: 5117224 - DNA, 14 bp, Homo sapiens
aatctcatcccccc

SEQ ID NO: 5117225 - DNA, 15 bp, Homo sapiens
aatctcatcccccca

SEQ ID NO: 5117226 - DNA, 17 bp, Homo sapiens
aatctcatccccccacc

SEQ ID NO: 5117227 - DNA, 18 bp, Homo sapiens
aatctcattatttcaaaa

SEQ ID NO: 5117228 - DNA, 21 bp, Homo sapiens
aatctcattatttcaaaatga

SEQ ID NO: 5117229 - DNA, 13 bp, Homo sapiens
aatctccaaaata

SEQ ID NO: 5117230 - DNA, 16 bp, Homo sapiens
aatctccaactttatt

SEQ ID NO: 5117231 - DNA, 21 bp, Homo sapiens
aatctccaatccacacatatt

SEQ ID NO: 5117232 - DNA, 21 bp, Homo sapiens
aatctccaccagtcatttttc

SEQ ID NO: 5117233 - DNA, 11 bp, Homo sapiens
aatctccaggg

SEQ ID NO: 5117234 - DNA, 14 bp, Homo sapiens
aatctccagggctc

SEQ ID NO: 5117235 - DNA, 18 bp, Homo sapiens
aatctccagggctgcccc

SEQ ID NO: 5117236 - DNA, 21 bp, Homo sapiens
aatctccagggctgcccctgt

SEQ ID NO: 5117237 - DNA, 22 bp, Homo sapiens
aatctccagggctgcccctgta

SEQ ID NO: 5117238 - DNA, 16 bp, Homo sapiens
aatctccatgtgtact

SEQ ID NO: 5117239 - DNA, 11 bp, Homo sapiens
aatctccattt

SEQ ID NO: 5117240 - DNA, 23 bp, Homo sapiens
aatctcccacaagtatatacttt

SEQ ID NO: 5117241 - DNA, 21 bp, Homo sapiens
aatctcccagacttgtttcct

SEQ ID NO: 5117242 - DNA, 19 bp, Homo sapiens
aatctcccagcccacctca

SEQ ID NO: 5117243 - DNA, 16 bp, Homo sapiens
aatctcccattttgga

SEQ ID NO: 5117244 - DNA, 19 bp, Homo sapiens
aatctccccagtagagaaa

SEQ ID NO: 5117245 - DNA, 22 bp, Homo sapiens
aatctcctattccttcacacag

SEQ ID NO: 5117246 - DNA, 21 bp, Homo sapiens
aatgcggttataaaaaatggt

SEQ ID NO: 5117247 - DNA, 23 bp, Homo sapiens
aatgcggttataaaaaatggttc

SEQ ID NO: 5117248 - DNA, 18 bp, Homo sapiens
aatgcgtcttgtgaaatt

SEQ ID NO: 5117249 - DNA, 19 bp, Homo sapiens
aatgcgtgcataccacttt

SEQ ID NO: 5117250 - DNA, 20 bp, Homo sapiens
aatgcgtggcacatctaaat

SEQ ID NO: 5117251 - DNA, 13 bp, Homo sapiens
aatgctaaacttg

SEQ ID NO: 5117252 - DNA, 18 bp, Homo sapiens
aatgctaaagaaaaagtc

SEQ ID NO: 5117253 - DNA, 20 bp, Homo sapiens
aatgctaaagaaaaagtcat

SEQ ID NO: 5117254 - DNA, 21 bp, Homo sapiens
aatgctaagccagttcttaag

SEQ ID NO: 5117255 - DNA, 17 bp, Homo sapiens
aatgctaagggcaggcc

SEQ ID NO: 5117256 - DNA, 17 bp, Homo sapiens
aatgctaatattaaaag

SEQ ID NO: 5117257 - DNA, 13 bp, Homo sapiens
aatgctaatgtaa

SEQ ID NO: 5117258 - DNA, 13 bp, Homo sapiens
aatgctaatttta

SEQ ID NO: 5117259 - DNA, 15 bp, Homo sapiens
aatgctacatgtgag

SEQ ID NO: 5117260 - DNA, 14 bp, Homo sapiens
aatgctagaagaaa

SEQ ID NO: 5117261 - DNA, 19 bp, Homo sapiens
aatgctaggttaattccaa

SEQ ID NO: 5117262 - DNA, 13 bp, Homo sapiens
aatgctaggttct

SEQ ID NO: 5117263 - DNA, 14 bp, Homo sapiens
aatgctaggttcta

SEQ ID NO: 5117264 - DNA, 17 bp, Homo sapiens
aatgctaggttctacct

SEQ ID NO: 5117265 - DNA, 17 bp, Homo sapiens
aatgctatactggaaat

SEQ ID NO: 5117266 - DNA, 21 bp, Homo sapiens
aatgctatcactgtctttgac

SEQ ID NO: 5117267 - DNA, 22 bp, Homo sapiens
aatgctatggaaatacatttag

SEQ ID NO: 5117268 - DNA, 17 bp, Homo sapiens
aatgctatgtcatttca

SEQ ID NO: 5117269 - DNA, 18 bp, Homo sapiens
aatgctattatactgtta

SEQ ID NO: 5117270 - DNA, 12 bp, Homo sapiens
aatgctattgaa

SEQ ID NO: 5117271 - DNA, 15 bp, Homo sapiens
aatgctattgaaaat

SEQ ID NO: 5117272 - DNA, 15 bp, Homo sapiens
aatgctattgaaatt

SEQ ID NO: 5117273 - DNA, 19 bp, Homo sapiens
aatgctattgttgtgggct

SEQ ID NO: 5117274 - DNA, 16 bp, Homo sapiens
aatgctattttaaaat

SEQ ID NO: 5117275 - DNA, 23 bp, Homo sapiens
aatgctattttaaaattcatgga

SEQ ID NO: 5117276 - DNA, 20 bp, Homo sapiens
aatgctattttttattttac

SEQ ID NO: 5117277 - DNA, 15 bp, Homo sapiens
aatgctcaagaatgt

SEQ ID NO: 5117278 - DNA, 16 bp, Homo sapiens
aatgctcaatttcagc

SEQ ID NO: 5117279 - DNA, 15 bp, Homo sapiens
aatgctcataaagat

SEQ ID NO: 5117280 - DNA, 16 bp, Homo sapiens
aatgctcataaagatg

SEQ ID NO: 5117281 - DNA, 17 bp, Homo sapiens
aatgctcatgtccctgt

SEQ ID NO: 5117282 - DNA, 16 bp, Homo sapiens
aatgctccagcactca

SEQ ID NO: 5117283 - DNA, 21 bp, Homo sapiens
aatgctccagctgtcgtctga

SEQ ID NO: 5117284 - DNA, 21 bp, Homo sapiens
aatgctcccacctgaatttgt

SEQ ID NO: 5117285 - DNA, 23 bp, Homo sapiens
aatgctcccacctgaatttgtat

SEQ ID NO: 5117286 - DNA, 16 bp, Homo sapiens
aatgctccccacagcg

SEQ ID NO: 5117287 - DNA, 20 bp, Homo sapiens
aatgctcccccatcctcccc

SEQ ID NO: 5117288 - DNA, 18 bp, Homo sapiens
aatgctcctagaagtctt

SEQ ID NO: 5117289 - DNA, 12 bp, Homo sapiens
aatgctcctgga

SEQ ID NO: 5117290 - DNA, 19 bp, Homo sapiens
aatgctcgtatctccttga

SEQ ID NO: 5117291 - DNA, 13 bp, Homo sapiens
aatgctctccttt

SEQ ID NO: 5117292 - DNA, 14 bp, Homo sapiens
aatgctctcctttc

SEQ ID NO: 5117293 - DNA, 13 bp, Homo sapiens
aatgctctgatta

SEQ ID NO: 5117294 - DNA, 19 bp, Homo sapiens
aatgctctgtcttcaatga

SEQ ID NO: 5117295 - DNA, 15 bp, Homo sapiens
aatgctcttaaaata

SEQ ID NO: 5117296 - DNA, 17 bp, Homo sapiens
aatgctcttttgcacaa

SEQ ID NO: 5117297 - DNA, 13 bp, Homo sapiens
aatgctgaaataa

SEQ ID NO: 5117298 - DNA, 14 bp, Homo sapiens
aatgctgaaataaa

SEQ ID NO: 5117299 - DNA, 16 bp, Homo sapiens
aatgctgacaaaaata

SEQ ID NO: 5117300 - DNA, 18 bp, Homo sapiens
aatgctgacaaaaatatt

SEQ ID NO: 5117301 - DNA, 23 bp, Homo sapiens
aatgctgacccatgggcaggaga

SEQ ID NO: 5117302 - DNA, 18 bp, Homo sapiens
aatgctgagctgaagaaa

SEQ ID NO: 5117303 - DNA, 15 bp, Homo sapiens
aatgctgaggttatg

SEQ ID NO: 5117304 - DNA, 13 bp, Homo sapiens
aatgctgatttaa

SEQ ID NO: 5117305 - DNA, 13 bp, Homo sapiens
aatgctgcacttc

SEQ ID NO: 5117306 - DNA, 17 bp, Homo sapiens
aatgctgcacttcctgt

SEQ ID NO: 5117307 - DNA, 12 bp, Homo sapiens
aatgctgcagat

SEQ ID NO: 5117308 - DNA, 19 bp, Homo sapiens
aatgctgcaggaaaagcaa

SEQ ID NO: 5117309 - DNA, 15 bp, Homo sapiens
aatgctgccatgccc

SEQ ID NO: 5117310 - DNA, 23 bp, Homo sapiens
aatgctgcccatgccaccgcttc

SEQ ID NO: 5117311 - DNA, 23 bp, Homo sapiens
aatgctgcccggttgccatggag

SEQ ID NO: 5117312 - DNA, 16 bp, Homo sapiens
aatgctgcctagtgct

SEQ ID NO: 5117313 - DNA, 16 bp, Homo sapiens
aatgctgcctgccttt

SEQ ID NO: 5117314 - DNA, 12 bp, Homo sapiens
aatgctgctcca

SEQ ID NO: 5117315 - DNA, 14 bp, Homo sapiens
aatgctggactgga

SEQ ID NO: 5117316 - DNA, 22 bp, Homo sapiens
aatgctggactggaggcccctg

SEQ ID NO: 5117317 - DNA, 12 bp, Homo sapiens
aatgctggcaaa

SEQ ID NO: 5117318 - DNA, 22 bp, Homo sapiens
aatgctggctatagatgtcttt

SEQ ID NO: 5117319 - DNA, 23 bp, Homo sapiens
aatgctggctatagatgtctttt

SEQ ID NO: 5117320 - DNA, 20 bp, Homo sapiens
aatgctggctggccttgtgg

SEQ ID NO: 5117321 - DNA, 23 bp, Homo sapiens
aatgctggctggccttgtggtcc

SEQ ID NO: 5117322 - DNA, 21 bp, Homo sapiens
aatgctggctgttggctgggg

SEQ ID NO: 5117323 - DNA, 14 bp, Homo sapiens
aatgctgggccctc

SEQ ID NO: 5117324 - DNA, 18 bp, Homo sapiens
aatgctgggtttatagat

SEQ ID NO: 5117325 - DNA, 15 bp, Homo sapiens
aatgctggttttcct

SEQ ID NO: 5117326 - DNA, 23 bp, Homo sapiens
aatgctggttttcctaaatgcag

SEQ ID NO: 5117327 - DNA, 19 bp, Homo sapiens
aatgctgtaaatatttcat

SEQ ID NO: 5117328 - DNA, 20 bp, Homo sapiens
aatgctgtaaatatttcata

SEQ ID NO: 5117329 - DNA, 15 bp, Homo sapiens
aatgctgtacctggc

SEQ ID NO: 5117330 - DNA, 16 bp, Homo sapiens
aatgctgtacctttct

SEQ ID NO: 5117331 - DNA, 19 bp, Homo sapiens
aatgctgtacgtactgcat

SEQ ID NO: 5117332 - DNA, 13 bp, Homo sapiens
aatgctgtagaat

SEQ ID NO: 5117333 - DNA, 19 bp, Homo sapiens
aatgctgtatgtcattaaa

SEQ ID NO: 5117334 - DNA, 20 bp, Homo sapiens
aatgctgtatgtcattaaag

SEQ ID NO: 5117335 - DNA, 21 bp, Homo sapiens
aatgctgtatgtcattaaagt

SEQ ID NO: 5117336 - DNA, 20 bp, Homo sapiens
aatgctgtattttaaaagaa

SEQ ID NO: 5117337 - DNA, 22 bp, Homo sapiens
aatgctgtatttttacagctac

SEQ ID NO: 5117338 - DNA, 19 bp, Homo sapiens
aatgctgtctttcttgctc

SEQ ID NO: 5117339 - DNA, 15 bp, Homo sapiens
aatgctgtctttgtg

SEQ ID NO: 5117340 - DNA, 12 bp, Homo sapiens
aatgctgtgaat

SEQ ID NO: 5117341 - DNA, 22 bp, Homo sapiens
aatgctgtgcaaacagtgtaag

SEQ ID NO: 5117342 - DNA, 13 bp, Homo sapiens
aatgctgtgccct

SEQ ID NO: 5117343 - DNA, 20 bp, Homo sapiens
aatgctgtgccctaaagtgt

SEQ ID NO: 5117344 - DNA, 18 bp, Homo sapiens
aatgctgtgggtttccaa

SEQ ID NO: 5117345 - DNA, 18 bp, Homo sapiens
aatgctgtggttcactgc

SEQ ID NO: 5117346 - DNA, 22 bp, Homo sapiens
aatgctgtggttcactgcactg

SEQ ID NO: 5117347 - DNA, 23 bp, Homo sapiens
aatgctgtgtacaacaatgcttt

SEQ ID NO: 5117348 - DNA, 13 bp, Homo sapiens
aatgctgtgttaa

SEQ ID NO: 5117349 - DNA, 20 bp, Homo sapiens
aatgctgttaatatttctaa

SEQ ID NO: 5117350 - DNA, 18 bp, Homo sapiens
aatgctgttcagaaatat

SEQ ID NO: 5117351 - DNA, 19 bp, Homo sapiens
aatgctgttctcaatcatt

SEQ ID NO: 5117352 - DNA, 22 bp, Homo sapiens
aatgctgttctcaatcattgtc

SEQ ID NO: 5117353 - DNA, 16 bp, Homo sapiens
aatgcttaaaaaataa

SEQ ID NO: 5117354 - DNA, 18 bp, Homo sapiens
aatgcttaaaaaataata

SEQ ID NO: 5117355 - DNA, 15 bp, Homo sapiens
aatgcttaaaacaag

SEQ ID NO: 5117356 - DNA, 19 bp, Homo sapiens
aatgcttaaagaattcaaa

SEQ ID NO: 5117357 - DNA, 16 bp, Homo sapiens
aatgcttaacataaac

SEQ ID NO: 5117358 - DNA, 15 bp, Homo sapiens
aatgcttaagatttg

SEQ ID NO: 5117359 - DNA, 20 bp, Homo sapiens
aatgcttaatttctaaagat

SEQ ID NO: 5117360 - DNA, 17 bp, Homo sapiens
aatgcttacctaatttc

SEQ ID NO: 5117361 - DNA, 18 bp, Homo sapiens
aatgcttacctaatttca

SEQ ID NO: 5117362 - DNA, 19 bp, Homo sapiens
aatgcttatgcttgtgtat

SEQ ID NO: 5117363 - DNA, 14 bp, Homo sapiens
aatgcttattttaa

SEQ ID NO: 5117364 - DNA, 23 bp, Homo sapiens
aatgcttattttaaaatgacagt

SEQ ID NO: 5117365 - DNA, 18 bp, Homo sapiens
aatgcttcactgtacgta

SEQ ID NO: 5117366 - DNA, 22 bp, Homo sapiens
aatgcttcattcaatattgaca

SEQ ID NO: 5117367 - DNA, 17 bp, Homo sapiens
aatgcttcattgaaagc

SEQ ID NO: 5117368 - DNA, 21 bp, Homo sapiens
aatgcttccactaccaaaaga

SEQ ID NO: 5117369 - DNA, 17 bp, Homo sapiens
aatgcttccgagacacc

SEQ ID NO: 5117370 - DNA, 19 bp, Homo sapiens
aatgcttctaagtaaatac

SEQ ID NO: 5117371 - DNA, 21 bp, Homo sapiens
aatgcttctctcatagtgtca

SEQ ID NO: 5117372 - DNA, 21 bp, Homo sapiens
aatgcttctgacttcatagat

SEQ ID NO: 5117373 - DNA, 15 bp, Homo sapiens
aatgcttctgagagc

SEQ ID NO: 5117374 - DNA, 13 bp, Homo sapiens
aatgcttctgatt

SEQ ID NO: 5117375 - DNA, 21 bp, Homo sapiens
aatgcttctgcctcagcttcc

SEQ ID NO: 5117376 - DNA, 12 bp, Homo sapiens
aatgcttctgta

SEQ ID NO: 5117377 - DNA, 23 bp, Homo sapiens
aatgcttcttttagtcagaaatg

SEQ ID NO: 5117378 - DNA, 13 bp, Homo sapiens
aatgcttgaaaaa

SEQ ID NO: 5117379 - DNA, 18 bp, Homo sapiens
aatgcttgaccctgaaat

SEQ ID NO: 5117380 - DNA, 19 bp, Homo sapiens
aatgcttgatgagaagaac

SEQ ID NO: 5117381 - DNA, 20 bp, Homo sapiens
aatgcttgcatggagaatgg

SEQ ID NO: 5117382 - DNA, 12 bp, Homo sapiens
aatgcttggaat

SEQ ID NO: 5117383 - DNA, 22 bp, Homo sapiens
aatgcttggaatatctgctgta

SEQ ID NO: 5117384 - DNA, 14 bp, Homo sapiens
aatgcttgtacagt

SEQ ID NO: 5117385 - DNA, 15 bp, Homo sapiens
aatgcttgtagaagt

SEQ ID NO: 5117386 - DNA, 20 bp, Homo sapiens
aatgcttgtggattgagggt

SEQ ID NO: 5117387 - DNA, 22 bp, Homo sapiens
aatgctttaaaaactatttaac

SEQ ID NO: 5117388 - DNA, 18 bp, Homo sapiens
aatgctttatttgtaaat

SEQ ID NO: 5117389 - DNA, 15 bp, Homo sapiens
aatgctttccaaaac

SEQ ID NO: 5117390 - DNA, 11 bp, Homo sapiens
aatgctttctg

SEQ ID NO: 5117391 - DNA, 18 bp, Homo sapiens
aatgctttgaaaatgttt

SEQ ID NO: 5117392 - DNA, 22 bp, Homo sapiens
aatgctttgaaattgaaccttt

SEQ ID NO: 5117393 - DNA, 13 bp, Homo sapiens
aatgctttgccat

SEQ ID NO: 5117394 - DNA, 13 bp, Homo sapiens
aatgctttggaaa

SEQ ID NO: 5117395 - DNA, 17 bp, Homo sapiens
aatgctttgggaggcca

SEQ ID NO: 5117396 - DNA, 21 bp, Homo sapiens
aatgctttgggaggccaaggc

SEQ ID NO: 5117397 - DNA, 13 bp, Homo sapiens
aatgcttttctaa

SEQ ID NO: 5117398 - DNA, 16 bp, Homo sapiens
aatgcttttctaatta

SEQ ID NO: 5117399 - DNA, 14 bp, Homo sapiens
aatgcttttctagc

SEQ ID NO: 5117400 - DNA, 17 bp, Homo sapiens
aatgctttttagaaagc

SEQ ID NO: 5117401 - DNA, 19 bp, Homo sapiens
aatgctttttagaaagcat

SEQ ID NO: 5117402 - DNA, 20 bp, Homo sapiens
aatgctttttatttctgcat

SEQ ID NO: 5117403 - DNA, 20 bp, Homo sapiens
aatggaaaaaaaaaaaagag

SEQ ID NO: 5117404 - DNA, 22 bp, Homo sapiens
aatggaaaaaaaaaaaagagga

SEQ ID NO: 5117405 - DNA, 23 bp, Homo sapiens
aatggaaaaaaagactgatgaag

SEQ ID NO: 5117406 - DNA, 18 bp, Homo sapiens
aatggaaaacatttacat

SEQ ID NO: 5117407 - DNA, 23 bp, Homo sapiens
aatggaaaactgcctgttccttg

SEQ ID NO: 5117408 - DNA, 14 bp, Homo sapiens
aatggaaaactgtt

SEQ ID NO: 5117409 - DNA, 15 bp, Homo sapiens
aatggaaaagagaga

SEQ ID NO: 5117410 - DNA, 16 bp, Homo sapiens
aatggaaaatatacaa

SEQ ID NO: 5117411 - DNA, 19 bp, Homo sapiens
aatggaaaatatacaagta

SEQ ID NO: 5117412 - DNA, 14 bp, Homo sapiens
aatggaaaatgtat

SEQ ID NO: 5117413 - DNA, 12 bp, Homo sapiens
aatggaaaatta

SEQ ID NO: 5117414 - DNA, 15 bp, Homo sapiens
aatggaaaattaatt

SEQ ID NO: 5117415 - DNA, 19 bp, Homo sapiens
aatggaaaattttctcctt

SEQ ID NO: 5117416 - DNA, 15 bp, Homo sapiens
aatggaaacacacac

SEQ ID NO: 5117417 - DNA, 17 bp, Homo sapiens
aatggaaacagaggacc

SEQ ID NO: 5117418 - DNA, 18 bp, Homo sapiens
aatggaaacagaggacca

SEQ ID NO: 5117419 - DNA, 22 bp, Homo sapiens
aatggaaacagggcagtgacaa

SEQ ID NO: 5117420 - DNA, 13 bp, Homo sapiens
aatggaaacatta

SEQ ID NO: 5117421 - DNA, 17 bp, Homo sapiens
aatggaaaccacaactt

SEQ ID NO: 5117422 - DNA, 16 bp, Homo sapiens
aatggaaactgaatgc

SEQ ID NO: 5117423 - DNA, 17 bp, Homo sapiens
aatggaaactgaatgct

SEQ ID NO: 5117424 - DNA, 21 bp, Homo sapiens
aatctcctatttttttaaaat

SEQ ID NO: 5117425 - DNA, 22 bp, Homo sapiens
aatctcctctctctttcctcca

SEQ ID NO: 5117426 - DNA, 17 bp, Homo sapiens
aatctcctctgctcatt

SEQ ID NO: 5117427 - DNA, 20 bp, Homo sapiens
aatctcctgagttgtataaa

SEQ ID NO: 5117428 - DNA, 12 bp, Homo sapiens
aatctcctgctg

SEQ ID NO: 5117429 - DNA, 14 bp, Homo sapiens
aatctcctgctgat

SEQ ID NO: 5117430 - DNA, 15 bp, Homo sapiens
aatctccttactgtg

SEQ ID NO: 5117431 - DNA, 23 bp, Homo sapiens
aatctcgctctgtcgcccaggct

SEQ ID NO: 5117432 - DNA, 17 bp, Homo sapiens
aatctcggctcactgca

SEQ ID NO: 5117433 - DNA, 19 bp, Homo sapiens
aatctcgtatagaagtctt

SEQ ID NO: 5117434 - DNA, 15 bp, Homo sapiens
aatctcgtttagtgc

SEQ ID NO: 5117435 - DNA, 20 bp, Homo sapiens
aatctcgtttagtgccaatg

SEQ ID NO: 5117436 - DNA, 15 bp, Homo sapiens
aatctcgtttcaaaa

SEQ ID NO: 5117437 - DNA, 16 bp, Homo sapiens
aatctcgtttcaaaaa

SEQ ID NO: 5117438 - DNA, 18 bp, Homo sapiens
aatctctacccctttctt

SEQ ID NO: 5117439 - DNA, 19 bp, Homo sapiens
aatctctacccctttcttc

SEQ ID NO: 5117440 - DNA, 18 bp, Homo sapiens
aatctctagcctctttgt

SEQ ID NO: 5117441 - DNA, 23 bp, Homo sapiens
aatctctatgccctgttaaatgg

SEQ ID NO: 5117442 - DNA, 18 bp, Homo sapiens
aatctctcaaaatgtgcc

SEQ ID NO: 5117443 - DNA, 19 bp, Homo sapiens
aatctctcaaaatgtgccg

SEQ ID NO: 5117444 - DNA, 21 bp, Homo sapiens
aatctctcagagccctcaact

SEQ ID NO: 5117445 - DNA, 22 bp, Homo sapiens
aatctctcatattcgctagtgt

SEQ ID NO: 5117446 - DNA, 20 bp, Homo sapiens
aatctctccaccttccaaag

SEQ ID NO: 5117447 - DNA, 21 bp, Homo sapiens
aatctctccaccttccaaaga

SEQ ID NO: 5117448 - DNA, 22 bp, Homo sapiens
aatctctccactttcagctgtc

SEQ ID NO: 5117449 - DNA, 23 bp, Homo sapiens
aatctctcctgaactgctttcca

SEQ ID NO: 5117450 - DNA, 17 bp, Homo sapiens
aatctctctctcttttt

SEQ ID NO: 5117451 - DNA, 23 bp, Homo sapiens
aatctctctctgtgtctttctct

SEQ ID NO: 5117452 - DNA, 18 bp, Homo sapiens
aatctctctctgttgtgt

SEQ ID NO: 5117453 - DNA, 21 bp, Homo sapiens
aatctctgattccctgattta

SEQ ID NO: 5117454 - DNA, 21 bp, Homo sapiens
aatctctgcctagaatcttta

SEQ ID NO: 5117455 - DNA, 13 bp, Homo sapiens
aatctctgggggc

SEQ ID NO: 5117456 - DNA, 13 bp, Homo sapiens
aatctctgtaaag

SEQ ID NO: 5117457 - DNA, 11 bp, Homo sapiens
aatctctgtga

SEQ ID NO: 5117458 - DNA, 20 bp, Homo sapiens
aatctctgtgactcgcttag

SEQ ID NO: 5117459 - DNA, 14 bp, Homo sapiens
aatctctgttactc

SEQ ID NO: 5117460 - DNA, 13 bp, Homo sapiens
aatctctgttatg

SEQ ID NO: 5117461 - DNA, 19 bp, Homo sapiens
aatctctgttatgtactgt

SEQ ID NO: 5117462 - DNA, 14 bp, Homo sapiens
aatctctgttctgc

SEQ ID NO: 5117463 - DNA, 22 bp, Homo sapiens
aatctctgttctgtttggcact

SEQ ID NO: 5117464 - DNA, 20 bp, Homo sapiens
aatctcttaatattgagaat

SEQ ID NO: 5117465 - DNA, 17 bp, Homo sapiens
aatctcttcaaattctt

SEQ ID NO: 5117466 - DNA, 13 bp, Homo sapiens
aatctcttcacta

SEQ ID NO: 5117467 - DNA, 19 bp, Homo sapiens
aatctcttcactaccctga

SEQ ID NO: 5117468 - DNA, 19 bp, Homo sapiens
aatctcttcatgcttgaca

SEQ ID NO: 5117469 - DNA, 21 bp, Homo sapiens
aatctcttcatgcttgacata

SEQ ID NO: 5117470 - DNA, 24 bp, Homo sapiens
aatctcttcatgcttgacatacct

SEQ ID NO: 5117471 - DNA, 15 bp, Homo sapiens
aatctcttcattatt

SEQ ID NO: 5117472 - DNA, 21 bp, Homo sapiens
aatctcttcattattctctgc

SEQ ID NO: 5117473 - DNA, 21 bp, Homo sapiens
aatctcttctaaaaaaaaaca

SEQ ID NO: 5117474 - DNA, 16 bp, Homo sapiens
aatctcttgattataa

SEQ ID NO: 5117475 - DNA, 19 bp, Homo sapiens
aatctctttattaaaacag

SEQ ID NO: 5117476 - DNA, 17 bp, Homo sapiens
aatctctttttgtttgc

SEQ ID NO: 5117477 - DNA, 22 bp, Homo sapiens
aatctgaaaagaacaaccctga

SEQ ID NO: 5117478 - DNA, 13 bp, Homo sapiens
aatctgaaacaca

SEQ ID NO: 5117479 - DNA, 20 bp, Homo sapiens
aatctgaagccttttcctga

SEQ ID NO: 5117480 - DNA, 20 bp, Homo sapiens
aatctgaagctattgatgtt

SEQ ID NO: 5117481 - DNA, 18 bp, Homo sapiens
aatctgaatgtaatttgt

SEQ ID NO: 5117482 - DNA, 15 bp, Homo sapiens
aatctgaatttctaa

SEQ ID NO: 5117483 - DNA, 15 bp, Homo sapiens
aatctgaattttgca

SEQ ID NO: 5117484 - DNA, 16 bp, Homo sapiens
aatctgaattttgcaa

SEQ ID NO: 5117485 - DNA, 17 bp, Homo sapiens
aatctgaattttgcaat

SEQ ID NO: 5117486 - DNA, 23 bp, Homo sapiens
aatctgacactaccttatcaggc

SEQ ID NO: 5117487 - DNA, 13 bp, Homo sapiens
aatctgacatatt

SEQ ID NO: 5117488 - DNA, 18 bp, Homo sapiens
aatctgaccacagacact

SEQ ID NO: 5117489 - DNA, 17 bp, Homo sapiens
aatctgacctaaaagtt

SEQ ID NO: 5117490 - DNA, 17 bp, Homo sapiens
aatctgacttctcactt

SEQ ID NO: 5117491 - DNA, 18 bp, Homo sapiens
aatctgacttctcacttc

SEQ ID NO: 5117492 - DNA, 18 bp, Homo sapiens
aatctgagaaactctaca

SEQ ID NO: 5117493 - DNA, 23 bp, Homo sapiens
aatctgagaaagtactttctggt

SEQ ID NO: 5117494 - DNA, 21 bp, Homo sapiens
aatctgagaggtaagaagtaa

SEQ ID NO: 5117495 - DNA, 22 bp, Homo sapiens
aatctgagatctccctccaggg

SEQ ID NO: 5117496 - DNA, 13 bp, Homo sapiens
aatctgagcaggt

SEQ ID NO: 5117497 - DNA, 11 bp, Homo sapiens
aatctgagcct

SEQ ID NO: 5117498 - DNA, 22 bp, Homo sapiens
aatctgagctgcagcctggctg

SEQ ID NO: 5117499 - DNA, 19 bp, Homo sapiens
aatctgaggcatcctctga

SEQ ID NO: 5117500 - DNA, 17 bp, Homo sapiens
aatctgaggcctcctct

SEQ ID NO: 5117501 - DNA, 18 bp, Homo sapiens
aatctgagggaaatgttt

SEQ ID NO: 5117502 - DNA, 21 bp, Homo sapiens
aatctgagggaaatgttttgt

SEQ ID NO: 5117503 - DNA, 13 bp, Homo sapiens
aatctgagtgaat

SEQ ID NO: 5117504 - DNA, 20 bp, Homo sapiens
aatctgatatgtattgtttg

SEQ ID NO: 5117505 - DNA, 16 bp, Homo sapiens
aatctgatcgttcttt

SEQ ID NO: 5117506 - DNA, 19 bp, Homo sapiens
aatctgatcgttctttcta

SEQ ID NO: 5117507 - DNA, 21 bp, Homo sapiens
aatctgatctttttatacaca

SEQ ID NO: 5117508 - DNA, 23 bp, Homo sapiens
aatctgatgaaaatattctgatt

SEQ ID NO: 5117509 - DNA, 14 bp, Homo sapiens
aatctgatggcctt

SEQ ID NO: 5117510 - DNA, 20 bp, Homo sapiens
aatctgatggccttaatttc

SEQ ID NO: 5117511 - DNA, 21 bp, Homo sapiens
aatctgatggccttaatttcc

SEQ ID NO: 5117512 - DNA, 15 bp, Homo sapiens
aatctgattagaagt

SEQ ID NO: 5117513 - DNA, 15 bp, Homo sapiens
aatctgatttaatgt

SEQ ID NO: 5117514 - DNA, 17 bp, Homo sapiens
aatctgatttaatgttt

SEQ ID NO: 5117515 - DNA, 22 bp, Homo sapiens
aatctgatttaatgttttctgc

SEQ ID NO: 5117516 - DNA, 16 bp, Homo sapiens
aatctgcaaaatggag

SEQ ID NO: 5117517 - DNA, 16 bp, Homo sapiens
aatctgcacactccag

SEQ ID NO: 5117518 - DNA, 17 bp, Homo sapiens
aatctgcagaaggaaaa

SEQ ID NO: 5117519 - DNA, 20 bp, Homo sapiens
aatctgcagccattcttcag

SEQ ID NO: 5117520 - DNA, 18 bp, Homo sapiens
aatctgcagggagcaact

SEQ ID NO: 5117521 - DNA, 23 bp, Homo sapiens
aatctgcagggagcaactctcca

SEQ ID NO: 5117522 - DNA, 12 bp, Homo sapiens
aatctgcagtga

SEQ ID NO: 5117523 - DNA, 15 bp, Homo sapiens
aatctgcatgtttga

SEQ ID NO: 5117524 - DNA, 20 bp, Homo sapiens
aatctgcatttagcacaaaa

SEQ ID NO: 5117525 - DNA, 20 bp, Homo sapiens
aatctgcatttattagtatt

SEQ ID NO: 5117526 - DNA, 11 bp, Homo sapiens
aatctgccacc

SEQ ID NO: 5117527 - DNA, 13 bp, Homo sapiens
aatctgccacctg

SEQ ID NO: 5117528 - DNA, 18 bp, Homo sapiens
aatctgccacctgcacag

SEQ ID NO: 5117529 - DNA, 21 bp, Homo sapiens
aatctgccatttcaaatttct

SEQ ID NO: 5117530 - DNA, 11 bp, Homo sapiens
aatctgccttc

SEQ ID NO: 5117531 - DNA, 13 bp, Homo sapiens
aatctgccttcca

SEQ ID NO: 5117532 - DNA, 14 bp, Homo sapiens
aatctgccttccag

SEQ ID NO: 5117533 - DNA, 11 bp, Homo sapiens
aatctgccttt

SEQ ID NO: 5117534 - DNA, 17 bp, Homo sapiens
aatctgcctttgtttct

SEQ ID NO: 5117535 - DNA, 19 bp, Homo sapiens
aatctgctaccaaaacagt

SEQ ID NO: 5117536 - DNA, 21 bp, Homo sapiens
aatctgctggttttaacaact

SEQ ID NO: 5117537 - DNA, 15 bp, Homo sapiens
aatctgctttaatta

SEQ ID NO: 5117538 - DNA, 16 bp, Homo sapiens
aatctgctttaattac

SEQ ID NO: 5117539 - DNA, 17 bp, Homo sapiens
aatctgctttcatccag

SEQ ID NO: 5117540 - DNA, 18 bp, Homo sapiens
aatctgctttcatccagc

SEQ ID NO: 5117541 - DNA, 15 bp, Homo sapiens
aatctggaaatctgt

SEQ ID NO: 5117542 - DNA, 22 bp, Homo sapiens
aatctggaagaaagccctgtgc

SEQ ID NO: 5117543 - DNA, 15 bp, Homo sapiens
aatctggacacttct

SEQ ID NO: 5117544 - DNA, 19 bp, Homo sapiens
aatctggacacttctttat

SEQ ID NO: 5117545 - DNA, 11 bp, Homo sapiens
aatctggatta

SEQ ID NO: 5117546 - DNA, 16 bp, Homo sapiens
aatctggattcatatt

SEQ ID NO: 5117547 - DNA, 18 bp, Homo sapiens
aatctggcaaagttatat

SEQ ID NO: 5117548 - DNA, 18 bp, Homo sapiens
aatctggcactactcagt

SEQ ID NO: 5117549 - DNA, 11 bp, Homo sapiens
aatctggccca

SEQ ID NO: 5117550 - DNA, 16 bp, Homo sapiens
aatctggcccagggtg

SEQ ID NO: 5117551 - DNA, 21 bp, Homo sapiens
aatctggcccttacacactca

SEQ ID NO: 5117552 - DNA, 14 bp, Homo sapiens
aatctggcttctgc

SEQ ID NO: 5117553 - DNA, 17 bp, Homo sapiens
aatctggcttctgcatt

SEQ ID NO: 5117554 - DNA, 15 bp, Homo sapiens
aatctgggaagattt

SEQ ID NO: 5117555 - DNA, 19 bp, Homo sapiens
aatctgggaagatttgaaa

SEQ ID NO: 5117556 - DNA, 19 bp, Homo sapiens
aatctgggactgtgcctgg

SEQ ID NO: 5117557 - DNA, 18 bp, Homo sapiens
aatctgggcatctcgtgc

SEQ ID NO: 5117558 - DNA, 18 bp, Homo sapiens
aatctggggaagaggttt

SEQ ID NO: 5117559 - DNA, 20 bp, Homo sapiens
aatctgggtggtaactgcca

SEQ ID NO: 5117560 - DNA, 14 bp, Homo sapiens
aatctggtctcttc

SEQ ID NO: 5117561 - DNA, 15 bp, Homo sapiens
aatctggtctcttct

SEQ ID NO: 5117562 - DNA, 19 bp, Homo sapiens
aatctggtcttgttagaaa

SEQ ID NO: 5117563 - DNA, 18 bp, Homo sapiens
aatctgtaaaaaagaaaa

SEQ ID NO: 5117564 - DNA, 12 bp, Homo sapiens
aatctgtaaact

SEQ ID NO: 5117565 - DNA, 14 bp, Homo sapiens
aatctgtaaactgt

SEQ ID NO: 5117566 - DNA, 15 bp, Homo sapiens
aatctgtaaactgtg

SEQ ID NO: 5117567 - DNA, 16 bp, Homo sapiens
aatctgtaaactgtgt

SEQ ID NO: 5117568 - DNA, 21 bp, Homo sapiens
aatctgtaacaggtattttgt

SEQ ID NO: 5117569 - DNA, 15 bp, Homo sapiens
aatctgtaactgctt

SEQ ID NO: 5117570 - DNA, 17 bp, Homo sapiens
aatctgtaatcacattt

SEQ ID NO: 5117571 - DNA, 15 bp, Homo sapiens
aatctgtaattacca

SEQ ID NO: 5117572 - DNA, 16 bp, Homo sapiens
aatctgtacaaaatgg

SEQ ID NO: 5117573 - DNA, 17 bp, Homo sapiens
aatctgtacaaaatggt

SEQ ID NO: 5117574 - DNA, 15 bp, Homo sapiens
aatctgtacatgtct

SEQ ID NO: 5117575 - DNA, 13 bp, Homo sapiens
aatctgtacattt

SEQ ID NO: 5117576 - DNA, 12 bp, Homo sapiens
aatctgtacttt

SEQ ID NO: 5117577 - DNA, 18 bp, Homo sapiens
aatctgtacttttttcaa

SEQ ID NO: 5117578 - DNA, 19 bp, Homo sapiens
aatctgtacttttttcaaa

SEQ ID NO: 5117579 - DNA, 16 bp, Homo sapiens
aatctgtagggctgga

SEQ ID NO: 5117580 - DNA, 19 bp, Homo sapiens
aatctgtagggctggacct

SEQ ID NO: 5117581 - DNA, 13 bp, Homo sapiens
aatctgtataaat

SEQ ID NO: 5117582 - DNA, 14 bp, Homo sapiens
aatctgtataaatg

SEQ ID NO: 5117583 - DNA, 18 bp, Homo sapiens
aatctgtataaatgtcta

SEQ ID NO: 5117584 - DNA, 18 bp, Homo sapiens
aatctgtataaatgtgaa

SEQ ID NO: 5117585 - DNA, 17 bp, Homo sapiens
aatctgtcaaaacactg

SEQ ID NO: 5117586 - DNA, 18 bp, Homo sapiens
aatctgtcaaaacactgt

SEQ ID NO: 5117587 - DNA, 20 bp, Homo sapiens
aatctgtcaaaacactgtgg

SEQ ID NO: 5117588 - DNA, 21 bp, Homo sapiens
aatctgtcaaaacactgtgga

SEQ ID NO: 5117589 - DNA, 19 bp, Homo sapiens
aatctgtcaagagtagtta

SEQ ID NO: 5117590 - DNA, 19 bp, Homo sapiens
aatctgtcctctgtagtat

SEQ ID NO: 5117591 - DNA, 13 bp, Homo sapiens
aatctgtcctgtg

SEQ ID NO: 5117592 - DNA, 19 bp, Homo sapiens
aatctgtcgcatttcatca

SEQ ID NO: 5117593 - DNA, 13 bp, Homo sapiens
aatctgtctagaa

SEQ ID NO: 5117594 - DNA, 23 bp, Homo sapiens
aatctgtctagaatcctgcttta

SEQ ID NO: 5117595 - DNA, 18 bp, Homo sapiens
aatctgtctccccagaag

SEQ ID NO: 5117596 - DNA, 18 bp, Homo sapiens
aatctgtctgattctatg

SEQ ID NO: 5117597 - DNA, 22 bp, Homo sapiens
aatctgtctgctggtcacttct

SEQ ID NO: 5117598 - DNA, 23 bp, Homo sapiens
aatctgtctgctggtcacttctt

SEQ ID NO: 5117599 - DNA, 22 bp, Homo sapiens
aatctgtctttgcggggcctgt

SEQ ID NO: 5117600 - DNA, 20 bp, Homo sapiens
aatctgtgaacttgaaattt

SEQ ID NO: 5117601 - DNA, 16 bp, Homo sapiens
aatctgtgacctgtca

SEQ ID NO: 5117602 - DNA, 13 bp, Homo sapiens
aatggaaagcttt

SEQ ID NO: 5117603 - DNA, 14 bp, Homo sapiens
aatggaaagctttt

SEQ ID NO: 5117604 - DNA, 22 bp, Homo sapiens
aatggaaagggtgttggcattg

SEQ ID NO: 5117605 - DNA, 19 bp, Homo sapiens
aatggaaagtaactcattt

SEQ ID NO: 5117606 - DNA, 20 bp, Homo sapiens
aatggaaatttaaatgacat

SEQ ID NO: 5117607 - DNA, 14 bp, Homo sapiens
aatggaaatttata

SEQ ID NO: 5117608 - DNA, 16 bp, Homo sapiens
aatggaaatttataat

SEQ ID NO: 5117609 - DNA, 17 bp, Homo sapiens
aatggaaattttgctat

SEQ ID NO: 5117610 - DNA, 14 bp, Homo sapiens
aatggaaccaggct

SEQ ID NO: 5117611 - DNA, 17 bp, Homo sapiens
aatggaaccaggcttgg

SEQ ID NO: 5117612 - DNA, 19 bp, Homo sapiens
aatggaactactgtacttt

SEQ ID NO: 5117613 - DNA, 16 bp, Homo sapiens
aatggaagaaatggct

SEQ ID NO: 5117614 - DNA, 20 bp, Homo sapiens
aatggaagaagaaaggactg

SEQ ID NO: 5117615 - DNA, 10 bp, Homo sapiens
aatggaagag

SEQ ID NO: 5117616 - DNA, 18 bp, Homo sapiens
aatggaagagaagagaaa

SEQ ID NO: 5117617 - DNA, 15 bp, Homo sapiens
aatggaagatttgcc

SEQ ID NO: 5117618 - DNA, 12 bp, Homo sapiens
aatggaagcaaa

SEQ ID NO: 5117619 - DNA, 22 bp, Homo sapiens
aatggaagcaaaattataagaa

SEQ ID NO: 5117620 - DNA, 17 bp, Homo sapiens
aatggaagcctccacct

SEQ ID NO: 5117621 - DNA, 22 bp, Homo sapiens
aatggaataaaaggcttgaagc

SEQ ID NO: 5117622 - DNA, 20 bp, Homo sapiens
aatggaataacatatcaaat

SEQ ID NO: 5117623 - DNA, 13 bp, Homo sapiens
aatggaataataa

SEQ ID NO: 5117624 - DNA, 13 bp, Homo sapiens
aatggaataatta

SEQ ID NO: 5117625 - DNA, 23 bp, Homo sapiens
aatggaatacagtcattccaaga

SEQ ID NO: 5117626 - DNA, 16 bp, Homo sapiens
aatggaatataaatat

SEQ ID NO: 5117627 - DNA, 22 bp, Homo sapiens
aatggaatataatatgtcttca

SEQ ID NO: 5117628 - DNA, 14 bp, Homo sapiens
aatggaatccatct

SEQ ID NO: 5117629 - DNA, 13 bp, Homo sapiens
aatggaatgagaa

SEQ ID NO: 5117630 - DNA, 15 bp, Homo sapiens
aatggaattactcca

SEQ ID NO: 5117631 - DNA, 15 bp, Homo sapiens
aatggaattattttg

SEQ ID NO: 5117632 - DNA, 17 bp, Homo sapiens
aatggaattcgtgttat

SEQ ID NO: 5117633 - DNA, 23 bp, Homo sapiens
aatggaattcgtgttatgaatct

SEQ ID NO: 5117634 - DNA, 16 bp, Homo sapiens
aatggacaaagaaaac

SEQ ID NO: 5117635 - DNA, 17 bp, Homo sapiens
aatggacaaataagttt

SEQ ID NO: 5117636 - DNA, 21 bp, Homo sapiens
aatggacacaaattttcaagt

SEQ ID NO: 5117637 - DNA, 19 bp, Homo sapiens
aatggacataggactcaaa

SEQ ID NO: 5117638 - DNA, 22 bp, Homo sapiens
aatggacatcctgtataagcac

SEQ ID NO: 5117639 - DNA, 14 bp, Homo sapiens
aatggacatggtgg

SEQ ID NO: 5117640 - DNA, 20 bp, Homo sapiens
aatggaccctctcctggact

SEQ ID NO: 5117641 - DNA, 21 bp, Homo sapiens
aatggaccctctcctggactc

SEQ ID NO: 5117642 - DNA, 16 bp, Homo sapiens
aatggactatccatta

SEQ ID NO: 5117643 - DNA, 20 bp, Homo sapiens
aatggactatgcacactttt

SEQ ID NO: 5117644 - DNA, 14 bp, Homo sapiens
aatggactcaaact

SEQ ID NO: 5117645 - DNA, 16 bp, Homo sapiens
aatggactgaccttaa

SEQ ID NO: 5117646 - DNA, 13 bp, Homo sapiens
aatggactgcacc

SEQ ID NO: 5117647 - DNA, 15 bp, Homo sapiens
aatggactggccagc

SEQ ID NO: 5117648 - DNA, 18 bp, Homo sapiens
aatggactggcttggcca

SEQ ID NO: 5117649 - DNA, 16 bp, Homo sapiens
aatggactgtggtgac

SEQ ID NO: 5117650 - DNA, 20 bp, Homo sapiens
aatggactgtggtgactttg

SEQ ID NO: 5117651 - DNA, 14 bp, Homo sapiens
aatggacttcaaat

SEQ ID NO: 5117652 - DNA, 14 bp, Homo sapiens
aatggacttgcttc

SEQ ID NO: 5117653 - DNA, 14 bp, Homo sapiens
aatggagaaaatga

SEQ ID NO: 5117654 - DNA, 21 bp, Homo sapiens
aatggagaaaatgaatggaca

SEQ ID NO: 5117655 - DNA, 12 bp, Homo sapiens
aatggagaaagt

SEQ ID NO: 5117656 - DNA, 14 bp, Homo sapiens
aatggagaagctct

SEQ ID NO: 5117657 - DNA, 20 bp, Homo sapiens
aatggagagaatacaataac

SEQ ID NO: 5117658 - DNA, 17 bp, Homo sapiens
aatggagctttctgtat

SEQ ID NO: 5117659 - DNA, 17 bp, Homo sapiens
aatggaggaagaacaac

SEQ ID NO: 5117660 - DNA, 14 bp, Homo sapiens
aatggaggagccag

SEQ ID NO: 5117661 - DNA, 20 bp, Homo sapiens
aatggaggagccaggcccca

SEQ ID NO: 5117662 - DNA, 18 bp, Homo sapiens
aatggaggagtctcaaca

SEQ ID NO: 5117663 - DNA, 23 bp, Homo sapiens
aatggaggataattgaggctaag

SEQ ID NO: 5117664 - DNA, 20 bp, Homo sapiens
aatggaggatctctaaagag

SEQ ID NO: 5117665 - DNA, 13 bp, Homo sapiens
aatggaggcagag

SEQ ID NO: 5117666 - DNA, 20 bp, Homo sapiens
aatggaggccatatttccat

SEQ ID NO: 5117667 - DNA, 18 bp, Homo sapiens
aatggaggcttttcactg

SEQ ID NO: 5117668 - DNA, 14 bp, Homo sapiens
aatggagggagcca

SEQ ID NO: 5117669 - DNA, 22 bp, Homo sapiens
aatggaggggcagagccaggaa

SEQ ID NO: 5117670 - DNA, 15 bp, Homo sapiens
aatggagggtggggc

SEQ ID NO: 5117671 - DNA, 15 bp, Homo sapiens
aatggaggtacagga

SEQ ID NO: 5117672 - DNA, 14 bp, Homo sapiens
aatggaggtcccag

SEQ ID NO: 5117673 - DNA, 20 bp, Homo sapiens
aatggaggtcccagccctgg

SEQ ID NO: 5117674 - DNA, 19 bp, Homo sapiens
aatggagtagacccctggc

SEQ ID NO: 5117675 - DNA, 19 bp, Homo sapiens
aatggagtcagtttgcagt

SEQ ID NO: 5117676 - DNA, 21 bp, Homo sapiens
aatggagtgggagatcagcca

SEQ ID NO: 5117677 - DNA, 15 bp, Homo sapiens
aatggagtgtttgaa

SEQ ID NO: 5117678 - DNA, 16 bp, Homo sapiens
aatggagtgtttgaaa

SEQ ID NO: 5117679 - DNA, 20 bp, Homo sapiens
aatggagttaaactttagtg

SEQ ID NO: 5117680 - DNA, 17 bp, Homo sapiens
aatggatacataaagac

SEQ ID NO: 5117681 - DNA, 18 bp, Homo sapiens
aatggatacataaagact

SEQ ID NO: 5117682 - DNA, 19 bp, Homo sapiens
aatggatactacatcttta

SEQ ID NO: 5117683 - DNA, 18 bp, Homo sapiens
aatggatagaaaaaaact

SEQ ID NO: 5117684 - DNA, 12 bp, Homo sapiens
aatggatattaa

SEQ ID NO: 5117685 - DNA, 16 bp, Homo sapiens
aatggatcaatacaca

SEQ ID NO: 5117686 - DNA, 15 bp, Homo sapiens
aatggatcagccaag

SEQ ID NO: 5117687 - DNA, 13 bp, Homo sapiens
aatggatccacaa

SEQ ID NO: 5117688 - DNA, 20 bp, Homo sapiens
aatggatccccagtgaaaac

SEQ ID NO: 5117689 - DNA, 22 bp, Homo sapiens
aatggatccccagtgaaaacta

SEQ ID NO: 5117690 - DNA, 15 bp, Homo sapiens
aatggatgacaaaga

SEQ ID NO: 5117691 - DNA, 16 bp, Homo sapiens
aatggatgacaaagaa

SEQ ID NO: 5117692 - DNA, 22 bp, Homo sapiens
aatggatgccttgaataataag

SEQ ID NO: 5117693 - DNA, 13 bp, Homo sapiens
aatggatgtaata

SEQ ID NO: 5117694 - DNA, 17 bp, Homo sapiens
aatggattaattactaa

SEQ ID NO: 5117695 - DNA, 17 bp, Homo sapiens
aatggattatacaaaaa

SEQ ID NO: 5117696 - DNA, 14 bp, Homo sapiens
aatggattctctat

SEQ ID NO: 5117697 - DNA, 16 bp, Homo sapiens
aatggattggattatt

SEQ ID NO: 5117698 - DNA, 22 bp, Homo sapiens
aatggattggattatttaataa

SEQ ID NO: 5117699 - DNA, 18 bp, Homo sapiens
aatggattgttaatttca

SEQ ID NO: 5117700 - DNA, 20 bp, Homo sapiens
aatggatttcctagtggagt

SEQ ID NO: 5117701 - DNA, 13 bp, Homo sapiens
aatggatttttct

SEQ ID NO: 5117702 - DNA, 17 bp, Homo sapiens
aatggatttttctttaa

SEQ ID NO: 5117703 - DNA, 20 bp, Homo sapiens
aatggatttttctttaactg

SEQ ID NO: 5117704 - DNA, 19 bp, Homo sapiens
aatggattttttttttcag

SEQ ID NO: 5117705 - DNA, 22 bp, Homo sapiens
aatggattttttttttcaggtt

SEQ ID NO: 5117706 - DNA, 13 bp, Homo sapiens
aatggcaaatgca

SEQ ID NO: 5117707 - DNA, 14 bp, Homo sapiens
aatggcaacaaact

SEQ ID NO: 5117708 - DNA, 17 bp, Homo sapiens
aatggcaacaaactgca

SEQ ID NO: 5117709 - DNA, 13 bp, Homo sapiens
aatggcaagagat

SEQ ID NO: 5117710 - DNA, 18 bp, Homo sapiens
aatggcaagagatcatat

SEQ ID NO: 5117711 - DNA, 16 bp, Homo sapiens
aatggcaagttttgat

SEQ ID NO: 5117712 - DNA, 21 bp, Homo sapiens
aatggcaatagggtagaatga

SEQ ID NO: 5117713 - DNA, 15 bp, Homo sapiens
aatggcacctctgcc

SEQ ID NO: 5117714 - DNA, 18 bp, Homo sapiens
aatggcacgatctcagct

SEQ ID NO: 5117715 - DNA, 17 bp, Homo sapiens
aatggcactgagaaaca

SEQ ID NO: 5117716 - DNA, 18 bp, Homo sapiens
aatggcagaaagatggag

SEQ ID NO: 5117717 - DNA, 16 bp, Homo sapiens
aatggcagcagaaaac

SEQ ID NO: 5117718 - DNA, 18 bp, Homo sapiens
aatggcagcagaaaactt

SEQ ID NO: 5117719 - DNA, 19 bp, Homo sapiens
aatggcagcagttccatga

SEQ ID NO: 5117720 - DNA, 22 bp, Homo sapiens
aatggcagcagttccatgaaga

SEQ ID NO: 5117721 - DNA, 12 bp, Homo sapiens
aatggcagcctt

SEQ ID NO: 5117722 - DNA, 19 bp, Homo sapiens
aatggcaggggaagccttg

SEQ ID NO: 5117723 - DNA, 16 bp, Homo sapiens
aatggcaggttttaca

SEQ ID NO: 5117724 - DNA, 19 bp, Homo sapiens
aatggcagtatttcatttc

SEQ ID NO: 5117725 - DNA, 17 bp, Homo sapiens
aatggcagtcctggagg

SEQ ID NO: 5117726 - DNA, 18 bp, Homo sapiens
aatggcagtgactcccca

SEQ ID NO: 5117727 - DNA, 17 bp, Homo sapiens
aatggcagttatatttt

SEQ ID NO: 5117728 - DNA, 15 bp, Homo sapiens
aatggcataacaaag

SEQ ID NO: 5117729 - DNA, 13 bp, Homo sapiens
aatggcatggcag

SEQ ID NO: 5117730 - DNA, 23 bp, Homo sapiens
aatggcatttagcacagtattta

SEQ ID NO: 5117731 - DNA, 15 bp, Homo sapiens
aatggcatttgcaat

SEQ ID NO: 5117732 - DNA, 23 bp, Homo sapiens
aatggcatttttttagtaaatta

SEQ ID NO: 5117733 - DNA, 19 bp, Homo sapiens
aatggccaagtgtacattt

SEQ ID NO: 5117734 - DNA, 19 bp, Homo sapiens
aatggccagagcctctggc

SEQ ID NO: 5117735 - DNA, 14 bp, Homo sapiens
aatggccaggggcc

SEQ ID NO: 5117736 - DNA, 15 bp, Homo sapiens
aatggccaggggcca

SEQ ID NO: 5117737 - DNA, 15 bp, Homo sapiens
aatggccatgcagga

SEQ ID NO: 5117738 - DNA, 18 bp, Homo sapiens
aatggccatgcaggaggt

SEQ ID NO: 5117739 - DNA, 17 bp, Homo sapiens
aatggccatttgctttt

SEQ ID NO: 5117740 - DNA, 12 bp, Homo sapiens
aatggccctgtt

SEQ ID NO: 5117741 - DNA, 17 bp, Homo sapiens
aatggcctcctccctta

SEQ ID NO: 5117742 - DNA, 15 bp, Homo sapiens
aatggcctcttaaaa

SEQ ID NO: 5117743 - DNA, 13 bp, Homo sapiens
aatggcctggagc

SEQ ID NO: 5117744 - DNA, 18 bp, Homo sapiens
aatggcctggagcaggcc

SEQ ID NO: 5117745 - DNA, 14 bp, Homo sapiens
aatggcctggaggg

SEQ ID NO: 5117746 - DNA, 19 bp, Homo sapiens
aatggcctggtaggtctgg

SEQ ID NO: 5117747 - DNA, 16 bp, Homo sapiens
aatggccttaattaat

SEQ ID NO: 5117748 - DNA, 17 bp, Homo sapiens
aatggccttcatatcat

SEQ ID NO: 5117749 - DNA, 22 bp, Homo sapiens
aatggccttcccgccggaggcc

SEQ ID NO: 5117750 - DNA, 19 bp, Homo sapiens
aatggcgcagtgcctctgg

SEQ ID NO: 5117751 - DNA, 17 bp, Homo sapiens
aatggcgtctgctctgg

SEQ ID NO: 5117752 - DNA, 20 bp, Homo sapiens
aatggcgtctggaagtccaa

SEQ ID NO: 5117753 - DNA, 18 bp, Homo sapiens
aatggctaataaactgta

SEQ ID NO: 5117754 - DNA, 22 bp, Homo sapiens
aatggctaataaactgtattaa

SEQ ID NO: 5117755 - DNA, 20 bp, Homo sapiens
aatggctacatctccaaata

SEQ ID NO: 5117756 - DNA, 14 bp, Homo sapiens
aatggctattaaca

SEQ ID NO: 5117757 - DNA, 21 bp, Homo sapiens
aatggctcactatggtgccaa

SEQ ID NO: 5117758 - DNA, 23 bp, Homo sapiens
aatggctcgtgggctctggctcc

SEQ ID NO: 5117759 - DNA, 12 bp, Homo sapiens
aatggctctggg

SEQ ID NO: 5117760 - DNA, 18 bp, Homo sapiens
aatggctgataattttaa

SEQ ID NO: 5117761 - DNA, 19 bp, Homo sapiens
aatggctgataattttaaa

SEQ ID NO: 5117762 - DNA, 21 bp, Homo sapiens
aatggctgcagtgacccagat

SEQ ID NO: 5117763 - DNA, 22 bp, Homo sapiens
aatggctggggccgctggggtc

SEQ ID NO: 5117764 - DNA, 16 bp, Homo sapiens
aatggctgggtcaggg

SEQ ID NO: 5117765 - DNA, 21 bp, Homo sapiens
aatggctgggtcagggccaga

SEQ ID NO: 5117766 - DNA, 12 bp, Homo sapiens
aatggctgtgcc

SEQ ID NO: 5117767 - DNA, 22 bp, Homo sapiens
aatggcttatccagctggtgag

SEQ ID NO: 5117768 - DNA, 14 bp, Homo sapiens
aatggcttgttcat

SEQ ID NO: 5117769 - DNA, 15 bp, Homo sapiens
aatggctttgtactt

SEQ ID NO: 5117770 - DNA, 16 bp, Homo sapiens
aatggctttgtataga

SEQ ID NO: 5117771 - DNA, 17 bp, Homo sapiens
aatggcttttcttaccc

SEQ ID NO: 5117772 - DNA, 21 bp, Homo sapiens
aatgggaaaaaacttaaaaat

SEQ ID NO: 5117773 - DNA, 21 bp, Homo sapiens
aatgggaaagtatttttgaaa

SEQ ID NO: 5117774 - DNA, 20 bp, Homo sapiens
aatgggaaatactactcctg

SEQ ID NO: 5117775 - DNA, 22 bp, Homo sapiens
aatgggaactgcctctttcctg

SEQ ID NO: 5117776 - DNA, 16 bp, Homo sapiens
aatgggaagcagggaa

SEQ ID NO: 5117777 - DNA, 13 bp, Homo sapiens
aatgggaatcatg

SEQ ID NO: 5117778 - DNA, 17 bp, Homo sapiens
aatgggaatcattccac

SEQ ID NO: 5117779 - DNA, 17 bp, Homo sapiens
aatgggaattgcgctca

SEQ ID NO: 5117780 - DNA, 20 bp, Homo sapiens
aatgggactgatgtcatctt

SEQ ID NO: 5117781 - DNA, 19 bp, Homo sapiens
aatctgtgacctgtcagaa

SEQ ID NO: 5117782 - DNA, 14 bp, Homo sapiens
aatctgtgagaagt

SEQ ID NO: 5117783 - DNA, 18 bp, Homo sapiens
aatctgtgagaagttttt

SEQ ID NO: 5117784 - DNA, 13 bp, Homo sapiens
aatctgtgcaata

SEQ ID NO: 5117785 - DNA, 15 bp, Homo sapiens
aatctgtgcaataaa

SEQ ID NO: 5117786 - DNA, 17 bp, Homo sapiens
aatctgtgcaataaaat

SEQ ID NO: 5117787 - DNA, 22 bp, Homo sapiens
aatctgtgcaataaaataacag

SEQ ID NO: 5117788 - DNA, 19 bp, Homo sapiens
aatctgtgggtctgggagt

SEQ ID NO: 5117789 - DNA, 20 bp, Homo sapiens
aatctgtgtaagaaaacaaa

SEQ ID NO: 5117790 - DNA, 18 bp, Homo sapiens
aatctgtgtacaaagaaa

SEQ ID NO: 5117791 - DNA, 18 bp, Homo sapiens
aatctgtgtagacgaagg

SEQ ID NO: 5117792 - DNA, 19 bp, Homo sapiens
aatctgtgtgcatatttgt

SEQ ID NO: 5117793 - DNA, 17 bp, Homo sapiens
aatctgttactgaaatg

SEQ ID NO: 5117794 - DNA, 20 bp, Homo sapiens
aatctgttatgtactagtgt

SEQ ID NO: 5117795 - DNA, 19 bp, Homo sapiens
aatctgttctgggctcttt

SEQ ID NO: 5117796 - DNA, 21 bp, Homo sapiens
aatctgttgataaatccatca

SEQ ID NO: 5117797 - DNA, 21 bp, Homo sapiens
aatctgttgttccaaatgtgt

SEQ ID NO: 5117798 - DNA, 19 bp, Homo sapiens
aatctgttgtttgaagaac

SEQ ID NO: 5117799 - DNA, 15 bp, Homo sapiens
aatctgtttctatgt

SEQ ID NO: 5117800 - DNA, 17 bp, Homo sapiens
aatctgtttctctgctg

SEQ ID NO: 5117801 - DNA, 23 bp, Homo sapiens
aatctgtttgtgcaaacataata

SEQ ID NO: 5117802 - DNA, 12 bp, Homo sapiens
aatctgttttgg

SEQ ID NO: 5117803 - DNA, 17 bp, Homo sapiens
aatctgttttgtatatg

SEQ ID NO: 5117804 - DNA, 22 bp, Homo sapiens
aatctgttttgtatatgatcta

SEQ ID NO: 5117805 - DNA, 23 bp, Homo sapiens
aatctgtttttgtttatttcatt

SEQ ID NO: 5117806 - DNA, 13 bp, Homo sapiens
aatcttaaacaat

SEQ ID NO: 5117807 - DNA, 17 bp, Homo sapiens
aatcttaaacaatgtat

SEQ ID NO: 5117808 - DNA, 19 bp, Homo sapiens
aatcttaaacaatgtataa

SEQ ID NO: 5117809 - DNA, 14 bp, Homo sapiens
aatcttaaagacaa

SEQ ID NO: 5117810 - DNA, 17 bp, Homo sapiens
aatcttaaagacaaatt

SEQ ID NO: 5117811 - DNA, 17 bp, Homo sapiens
aatcttaaattttgacg

SEQ ID NO: 5117812 - DNA, 13 bp, Homo sapiens
aatcttaacaaaa

SEQ ID NO: 5117813 - DNA, 14 bp, Homo sapiens
aatcttaacatcat

SEQ ID NO: 5117814 - DNA, 19 bp, Homo sapiens
aatcttaaggtgtagccac

SEQ ID NO: 5117815 - DNA, 23 bp, Homo sapiens
aatcttaagtaccaatgggaagc

SEQ ID NO: 5117816 - DNA, 15 bp, Homo sapiens
aatcttaagtcataa

SEQ ID NO: 5117817 - DNA, 19 bp, Homo sapiens
aatcttaagtcataatgaa

SEQ ID NO: 5117818 - DNA, 12 bp, Homo sapiens
aatcttaatact

SEQ ID NO: 5117819 - DNA, 14 bp, Homo sapiens
aatcttaatactgt

SEQ ID NO: 5117820 - DNA, 19 bp, Homo sapiens
aatcttaatacttgaactg

SEQ ID NO: 5117821 - DNA, 20 bp, Homo sapiens
aatcttaatcgatgaatgta

SEQ ID NO: 5117822 - DNA, 14 bp, Homo sapiens
aatcttaatgtctg

SEQ ID NO: 5117823 - DNA, 19 bp, Homo sapiens
aatcttaatgtctggtgtt

SEQ ID NO: 5117824 - DNA, 13 bp, Homo sapiens
aatcttacaaaat

SEQ ID NO: 5117825 - DNA, 17 bp, Homo sapiens
aatcttacaaaatcctg

SEQ ID NO: 5117826 - DNA, 22 bp, Homo sapiens
aatcttacaaaatcctggaaga

SEQ ID NO: 5117827 - DNA, 15 bp, Homo sapiens
aatcttacagagtga

SEQ ID NO: 5117828 - DNA, 23 bp, Homo sapiens
aatcttacagctgggtggcactg

SEQ ID NO: 5117829 - DNA, 16 bp, Homo sapiens
aatcttaccagatgct

SEQ ID NO: 5117830 - DNA, 17 bp, Homo sapiens
aatcttaccagatgcta

SEQ ID NO: 5117831 - DNA, 19 bp, Homo sapiens
aatcttacccttcaatgtt

SEQ ID NO: 5117832 - DNA, 14 bp, Homo sapiens
aatcttactctaga

SEQ ID NO: 5117833 - DNA, 18 bp, Homo sapiens
aatcttactttgtaaatt

SEQ ID NO: 5117834 - DNA, 14 bp, Homo sapiens
aatcttagataact

SEQ ID NO: 5117835 - DNA, 19 bp, Homo sapiens
aatcttaggggagagcttt

SEQ ID NO: 5117836 - DNA, 21 bp, Homo sapiens
aatcttagtatagtagaaaga

SEQ ID NO: 5117837 - DNA, 13 bp, Homo sapiens
aatcttataaaaa

SEQ ID NO: 5117838 - DNA, 15 bp, Homo sapiens
aatcttataattgtt

SEQ ID NO: 5117839 - DNA, 12 bp, Homo sapiens
aatcttatacaa

SEQ ID NO: 5117840 - DNA, 14 bp, Homo sapiens
aatcttatacaaca

SEQ ID NO: 5117841 - DNA, 14 bp, Homo sapiens
aatcttatagttct

SEQ ID NO: 5117842 - DNA, 15 bp, Homo sapiens
aatcttatagttcta

SEQ ID NO: 5117843 - DNA, 15 bp, Homo sapiens
aatcttatgcttaaa

SEQ ID NO: 5117844 - DNA, 13 bp, Homo sapiens
aatcttatgttga

SEQ ID NO: 5117845 - DNA, 17 bp, Homo sapiens
aatcttattaaagtttc

SEQ ID NO: 5117846 - DNA, 18 bp, Homo sapiens
aatcttattaaagtttca

SEQ ID NO: 5117847 - DNA, 19 bp, Homo sapiens
aatcttattaaagtttcaa

SEQ ID NO: 5117848 - DNA, 22 bp, Homo sapiens
aatcttattccgagcattccag

SEQ ID NO: 5117849 - DNA, 14 bp, Homo sapiens
aatcttattgttta

SEQ ID NO: 5117850 - DNA, 18 bp, Homo sapiens
aatcttattttatcttct

SEQ ID NO: 5117851 - DNA, 22 bp, Homo sapiens
aatcttatttttcctgtcctgc

SEQ ID NO: 5117852 - DNA, 17 bp, Homo sapiens
aatcttcaaagccttct

SEQ ID NO: 5117853 - DNA, 17 bp, Homo sapiens
aatcttcacctcagagt

SEQ ID NO: 5117854 - DNA, 22 bp, Homo sapiens
aatcttcactgaatatcatatg

SEQ ID NO: 5117855 - DNA, 19 bp, Homo sapiens
aatcttcagctgaacacaa

SEQ ID NO: 5117856 - DNA, 13 bp, Homo sapiens
aatcttcagctgg

SEQ ID NO: 5117857 - DNA, 17 bp, Homo sapiens
aatcttcagctggtgga

SEQ ID NO: 5117858 - DNA, 23 bp, Homo sapiens
aatcttcagctggtggatggtga

SEQ ID NO: 5117859 - DNA, 20 bp, Homo sapiens
aatcttcagtattttctcca

SEQ ID NO: 5117860 - DNA, 21 bp, Homo sapiens
aatcttcatggaattcacaaa

SEQ ID NO: 5117861 - DNA, 17 bp, Homo sapiens
aatcttcctctggagct

SEQ ID NO: 5117862 - DNA, 10 bp, Homo sapiens
aatcttcctg

SEQ ID NO: 5117863 - DNA, 17 bp, Homo sapiens
aatcttcctggcacaat

SEQ ID NO: 5117864 - DNA, 19 bp, Homo sapiens
aatcttcctggtcgaaagt

SEQ ID NO: 5117865 - DNA, 23 bp, Homo sapiens
aatcttcctggtcgaaagttagt

SEQ ID NO: 5117866 - DNA, 16 bp, Homo sapiens
aatcttctctcttgat

SEQ ID NO: 5117867 - DNA, 13 bp, Homo sapiens
aatcttctgaact

SEQ ID NO: 5117868 - DNA, 20 bp, Homo sapiens
aatcttctgaacttggcgct

SEQ ID NO: 5117869 - DNA, 13 bp, Homo sapiens
aatcttgaaaatg

SEQ ID NO: 5117870 - DNA, 14 bp, Homo sapiens
aatcttgaaattaa

SEQ ID NO: 5117871 - DNA, 16 bp, Homo sapiens
aatcttgatagctaaa

SEQ ID NO: 5117872 - DNA, 23 bp, Homo sapiens
aatcttgatcagttaagaaattt

SEQ ID NO: 5117873 - DNA, 15 bp, Homo sapiens
aatcttgatcattcc

SEQ ID NO: 5117874 - DNA, 18 bp, Homo sapiens
aatcttgcagttttgtaa

SEQ ID NO: 5117875 - DNA, 19 bp, Homo sapiens
aatcttgcagttttgtaag

SEQ ID NO: 5117876 - DNA, 20 bp, Homo sapiens
aatcttgcataagctgaact

SEQ ID NO: 5117877 - DNA, 17 bp, Homo sapiens
aatcttgcttcattgtt

SEQ ID NO: 5117878 - DNA, 22 bp, Homo sapiens
aatcttgctttctttagaattt

SEQ ID NO: 5117879 - DNA, 18 bp, Homo sapiens
aatcttgctttctttgtt

SEQ ID NO: 5117880 - DNA, 12 bp, Homo sapiens
aatcttggaagt

SEQ ID NO: 5117881 - DNA, 18 bp, Homo sapiens
aatcttggcgagtcatta

SEQ ID NO: 5117882 - DNA, 14 bp, Homo sapiens
aatcttggcttctt

SEQ ID NO: 5117883 - DNA, 18 bp, Homo sapiens
aatcttggcttcttaaaa

SEQ ID NO: 5117884 - DNA, 15 bp, Homo sapiens
aatcttggggctgat

SEQ ID NO: 5117885 - DNA, 18 bp, Homo sapiens
aatcttggggctgatgaa

SEQ ID NO: 5117886 - DNA, 22 bp, Homo sapiens
aatcttggtgtaacttaaatat

SEQ ID NO: 5117887 - DNA, 13 bp, Homo sapiens
aatcttggtttgc

SEQ ID NO: 5117888 - DNA, 15 bp, Homo sapiens
aatcttgtagacact

SEQ ID NO: 5117889 - DNA, 19 bp, Homo sapiens
aatcttgtagacacttact

SEQ ID NO: 5117890 - DNA, 19 bp, Homo sapiens
aatcttgtcatgtgtataa

SEQ ID NO: 5117891 - DNA, 17 bp, Homo sapiens
aatcttgtccaagttgt

SEQ ID NO: 5117892 - DNA, 13 bp, Homo sapiens
aatcttgtctaac

SEQ ID NO: 5117893 - DNA, 16 bp, Homo sapiens
aatcttgtgctagaat

SEQ ID NO: 5117894 - DNA, 12 bp, Homo sapiens
aatcttgtgtta

SEQ ID NO: 5117895 - DNA, 20 bp, Homo sapiens
aatcttgttaatttcattcc

SEQ ID NO: 5117896 - DNA, 15 bp, Homo sapiens
aatcttgttactgct

SEQ ID NO: 5117897 - DNA, 18 bp, Homo sapiens
aatcttgttactgctgat

SEQ ID NO: 5117898 - DNA, 22 bp, Homo sapiens
aatcttgttactgctgattctt

SEQ ID NO: 5117899 - DNA, 19 bp, Homo sapiens
aatcttgttggttcaccat

SEQ ID NO: 5117900 - DNA, 17 bp, Homo sapiens
aatcttgtttctgaaaa

SEQ ID NO: 5117901 - DNA, 23 bp, Homo sapiens
aatcttgtttgttactgtcattc

SEQ ID NO: 5117902 - DNA, 17 bp, Homo sapiens
aatcttgttttaagcaa

SEQ ID NO: 5117903 - DNA, 17 bp, Homo sapiens
aatcttgttttgaaaat

SEQ ID NO: 5117904 - DNA, 20 bp, Homo sapiens
aatcttgttttgtttgcttc

SEQ ID NO: 5117905 - DNA, 22 bp, Homo sapiens
aatcttgttttgtttgcttcca

SEQ ID NO: 5117906 - DNA, 20 bp, Homo sapiens
aatctttaaaaaaaaaattg

SEQ ID NO: 5117907 - DNA, 21 bp, Homo sapiens
aatctttaaaagatgctttta

SEQ ID NO: 5117908 - DNA, 17 bp, Homo sapiens
aatctttaactgaactc

SEQ ID NO: 5117909 - DNA, 15 bp, Homo sapiens
aatctttaattttac

SEQ ID NO: 5117910 - DNA, 16 bp, Homo sapiens
aatctttaattttaca

SEQ ID NO: 5117911 - DNA, 17 bp, Homo sapiens
aatctttagaaaaggca

SEQ ID NO: 5117912 - DNA, 12 bp, Homo sapiens
aatctttagcct

SEQ ID NO: 5117913 - DNA, 16 bp, Homo sapiens
aatctttataaatgta

SEQ ID NO: 5117914 - DNA, 20 bp, Homo sapiens
aatctttatagtaaaatttt

SEQ ID NO: 5117915 - DNA, 11 bp, Homo sapiens
aatctttatgt

SEQ ID NO: 5117916 - DNA, 20 bp, Homo sapiens
aatctttattatgcattctt

SEQ ID NO: 5117917 - DNA, 22 bp, Homo sapiens
aatctttattcaaacttttatt

SEQ ID NO: 5117918 - DNA, 15 bp, Homo sapiens
aatctttattgagaa

SEQ ID NO: 5117919 - DNA, 18 bp, Homo sapiens
aatctttattgagaaaga

SEQ ID NO: 5117920 - DNA, 22 bp, Homo sapiens
aatctttattttattattcaga

SEQ ID NO: 5117921 - DNA, 19 bp, Homo sapiens
aatctttcaacttatttct

SEQ ID NO: 5117922 - DNA, 23 bp, Homo sapiens
aatctttcaccaagtaaatttgt

SEQ ID NO: 5117923 - DNA, 18 bp, Homo sapiens
aatctttcacttgaaaga

SEQ ID NO: 5117924 - DNA, 21 bp, Homo sapiens
aatctttcagaatacaattca

SEQ ID NO: 5117925 - DNA, 16 bp, Homo sapiens
aatctttcatacatat

SEQ ID NO: 5117926 - DNA, 18 bp, Homo sapiens
aatctttcatacatatat

SEQ ID NO: 5117927 - DNA, 16 bp, Homo sapiens
aatctttccatctcat

SEQ ID NO: 5117928 - DNA, 14 bp, Homo sapiens
aatctttctacctc

SEQ ID NO: 5117929 - DNA, 16 bp, Homo sapiens
aatctttctatataaa

SEQ ID NO: 5117930 - DNA, 20 bp, Homo sapiens
aatctttctatataaaatgt

SEQ ID NO: 5117931 - DNA, 23 bp, Homo sapiens
aatctttctatattttttaaatt

SEQ ID NO: 5117932 - DNA, 15 bp, Homo sapiens
aatctttctcctggt

SEQ ID NO: 5117933 - DNA, 18 bp, Homo sapiens
aatctttctcctggtgac

SEQ ID NO: 5117934 - DNA, 13 bp, Homo sapiens
aatctttctgcag

SEQ ID NO: 5117935 - DNA, 22 bp, Homo sapiens
aatctttctggaattgatgttt

SEQ ID NO: 5117936 - DNA, 21 bp, Homo sapiens
aatctttctttacctgagacc

SEQ ID NO: 5117937 - DNA, 20 bp, Homo sapiens
aatctttctttcttagaaat

SEQ ID NO: 5117938 - DNA, 21 bp, Homo sapiens
aatctttctttcttagaaatt

SEQ ID NO: 5117939 - DNA, 16 bp, Homo sapiens
aatctttctttcttcc

SEQ ID NO: 5117940 - DNA, 21 bp, Homo sapiens
aatctttctttggggaaaaat

SEQ ID NO: 5117941 - DNA, 23 bp, Homo sapiens
aatctttgaaagacttccaaaga

SEQ ID NO: 5117942 - DNA, 13 bp, Homo sapiens
aatctttgaaata

SEQ ID NO: 5117943 - DNA, 15 bp, Homo sapiens
aatctttgattcaga

SEQ ID NO: 5117944 - DNA, 17 bp, Homo sapiens
aatctttggtggccaaa

SEQ ID NO: 5117945 - DNA, 23 bp, Homo sapiens
aatctttgtaccaaaattttaaa

SEQ ID NO: 5117946 - DNA, 16 bp, Homo sapiens
aatctttgtgaacatt

SEQ ID NO: 5117947 - DNA, 22 bp, Homo sapiens
aatctttgtgacaggaaagccc

SEQ ID NO: 5117948 - DNA, 13 bp, Homo sapiens
aatctttgttaag

SEQ ID NO: 5117949 - DNA, 22 bp, Homo sapiens
aatctttgtttcaggttcagta

SEQ ID NO: 5117950 - DNA, 21 bp, Homo sapiens
aatcttttacaactgcctcga

SEQ ID NO: 5117951 - DNA, 12 bp, Homo sapiens
aatcttttataa

SEQ ID NO: 5117952 - DNA, 15 bp, Homo sapiens
aatcttttcacaaat

SEQ ID NO: 5117953 - DNA, 17 bp, Homo sapiens
aatcttttcacaaataa

SEQ ID NO: 5117954 - DNA, 15 bp, Homo sapiens
aatcttttcttattt

SEQ ID NO: 5117955 - DNA, 18 bp, Homo sapiens
aatcttttgggggaaact

SEQ ID NO: 5117956 - DNA, 20 bp, Homo sapiens
aatcttttggggtcatcttt

SEQ ID NO: 5117957 - DNA, 15 bp, Homo sapiens
aatcttttgtagttt

SEQ ID NO: 5117958 - DNA, 15 bp, Homo sapiens
aatctttttctccac

SEQ ID NO: 5117959 - DNA, 22 bp, Homo sapiens
aatgggactgatgtcatcttga

SEQ ID NO: 5117960 - DNA, 18 bp, Homo sapiens
aatgggactggagtccct

SEQ ID NO: 5117961 - DNA, 21 bp, Homo sapiens
aatgggagaatcagcagaacc

SEQ ID NO: 5117962 - DNA, 14 bp, Homo sapiens
aatgggagccagaa

SEQ ID NO: 5117963 - DNA, 14 bp, Homo sapiens
aatgggagccagga

SEQ ID NO: 5117964 - DNA, 12 bp, Homo sapiens
aatgggagctga

SEQ ID NO: 5117965 - DNA, 14 bp, Homo sapiens
aatgggaggaggaa

SEQ ID NO: 5117966 - DNA, 21 bp, Homo sapiens
aatgggagggggctccatgga

SEQ ID NO: 5117967 - DNA, 15 bp, Homo sapiens
aatgggagtctgaaa

SEQ ID NO: 5117968 - DNA, 20 bp, Homo sapiens
aatgggagtgaacatttcta

SEQ ID NO: 5117969 - DNA, 19 bp, Homo sapiens
aatgggatattttgaaatg

SEQ ID NO: 5117970 - DNA, 15 bp, Homo sapiens
aatgggcaattccag

SEQ ID NO: 5117971 - DNA, 14 bp, Homo sapiens
aatgggcacttaaa

SEQ ID NO: 5117972 - DNA, 13 bp, Homo sapiens
aatgggcagagca

SEQ ID NO: 5117973 - DNA, 15 bp, Homo sapiens
aatgggcagagcaga

SEQ ID NO: 5117974 - DNA, 18 bp, Homo sapiens
aatgggcaggtggcctct

SEQ ID NO: 5117975 - DNA, 18 bp, Homo sapiens
aatgggcagttacatgca

SEQ ID NO: 5117976 - DNA, 21 bp, Homo sapiens
aatgggcagttacatgcatac

SEQ ID NO: 5117977 - DNA, 20 bp, Homo sapiens
aatgggcatttctaaaatgt

SEQ ID NO: 5117978 - DNA, 19 bp, Homo sapiens
aatgggccgtcccctctcc

SEQ ID NO: 5117979 - DNA, 21 bp, Homo sapiens
aatgggccgtcccctctcccc

SEQ ID NO: 5117980 - DNA, 16 bp, Homo sapiens
aatgggcctgcctgcc

SEQ ID NO: 5117981 - DNA, 23 bp, Homo sapiens
aatgggcctgcctgcctccaccc

SEQ ID NO: 5117982 - DNA, 17 bp, Homo sapiens
aatgggctctgccctca

SEQ ID NO: 5117983 - DNA, 20 bp, Homo sapiens
aatgggctcttccaacaagg

SEQ ID NO: 5117984 - DNA, 19 bp, Homo sapiens
aatggggaaagcagaactg

SEQ ID NO: 5117985 - DNA, 19 bp, Homo sapiens
aatggggaagattagaaag

SEQ ID NO: 5117986 - DNA, 17 bp, Homo sapiens
aatggggatcacagaga

SEQ ID NO: 5117987 - DNA, 16 bp, Homo sapiens
aatggggcagacacaa

SEQ ID NO: 5117988 - DNA, 12 bp, Homo sapiens
aatggggccaga

SEQ ID NO: 5117989 - DNA, 14 bp, Homo sapiens
aatggggccagatc

SEQ ID NO: 5117990 - DNA, 17 bp, Homo sapiens
aatggggccagatccag

SEQ ID NO: 5117991 - DNA, 22 bp, Homo sapiens
aatggggccagatccagcctgg

SEQ ID NO: 5117992 - DNA, 12 bp, Homo sapiens
aatggggcggca

SEQ ID NO: 5117993 - DNA, 14 bp, Homo sapiens
aatggggcttgccc

SEQ ID NO: 5117994 - DNA, 20 bp, Homo sapiens
aatggggcttgccctgggtc

SEQ ID NO: 5117995 - DNA, 15 bp, Homo sapiens
aatgggggagggagg

SEQ ID NO: 5117996 - DNA, 19 bp, Homo sapiens
aatgggggcaggaaagcca

SEQ ID NO: 5117997 - DNA, 20 bp, Homo sapiens
aatgggggcggctggaaaga

SEQ ID NO: 5117998 - DNA, 19 bp, Homo sapiens
aatggggggcgggccaggg

SEQ ID NO: 5117999 - DNA, 19 bp, Homo sapiens
aatgggggtagcagctgga

SEQ ID NO: 5118000 - DNA, 20 bp, Homo sapiens
aatgggggtatcctgtgcat

SEQ ID NO: 5118001 - DNA, 21 bp, Homo sapiens
aatgggggtgaccacaaaaga

SEQ ID NO: 5118002 - DNA, 23 bp, Homo sapiens
aatgggggtgaccacaaaagagg

SEQ ID NO: 5118003 - DNA, 21 bp, Homo sapiens
aatggggtagaggagggcatg

SEQ ID NO: 5118004 - DNA, 17 bp, Homo sapiens
aatggggtcctggccat

SEQ ID NO: 5118005 - DNA, 17 bp, Homo sapiens
aatggggttcctgctgt

SEQ ID NO: 5118006 - DNA, 17 bp, Homo sapiens
aatgggtaaataaatgc

SEQ ID NO: 5118007 - DNA, 23 bp, Homo sapiens
aatgggtaaataaatgctgcttt

SEQ ID NO: 5118008 - DNA, 15 bp, Homo sapiens
aatgggtaagggagg

SEQ ID NO: 5118009 - DNA, 19 bp, Homo sapiens
aatgggtaagggagggaag

SEQ ID NO: 5118010 - DNA, 17 bp, Homo sapiens
aatgggtcttagctctt

SEQ ID NO: 5118011 - DNA, 15 bp, Homo sapiens
aatgggtcttttata

SEQ ID NO: 5118012 - DNA, 21 bp, Homo sapiens
aatgggtgcccgtatccagag

SEQ ID NO: 5118013 - DNA, 15 bp, Homo sapiens
aatgggttacttgat

SEQ ID NO: 5118014 - DNA, 22 bp, Homo sapiens
aatggtaaaataaaatgcctca

SEQ ID NO: 5118015 - DNA, 15 bp, Homo sapiens
aatggtaaaattgca

SEQ ID NO: 5118016 - DNA, 13 bp, Homo sapiens
aatggtaactttt

SEQ ID NO: 5118017 - DNA, 16 bp, Homo sapiens
aatggtaatttagtgt

SEQ ID NO: 5118018 - DNA, 18 bp, Homo sapiens
aatggtacagcttctgga

SEQ ID NO: 5118019 - DNA, 21 bp, Homo sapiens
aatggtactcccaaactgaca

SEQ ID NO: 5118020 - DNA, 21 bp, Homo sapiens
aatggtactctaatcagtcct

SEQ ID NO: 5118021 - DNA, 22 bp, Homo sapiens
aatggtagaagatgaatcagta

SEQ ID NO: 5118022 - DNA, 21 bp, Homo sapiens
aatggtagctctgaagggagg

SEQ ID NO: 5118023 - DNA, 17 bp, Homo sapiens
aatggtagctgaaaaaa

SEQ ID NO: 5118024 - DNA, 23 bp, Homo sapiens
aatggtagtaatcacagttggcc

SEQ ID NO: 5118025 - DNA, 24 bp, Homo sapiens
aatggtagtctaaccaaatgcatc

SEQ ID NO: 5118026 - DNA, 17 bp, Homo sapiens
aatggtagtttctgtgg

SEQ ID NO: 5118027 - DNA, 18 bp, Homo sapiens
aatggtagtttctgtggt

SEQ ID NO: 5118028 - DNA, 20 bp, Homo sapiens
aatggtagtttctgtggttg

SEQ ID NO: 5118029 - DNA, 14 bp, Homo sapiens
aatggtagttttac

SEQ ID NO: 5118030 - DNA, 15 bp, Homo sapiens
aatggtatagcaaat

SEQ ID NO: 5118031 - DNA, 15 bp, Homo sapiens
aatggtatgagctga

SEQ ID NO: 5118032 - DNA, 14 bp, Homo sapiens
aatggtattaaaga

SEQ ID NO: 5118033 - DNA, 15 bp, Homo sapiens
aatggtattgggcag

SEQ ID NO: 5118034 - DNA, 22 bp, Homo sapiens
aatggtcacgtttggtgcttct

SEQ ID NO: 5118035 - DNA, 23 bp, Homo sapiens
aatggtcacgtttggtgcttctc

SEQ ID NO: 5118036 - DNA, 19 bp, Homo sapiens
aatggtccaggagaaggcc

SEQ ID NO: 5118037 - DNA, 13 bp, Homo sapiens
aatggtccagggt

SEQ ID NO: 5118038 - DNA, 14 bp, Homo sapiens
aatggtcccttctt

SEQ ID NO: 5118039 - DNA, 21 bp, Homo sapiens
aatggtccgtgctaaggactt

SEQ ID NO: 5118040 - DNA, 15 bp, Homo sapiens
aatggtcctgacttt

SEQ ID NO: 5118041 - DNA, 15 bp, Homo sapiens
aatggtcctgttatg

SEQ ID NO: 5118042 - DNA, 16 bp, Homo sapiens
aatggtcgcccaggag

SEQ ID NO: 5118043 - DNA, 18 bp, Homo sapiens
aatggtctcatctccttt

SEQ ID NO: 5118044 - DNA, 22 bp, Homo sapiens
aatggtctcatctcctttgcta

SEQ ID NO: 5118045 - DNA, 23 bp, Homo sapiens
aatggtctcttccctttgtgtat

SEQ ID NO: 5118046 - DNA, 14 bp, Homo sapiens
aatggtctttgctc

SEQ ID NO: 5118047 - DNA, 15 bp, Homo sapiens
aatggtctttgctcc

SEQ ID NO: 5118048 - DNA, 22 bp, Homo sapiens
aatggtgaaaataaaataaagc

SEQ ID NO: 5118049 - DNA, 15 bp, Homo sapiens
aatggtgaacatttt

SEQ ID NO: 5118050 - DNA, 21 bp, Homo sapiens
aatggtgagcgatcatttatt

SEQ ID NO: 5118051 - DNA, 23 bp, Homo sapiens
aatggtgagcgatcatttatttc

SEQ ID NO: 5118052 - DNA, 14 bp, Homo sapiens
aatggtgagggctg

SEQ ID NO: 5118053 - DNA, 19 bp, Homo sapiens
aatggtgatcctctatttt

SEQ ID NO: 5118054 - DNA, 20 bp, Homo sapiens
aatggtgatttaaaaacttg

SEQ ID NO: 5118055 - DNA, 15 bp, Homo sapiens
aatggtgattttaaa

SEQ ID NO: 5118056 - DNA, 12 bp, Homo sapiens
aatggtgcaaaa

SEQ ID NO: 5118057 - DNA, 19 bp, Homo sapiens
aatggtgcaaaaaaaaact

SEQ ID NO: 5118058 - DNA, 22 bp, Homo sapiens
aatggtgcaaaaaaaaacttaa

SEQ ID NO: 5118059 - DNA, 10 bp, Homo sapiens
aatggtgcct

SEQ ID NO: 5118060 - DNA, 23 bp, Homo sapiens
aatggtgcttattaagaccaaag

SEQ ID NO: 5118061 - DNA, 21 bp, Homo sapiens
aatggtggaggattgctgcca

SEQ ID NO: 5118062 - DNA, 22 bp, Homo sapiens
aatggtggggaactataaagaa

SEQ ID NO: 5118063 - DNA, 23 bp, Homo sapiens
aatggtggttgtttcttccaaga

SEQ ID NO: 5118064 - DNA, 16 bp, Homo sapiens
aatggtggtttgtcat

SEQ ID NO: 5118065 - DNA, 12 bp, Homo sapiens
aatggtggtttt

SEQ ID NO: 5118066 - DNA, 17 bp, Homo sapiens
aatggtgtagctgtcct

SEQ ID NO: 5118067 - DNA, 20 bp, Homo sapiens
aatggtgtcagtatccaggc

SEQ ID NO: 5118068 - DNA, 17 bp, Homo sapiens
aatggtgtcataactag

SEQ ID NO: 5118069 - DNA, 22 bp, Homo sapiens
aatggtgtcataactagagcac

SEQ ID NO: 5118070 - DNA, 16 bp, Homo sapiens
aatggtgtcatggctg

SEQ ID NO: 5118071 - DNA, 18 bp, Homo sapiens
aatggtgtcatggctgaa

SEQ ID NO: 5118072 - DNA, 17 bp, Homo sapiens
aatggtgtggtgaatgt

SEQ ID NO: 5118073 - DNA, 15 bp, Homo sapiens
aatggtgtgtttccc

SEQ ID NO: 5118074 - DNA, 23 bp, Homo sapiens
aatggtgtgtttccctagactct

SEQ ID NO: 5118075 - DNA, 19 bp, Homo sapiens
aatggtgtttttcttgtaa

SEQ ID NO: 5118076 - DNA, 20 bp, Homo sapiens
aatggtgtttttcttgtaaa

SEQ ID NO: 5118077 - DNA, 16 bp, Homo sapiens
aatggttaaattttac

SEQ ID NO: 5118078 - DNA, 16 bp, Homo sapiens
aatggttaattcttca

SEQ ID NO: 5118079 - DNA, 18 bp, Homo sapiens
aatggttaatttttcctg

SEQ ID NO: 5118080 - DNA, 23 bp, Homo sapiens
aatggttaatttttcctgcatgt

SEQ ID NO: 5118081 - DNA, 17 bp, Homo sapiens
aatggttataaaagtga

SEQ ID NO: 5118082 - DNA, 19 bp, Homo sapiens
aatggttataaaagtgatt

SEQ ID NO: 5118083 - DNA, 18 bp, Homo sapiens
aatggttatgtgcattat

SEQ ID NO: 5118084 - DNA, 14 bp, Homo sapiens
aatggttcaagtct

SEQ ID NO: 5118085 - DNA, 21 bp, Homo sapiens
aatggttccatgcctgagggt

SEQ ID NO: 5118086 - DNA, 23 bp, Homo sapiens
aatggttctttatcatttctctt

SEQ ID NO: 5118087 - DNA, 17 bp, Homo sapiens
aatggttgactgggttt

SEQ ID NO: 5118088 - DNA, 16 bp, Homo sapiens
aatggttgatggaaaa

SEQ ID NO: 5118089 - DNA, 17 bp, Homo sapiens
aatggttgcaaagtgtt

SEQ ID NO: 5118090 - DNA, 18 bp, Homo sapiens
aatggttgggacaatggc

SEQ ID NO: 5118091 - DNA, 24 bp, Homo sapiens
aatggttgtattagatgttctcta

SEQ ID NO: 5118092 - DNA, 21 bp, Homo sapiens
aatggttgtgaaatgtaacat

SEQ ID NO: 5118093 - DNA, 14 bp, Homo sapiens
aatggtttacatga

SEQ ID NO: 5118094 - DNA, 16 bp, Homo sapiens
aatggtttactgctgt

SEQ ID NO: 5118095 - DNA, 14 bp, Homo sapiens
aatggtttattccc

SEQ ID NO: 5118096 - DNA, 16 bp, Homo sapiens
aatggtttattttgta

SEQ ID NO: 5118097 - DNA, 21 bp, Homo sapiens
aatggtttattttgtattgtg

SEQ ID NO: 5118098 - DNA, 13 bp, Homo sapiens
aatggtttcaaag

SEQ ID NO: 5118099 - DNA, 17 bp, Homo sapiens
aatggtttgcaaggaag

SEQ ID NO: 5118100 - DNA, 18 bp, Homo sapiens
aatggtttgcaaggaagc

SEQ ID NO: 5118101 - DNA, 19 bp, Homo sapiens
aatggtttgcaaggaagcc

SEQ ID NO: 5118102 - DNA, 14 bp, Homo sapiens
aatggtttgtgtca

SEQ ID NO: 5118103 - DNA, 20 bp, Homo sapiens
aatggtttgtgtcaaaactg

SEQ ID NO: 5118104 - DNA, 14 bp, Homo sapiens
aatggttttcaaca

SEQ ID NO: 5118105 - DNA, 21 bp, Homo sapiens
aatggtttttaaattttgtaa

SEQ ID NO: 5118106 - DNA, 22 bp, Homo sapiens
aatggtttttcttttctttatt

SEQ ID NO: 5118107 - DNA, 20 bp, Homo sapiens
aatggtttttgcctaaaata

SEQ ID NO: 5118108 - DNA, 17 bp, Homo sapiens
aatgtaaaaaacaaaaa

SEQ ID NO: 5118109 - DNA, 19 bp, Homo sapiens
aatgtaaaaaagaaaaaca

SEQ ID NO: 5118110 - DNA, 20 bp, Homo sapiens
aatgtaaaacacaagactgt

SEQ ID NO: 5118111 - DNA, 23 bp, Homo sapiens
aatgtaaaacacatacaaaagaa

SEQ ID NO: 5118112 - DNA, 20 bp, Homo sapiens
aatgtaaaactccattcata

SEQ ID NO: 5118113 - DNA, 12 bp, Homo sapiens
aatgtaaaagaa

SEQ ID NO: 5118114 - DNA, 16 bp, Homo sapiens
aatgtaaaagaaaatt

SEQ ID NO: 5118115 - DNA, 19 bp, Homo sapiens
aatgtaaaagaaaattttt

SEQ ID NO: 5118116 - DNA, 20 bp, Homo sapiens
aatgtaaaataaaggctctg

SEQ ID NO: 5118117 - DNA, 21 bp, Homo sapiens
aatgtaaaataaaggctctgt

SEQ ID NO: 5118118 - DNA, 15 bp, Homo sapiens
aatgtaaaatattta

SEQ ID NO: 5118119 - DNA, 12 bp, Homo sapiens
aatgtaaaatga

SEQ ID NO: 5118120 - DNA, 14 bp, Homo sapiens
aatgtaaaatgatt

SEQ ID NO: 5118121 - DNA, 13 bp, Homo sapiens
aatgtaaaattat

SEQ ID NO: 5118122 - DNA, 15 bp, Homo sapiens
aatgtaaaccacatg

SEQ ID NO: 5118123 - DNA, 20 bp, Homo sapiens
aatgtaaaccagaaaaaata

SEQ ID NO: 5118124 - DNA, 19 bp, Homo sapiens
aatgtaaactctcttctct

SEQ ID NO: 5118125 - DNA, 16 bp, Homo sapiens
aatgtaaactgccata

SEQ ID NO: 5118126 - DNA, 23 bp, Homo sapiens
aatgtaaactgctcgccttattc

SEQ ID NO: 5118127 - DNA, 21 bp, Homo sapiens
aatgtaaactgtttctttaaa

SEQ ID NO: 5118128 - DNA, 14 bp, Homo sapiens
aatgtaaagccatg

SEQ ID NO: 5118129 - DNA, 15 bp, Homo sapiens
aatgtaaagccatgc

SEQ ID NO: 5118130 - DNA, 19 bp, Homo sapiens
aatgtaaagcttgtctgat

SEQ ID NO: 5118131 - DNA, 14 bp, Homo sapiens
aatgtaaaggaggg

SEQ ID NO: 5118132 - DNA, 16 bp, Homo sapiens
aatgtaaaggagggag

SEQ ID NO: 5118133 - DNA, 13 bp, Homo sapiens
aatgtaaagtcta

SEQ ID NO: 5118134 - DNA, 17 bp, Homo sapiens
aatgtaaagttatgtat

SEQ ID NO: 5118135 - DNA, 20 bp, Homo sapiens
aatgtaaagttatgtattta

SEQ ID NO: 5118136 - DNA, 17 bp, Homo sapiens
aatctttttctccaccc

SEQ ID NO: 5118137 - DNA, 13 bp, Homo sapiens
aatgaaaaaataa

SEQ ID NO: 5118138 - DNA, 15 bp, Homo sapiens
aatgaaaaacaaaaa

SEQ ID NO: 5118139 - DNA, 19 bp, Homo sapiens
aatgaaaaacaaaaagcta

SEQ ID NO: 5118140 - DNA, 16 bp, Homo sapiens
aatgaaaaatataatg

SEQ ID NO: 5118141 - DNA, 12 bp, Homo sapiens
aatgaaaaatga

SEQ ID NO: 5118142 - DNA, 14 bp, Homo sapiens
aatgaaaaatgaaa

SEQ ID NO: 5118143 - DNA, 17 bp, Homo sapiens
aatgaaaaattctcagt

SEQ ID NO: 5118144 - DNA, 22 bp, Homo sapiens
aatgaaaaatttaagcattgtt

SEQ ID NO: 5118145 - DNA, 19 bp, Homo sapiens
aatgaaaacaaaattccat

SEQ ID NO: 5118146 - DNA, 23 bp, Homo sapiens
aatgaaaacaaaattccattaca

SEQ ID NO: 5118147 - DNA, 15 bp, Homo sapiens
aatgaaaacaaataa

SEQ ID NO: 5118148 - DNA, 14 bp, Homo sapiens
aatgaaaacatgta

SEQ ID NO: 5118149 - DNA, 22 bp, Homo sapiens
aatgaaaacatgtactacagct

SEQ ID NO: 5118150 - DNA, 23 bp, Homo sapiens
aatgaaaacatgtactacagcta

SEQ ID NO: 5118151 - DNA, 19 bp, Homo sapiens
aatgaaaacattttatttt

SEQ ID NO: 5118152 - DNA, 15 bp, Homo sapiens
aatgaaaaccacatt

SEQ ID NO: 5118153 - DNA, 18 bp, Homo sapiens
aatgaaaactctttgctg

SEQ ID NO: 5118154 - DNA, 19 bp, Homo sapiens
aatgaaaactgtaaatatt

SEQ ID NO: 5118155 - DNA, 14 bp, Homo sapiens
aatgaaaacttttg

SEQ ID NO: 5118156 - DNA, 21 bp, Homo sapiens
aatgaaaacttttgtaaatta

SEQ ID NO: 5118157 - DNA, 17 bp, Homo sapiens
aatgaaaactttttcac

SEQ ID NO: 5118158 - DNA, 12 bp, Homo sapiens
aatgaaaagaga

SEQ ID NO: 5118159 - DNA, 19 bp, Homo sapiens
aatgaaaataactgaacca

SEQ ID NO: 5118160 - DNA, 15 bp, Homo sapiens
aatgaaaataagtga

SEQ ID NO: 5118161 - DNA, 21 bp, Homo sapiens
aatgaaaataagtgaataata

SEQ ID NO: 5118162 - DNA, 12 bp, Homo sapiens
aatgaaaatcag

SEQ ID NO: 5118163 - DNA, 13 bp, Homo sapiens
aatgaaaatgaat

SEQ ID NO: 5118164 - DNA, 14 bp, Homo sapiens
aatgaaaatgtaac

SEQ ID NO: 5118165 - DNA, 13 bp, Homo sapiens
aatgaaaatgtca

SEQ ID NO: 5118166 - DNA, 13 bp, Homo sapiens
aatgaaaatttta

SEQ ID NO: 5118167 - DNA, 16 bp, Homo sapiens
aatgaaacaaagagtt

SEQ ID NO: 5118168 - DNA, 19 bp, Homo sapiens
aatgaaacagatgataaat

SEQ ID NO: 5118169 - DNA, 15 bp, Homo sapiens
aatgaaaccaaagcc

SEQ ID NO: 5118170 - DNA, 18 bp, Homo sapiens
aatgaaacccccacacac

SEQ ID NO: 5118171 - DNA, 17 bp, Homo sapiens
aatgaaaccctatggag

SEQ ID NO: 5118172 - DNA, 17 bp, Homo sapiens
aatgaaaccttcctctt

SEQ ID NO: 5118173 - DNA, 17 bp, Homo sapiens
aatgaaagactgtacaa

SEQ ID NO: 5118174 - DNA, 18 bp, Homo sapiens
aatgaaagactgtacaaa

SEQ ID NO: 5118175 - DNA, 14 bp, Homo sapiens
aatgaaagagaaaa

SEQ ID NO: 5118176 - DNA, 13 bp, Homo sapiens
aatgaaagattaa

SEQ ID NO: 5118177 - DNA, 20 bp, Homo sapiens
aatgaaagattaaacagatg

SEQ ID NO: 5118178 - DNA, 23 bp, Homo sapiens
aatgaaagcataagcttaagcat

SEQ ID NO: 5118179 - DNA, 17 bp, Homo sapiens
aatgaaagcatgtctca

SEQ ID NO: 5118180 - DNA, 22 bp, Homo sapiens
aatgaaagcatgtggcatgttc

SEQ ID NO: 5118181 - DNA, 15 bp, Homo sapiens
aatgaaagggaaact

SEQ ID NO: 5118182 - DNA, 20 bp, Homo sapiens
aatgaaaggtactatatttg

SEQ ID NO: 5118183 - DNA, 19 bp, Homo sapiens
aatgaaagtcaaatttact

SEQ ID NO: 5118184 - DNA, 20 bp, Homo sapiens
aatgaaagtcttgtgactag

SEQ ID NO: 5118185 - DNA, 23 bp, Homo sapiens
aatgaaagtcttgtgactagtgc

SEQ ID NO: 5118186 - DNA, 18 bp, Homo sapiens
aatgaaagtgactttaaa

SEQ ID NO: 5118187 - DNA, 21 bp, Homo sapiens
aatgaaataaaatttgaaact

SEQ ID NO: 5118188 - DNA, 16 bp, Homo sapiens
aatgaaataatcagtg

SEQ ID NO: 5118189 - DNA, 20 bp, Homo sapiens
aatgaaatactccagcacct

SEQ ID NO: 5118190 - DNA, 15 bp, Homo sapiens
aatgaaatactgcct

SEQ ID NO: 5118191 - DNA, 17 bp, Homo sapiens
aatgaaatataaactgt

SEQ ID NO: 5118192 - DNA, 14 bp, Homo sapiens
aatgaaatatctgt

SEQ ID NO: 5118193 - DNA, 14 bp, Homo sapiens
aatgaaatattgct

SEQ ID NO: 5118194 - DNA, 15 bp, Homo sapiens
aatgaaatcaaatgt

SEQ ID NO: 5118195 - DNA, 17 bp, Homo sapiens
aatgaaatcaaatgtat

SEQ ID NO: 5118196 - DNA, 21 bp, Homo sapiens
aatgaaatcctgcttcagtgt

SEQ ID NO: 5118197 - DNA, 17 bp, Homo sapiens
aatgaaatccttttcct

SEQ ID NO: 5118198 - DNA, 14 bp, Homo sapiens
aatgaaatgaatga

SEQ ID NO: 5118199 - DNA, 16 bp, Homo sapiens
aatgaaatgcattttg

SEQ ID NO: 5118200 - DNA, 15 bp, Homo sapiens
aatgaaatgccaaag

SEQ ID NO: 5118201 - DNA, 17 bp, Homo sapiens
aatgaaatgtatgtgct

SEQ ID NO: 5118202 - DNA, 13 bp, Homo sapiens
aatgaaatgtctt

SEQ ID NO: 5118203 - DNA, 23 bp, Homo sapiens
aatgaaatgtttactaagtggac

SEQ ID NO: 5118204 - DNA, 15 bp, Homo sapiens
aatgaaatgtttttg

SEQ ID NO: 5118205 - DNA, 17 bp, Homo sapiens
aatgaaattactacaaa

SEQ ID NO: 5118206 - DNA, 23 bp, Homo sapiens
aatgaaattactacaaaatttga

SEQ ID NO: 5118207 - DNA, 18 bp, Homo sapiens
aatgaaattcttttataa

SEQ ID NO: 5118208 - DNA, 14 bp, Homo sapiens
aatgaaattgacct

SEQ ID NO: 5118209 - DNA, 16 bp, Homo sapiens
aatgaaatttaaacat

SEQ ID NO: 5118210 - DNA, 17 bp, Homo sapiens
aatgaaatttaaacatt

SEQ ID NO: 5118211 - DNA, 15 bp, Homo sapiens
aatgaaatttaagca

SEQ ID NO: 5118212 - DNA, 16 bp, Homo sapiens
aatgaaatttaagcac

SEQ ID NO: 5118213 - DNA, 18 bp, Homo sapiens
aatgaaatttaagcacaa

SEQ ID NO: 5118214 - DNA, 22 bp, Homo sapiens
aatgaaatttaattacaaacaa

SEQ ID NO: 5118215 - DNA, 15 bp, Homo sapiens
aatgaaatttgcaaa

SEQ ID NO: 5118216 - DNA, 16 bp, Homo sapiens
aatgaaatttgcaaaa

SEQ ID NO: 5118217 - DNA, 13 bp, Homo sapiens
aatgaaattttac

SEQ ID NO: 5118218 - DNA, 22 bp, Homo sapiens
aatgaaattttaccaagttata

SEQ ID NO: 5118219 - DNA, 12 bp, Homo sapiens
aatgaacaaaag

SEQ ID NO: 5118220 - DNA, 14 bp, Homo sapiens
aatgaacaaaagat

SEQ ID NO: 5118221 - DNA, 12 bp, Homo sapiens
aatgaacaaatg

SEQ ID NO: 5118222 - DNA, 12 bp, Homo sapiens
aatgaacaagag

SEQ ID NO: 5118223 - DNA, 16 bp, Homo sapiens
aatgaacaagagaagc

SEQ ID NO: 5118224 - DNA, 21 bp, Homo sapiens
aatgaacaagcattctctcca

SEQ ID NO: 5118225 - DNA, 20 bp, Homo sapiens
aatgaacacaaattatgcta

SEQ ID NO: 5118226 - DNA, 14 bp, Homo sapiens
aatgaacacaatca

SEQ ID NO: 5118227 - DNA, 17 bp, Homo sapiens
aatgaacacagctcttt

SEQ ID NO: 5118228 - DNA, 21 bp, Homo sapiens
aatgaacacagctctttaaca

SEQ ID NO: 5118229 - DNA, 15 bp, Homo sapiens
aatgaacactctttt

SEQ ID NO: 5118230 - DNA, 14 bp, Homo sapiens
aatgaacagaacat

SEQ ID NO: 5118231 - DNA, 18 bp, Homo sapiens
aatgaacatctcatgtgt

SEQ ID NO: 5118232 - DNA, 19 bp, Homo sapiens
aatgaaccacatagacttt

SEQ ID NO: 5118233 - DNA, 18 bp, Homo sapiens
aatgaaccctcctccttt

SEQ ID NO: 5118234 - DNA, 18 bp, Homo sapiens
aatgaacctgcaagcctt

SEQ ID NO: 5118235 - DNA, 15 bp, Homo sapiens
aatgaactaactgcc

SEQ ID NO: 5118236 - DNA, 16 bp, Homo sapiens
aatgaactaactgcca

SEQ ID NO: 5118237 - DNA, 19 bp, Homo sapiens
aatgaactaccatctgatg

SEQ ID NO: 5118238 - DNA, 22 bp, Homo sapiens
aatgaactaccatctgatgttt

SEQ ID NO: 5118239 - DNA, 14 bp, Homo sapiens
aatgaactactgct

SEQ ID NO: 5118240 - DNA, 23 bp, Homo sapiens
aatgaactatgtcgatgcacagt

SEQ ID NO: 5118241 - DNA, 14 bp, Homo sapiens
aatgaactctttcc

SEQ ID NO: 5118242 - DNA, 14 bp, Homo sapiens
aatgaactgaagtt

SEQ ID NO: 5118243 - DNA, 17 bp, Homo sapiens
aatgaactgtatattat

SEQ ID NO: 5118244 - DNA, 23 bp, Homo sapiens
aatgaactgtatattattgctat

SEQ ID NO: 5118245 - DNA, 18 bp, Homo sapiens
aatgaactgtccgtgaat

SEQ ID NO: 5118246 - DNA, 15 bp, Homo sapiens
aatgaactgtgacag

SEQ ID NO: 5118247 - DNA, 16 bp, Homo sapiens
aatgaactgtgacagg

SEQ ID NO: 5118248 - DNA, 21 bp, Homo sapiens
aatgaactgtgacaggaagcc

SEQ ID NO: 5118249 - DNA, 18 bp, Homo sapiens
aatgaactgtggaattta

SEQ ID NO: 5118250 - DNA, 22 bp, Homo sapiens
aatgaacttccatttgtattca

SEQ ID NO: 5118251 - DNA, 16 bp, Homo sapiens
aatgaacttgttactt

SEQ ID NO: 5118252 - DNA, 11 bp, Homo sapiens
aatgaactttg

SEQ ID NO: 5118253 - DNA, 20 bp, Homo sapiens
aatgaactttgtcagtgttg

SEQ ID NO: 5118254 - DNA, 23 bp, Homo sapiens
aatgaactttgtcagtgttgcct

SEQ ID NO: 5118255 - DNA, 16 bp, Homo sapiens
aatgaacttttacaga

SEQ ID NO: 5118256 - DNA, 22 bp, Homo sapiens
aatgaacttttacagaatgcat

SEQ ID NO: 5118257 - DNA, 11 bp, Homo sapiens
aatgaagaaag

SEQ ID NO: 5118258 - DNA, 21 bp, Homo sapiens
aatgaagaaagggaggcccag

SEQ ID NO: 5118259 - DNA, 12 bp, Homo sapiens
aatgaagaagga

SEQ ID NO: 5118260 - DNA, 15 bp, Homo sapiens
aatgaagaaggaagc

SEQ ID NO: 5118261 - DNA, 15 bp, Homo sapiens
aatgaagaatcacga

SEQ ID NO: 5118262 - DNA, 15 bp, Homo sapiens
aatgaagaattatgt

SEQ ID NO: 5118263 - DNA, 16 bp, Homo sapiens
aatgaagaatttaaag

SEQ ID NO: 5118264 - DNA, 17 bp, Homo sapiens
aatgaagaatttaaaga

SEQ ID NO: 5118265 - DNA, 18 bp, Homo sapiens
aatgaagaatttaaagaa

SEQ ID NO: 5118266 - DNA, 22 bp, Homo sapiens
aatgaagacatttctgctctca

SEQ ID NO: 5118267 - DNA, 13 bp, Homo sapiens
aatgaagagaaaa

SEQ ID NO: 5118268 - DNA, 16 bp, Homo sapiens
aatgaagagccagccc

SEQ ID NO: 5118269 - DNA, 22 bp, Homo sapiens
aatgaagatcggctttcatgta

SEQ ID NO: 5118270 - DNA, 12 bp, Homo sapiens
aatgaagatcta

SEQ ID NO: 5118271 - DNA, 24 bp, Homo sapiens
aatgaagatctaaataaaatgcta

SEQ ID NO: 5118272 - DNA, 22 bp, Homo sapiens
aatgaagatgcattttaaatgt

SEQ ID NO: 5118273 - DNA, 17 bp, Homo sapiens
aatgaagattaacactg

SEQ ID NO: 5118274 - DNA, 13 bp, Homo sapiens
aatgaagattacc

SEQ ID NO: 5118275 - DNA, 21 bp, Homo sapiens
aatgaagcaatttatatcttt

SEQ ID NO: 5118276 - DNA, 16 bp, Homo sapiens
aatgaagcagaaatgt

SEQ ID NO: 5118277 - DNA, 20 bp, Homo sapiens
aatgaagcagaggaaggaaa

SEQ ID NO: 5118278 - DNA, 19 bp, Homo sapiens
aatgaagcagctttaaaca

SEQ ID NO: 5118279 - DNA, 22 bp, Homo sapiens
aatgaagcagctttaaacaaat

SEQ ID NO: 5118280 - DNA, 14 bp, Homo sapiens
aatgaagcagtatt

SEQ ID NO: 5118281 - DNA, 16 bp, Homo sapiens
aatgaagcagtatttt

SEQ ID NO: 5118282 - DNA, 16 bp, Homo sapiens
aatgaagctaatgtga

SEQ ID NO: 5118283 - DNA, 13 bp, Homo sapiens
aatgaagctgaag

SEQ ID NO: 5118284 - DNA, 12 bp, Homo sapiens
aatgaagcttgt

SEQ ID NO: 5118285 - DNA, 15 bp, Homo sapiens
aatgaagcttgtgta

SEQ ID NO: 5118286 - DNA, 19 bp, Homo sapiens
aatgaagctttatacgtgt

SEQ ID NO: 5118287 - DNA, 12 bp, Homo sapiens
aatgaagctttg

SEQ ID NO: 5118288 - DNA, 16 bp, Homo sapiens
aatgaagcttttgaat

SEQ ID NO: 5118289 - DNA, 23 bp, Homo sapiens
aatgaaggccatcatctctgtaa

SEQ ID NO: 5118290 - DNA, 18 bp, Homo sapiens
aatgaagggtcatttctc

SEQ ID NO: 5118291 - DNA, 21 bp, Homo sapiens
aatgaaggttaggatttaaca

SEQ ID NO: 5118292 - DNA, 22 bp, Homo sapiens
aatgaaggttaggatttaacag

SEQ ID NO: 5118293 - DNA, 20 bp, Homo sapiens
aatgaaggtttttgtaaaga

SEQ ID NO: 5118294 - DNA, 21 bp, Homo sapiens
aatgaagtaacttgtcttaaa

SEQ ID NO: 5118295 - DNA, 15 bp, Homo sapiens
aatgaagtcactatt

SEQ ID NO: 5118296 - DNA, 14 bp, Homo sapiens
aatgaagtgattct

SEQ ID NO: 5118297 - DNA, 19 bp, Homo sapiens
aatgaagtgttttacaatg

SEQ ID NO: 5118298 - DNA, 22 bp, Homo sapiens
aatgaagttaacttagtgttta

SEQ ID NO: 5118299 - DNA, 16 bp, Homo sapiens
aatgaagttattcttg

SEQ ID NO: 5118300 - DNA, 19 bp, Homo sapiens
aatgaagttgaaaatcata

SEQ ID NO: 5118301 - DNA, 17 bp, Homo sapiens
aatgaagttgtaggtaa

SEQ ID NO: 5118302 - DNA, 14 bp, Homo sapiens
aatgaagtttatac

SEQ ID NO: 5118303 - DNA, 15 bp, Homo sapiens
aatgaagtttataca

SEQ ID NO: 5118304 - DNA, 12 bp, Homo sapiens
aatgaagtttga

SEQ ID NO: 5118305 - DNA, 19 bp, Homo sapiens
aatgaagtttgaatgttaa

SEQ ID NO: 5118306 - DNA, 20 bp, Homo sapiens
aatgaagtttgaatgttaaa

SEQ ID NO: 5118307 - DNA, 14 bp, Homo sapiens
aatgaataaatcca

SEQ ID NO: 5118308 - DNA, 10 bp, Homo sapiens
aatgaataat

SEQ ID NO: 5118309 - DNA, 20 bp, Homo sapiens
aatgaataatgcctttgtaa

SEQ ID NO: 5118310 - DNA, 17 bp, Homo sapiens
aatgaataatggaaaat

SEQ ID NO: 5118311 - DNA, 21 bp, Homo sapiens
aatgaataatggaaaatgcca

SEQ ID NO: 5118312 - DNA, 16 bp, Homo sapiens
aatgaatatcaggcta

SEQ ID NO: 5118313 - DNA, 15 bp, Homo sapiens
aatgaatatctatta

SEQ ID NO: 5118314 - DNA, 13 bp, Homo sapiens
aatgaatattgaa

SEQ ID NO: 5118315 - DNA, 15 bp, Homo sapiens
aatgaatattgaagt

SEQ ID NO: 5118316 - DNA, 14 bp, Homo sapiens
aatgtaaataaact

SEQ ID NO: 5118317 - DNA, 16 bp, Homo sapiens
aatgtaaataaactat

SEQ ID NO: 5118318 - DNA, 22 bp, Homo sapiens
aatgtaaataaaggatttctag

SEQ ID NO: 5118319 - DNA, 14 bp, Homo sapiens
aatgtaaatacatc

SEQ ID NO: 5118320 - DNA, 21 bp, Homo sapiens
aatgtaaatactcatgaatga

SEQ ID NO: 5118321 - DNA, 12 bp, Homo sapiens
aatgtaaatatt

SEQ ID NO: 5118322 - DNA, 18 bp, Homo sapiens
aatgtaaatattctatat

SEQ ID NO: 5118323 - DNA, 16 bp, Homo sapiens
aatgtaaatggtactt

SEQ ID NO: 5118324 - DNA, 24 bp, Homo sapiens
aatgtaaatgtctcactgagcact

SEQ ID NO: 5118325 - DNA, 13 bp, Homo sapiens
aatgtaaatgtta

SEQ ID NO: 5118326 - DNA, 15 bp, Homo sapiens
aatgtaaattagttt

SEQ ID NO: 5118327 - DNA, 13 bp, Homo sapiens
aatgtaaatttgt

SEQ ID NO: 5118328 - DNA, 13 bp, Homo sapiens
aatgtaaatttta

SEQ ID NO: 5118329 - DNA, 17 bp, Homo sapiens
aatgtaacatcataatt

SEQ ID NO: 5118330 - DNA, 20 bp, Homo sapiens
aatgtaacatcataattaca

SEQ ID NO: 5118331 - DNA, 21 bp, Homo sapiens
aatgtaacatcataattacat

SEQ ID NO: 5118332 - DNA, 13 bp, Homo sapiens
aatgtaacatgat

SEQ ID NO: 5118333 - DNA, 12 bp, Homo sapiens
aatgtaaccaat

SEQ ID NO: 5118334 - DNA, 22 bp, Homo sapiens
aatgtaactccagatagagaaa

SEQ ID NO: 5118335 - DNA, 23 bp, Homo sapiens
aatgtaactccagatagagaaat

SEQ ID NO: 5118336 - DNA, 23 bp, Homo sapiens
aatgtaactgaagcataaacatc

SEQ ID NO: 5118337 - DNA, 11 bp, Homo sapiens
aatgtaactgc

SEQ ID NO: 5118338 - DNA, 15 bp, Homo sapiens
aatgtaactgctctt

SEQ ID NO: 5118339 - DNA, 22 bp, Homo sapiens
aatgtaactgttaccattggaa

SEQ ID NO: 5118340 - DNA, 18 bp, Homo sapiens
aatgtaacttaattataa

SEQ ID NO: 5118341 - DNA, 18 bp, Homo sapiens
aatgtaacttattccaag

SEQ ID NO: 5118342 - DNA, 22 bp, Homo sapiens
aatgtaacttttcttacagcac

SEQ ID NO: 5118343 - DNA, 15 bp, Homo sapiens
aatgtaagaaaattt

SEQ ID NO: 5118344 - DNA, 18 bp, Homo sapiens
aatgtaagcattacatga

SEQ ID NO: 5118345 - DNA, 15 bp, Homo sapiens
aatgtaagctgttta

SEQ ID NO: 5118346 - DNA, 18 bp, Homo sapiens
aatgtaaggattctggaa

SEQ ID NO: 5118347 - DNA, 22 bp, Homo sapiens
aatgtaaggctgtgtaagattt

SEQ ID NO: 5118348 - DNA, 21 bp, Homo sapiens
aatgtaagttgagaaaaattt

SEQ ID NO: 5118349 - DNA, 14 bp, Homo sapiens
aatgtaatactgga

SEQ ID NO: 5118350 - DNA, 13 bp, Homo sapiens
aatgtaatactgt

SEQ ID NO: 5118351 - DNA, 18 bp, Homo sapiens
aatgtaatactgtagaaa

SEQ ID NO: 5118352 - DNA, 19 bp, Homo sapiens
aatgtaatactgtagaaat

SEQ ID NO: 5118353 - DNA, 22 bp, Homo sapiens
aatgtaatataatgtattttct

SEQ ID NO: 5118354 - DNA, 21 bp, Homo sapiens
aatgtaatatactgagctgct

SEQ ID NO: 5118355 - DNA, 20 bp, Homo sapiens
aatgtaatcggcttgaattt

SEQ ID NO: 5118356 - DNA, 21 bp, Homo sapiens
aatgtaatgatcataagtcta

SEQ ID NO: 5118357 - DNA, 16 bp, Homo sapiens
aatgtaatgtcagact

SEQ ID NO: 5118358 - DNA, 19 bp, Homo sapiens
aatgtaatgtttttatttc

SEQ ID NO: 5118359 - DNA, 14 bp, Homo sapiens
aatgtaattgaata

SEQ ID NO: 5118360 - DNA, 20 bp, Homo sapiens
aatgtaatttaatgcctgcc

SEQ ID NO: 5118361 - DNA, 16 bp, Homo sapiens
aatgtaatttagaaac

SEQ ID NO: 5118362 - DNA, 17 bp, Homo sapiens
aatgtaatttagaaact

SEQ ID NO: 5118363 - DNA, 23 bp, Homo sapiens
aatgtaatttgtgtaataaagtg

SEQ ID NO: 5118364 - DNA, 16 bp, Homo sapiens
aatgtacaagttttgt

SEQ ID NO: 5118365 - DNA, 15 bp, Homo sapiens
aatgtacaattatgt

SEQ ID NO: 5118366 - DNA, 20 bp, Homo sapiens
aatgtacaattatgtctctt

SEQ ID NO: 5118367 - DNA, 17 bp, Homo sapiens
aatgtacactttttaca

SEQ ID NO: 5118368 - DNA, 13 bp, Homo sapiens
aatgtacagaaaa

SEQ ID NO: 5118369 - DNA, 15 bp, Homo sapiens
aatgtacagaaaata

SEQ ID NO: 5118370 - DNA, 20 bp, Homo sapiens
aatgtacagaaaatagcttt

SEQ ID NO: 5118371 - DNA, 22 bp, Homo sapiens
aatgtacagaaaatagctttta

SEQ ID NO: 5118372 - DNA, 15 bp, Homo sapiens
aatgtacagacatat

SEQ ID NO: 5118373 - DNA, 17 bp, Homo sapiens
aatgtacagacatattt

SEQ ID NO: 5118374 - DNA, 21 bp, Homo sapiens
aatgtacagacatatttaact

SEQ ID NO: 5118375 - DNA, 16 bp, Homo sapiens
aatgtacagagtaacc

SEQ ID NO: 5118376 - DNA, 19 bp, Homo sapiens
aatgtacagatatgcaaat

SEQ ID NO: 5118377 - DNA, 21 bp, Homo sapiens
aatgtacagcaaggagattta

SEQ ID NO: 5118378 - DNA, 23 bp, Homo sapiens
aatgtacagcaaggagatttaca

SEQ ID NO: 5118379 - DNA, 17 bp, Homo sapiens
aatgtacagttgaaata

SEQ ID NO: 5118380 - DNA, 21 bp, Homo sapiens
aatgtacatagtgctaacatg

SEQ ID NO: 5118381 - DNA, 17 bp, Homo sapiens
aatgtacatctggcctt

SEQ ID NO: 5118382 - DNA, 18 bp, Homo sapiens
aatgtacccaccgggcca

SEQ ID NO: 5118383 - DNA, 14 bp, Homo sapiens
aatgtacccagtat

SEQ ID NO: 5118384 - DNA, 21 bp, Homo sapiens
aatgtacccctctcagtctgc

SEQ ID NO: 5118385 - DNA, 23 bp, Homo sapiens
aatgtaccgatgatactgtttct

SEQ ID NO: 5118386 - DNA, 17 bp, Homo sapiens
aatgtacgataggtaga

SEQ ID NO: 5118387 - DNA, 20 bp, Homo sapiens
aatgtacgataggtagaatt

SEQ ID NO: 5118388 - DNA, 18 bp, Homo sapiens
aatgtacgatgagaaatt

SEQ ID NO: 5118389 - DNA, 17 bp, Homo sapiens
aatgtactacatttgca

SEQ ID NO: 5118390 - DNA, 18 bp, Homo sapiens
aatgtactatgtctgaac

SEQ ID NO: 5118391 - DNA, 22 bp, Homo sapiens
aatgtactcttccgatgtttgt

SEQ ID NO: 5118392 - DNA, 15 bp, Homo sapiens
aatgtactgagattt

SEQ ID NO: 5118393 - DNA, 14 bp, Homo sapiens
aatgtactgcatat

SEQ ID NO: 5118394 - DNA, 21 bp, Homo sapiens
aatgtactggtaattgtacaa

SEQ ID NO: 5118395 - DNA, 22 bp, Homo sapiens
aatgtactggtaattgtacaat

SEQ ID NO: 5118396 - DNA, 14 bp, Homo sapiens
aatgtactgtacat

SEQ ID NO: 5118397 - DNA, 18 bp, Homo sapiens
aatgtactgtacataaat

SEQ ID NO: 5118398 - DNA, 19 bp, Homo sapiens
aatgtactgtacataaatt

SEQ ID NO: 5118399 - DNA, 22 bp, Homo sapiens
aatgtacttaaatgagttactt

SEQ ID NO: 5118400 - DNA, 14 bp, Homo sapiens
aatgtacttgtttg

SEQ ID NO: 5118401 - DNA, 21 bp, Homo sapiens
aatgtactttcattccctttc

SEQ ID NO: 5118402 - DNA, 12 bp, Homo sapiens
aatgtacttttt

SEQ ID NO: 5118403 - DNA, 17 bp, Homo sapiens
aatgtactttttattgc

SEQ ID NO: 5118404 - DNA, 21 bp, Homo sapiens
aatgtactttttattgcatgg

SEQ ID NO: 5118405 - DNA, 15 bp, Homo sapiens
aatgtagaaataaat

SEQ ID NO: 5118406 - DNA, 14 bp, Homo sapiens
aatgtagaaattct

SEQ ID NO: 5118407 - DNA, 16 bp, Homo sapiens
aatgtagaaattctaa

SEQ ID NO: 5118408 - DNA, 19 bp, Homo sapiens
aatgtagaaattctaactt

SEQ ID NO: 5118409 - DNA, 16 bp, Homo sapiens
aatgtagacaaagtga

SEQ ID NO: 5118410 - DNA, 23 bp, Homo sapiens
aatgtagacagatatttcaaaca

SEQ ID NO: 5118411 - DNA, 14 bp, Homo sapiens
aatgtagataagtg

SEQ ID NO: 5118412 - DNA, 12 bp, Homo sapiens
aatgtagcagca

SEQ ID NO: 5118413 - DNA, 22 bp, Homo sapiens
aatgtagcagcagcctactgag

SEQ ID NO: 5118414 - DNA, 13 bp, Homo sapiens
aatgtagccatgg

SEQ ID NO: 5118415 - DNA, 23 bp, Homo sapiens
aatgtagccctctccaaatcaag

SEQ ID NO: 5118416 - DNA, 18 bp, Homo sapiens
aatgtagcgacagcattt

SEQ ID NO: 5118417 - DNA, 20 bp, Homo sapiens
aatgtagctgctagctattg

SEQ ID NO: 5118418 - DNA, 17 bp, Homo sapiens
aatgtagctggtttcct

SEQ ID NO: 5118419 - DNA, 15 bp, Homo sapiens
aatgtaggactgtat

SEQ ID NO: 5118420 - DNA, 22 bp, Homo sapiens
aatgtaggagactgtttggaaa

SEQ ID NO: 5118421 - DNA, 16 bp, Homo sapiens
aatgtaggcttagttt

SEQ ID NO: 5118422 - DNA, 22 bp, Homo sapiens
aatgtaggcttagtttgtgtgt

SEQ ID NO: 5118423 - DNA, 16 bp, Homo sapiens
aatgtaggtcctcaga

SEQ ID NO: 5118424 - DNA, 16 bp, Homo sapiens
aatgtaggtttagata

SEQ ID NO: 5118425 - DNA, 19 bp, Homo sapiens
aatgtagttatctattgaa

SEQ ID NO: 5118426 - DNA, 23 bp, Homo sapiens
aatgtagttctttgttcctgctt

SEQ ID NO: 5118427 - DNA, 19 bp, Homo sapiens
aatgtagttgatgtatcca

SEQ ID NO: 5118428 - DNA, 15 bp, Homo sapiens
aatgtagtttgagga

SEQ ID NO: 5118429 - DNA, 14 bp, Homo sapiens
aatgtataaatata

SEQ ID NO: 5118430 - DNA, 18 bp, Homo sapiens
aatgtataaattattcag

SEQ ID NO: 5118431 - DNA, 17 bp, Homo sapiens
aatgtataattaactta

SEQ ID NO: 5118432 - DNA, 22 bp, Homo sapiens
aatgtataattaacttaactga

SEQ ID NO: 5118433 - DNA, 15 bp, Homo sapiens
aatgtatacaatgca

SEQ ID NO: 5118434 - DNA, 14 bp, Homo sapiens
aatgtatagtattt

SEQ ID NO: 5118435 - DNA, 17 bp, Homo sapiens
aatgtatagtatttgaa

SEQ ID NO: 5118436 - DNA, 19 bp, Homo sapiens
aatgtatagtatttgaaaa

SEQ ID NO: 5118437 - DNA, 17 bp, Homo sapiens
aatgtatataaaaatgg

SEQ ID NO: 5118438 - DNA, 20 bp, Homo sapiens
aatgtatataaactgggatg

SEQ ID NO: 5118439 - DNA, 15 bp, Homo sapiens
aatgtatatacacat

SEQ ID NO: 5118440 - DNA, 21 bp, Homo sapiens
aatgtatatttgctgcaaaga

SEQ ID NO: 5118441 - DNA, 22 bp, Homo sapiens
aatgtatatttgctgcaaagag

SEQ ID NO: 5118442 - DNA, 14 bp, Homo sapiens
aatgtatattttgt

SEQ ID NO: 5118443 - DNA, 15 bp, Homo sapiens
aatgtatatttttaa

SEQ ID NO: 5118444 - DNA, 19 bp, Homo sapiens
aatgtatatttttaaagaa

SEQ ID NO: 5118445 - DNA, 18 bp, Homo sapiens
aatgtatcaaatacattt

SEQ ID NO: 5118446 - DNA, 20 bp, Homo sapiens
aatgtatcagccagccttcc

SEQ ID NO: 5118447 - DNA, 22 bp, Homo sapiens
aatgtatcatagaaatgtaact

SEQ ID NO: 5118448 - DNA, 19 bp, Homo sapiens
aatgtatcatttttgtgca

SEQ ID NO: 5118449 - DNA, 21 bp, Homo sapiens
aatgtatcccttctcacagca

SEQ ID NO: 5118450 - DNA, 14 bp, Homo sapiens
aatgtatcctgata

SEQ ID NO: 5118451 - DNA, 18 bp, Homo sapiens
aatgtatctatttgtaca

SEQ ID NO: 5118452 - DNA, 13 bp, Homo sapiens
aatgtatctgcat

SEQ ID NO: 5118453 - DNA, 13 bp, Homo sapiens
aatgtatcttaaa

SEQ ID NO: 5118454 - DNA, 15 bp, Homo sapiens
aatgtatcttaaagg

SEQ ID NO: 5118455 - DNA, 13 bp, Homo sapiens
aatgtatcttatt

SEQ ID NO: 5118456 - DNA, 17 bp, Homo sapiens
aatgtatcttattcaca

SEQ ID NO: 5118457 - DNA, 14 bp, Homo sapiens
aatgtatcttattt

SEQ ID NO: 5118458 - DNA, 18 bp, Homo sapiens
aatgtatcttatttatat

SEQ ID NO: 5118459 - DNA, 21 bp, Homo sapiens
aatgtatctttattaaaacaa

SEQ ID NO: 5118460 - DNA, 14 bp, Homo sapiens
aatgtatgaatttt

SEQ ID NO: 5118461 - DNA, 18 bp, Homo sapiens
aatgtatgaattttgtaa

SEQ ID NO: 5118462 - DNA, 22 bp, Homo sapiens
aatgtatgaattttgtaagtat

SEQ ID NO: 5118463 - DNA, 13 bp, Homo sapiens
aatgtatgcatgt

SEQ ID NO: 5118464 - DNA, 20 bp, Homo sapiens
aatgtatgcattcacattta

SEQ ID NO: 5118465 - DNA, 20 bp, Homo sapiens
aatgtatgctaattgaacat

SEQ ID NO: 5118466 - DNA, 15 bp, Homo sapiens
aatgtatgcttcata

SEQ ID NO: 5118467 - DNA, 14 bp, Homo sapiens
aatgtatgtaaata

SEQ ID NO: 5118468 - DNA, 13 bp, Homo sapiens
aatgtatgtacaa

SEQ ID NO: 5118469 - DNA, 19 bp, Homo sapiens
aatgtatgtacaatacaat

SEQ ID NO: 5118470 - DNA, 17 bp, Homo sapiens
aatgtatgtcagtgcta

SEQ ID NO: 5118471 - DNA, 13 bp, Homo sapiens
aatgtatgtctgg

SEQ ID NO: 5118472 - DNA, 17 bp, Homo sapiens
aatgtatgtgaaagtgt

SEQ ID NO: 5118473 - DNA, 18 bp, Homo sapiens
aatgtatgtgaaagtgta

SEQ ID NO: 5118474 - DNA, 20 bp, Homo sapiens
aatgtatgtgcactgtcact

SEQ ID NO: 5118475 - DNA, 21 bp, Homo sapiens
aatgtatgtgcactgtcactt

SEQ ID NO: 5118476 - DNA, 12 bp, Homo sapiens
aatgtatgtgta

SEQ ID NO: 5118477 - DNA, 14 bp, Homo sapiens
aatgtatgtgtaag

SEQ ID NO: 5118478 - DNA, 16 bp, Homo sapiens
aatgtatgtgtggctg

SEQ ID NO: 5118479 - DNA, 17 bp, Homo sapiens
aatgtatgtgtggctgt

SEQ ID NO: 5118480 - DNA, 13 bp, Homo sapiens
aatgtatgtgtgt

SEQ ID NO: 5118481 - DNA, 18 bp, Homo sapiens
aatgtatgtgtgtctatt

SEQ ID NO: 5118482 - DNA, 13 bp, Homo sapiens
aatgtatgttacc

SEQ ID NO: 5118483 - DNA, 21 bp, Homo sapiens
aatgtatgttaccaaaaataa

SEQ ID NO: 5118484 - DNA, 22 bp, Homo sapiens
aatgtattagtatggttcaaga

SEQ ID NO: 5118485 - DNA, 19 bp, Homo sapiens
aatgtattcaagcaaacat

SEQ ID NO: 5118486 - DNA, 15 bp, Homo sapiens
aatgtattcatattt

SEQ ID NO: 5118487 - DNA, 16 bp, Homo sapiens
aatgtattcatatttg

SEQ ID NO: 5118488 - DNA, 15 bp, Homo sapiens
aatgtattcccttca

SEQ ID NO: 5118489 - DNA, 19 bp, Homo sapiens
aatgtattcctgaaaagct

SEQ ID NO: 5118490 - DNA, 16 bp, Homo sapiens
aatgtattctatctct

SEQ ID NO: 5118491 - DNA, 14 bp, Homo sapiens
aatgtattctgtat

SEQ ID NO: 5118492 - DNA, 15 bp, Homo sapiens
aatgtattctgtatc

SEQ ID NO: 5118493 - DNA, 19 bp, Homo sapiens
aatgtattgaacttggaaa

SEQ ID NO: 5118494 - DNA, 15 bp, Homo sapiens
aaacagaaaagagaa

SEQ ID NO: 5118495 - DNA, 14 bp, Homo sapiens
aaacagaaacgaga

SEQ ID NO: 5118496 - DNA, 15 bp, Homo sapiens
aaacagaaattaatc

SEQ ID NO: 5118497 - DNA, 12 bp, Homo sapiens
aaacagaacact

SEQ ID NO: 5118498 - DNA, 15 bp, Homo sapiens
aaacagaacactgta

SEQ ID NO: 5118499 - DNA, 13 bp, Homo sapiens
aaacagaacactt

SEQ ID NO: 5118500 - DNA, 14 bp, Homo sapiens
aaacagaacactta

SEQ ID NO: 5118501 - DNA, 13 bp, Homo sapiens
aaacagaacatca

SEQ ID NO: 5118502 - DNA, 21 bp, Homo sapiens
aaacagaacatcattagaaca

SEQ ID NO: 5118503 - DNA, 15 bp, Homo sapiens
aaacagaactccctt

SEQ ID NO: 5118504 - DNA, 21 bp, Homo sapiens
aaacagaactcgatgcactga

SEQ ID NO: 5118505 - DNA, 14 bp, Homo sapiens
aaacagaagcaaat

SEQ ID NO: 5118506 - DNA, 14 bp, Homo sapiens
aaacagaagtgcat

SEQ ID NO: 5118507 - DNA, 13 bp, Homo sapiens
aaacagaatttga

SEQ ID NO: 5118508 - DNA, 14 bp, Homo sapiens
aaacagaatttttc

SEQ ID NO: 5118509 - DNA, 12 bp, Homo sapiens
aaacagacaaaa

SEQ ID NO: 5118510 - DNA, 16 bp, Homo sapiens
aaacagacaaaacaat

SEQ ID NO: 5118511 - DNA, 16 bp, Homo sapiens
aaacagagaaagaaaa

SEQ ID NO: 5118512 - DNA, 17 bp, Homo sapiens
aaacagagaaagaaaag

SEQ ID NO: 5118513 - DNA, 18 bp, Homo sapiens
aaacagagaaagggtaat

SEQ ID NO: 5118514 - DNA, 15 bp, Homo sapiens
aaacagagacaggcc

SEQ ID NO: 5118515 - DNA, 22 bp, Homo sapiens
aaacagagacaggcccaagaga

SEQ ID NO: 5118516 - DNA, 21 bp, Homo sapiens
aaacagagatcataaagagca

SEQ ID NO: 5118517 - DNA, 13 bp, Homo sapiens
aaacagaggacca

SEQ ID NO: 5118518 - DNA, 14 bp, Homo sapiens
aaacagaggatgct

SEQ ID NO: 5118519 - DNA, 19 bp, Homo sapiens
aaacagaggatgctgaagt

SEQ ID NO: 5118520 - DNA, 20 bp, Homo sapiens
aaacagaggccatggcagaa

SEQ ID NO: 5118521 - DNA, 12 bp, Homo sapiens
aaacagagggcc

SEQ ID NO: 5118522 - DNA, 16 bp, Homo sapiens
aaacagaggtaaaaaa

SEQ ID NO: 5118523 - DNA, 20 bp, Homo sapiens
aaacagaggtaaaaaaaaga

SEQ ID NO: 5118524 - DNA, 21 bp, Homo sapiens
aaacagaggtaaaaaaaagaa

SEQ ID NO: 5118525 - DNA, 14 bp, Homo sapiens
aaacagagtatttc

SEQ ID NO: 5118526 - DNA, 22 bp, Homo sapiens
aaacagagtccaatttaaggaa

SEQ ID NO: 5118527 - DNA, 22 bp, Homo sapiens
aaacagagtggcctccctgctg

SEQ ID NO: 5118528 - DNA, 12 bp, Homo sapiens
aaacagatataa

SEQ ID NO: 5118529 - DNA, 18 bp, Homo sapiens
aaacagatatcttcagtt

SEQ ID NO: 5118530 - DNA, 19 bp, Homo sapiens
aaacagatatcttcagttt

SEQ ID NO: 5118531 - DNA, 20 bp, Homo sapiens
aaacagatatcttcagttta

SEQ ID NO: 5118532 - DNA, 14 bp, Homo sapiens
aaacagatctgaat

SEQ ID NO: 5118533 - DNA, 20 bp, Homo sapiens
aaacagatgtaatgggaaga

SEQ ID NO: 5118534 - DNA, 22 bp, Homo sapiens
aaacagatgtccatcagatgac

SEQ ID NO: 5118535 - DNA, 14 bp, Homo sapiens
aaacagatgtccct

SEQ ID NO: 5118536 - DNA, 15 bp, Homo sapiens
aaacagattcaaagc

SEQ ID NO: 5118537 - DNA, 21 bp, Homo sapiens
aaacagattcaggccagccca

SEQ ID NO: 5118538 - DNA, 22 bp, Homo sapiens
aaacagattcaggccagcccag

SEQ ID NO: 5118539 - DNA, 19 bp, Homo sapiens
aaacagattctgattccct

SEQ ID NO: 5118540 - DNA, 16 bp, Homo sapiens
aaacagattgtttgca

SEQ ID NO: 5118541 - DNA, 17 bp, Homo sapiens
aaacagatttggaaaga

SEQ ID NO: 5118542 - DNA, 22 bp, Homo sapiens
aaacagatttggtgaatttgaa

SEQ ID NO: 5118543 - DNA, 15 bp, Homo sapiens
aaacagatttttaca

SEQ ID NO: 5118544 - DNA, 14 bp, Homo sapiens
aaacagcaaacagt

SEQ ID NO: 5118545 - DNA, 14 bp, Homo sapiens
aaacagcaaaccaa

SEQ ID NO: 5118546 - DNA, 15 bp, Homo sapiens
aaacagcaaaccaag

SEQ ID NO: 5118547 - DNA, 17 bp, Homo sapiens
aaacagcaaaccaagag

SEQ ID NO: 5118548 - DNA, 20 bp, Homo sapiens
aaacagcaaaccaagagatt

SEQ ID NO: 5118549 - DNA, 17 bp, Homo sapiens
aaacagcaccaccattt

SEQ ID NO: 5118550 - DNA, 19 bp, Homo sapiens
aaacagcaccaccatttaa

SEQ ID NO: 5118551 - DNA, 22 bp, Homo sapiens
aaacagcaccaccatttaattt

SEQ ID NO: 5118552 - DNA, 13 bp, Homo sapiens
aaacagcagctga

SEQ ID NO: 5118553 - DNA, 23 bp, Homo sapiens
aaacagcagggtttgagcacaat

SEQ ID NO: 5118554 - DNA, 14 bp, Homo sapiens
aaacagcagtgttc

SEQ ID NO: 5118555 - DNA, 16 bp, Homo sapiens
aaacagcagtttgtga

SEQ ID NO: 5118556 - DNA, 14 bp, Homo sapiens
aaacagcatgaata

SEQ ID NO: 5118557 - DNA, 19 bp, Homo sapiens
aaacagcatgaataaaaca

SEQ ID NO: 5118558 - DNA, 14 bp, Homo sapiens
aaacagcattagat

SEQ ID NO: 5118559 - DNA, 16 bp, Homo sapiens
aaacagcattgctttc

SEQ ID NO: 5118560 - DNA, 18 bp, Homo sapiens
aaacagcatttattacct

SEQ ID NO: 5118561 - DNA, 20 bp, Homo sapiens
aaacagccaccgtttcttcc

SEQ ID NO: 5118562 - DNA, 16 bp, Homo sapiens
aaacagcccccctgct

SEQ ID NO: 5118563 - DNA, 15 bp, Homo sapiens
aaacagcccttcctt

SEQ ID NO: 5118564 - DNA, 17 bp, Homo sapiens
aaacagctaatgggaca

SEQ ID NO: 5118565 - DNA, 23 bp, Homo sapiens
aaacagctatttcccttttctgt

SEQ ID NO: 5118566 - DNA, 13 bp, Homo sapiens
aaacagctcagcc

SEQ ID NO: 5118567 - DNA, 19 bp, Homo sapiens
aaacagctgaaagaggagg

SEQ ID NO: 5118568 - DNA, 14 bp, Homo sapiens
aaacagctgaacca

SEQ ID NO: 5118569 - DNA, 11 bp, Homo sapiens
aaacagctgcc

SEQ ID NO: 5118570 - DNA, 14 bp, Homo sapiens
aaacagctgcttct

SEQ ID NO: 5118571 - DNA, 14 bp, Homo sapiens
aaacagctggtcct

SEQ ID NO: 5118572 - DNA, 16 bp, Homo sapiens
aaacagcttaaattct

SEQ ID NO: 5118573 - DNA, 22 bp, Homo sapiens
aaacagcttcatgcctttgtaa

SEQ ID NO: 5118574 - DNA, 22 bp, Homo sapiens
aaacagcttcctgttactgaga

SEQ ID NO: 5118575 - DNA, 12 bp, Homo sapiens
aaacagctttca

SEQ ID NO: 5118576 - DNA, 14 bp, Homo sapiens
aaacagctttcaag

SEQ ID NO: 5118577 - DNA, 13 bp, Homo sapiens
aaacagctttctg

SEQ ID NO: 5118578 - DNA, 14 bp, Homo sapiens
aaacagctttctgg

SEQ ID NO: 5118579 - DNA, 23 bp, Homo sapiens
aaacagctttctgggtaattcac

SEQ ID NO: 5118580 - DNA, 13 bp, Homo sapiens
aaacagctttgtc

SEQ ID NO: 5118581 - DNA, 15 bp, Homo sapiens
aaacagctttgtctc

SEQ ID NO: 5118582 - DNA, 19 bp, Homo sapiens
aaacagctttgtctccaaa

SEQ ID NO: 5118583 - DNA, 23 bp, Homo sapiens
aaacagctttgtctccaaagaag

SEQ ID NO: 5118584 - DNA, 14 bp, Homo sapiens
aaacaggaaaaaaa

SEQ ID NO: 5118585 - DNA, 15 bp, Homo sapiens
aaacaggaaaaaaac

SEQ ID NO: 5118586 - DNA, 16 bp, Homo sapiens
aaacaggaaaaaaact

SEQ ID NO: 5118587 - DNA, 21 bp, Homo sapiens
aaacaggagcaaatggcgttt

SEQ ID NO: 5118588 - DNA, 13 bp, Homo sapiens
aaacaggcaaagt

SEQ ID NO: 5118589 - DNA, 15 bp, Homo sapiens
aaacaggcacaggct

SEQ ID NO: 5118590 - DNA, 23 bp, Homo sapiens
aaacaggcacttggcagccttgt

SEQ ID NO: 5118591 - DNA, 14 bp, Homo sapiens
aaacaggcccagca

SEQ ID NO: 5118592 - DNA, 16 bp, Homo sapiens
aaacaggctccaagag

SEQ ID NO: 5118593 - DNA, 20 bp, Homo sapiens
aaacagggacactacaaaca

SEQ ID NO: 5118594 - DNA, 23 bp, Homo sapiens
aaacagggagcccctaggaaagc

SEQ ID NO: 5118595 - DNA, 11 bp, Homo sapiens
aaacagggcag

SEQ ID NO: 5118596 - DNA, 11 bp, Homo sapiens
aaacagggcct

SEQ ID NO: 5118597 - DNA, 22 bp, Homo sapiens
aaacagggctgccttctggcct

SEQ ID NO: 5118598 - DNA, 19 bp, Homo sapiens
aaacaggggatcaaagttc

SEQ ID NO: 5118599 - DNA, 20 bp, Homo sapiens
aaacagggtaactaactaaa

SEQ ID NO: 5118600 - DNA, 16 bp, Homo sapiens
aaacaggtgctggccc

SEQ ID NO: 5118601 - DNA, 23 bp, Homo sapiens
aaacaggtgctggcccagcatgg

SEQ ID NO: 5118602 - DNA, 17 bp, Homo sapiens
aaacaggtgtgtgtgaa

SEQ ID NO: 5118603 - DNA, 18 bp, Homo sapiens
aaacaggttgggatggga

SEQ ID NO: 5118604 - DNA, 21 bp, Homo sapiens
aaacagtaaaggccatgtgaa

SEQ ID NO: 5118605 - DNA, 20 bp, Homo sapiens
aaacagtaatctaggtgtgg

SEQ ID NO: 5118606 - DNA, 20 bp, Homo sapiens
aaacagtaatgactctctga

SEQ ID NO: 5118607 - DNA, 14 bp, Homo sapiens
aaacagtagtgata

SEQ ID NO: 5118608 - DNA, 20 bp, Homo sapiens
aaacagtagttgtattcttc

SEQ ID NO: 5118609 - DNA, 20 bp, Homo sapiens
aaacagtataatttgacaaa

SEQ ID NO: 5118610 - DNA, 11 bp, Homo sapiens
aaacagtatct

SEQ ID NO: 5118611 - DNA, 17 bp, Homo sapiens
aaacagtatttattttg

SEQ ID NO: 5118612 - DNA, 15 bp, Homo sapiens
aaacagtatttcatt

SEQ ID NO: 5118613 - DNA, 17 bp, Homo sapiens
aaacagtatttcattgc

SEQ ID NO: 5118614 - DNA, 18 bp, Homo sapiens
aaacagtatttcattgcc

SEQ ID NO: 5118615 - DNA, 15 bp, Homo sapiens
aaacagtattttctt

SEQ ID NO: 5118616 - DNA, 17 bp, Homo sapiens
aaacagtcctttaaatt

SEQ ID NO: 5118617 - DNA, 20 bp, Homo sapiens
aaacagtctcaggaaatcaa

SEQ ID NO: 5118618 - DNA, 16 bp, Homo sapiens
aaacagtctcccttcc

SEQ ID NO: 5118619 - DNA, 14 bp, Homo sapiens
aaacagtgaaagcc

SEQ ID NO: 5118620 - DNA, 15 bp, Homo sapiens
aaacagtgaatctta

SEQ ID NO: 5118621 - DNA, 13 bp, Homo sapiens
aaacagtgactgt

SEQ ID NO: 5118622 - DNA, 14 bp, Homo sapiens
aaacagtgagcata

SEQ ID NO: 5118623 - DNA, 15 bp, Homo sapiens
aaacagtgagcatat

SEQ ID NO: 5118624 - DNA, 16 bp, Homo sapiens
aaacagtgagcatatc

SEQ ID NO: 5118625 - DNA, 18 bp, Homo sapiens
aaacagtgagcatatctg

SEQ ID NO: 5118626 - DNA, 20 bp, Homo sapiens
aaacagtgccaaatgctggg

SEQ ID NO: 5118627 - DNA, 18 bp, Homo sapiens
aaacagtgggagccctga

SEQ ID NO: 5118628 - DNA, 20 bp, Homo sapiens
aaacagtgtggatgtaaatt

SEQ ID NO: 5118629 - DNA, 16 bp, Homo sapiens
aaacagtgtgttggtg

SEQ ID NO: 5118630 - DNA, 12 bp, Homo sapiens
aaacagtgtttc

SEQ ID NO: 5118631 - DNA, 23 bp, Homo sapiens
aaacagttaactttcagaagaga

SEQ ID NO: 5118632 - DNA, 11 bp, Homo sapiens
aaacagttcca

SEQ ID NO: 5118633 - DNA, 22 bp, Homo sapiens
aaacagttctcactgggaagaa

SEQ ID NO: 5118634 - DNA, 15 bp, Homo sapiens
aaacagttcttggac

SEQ ID NO: 5118635 - DNA, 16 bp, Homo sapiens
aaacagttcttggacc

SEQ ID NO: 5118636 - DNA, 18 bp, Homo sapiens
aaacagttgaataatttg

SEQ ID NO: 5118637 - DNA, 18 bp, Homo sapiens
aaacagttgcacagcatc

SEQ ID NO: 5118638 - DNA, 21 bp, Homo sapiens
aaacagttgcacagcatctca

SEQ ID NO: 5118639 - DNA, 15 bp, Homo sapiens
aaacagttgctgtga

SEQ ID NO: 5118640 - DNA, 23 bp, Homo sapiens
aaacagttgctgtgaactttcat

SEQ ID NO: 5118641 - DNA, 19 bp, Homo sapiens
aaacagttggtaacttttg

SEQ ID NO: 5118642 - DNA, 22 bp, Homo sapiens
aaacagttggtaacttttgtga

SEQ ID NO: 5118643 - DNA, 14 bp, Homo sapiens
aaacagtttaacag

SEQ ID NO: 5118644 - DNA, 22 bp, Homo sapiens
aaacagtttttattaaaacatg

SEQ ID NO: 5118645 - DNA, 14 bp, Homo sapiens
aaacataaaaagca

SEQ ID NO: 5118646 - DNA, 21 bp, Homo sapiens
aaacataaaaagcagaatttt

SEQ ID NO: 5118647 - DNA, 22 bp, Homo sapiens
aaacataaaaagcagaatttta

SEQ ID NO: 5118648 - DNA, 20 bp, Homo sapiens
aaacataaacacatttccat

SEQ ID NO: 5118649 - DNA, 13 bp, Homo sapiens
aaacataaataaa

SEQ ID NO: 5118650 - DNA, 19 bp, Homo sapiens
aaacataactttgtaaata

SEQ ID NO: 5118651 - DNA, 18 bp, Homo sapiens
aaacataagacgacttat

SEQ ID NO: 5118652 - DNA, 17 bp, Homo sapiens
aaacataagatcactgc

SEQ ID NO: 5118653 - DNA, 19 bp, Homo sapiens
aaacataagccatggtgaa

SEQ ID NO: 5118654 - DNA, 14 bp, Homo sapiens
aaacataataaatc

SEQ ID NO: 5118655 - DNA, 22 bp, Homo sapiens
aaacataatagaatttcctaat

SEQ ID NO: 5118656 - DNA, 23 bp, Homo sapiens
aaacataatagaatttcctaatg

SEQ ID NO: 5118657 - DNA, 20 bp, Homo sapiens
aaacataatcttctgccttc

SEQ ID NO: 5118658 - DNA, 15 bp, Homo sapiens
aaacataatgaaaat

SEQ ID NO: 5118659 - DNA, 15 bp, Homo sapiens
aaacatacaagcaac

SEQ ID NO: 5118660 - DNA, 13 bp, Homo sapiens
aaacatacataat

SEQ ID NO: 5118661 - DNA, 17 bp, Homo sapiens
aaacataccaacatgtt

SEQ ID NO: 5118662 - DNA, 20 bp, Homo sapiens
aaacatacttacatttcaga

SEQ ID NO: 5118663 - DNA, 14 bp, Homo sapiens
aaacatagaaacat

SEQ ID NO: 5118664 - DNA, 13 bp, Homo sapiens
aaacatagaaaga

SEQ ID NO: 5118665 - DNA, 14 bp, Homo sapiens
aaacatagaaagac

SEQ ID NO: 5118666 - DNA, 16 bp, Homo sapiens
aaacatagaaagacat

SEQ ID NO: 5118667 - DNA, 14 bp, Homo sapiens
aaacatagaaatgg

SEQ ID NO: 5118668 - DNA, 13 bp, Homo sapiens
aaacatagactga

SEQ ID NO: 5118669 - DNA, 14 bp, Homo sapiens
aaacatagactgaa

SEQ ID NO: 5118670 - DNA, 22 bp, Homo sapiens
aaacatagagtagacctgagat

SEQ ID NO: 5118671 - DNA, 18 bp, Homo sapiens
aaacatagatagtgcttt

SEQ ID NO: 5118672 - DNA, 14 bp, Homo sapiens
aaacataggaaagt

SEQ ID NO: 5118673 - DNA, 18 bp, Homo sapiens
aaacatagtggtatttta

SEQ ID NO: 5118674 - DNA, 16 bp, Homo sapiens
aaacatatacagaaaa

SEQ ID NO: 5118675 - DNA, 18 bp, Homo sapiens
aatgtattgattacaaat

SEQ ID NO: 5118676 - DNA, 19 bp, Homo sapiens
aatgtattgattcaacagg

SEQ ID NO: 5118677 - DNA, 13 bp, Homo sapiens
aatgtattgtacc

SEQ ID NO: 5118678 - DNA, 14 bp, Homo sapiens
aatgtattgtacct

SEQ ID NO: 5118679 - DNA, 23 bp, Homo sapiens
aatgtattgtaccttttaacacc

SEQ ID NO: 5118680 - DNA, 19 bp, Homo sapiens
aatgtattgttggtaatta

SEQ ID NO: 5118681 - DNA, 16 bp, Homo sapiens
aatgtatttagctaca

SEQ ID NO: 5118682 - DNA, 20 bp, Homo sapiens
aatgtatttagctacagctt

SEQ ID NO: 5118683 - DNA, 13 bp, Homo sapiens
aatgtatttatat

SEQ ID NO: 5118684 - DNA, 17 bp, Homo sapiens
aatgtatttatatgtta

SEQ ID NO: 5118685 - DNA, 12 bp, Homo sapiens
aatgtatttatg

SEQ ID NO: 5118686 - DNA, 13 bp, Homo sapiens
aatgtatttatgt

SEQ ID NO: 5118687 - DNA, 14 bp, Homo sapiens
aatgtatttcctga

SEQ ID NO: 5118688 - DNA, 15 bp, Homo sapiens
aatgtatttcctgaa

SEQ ID NO: 5118689 - DNA, 13 bp, Homo sapiens
aatgtatttgaaa

SEQ ID NO: 5118690 - DNA, 16 bp, Homo sapiens
aatgtatttgaaaatt

SEQ ID NO: 5118691 - DNA, 14 bp, Homo sapiens
aatgtatttgttca

SEQ ID NO: 5118692 - DNA, 19 bp, Homo sapiens
aatgtatttgttcatgttt

SEQ ID NO: 5118693 - DNA, 18 bp, Homo sapiens
aatgtattttatgttata

SEQ ID NO: 5118694 - DNA, 17 bp, Homo sapiens
aatgtattttattgtaa

SEQ ID NO: 5118695 - DNA, 21 bp, Homo sapiens
aatgtattttattgtaacaga

SEQ ID NO: 5118696 - DNA, 23 bp, Homo sapiens
aatgtattttattgtaacagaca

SEQ ID NO: 5118697 - DNA, 17 bp, Homo sapiens
aatgtattttcttttta

SEQ ID NO: 5118698 - DNA, 15 bp, Homo sapiens
aatgtattttgaaga

SEQ ID NO: 5118699 - DNA, 19 bp, Homo sapiens
aatgtattttgaagaatat

SEQ ID NO: 5118700 - DNA, 23 bp, Homo sapiens
aatgtattttggttgctgatgtt

SEQ ID NO: 5118701 - DNA, 14 bp, Homo sapiens
aatgtatttttcct

SEQ ID NO: 5118702 - DNA, 14 bp, Homo sapiens
aatgtatttttcta

SEQ ID NO: 5118703 - DNA, 15 bp, Homo sapiens
aatgtatttttgtaa

SEQ ID NO: 5118704 - DNA, 19 bp, Homo sapiens
aatgtatttttgtaaatag

SEQ ID NO: 5118705 - DNA, 19 bp, Homo sapiens
aatgtcaaaagtagaactt

SEQ ID NO: 5118706 - DNA, 23 bp, Homo sapiens
aatgtcaaaagtagaactttgta

SEQ ID NO: 5118707 - DNA, 19 bp, Homo sapiens
aatgtcaaatcaaggcaaa

SEQ ID NO: 5118708 - DNA, 20 bp, Homo sapiens
aatgtcaaccatctttaagg

SEQ ID NO: 5118709 - DNA, 22 bp, Homo sapiens
aatgtcaacctttgtaagaaaa

SEQ ID NO: 5118710 - DNA, 12 bp, Homo sapiens
aatgtcaaggca

SEQ ID NO: 5118711 - DNA, 19 bp, Homo sapiens
aatgtcaatagcaaatgaa

SEQ ID NO: 5118712 - DNA, 19 bp, Homo sapiens
aatgtcacaacatggtgct

SEQ ID NO: 5118713 - DNA, 23 bp, Homo sapiens
aatgtcacaacatggtgctactt

SEQ ID NO: 5118714 - DNA, 22 bp, Homo sapiens
aatgtcacaattatgtgcaaag

SEQ ID NO: 5118715 - DNA, 15 bp, Homo sapiens
aatgtcaccaccttc

SEQ ID NO: 5118716 - DNA, 18 bp, Homo sapiens
aatgtcaccaccttccca

SEQ ID NO: 5118717 - DNA, 23 bp, Homo sapiens
aatgtcaccaccttcccagctct

SEQ ID NO: 5118718 - DNA, 15 bp, Homo sapiens
aatgtcaccatgctt

SEQ ID NO: 5118719 - DNA, 22 bp, Homo sapiens
aatgtcacgtactgtctgattg

SEQ ID NO: 5118720 - DNA, 23 bp, Homo sapiens
aatgtcacgttttgttttgtgcc

SEQ ID NO: 5118721 - DNA, 13 bp, Homo sapiens
aatgtcactgtta

SEQ ID NO: 5118722 - DNA, 14 bp, Homo sapiens
aatgtcactgttat

SEQ ID NO: 5118723 - DNA, 20 bp, Homo sapiens
aatgtcactttttgaggcaa

SEQ ID NO: 5118724 - DNA, 18 bp, Homo sapiens
aatgtcagaaaaacaata

SEQ ID NO: 5118725 - DNA, 19 bp, Homo sapiens
aatgtcagaattaaaataa

SEQ ID NO: 5118726 - DNA, 16 bp, Homo sapiens
aatgtcagactttgct

SEQ ID NO: 5118727 - DNA, 15 bp, Homo sapiens
aatgtcagatacaat

SEQ ID NO: 5118728 - DNA, 17 bp, Homo sapiens
aatgtcagatacaatgt

SEQ ID NO: 5118729 - DNA, 18 bp, Homo sapiens
aatgtcagatacaatgta

SEQ ID NO: 5118730 - DNA, 16 bp, Homo sapiens
aatgtcagattccttt

SEQ ID NO: 5118731 - DNA, 17 bp, Homo sapiens
aatgtcagcaaatgtaa

SEQ ID NO: 5118732 - DNA, 16 bp, Homo sapiens
aatgtcagcctttgtt

SEQ ID NO: 5118733 - DNA, 17 bp, Homo sapiens
aatgtcagcctttgtta

SEQ ID NO: 5118734 - DNA, 22 bp, Homo sapiens
aatgtcagcttaaaattggtaa

SEQ ID NO: 5118735 - DNA, 18 bp, Homo sapiens
aatgtcaggaacagaagg

SEQ ID NO: 5118736 - DNA, 13 bp, Homo sapiens
aatgtcagtatgt

SEQ ID NO: 5118737 - DNA, 12 bp, Homo sapiens
aatgtcagtgac

SEQ ID NO: 5118738 - DNA, 18 bp, Homo sapiens
aatgtcagttgttattta

SEQ ID NO: 5118739 - DNA, 21 bp, Homo sapiens
aatgtcataaagtgagaaaac

SEQ ID NO: 5118740 - DNA, 19 bp, Homo sapiens
aatgtcataaatgtcacaa

SEQ ID NO: 5118741 - DNA, 18 bp, Homo sapiens
aatgtcataaattactgt

SEQ ID NO: 5118742 - DNA, 23 bp, Homo sapiens
aatgtcatggccttgaaacagtt

SEQ ID NO: 5118743 - DNA, 12 bp, Homo sapiens
aatgtcattatt

SEQ ID NO: 5118744 - DNA, 19 bp, Homo sapiens
aatgtcattgaaaaactaa

SEQ ID NO: 5118745 - DNA, 21 bp, Homo sapiens
aatgtcattgctaaaaaataa

SEQ ID NO: 5118746 - DNA, 13 bp, Homo sapiens
aatgtcattgtct

SEQ ID NO: 5118747 - DNA, 16 bp, Homo sapiens
aatgtcattgtctact

SEQ ID NO: 5118748 - DNA, 18 bp, Homo sapiens
aatgtcattgtctactcc

SEQ ID NO: 5118749 - DNA, 20 bp, Homo sapiens
aatgtcatttcatacaaatt

SEQ ID NO: 5118750 - DNA, 12 bp, Homo sapiens
aatgtcatttgc

SEQ ID NO: 5118751 - DNA, 20 bp, Homo sapiens
aatgtccaaatactctgaaa

SEQ ID NO: 5118752 - DNA, 21 bp, Homo sapiens
aatgtccaccaatagaatgag

SEQ ID NO: 5118753 - DNA, 22 bp, Homo sapiens
aatgtccaccatgaacttgata

SEQ ID NO: 5118754 - DNA, 19 bp, Homo sapiens
aatgtccaggtcacaggca

SEQ ID NO: 5118755 - DNA, 20 bp, Homo sapiens
aatgtccaggtcacaggcat

SEQ ID NO: 5118756 - DNA, 12 bp, Homo sapiens
aatgtccccact

SEQ ID NO: 5118757 - DNA, 15 bp, Homo sapiens
aatgtccccactccc

SEQ ID NO: 5118758 - DNA, 15 bp, Homo sapiens
aatgtcccccacctc

SEQ ID NO: 5118759 - DNA, 17 bp, Homo sapiens
aatgtcctccagaagcc

SEQ ID NO: 5118760 - DNA, 14 bp, Homo sapiens
aatgtcctcttgga

SEQ ID NO: 5118761 - DNA, 14 bp, Homo sapiens
aatgtcctgaaaca

SEQ ID NO: 5118762 - DNA, 18 bp, Homo sapiens
aatgtcctgaaacatgaa

SEQ ID NO: 5118763 - DNA, 18 bp, Homo sapiens
aatgtcctgcatgcataa

SEQ ID NO: 5118764 - DNA, 21 bp, Homo sapiens
aatgtccttattcttgtggtt

SEQ ID NO: 5118765 - DNA, 13 bp, Homo sapiens
aatgtcctttccc

SEQ ID NO: 5118766 - DNA, 16 bp, Homo sapiens
aatgtcctttctcaga

SEQ ID NO: 5118767 - DNA, 20 bp, Homo sapiens
aatgtcctttctccagtgta

SEQ ID NO: 5118768 - DNA, 20 bp, Homo sapiens
aatgtcgatcaagagaatca

SEQ ID NO: 5118769 - DNA, 16 bp, Homo sapiens
aatgtcgctgtaaatt

SEQ ID NO: 5118770 - DNA, 18 bp, Homo sapiens
aatgtctaaaaacatttg

SEQ ID NO: 5118771 - DNA, 15 bp, Homo sapiens
aatgtctaaatgctg

SEQ ID NO: 5118772 - DNA, 14 bp, Homo sapiens
aatgtctaacttaa

SEQ ID NO: 5118773 - DNA, 15 bp, Homo sapiens
aatgtctaacttaaa

SEQ ID NO: 5118774 - DNA, 15 bp, Homo sapiens
aatgtctactgaagc

SEQ ID NO: 5118775 - DNA, 21 bp, Homo sapiens
aatgtctagattttgaaaaat

SEQ ID NO: 5118776 - DNA, 18 bp, Homo sapiens
aatgtctcaagtgcaatg

SEQ ID NO: 5118777 - DNA, 14 bp, Homo sapiens
aatgtctcaatggt

SEQ ID NO: 5118778 - DNA, 16 bp, Homo sapiens
aatgtctcactgagca

SEQ ID NO: 5118779 - DNA, 19 bp, Homo sapiens
aatgtctcactgagcactg

SEQ ID NO: 5118780 - DNA, 22 bp, Homo sapiens
aatgtctcactgagcactgttt

SEQ ID NO: 5118781 - DNA, 18 bp, Homo sapiens
aatgtctcactgttctgc

SEQ ID NO: 5118782 - DNA, 19 bp, Homo sapiens
aatgtctcactgttctgca

SEQ ID NO: 5118783 - DNA, 17 bp, Homo sapiens
aatgtctcatgtcaatg

SEQ ID NO: 5118784 - DNA, 12 bp, Homo sapiens
aatgtctcccac

SEQ ID NO: 5118785 - DNA, 13 bp, Homo sapiens
aatgtctcccaca

SEQ ID NO: 5118786 - DNA, 18 bp, Homo sapiens
aatgtctctgtgagactc

SEQ ID NO: 5118787 - DNA, 17 bp, Homo sapiens
aatgtctgacacattaa

SEQ ID NO: 5118788 - DNA, 17 bp, Homo sapiens
aatgtctgacctagcct

SEQ ID NO: 5118789 - DNA, 20 bp, Homo sapiens
aatgtctgcactgaggattt

SEQ ID NO: 5118790 - DNA, 12 bp, Homo sapiens
aatgtctgcagc

SEQ ID NO: 5118791 - DNA, 13 bp, Homo sapiens
aatgtctgcagct

SEQ ID NO: 5118792 - DNA, 21 bp, Homo sapiens
aatgtctgctggtatttctaa

SEQ ID NO: 5118793 - DNA, 14 bp, Homo sapiens
aatgtctggagacc

SEQ ID NO: 5118794 - DNA, 23 bp, Homo sapiens
aatgtctggagtggtaacagctc

SEQ ID NO: 5118795 - DNA, 17 bp, Homo sapiens
aatgtctggggacaggc

SEQ ID NO: 5118796 - DNA, 19 bp, Homo sapiens
aatgtctggtgtttgtcat

SEQ ID NO: 5118797 - DNA, 16 bp, Homo sapiens
aatgtctgtaataata

SEQ ID NO: 5118798 - DNA, 17 bp, Homo sapiens
aatgtctgtaataatag

SEQ ID NO: 5118799 - DNA, 18 bp, Homo sapiens
aatgtctgtaataataga

SEQ ID NO: 5118800 - DNA, 23 bp, Homo sapiens
aatgtctgtaataatagactgta

SEQ ID NO: 5118801 - DNA, 23 bp, Homo sapiens
aatgtctgtcagaagacactaat

SEQ ID NO: 5118802 - DNA, 12 bp, Homo sapiens
aatgtctgtgct

SEQ ID NO: 5118803 - DNA, 13 bp, Homo sapiens
aatgtctgtgcta

SEQ ID NO: 5118804 - DNA, 20 bp, Homo sapiens
aatgtctgttgaacagctat

SEQ ID NO: 5118805 - DNA, 12 bp, Homo sapiens
aatgtcttcata

SEQ ID NO: 5118806 - DNA, 19 bp, Homo sapiens
aatgtcttccttttctttc

SEQ ID NO: 5118807 - DNA, 17 bp, Homo sapiens
aatgtcttgagctctat

SEQ ID NO: 5118808 - DNA, 23 bp, Homo sapiens
aatgtcttgctgttgacatattt

SEQ ID NO: 5118809 - DNA, 19 bp, Homo sapiens
aatgtcttggtacttgctg

SEQ ID NO: 5118810 - DNA, 17 bp, Homo sapiens
aatgtcttgtaagcaaa

SEQ ID NO: 5118811 - DNA, 17 bp, Homo sapiens
aatgtcttgtgtatttc

SEQ ID NO: 5118812 - DNA, 24 bp, Homo sapiens
aatgtcttgtgtatttctctgtga

SEQ ID NO: 5118813 - DNA, 13 bp, Homo sapiens
aatgtcttgtgtt

SEQ ID NO: 5118814 - DNA, 20 bp, Homo sapiens
aatgtcttgttaatattctt

SEQ ID NO: 5118815 - DNA, 21 bp, Homo sapiens
aatgtcttgttaatattcttt

SEQ ID NO: 5118816 - DNA, 19 bp, Homo sapiens
aatgtcttgttcctgtgca

SEQ ID NO: 5118817 - DNA, 14 bp, Homo sapiens
aatgtctttcatgt

SEQ ID NO: 5118818 - DNA, 17 bp, Homo sapiens
aatgtctttggtcctct

SEQ ID NO: 5118819 - DNA, 19 bp, Homo sapiens
aatgtctttgtaagtcagt

SEQ ID NO: 5118820 - DNA, 22 bp, Homo sapiens
aatgtctttgttggaaaagaat

SEQ ID NO: 5118821 - DNA, 13 bp, Homo sapiens
aatgtcttttgaa

SEQ ID NO: 5118822 - DNA, 21 bp, Homo sapiens
aatgtcttttttttaatgtgc

SEQ ID NO: 5118823 - DNA, 13 bp, Homo sapiens
aatgtgaaaaact

SEQ ID NO: 5118824 - DNA, 17 bp, Homo sapiens
aatgtgaaaaaggaata

SEQ ID NO: 5118825 - DNA, 15 bp, Homo sapiens
aatgtgaaaaatctg

SEQ ID NO: 5118826 - DNA, 17 bp, Homo sapiens
aatgtgaaaagaaaaat

SEQ ID NO: 5118827 - DNA, 22 bp, Homo sapiens
aatgtgaaaatggtccaggaga

SEQ ID NO: 5118828 - DNA, 18 bp, Homo sapiens
aatgtgaaagatgcatgt

SEQ ID NO: 5118829 - DNA, 13 bp, Homo sapiens
aatgtgaaagatt

SEQ ID NO: 5118830 - DNA, 18 bp, Homo sapiens
aatgtgaaagattattta

SEQ ID NO: 5118831 - DNA, 14 bp, Homo sapiens
aatgtgaaatttaa

SEQ ID NO: 5118832 - DNA, 13 bp, Homo sapiens
aatgtgaaatttt

SEQ ID NO: 5118833 - DNA, 14 bp, Homo sapiens
aatgtgaaattttt

SEQ ID NO: 5118834 - DNA, 23 bp, Homo sapiens
aatgtgaactaagttttttactt

SEQ ID NO: 5118835 - DNA, 20 bp, Homo sapiens
aatgtgaactagctggaatt

SEQ ID NO: 5118836 - DNA, 15 bp, Homo sapiens
aatgtgaactctccc

SEQ ID NO: 5118837 - DNA, 16 bp, Homo sapiens
aatgtgaactctcccc

SEQ ID NO: 5118838 - DNA, 19 bp, Homo sapiens
aatgtgaactctcccctcc

SEQ ID NO: 5118839 - DNA, 20 bp, Homo sapiens
aatgtgaactctcccctccc

SEQ ID NO: 5118840 - DNA, 20 bp, Homo sapiens
aatgtgaactttattaaata

SEQ ID NO: 5118841 - DNA, 12 bp, Homo sapiens
aatgtgaagatg

SEQ ID NO: 5118842 - DNA, 13 bp, Homo sapiens
aatgtgaagccag

SEQ ID NO: 5118843 - DNA, 15 bp, Homo sapiens
aatgtgaagggtggg

SEQ ID NO: 5118844 - DNA, 16 bp, Homo sapiens
aatgtgaagggtgggg

SEQ ID NO: 5118845 - DNA, 14 bp, Homo sapiens
aatgtgaagtgtta

SEQ ID NO: 5118846 - DNA, 17 bp, Homo sapiens
aatgtgaagtgttaata

SEQ ID NO: 5118847 - DNA, 17 bp, Homo sapiens
aatgtgaagttttcttt

SEQ ID NO: 5118848 - DNA, 14 bp, Homo sapiens
aatgtgaatctctt

SEQ ID NO: 5118849 - DNA, 12 bp, Homo sapiens
aatgtgaatttc

SEQ ID NO: 5118850 - DNA, 19 bp, Homo sapiens
aatgtgaatttcaactttt

SEQ ID NO: 5118851 - DNA, 14 bp, Homo sapiens
aatgtgaattttaa

SEQ ID NO: 5118852 - DNA, 15 bp, Homo sapiens
aatgtgaatttttat

SEQ ID NO: 5118853 - DNA, 18 bp, Homo sapiens
aatgtgaatttttattgt

SEQ ID NO: 5118854 - DNA, 18 bp, Homo sapiens
aaacatatacagaaaaat

SEQ ID NO: 5118855 - DNA, 13 bp, Homo sapiens
aaacatatataac

SEQ ID NO: 5118856 - DNA, 14 bp, Homo sapiens
aaacatatcaattc

SEQ ID NO: 5118857 - DNA, 18 bp, Homo sapiens
aaacatatcaattcaaca

SEQ ID NO: 5118858 - DNA, 21 bp, Homo sapiens
aaacatatcaattcaacacat

SEQ ID NO: 5118859 - DNA, 13 bp, Homo sapiens
aaacatatgattt

SEQ ID NO: 5118860 - DNA, 15 bp, Homo sapiens
aaacatatgtatctt

SEQ ID NO: 5118861 - DNA, 14 bp, Homo sapiens
aaacatatttcatt

SEQ ID NO: 5118862 - DNA, 15 bp, Homo sapiens
aaacatattttacat

SEQ ID NO: 5118863 - DNA, 17 bp, Homo sapiens
aaacatatttttatact

SEQ ID NO: 5118864 - DNA, 14 bp, Homo sapiens
aaacatcaaataaa

SEQ ID NO: 5118865 - DNA, 17 bp, Homo sapiens
aaacatcaattgatatt

SEQ ID NO: 5118866 - DNA, 16 bp, Homo sapiens
aaacatcactatcaat

SEQ ID NO: 5118867 - DNA, 21 bp, Homo sapiens
aaacatcactatcaattttaa

SEQ ID NO: 5118868 - DNA, 18 bp, Homo sapiens
aaacatcagacctgtctt

SEQ ID NO: 5118869 - DNA, 19 bp, Homo sapiens
aaacatcagttactctgaa

SEQ ID NO: 5118870 - DNA, 18 bp, Homo sapiens
aaacatcattccttttta

SEQ ID NO: 5118871 - DNA, 20 bp, Homo sapiens
aaacatcattcctttttatt

SEQ ID NO: 5118872 - DNA, 21 bp, Homo sapiens
aaacatcattggataaatttg

SEQ ID NO: 5118873 - DNA, 18 bp, Homo sapiens
aaacatccacttaagttc

SEQ ID NO: 5118874 - DNA, 14 bp, Homo sapiens
aaacatcccaaact

SEQ ID NO: 5118875 - DNA, 15 bp, Homo sapiens
aaacatcccaaactt

SEQ ID NO: 5118876 - DNA, 17 bp, Homo sapiens
aaacatcccaaacttta

SEQ ID NO: 5118877 - DNA, 21 bp, Homo sapiens
aaacatcccaaactttaaaat

SEQ ID NO: 5118878 - DNA, 19 bp, Homo sapiens
aaacatcccaattctttag

SEQ ID NO: 5118879 - DNA, 20 bp, Homo sapiens
aaacatcctagggtgtttta

SEQ ID NO: 5118880 - DNA, 16 bp, Homo sapiens
aaacatctagcccaaa

SEQ ID NO: 5118881 - DNA, 13 bp, Homo sapiens
aaacatctgattt

SEQ ID NO: 5118882 - DNA, 21 bp, Homo sapiens
aaacatctggaaaataaaagg

SEQ ID NO: 5118883 - DNA, 17 bp, Homo sapiens
aaacatctttgaaatta

SEQ ID NO: 5118884 - DNA, 16 bp, Homo sapiens
aaacatgaaaacattg

SEQ ID NO: 5118885 - DNA, 17 bp, Homo sapiens
aaacatgaaaacattga

SEQ ID NO: 5118886 - DNA, 16 bp, Homo sapiens
aaacatgaaacaactc

SEQ ID NO: 5118887 - DNA, 12 bp, Homo sapiens
aaacatgaagtg

SEQ ID NO: 5118888 - DNA, 19 bp, Homo sapiens
aaacatgaatcctgtgata

SEQ ID NO: 5118889 - DNA, 17 bp, Homo sapiens
aaacatgaatttaatgt

SEQ ID NO: 5118890 - DNA, 17 bp, Homo sapiens
aaacatgacactgacct

SEQ ID NO: 5118891 - DNA, 19 bp, Homo sapiens
aaacatgactctttattgt

SEQ ID NO: 5118892 - DNA, 20 bp, Homo sapiens
aaacatgactctttattgtc

SEQ ID NO: 5118893 - DNA, 19 bp, Homo sapiens
aaacatgagaaatgtgaac

SEQ ID NO: 5118894 - DNA, 17 bp, Homo sapiens
aaacatgatactgctgc

SEQ ID NO: 5118895 - DNA, 12 bp, Homo sapiens
aaacatgcacac

SEQ ID NO: 5118896 - DNA, 20 bp, Homo sapiens
aaacatgcagaacaaatgaa

SEQ ID NO: 5118897 - DNA, 18 bp, Homo sapiens
aaacatgctgtacatact

SEQ ID NO: 5118898 - DNA, 21 bp, Homo sapiens
aaacatgctgtacatactttt

SEQ ID NO: 5118899 - DNA, 12 bp, Homo sapiens
aaacatgcttaa

SEQ ID NO: 5118900 - DNA, 19 bp, Homo sapiens
aaacatgcttataacatta

SEQ ID NO: 5118901 - DNA, 16 bp, Homo sapiens
aaacatgcttttccaa

SEQ ID NO: 5118902 - DNA, 17 bp, Homo sapiens
aaacatgcttttccaaa

SEQ ID NO: 5118903 - DNA, 18 bp, Homo sapiens
aaacatggaaaacagagt

SEQ ID NO: 5118904 - DNA, 13 bp, Homo sapiens
aaacatggagaaa

SEQ ID NO: 5118905 - DNA, 16 bp, Homo sapiens
aaacatggagaaatct

SEQ ID NO: 5118906 - DNA, 20 bp, Homo sapiens
aaacatgggtggtaacaaga

SEQ ID NO: 5118907 - DNA, 15 bp, Homo sapiens
aaacatggtgcctat

SEQ ID NO: 5118908 - DNA, 16 bp, Homo sapiens
aaacatggtgcctata

SEQ ID NO: 5118909 - DNA, 19 bp, Homo sapiens
aaacatgtaaatacaaatt

SEQ ID NO: 5118910 - DNA, 18 bp, Homo sapiens
aaacatgtacaaaatcga

SEQ ID NO: 5118911 - DNA, 15 bp, Homo sapiens
aaacatgtactacag

SEQ ID NO: 5118912 - DNA, 17 bp, Homo sapiens
aaacatgtctgtgaact

SEQ ID NO: 5118913 - DNA, 16 bp, Homo sapiens
aaacatgttaatgaca

SEQ ID NO: 5118914 - DNA, 17 bp, Homo sapiens
aaacatgttagaagcaa

SEQ ID NO: 5118915 - DNA, 21 bp, Homo sapiens
aaacatgtttatttttcttgt

SEQ ID NO: 5118916 - DNA, 23 bp, Homo sapiens
aaacatgtttctttgtaatgaaa

SEQ ID NO: 5118917 - DNA, 15 bp, Homo sapiens
aaacattaaaagaag

SEQ ID NO: 5118918 - DNA, 21 bp, Homo sapiens
aaacattaaaagaagactgga

SEQ ID NO: 5118919 - DNA, 15 bp, Homo sapiens
aaacattaaacactg

SEQ ID NO: 5118920 - DNA, 18 bp, Homo sapiens
aaacattaagaaaatcat

SEQ ID NO: 5118921 - DNA, 17 bp, Homo sapiens
aaacattaatatttacc

SEQ ID NO: 5118922 - DNA, 15 bp, Homo sapiens
aaacattaatgttga

SEQ ID NO: 5118923 - DNA, 20 bp, Homo sapiens
aaacattagaagaaaacata

SEQ ID NO: 5118924 - DNA, 24 bp, Homo sapiens
aaacattagaagaaaacatatatt

SEQ ID NO: 5118925 - DNA, 21 bp, Homo sapiens
aaacattagtactttatagaa

SEQ ID NO: 5118926 - DNA, 20 bp, Homo sapiens
aaacattatagattttcatg

SEQ ID NO: 5118927 - DNA, 18 bp, Homo sapiens
aaacattatatgtataca

SEQ ID NO: 5118928 - DNA, 23 bp, Homo sapiens
aaacattcacacagggctctttg

SEQ ID NO: 5118929 - DNA, 24 bp, Homo sapiens
aaacattcatccagttgcaataaa

SEQ ID NO: 5118930 - DNA, 14 bp, Homo sapiens
aaacattcatgtaa

SEQ ID NO: 5118931 - DNA, 16 bp, Homo sapiens
aaacattcatgtaact

SEQ ID NO: 5118932 - DNA, 11 bp, Homo sapiens
aaacattccaa

SEQ ID NO: 5118933 - DNA, 18 bp, Homo sapiens
aaacattccagagaaaat

SEQ ID NO: 5118934 - DNA, 17 bp, Homo sapiens
aaacattcgtgagctgg

SEQ ID NO: 5118935 - DNA, 19 bp, Homo sapiens
aaacattctatctactgat

SEQ ID NO: 5118936 - DNA, 17 bp, Homo sapiens
aaacattctcctttgca

SEQ ID NO: 5118937 - DNA, 23 bp, Homo sapiens
aaacattcttttaacttctttct

SEQ ID NO: 5118938 - DNA, 16 bp, Homo sapiens
aaacattgaaatatta

SEQ ID NO: 5118939 - DNA, 12 bp, Homo sapiens
aaacattgaaga

SEQ ID NO: 5118940 - DNA, 23 bp, Homo sapiens
aaacattgagactgctagaacca

SEQ ID NO: 5118941 - DNA, 19 bp, Homo sapiens
aaacattgcatgtatttaa

SEQ ID NO: 5118942 - DNA, 23 bp, Homo sapiens
aaacattgccatgtaactatgta

SEQ ID NO: 5118943 - DNA, 19 bp, Homo sapiens
aaacattgcctttgaatgt

SEQ ID NO: 5118944 - DNA, 15 bp, Homo sapiens
aaacattggattatc

SEQ ID NO: 5118945 - DNA, 18 bp, Homo sapiens
aaacattggttcttgtat

SEQ ID NO: 5118946 - DNA, 12 bp, Homo sapiens
aaacatttaaca

SEQ ID NO: 5118947 - DNA, 14 bp, Homo sapiens
aaacatttaacata

SEQ ID NO: 5118948 - DNA, 22 bp, Homo sapiens
aaacatttacaataaatattct

SEQ ID NO: 5118949 - DNA, 13 bp, Homo sapiens
aaacatttatctt

SEQ ID NO: 5118950 - DNA, 22 bp, Homo sapiens
aaacatttatgacaagctgtat

SEQ ID NO: 5118951 - DNA, 21 bp, Homo sapiens
aaacatttcataatttgtttc

SEQ ID NO: 5118952 - DNA, 23 bp, Homo sapiens
aaacatttcataatttgtttcca

SEQ ID NO: 5118953 - DNA, 22 bp, Homo sapiens
aaacatttcctttttctatttt

SEQ ID NO: 5118954 - DNA, 18 bp, Homo sapiens
aaacatttctaagactac

SEQ ID NO: 5118955 - DNA, 16 bp, Homo sapiens
aaacatttgattaata

SEQ ID NO: 5118956 - DNA, 21 bp, Homo sapiens
aaacatttgattaataaaata

SEQ ID NO: 5118957 - DNA, 22 bp, Homo sapiens
aaacatttgattaataaaatat

SEQ ID NO: 5118958 - DNA, 23 bp, Homo sapiens
aaacatttgattaataaaatatc

SEQ ID NO: 5118959 - DNA, 13 bp, Homo sapiens
aaacatttgccaa

SEQ ID NO: 5118960 - DNA, 18 bp, Homo sapiens
aaacatttgctctggggg

SEQ ID NO: 5118961 - DNA, 18 bp, Homo sapiens
aaacatttgctggagaaa

SEQ ID NO: 5118962 - DNA, 23 bp, Homo sapiens
aaacatttggaaaagacagaaaa

SEQ ID NO: 5118963 - DNA, 23 bp, Homo sapiens
aaacatttgtaaaaatactgttt

SEQ ID NO: 5118964 - DNA, 14 bp, Homo sapiens
aaacatttgtacat

SEQ ID NO: 5118965 - DNA, 21 bp, Homo sapiens
aaacatttgtacattcctgat

SEQ ID NO: 5118966 - DNA, 21 bp, Homo sapiens
aaacatttgtcagagaagaaa

SEQ ID NO: 5118967 - DNA, 15 bp, Homo sapiens
aaacatttgttcctg

SEQ ID NO: 5118968 - DNA, 17 bp, Homo sapiens
aaacatttgttcctgga

SEQ ID NO: 5118969 - DNA, 19 bp, Homo sapiens
aaacattttaaaatcaact

SEQ ID NO: 5118970 - DNA, 20 bp, Homo sapiens
aaacattttaaatggacaga

SEQ ID NO: 5118971 - DNA, 19 bp, Homo sapiens
aaacattttatactgtaca

SEQ ID NO: 5118972 - DNA, 16 bp, Homo sapiens
aaacattttatcatta

SEQ ID NO: 5118973 - DNA, 21 bp, Homo sapiens
aaacattttatttttaaaata

SEQ ID NO: 5118974 - DNA, 23 bp, Homo sapiens
aaacattttatttttaaaatatt

SEQ ID NO: 5118975 - DNA, 10 bp, Homo sapiens
aaacattttc

SEQ ID NO: 5118976 - DNA, 22 bp, Homo sapiens
aaacattttcacacaatacaat

SEQ ID NO: 5118977 - DNA, 19 bp, Homo sapiens
aaacattttcagaaatatt

SEQ ID NO: 5118978 - DNA, 12 bp, Homo sapiens
aaacattttcat

SEQ ID NO: 5118979 - DNA, 19 bp, Homo sapiens
aaacattttctcttagaaa

SEQ ID NO: 5118980 - DNA, 12 bp, Homo sapiens
aaacattttctg

SEQ ID NO: 5118981 - DNA, 17 bp, Homo sapiens
aaacattttgaaggaaa

SEQ ID NO: 5118982 - DNA, 19 bp, Homo sapiens
aaacattttgtcatataag

SEQ ID NO: 5118983 - DNA, 16 bp, Homo sapiens
aaacatttttgttctt

SEQ ID NO: 5118984 - DNA, 19 bp, Homo sapiens
aaacattttttaagaaaac

SEQ ID NO: 5118985 - DNA, 20 bp, Homo sapiens
aaacattttttagtctgtaa

SEQ ID NO: 5118986 - DNA, 16 bp, Homo sapiens
aaacattttttataca

SEQ ID NO: 5118987 - DNA, 19 bp, Homo sapiens
aaacattttttatacattt

SEQ ID NO: 5118988 - DNA, 15 bp, Homo sapiens
aaacattttttcttc

SEQ ID NO: 5118989 - DNA, 22 bp, Homo sapiens
aaacattttttcttctgaagat

SEQ ID NO: 5118990 - DNA, 18 bp, Homo sapiens
aaacattttttgtttctt

SEQ ID NO: 5118991 - DNA, 16 bp, Homo sapiens
aaacatttttttaagc

SEQ ID NO: 5118992 - DNA, 20 bp, Homo sapiens
aaaccaaaaaaaaaaaaaat

SEQ ID NO: 5118993 - DNA, 13 bp, Homo sapiens
aaaccaaaaacat

SEQ ID NO: 5118994 - DNA, 13 bp, Homo sapiens
aaaccaaaacaga

SEQ ID NO: 5118995 - DNA, 18 bp, Homo sapiens
aaaccaaaacagaacaat

SEQ ID NO: 5118996 - DNA, 12 bp, Homo sapiens
aaaccaaaacat

SEQ ID NO: 5118997 - DNA, 20 bp, Homo sapiens
aaaccaaaagttattaaaat

SEQ ID NO: 5118998 - DNA, 22 bp, Homo sapiens
aaaccaaaagttattaaaattg

SEQ ID NO: 5118999 - DNA, 18 bp, Homo sapiens
aaaccaaaatactccaaa

SEQ ID NO: 5119000 - DNA, 19 bp, Homo sapiens
aaaccaaaatgacatcttt

SEQ ID NO: 5119001 - DNA, 20 bp, Homo sapiens
aaaccaaaatgacatctttt

SEQ ID NO: 5119002 - DNA, 22 bp, Homo sapiens
aaaccaaaatgacatcttttta

SEQ ID NO: 5119003 - DNA, 16 bp, Homo sapiens
aaaccaaacacccaga

SEQ ID NO: 5119004 - DNA, 19 bp, Homo sapiens
aaaccaaactaggagatga

SEQ ID NO: 5119005 - DNA, 23 bp, Homo sapiens
aaaccaaactgggtcttcagctt

SEQ ID NO: 5119006 - DNA, 22 bp, Homo sapiens
aaaccaaactggttcacctgaa

SEQ ID NO: 5119007 - DNA, 21 bp, Homo sapiens
aaaccaaacttgttcatttag

SEQ ID NO: 5119008 - DNA, 15 bp, Homo sapiens
aaaccaaagaagaaa

SEQ ID NO: 5119009 - DNA, 14 bp, Homo sapiens
aaaccaaagctgcc

SEQ ID NO: 5119010 - DNA, 15 bp, Homo sapiens
aaaccaaagctgcct

SEQ ID NO: 5119011 - DNA, 11 bp, Homo sapiens
aaaccaaagtc

SEQ ID NO: 5119012 - DNA, 18 bp, Homo sapiens
aaaccaaattacaagtat

SEQ ID NO: 5119013 - DNA, 23 bp, Homo sapiens
aaaccaaattcagggacaaatgg

SEQ ID NO: 5119014 - DNA, 19 bp, Homo sapiens
aaaccaacaagaaccactc

SEQ ID NO: 5119015 - DNA, 13 bp, Homo sapiens
aaaccaacaccat

SEQ ID NO: 5119016 - DNA, 14 bp, Homo sapiens
aaaccaacatcttt

SEQ ID NO: 5119017 - DNA, 17 bp, Homo sapiens
aaaccaacccatgtata

SEQ ID NO: 5119018 - DNA, 20 bp, Homo sapiens
aaaccaacctttaaaattgt

SEQ ID NO: 5119019 - DNA, 21 bp, Homo sapiens
aaaccaacctttaaaattgtc

SEQ ID NO: 5119020 - DNA, 17 bp, Homo sapiens
aaaccaactctaatatt

SEQ ID NO: 5119021 - DNA, 21 bp, Homo sapiens
aaaccaactctaatattgctt

SEQ ID NO: 5119022 - DNA, 15 bp, Homo sapiens
aaaccaagaaggaga

SEQ ID NO: 5119023 - DNA, 18 bp, Homo sapiens
aaaccaagagattgctaa

SEQ ID NO: 5119024 - DNA, 14 bp, Homo sapiens
aaaccaagatagat

SEQ ID NO: 5119025 - DNA, 21 bp, Homo sapiens
aaaccaagattttgaaggaaa

SEQ ID NO: 5119026 - DNA, 15 bp, Homo sapiens
aaaccaagcaaagga

SEQ ID NO: 5119027 - DNA, 18 bp, Homo sapiens
aaaccaagccattaatga

SEQ ID NO: 5119028 - DNA, 19 bp, Homo sapiens
aaaccaagggtacagatcc

SEQ ID NO: 5119029 - DNA, 17 bp, Homo sapiens
aaaccaagtcaggccag

SEQ ID NO: 5119030 - DNA, 22 bp, Homo sapiens
aaaccaagtctacttcactaat

SEQ ID NO: 5119031 - DNA, 20 bp, Homo sapiens
aatgtgaatttttattgttg

SEQ ID NO: 5119032 - DNA, 21 bp, Homo sapiens
aatgtgaatttttgcctatct

SEQ ID NO: 5119033 - DNA, 12 bp, Homo sapiens
aatgtgacattt

SEQ ID NO: 5119034 - DNA, 14 bp, Homo sapiens
aatgtgacatttac

SEQ ID NO: 5119035 - DNA, 19 bp, Homo sapiens
aatgtgaccctccaaatgg

SEQ ID NO: 5119036 - DNA, 19 bp, Homo sapiens
aatgtgacctttaattcag

SEQ ID NO: 5119037 - DNA, 19 bp, Homo sapiens
aatgtgacttggattcaat

SEQ ID NO: 5119038 - DNA, 17 bp, Homo sapiens
aatgtgagaaatgtcta

SEQ ID NO: 5119039 - DNA, 21 bp, Homo sapiens
aatgtgagaagccagccagag

SEQ ID NO: 5119040 - DNA, 12 bp, Homo sapiens
aatgtgagcaca

SEQ ID NO: 5119041 - DNA, 15 bp, Homo sapiens
aatgtgaggcaataa

SEQ ID NO: 5119042 - DNA, 16 bp, Homo sapiens
aatgtgaggcaataag

SEQ ID NO: 5119043 - DNA, 14 bp, Homo sapiens
aatgtgagtatttc

SEQ ID NO: 5119044 - DNA, 15 bp, Homo sapiens
aatgtgagtcattat

SEQ ID NO: 5119045 - DNA, 23 bp, Homo sapiens
aatgtgagtgacctcacttctgg

SEQ ID NO: 5119046 - DNA, 21 bp, Homo sapiens
aatgtgagtttggtctggact

SEQ ID NO: 5119047 - DNA, 14 bp, Homo sapiens
aatgtgatcaactg

SEQ ID NO: 5119048 - DNA, 18 bp, Homo sapiens
aatgtgatcaactgttca

SEQ ID NO: 5119049 - DNA, 13 bp, Homo sapiens
aatgtgatcatat

SEQ ID NO: 5119050 - DNA, 15 bp, Homo sapiens
aatgtgatcatatga

SEQ ID NO: 5119051 - DNA, 21 bp, Homo sapiens
aatgtgatcatatgaggacct

SEQ ID NO: 5119052 - DNA, 13 bp, Homo sapiens
aatgtgatcatct

SEQ ID NO: 5119053 - DNA, 19 bp, Homo sapiens
aatgtgatctatgtttcat

SEQ ID NO: 5119054 - DNA, 20 bp, Homo sapiens
aatgtgatgaatactgtatt

SEQ ID NO: 5119055 - DNA, 23 bp, Homo sapiens
aatgtgatggtcaggatctcatg

SEQ ID NO: 5119056 - DNA, 19 bp, Homo sapiens
aatgtgatgttctaaggct

SEQ ID NO: 5119057 - DNA, 21 bp, Homo sapiens
aatgtgattcctttgaagagg

SEQ ID NO: 5119058 - DNA, 12 bp, Homo sapiens
aatgtgattttg

SEQ ID NO: 5119059 - DNA, 23 bp, Homo sapiens
aatgtgattttgtaggttatttt

SEQ ID NO: 5119060 - DNA, 12 bp, Homo sapiens
aatgtgcaaatt

SEQ ID NO: 5119061 - DNA, 14 bp, Homo sapiens
aatgtgcaaatttt

SEQ ID NO: 5119062 - DNA, 15 bp, Homo sapiens
aatgtgcaaattttg

SEQ ID NO: 5119063 - DNA, 19 bp, Homo sapiens
aatgtgcaagttgtactgt

SEQ ID NO: 5119064 - DNA, 22 bp, Homo sapiens
aatgtgcagaaaatatttaata

SEQ ID NO: 5119065 - DNA, 19 bp, Homo sapiens
aatgtgcaggtttgttaca

SEQ ID NO: 5119066 - DNA, 20 bp, Homo sapiens
aatgtgcaggtttgttacat

SEQ ID NO: 5119067 - DNA, 11 bp, Homo sapiens
aatgtgcagta

SEQ ID NO: 5119068 - DNA, 21 bp, Homo sapiens
aatgtgcataatgataaaata

SEQ ID NO: 5119069 - DNA, 11 bp, Homo sapiens
aatgtgccaaa

SEQ ID NO: 5119070 - DNA, 19 bp, Homo sapiens
aatgtgccacagaggcccc

SEQ ID NO: 5119071 - DNA, 21 bp, Homo sapiens
aatgtgccatactaatgatga

SEQ ID NO: 5119072 - DNA, 14 bp, Homo sapiens
aatgtgccatgtat

SEQ ID NO: 5119073 - DNA, 15 bp, Homo sapiens
aatgtgcccctggcc

SEQ ID NO: 5119074 - DNA, 21 bp, Homo sapiens
aatgtgcctattgctagagct

SEQ ID NO: 5119075 - DNA, 23 bp, Homo sapiens
aatgtgcctccaagcggccctgt

SEQ ID NO: 5119076 - DNA, 21 bp, Homo sapiens
aatgtgcgaggatcctggtat

SEQ ID NO: 5119077 - DNA, 15 bp, Homo sapiens
aatgtgctagagtta

SEQ ID NO: 5119078 - DNA, 22 bp, Homo sapiens
aatgtgctagagttaaaagtta

SEQ ID NO: 5119079 - DNA, 18 bp, Homo sapiens
aatgtgctatactgcata

SEQ ID NO: 5119080 - DNA, 15 bp, Homo sapiens
aatgtgctgcaaaga

SEQ ID NO: 5119081 - DNA, 22 bp, Homo sapiens
aatgtgctgcaaagagttatat

SEQ ID NO: 5119082 - DNA, 22 bp, Homo sapiens
aatgtgctggtgaacactgtga

SEQ ID NO: 5119083 - DNA, 20 bp, Homo sapiens
aatgtgctgtgtaaagttag

SEQ ID NO: 5119084 - DNA, 21 bp, Homo sapiens
aatgtgcttttccatctaaaa

SEQ ID NO: 5119085 - DNA, 15 bp, Homo sapiens
aatgtggaagaaaat

SEQ ID NO: 5119086 - DNA, 18 bp, Homo sapiens
aatgtggaaggaaaatat

SEQ ID NO: 5119087 - DNA, 21 bp, Homo sapiens
aatgtggaataggataatata

SEQ ID NO: 5119088 - DNA, 17 bp, Homo sapiens
aatgtggacgtgcactg

SEQ ID NO: 5119089 - DNA, 19 bp, Homo sapiens
aatgtggagaactaaaggt

SEQ ID NO: 5119090 - DNA, 17 bp, Homo sapiens
aatgtggagaagagtgc

SEQ ID NO: 5119091 - DNA, 20 bp, Homo sapiens
aatgtggatttcctatttta

SEQ ID NO: 5119092 - DNA, 17 bp, Homo sapiens
aatgtggatttgattca

SEQ ID NO: 5119093 - DNA, 19 bp, Homo sapiens
aatgtggatttgattcatt

SEQ ID NO: 5119094 - DNA, 19 bp, Homo sapiens
aatgtggctgtatccactt

SEQ ID NO: 5119095 - DNA, 16 bp, Homo sapiens
aatgtggcttgagaaa

SEQ ID NO: 5119096 - DNA, 18 bp, Homo sapiens
aatgtgggagcagcggtt

SEQ ID NO: 5119097 - DNA, 23 bp, Homo sapiens
aatgtgggcgtttgtaaattctg

SEQ ID NO: 5119098 - DNA, 12 bp, Homo sapiens
aatgtgggctat

SEQ ID NO: 5119099 - DNA, 19 bp, Homo sapiens
aatgtgggttatcctcctc

SEQ ID NO: 5119100 - DNA, 21 bp, Homo sapiens
aatgtgggttatcctcctctc

SEQ ID NO: 5119101 - DNA, 16 bp, Homo sapiens
aatgtggtaagtggag

SEQ ID NO: 5119102 - DNA, 16 bp, Homo sapiens
aatgtggtctgccaat

SEQ ID NO: 5119103 - DNA, 22 bp, Homo sapiens
aatgtggtctgccaatctgtac

SEQ ID NO: 5119104 - DNA, 19 bp, Homo sapiens
aatgtggttatttctctga

SEQ ID NO: 5119105 - DNA, 18 bp, Homo sapiens
aatgtggtttcaatctaa

SEQ ID NO: 5119106 - DNA, 22 bp, Homo sapiens
aatgtggtttttgatgcctttt

SEQ ID NO: 5119107 - DNA, 23 bp, Homo sapiens
aatgtgtaaagatctacatgaat

SEQ ID NO: 5119108 - DNA, 21 bp, Homo sapiens
aatgtgtaagaacaactacct

SEQ ID NO: 5119109 - DNA, 21 bp, Homo sapiens
aatgtgtaagcattgtataca

SEQ ID NO: 5119110 - DNA, 19 bp, Homo sapiens
aatgtgtacaatgtacaca

SEQ ID NO: 5119111 - DNA, 14 bp, Homo sapiens
aatgtgtacagtga

SEQ ID NO: 5119112 - DNA, 21 bp, Homo sapiens
aatgtgtacagtgaattgtct

SEQ ID NO: 5119113 - DNA, 22 bp, Homo sapiens
aatgtgtacatgtagttgaatt

SEQ ID NO: 5119114 - DNA, 22 bp, Homo sapiens
aatgtgtagttcatgtaaataa

SEQ ID NO: 5119115 - DNA, 15 bp, Homo sapiens
aatgtgtataaacaa

SEQ ID NO: 5119116 - DNA, 18 bp, Homo sapiens
aatgtgtataaattgtct

SEQ ID NO: 5119117 - DNA, 16 bp, Homo sapiens
aatgtgtattctggct

SEQ ID NO: 5119118 - DNA, 14 bp, Homo sapiens
aatgtgtcattgga

SEQ ID NO: 5119119 - DNA, 15 bp, Homo sapiens
aatgtgtccaagaca

SEQ ID NO: 5119120 - DNA, 15 bp, Homo sapiens
aatgtgtcctcctgc

SEQ ID NO: 5119121 - DNA, 18 bp, Homo sapiens
aatgtgtcctcctgctct

SEQ ID NO: 5119122 - DNA, 20 bp, Homo sapiens
aatgtgtcctcctgctctgc

SEQ ID NO: 5119123 - DNA, 22 bp, Homo sapiens
aatgtgtctcaggctcaagttt

SEQ ID NO: 5119124 - DNA, 18 bp, Homo sapiens
aatgtgtctgcaacatgg

SEQ ID NO: 5119125 - DNA, 20 bp, Homo sapiens
aatgtgtctgcaacatggat

SEQ ID NO: 5119126 - DNA, 14 bp, Homo sapiens
aatgtgtctgtgtt

SEQ ID NO: 5119127 - DNA, 17 bp, Homo sapiens
aatgtgtcttgtattat

SEQ ID NO: 5119128 - DNA, 17 bp, Homo sapiens
aatgtgtctttagatag

SEQ ID NO: 5119129 - DNA, 15 bp, Homo sapiens
aatgtgtgagaaaaa

SEQ ID NO: 5119130 - DNA, 21 bp, Homo sapiens
aatgtgtgagtgcatgtacta

SEQ ID NO: 5119131 - DNA, 16 bp, Homo sapiens
aatgtgtgcccagctt

SEQ ID NO: 5119132 - DNA, 13 bp, Homo sapiens
aatgtgtgcttta

SEQ ID NO: 5119133 - DNA, 21 bp, Homo sapiens
aatgtgtggtgctaactgtat

SEQ ID NO: 5119134 - DNA, 16 bp, Homo sapiens
aatgtgtggtggcctc

SEQ ID NO: 5119135 - DNA, 21 bp, Homo sapiens
aatgtgtggtggcctcagctg

SEQ ID NO: 5119136 - DNA, 20 bp, Homo sapiens
aatgtgtgtaaaaaagtgtt

SEQ ID NO: 5119137 - DNA, 13 bp, Homo sapiens
aatgtgtgtatat

SEQ ID NO: 5119138 - DNA, 15 bp, Homo sapiens
aatgtgtgtatatgg

SEQ ID NO: 5119139 - DNA, 16 bp, Homo sapiens
aatgtgtgtatatgga

SEQ ID NO: 5119140 - DNA, 13 bp, Homo sapiens
aatgtgtgtatgt

SEQ ID NO: 5119141 - DNA, 18 bp, Homo sapiens
aatgtgtgtatgtgtatt

SEQ ID NO: 5119142 - DNA, 16 bp, Homo sapiens
aatgtgtgtatgtgtg

SEQ ID NO: 5119143 - DNA, 23 bp, Homo sapiens
aatgtgtgtattcttaaaatgca

SEQ ID NO: 5119144 - DNA, 21 bp, Homo sapiens
aatgtgtgtgatgtgacattt

SEQ ID NO: 5119145 - DNA, 23 bp, Homo sapiens
aatgtgtgtgatgtgacatttgt

SEQ ID NO: 5119146 - DNA, 17 bp, Homo sapiens
aatgtgtgtggtttttt

SEQ ID NO: 5119147 - DNA, 11 bp, Homo sapiens
aatgtgtgtgt

SEQ ID NO: 5119148 - DNA, 16 bp, Homo sapiens
aatgtgtgttgactgc

SEQ ID NO: 5119149 - DNA, 21 bp, Homo sapiens
aatgtgtgttgtaacaaatat

SEQ ID NO: 5119150 - DNA, 18 bp, Homo sapiens
aatgtgtgttgtgtgagc

SEQ ID NO: 5119151 - DNA, 23 bp, Homo sapiens
aatgtgttagcactgatagtcct

SEQ ID NO: 5119152 - DNA, 22 bp, Homo sapiens
aatgtgttctcggagtgtgtat

SEQ ID NO: 5119153 - DNA, 23 bp, Homo sapiens
aatgtgttcttttctcctttacc

SEQ ID NO: 5119154 - DNA, 15 bp, Homo sapiens
aatgtgttgaaactg

SEQ ID NO: 5119155 - DNA, 18 bp, Homo sapiens
aatgtgttggaaactgta

SEQ ID NO: 5119156 - DNA, 14 bp, Homo sapiens
aatgtgttggacaa

SEQ ID NO: 5119157 - DNA, 17 bp, Homo sapiens
aatgtgtttaattttgg

SEQ ID NO: 5119158 - DNA, 22 bp, Homo sapiens
aatgtgtttcttgctgccatga

SEQ ID NO: 5119159 - DNA, 13 bp, Homo sapiens
aatgtgtttgctg

SEQ ID NO: 5119160 - DNA, 22 bp, Homo sapiens
aatgtgttttagagtaagaaat

SEQ ID NO: 5119161 - DNA, 22 bp, Homo sapiens
aatgtgtttttcagttataatt

SEQ ID NO: 5119162 - DNA, 15 bp, Homo sapiens
aatgttaaaatgtat

SEQ ID NO: 5119163 - DNA, 16 bp, Homo sapiens
aatgttaaaatgtatt

SEQ ID NO: 5119164 - DNA, 13 bp, Homo sapiens
aatgttaaagatg

SEQ ID NO: 5119165 - DNA, 16 bp, Homo sapiens
aatgttaaagatgtag

SEQ ID NO: 5119166 - DNA, 22 bp, Homo sapiens
aatgttaaataaattgtatatt

SEQ ID NO: 5119167 - DNA, 23 bp, Homo sapiens
aatgttaaataaattgtatattc

SEQ ID NO: 5119168 - DNA, 15 bp, Homo sapiens
aatgttaaatctaca

SEQ ID NO: 5119169 - DNA, 13 bp, Homo sapiens
aatgttaaatttg

SEQ ID NO: 5119170 - DNA, 18 bp, Homo sapiens
aatgttaaatttgtaagt

SEQ ID NO: 5119171 - DNA, 14 bp, Homo sapiens
aatgttaacaactt

SEQ ID NO: 5119172 - DNA, 17 bp, Homo sapiens
aatgttaactacatatt

SEQ ID NO: 5119173 - DNA, 15 bp, Homo sapiens
aatgttaactttcaa

SEQ ID NO: 5119174 - DNA, 14 bp, Homo sapiens
aatgttaagaaaga

SEQ ID NO: 5119175 - DNA, 22 bp, Homo sapiens
aatgttaagcatctaaggacaa

SEQ ID NO: 5119176 - DNA, 13 bp, Homo sapiens
aatgttaataaag

SEQ ID NO: 5119177 - DNA, 15 bp, Homo sapiens
aatgttaataaaggt

SEQ ID NO: 5119178 - DNA, 18 bp, Homo sapiens
aatgttaatgagaaaatg

SEQ ID NO: 5119179 - DNA, 17 bp, Homo sapiens
aatgttaattatgcagt

SEQ ID NO: 5119180 - DNA, 20 bp, Homo sapiens
aatgttaattttttggtaca

SEQ ID NO: 5119181 - DNA, 22 bp, Homo sapiens
aatgttaattttttggtacaaa

SEQ ID NO: 5119182 - DNA, 17 bp, Homo sapiens
aatgttacatagtgtag

SEQ ID NO: 5119183 - DNA, 15 bp, Homo sapiens
aatgttacattatta

SEQ ID NO: 5119184 - DNA, 15 bp, Homo sapiens
aatgttacattgttt

SEQ ID NO: 5119185 - DNA, 12 bp, Homo sapiens
aatgttaccagt

SEQ ID NO: 5119186 - DNA, 22 bp, Homo sapiens
aatgttacctaattattacagc

SEQ ID NO: 5119187 - DNA, 15 bp, Homo sapiens
aatgttacctctgaa

SEQ ID NO: 5119188 - DNA, 20 bp, Homo sapiens
aatgttactgatcatgcatt

SEQ ID NO: 5119189 - DNA, 22 bp, Homo sapiens
aatgttactgatcatgcattgt

SEQ ID NO: 5119190 - DNA, 15 bp, Homo sapiens
aatgttagagacttt

SEQ ID NO: 5119191 - DNA, 16 bp, Homo sapiens
aatgttagagcacagt

SEQ ID NO: 5119192 - DNA, 22 bp, Homo sapiens
aatgttagaggttttaaagtga

SEQ ID NO: 5119193 - DNA, 12 bp, Homo sapiens
aatgttagagta

SEQ ID NO: 5119194 - DNA, 17 bp, Homo sapiens
aatgttagcctcaattt

SEQ ID NO: 5119195 - DNA, 20 bp, Homo sapiens
aatgttaggggtatttaatg

SEQ ID NO: 5119196 - DNA, 13 bp, Homo sapiens
aatgttagtattt

SEQ ID NO: 5119197 - DNA, 14 bp, Homo sapiens
aatgttagtggcat

SEQ ID NO: 5119198 - DNA, 17 bp, Homo sapiens
aatgttagttagtgtag

SEQ ID NO: 5119199 - DNA, 13 bp, Homo sapiens
aatgttataaagt

SEQ ID NO: 5119200 - DNA, 16 bp, Homo sapiens
aatgttatagtgaatt

SEQ ID NO: 5119201 - DNA, 22 bp, Homo sapiens
aatgttatcttatactgtacaa

SEQ ID NO: 5119202 - DNA, 19 bp, Homo sapiens
aatgttatgactatgtaaa

SEQ ID NO: 5119203 - DNA, 22 bp, Homo sapiens
aatgttatgactatgtaaacta

SEQ ID NO: 5119204 - DNA, 23 bp, Homo sapiens
aatgttatgaggacgtgtctgtt

SEQ ID NO: 5119205 - DNA, 16 bp, Homo sapiens
aatgttatgccagctc

SEQ ID NO: 5119206 - DNA, 21 bp, Homo sapiens
aatgttatgggatgtaaacaa

SEQ ID NO: 5119207 - DNA, 20 bp, Homo sapiens
aatgttatgtgctctgattt

SEQ ID NO: 5119208 - DNA, 13 bp, Homo sapiens
aatgaatattgta

SEQ ID NO: 5119209 - DNA, 14 bp, Homo sapiens
aatgaatattgtaa

SEQ ID NO: 5119210 - DNA, 13 bp, Homo sapiens
aatgaatcattgt

SEQ ID NO: 5119211 - DNA, 14 bp, Homo sapiens
aatgaatcattgtt

SEQ ID NO: 5119212 - DNA, 18 bp, Homo sapiens
aatgaatcgcaagttaac

SEQ ID NO: 5119213 - DNA, 20 bp, Homo sapiens
aatgaatcgtaatgaagttg

SEQ ID NO: 5119214 - DNA, 21 bp, Homo sapiens
aatgaatctcgttcccaaaga

SEQ ID NO: 5119215 - DNA, 20 bp, Homo sapiens
aatgaatcttcgggtgtttc

SEQ ID NO: 5119216 - DNA, 19 bp, Homo sapiens
aatgaatctttgactgaag

SEQ ID NO: 5119217 - DNA, 15 bp, Homo sapiens
aatgaatgaaatata

SEQ ID NO: 5119218 - DNA, 22 bp, Homo sapiens
aatgaatgaaatataaactgtg

SEQ ID NO: 5119219 - DNA, 16 bp, Homo sapiens
aatgaatgaatggctt

SEQ ID NO: 5119220 - DNA, 18 bp, Homo sapiens
aatgaatgatcattgaaa

SEQ ID NO: 5119221 - DNA, 20 bp, Homo sapiens
aatgaatgattaaattatga

SEQ ID NO: 5119222 - DNA, 17 bp, Homo sapiens
aatgaatgcataaaatg

SEQ ID NO: 5119223 - DNA, 12 bp, Homo sapiens
aatgaatgcatt

SEQ ID NO: 5119224 - DNA, 19 bp, Homo sapiens
aatgaatgccgaatttggt

SEQ ID NO: 5119225 - DNA, 17 bp, Homo sapiens
aatgaatgcctttcaaa

SEQ ID NO: 5119226 - DNA, 23 bp, Homo sapiens
aatgaatgggatattttgaaatg

SEQ ID NO: 5119227 - DNA, 13 bp, Homo sapiens
aatgaatgtcact

SEQ ID NO: 5119228 - DNA, 13 bp, Homo sapiens
aatgaatgtcagt

SEQ ID NO: 5119229 - DNA, 22 bp, Homo sapiens
aatgaatgtcagtgtgactgat

SEQ ID NO: 5119230 - DNA, 16 bp, Homo sapiens
aatgaattagttgcat

SEQ ID NO: 5119231 - DNA, 15 bp, Homo sapiens
aatgaattataacag

SEQ ID NO: 5119232 - DNA, 18 bp, Homo sapiens
aatgaattataacagtta

SEQ ID NO: 5119233 - DNA, 13 bp, Homo sapiens
aatgaattcatgg

SEQ ID NO: 5119234 - DNA, 21 bp, Homo sapiens
aatgaattcctagaattaaac

SEQ ID NO: 5119235 - DNA, 20 bp, Homo sapiens
aatgaattcgatgcgtattc

SEQ ID NO: 5119236 - DNA, 22 bp, Homo sapiens
aatgaattctctctaaaaataa

SEQ ID NO: 5119237 - DNA, 22 bp, Homo sapiens
aatgaattgtattttttgttga

SEQ ID NO: 5119238 - DNA, 19 bp, Homo sapiens
aatgaatttaaggcaaaaa

SEQ ID NO: 5119239 - DNA, 20 bp, Homo sapiens
aatgaatttatctgaatata

SEQ ID NO: 5119240 - DNA, 16 bp, Homo sapiens
aatgaatttgactggt

SEQ ID NO: 5119241 - DNA, 12 bp, Homo sapiens
aatgaatttgtc

SEQ ID NO: 5119242 - DNA, 19 bp, Homo sapiens
aatgaatttgtcgcaaaga

SEQ ID NO: 5119243 - DNA, 16 bp, Homo sapiens
aatgaattttaaaagc

SEQ ID NO: 5119244 - DNA, 13 bp, Homo sapiens
aatgaattttgtt

SEQ ID NO: 5119245 - DNA, 17 bp, Homo sapiens
aatgaatttttatgata

SEQ ID NO: 5119246 - DNA, 16 bp, Homo sapiens
aatgacaaaagataca

SEQ ID NO: 5119247 - DNA, 20 bp, Homo sapiens
aatgacaacagaaaaacaat

SEQ ID NO: 5119248 - DNA, 18 bp, Homo sapiens
aatgacaagtgacttatt

SEQ ID NO: 5119249 - DNA, 19 bp, Homo sapiens
aatgacaatatcaatcaca

SEQ ID NO: 5119250 - DNA, 13 bp, Homo sapiens
aatgacacagtct

SEQ ID NO: 5119251 - DNA, 22 bp, Homo sapiens
aatgacaccacacttgttttct

SEQ ID NO: 5119252 - DNA, 23 bp, Homo sapiens
aatgacacggtaggccaagctga

SEQ ID NO: 5119253 - DNA, 14 bp, Homo sapiens
aatgacactcatat

SEQ ID NO: 5119254 - DNA, 16 bp, Homo sapiens
aatgacactggaaggg

SEQ ID NO: 5119255 - DNA, 11 bp, Homo sapiens
aatgacacttc

SEQ ID NO: 5119256 - DNA, 23 bp, Homo sapiens
aatgacagaaatgacaacaaggc

SEQ ID NO: 5119257 - DNA, 21 bp, Homo sapiens
aatgacagaatgctgttttaa

SEQ ID NO: 5119258 - DNA, 23 bp, Homo sapiens
aatgacagataaatccttaacat

SEQ ID NO: 5119259 - DNA, 14 bp, Homo sapiens
aatgacagatctca

SEQ ID NO: 5119260 - DNA, 16 bp, Homo sapiens
aatgacagatctcaat

SEQ ID NO: 5119261 - DNA, 19 bp, Homo sapiens
aatgacagatgcaagttat

SEQ ID NO: 5119262 - DNA, 18 bp, Homo sapiens
aatgacagattctgacat

SEQ ID NO: 5119263 - DNA, 13 bp, Homo sapiens
aatgacagggatg

SEQ ID NO: 5119264 - DNA, 16 bp, Homo sapiens
aatgacagtaatattg

SEQ ID NO: 5119265 - DNA, 14 bp, Homo sapiens
aatgacagtagcat

SEQ ID NO: 5119266 - DNA, 15 bp, Homo sapiens
aatgacagtcaaaag

SEQ ID NO: 5119267 - DNA, 22 bp, Homo sapiens
aatgacagtccgtcaaaacaga

SEQ ID NO: 5119268 - DNA, 13 bp, Homo sapiens
aatgacagtttca

SEQ ID NO: 5119269 - DNA, 13 bp, Homo sapiens
aatgacatcttca

SEQ ID NO: 5119270 - DNA, 21 bp, Homo sapiens
aatgacatctttttaaagctt

SEQ ID NO: 5119271 - DNA, 19 bp, Homo sapiens
aatgacatgaattttagct

SEQ ID NO: 5119272 - DNA, 21 bp, Homo sapiens
aatgacatgtgtcaagctgct

SEQ ID NO: 5119273 - DNA, 15 bp, Homo sapiens
aatgacattattaaa

SEQ ID NO: 5119274 - DNA, 14 bp, Homo sapiens
aatgacattcccct

SEQ ID NO: 5119275 - DNA, 20 bp, Homo sapiens
aatgacattgatttctaatg

SEQ ID NO: 5119276 - DNA, 18 bp, Homo sapiens
aatgacatttatatcaca

SEQ ID NO: 5119277 - DNA, 13 bp, Homo sapiens
aatgacatttcac

SEQ ID NO: 5119278 - DNA, 17 bp, Homo sapiens
aatgacatttttgataa

SEQ ID NO: 5119279 - DNA, 22 bp, Homo sapiens
aatgaccaacctgtttctacct

SEQ ID NO: 5119280 - DNA, 16 bp, Homo sapiens
aatgaccaagaaaaag

SEQ ID NO: 5119281 - DNA, 19 bp, Homo sapiens
aatgaccaagaaaaagaaa

SEQ ID NO: 5119282 - DNA, 23 bp, Homo sapiens
aatgaccaagctcagttcaatga

SEQ ID NO: 5119283 - DNA, 14 bp, Homo sapiens
aatgaccaatatta

SEQ ID NO: 5119284 - DNA, 21 bp, Homo sapiens
aatgaccacgggcctcagttt

SEQ ID NO: 5119285 - DNA, 14 bp, Homo sapiens
aatgaccagaaaat

SEQ ID NO: 5119286 - DNA, 20 bp, Homo sapiens
aatgaccagcagcagctttc

SEQ ID NO: 5119287 - DNA, 19 bp, Homo sapiens
aatgaccagtaattgtgaa

SEQ ID NO: 5119288 - DNA, 16 bp, Homo sapiens
aatgaccagtttacct

SEQ ID NO: 5119289 - DNA, 20 bp, Homo sapiens
aatgacccagatatggaaac

SEQ ID NO: 5119290 - DNA, 16 bp, Homo sapiens
aatgaccgagccctgg

SEQ ID NO: 5119291 - DNA, 19 bp, Homo sapiens
aatgaccgagccctggaga

SEQ ID NO: 5119292 - DNA, 18 bp, Homo sapiens
aatgaccgctctcccttt

SEQ ID NO: 5119293 - DNA, 16 bp, Homo sapiens
aatgacctcagatctt

SEQ ID NO: 5119294 - DNA, 13 bp, Homo sapiens
aatgacctcagca

SEQ ID NO: 5119295 - DNA, 15 bp, Homo sapiens
aatgacctcagcaaa

SEQ ID NO: 5119296 - DNA, 14 bp, Homo sapiens
aatgacctttcaat

SEQ ID NO: 5119297 - DNA, 16 bp, Homo sapiens
aatgacctttcaatag

SEQ ID NO: 5119298 - DNA, 20 bp, Homo sapiens
aatgacctttcaataggaaa

SEQ ID NO: 5119299 - DNA, 16 bp, Homo sapiens
aatgacctttttacaa

SEQ ID NO: 5119300 - DNA, 22 bp, Homo sapiens
aatgacggtaagtgttctcatg

SEQ ID NO: 5119301 - DNA, 16 bp, Homo sapiens
aatgacggtgttaatt

SEQ ID NO: 5119302 - DNA, 21 bp, Homo sapiens
aatgacggtgttaattttgct

SEQ ID NO: 5119303 - DNA, 22 bp, Homo sapiens
aatgacggtgttaattttgcta

SEQ ID NO: 5119304 - DNA, 20 bp, Homo sapiens
aatgacgtattgtgaaattt

SEQ ID NO: 5119305 - DNA, 14 bp, Homo sapiens
aatgacgtttacat

SEQ ID NO: 5119306 - DNA, 20 bp, Homo sapiens
aatgactaaaaaacaaagaa

SEQ ID NO: 5119307 - DNA, 22 bp, Homo sapiens
aatgactaagaggaaagtacat

SEQ ID NO: 5119308 - DNA, 14 bp, Homo sapiens
aatgactacttagc

SEQ ID NO: 5119309 - DNA, 17 bp, Homo sapiens
aatgactataaacatta

SEQ ID NO: 5119310 - DNA, 20 bp, Homo sapiens
aatgactcagaatattgctt

SEQ ID NO: 5119311 - DNA, 20 bp, Homo sapiens
aatgactcatgcctctgagc

SEQ ID NO: 5119312 - DNA, 21 bp, Homo sapiens
aatgactccaccttctcacct

SEQ ID NO: 5119313 - DNA, 16 bp, Homo sapiens
aatgactccactgttt

SEQ ID NO: 5119314 - DNA, 14 bp, Homo sapiens
aatgactgaaagaa

SEQ ID NO: 5119315 - DNA, 16 bp, Homo sapiens
aatgactgacaaagac

SEQ ID NO: 5119316 - DNA, 21 bp, Homo sapiens
aatgactgacccaaaatgtga

SEQ ID NO: 5119317 - DNA, 13 bp, Homo sapiens
aatgactgagatt

SEQ ID NO: 5119318 - DNA, 23 bp, Homo sapiens
aatgactgagatttgtaaatctt

SEQ ID NO: 5119319 - DNA, 21 bp, Homo sapiens
aatgactgccggtcatttgaa

SEQ ID NO: 5119320 - DNA, 20 bp, Homo sapiens
aatgactggctacagagtaa

SEQ ID NO: 5119321 - DNA, 22 bp, Homo sapiens
aatgactgtctaagagatctgg

SEQ ID NO: 5119322 - DNA, 14 bp, Homo sapiens
aatgacttactgta

SEQ ID NO: 5119323 - DNA, 21 bp, Homo sapiens
aatgacttacttagaatttat

SEQ ID NO: 5119324 - DNA, 14 bp, Homo sapiens
aatgacttattgtg

SEQ ID NO: 5119325 - DNA, 15 bp, Homo sapiens
aatgacttatttctg

SEQ ID NO: 5119326 - DNA, 21 bp, Homo sapiens
aatgacttatttctgctctgg

SEQ ID NO: 5119327 - DNA, 22 bp, Homo sapiens
aatgacttatttctgctctgga

SEQ ID NO: 5119328 - DNA, 11 bp, Homo sapiens
aatgactttat

SEQ ID NO: 5119329 - DNA, 15 bp, Homo sapiens
aatgactttatacaa

SEQ ID NO: 5119330 - DNA, 15 bp, Homo sapiens
aatgactttattatt

SEQ ID NO: 5119331 - DNA, 16 bp, Homo sapiens
aatgacttttaaaatt

SEQ ID NO: 5119332 - DNA, 17 bp, Homo sapiens
aatgacttttaaaattt

SEQ ID NO: 5119333 - DNA, 15 bp, Homo sapiens
aatgactttttataa

SEQ ID NO: 5119334 - DNA, 22 bp, Homo sapiens
aatgagaaaaataaatggaaac

SEQ ID NO: 5119335 - DNA, 14 bp, Homo sapiens
aatgagaaaattgt

SEQ ID NO: 5119336 - DNA, 23 bp, Homo sapiens
aatgagaaagaaaaggaatgcaa

SEQ ID NO: 5119337 - DNA, 17 bp, Homo sapiens
aatgagaaaggacagag

SEQ ID NO: 5119338 - DNA, 22 bp, Homo sapiens
aatgagaaatctaaaaaacgaa

SEQ ID NO: 5119339 - DNA, 20 bp, Homo sapiens
aatgagaaattgtgccaaag

SEQ ID NO: 5119340 - DNA, 12 bp, Homo sapiens
aatgagaacaat

SEQ ID NO: 5119341 - DNA, 15 bp, Homo sapiens
aatgagaaggcagcc

SEQ ID NO: 5119342 - DNA, 17 bp, Homo sapiens
aatgagaaggcagccac

SEQ ID NO: 5119343 - DNA, 13 bp, Homo sapiens
aatgagaatctac

SEQ ID NO: 5119344 - DNA, 17 bp, Homo sapiens
aatgagaatgtgccatg

SEQ ID NO: 5119345 - DNA, 20 bp, Homo sapiens
aatgagaatgtgccatgtat

SEQ ID NO: 5119346 - DNA, 19 bp, Homo sapiens
aatgagaccctcgtggcct

SEQ ID NO: 5119347 - DNA, 15 bp, Homo sapiens
aatgagacttgcctt

SEQ ID NO: 5119348 - DNA, 21 bp, Homo sapiens
aatgagagacacactgaagaa

SEQ ID NO: 5119349 - DNA, 13 bp, Homo sapiens
aatgagaggaaaa

SEQ ID NO: 5119350 - DNA, 17 bp, Homo sapiens
aatgagatcccgcctct

SEQ ID NO: 5119351 - DNA, 21 bp, Homo sapiens
aatgagatctcattaaaaggt

SEQ ID NO: 5119352 - DNA, 20 bp, Homo sapiens
aatgagatgttattactgtt

SEQ ID NO: 5119353 - DNA, 18 bp, Homo sapiens
aatgagcaatatctgcta

SEQ ID NO: 5119354 - DNA, 23 bp, Homo sapiens
aatgagcagagagcaaaggagaa

SEQ ID NO: 5119355 - DNA, 14 bp, Homo sapiens
aatgagcagatgag

SEQ ID NO: 5119356 - DNA, 21 bp, Homo sapiens
aatgagcagcccttacagtat

SEQ ID NO: 5119357 - DNA, 20 bp, Homo sapiens
aatgagcatctcaaatgttt

SEQ ID NO: 5119358 - DNA, 14 bp, Homo sapiens
aatgagcatgttta

SEQ ID NO: 5119359 - DNA, 13 bp, Homo sapiens
aatgagcattttt

SEQ ID NO: 5119360 - DNA, 22 bp, Homo sapiens
aatgagccaataaagctcacac

SEQ ID NO: 5119361 - DNA, 15 bp, Homo sapiens
aatgagccataggaa

SEQ ID NO: 5119362 - DNA, 22 bp, Homo sapiens
aatgagccatcactagaagaaa

SEQ ID NO: 5119363 - DNA, 15 bp, Homo sapiens
aatgagccatcccca

SEQ ID NO: 5119364 - DNA, 18 bp, Homo sapiens
aatgagccatgatttccc

SEQ ID NO: 5119365 - DNA, 13 bp, Homo sapiens
aatgagcccagag

SEQ ID NO: 5119366 - DNA, 13 bp, Homo sapiens
aatgagccctggc

SEQ ID NO: 5119367 - DNA, 23 bp, Homo sapiens
aatgagccctggctcccacctgt

SEQ ID NO: 5119368 - DNA, 11 bp, Homo sapiens
aatgagcctgg

SEQ ID NO: 5119369 - DNA, 13 bp, Homo sapiens
aatgagcctgtcc

SEQ ID NO: 5119370 - DNA, 17 bp, Homo sapiens
aatgagctacttcttat

SEQ ID NO: 5119371 - DNA, 16 bp, Homo sapiens
aatgagctatgtatta

SEQ ID NO: 5119372 - DNA, 23 bp, Homo sapiens
aatgagctattaaaactcagcct

SEQ ID NO: 5119373 - DNA, 14 bp, Homo sapiens
aatgagctcctgcg

SEQ ID NO: 5119374 - DNA, 23 bp, Homo sapiens
aatgagctctctaatagaagtcc

SEQ ID NO: 5119375 - DNA, 14 bp, Homo sapiens
aatgagctctgaaa

SEQ ID NO: 5119376 - DNA, 19 bp, Homo sapiens
aatgagctgggccctgggt

SEQ ID NO: 5119377 - DNA, 21 bp, Homo sapiens
aatgagctggtttgtcaaaca

SEQ ID NO: 5119378 - DNA, 19 bp, Homo sapiens
aatgagctgtatctgtaat

SEQ ID NO: 5119379 - DNA, 12 bp, Homo sapiens
aatgagctgttg

SEQ ID NO: 5119380 - DNA, 16 bp, Homo sapiens
aatgagctttctgaac

SEQ ID NO: 5119381 - DNA, 15 bp, Homo sapiens
aatgaggaagcaaag

SEQ ID NO: 5119382 - DNA, 19 bp, Homo sapiens
aatgaggaatagcaaaatt

SEQ ID NO: 5119383 - DNA, 14 bp, Homo sapiens
aatgaggacatgtt

SEQ ID NO: 5119384 - DNA, 12 bp, Homo sapiens
aatgaggaggaa

SEQ ID NO: 5119385 - DNA, 14 bp, Homo sapiens
aatgaggatccagg

SEQ ID NO: 5119386 - DNA, 17 bp, Homo sapiens
aatgaggatccagggca

SEQ ID NO: 5119387 - DNA, 19 bp, Homo sapiens
aatgttattactgaggaaa

SEQ ID NO: 5119388 - DNA, 23 bp, Homo sapiens
aatgttattattactctacactg

SEQ ID NO: 5119389 - DNA, 21 bp, Homo sapiens
aatgttattattggcttgcac

SEQ ID NO: 5119390 - DNA, 16 bp, Homo sapiens
aatgttattgtgtata

SEQ ID NO: 5119391 - DNA, 19 bp, Homo sapiens
aatgttatttcttaaaatt

SEQ ID NO: 5119392 - DNA, 15 bp, Homo sapiens
aatgttattttcctt

SEQ ID NO: 5119393 - DNA, 18 bp, Homo sapiens
aatgttattttcttctaa

SEQ ID NO: 5119394 - DNA, 19 bp, Homo sapiens
aatgttcacgcaacttgaa

SEQ ID NO: 5119395 - DNA, 19 bp, Homo sapiens
aatgttcactgaataaata

SEQ ID NO: 5119396 - DNA, 19 bp, Homo sapiens
aatgttcatactgatgtgt

SEQ ID NO: 5119397 - DNA, 20 bp, Homo sapiens
aatgttcatcaatgaatgaa

SEQ ID NO: 5119398 - DNA, 17 bp, Homo sapiens
aatgttcatcaattccc

SEQ ID NO: 5119399 - DNA, 22 bp, Homo sapiens
aatgttcatcccatgatgtagt

SEQ ID NO: 5119400 - DNA, 12 bp, Homo sapiens
aatgttcattct

SEQ ID NO: 5119401 - DNA, 11 bp, Homo sapiens
aatgttcattg

SEQ ID NO: 5119402 - DNA, 12 bp, Homo sapiens
aatgttcattgt

SEQ ID NO: 5119403 - DNA, 17 bp, Homo sapiens
aatgttcattgtaatgt

SEQ ID NO: 5119404 - DNA, 21 bp, Homo sapiens
aatgttcattgtaatgttact

SEQ ID NO: 5119405 - DNA, 15 bp, Homo sapiens
aatgttcattttctc

SEQ ID NO: 5119406 - DNA, 16 bp, Homo sapiens
aatgttcattttgaaa

SEQ ID NO: 5119407 - DNA, 19 bp, Homo sapiens
aatgttcattttgaaaata

SEQ ID NO: 5119408 - DNA, 21 bp, Homo sapiens
aatgttcattttgaaaatatg

SEQ ID NO: 5119409 - DNA, 18 bp, Homo sapiens
aatgttccagtttgaaga

SEQ ID NO: 5119410 - DNA, 20 bp, Homo sapiens
aatgttccagtttgaagacc

SEQ ID NO: 5119411 - DNA, 11 bp, Homo sapiens
aatgttccatt

SEQ ID NO: 5119412 - DNA, 20 bp, Homo sapiens
aatgttcccaagtaggcatt

SEQ ID NO: 5119413 - DNA, 16 bp, Homo sapiens
aatgttccccaccgct

SEQ ID NO: 5119414 - DNA, 14 bp, Homo sapiens
aatgttccctgcac

SEQ ID NO: 5119415 - DNA, 21 bp, Homo sapiens
aatgttcctgcctccttgata

SEQ ID NO: 5119416 - DNA, 13 bp, Homo sapiens
aatgttctaagtt

SEQ ID NO: 5119417 - DNA, 22 bp, Homo sapiens
aatgttctaagtttctaagatt

SEQ ID NO: 5119418 - DNA, 22 bp, Homo sapiens
aatgttctatataatttttcct

SEQ ID NO: 5119419 - DNA, 13 bp, Homo sapiens
aatgttctattta

SEQ ID NO: 5119420 - DNA, 21 bp, Homo sapiens
aatgttctgaataatttctta

SEQ ID NO: 5119421 - DNA, 18 bp, Homo sapiens
aatgttctgaatttcctt

SEQ ID NO: 5119422 - DNA, 20 bp, Homo sapiens
aatgttctgaatttcctttt

SEQ ID NO: 5119423 - DNA, 18 bp, Homo sapiens
aatgttctgacagttgtg

SEQ ID NO: 5119424 - DNA, 17 bp, Homo sapiens
aatgttctgacattaac

SEQ ID NO: 5119425 - DNA, 19 bp, Homo sapiens
aatgttctgacattaacag

SEQ ID NO: 5119426 - DNA, 21 bp, Homo sapiens
aatgttctggcactattataa

SEQ ID NO: 5119427 - DNA, 14 bp, Homo sapiens
aatgttctgggaag

SEQ ID NO: 5119428 - DNA, 22 bp, Homo sapiens
aatgttctgttcaccctgcatt

SEQ ID NO: 5119429 - DNA, 20 bp, Homo sapiens
aatgttcttatgcaaaatgg

SEQ ID NO: 5119430 - DNA, 21 bp, Homo sapiens
aatgttcttatgcaaaatgga

SEQ ID NO: 5119431 - DNA, 12 bp, Homo sapiens
aatgttcttcca

SEQ ID NO: 5119432 - DNA, 13 bp, Homo sapiens
aatgttcttggtg

SEQ ID NO: 5119433 - DNA, 21 bp, Homo sapiens
aatgttctttataaaaagtga

SEQ ID NO: 5119434 - DNA, 23 bp, Homo sapiens
aatgttctttcctttcatcctca

SEQ ID NO: 5119435 - DNA, 12 bp, Homo sapiens
aatgttctttct

SEQ ID NO: 5119436 - DNA, 18 bp, Homo sapiens
aatgttctttctgctcta

SEQ ID NO: 5119437 - DNA, 11 bp, Homo sapiens
aatgttctttg

SEQ ID NO: 5119438 - DNA, 14 bp, Homo sapiens
aatgttctttggaa

SEQ ID NO: 5119439 - DNA, 19 bp, Homo sapiens
aatgttgaaaagtcaaact

SEQ ID NO: 5119440 - DNA, 14 bp, Homo sapiens
aatgttgaaatctt

SEQ ID NO: 5119441 - DNA, 15 bp, Homo sapiens
aatgttgaacaaaat

SEQ ID NO: 5119442 - DNA, 16 bp, Homo sapiens
aatgttgaacaaaata

SEQ ID NO: 5119443 - DNA, 21 bp, Homo sapiens
aatgttgaacaaaataaattg

SEQ ID NO: 5119444 - DNA, 23 bp, Homo sapiens
aatgttgaagaactcatgtgatt

SEQ ID NO: 5119445 - DNA, 14 bp, Homo sapiens
aatgttgaattttg

SEQ ID NO: 5119446 - DNA, 12 bp, Homo sapiens
aatgttgagaag

SEQ ID NO: 5119447 - DNA, 21 bp, Homo sapiens
aatgttgagaagcgtttttaa

SEQ ID NO: 5119448 - DNA, 19 bp, Homo sapiens
aatgttgattacagtgcag

SEQ ID NO: 5119449 - DNA, 12 bp, Homo sapiens
aatgttgatttc

SEQ ID NO: 5119450 - DNA, 18 bp, Homo sapiens
aatgttgatttctagtta

SEQ ID NO: 5119451 - DNA, 20 bp, Homo sapiens
aatgttgatttctagttatt

SEQ ID NO: 5119452 - DNA, 18 bp, Homo sapiens
aatgttgcacatcattca

SEQ ID NO: 5119453 - DNA, 19 bp, Homo sapiens
aatgttgcacatcattcat

SEQ ID NO: 5119454 - DNA, 17 bp, Homo sapiens
aatgttgccttggaaac

SEQ ID NO: 5119455 - DNA, 20 bp, Homo sapiens
aatgttgccttggaaacatt

SEQ ID NO: 5119456 - DNA, 13 bp, Homo sapiens
aatgttgctggat

SEQ ID NO: 5119457 - DNA, 17 bp, Homo sapiens
aatgttggaaaacatat

SEQ ID NO: 5119458 - DNA, 21 bp, Homo sapiens
aatgttggaaaacatatgaaa

SEQ ID NO: 5119459 - DNA, 22 bp, Homo sapiens
aatgttggaaaacatatgaaat

SEQ ID NO: 5119460 - DNA, 13 bp, Homo sapiens
aatgttggaattt

SEQ ID NO: 5119461 - DNA, 13 bp, Homo sapiens
aatgttggataag

SEQ ID NO: 5119462 - DNA, 19 bp, Homo sapiens
aatgttggatttataaatg

SEQ ID NO: 5119463 - DNA, 23 bp, Homo sapiens
aatgttggcagatgcagctcttc

SEQ ID NO: 5119464 - DNA, 22 bp, Homo sapiens
aatgttgggactgctaaataaa

SEQ ID NO: 5119465 - DNA, 20 bp, Homo sapiens
aatgttgggatttatatcta

SEQ ID NO: 5119466 - DNA, 22 bp, Homo sapiens
aatgttgggtctcactctctgg

SEQ ID NO: 5119467 - DNA, 23 bp, Homo sapiens
aatgttggtcattttatgttaag

SEQ ID NO: 5119468 - DNA, 23 bp, Homo sapiens
aatgttggtgcaattaactctgg

SEQ ID NO: 5119469 - DNA, 24 bp, Homo sapiens
aatgttggtgtggagttttcatga

SEQ ID NO: 5119470 - DNA, 18 bp, Homo sapiens
aatgttggtttactttca

SEQ ID NO: 5119471 - DNA, 22 bp, Homo sapiens
aatgttgtagttacctactgag

SEQ ID NO: 5119472 - DNA, 17 bp, Homo sapiens
aatgttgtattcagtga

SEQ ID NO: 5119473 - DNA, 19 bp, Homo sapiens
aatgttgtccaacaataaa

SEQ ID NO: 5119474 - DNA, 12 bp, Homo sapiens
aatgttgtccag

SEQ ID NO: 5119475 - DNA, 23 bp, Homo sapiens
aatgttgtcctgttaatttatag

SEQ ID NO: 5119476 - DNA, 21 bp, Homo sapiens
aatgttgtgaataattacagt

SEQ ID NO: 5119477 - DNA, 16 bp, Homo sapiens
aatgttgtgtgttgca

SEQ ID NO: 5119478 - DNA, 23 bp, Homo sapiens
aatgttgtgttggtatttactgc

SEQ ID NO: 5119479 - DNA, 16 bp, Homo sapiens
aatgttgttaaatgct

SEQ ID NO: 5119480 - DNA, 17 bp, Homo sapiens
aatgttgttaaatgcta

SEQ ID NO: 5119481 - DNA, 18 bp, Homo sapiens
aatgttgttaaatgctat

SEQ ID NO: 5119482 - DNA, 12 bp, Homo sapiens
aatgttgtttcc

SEQ ID NO: 5119483 - DNA, 22 bp, Homo sapiens
aatgttgtttcctaatatcaaa

SEQ ID NO: 5119484 - DNA, 14 bp, Homo sapiens
aatgtttaaaagca

SEQ ID NO: 5119485 - DNA, 16 bp, Homo sapiens
aatgtttaaacatttt

SEQ ID NO: 5119486 - DNA, 19 bp, Homo sapiens
aatgtttaaatcatgtatg

SEQ ID NO: 5119487 - DNA, 12 bp, Homo sapiens
aatgtttaagat

SEQ ID NO: 5119488 - DNA, 15 bp, Homo sapiens
aatgtttaagcagaa

SEQ ID NO: 5119489 - DNA, 22 bp, Homo sapiens
aatgtttaagcagaattggaaa

SEQ ID NO: 5119490 - DNA, 14 bp, Homo sapiens
aatgtttaagtatt

SEQ ID NO: 5119491 - DNA, 19 bp, Homo sapiens
aatgtttaataaagcttta

SEQ ID NO: 5119492 - DNA, 21 bp, Homo sapiens
aatgtttaatatctgactgaa

SEQ ID NO: 5119493 - DNA, 14 bp, Homo sapiens
aatgtttaatcata

SEQ ID NO: 5119494 - DNA, 23 bp, Homo sapiens
aatgtttaatcatataaatagaa

SEQ ID NO: 5119495 - DNA, 14 bp, Homo sapiens
aatgtttaatgctg

SEQ ID NO: 5119496 - DNA, 13 bp, Homo sapiens
aatgtttaattca

SEQ ID NO: 5119497 - DNA, 14 bp, Homo sapiens
aatgtttacatttt

SEQ ID NO: 5119498 - DNA, 17 bp, Homo sapiens
aatgtttacattttctt

SEQ ID NO: 5119499 - DNA, 15 bp, Homo sapiens
aatgtttactataga

SEQ ID NO: 5119500 - DNA, 15 bp, Homo sapiens
aatgtttactatata

SEQ ID NO: 5119501 - DNA, 18 bp, Homo sapiens
aatgtttactgtaaattt

SEQ ID NO: 5119502 - DNA, 20 bp, Homo sapiens
aatgtttactgtatcaattt

SEQ ID NO: 5119503 - DNA, 14 bp, Homo sapiens
aatgtttaggaaat

SEQ ID NO: 5119504 - DNA, 20 bp, Homo sapiens
aatgtttagtgtgctgctgt

SEQ ID NO: 5119505 - DNA, 22 bp, Homo sapiens
aatgtttagtgtgctgctgttc

SEQ ID NO: 5119506 - DNA, 12 bp, Homo sapiens
aatgtttataac

SEQ ID NO: 5119507 - DNA, 19 bp, Homo sapiens
aatgtttatacaataattt

SEQ ID NO: 5119508 - DNA, 16 bp, Homo sapiens
aatgtttatactgtat

SEQ ID NO: 5119509 - DNA, 15 bp, Homo sapiens
aatgtttatgttctc

SEQ ID NO: 5119510 - DNA, 18 bp, Homo sapiens
aatgtttatgttctcaga

SEQ ID NO: 5119511 - DNA, 16 bp, Homo sapiens
aatgtttattaaatgc

SEQ ID NO: 5119512 - DNA, 20 bp, Homo sapiens
aatgtttattcctgataata

SEQ ID NO: 5119513 - DNA, 23 bp, Homo sapiens
aatgtttattccttctgtagtgt

SEQ ID NO: 5119514 - DNA, 15 bp, Homo sapiens
aatgtttattccttg

SEQ ID NO: 5119515 - DNA, 16 bp, Homo sapiens
aatgtttcaaaataga

SEQ ID NO: 5119516 - DNA, 13 bp, Homo sapiens
aatgtttcaaatc

SEQ ID NO: 5119517 - DNA, 21 bp, Homo sapiens
aatgtttcaagcgcttaactc

SEQ ID NO: 5119518 - DNA, 20 bp, Homo sapiens
aatgtttcactatgattttc

SEQ ID NO: 5119519 - DNA, 12 bp, Homo sapiens
aatgtttcatga

SEQ ID NO: 5119520 - DNA, 14 bp, Homo sapiens
aatgtttccactgg

SEQ ID NO: 5119521 - DNA, 22 bp, Homo sapiens
aatgtttccttttagttgttga

SEQ ID NO: 5119522 - DNA, 12 bp, Homo sapiens
aatgtttctatc

SEQ ID NO: 5119523 - DNA, 14 bp, Homo sapiens
aatgtttctatttc

SEQ ID NO: 5119524 - DNA, 23 bp, Homo sapiens
aatgtttctctctctctaccttt

SEQ ID NO: 5119525 - DNA, 17 bp, Homo sapiens
aatgtttctgtgtcatt

SEQ ID NO: 5119526 - DNA, 12 bp, Homo sapiens
aatgtttcttag

SEQ ID NO: 5119527 - DNA, 12 bp, Homo sapiens
aatgtttctttt

SEQ ID NO: 5119528 - DNA, 17 bp, Homo sapiens
aatgtttcttttgtttg

SEQ ID NO: 5119529 - DNA, 13 bp, Homo sapiens
aatgtttcttttt

SEQ ID NO: 5119530 - DNA, 15 bp, Homo sapiens
aatgtttctttttct

SEQ ID NO: 5119531 - DNA, 23 bp, Homo sapiens
aatgtttctttttcttttttgag

SEQ ID NO: 5119532 - DNA, 13 bp, Homo sapiens
aatgtttgaattt

SEQ ID NO: 5119533 - DNA, 14 bp, Homo sapiens
aatgtttgaattta

SEQ ID NO: 5119534 - DNA, 20 bp, Homo sapiens
aatgtttgacacaattggaa

SEQ ID NO: 5119535 - DNA, 21 bp, Homo sapiens
aatgtttgaggagcatgtttt

SEQ ID NO: 5119536 - DNA, 20 bp, Homo sapiens
aatgtttgatagtaaatgtc

SEQ ID NO: 5119537 - DNA, 19 bp, Homo sapiens
aatgtttgcctctgcctct

SEQ ID NO: 5119538 - DNA, 12 bp, Homo sapiens
aatgtttgctat

SEQ ID NO: 5119539 - DNA, 13 bp, Homo sapiens
aatgtttggaatt

SEQ ID NO: 5119540 - DNA, 18 bp, Homo sapiens
aatgtttggaatttaaga

SEQ ID NO: 5119541 - DNA, 20 bp, Homo sapiens
aatgtttggcatgtaaatgt

SEQ ID NO: 5119542 - DNA, 23 bp, Homo sapiens
aatgtttgggcagaagggagaag

SEQ ID NO: 5119543 - DNA, 22 bp, Homo sapiens
aatgtttgggggaaaaaaaaga

SEQ ID NO: 5119544 - DNA, 14 bp, Homo sapiens
aatgtttgtaagca

SEQ ID NO: 5119545 - DNA, 20 bp, Homo sapiens
aatgtttgtaagcaattcta

SEQ ID NO: 5119546 - DNA, 12 bp, Homo sapiens
aatgtttgtact

SEQ ID NO: 5119547 - DNA, 19 bp, Homo sapiens
aatgtttgtctcagttgga

SEQ ID NO: 5119548 - DNA, 22 bp, Homo sapiens
aatgtttgtctcagttggaaat

SEQ ID NO: 5119549 - DNA, 23 bp, Homo sapiens
aatgtttgtgggtatttcttggc

SEQ ID NO: 5119550 - DNA, 18 bp, Homo sapiens
aatgtttgtgtctgtggt

SEQ ID NO: 5119551 - DNA, 20 bp, Homo sapiens
aatgtttgtgtctgtggttg

SEQ ID NO: 5119552 - DNA, 19 bp, Homo sapiens
aatgtttgttaaaaataaa

SEQ ID NO: 5119553 - DNA, 23 bp, Homo sapiens
aatgtttgtttatatcactgtct

SEQ ID NO: 5119554 - DNA, 15 bp, Homo sapiens
aatgttttaaagaag

SEQ ID NO: 5119555 - DNA, 14 bp, Homo sapiens
aatgttttaaatgt

SEQ ID NO: 5119556 - DNA, 16 bp, Homo sapiens
aatgttttaacaagaa

SEQ ID NO: 5119557 - DNA, 13 bp, Homo sapiens
aatgttttaatgc

SEQ ID NO: 5119558 - DNA, 14 bp, Homo sapiens
aatgttttaatgcc

SEQ ID NO: 5119559 - DNA, 22 bp, Homo sapiens
aatgttttactgtgaaactggc

SEQ ID NO: 5119560 - DNA, 16 bp, Homo sapiens
aatgttttcaaaaggt

SEQ ID NO: 5119561 - DNA, 12 bp, Homo sapiens
aatgttttcatt

SEQ ID NO: 5119562 - DNA, 19 bp, Homo sapiens
aatgttttcattatgttca

SEQ ID NO: 5119563 - DNA, 21 bp, Homo sapiens
aatgttttcattatgttcatg

SEQ ID NO: 5119564 - DNA, 14 bp, Homo sapiens
aatgttttcattgg

SEQ ID NO: 5119565 - DNA, 21 bp, Homo sapiens
aatgaggcagggatactctgt

SEQ ID NO: 5119566 - DNA, 19 bp, Homo sapiens
aatgaggcggagctccagg

SEQ ID NO: 5119567 - DNA, 18 bp, Homo sapiens
aatgagggaaacaaaata

SEQ ID NO: 5119568 - DNA, 21 bp, Homo sapiens
aatgagggaaattgctatttt

SEQ ID NO: 5119569 - DNA, 20 bp, Homo sapiens
aatgagggactggaaccagg

SEQ ID NO: 5119570 - DNA, 18 bp, Homo sapiens
aatgagggccaagaaaga

SEQ ID NO: 5119571 - DNA, 17 bp, Homo sapiens
aatgagggcgtgaaaca

SEQ ID NO: 5119572 - DNA, 16 bp, Homo sapiens
aatgagggggctcagt

SEQ ID NO: 5119573 - DNA, 16 bp, Homo sapiens
aatgagggtttctgat

SEQ ID NO: 5119574 - DNA, 16 bp, Homo sapiens
aatgaggtcagagcct

SEQ ID NO: 5119575 - DNA, 16 bp, Homo sapiens
aatgaggtctgggcta

SEQ ID NO: 5119576 - DNA, 15 bp, Homo sapiens
aatgaggtctgttta

SEQ ID NO: 5119577 - DNA, 17 bp, Homo sapiens
aatgaggtggtactatg

SEQ ID NO: 5119578 - DNA, 15 bp, Homo sapiens
aatgaggttatgaga

SEQ ID NO: 5119579 - DNA, 14 bp, Homo sapiens
aatgagtaaaatca

SEQ ID NO: 5119580 - DNA, 19 bp, Homo sapiens
aatgagtaaataaactctt

SEQ ID NO: 5119581 - DNA, 23 bp, Homo sapiens
aatgagtaggatgtctcttggaa

SEQ ID NO: 5119582 - DNA, 20 bp, Homo sapiens
aatgagtatatgtaacagtt

SEQ ID NO: 5119583 - DNA, 15 bp, Homo sapiens
aatgagtatttggtc

SEQ ID NO: 5119584 - DNA, 17 bp, Homo sapiens
aatgagtcaatcagcct

SEQ ID NO: 5119585 - DNA, 19 bp, Homo sapiens
aatgagtcaatcagccttt

SEQ ID NO: 5119586 - DNA, 18 bp, Homo sapiens
aatgagtcacaaaataaa

SEQ ID NO: 5119587 - DNA, 18 bp, Homo sapiens
aatgagtcatttgtttaa

SEQ ID NO: 5119588 - DNA, 22 bp, Homo sapiens
aatgagtctgcataaacttcat

SEQ ID NO: 5119589 - DNA, 14 bp, Homo sapiens
aatgagtctgtaat

SEQ ID NO: 5119590 - DNA, 15 bp, Homo sapiens
aatgagtctgtaatt

SEQ ID NO: 5119591 - DNA, 14 bp, Homo sapiens
aatgagtctgttgt

SEQ ID NO: 5119592 - DNA, 21 bp, Homo sapiens
aatgagtgaagtattgctgaa

SEQ ID NO: 5119593 - DNA, 19 bp, Homo sapiens
aatgagtgggctgtagttg

SEQ ID NO: 5119594 - DNA, 18 bp, Homo sapiens
aatgagtgtgccagagtt

SEQ ID NO: 5119595 - DNA, 20 bp, Homo sapiens
aatgagttaaataaaacatt

SEQ ID NO: 5119596 - DNA, 13 bp, Homo sapiens
aatgagttacctc

SEQ ID NO: 5119597 - DNA, 15 bp, Homo sapiens
aatgagttacttaga

SEQ ID NO: 5119598 - DNA, 16 bp, Homo sapiens
aatgagttgtcacaga

SEQ ID NO: 5119599 - DNA, 13 bp, Homo sapiens
aatgagttgtgaa

SEQ ID NO: 5119600 - DNA, 14 bp, Homo sapiens
aatgagtttaaaaa

SEQ ID NO: 5119601 - DNA, 19 bp, Homo sapiens
aatgagtttaaaaaaataa

SEQ ID NO: 5119602 - DNA, 21 bp, Homo sapiens
aatgagtttcacagtgtgatt

SEQ ID NO: 5119603 - DNA, 15 bp, Homo sapiens
aatgagtttgtatta

SEQ ID NO: 5119604 - DNA, 17 bp, Homo sapiens
aatgagtttgtattatt

SEQ ID NO: 5119605 - DNA, 18 bp, Homo sapiens
aatgagtttttaatagtc

SEQ ID NO: 5119606 - DNA, 20 bp, Homo sapiens
aatgataaaataaataattt

SEQ ID NO: 5119607 - DNA, 21 bp, Homo sapiens
aatgataaaataaataatttt

SEQ ID NO: 5119608 - DNA, 13 bp, Homo sapiens
aatgataaaatag

SEQ ID NO: 5119609 - DNA, 12 bp, Homo sapiens
aatgataaaatc

SEQ ID NO: 5119610 - DNA, 21 bp, Homo sapiens
aatgataaaatcccattgtat

SEQ ID NO: 5119611 - DNA, 15 bp, Homo sapiens
aatgataaagacttt

SEQ ID NO: 5119612 - DNA, 23 bp, Homo sapiens
aatgataagcaggaaggatggca

SEQ ID NO: 5119613 - DNA, 21 bp, Homo sapiens
aatgataagtaaatgctaggt

SEQ ID NO: 5119614 - DNA, 16 bp, Homo sapiens
aatgataatagctcac

SEQ ID NO: 5119615 - DNA, 18 bp, Homo sapiens
aatgataccctgaatttg

SEQ ID NO: 5119616 - DNA, 17 bp, Homo sapiens
aatgatactgaattgtt

SEQ ID NO: 5119617 - DNA, 15 bp, Homo sapiens
aatgatactgtctaa

SEQ ID NO: 5119618 - DNA, 18 bp, Homo sapiens
aatgatactgtctaagaa

SEQ ID NO: 5119619 - DNA, 16 bp, Homo sapiens
aatgatagaactgtac

SEQ ID NO: 5119620 - DNA, 15 bp, Homo sapiens
aatgatagaactttg

SEQ ID NO: 5119621 - DNA, 21 bp, Homo sapiens
aatgatagacaattgaggtaa

SEQ ID NO: 5119622 - DNA, 18 bp, Homo sapiens
aatgatagataatgcctt

SEQ ID NO: 5119623 - DNA, 17 bp, Homo sapiens
aatgatagcccagaaca

SEQ ID NO: 5119624 - DNA, 16 bp, Homo sapiens
aatgatagtagagtga

SEQ ID NO: 5119625 - DNA, 19 bp, Homo sapiens
aatgatagtgttttgtact

SEQ ID NO: 5119626 - DNA, 18 bp, Homo sapiens
aatgatagttgattttca

SEQ ID NO: 5119627 - DNA, 18 bp, Homo sapiens
aatgatatagccagaaaa

SEQ ID NO: 5119628 - DNA, 19 bp, Homo sapiens
aatgatataggaaaataca

SEQ ID NO: 5119629 - DNA, 14 bp, Homo sapiens
aatgatatcaaaga

SEQ ID NO: 5119630 - DNA, 12 bp, Homo sapiens
aatgatatcttt

SEQ ID NO: 5119631 - DNA, 16 bp, Homo sapiens
aatgatatgtctttaa

SEQ ID NO: 5119632 - DNA, 21 bp, Homo sapiens
aatgatattcaatcttaacaa

SEQ ID NO: 5119633 - DNA, 12 bp, Homo sapiens
aatgatcaaatt

SEQ ID NO: 5119634 - DNA, 19 bp, Homo sapiens
aatgatcaaattttgagca

SEQ ID NO: 5119635 - DNA, 17 bp, Homo sapiens
aatgatcacatctaaag

SEQ ID NO: 5119636 - DNA, 23 bp, Homo sapiens
aatgatcacatctaaagctttat

SEQ ID NO: 5119637 - DNA, 22 bp, Homo sapiens
aatgatcatatcaattggcagt

SEQ ID NO: 5119638 - DNA, 14 bp, Homo sapiens
aatgatcatgaaac

SEQ ID NO: 5119639 - DNA, 16 bp, Homo sapiens
aatgatcattgaaagt

SEQ ID NO: 5119640 - DNA, 22 bp, Homo sapiens
aatgatccccagctgtttatgc

SEQ ID NO: 5119641 - DNA, 15 bp, Homo sapiens
aatgatccctcagtc

SEQ ID NO: 5119642 - DNA, 17 bp, Homo sapiens
aatgatcctcccacctc

SEQ ID NO: 5119643 - DNA, 19 bp, Homo sapiens
aatgatcctgtattcagac

SEQ ID NO: 5119644 - DNA, 21 bp, Homo sapiens
aatgatcctgtattcagacag

SEQ ID NO: 5119645 - DNA, 23 bp, Homo sapiens
aatgatcctgtattcagacagat

SEQ ID NO: 5119646 - DNA, 13 bp, Homo sapiens
aatgatccttcct

SEQ ID NO: 5119647 - DNA, 17 bp, Homo sapiens
aatgatcgaaaaaataa

SEQ ID NO: 5119648 - DNA, 21 bp, Homo sapiens
aatgatcgaaaaaataattat

SEQ ID NO: 5119649 - DNA, 17 bp, Homo sapiens
aatgatctagttcagaa

SEQ ID NO: 5119650 - DNA, 13 bp, Homo sapiens
aatgatctattgc

SEQ ID NO: 5119651 - DNA, 19 bp, Homo sapiens
aatgatgacaaaaaatgtt

SEQ ID NO: 5119652 - DNA, 15 bp, Homo sapiens
aatgatgacccacta

SEQ ID NO: 5119653 - DNA, 20 bp, Homo sapiens
aatgatgacccactaaagag

SEQ ID NO: 5119654 - DNA, 17 bp, Homo sapiens
aatgatgaggatctgaa

SEQ ID NO: 5119655 - DNA, 22 bp, Homo sapiens
aatgatgagtctatattatcta

SEQ ID NO: 5119656 - DNA, 12 bp, Homo sapiens
aatgatgataac

SEQ ID NO: 5119657 - DNA, 21 bp, Homo sapiens
aatgatgatcaattatagttt

SEQ ID NO: 5119658 - DNA, 21 bp, Homo sapiens
aatgatgatcctaggcatttg

SEQ ID NO: 5119659 - DNA, 12 bp, Homo sapiens
aatgatgatgac

SEQ ID NO: 5119660 - DNA, 17 bp, Homo sapiens
aatgatgatgataatga

SEQ ID NO: 5119661 - DNA, 21 bp, Homo sapiens
aatgatgatgatgatgatgaa

SEQ ID NO: 5119662 - DNA, 21 bp, Homo sapiens
aatgatgatgtggaagaactt

SEQ ID NO: 5119663 - DNA, 22 bp, Homo sapiens
aatgatgattgaactggaataa

SEQ ID NO: 5119664 - DNA, 21 bp, Homo sapiens
aatgatgcagctgttgagaaa

SEQ ID NO: 5119665 - DNA, 22 bp, Homo sapiens
aatgatgccaaaatattgctta

SEQ ID NO: 5119666 - DNA, 19 bp, Homo sapiens
aatgatgccatgaggaaca

SEQ ID NO: 5119667 - DNA, 18 bp, Homo sapiens
aatgatgccctgctccag

SEQ ID NO: 5119668 - DNA, 21 bp, Homo sapiens
aatgatgcttactacagaaag

SEQ ID NO: 5119669 - DNA, 15 bp, Homo sapiens
aatgatggacccaat

SEQ ID NO: 5119670 - DNA, 16 bp, Homo sapiens
aatgatggatttaaca

SEQ ID NO: 5119671 - DNA, 22 bp, Homo sapiens
aatgatggatttaacagcatga

SEQ ID NO: 5119672 - DNA, 14 bp, Homo sapiens
aatgatggcaattt

SEQ ID NO: 5119673 - DNA, 15 bp, Homo sapiens
aatgatggcagagga

SEQ ID NO: 5119674 - DNA, 13 bp, Homo sapiens
aatgatggcccat

SEQ ID NO: 5119675 - DNA, 22 bp, Homo sapiens
aatgatggcccattctacttgc

SEQ ID NO: 5119676 - DNA, 20 bp, Homo sapiens
aatgatggtaaagccatgtt

SEQ ID NO: 5119677 - DNA, 21 bp, Homo sapiens
aatgatggtgttaaagctgta

SEQ ID NO: 5119678 - DNA, 23 bp, Homo sapiens
aatgatggtgttaaagctgtaca

SEQ ID NO: 5119679 - DNA, 21 bp, Homo sapiens
aatgatgtacaggcagatgaa

SEQ ID NO: 5119680 - DNA, 13 bp, Homo sapiens
aatgatgtagaca

SEQ ID NO: 5119681 - DNA, 18 bp, Homo sapiens
aatgatgtagacatttta

SEQ ID NO: 5119682 - DNA, 15 bp, Homo sapiens
aatgatgtatgattt

SEQ ID NO: 5119683 - DNA, 20 bp, Homo sapiens
aatgatgtatgttgaagcct

SEQ ID NO: 5119684 - DNA, 13 bp, Homo sapiens
aatgatgtcttta

SEQ ID NO: 5119685 - DNA, 15 bp, Homo sapiens
aatgatgtctttaag

SEQ ID NO: 5119686 - DNA, 16 bp, Homo sapiens
aatgatgtgaaagata

SEQ ID NO: 5119687 - DNA, 18 bp, Homo sapiens
aatgatgtgaaagataaa

SEQ ID NO: 5119688 - DNA, 22 bp, Homo sapiens
aatgatgtgtcatatgagtcct

SEQ ID NO: 5119689 - DNA, 17 bp, Homo sapiens
aatgatgttatagaatt

SEQ ID NO: 5119690 - DNA, 16 bp, Homo sapiens
aatgatgttttaaaaa

SEQ ID NO: 5119691 - DNA, 19 bp, Homo sapiens
aatgatgttttagaatgat

SEQ ID NO: 5119692 - DNA, 13 bp, Homo sapiens
aatgattaaatta

SEQ ID NO: 5119693 - DNA, 18 bp, Homo sapiens
aatgattaaattatgaag

SEQ ID NO: 5119694 - DNA, 16 bp, Homo sapiens
aatgattaatcataaa

SEQ ID NO: 5119695 - DNA, 14 bp, Homo sapiens
aatgattataatca

SEQ ID NO: 5119696 - DNA, 13 bp, Homo sapiens
aatgattatattc

SEQ ID NO: 5119697 - DNA, 16 bp, Homo sapiens
aatgattatattcaca

SEQ ID NO: 5119698 - DNA, 12 bp, Homo sapiens
aatgattatttt

SEQ ID NO: 5119699 - DNA, 15 bp, Homo sapiens
aatgattattttcat

SEQ ID NO: 5119700 - DNA, 19 bp, Homo sapiens
aatgattattttcattaca

SEQ ID NO: 5119701 - DNA, 12 bp, Homo sapiens
aatgattcaaaa

SEQ ID NO: 5119702 - DNA, 17 bp, Homo sapiens
aatgattcaatgtgaat

SEQ ID NO: 5119703 - DNA, 19 bp, Homo sapiens
aatgattcacttttattgt

SEQ ID NO: 5119704 - DNA, 12 bp, Homo sapiens
aatgattcaggg

SEQ ID NO: 5119705 - DNA, 14 bp, Homo sapiens
aatgattcagtgtt

SEQ ID NO: 5119706 - DNA, 18 bp, Homo sapiens
aatgattcataacaatgt

SEQ ID NO: 5119707 - DNA, 19 bp, Homo sapiens
aatgattcatctttcagaa

SEQ ID NO: 5119708 - DNA, 22 bp, Homo sapiens
aatgattcatctttcagaaata

SEQ ID NO: 5119709 - DNA, 14 bp, Homo sapiens
aatgattcatgtta

SEQ ID NO: 5119710 - DNA, 21 bp, Homo sapiens
aatgattcatttttctgttag

SEQ ID NO: 5119711 - DNA, 14 bp, Homo sapiens
aatgattccaaata

SEQ ID NO: 5119712 - DNA, 18 bp, Homo sapiens
aatgattccctcttgcta

SEQ ID NO: 5119713 - DNA, 22 bp, Homo sapiens
aatgattcttccttttattaaa

SEQ ID NO: 5119714 - DNA, 16 bp, Homo sapiens
aatgattcttgtgtca

SEQ ID NO: 5119715 - DNA, 20 bp, Homo sapiens
aatgattgtaaaatagcttg

SEQ ID NO: 5119716 - DNA, 15 bp, Homo sapiens
aatgattgtagtaat

SEQ ID NO: 5119717 - DNA, 16 bp, Homo sapiens
aatgattgtgcctctg

SEQ ID NO: 5119718 - DNA, 12 bp, Homo sapiens
aatgattgttta

SEQ ID NO: 5119719 - DNA, 13 bp, Homo sapiens
aatgattgtttaa

SEQ ID NO: 5119720 - DNA, 18 bp, Homo sapiens
aatgatttaagcatttta

SEQ ID NO: 5119721 - DNA, 13 bp, Homo sapiens
aatgatttacata

SEQ ID NO: 5119722 - DNA, 19 bp, Homo sapiens
aatgatttagctccctcca

SEQ ID NO: 5119723 - DNA, 15 bp, Homo sapiens
aatgatttcatattg

SEQ ID NO: 5119724 - DNA, 22 bp, Homo sapiens
aatgatttcatgctatctctgt

SEQ ID NO: 5119725 - DNA, 18 bp, Homo sapiens
aatgatttccaaagagaa

SEQ ID NO: 5119726 - DNA, 13 bp, Homo sapiens
aatgatttgtaaa

SEQ ID NO: 5119727 - DNA, 22 bp, Homo sapiens
aatgatttgtaaaggactattt

SEQ ID NO: 5119728 - DNA, 15 bp, Homo sapiens
aatgattttcatcaa

SEQ ID NO: 5119729 - DNA, 18 bp, Homo sapiens
aatgattttcatcaattt

SEQ ID NO: 5119730 - DNA, 20 bp, Homo sapiens
aatgattttcatcaatttaa

SEQ ID NO: 5119731 - DNA, 23 bp, Homo sapiens
aatgattttggaactgtgtttca

SEQ ID NO: 5119732 - DNA, 18 bp, Homo sapiens
aatgatttttctttacaa

SEQ ID NO: 5119733 - DNA, 16 bp, Homo sapiens
aatgatttttgctatt

SEQ ID NO: 5119734 - DNA, 13 bp, Homo sapiens
aatgcaaaaataa

SEQ ID NO: 5119735 - DNA, 13 bp, Homo sapiens
aatgcaaaaatct

SEQ ID NO: 5119736 - DNA, 21 bp, Homo sapiens
aatgcaaaaattagccgggcg

SEQ ID NO: 5119737 - DNA, 20 bp, Homo sapiens
aatgcaaaacacaaaacaaa

SEQ ID NO: 5119738 - DNA, 20 bp, Homo sapiens
aatgcaaaagtctagagggg

SEQ ID NO: 5119739 - DNA, 18 bp, Homo sapiens
aatgcaaaattgttttca

SEQ ID NO: 5119740 - DNA, 11 bp, Homo sapiens
aatgcaaacca

SEQ ID NO: 5119741 - DNA, 23 bp, Homo sapiens
aatgcaaaccatcattgaaatct

SEQ ID NO: 5119742 - DNA, 13 bp, Homo sapiens
aatgcaaagaatc

SEQ ID NO: 5119743 - DNA, 14 bp, Homo sapiens
aatgcaaagatgaa

SEQ ID NO: 5119744 - DNA, 20 bp, Homo sapiens
aatgttttccaatattttaa

SEQ ID NO: 5119745 - DNA, 22 bp, Homo sapiens
aatgttttccaatattttaata

SEQ ID NO: 5119746 - DNA, 18 bp, Homo sapiens
aatgttttcgcaaatgtt

SEQ ID NO: 5119747 - DNA, 17 bp, Homo sapiens
aatgttttctgcagaaa

SEQ ID NO: 5119748 - DNA, 20 bp, Homo sapiens
aatgttttctgcagaaaaaa

SEQ ID NO: 5119749 - DNA, 23 bp, Homo sapiens
aatgttttcttcaacatgctcca

SEQ ID NO: 5119750 - DNA, 13 bp, Homo sapiens
aatgttttctttg

SEQ ID NO: 5119751 - DNA, 22 bp, Homo sapiens
aatgttttctttgcaaagtatt

SEQ ID NO: 5119752 - DNA, 12 bp, Homo sapiens
aatgttttgcta

SEQ ID NO: 5119753 - DNA, 14 bp, Homo sapiens
aatgttttgctttt

SEQ ID NO: 5119754 - DNA, 21 bp, Homo sapiens
aatgttttggtctgaaaagct

SEQ ID NO: 5119755 - DNA, 13 bp, Homo sapiens
aatgttttgtaaa

SEQ ID NO: 5119756 - DNA, 18 bp, Homo sapiens
aatgttttgtaaactttg

SEQ ID NO: 5119757 - DNA, 19 bp, Homo sapiens
aatgttttgtaaactttga

SEQ ID NO: 5119758 - DNA, 23 bp, Homo sapiens
aatgttttgtaaactttgaaata

SEQ ID NO: 5119759 - DNA, 14 bp, Homo sapiens
aatgttttgtatat

SEQ ID NO: 5119760 - DNA, 22 bp, Homo sapiens
aatgtttttaataaaagaaaat

SEQ ID NO: 5119761 - DNA, 13 bp, Homo sapiens
aatgtttttagaa

SEQ ID NO: 5119762 - DNA, 23 bp, Homo sapiens
aatgtttttagaacatgtaaaat

SEQ ID NO: 5119763 - DNA, 16 bp, Homo sapiens
aatgtttttattaaca

SEQ ID NO: 5119764 - DNA, 21 bp, Homo sapiens
aatgtttttatttcaattgtt

SEQ ID NO: 5119765 - DNA, 16 bp, Homo sapiens
aatgtttttccctccc

SEQ ID NO: 5119766 - DNA, 21 bp, Homo sapiens
aatgtttttccctccccagaa

SEQ ID NO: 5119767 - DNA, 14 bp, Homo sapiens
aatgtttttctcaa

SEQ ID NO: 5119768 - DNA, 17 bp, Homo sapiens
aatgtttttctcaaaaa

SEQ ID NO: 5119769 - DNA, 15 bp, Homo sapiens
aatgtttttctgcca

SEQ ID NO: 5119770 - DNA, 21 bp, Homo sapiens
aatgtttttctgccagggagc

SEQ ID NO: 5119771 - DNA, 14 bp, Homo sapiens
aatgtttttgtgta

SEQ ID NO: 5119772 - DNA, 23 bp, Homo sapiens
aatgttttttatacttcaaatgt

SEQ ID NO: 5119773 - DNA, 19 bp, Homo sapiens
aatgttttttcatgtgttt

SEQ ID NO: 5119774 - DNA, 15 bp, Homo sapiens
aatgttttttgccac

SEQ ID NO: 5119775 - DNA, 16 bp, Homo sapiens
aattaaaaaagataaa

SEQ ID NO: 5119776 - DNA, 18 bp, Homo sapiens
aattaaaaaatggtcagt

SEQ ID NO: 5119777 - DNA, 16 bp, Homo sapiens
aattaaaaacagaaaa

SEQ ID NO: 5119778 - DNA, 14 bp, Homo sapiens
aattaaaaaccact

SEQ ID NO: 5119779 - DNA, 12 bp, Homo sapiens
aattaaaaacta

SEQ ID NO: 5119780 - DNA, 23 bp, Homo sapiens
aattaaaaactgtgatttttatc

SEQ ID NO: 5119781 - DNA, 16 bp, Homo sapiens
aattaaaaactttaaa

SEQ ID NO: 5119782 - DNA, 15 bp, Homo sapiens
aattaaaaattactg

SEQ ID NO: 5119783 - DNA, 14 bp, Homo sapiens
aattaaaaattttt

SEQ ID NO: 5119784 - DNA, 14 bp, Homo sapiens
aattaaaacaaata

SEQ ID NO: 5119785 - DNA, 21 bp, Homo sapiens
aattaaaacaatgtcaaggtg

SEQ ID NO: 5119786 - DNA, 22 bp, Homo sapiens
aattaaaacatatttcatttta

SEQ ID NO: 5119787 - DNA, 12 bp, Homo sapiens
aattaaaaccat

SEQ ID NO: 5119788 - DNA, 13 bp, Homo sapiens
aattaaaaccatt

SEQ ID NO: 5119789 - DNA, 10 bp, Homo sapiens
aattaaaact

SEQ ID NO: 5119790 - DNA, 19 bp, Homo sapiens
aattaaaactattcatgct

SEQ ID NO: 5119791 - DNA, 20 bp, Homo sapiens
aattaaaactcaacattact

SEQ ID NO: 5119792 - DNA, 19 bp, Homo sapiens
aattaaaactcatttagga

SEQ ID NO: 5119793 - DNA, 11 bp, Homo sapiens
aattaaaactg

SEQ ID NO: 5119794 - DNA, 13 bp, Homo sapiens
aattaaaactgag

SEQ ID NO: 5119795 - DNA, 15 bp, Homo sapiens
aattaaaacttctta

SEQ ID NO: 5119796 - DNA, 16 bp, Homo sapiens
aattaaaacttcttaa

SEQ ID NO: 5119797 - DNA, 15 bp, Homo sapiens
aattaaaactttgta

SEQ ID NO: 5119798 - DNA, 19 bp, Homo sapiens
aattaaaactttgtagaca

SEQ ID NO: 5119799 - DNA, 22 bp, Homo sapiens
aattaaaactttgtagacattt

SEQ ID NO: 5119800 - DNA, 22 bp, Homo sapiens
aattaaaagaaatatacagttt

SEQ ID NO: 5119801 - DNA, 20 bp, Homo sapiens
aattaaaagcaaatcatttg

SEQ ID NO: 5119802 - DNA, 13 bp, Homo sapiens
aattaaaagtttg

SEQ ID NO: 5119803 - DNA, 13 bp, Homo sapiens
aattaaaatacta

SEQ ID NO: 5119804 - DNA, 12 bp, Homo sapiens
aattaaaatata

SEQ ID NO: 5119805 - DNA, 13 bp, Homo sapiens
aattaaaatatat

SEQ ID NO: 5119806 - DNA, 19 bp, Homo sapiens
aattaaaatatatataaat

SEQ ID NO: 5119807 - DNA, 22 bp, Homo sapiens
aattaaaatatatataaatata

SEQ ID NO: 5119808 - DNA, 15 bp, Homo sapiens
aattaaaatattatt

SEQ ID NO: 5119809 - DNA, 17 bp, Homo sapiens
aattaaaatattatttg

SEQ ID NO: 5119810 - DNA, 23 bp, Homo sapiens
aattaaaatattatttgatatct

SEQ ID NO: 5119811 - DNA, 13 bp, Homo sapiens
aattaaaatggat

SEQ ID NO: 5119812 - DNA, 21 bp, Homo sapiens
aattaaaatggatgccttgaa

SEQ ID NO: 5119813 - DNA, 20 bp, Homo sapiens
aattaaaatgtgcagtattt

SEQ ID NO: 5119814 - DNA, 21 bp, Homo sapiens
aattaaaattgtcccatttgc

SEQ ID NO: 5119815 - DNA, 13 bp, Homo sapiens
aattaaaattgtg

SEQ ID NO: 5119816 - DNA, 22 bp, Homo sapiens
aattaaaattgtgcataatgct

SEQ ID NO: 5119817 - DNA, 16 bp, Homo sapiens
aattaaaattttatga

SEQ ID NO: 5119818 - DNA, 14 bp, Homo sapiens
aattaaacaattta

SEQ ID NO: 5119819 - DNA, 16 bp, Homo sapiens
aattaaacatgctgtt

SEQ ID NO: 5119820 - DNA, 18 bp, Homo sapiens
aattaaaccaatgaagaa

SEQ ID NO: 5119821 - DNA, 23 bp, Homo sapiens
aattaaacccacaagctgcctct

SEQ ID NO: 5119822 - DNA, 15 bp, Homo sapiens
aattaaacggattat

SEQ ID NO: 5119823 - DNA, 17 bp, Homo sapiens
aattaaacggattattt

SEQ ID NO: 5119824 - DNA, 21 bp, Homo sapiens
aattaaacggattattttttc

SEQ ID NO: 5119825 - DNA, 14 bp, Homo sapiens
aattaaactacaga

SEQ ID NO: 5119826 - DNA, 14 bp, Homo sapiens
aattaaacttcaaa

SEQ ID NO: 5119827 - DNA, 12 bp, Homo sapiens
aattaaagaaaa

SEQ ID NO: 5119828 - DNA, 13 bp, Homo sapiens
aattaaagaaaat

SEQ ID NO: 5119829 - DNA, 17 bp, Homo sapiens
aattaaagaaaataaaa

SEQ ID NO: 5119830 - DNA, 18 bp, Homo sapiens
aattaaagaaaattaatt

SEQ ID NO: 5119831 - DNA, 17 bp, Homo sapiens
aattaaagaaaattgcc

SEQ ID NO: 5119832 - DNA, 20 bp, Homo sapiens
aattaaagaaaattgccaaa

SEQ ID NO: 5119833 - DNA, 21 bp, Homo sapiens
aattaaagaaaattgccaaaa

SEQ ID NO: 5119834 - DNA, 22 bp, Homo sapiens
aattaaagaaaattgccaaaat

SEQ ID NO: 5119835 - DNA, 14 bp, Homo sapiens
aattaaagaaatga

SEQ ID NO: 5119836 - DNA, 18 bp, Homo sapiens
aattaaagaatttaaaaa

SEQ ID NO: 5119837 - DNA, 19 bp, Homo sapiens
aattaaagatggtttatgc

SEQ ID NO: 5119838 - DNA, 15 bp, Homo sapiens
aattaaagcagcaaa

SEQ ID NO: 5119839 - DNA, 13 bp, Homo sapiens
aattaaagcctta

SEQ ID NO: 5119840 - DNA, 16 bp, Homo sapiens
aattaaagtactttaa

SEQ ID NO: 5119841 - DNA, 21 bp, Homo sapiens
aattaaagtctacactgcctt

SEQ ID NO: 5119842 - DNA, 12 bp, Homo sapiens
aattaaagtctt

SEQ ID NO: 5119843 - DNA, 15 bp, Homo sapiens
aattaaagtgctgtt

SEQ ID NO: 5119844 - DNA, 19 bp, Homo sapiens
aattaaagtgctgtttaga

SEQ ID NO: 5119845 - DNA, 12 bp, Homo sapiens
aattaaagtgtc

SEQ ID NO: 5119846 - DNA, 24 bp, Homo sapiens
aattaaataaactgttttcaagtc

SEQ ID NO: 5119847 - DNA, 17 bp, Homo sapiens
aattaaataaattttaa

SEQ ID NO: 5119848 - DNA, 14 bp, Homo sapiens
aattaaatactttt

SEQ ID NO: 5119849 - DNA, 16 bp, Homo sapiens
aattaaatactttttc

SEQ ID NO: 5119850 - DNA, 17 bp, Homo sapiens
aattaaatccaataaaa

SEQ ID NO: 5119851 - DNA, 17 bp, Homo sapiens
aattaaatctagacatt

SEQ ID NO: 5119852 - DNA, 16 bp, Homo sapiens
aattaaatgaaatact

SEQ ID NO: 5119853 - DNA, 22 bp, Homo sapiens
aattaaatgacttagaaacaat

SEQ ID NO: 5119854 - DNA, 11 bp, Homo sapiens
aattaaatgta

SEQ ID NO: 5119855 - DNA, 17 bp, Homo sapiens
aattaaattttgtgtct

SEQ ID NO: 5119856 - DNA, 19 bp, Homo sapiens
aattaacaaagaatttcag

SEQ ID NO: 5119857 - DNA, 20 bp, Homo sapiens
aattaacaagaactcattat

SEQ ID NO: 5119858 - DNA, 21 bp, Homo sapiens
aattaacaagaactcattatt

SEQ ID NO: 5119859 - DNA, 16 bp, Homo sapiens
aattaacaataaagaa

SEQ ID NO: 5119860 - DNA, 15 bp, Homo sapiens
aattaacacaaagga

SEQ ID NO: 5119861 - DNA, 20 bp, Homo sapiens
aattaacacagtgtttcaat

SEQ ID NO: 5119862 - DNA, 21 bp, Homo sapiens
aattaacacagtgtttcaatt

SEQ ID NO: 5119863 - DNA, 14 bp, Homo sapiens
aattaacagaaaaa

SEQ ID NO: 5119864 - DNA, 19 bp, Homo sapiens
aattaacatataatatatg

SEQ ID NO: 5119865 - DNA, 15 bp, Homo sapiens
aattaacatatcttt

SEQ ID NO: 5119866 - DNA, 12 bp, Homo sapiens
aattaacatcaa

SEQ ID NO: 5119867 - DNA, 19 bp, Homo sapiens
aattaacatgttaaaccat

SEQ ID NO: 5119868 - DNA, 20 bp, Homo sapiens
aattaacatgttaaaccatg

SEQ ID NO: 5119869 - DNA, 15 bp, Homo sapiens
aattaaccatttaat

SEQ ID NO: 5119870 - DNA, 19 bp, Homo sapiens
aattaaccatttaataaag

SEQ ID NO: 5119871 - DNA, 20 bp, Homo sapiens
aattaaccccataattagat

SEQ ID NO: 5119872 - DNA, 21 bp, Homo sapiens
aattaacctttcaggaaagta

SEQ ID NO: 5119873 - DNA, 20 bp, Homo sapiens
aattaactataacaatcact

SEQ ID NO: 5119874 - DNA, 19 bp, Homo sapiens
aattaactatgtgatgtta

SEQ ID NO: 5119875 - DNA, 21 bp, Homo sapiens
aattaactcactatggttttt

SEQ ID NO: 5119876 - DNA, 19 bp, Homo sapiens
aattaactccgtttccaaa

SEQ ID NO: 5119877 - DNA, 23 bp, Homo sapiens
aattaactccgtttccaaataca

SEQ ID NO: 5119878 - DNA, 14 bp, Homo sapiens
aattaactgaaaca

SEQ ID NO: 5119879 - DNA, 18 bp, Homo sapiens
aattaactgaagcaaata

SEQ ID NO: 5119880 - DNA, 21 bp, Homo sapiens
aattaactgggtaatgaaaca

SEQ ID NO: 5119881 - DNA, 23 bp, Homo sapiens
aattaactgtaaacttggaatca

SEQ ID NO: 5119882 - DNA, 14 bp, Homo sapiens
aattaacttagttt

SEQ ID NO: 5119883 - DNA, 15 bp, Homo sapiens
aattaacttagtttt

SEQ ID NO: 5119884 - DNA, 11 bp, Homo sapiens
aattaactttt

SEQ ID NO: 5119885 - DNA, 12 bp, Homo sapiens
aattaactttta

SEQ ID NO: 5119886 - DNA, 15 bp, Homo sapiens
aattaagaaaactat

SEQ ID NO: 5119887 - DNA, 13 bp, Homo sapiens
aattaagaaagat

SEQ ID NO: 5119888 - DNA, 20 bp, Homo sapiens
aattaagaaagattaaatat

SEQ ID NO: 5119889 - DNA, 21 bp, Homo sapiens
aattaagaaagattaaatata

SEQ ID NO: 5119890 - DNA, 21 bp, Homo sapiens
aattaagaaaggataaagttg

SEQ ID NO: 5119891 - DNA, 14 bp, Homo sapiens
aattaagaactgaa

SEQ ID NO: 5119892 - DNA, 15 bp, Homo sapiens
aattaagaactgaat

SEQ ID NO: 5119893 - DNA, 15 bp, Homo sapiens
aattaagaagaaaat

SEQ ID NO: 5119894 - DNA, 14 bp, Homo sapiens
aattaagaaggcaa

SEQ ID NO: 5119895 - DNA, 19 bp, Homo sapiens
aattaagaaggcaaaaatg

SEQ ID NO: 5119896 - DNA, 19 bp, Homo sapiens
aattaagaggatacacacg

SEQ ID NO: 5119897 - DNA, 18 bp, Homo sapiens
aattaagatcctaaactc

SEQ ID NO: 5119898 - DNA, 22 bp, Homo sapiens
aattaagatcctaaactctcta

SEQ ID NO: 5119899 - DNA, 21 bp, Homo sapiens
aattaagcattttgaaacaaa

SEQ ID NO: 5119900 - DNA, 23 bp, Homo sapiens
aattaagcattttgaaacaaagt

SEQ ID NO: 5119901 - DNA, 19 bp, Homo sapiens
aattaagccctaaggtcct

SEQ ID NO: 5119902 - DNA, 19 bp, Homo sapiens
aattaagctccttcagttt

SEQ ID NO: 5119903 - DNA, 18 bp, Homo sapiens
aattaagctctcatagct

SEQ ID NO: 5119904 - DNA, 16 bp, Homo sapiens
aattaaggaaatgtta

SEQ ID NO: 5119905 - DNA, 20 bp, Homo sapiens
aattaaggattttatgcttt

SEQ ID NO: 5119906 - DNA, 15 bp, Homo sapiens
aattaaggccagagg

SEQ ID NO: 5119907 - DNA, 21 bp, Homo sapiens
aattaagggttaaatcagaga

SEQ ID NO: 5119908 - DNA, 20 bp, Homo sapiens
aattaaggtacatcattatt

SEQ ID NO: 5119909 - DNA, 17 bp, Homo sapiens
aattaaggtgtttgaaa

SEQ ID NO: 5119910 - DNA, 17 bp, Homo sapiens
aattaaggtttgccctg

SEQ ID NO: 5119911 - DNA, 13 bp, Homo sapiens
aattaaggtttgt

SEQ ID NO: 5119912 - DNA, 15 bp, Homo sapiens
aattaagtatatata

SEQ ID NO: 5119913 - DNA, 13 bp, Homo sapiens
aattaagtatctg

SEQ ID NO: 5119914 - DNA, 15 bp, Homo sapiens
aattaagtgcaattt

SEQ ID NO: 5119915 - DNA, 14 bp, Homo sapiens
aattaagttatctt

SEQ ID NO: 5119916 - DNA, 18 bp, Homo sapiens
aattaagttattaacatt

SEQ ID NO: 5119917 - DNA, 12 bp, Homo sapiens
aattaagttgaa

SEQ ID NO: 5119918 - DNA, 13 bp, Homo sapiens
aattaagttgaaa

SEQ ID NO: 5119919 - DNA, 14 bp, Homo sapiens
aattaagttgaaaa

SEQ ID NO: 5119920 - DNA, 16 bp, Homo sapiens
aattaagttgaaaaag

SEQ ID NO: 5119921 - DNA, 19 bp, Homo sapiens
aattaagttgttgaaagta

SEQ ID NO: 5119922 - DNA, 21 bp, Homo sapiens
aattaataaatcatgttttga

SEQ ID NO: 5119923 - DNA, 18 bp, Homo sapiens
aatgcaaagatgaaggtc

SEQ ID NO: 5119924 - DNA, 15 bp, Homo sapiens
aatgcaaagctgaag

SEQ ID NO: 5119925 - DNA, 19 bp, Homo sapiens
aatgcaaagctgaagacca

SEQ ID NO: 5119926 - DNA, 23 bp, Homo sapiens
aatgcaaagttctgtgtttaatt

SEQ ID NO: 5119927 - DNA, 16 bp, Homo sapiens
aatgcaaatcctatgt

SEQ ID NO: 5119928 - DNA, 12 bp, Homo sapiens
aatgcaaatgaa

SEQ ID NO: 5119929 - DNA, 13 bp, Homo sapiens
aatgcaaatgaat

SEQ ID NO: 5119930 - DNA, 14 bp, Homo sapiens
aatgcaaatgaatc

SEQ ID NO: 5119931 - DNA, 13 bp, Homo sapiens
aatgcaaattaaa

SEQ ID NO: 5119932 - DNA, 21 bp, Homo sapiens
aatgcaaattaaaacatattt

SEQ ID NO: 5119933 - DNA, 12 bp, Homo sapiens
aatgcaaattca

SEQ ID NO: 5119934 - DNA, 19 bp, Homo sapiens
aatgcaaatttctataaat

SEQ ID NO: 5119935 - DNA, 17 bp, Homo sapiens
aatgcaaccagaattgt

SEQ ID NO: 5119936 - DNA, 18 bp, Homo sapiens
aatgcaaccatttgaaac

SEQ ID NO: 5119937 - DNA, 18 bp, Homo sapiens
aatgcaagagaacatttt

SEQ ID NO: 5119938 - DNA, 22 bp, Homo sapiens
aatgcaagagtgattgcagctt

SEQ ID NO: 5119939 - DNA, 14 bp, Homo sapiens
aatgcaataatttt

SEQ ID NO: 5119940 - DNA, 17 bp, Homo sapiens
aatgcaataattttact

SEQ ID NO: 5119941 - DNA, 17 bp, Homo sapiens
aatgcaatagaagtgct

SEQ ID NO: 5119942 - DNA, 17 bp, Homo sapiens
aatgcaatgaaaacaaa

SEQ ID NO: 5119943 - DNA, 22 bp, Homo sapiens
aatgcaatgtcttaaataaaac

SEQ ID NO: 5119944 - DNA, 13 bp, Homo sapiens
aatgcaattagat

SEQ ID NO: 5119945 - DNA, 21 bp, Homo sapiens
aatgcaattagatagaaaagg

SEQ ID NO: 5119946 - DNA, 16 bp, Homo sapiens
aatgcaatttaaaatt

SEQ ID NO: 5119947 - DNA, 18 bp, Homo sapiens
aatgcacaaacagaggcc

SEQ ID NO: 5119948 - DNA, 21 bp, Homo sapiens
aatgcacaaattgaaaacaca

SEQ ID NO: 5119949 - DNA, 14 bp, Homo sapiens
aatgcacaatgtct

SEQ ID NO: 5119950 - DNA, 15 bp, Homo sapiens
aatgcacaatgtctt

SEQ ID NO: 5119951 - DNA, 17 bp, Homo sapiens
aatgcacaatttagaaa

SEQ ID NO: 5119952 - DNA, 16 bp, Homo sapiens
aatgcacacacctcat

SEQ ID NO: 5119953 - DNA, 17 bp, Homo sapiens
aatgcacactagcctct

SEQ ID NO: 5119954 - DNA, 13 bp, Homo sapiens
aatgcacagggca

SEQ ID NO: 5119955 - DNA, 17 bp, Homo sapiens
aatgcacagttctattt

SEQ ID NO: 5119956 - DNA, 21 bp, Homo sapiens
aatgcacatcctcattcacta

SEQ ID NO: 5119957 - DNA, 19 bp, Homo sapiens
aatgcacccatcagcactc

SEQ ID NO: 5119958 - DNA, 13 bp, Homo sapiens
aatgcacctggaa

SEQ ID NO: 5119959 - DNA, 19 bp, Homo sapiens
aatgcacgtagctgaggcc

SEQ ID NO: 5119960 - DNA, 14 bp, Homo sapiens
aatgcactcctgcc

SEQ ID NO: 5119961 - DNA, 21 bp, Homo sapiens
aatgcactggggtaccacatg

SEQ ID NO: 5119962 - DNA, 21 bp, Homo sapiens
aatgcactgtgacaccagaat

SEQ ID NO: 5119963 - DNA, 15 bp, Homo sapiens
aatgcactgttttta

SEQ ID NO: 5119964 - DNA, 15 bp, Homo sapiens
aatgcacttctattt

SEQ ID NO: 5119965 - DNA, 20 bp, Homo sapiens
aatgcacttgattcaggagg

SEQ ID NO: 5119966 - DNA, 11 bp, Homo sapiens
aatgcactttc

SEQ ID NO: 5119967 - DNA, 13 bp, Homo sapiens
aatgcactttcta

SEQ ID NO: 5119968 - DNA, 15 bp, Homo sapiens
aatgcactttctatc

SEQ ID NO: 5119969 - DNA, 19 bp, Homo sapiens
aatgcactttgttctggct

SEQ ID NO: 5119970 - DNA, 21 bp, Homo sapiens
aatgcagaaccacaaacaatt

SEQ ID NO: 5119971 - DNA, 12 bp, Homo sapiens
aatgcagaactc

SEQ ID NO: 5119972 - DNA, 16 bp, Homo sapiens
aatgcagaagcaaaca

SEQ ID NO: 5119973 - DNA, 17 bp, Homo sapiens
aatgcagaagcaaacaa

SEQ ID NO: 5119974 - DNA, 16 bp, Homo sapiens
aatgcagacatttaca

SEQ ID NO: 5119975 - DNA, 19 bp, Homo sapiens
aatgcagagatgtgccccc

SEQ ID NO: 5119976 - DNA, 17 bp, Homo sapiens
aatgcagattacactga

SEQ ID NO: 5119977 - DNA, 17 bp, Homo sapiens
aatgcagattcctgggc

SEQ ID NO: 5119978 - DNA, 18 bp, Homo sapiens
aatgcagatttctcttta

SEQ ID NO: 5119979 - DNA, 17 bp, Homo sapiens
aatgcagcacccttgcc

SEQ ID NO: 5119980 - DNA, 16 bp, Homo sapiens
aatgcagcactgctgc

SEQ ID NO: 5119981 - DNA, 19 bp, Homo sapiens
aatgcagcactgctgcctc

SEQ ID NO: 5119982 - DNA, 20 bp, Homo sapiens
aatgcagcactgctgcctca

SEQ ID NO: 5119983 - DNA, 13 bp, Homo sapiens
aatgcagcaggaa

SEQ ID NO: 5119984 - DNA, 15 bp, Homo sapiens
aatgcagcaggaagg

SEQ ID NO: 5119985 - DNA, 20 bp, Homo sapiens
aatgcagcagggatgccctg

SEQ ID NO: 5119986 - DNA, 22 bp, Homo sapiens
aatgcagcagggatgccctgga

SEQ ID NO: 5119987 - DNA, 21 bp, Homo sapiens
aatgcagccacgattggagaa

SEQ ID NO: 5119988 - DNA, 12 bp, Homo sapiens
aatgcagccaga

SEQ ID NO: 5119989 - DNA, 20 bp, Homo sapiens
aatgcagcccatttctccag

SEQ ID NO: 5119990 - DNA, 21 bp, Homo sapiens
aatgcagcccatttctccaga

SEQ ID NO: 5119991 - DNA, 14 bp, Homo sapiens
aatgcagcgtgaag

SEQ ID NO: 5119992 - DNA, 17 bp, Homo sapiens
aatgcaggagagcttcc

SEQ ID NO: 5119993 - DNA, 20 bp, Homo sapiens
aatgcaggccccgccccctc

SEQ ID NO: 5119994 - DNA, 20 bp, Homo sapiens
aatgcagtacaggacatata

SEQ ID NO: 5119995 - DNA, 15 bp, Homo sapiens
aatgcagtataaaat

SEQ ID NO: 5119996 - DNA, 23 bp, Homo sapiens
aatgcagtatccgcgagcctgct

SEQ ID NO: 5119997 - DNA, 16 bp, Homo sapiens
aatgcagtatggtaca

SEQ ID NO: 5119998 - DNA, 17 bp, Homo sapiens
aatgcagtatggtacat

SEQ ID NO: 5119999 - DNA, 23 bp, Homo sapiens
aatgcagtatggtacatttttca

SEQ ID NO: 5120000 - DNA, 16 bp, Homo sapiens
aatgcagtccagaata

SEQ ID NO: 5120001 - DNA, 17 bp, Homo sapiens
aatgcagtccagaataa

SEQ ID NO: 5120002 - DNA, 19 bp, Homo sapiens
aatgcagtccagaataagt

SEQ ID NO: 5120003 - DNA, 17 bp, Homo sapiens
aatgcagtcctgaggag

SEQ ID NO: 5120004 - DNA, 20 bp, Homo sapiens
aatgcagtcctgaggagagg

SEQ ID NO: 5120005 - DNA, 20 bp, Homo sapiens
aatgcagtgacacaatctcg

SEQ ID NO: 5120006 - DNA, 17 bp, Homo sapiens
aatgcagttacaaatta

SEQ ID NO: 5120007 - DNA, 20 bp, Homo sapiens
aatgcagttacaaattataa

SEQ ID NO: 5120008 - DNA, 23 bp, Homo sapiens
aatgcagttacaaattataatgt

SEQ ID NO: 5120009 - DNA, 15 bp, Homo sapiens
aatgcagttgtctct

SEQ ID NO: 5120010 - DNA, 22 bp, Homo sapiens
aatgcagttgtggtgtgccatg

SEQ ID NO: 5120011 - DNA, 14 bp, Homo sapiens
aatgcataaatgca

SEQ ID NO: 5120012 - DNA, 22 bp, Homo sapiens
aatgcataaatgcataatttat

SEQ ID NO: 5120013 - DNA, 13 bp, Homo sapiens
aatgcataatgtt

SEQ ID NO: 5120014 - DNA, 21 bp, Homo sapiens
aatgcataattggcaaaaaaa

SEQ ID NO: 5120015 - DNA, 14 bp, Homo sapiens
aatgcatacaagtt

SEQ ID NO: 5120016 - DNA, 14 bp, Homo sapiens
aatgcatacaataa

SEQ ID NO: 5120017 - DNA, 20 bp, Homo sapiens
aatgcatacaataaaagagc

SEQ ID NO: 5120018 - DNA, 17 bp, Homo sapiens
aatgcatacagaaatat

SEQ ID NO: 5120019 - DNA, 18 bp, Homo sapiens
aatgcatactgttgatac

SEQ ID NO: 5120020 - DNA, 13 bp, Homo sapiens
aatgcatagagca

SEQ ID NO: 5120021 - DNA, 15 bp, Homo sapiens
aatgcatatctgttt

SEQ ID NO: 5120022 - DNA, 18 bp, Homo sapiens
aatgcatattcaacacac

SEQ ID NO: 5120023 - DNA, 14 bp, Homo sapiens
aatgcatatttata

SEQ ID NO: 5120024 - DNA, 18 bp, Homo sapiens
aatgcatatttataagag

SEQ ID NO: 5120025 - DNA, 14 bp, Homo sapiens
aatgcatatttgca

SEQ ID NO: 5120026 - DNA, 17 bp, Homo sapiens
aatgcatatttgcaaag

SEQ ID NO: 5120027 - DNA, 20 bp, Homo sapiens
aatgcatatttttgcacagt

SEQ ID NO: 5120028 - DNA, 17 bp, Homo sapiens
aatgcatcacatgatga

SEQ ID NO: 5120029 - DNA, 22 bp, Homo sapiens
aatgcatcacgtaccccactgg

SEQ ID NO: 5120030 - DNA, 23 bp, Homo sapiens
aatgcatcacgtaccccactggg

SEQ ID NO: 5120031 - DNA, 19 bp, Homo sapiens
aatgcatccattcctcagg

SEQ ID NO: 5120032 - DNA, 16 bp, Homo sapiens
aatgcatctagattat

SEQ ID NO: 5120033 - DNA, 18 bp, Homo sapiens
aatgcatctgaaagtttt

SEQ ID NO: 5120034 - DNA, 21 bp, Homo sapiens
aatgcatctgaaagttttgat

SEQ ID NO: 5120035 - DNA, 15 bp, Homo sapiens
aatgcatctttgatg

SEQ ID NO: 5120036 - DNA, 15 bp, Homo sapiens
aatgcatgaagcaac

SEQ ID NO: 5120037 - DNA, 14 bp, Homo sapiens
aatgcatgatattg

SEQ ID NO: 5120038 - DNA, 16 bp, Homo sapiens
aatgcatgatgactct

SEQ ID NO: 5120039 - DNA, 21 bp, Homo sapiens
aatgcatgattttatacatag

SEQ ID NO: 5120040 - DNA, 22 bp, Homo sapiens
aatgcatgattttatacatagt

SEQ ID NO: 5120041 - DNA, 18 bp, Homo sapiens
aatgcatgctttccatat

SEQ ID NO: 5120042 - DNA, 15 bp, Homo sapiens
aatgcatgctttgga

SEQ ID NO: 5120043 - DNA, 18 bp, Homo sapiens
aatgcatgttaggaaaat

SEQ ID NO: 5120044 - DNA, 13 bp, Homo sapiens
aatgcattaaacc

SEQ ID NO: 5120045 - DNA, 19 bp, Homo sapiens
aatgcattaataaaaatca

SEQ ID NO: 5120046 - DNA, 22 bp, Homo sapiens
aatgcattataggatcatttgt

SEQ ID NO: 5120047 - DNA, 23 bp, Homo sapiens
aatgcattataggatcatttgtt

SEQ ID NO: 5120048 - DNA, 19 bp, Homo sapiens
aatgcattcaaaatataac

SEQ ID NO: 5120049 - DNA, 13 bp, Homo sapiens
aatgcattcaaag

SEQ ID NO: 5120050 - DNA, 18 bp, Homo sapiens
aatgcattcaaagtaata

SEQ ID NO: 5120051 - DNA, 12 bp, Homo sapiens
aatgcattcatg

SEQ ID NO: 5120052 - DNA, 14 bp, Homo sapiens
aatgcattcatgtt

SEQ ID NO: 5120053 - DNA, 18 bp, Homo sapiens
aatgcattccctgaatct

SEQ ID NO: 5120054 - DNA, 14 bp, Homo sapiens
aatgcattgaaaga

SEQ ID NO: 5120055 - DNA, 19 bp, Homo sapiens
aatgcattgatattgtgaa

SEQ ID NO: 5120056 - DNA, 22 bp, Homo sapiens
aatgcattgatattgtgaacat

SEQ ID NO: 5120057 - DNA, 16 bp, Homo sapiens
aatgcattgcctgtaa

SEQ ID NO: 5120058 - DNA, 16 bp, Homo sapiens
aatgcattggcctctg

SEQ ID NO: 5120059 - DNA, 10 bp, Homo sapiens
aatgcattgt

SEQ ID NO: 5120060 - DNA, 20 bp, Homo sapiens
aatgcattgtgaattgcctg

SEQ ID NO: 5120061 - DNA, 21 bp, Homo sapiens
aatgcattgtgaattgcctgc

SEQ ID NO: 5120062 - DNA, 23 bp, Homo sapiens
aatgcattgtggatatgagcttt

SEQ ID NO: 5120063 - DNA, 10 bp, Homo sapiens
aatgcattta

SEQ ID NO: 5120064 - DNA, 12 bp, Homo sapiens
aatgcatttaaa

SEQ ID NO: 5120065 - DNA, 16 bp, Homo sapiens
aatgcatttaagttgt

SEQ ID NO: 5120066 - DNA, 17 bp, Homo sapiens
aatgcatttaagttgta

SEQ ID NO: 5120067 - DNA, 18 bp, Homo sapiens
aatgcatttaagttgtaa

SEQ ID NO: 5120068 - DNA, 21 bp, Homo sapiens
aatgcatttatagatcatttc

SEQ ID NO: 5120069 - DNA, 19 bp, Homo sapiens
aatgcatttctgtggatac

SEQ ID NO: 5120070 - DNA, 14 bp, Homo sapiens
aatgcattttgctg

SEQ ID NO: 5120071 - DNA, 22 bp, Homo sapiens
aatgcatttttatcatgtaaca

SEQ ID NO: 5120072 - DNA, 18 bp, Homo sapiens
aatgccaaaaatgtgcct

SEQ ID NO: 5120073 - DNA, 15 bp, Homo sapiens
aatgccaaagccatt

SEQ ID NO: 5120074 - DNA, 15 bp, Homo sapiens
aatgccaaattaaaa

SEQ ID NO: 5120075 - DNA, 22 bp, Homo sapiens
aatgccaaattaaaaaagataa

SEQ ID NO: 5120076 - DNA, 19 bp, Homo sapiens
aatgccaactggtcactgt

SEQ ID NO: 5120077 - DNA, 18 bp, Homo sapiens
aatgccaactgttggaat

SEQ ID NO: 5120078 - DNA, 19 bp, Homo sapiens
aatgccaagggggtgactg

SEQ ID NO: 5120079 - DNA, 16 bp, Homo sapiens
aatgccaagtgcctgc

SEQ ID NO: 5120080 - DNA, 19 bp, Homo sapiens
aatgccacacattgtgctt

SEQ ID NO: 5120081 - DNA, 14 bp, Homo sapiens
aatgccacagccct

SEQ ID NO: 5120082 - DNA, 18 bp, Homo sapiens
aatgccacagccctgtca

SEQ ID NO: 5120083 - DNA, 19 bp, Homo sapiens
aatgccacagccctgtcag

SEQ ID NO: 5120084 - DNA, 22 bp, Homo sapiens
aatgccacagccctgtcagcat

SEQ ID NO: 5120085 - DNA, 19 bp, Homo sapiens
aatgccacctagactctcc

SEQ ID NO: 5120086 - DNA, 23 bp, Homo sapiens
aatgccacggcagccaccctgcc

SEQ ID NO: 5120087 - DNA, 17 bp, Homo sapiens
aatgccactccctaccc

SEQ ID NO: 5120088 - DNA, 22 bp, Homo sapiens
aatgccactgggacagctggct

SEQ ID NO: 5120089 - DNA, 16 bp, Homo sapiens
aatgccacttaacagg

SEQ ID NO: 5120090 - DNA, 21 bp, Homo sapiens
aatgccagacttctaaaataa

SEQ ID NO: 5120091 - DNA, 12 bp, Homo sapiens
aatgccagagcc

SEQ ID NO: 5120092 - DNA, 20 bp, Homo sapiens
aatgccagagccaacctgga

SEQ ID NO: 5120093 - DNA, 21 bp, Homo sapiens
aatgccagagccaacctggac

SEQ ID NO: 5120094 - DNA, 23 bp, Homo sapiens
aatgccagagccaacctggactt

SEQ ID NO: 5120095 - DNA, 13 bp, Homo sapiens
aatgccagatgtt

SEQ ID NO: 5120096 - DNA, 18 bp, Homo sapiens
aatgccaggacagctgca

SEQ ID NO: 5120097 - DNA, 18 bp, Homo sapiens
aatgccaggatttctcat

SEQ ID NO: 5120098 - DNA, 20 bp, Homo sapiens
aatgccaggcggacaaagtt

SEQ ID NO: 5120099 - DNA, 11 bp, Homo sapiens
aatgccagggc

SEQ ID NO: 5120100 - DNA, 13 bp, Homo sapiens
aatgccagggccc

SEQ ID NO: 5120101 - DNA, 23 bp, Homo sapiens
aatgccatagtcaaagagagttt

SEQ ID NO: 5120102 - DNA, 12 bp, Homo sapiens
aattaataaatt

SEQ ID NO: 5120103 - DNA, 12 bp, Homo sapiens
aattaatacata

SEQ ID NO: 5120104 - DNA, 17 bp, Homo sapiens
aattaatagcttttgat

SEQ ID NO: 5120105 - DNA, 13 bp, Homo sapiens
aattaatatcttt

SEQ ID NO: 5120106 - DNA, 17 bp, Homo sapiens
aattaatatctttctgc

SEQ ID NO: 5120107 - DNA, 15 bp, Homo sapiens
aattaatatgttcat

SEQ ID NO: 5120108 - DNA, 15 bp, Homo sapiens
aattaatatttatgt

SEQ ID NO: 5120109 - DNA, 22 bp, Homo sapiens
aattaatatttgtgctttgaaa

SEQ ID NO: 5120110 - DNA, 23 bp, Homo sapiens
aattaatattttggcagatgata

SEQ ID NO: 5120111 - DNA, 18 bp, Homo sapiens
aattaatcatctggattt

SEQ ID NO: 5120112 - DNA, 16 bp, Homo sapiens
aattaatcatgaatgt

SEQ ID NO: 5120113 - DNA, 19 bp, Homo sapiens
aattaatcgaaatgaattt

SEQ ID NO: 5120114 - DNA, 18 bp, Homo sapiens
aattaatctagaaaatga

SEQ ID NO: 5120115 - DNA, 14 bp, Homo sapiens
aattaatcttttaa

SEQ ID NO: 5120116 - DNA, 17 bp, Homo sapiens
aattaatcttttaaaaa

SEQ ID NO: 5120117 - DNA, 19 bp, Homo sapiens
aattaatgaagttgattca

SEQ ID NO: 5120118 - DNA, 21 bp, Homo sapiens
aattaatgatgaggatctgaa

SEQ ID NO: 5120119 - DNA, 14 bp, Homo sapiens
aattaatgattctg

SEQ ID NO: 5120120 - DNA, 14 bp, Homo sapiens
aattaatgcattca

SEQ ID NO: 5120121 - DNA, 16 bp, Homo sapiens
aattaatgcttagtga

SEQ ID NO: 5120122 - DNA, 16 bp, Homo sapiens
aattaatgtgtaaaat

SEQ ID NO: 5120123 - DNA, 20 bp, Homo sapiens
aattaatgtgtaaaattgga

SEQ ID NO: 5120124 - DNA, 14 bp, Homo sapiens
aattaatgtgtgtc

SEQ ID NO: 5120125 - DNA, 16 bp, Homo sapiens
aattaattaacatcaa

SEQ ID NO: 5120126 - DNA, 13 bp, Homo sapiens
aattaattaatta

SEQ ID NO: 5120127 - DNA, 17 bp, Homo sapiens
aattaattccttcagca

SEQ ID NO: 5120128 - DNA, 13 bp, Homo sapiens
aattaattctaaa

SEQ ID NO: 5120129 - DNA, 15 bp, Homo sapiens
aattaattctaaact

SEQ ID NO: 5120130 - DNA, 16 bp, Homo sapiens
aattaattctaaactt

SEQ ID NO: 5120131 - DNA, 15 bp, Homo sapiens
aattaattgaatcta

SEQ ID NO: 5120132 - DNA, 15 bp, Homo sapiens
aattaattgtgcctg

SEQ ID NO: 5120133 - DNA, 15 bp, Homo sapiens
aattaattgtgtgaa

SEQ ID NO: 5120134 - DNA, 15 bp, Homo sapiens
aattaatttgattaa

SEQ ID NO: 5120135 - DNA, 22 bp, Homo sapiens
aattaatttgattaacaaatat

SEQ ID NO: 5120136 - DNA, 15 bp, Homo sapiens
aattaatttgtgaat

SEQ ID NO: 5120137 - DNA, 18 bp, Homo sapiens
aattaatttgtgaatttg

SEQ ID NO: 5120138 - DNA, 11 bp, Homo sapiens
aattaattttt

SEQ ID NO: 5120139 - DNA, 22 bp, Homo sapiens
aattaatttttttattgtttaa

SEQ ID NO: 5120140 - DNA, 20 bp, Homo sapiens
aattacaaaagagcagcatt

SEQ ID NO: 5120141 - DNA, 19 bp, Homo sapiens
aattacaaaatgaagtttt

SEQ ID NO: 5120142 - DNA, 18 bp, Homo sapiens
aattacaaacaataagaa

SEQ ID NO: 5120143 - DNA, 16 bp, Homo sapiens
aattacaaagaaaata

SEQ ID NO: 5120144 - DNA, 16 bp, Homo sapiens
aattacaactaaatta

SEQ ID NO: 5120145 - DNA, 14 bp, Homo sapiens
aattacaactaagt

SEQ ID NO: 5120146 - DNA, 19 bp, Homo sapiens
aattacaaggcaatggaaa

SEQ ID NO: 5120147 - DNA, 17 bp, Homo sapiens
aattacaagtattcagt

SEQ ID NO: 5120148 - DNA, 21 bp, Homo sapiens
aattacaagtattcagttcca

SEQ ID NO: 5120149 - DNA, 14 bp, Homo sapiens
aattacaagtttca

SEQ ID NO: 5120150 - DNA, 14 bp, Homo sapiens
aattacaatacaaa

SEQ ID NO: 5120151 - DNA, 20 bp, Homo sapiens
aattacaatttctttaaatc

SEQ ID NO: 5120152 - DNA, 23 bp, Homo sapiens
aattacaatttctttaaatcatt

SEQ ID NO: 5120153 - DNA, 19 bp, Homo sapiens
aattacaattttatctgtt

SEQ ID NO: 5120154 - DNA, 17 bp, Homo sapiens
aattacacaataaagca

SEQ ID NO: 5120155 - DNA, 15 bp, Homo sapiens
aattacacccatgca

SEQ ID NO: 5120156 - DNA, 14 bp, Homo sapiens
aattacactacaag

SEQ ID NO: 5120157 - DNA, 17 bp, Homo sapiens
aattacactacaagttt

SEQ ID NO: 5120158 - DNA, 18 bp, Homo sapiens
aattacactataatataa

SEQ ID NO: 5120159 - DNA, 19 bp, Homo sapiens
aattacactgtgccttttc

SEQ ID NO: 5120160 - DNA, 13 bp, Homo sapiens
aattacagaaaat

SEQ ID NO: 5120161 - DNA, 12 bp, Homo sapiens
aattacagaaga

SEQ ID NO: 5120162 - DNA, 14 bp, Homo sapiens
aattacagaagaag

SEQ ID NO: 5120163 - DNA, 20 bp, Homo sapiens
aattacagaagaagctcctg

SEQ ID NO: 5120164 - DNA, 23 bp, Homo sapiens
aattacagaagagtttcttaact

SEQ ID NO: 5120165 - DNA, 17 bp, Homo sapiens
aattacagcttcaccct

SEQ ID NO: 5120166 - DNA, 15 bp, Homo sapiens
aattacagcttttat

SEQ ID NO: 5120167 - DNA, 19 bp, Homo sapiens
aattacagcttttatggat

SEQ ID NO: 5120168 - DNA, 21 bp, Homo sapiens
aattacagcttttatggatga

SEQ ID NO: 5120169 - DNA, 15 bp, Homo sapiens
aattacaggagggaa

SEQ ID NO: 5120170 - DNA, 19 bp, Homo sapiens
aattacagggtgactcaca

SEQ ID NO: 5120171 - DNA, 15 bp, Homo sapiens
aattacaggttcctt

SEQ ID NO: 5120172 - DNA, 17 bp, Homo sapiens
aattacagttaaagaag

SEQ ID NO: 5120173 - DNA, 16 bp, Homo sapiens
aattacagttcacact

SEQ ID NO: 5120174 - DNA, 13 bp, Homo sapiens
aattacataacag

SEQ ID NO: 5120175 - DNA, 16 bp, Homo sapiens
aattacataacaggca

SEQ ID NO: 5120176 - DNA, 18 bp, Homo sapiens
aattacataacaggcatt

SEQ ID NO: 5120177 - DNA, 21 bp, Homo sapiens
aattacatcccataacttgtc

SEQ ID NO: 5120178 - DNA, 16 bp, Homo sapiens
aattacatctctaatt

SEQ ID NO: 5120179 - DNA, 23 bp, Homo sapiens
aattacatgaagatttggttttt

SEQ ID NO: 5120180 - DNA, 12 bp, Homo sapiens
aattacatgcat

SEQ ID NO: 5120181 - DNA, 17 bp, Homo sapiens
aattacatgcatgagca

SEQ ID NO: 5120182 - DNA, 15 bp, Homo sapiens
aattacatgtaaaca

SEQ ID NO: 5120183 - DNA, 18 bp, Homo sapiens
aattacatgtaaacaaat

SEQ ID NO: 5120184 - DNA, 19 bp, Homo sapiens
aattacattttatatgtga

SEQ ID NO: 5120185 - DNA, 12 bp, Homo sapiens
aattacattttt

SEQ ID NO: 5120186 - DNA, 21 bp, Homo sapiens
aattaccacaccatctcccat

SEQ ID NO: 5120187 - DNA, 17 bp, Homo sapiens
aattaccagatagttat

SEQ ID NO: 5120188 - DNA, 20 bp, Homo sapiens
aattaccagtaaagtgtaac

SEQ ID NO: 5120189 - DNA, 17 bp, Homo sapiens
aattaccattaattaca

SEQ ID NO: 5120190 - DNA, 22 bp, Homo sapiens
aattaccattaattacatacag

SEQ ID NO: 5120191 - DNA, 23 bp, Homo sapiens
aattaccatttgttaatatcact

SEQ ID NO: 5120192 - DNA, 16 bp, Homo sapiens
aattacccataaacag

SEQ ID NO: 5120193 - DNA, 22 bp, Homo sapiens
aattacccctatacctgagcct

SEQ ID NO: 5120194 - DNA, 19 bp, Homo sapiens
aattaccctttcattcagc

SEQ ID NO: 5120195 - DNA, 19 bp, Homo sapiens
aattacctaggctgaggtt

SEQ ID NO: 5120196 - DNA, 13 bp, Homo sapiens
aattacctggtga

SEQ ID NO: 5120197 - DNA, 14 bp, Homo sapiens
aattacctgtggat

SEQ ID NO: 5120198 - DNA, 21 bp, Homo sapiens
aattaccttagattagctctg

SEQ ID NO: 5120199 - DNA, 23 bp, Homo sapiens
aattaccttagattagctctgga

SEQ ID NO: 5120200 - DNA, 18 bp, Homo sapiens
aattacctttaatgcaat

SEQ ID NO: 5120201 - DNA, 18 bp, Homo sapiens
aattacctttacatatat

SEQ ID NO: 5120202 - DNA, 13 bp, Homo sapiens
aattactaacttc

SEQ ID NO: 5120203 - DNA, 13 bp, Homo sapiens
aattactaatttt

SEQ ID NO: 5120204 - DNA, 15 bp, Homo sapiens
aattactaattttac

SEQ ID NO: 5120205 - DNA, 15 bp, Homo sapiens
aattactacaaaatt

SEQ ID NO: 5120206 - DNA, 15 bp, Homo sapiens
aattactactttgtt

SEQ ID NO: 5120207 - DNA, 23 bp, Homo sapiens
aattactattcttggttcttatt

SEQ ID NO: 5120208 - DNA, 18 bp, Homo sapiens
aattactcactaaagggc

SEQ ID NO: 5120209 - DNA, 19 bp, Homo sapiens
aattactcagcagaatggt

SEQ ID NO: 5120210 - DNA, 13 bp, Homo sapiens
aattactcaggaa

SEQ ID NO: 5120211 - DNA, 11 bp, Homo sapiens
aattactccaa

SEQ ID NO: 5120212 - DNA, 20 bp, Homo sapiens
aattactccaaaaagacaag

SEQ ID NO: 5120213 - DNA, 14 bp, Homo sapiens
aattactgcactct

SEQ ID NO: 5120214 - DNA, 21 bp, Homo sapiens
aattactgtgagaactgtgaa

SEQ ID NO: 5120215 - DNA, 15 bp, Homo sapiens
aattactgtgtaaat

SEQ ID NO: 5120216 - DNA, 21 bp, Homo sapiens
aattactgtgtgtgagccaga

SEQ ID NO: 5120217 - DNA, 23 bp, Homo sapiens
aattactgtttgaaacttttcaa

SEQ ID NO: 5120218 - DNA, 12 bp, Homo sapiens
aattacttaaat

SEQ ID NO: 5120219 - DNA, 16 bp, Homo sapiens
aattacttaaatttta

SEQ ID NO: 5120220 - DNA, 20 bp, Homo sapiens
aattacttacgtatgtttgt

SEQ ID NO: 5120221 - DNA, 13 bp, Homo sapiens
aattacttagtat

SEQ ID NO: 5120222 - DNA, 17 bp, Homo sapiens
aattacttagtattgca

SEQ ID NO: 5120223 - DNA, 22 bp, Homo sapiens
aattacttatcatccacattgt

SEQ ID NO: 5120224 - DNA, 19 bp, Homo sapiens
aattacttatccctgccca

SEQ ID NO: 5120225 - DNA, 15 bp, Homo sapiens
aattacttctagtca

SEQ ID NO: 5120226 - DNA, 14 bp, Homo sapiens
aattacttctctct

SEQ ID NO: 5120227 - DNA, 14 bp, Homo sapiens
aattacttggcttt

SEQ ID NO: 5120228 - DNA, 23 bp, Homo sapiens
aattactttaacattttggaaat

SEQ ID NO: 5120229 - DNA, 14 bp, Homo sapiens
aattactttcagaa

SEQ ID NO: 5120230 - DNA, 14 bp, Homo sapiens
aattactttcctcc

SEQ ID NO: 5120231 - DNA, 21 bp, Homo sapiens
aattactttgaacattaatgt

SEQ ID NO: 5120232 - DNA, 23 bp, Homo sapiens
aattactttggggctaatttaac

SEQ ID NO: 5120233 - DNA, 14 bp, Homo sapiens
aattagaaaacaaa

SEQ ID NO: 5120234 - DNA, 11 bp, Homo sapiens
aattagaaaat

SEQ ID NO: 5120235 - DNA, 16 bp, Homo sapiens
aattagaaaatatagt

SEQ ID NO: 5120236 - DNA, 14 bp, Homo sapiens
aattagaaaatatt

SEQ ID NO: 5120237 - DNA, 19 bp, Homo sapiens
aattagaaaatattctcta

SEQ ID NO: 5120238 - DNA, 23 bp, Homo sapiens
aattagaaacacacttttgcaca

SEQ ID NO: 5120239 - DNA, 20 bp, Homo sapiens
aattagaaatttatatgtca

SEQ ID NO: 5120240 - DNA, 18 bp, Homo sapiens
aattagaacccttgcaca

SEQ ID NO: 5120241 - DNA, 15 bp, Homo sapiens
aattagaacttgaat

SEQ ID NO: 5120242 - DNA, 20 bp, Homo sapiens
aattagaacttgaatacttt

SEQ ID NO: 5120243 - DNA, 20 bp, Homo sapiens
aattagaagaaaatggatga

SEQ ID NO: 5120244 - DNA, 14 bp, Homo sapiens
aattagaagacatt

SEQ ID NO: 5120245 - DNA, 15 bp, Homo sapiens
aattagaagacattt

SEQ ID NO: 5120246 - DNA, 16 bp, Homo sapiens
aattagaatagaactt

SEQ ID NO: 5120247 - DNA, 17 bp, Homo sapiens
aattagaatgaatttat

SEQ ID NO: 5120248 - DNA, 22 bp, Homo sapiens
aattagaatgaatttatcttta

SEQ ID NO: 5120249 - DNA, 20 bp, Homo sapiens
aattagactgtgattcagaa

SEQ ID NO: 5120250 - DNA, 21 bp, Homo sapiens
aattagactgtgattcagaaa

SEQ ID NO: 5120251 - DNA, 23 bp, Homo sapiens
aattagactgtgattcagaaaat

SEQ ID NO: 5120252 - DNA, 18 bp, Homo sapiens
aattagagaagctgaaag

SEQ ID NO: 5120253 - DNA, 19 bp, Homo sapiens
aattagagatatttttata

SEQ ID NO: 5120254 - DNA, 19 bp, Homo sapiens
aattagagatcatgaatta

SEQ ID NO: 5120255 - DNA, 22 bp, Homo sapiens
aattagagattgacttcagaaa

SEQ ID NO: 5120256 - DNA, 13 bp, Homo sapiens
aattagaggagac

SEQ ID NO: 5120257 - DNA, 20 bp, Homo sapiens
aattagaggatgtggcaggg

SEQ ID NO: 5120258 - DNA, 21 bp, Homo sapiens
aattagatccattaatttaaa

SEQ ID NO: 5120259 - DNA, 16 bp, Homo sapiens
aattagatgactgaat

SEQ ID NO: 5120260 - DNA, 13 bp, Homo sapiens
aattagatgttta

SEQ ID NO: 5120261 - DNA, 14 bp, Homo sapiens
aattagatgtttat

SEQ ID NO: 5120262 - DNA, 15 bp, Homo sapiens
aattagatttaaaat

SEQ ID NO: 5120263 - DNA, 12 bp, Homo sapiens
aattagatttgt

SEQ ID NO: 5120264 - DNA, 12 bp, Homo sapiens
aattagcaattg

SEQ ID NO: 5120265 - DNA, 19 bp, Homo sapiens
aattagcagaagtgaccaa

SEQ ID NO: 5120266 - DNA, 19 bp, Homo sapiens
aattagcagaatggagaaa

SEQ ID NO: 5120267 - DNA, 16 bp, Homo sapiens
aattagcatgcaagct

SEQ ID NO: 5120268 - DNA, 14 bp, Homo sapiens
aattagcattctgt

SEQ ID NO: 5120269 - DNA, 18 bp, Homo sapiens
aattagccagtaatcctg

SEQ ID NO: 5120270 - DNA, 15 bp, Homo sapiens
aattagcctaagata

SEQ ID NO: 5120271 - DNA, 18 bp, Homo sapiens
aattagctatttctgctc

SEQ ID NO: 5120272 - DNA, 17 bp, Homo sapiens
aattagctctggggggc

SEQ ID NO: 5120273 - DNA, 14 bp, Homo sapiens
aattagctgggtgt

SEQ ID NO: 5120274 - DNA, 16 bp, Homo sapiens
aattagcttatgttaa

SEQ ID NO: 5120275 - DNA, 20 bp, Homo sapiens
aattagcttttagttttaaa

SEQ ID NO: 5120276 - DNA, 22 bp, Homo sapiens
aattagctttttcatcccctta

SEQ ID NO: 5120277 - DNA, 22 bp, Homo sapiens
aattaggaagcttgatttgctt

SEQ ID NO: 5120278 - DNA, 14 bp, Homo sapiens
aattaggataacta

SEQ ID NO: 5120279 - DNA, 20 bp, Homo sapiens
aattaggataactaaaattc

SEQ ID NO: 5120280 - DNA, 15 bp, Homo sapiens
aattaggatctatgc

SEQ ID NO: 5120281 - DNA, 18 bp, Homo sapiens
aattaggatctatgcaat

SEQ ID NO: 5120282 - DNA, 21 bp, Homo sapiens
aatgccatcaataaaaaatta

SEQ ID NO: 5120283 - DNA, 19 bp, Homo sapiens
aatgccatcagcccctggg

SEQ ID NO: 5120284 - DNA, 17 bp, Homo sapiens
aatgccatgaacaaatt

SEQ ID NO: 5120285 - DNA, 18 bp, Homo sapiens
aatgccatgactgctcag

SEQ ID NO: 5120286 - DNA, 20 bp, Homo sapiens
aatgccatgactgctcaggc

SEQ ID NO: 5120287 - DNA, 22 bp, Homo sapiens
aatgccatgactgctcaggcct

SEQ ID NO: 5120288 - DNA, 22 bp, Homo sapiens
aatgccatgatgcctctgtctt

SEQ ID NO: 5120289 - DNA, 13 bp, Homo sapiens
aatgccattctct

SEQ ID NO: 5120290 - DNA, 13 bp, Homo sapiens
aatgccattgtgc

SEQ ID NO: 5120291 - DNA, 17 bp, Homo sapiens
aatgccatttagaatct

SEQ ID NO: 5120292 - DNA, 18 bp, Homo sapiens
aatgccatttagaatcta

SEQ ID NO: 5120293 - DNA, 19 bp, Homo sapiens
aatgccatttagaatctag

SEQ ID NO: 5120294 - DNA, 22 bp, Homo sapiens
aatgccatttagaatctagaaa

SEQ ID NO: 5120295 - DNA, 19 bp, Homo sapiens
aatgccatttatttattga

SEQ ID NO: 5120296 - DNA, 20 bp, Homo sapiens
aatgccatttatttattgat

SEQ ID NO: 5120297 - DNA, 21 bp, Homo sapiens
aatgccatttcagtggcttcc

SEQ ID NO: 5120298 - DNA, 19 bp, Homo sapiens
aatgccatttctcacgccc

SEQ ID NO: 5120299 - DNA, 18 bp, Homo sapiens
aatgccattttaaggaaa

SEQ ID NO: 5120300 - DNA, 20 bp, Homo sapiens
aatgccattttaaggaaaac

SEQ ID NO: 5120301 - DNA, 12 bp, Homo sapiens
aatgcccagaca

SEQ ID NO: 5120302 - DNA, 15 bp, Homo sapiens
aatgcccagcacaat

SEQ ID NO: 5120303 - DNA, 16 bp, Homo sapiens
aatgcccagccagcca

SEQ ID NO: 5120304 - DNA, 18 bp, Homo sapiens
aatgcccagccagccacc

SEQ ID NO: 5120305 - DNA, 13 bp, Homo sapiens
aatgcccagcccc

SEQ ID NO: 5120306 - DNA, 13 bp, Homo sapiens
aatgccccaaact

SEQ ID NO: 5120307 - DNA, 15 bp, Homo sapiens
aatgcccccagctgg

SEQ ID NO: 5120308 - DNA, 16 bp, Homo sapiens
aatgccccctcccctc

SEQ ID NO: 5120309 - DNA, 16 bp, Homo sapiens
aatgccctatgtgtat

SEQ ID NO: 5120310 - DNA, 17 bp, Homo sapiens
aatgccctcctaaatgt

SEQ ID NO: 5120311 - DNA, 19 bp, Homo sapiens
aatgccctcctaaatgtca

SEQ ID NO: 5120312 - DNA, 11 bp, Homo sapiens
aatgccctctt

SEQ ID NO: 5120313 - DNA, 14 bp, Homo sapiens
aatgccctgccatt

SEQ ID NO: 5120314 - DNA, 20 bp, Homo sapiens
aatgccctgccttgctgcct

SEQ ID NO: 5120315 - DNA, 11 bp, Homo sapiens
aatgccctgcg

SEQ ID NO: 5120316 - DNA, 16 bp, Homo sapiens
aatgcccttaaatcat

SEQ ID NO: 5120317 - DNA, 22 bp, Homo sapiens
aatgcccttacacttactgttg

SEQ ID NO: 5120318 - DNA, 13 bp, Homo sapiens
aatgcccttcact

SEQ ID NO: 5120319 - DNA, 21 bp, Homo sapiens
aatgccgccctcccagctctg

SEQ ID NO: 5120320 - DNA, 23 bp, Homo sapiens
aatgccgcctgtcaataaatgtt

SEQ ID NO: 5120321 - DNA, 16 bp, Homo sapiens
aatgcctaataaacaa

SEQ ID NO: 5120322 - DNA, 20 bp, Homo sapiens
aatgcctacagctgtcttca

SEQ ID NO: 5120323 - DNA, 18 bp, Homo sapiens
aatgcctaggccagctcc

SEQ ID NO: 5120324 - DNA, 18 bp, Homo sapiens
aatgcctataaaatgccc

SEQ ID NO: 5120325 - DNA, 22 bp, Homo sapiens
aatgcctataactttttttcaa

SEQ ID NO: 5120326 - DNA, 20 bp, Homo sapiens
aatgcctcaatgtgaccagg

SEQ ID NO: 5120327 - DNA, 15 bp, Homo sapiens
aatgcctcagtgtat

SEQ ID NO: 5120328 - DNA, 16 bp, Homo sapiens
aatgcctcataaatta

SEQ ID NO: 5120329 - DNA, 14 bp, Homo sapiens
aatgcctcctccct

SEQ ID NO: 5120330 - DNA, 16 bp, Homo sapiens
aatgcctgagtgcctg

SEQ ID NO: 5120331 - DNA, 17 bp, Homo sapiens
aatgcctgagtgcctgg

SEQ ID NO: 5120332 - DNA, 12 bp, Homo sapiens
aatgcctgccaa

SEQ ID NO: 5120333 - DNA, 12 bp, Homo sapiens
aatgcctgccca

SEQ ID NO: 5120334 - DNA, 18 bp, Homo sapiens
aatgcctgctgctgccaa

SEQ ID NO: 5120335 - DNA, 17 bp, Homo sapiens
aatgcctgctttttgga

SEQ ID NO: 5120336 - DNA, 19 bp, Homo sapiens
aatgcctgctttttggaaa

SEQ ID NO: 5120337 - DNA, 15 bp, Homo sapiens
aatgcctggagggta

SEQ ID NO: 5120338 - DNA, 22 bp, Homo sapiens
aatgcctgtgaagcagtcagcc

SEQ ID NO: 5120339 - DNA, 13 bp, Homo sapiens
aatgcctgtgcca

SEQ ID NO: 5120340 - DNA, 14 bp, Homo sapiens
aatgcctgtgccaa

SEQ ID NO: 5120341 - DNA, 17 bp, Homo sapiens
aatgccttaaaatggaa

SEQ ID NO: 5120342 - DNA, 19 bp, Homo sapiens
aatgccttaattaaagaat

SEQ ID NO: 5120343 - DNA, 23 bp, Homo sapiens
aatgccttaccctcatgttctta

SEQ ID NO: 5120344 - DNA, 16 bp, Homo sapiens
aatgccttactttgta

SEQ ID NO: 5120345 - DNA, 18 bp, Homo sapiens
aatgccttactttgtatg

SEQ ID NO: 5120346 - DNA, 19 bp, Homo sapiens
aatgccttatttttgaatt

SEQ ID NO: 5120347 - DNA, 21 bp, Homo sapiens
aatgccttgacaacagactga

SEQ ID NO: 5120348 - DNA, 24 bp, Homo sapiens
aatgccttggtttgatttctagta

SEQ ID NO: 5120349 - DNA, 15 bp, Homo sapiens
aatgccttgtataaa

SEQ ID NO: 5120350 - DNA, 17 bp, Homo sapiens
aatgccttgtataaaat

SEQ ID NO: 5120351 - DNA, 15 bp, Homo sapiens
aatgccttgttgtat

SEQ ID NO: 5120352 - DNA, 17 bp, Homo sapiens
aatgcctttatatttca

SEQ ID NO: 5120353 - DNA, 13 bp, Homo sapiens
aatgcctttgaga

SEQ ID NO: 5120354 - DNA, 16 bp, Homo sapiens
aatgcctttgagacag

SEQ ID NO: 5120355 - DNA, 15 bp, Homo sapiens
aatgccttttcccaa

SEQ ID NO: 5120356 - DNA, 21 bp, Homo sapiens
aatgcctttttagatgtattt

SEQ ID NO: 5120357 - DNA, 17 bp, Homo sapiens
aatgcgacaagtagttc

SEQ ID NO: 5120358 - DNA, 15 bp, Homo sapiens
aatgcgagactctga

SEQ ID NO: 5120359 - DNA, 16 bp, Homo sapiens
aatgcgagactctgat

SEQ ID NO: 5120360 - DNA, 13 bp, Homo sapiens
aatgcgattttat

SEQ ID NO: 5120361 - DNA, 20 bp, Homo sapiens
aatgcgctcttcaccaggaa

SEQ ID NO: 5120362 - DNA, 21 bp, Homo sapiens
aatgcgctcttcaccaggaag

SEQ ID NO: 5120363 - DNA, 12 bp, Homo sapiens
aatgcgctcttt

SEQ ID NO: 5120364 - DNA, 14 bp, Homo sapiens
aatgcggacacttt

SEQ ID NO: 5120365 - DNA, 20 bp, Homo sapiens
aatgcgggggagcaggcagt

SEQ ID NO: 5120366 - DNA, 18 bp, Homo sapiens
aatgcgggtgagagtaat

SEQ ID NO: 5120367 - DNA, 16 bp, Homo sapiens
aatgcgtatttgcatt

SEQ ID NO: 5120368 - DNA, 16 bp, Homo sapiens
aatgcgtcttgtgaaa

SEQ ID NO: 5120369 - DNA, 23 bp, Homo sapiens
aatgcgtgcataccacttttgtt

SEQ ID NO: 5120370 - DNA, 14 bp, Homo sapiens
aatgctaaatgcaa

SEQ ID NO: 5120371 - DNA, 15 bp, Homo sapiens
aatgctaaatgtgta

SEQ ID NO: 5120372 - DNA, 20 bp, Homo sapiens
aatgctaacagttcacttgc

SEQ ID NO: 5120373 - DNA, 13 bp, Homo sapiens
aatgctaagaaat

SEQ ID NO: 5120374 - DNA, 16 bp, Homo sapiens
aatgctaagaaatgct

SEQ ID NO: 5120375 - DNA, 19 bp, Homo sapiens
aatgctaagaatgcattat

SEQ ID NO: 5120376 - DNA, 14 bp, Homo sapiens
aatgctaatattaa

SEQ ID NO: 5120377 - DNA, 22 bp, Homo sapiens
aatgctaatgtaatcatttatc

SEQ ID NO: 5120378 - DNA, 20 bp, Homo sapiens
aatgctacaaaatgtgtgct

SEQ ID NO: 5120379 - DNA, 13 bp, Homo sapiens
aatgctaccagga

SEQ ID NO: 5120380 - DNA, 16 bp, Homo sapiens
aatgctacgtgtgatt

SEQ ID NO: 5120381 - DNA, 18 bp, Homo sapiens
aatgctagctctgagcca

SEQ ID NO: 5120382 - DNA, 15 bp, Homo sapiens
aatgctaggttctac

SEQ ID NO: 5120383 - DNA, 12 bp, Homo sapiens
aatgctatggac

SEQ ID NO: 5120384 - DNA, 16 bp, Homo sapiens
aatgctatggactgca

SEQ ID NO: 5120385 - DNA, 21 bp, Homo sapiens
aatgctatgtcatttcatgtc

SEQ ID NO: 5120386 - DNA, 14 bp, Homo sapiens
aatgctattatact

SEQ ID NO: 5120387 - DNA, 16 bp, Homo sapiens
aatgctattatactgt

SEQ ID NO: 5120388 - DNA, 21 bp, Homo sapiens
aatgctattcagataaggcag

SEQ ID NO: 5120389 - DNA, 22 bp, Homo sapiens
aatgctattcagataaggcaga

SEQ ID NO: 5120390 - DNA, 14 bp, Homo sapiens
aatgctattgaaaa

SEQ ID NO: 5120391 - DNA, 16 bp, Homo sapiens
aatgctattgaaaatg

SEQ ID NO: 5120392 - DNA, 21 bp, Homo sapiens
aatgctattgttgtgggcttt

SEQ ID NO: 5120393 - DNA, 11 bp, Homo sapiens
aatgctatttg

SEQ ID NO: 5120394 - DNA, 16 bp, Homo sapiens
aatgctatttgaacaa

SEQ ID NO: 5120395 - DNA, 14 bp, Homo sapiens
aatgctatttgtgt

SEQ ID NO: 5120396 - DNA, 16 bp, Homo sapiens
aatgctatttgtgtaa

SEQ ID NO: 5120397 - DNA, 21 bp, Homo sapiens
aatgctatttgtgtaactgaa

SEQ ID NO: 5120398 - DNA, 21 bp, Homo sapiens
aatgctattttaaaaaatata

SEQ ID NO: 5120399 - DNA, 18 bp, Homo sapiens
aatgctattttaaaattc

SEQ ID NO: 5120400 - DNA, 19 bp, Homo sapiens
aatgctattttttcccttc

SEQ ID NO: 5120401 - DNA, 14 bp, Homo sapiens
aatgctcaatgtgc

SEQ ID NO: 5120402 - DNA, 15 bp, Homo sapiens
aatgctcaatgtgct

SEQ ID NO: 5120403 - DNA, 16 bp, Homo sapiens
aatgctcaatgtgctg

SEQ ID NO: 5120404 - DNA, 18 bp, Homo sapiens
aatgctcaatttcagcac

SEQ ID NO: 5120405 - DNA, 22 bp, Homo sapiens
aatgctcagggtcactgaacca

SEQ ID NO: 5120406 - DNA, 20 bp, Homo sapiens
aatgctcataaagatgttaa

SEQ ID NO: 5120407 - DNA, 21 bp, Homo sapiens
aatgctcataaagatgttaaa

SEQ ID NO: 5120408 - DNA, 15 bp, Homo sapiens
aatgctcattttctg

SEQ ID NO: 5120409 - DNA, 17 bp, Homo sapiens
aatgctcattttctggt

SEQ ID NO: 5120410 - DNA, 20 bp, Homo sapiens
aatgctcattttctggtttg

SEQ ID NO: 5120411 - DNA, 12 bp, Homo sapiens
aatgctcccagc

SEQ ID NO: 5120412 - DNA, 14 bp, Homo sapiens
aatgctcccagctg

SEQ ID NO: 5120413 - DNA, 15 bp, Homo sapiens
aatgctcccagctgt

SEQ ID NO: 5120414 - DNA, 20 bp, Homo sapiens
aatgctccccacagcgtccc

SEQ ID NO: 5120415 - DNA, 14 bp, Homo sapiens
aatgctcccccatc

SEQ ID NO: 5120416 - DNA, 22 bp, Homo sapiens
aatgctcccccatcctcccctt

SEQ ID NO: 5120417 - DNA, 11 bp, Homo sapiens
aatgctctagt

SEQ ID NO: 5120418 - DNA, 14 bp, Homo sapiens
aatgctctctcttc

SEQ ID NO: 5120419 - DNA, 12 bp, Homo sapiens
aatgctctgaaa

SEQ ID NO: 5120420 - DNA, 16 bp, Homo sapiens
aatgctcttaaaatat

SEQ ID NO: 5120421 - DNA, 15 bp, Homo sapiens
aatgctgaaaacaca

SEQ ID NO: 5120422 - DNA, 18 bp, Homo sapiens
aatgctgaacattgcata

SEQ ID NO: 5120423 - DNA, 18 bp, Homo sapiens
aatgctgaatatatagaa

SEQ ID NO: 5120424 - DNA, 21 bp, Homo sapiens
aatgctgacaatgctgccatg

SEQ ID NO: 5120425 - DNA, 15 bp, Homo sapiens
aatgctgacccatgg

SEQ ID NO: 5120426 - DNA, 17 bp, Homo sapiens
aatgctgacccatgggc

SEQ ID NO: 5120427 - DNA, 22 bp, Homo sapiens
aatgctgacccatgggcaggag

SEQ ID NO: 5120428 - DNA, 13 bp, Homo sapiens
aatgctgagccag

SEQ ID NO: 5120429 - DNA, 17 bp, Homo sapiens
aatgctgcaaacttaat

SEQ ID NO: 5120430 - DNA, 22 bp, Homo sapiens
aatgctgcaagttatgaaatat

SEQ ID NO: 5120431 - DNA, 13 bp, Homo sapiens
aatgctgcactaa

SEQ ID NO: 5120432 - DNA, 15 bp, Homo sapiens
aatgctgcaggatgg

SEQ ID NO: 5120433 - DNA, 14 bp, Homo sapiens
aatgctgcatttta

SEQ ID NO: 5120434 - DNA, 17 bp, Homo sapiens
aatgctgccagtgtgga

SEQ ID NO: 5120435 - DNA, 21 bp, Homo sapiens
aatgctgcccagggtcagtgt

SEQ ID NO: 5120436 - DNA, 22 bp, Homo sapiens
aatgctgcccatgccaccgctt

SEQ ID NO: 5120437 - DNA, 15 bp, Homo sapiens
aatgctgcctgcctg

SEQ ID NO: 5120438 - DNA, 18 bp, Homo sapiens
aatgctgcctgcctgtct

SEQ ID NO: 5120439 - DNA, 17 bp, Homo sapiens
aatgctgcgcttcgctt

SEQ ID NO: 5120440 - DNA, 16 bp, Homo sapiens
aatgctgcttctcctc

SEQ ID NO: 5120441 - DNA, 22 bp, Homo sapiens
aatgctggagaaaaatatctgt

SEQ ID NO: 5120442 - DNA, 18 bp, Homo sapiens
aatgctggagaaaaatga

SEQ ID NO: 5120443 - DNA, 18 bp, Homo sapiens
aatgctggctgagctgaa

SEQ ID NO: 5120444 - DNA, 12 bp, Homo sapiens
aatgctgggccc

SEQ ID NO: 5120445 - DNA, 20 bp, Homo sapiens
aatgctgggcccccagcctg

SEQ ID NO: 5120446 - DNA, 23 bp, Homo sapiens
aatgctgggcccccagcctggcc

SEQ ID NO: 5120447 - DNA, 21 bp, Homo sapiens
aatgctgggtatgctctgtga

SEQ ID NO: 5120448 - DNA, 22 bp, Homo sapiens
aatgctgggtatgctctgtgac

SEQ ID NO: 5120449 - DNA, 17 bp, Homo sapiens
aatgctggtgaaatgct

SEQ ID NO: 5120450 - DNA, 19 bp, Homo sapiens
aatgctggttttcctaaat

SEQ ID NO: 5120451 - DNA, 13 bp, Homo sapiens
aatgctgtaaata

SEQ ID NO: 5120452 - DNA, 12 bp, Homo sapiens
aatgctgtacat

SEQ ID NO: 5120453 - DNA, 15 bp, Homo sapiens
aatgctgtacatcta

SEQ ID NO: 5120454 - DNA, 17 bp, Homo sapiens
aatgctgtacctggctg

SEQ ID NO: 5120455 - DNA, 12 bp, Homo sapiens
aatgctgtactt

SEQ ID NO: 5120456 - DNA, 12 bp, Homo sapiens
aatgctgtagaa

SEQ ID NO: 5120457 - DNA, 13 bp, Homo sapiens
aatgctgtatgtc

SEQ ID NO: 5120458 - DNA, 22 bp, Homo sapiens
aatgctgtattagtcacagaga

SEQ ID NO: 5120459 - DNA, 17 bp, Homo sapiens
aatgctgtctttcttgc

SEQ ID NO: 5120460 - DNA, 14 bp, Homo sapiens
aatgctgtctttgt

SEQ ID NO: 5120461 - DNA, 20 bp, Homo sapiens
aatgctgtgcaaacagtgta

SEQ ID NO: 5120462 - DNA, 20 bp, Homo sapiens
aattaggatctatgcaattt

SEQ ID NO: 5120463 - DNA, 20 bp, Homo sapiens
aattaggcccccatcatcct

SEQ ID NO: 5120464 - DNA, 21 bp, Homo sapiens
aattaggcccccatcatcctc

SEQ ID NO: 5120465 - DNA, 17 bp, Homo sapiens
aattaggctgtaactac

SEQ ID NO: 5120466 - DNA, 20 bp, Homo sapiens
aattagggtacatttataat

SEQ ID NO: 5120467 - DNA, 23 bp, Homo sapiens
aattagggtgggctctaaatcca

SEQ ID NO: 5120468 - DNA, 14 bp, Homo sapiens
aattaggtaatgga

SEQ ID NO: 5120469 - DNA, 16 bp, Homo sapiens
aattaggtagcacagc

SEQ ID NO: 5120470 - DNA, 22 bp, Homo sapiens
aattaggtctgcattttctcag

SEQ ID NO: 5120471 - DNA, 22 bp, Homo sapiens
aattaggtgtactgtactgaag

SEQ ID NO: 5120472 - DNA, 14 bp, Homo sapiens
aattaggttaacta

SEQ ID NO: 5120473 - DNA, 22 bp, Homo sapiens
aattaggttgaaacatatctct

SEQ ID NO: 5120474 - DNA, 18 bp, Homo sapiens
aattaggtttttccttat

SEQ ID NO: 5120475 - DNA, 21 bp, Homo sapiens
aattaggtttttccttatttg

SEQ ID NO: 5120476 - DNA, 20 bp, Homo sapiens
aattagtaaaaaatcaatta

SEQ ID NO: 5120477 - DNA, 17 bp, Homo sapiens
aattagtaacatgtgtt

SEQ ID NO: 5120478 - DNA, 17 bp, Homo sapiens
aattagtaattgtcaat

SEQ ID NO: 5120479 - DNA, 21 bp, Homo sapiens
aattagtacagaaatatccat

SEQ ID NO: 5120480 - DNA, 19 bp, Homo sapiens
aattagtacagtagcttaa

SEQ ID NO: 5120481 - DNA, 15 bp, Homo sapiens
aattagtagtgtgtt

SEQ ID NO: 5120482 - DNA, 14 bp, Homo sapiens
aattagtattttga

SEQ ID NO: 5120483 - DNA, 23 bp, Homo sapiens
aattagtcgggcatgagtctgtt

SEQ ID NO: 5120484 - DNA, 24 bp, Homo sapiens
aattagtcgggcatgagtctgttt

SEQ ID NO: 5120485 - DNA, 13 bp, Homo sapiens
aattagtgaacca

SEQ ID NO: 5120486 - DNA, 17 bp, Homo sapiens
aattagtgagatttgta

SEQ ID NO: 5120487 - DNA, 18 bp, Homo sapiens
aattagtgagatttgtat

SEQ ID NO: 5120488 - DNA, 18 bp, Homo sapiens
aattagtgatatagtgct

SEQ ID NO: 5120489 - DNA, 17 bp, Homo sapiens
aattagtgccacttaat

SEQ ID NO: 5120490 - DNA, 14 bp, Homo sapiens
aattagtgctaagt

SEQ ID NO: 5120491 - DNA, 22 bp, Homo sapiens
aattagtgctaagtgtgaactg

SEQ ID NO: 5120492 - DNA, 17 bp, Homo sapiens
aattagtggtcataaaa

SEQ ID NO: 5120493 - DNA, 19 bp, Homo sapiens
aattagtggtcataaaata

SEQ ID NO: 5120494 - DNA, 18 bp, Homo sapiens
aattagttccagtttctc

SEQ ID NO: 5120495 - DNA, 15 bp, Homo sapiens
aattagtttcctttt

SEQ ID NO: 5120496 - DNA, 23 bp, Homo sapiens
aattagtttcctttttaatatgc

SEQ ID NO: 5120497 - DNA, 14 bp, Homo sapiens
aattagttttatat

SEQ ID NO: 5120498 - DNA, 10 bp, Homo sapiens
aattataaaa

SEQ ID NO: 5120499 - DNA, 14 bp, Homo sapiens
aattataaaagcca

SEQ ID NO: 5120500 - DNA, 17 bp, Homo sapiens
aattataaaattgaaaa

SEQ ID NO: 5120501 - DNA, 23 bp, Homo sapiens
aattataaaattgaaaacactaa

SEQ ID NO: 5120502 - DNA, 12 bp, Homo sapiens
aattataaactt

SEQ ID NO: 5120503 - DNA, 13 bp, Homo sapiens
aattataaatgtt

SEQ ID NO: 5120504 - DNA, 23 bp, Homo sapiens
aattataaatgtttcatgaagaa

SEQ ID NO: 5120505 - DNA, 14 bp, Homo sapiens
aattataaattgag

SEQ ID NO: 5120506 - DNA, 15 bp, Homo sapiens
aattataacagttat

SEQ ID NO: 5120507 - DNA, 18 bp, Homo sapiens
aattataacagttatatt

SEQ ID NO: 5120508 - DNA, 15 bp, Homo sapiens
aattataactattac

SEQ ID NO: 5120509 - DNA, 18 bp, Homo sapiens
aattataactattacagt

SEQ ID NO: 5120510 - DNA, 22 bp, Homo sapiens
aattataactattacagtgttg

SEQ ID NO: 5120511 - DNA, 18 bp, Homo sapiens
aattataactggaaagaa

SEQ ID NO: 5120512 - DNA, 19 bp, Homo sapiens
aattataactggaaagaag

SEQ ID NO: 5120513 - DNA, 17 bp, Homo sapiens
aattataagaatttcta

SEQ ID NO: 5120514 - DNA, 17 bp, Homo sapiens
aattataagaggctgat

SEQ ID NO: 5120515 - DNA, 18 bp, Homo sapiens
aattataaggactgcatg

SEQ ID NO: 5120516 - DNA, 21 bp, Homo sapiens
aattataagggccctgccctg

SEQ ID NO: 5120517 - DNA, 14 bp, Homo sapiens
aattataagtcaca

SEQ ID NO: 5120518 - DNA, 16 bp, Homo sapiens
aattataagtcacaaa

SEQ ID NO: 5120519 - DNA, 13 bp, Homo sapiens
aattataataaag

SEQ ID NO: 5120520 - DNA, 16 bp, Homo sapiens
aattataatatactat

SEQ ID NO: 5120521 - DNA, 16 bp, Homo sapiens
aattataatgcaaatt

SEQ ID NO: 5120522 - DNA, 17 bp, Homo sapiens
aattataatgcatctaa

SEQ ID NO: 5120523 - DNA, 22 bp, Homo sapiens
aattataatgtattcatatttg

SEQ ID NO: 5120524 - DNA, 15 bp, Homo sapiens
aattataattgtaat

SEQ ID NO: 5120525 - DNA, 20 bp, Homo sapiens
aattatacaaattaaaaaga

SEQ ID NO: 5120526 - DNA, 20 bp, Homo sapiens
aattatacagacctaatatc

SEQ ID NO: 5120527 - DNA, 23 bp, Homo sapiens
aattatacagacctaatatcatt

SEQ ID NO: 5120528 - DNA, 13 bp, Homo sapiens
aattatacagtaa

SEQ ID NO: 5120529 - DNA, 12 bp, Homo sapiens
aattatactaac

SEQ ID NO: 5120530 - DNA, 14 bp, Homo sapiens
aattatactacttt

SEQ ID NO: 5120531 - DNA, 14 bp, Homo sapiens
aattatactttgtt

SEQ ID NO: 5120532 - DNA, 20 bp, Homo sapiens
aattatagagcctcaatttt

SEQ ID NO: 5120533 - DNA, 15 bp, Homo sapiens
aattatagatgggaa

SEQ ID NO: 5120534 - DNA, 19 bp, Homo sapiens
aattatagctctaatgttt

SEQ ID NO: 5120535 - DNA, 22 bp, Homo sapiens
aattatagctctaatgtttgca

SEQ ID NO: 5120536 - DNA, 23 bp, Homo sapiens
aattatagctctaatgtttgcat

SEQ ID NO: 5120537 - DNA, 21 bp, Homo sapiens
aattataggaatatcaatata

SEQ ID NO: 5120538 - DNA, 20 bp, Homo sapiens
aattatagtagcttataaga

SEQ ID NO: 5120539 - DNA, 13 bp, Homo sapiens
aattatagtttct

SEQ ID NO: 5120540 - DNA, 16 bp, Homo sapiens
aattatagtttctgag

SEQ ID NO: 5120541 - DNA, 14 bp, Homo sapiens
aattatataactgt

SEQ ID NO: 5120542 - DNA, 13 bp, Homo sapiens
aattatataattt

SEQ ID NO: 5120543 - DNA, 23 bp, Homo sapiens
aattatatagcaaagatatatat

SEQ ID NO: 5120544 - DNA, 20 bp, Homo sapiens
aattatataggttgtgcaaa

SEQ ID NO: 5120545 - DNA, 17 bp, Homo sapiens
aattatatattgcaagg

SEQ ID NO: 5120546 - DNA, 21 bp, Homo sapiens
aattatatattttgttgttcc

SEQ ID NO: 5120547 - DNA, 23 bp, Homo sapiens
aattatatattttgttgttcctc

SEQ ID NO: 5120548 - DNA, 22 bp, Homo sapiens
aattatatcagagtatgtcagt

SEQ ID NO: 5120549 - DNA, 22 bp, Homo sapiens
aattatatcagtcctctttcaa

SEQ ID NO: 5120550 - DNA, 14 bp, Homo sapiens
aattatatctaatt

SEQ ID NO: 5120551 - DNA, 15 bp, Homo sapiens
aattatatctaattt

SEQ ID NO: 5120552 - DNA, 18 bp, Homo sapiens
aattatatctaatttata

SEQ ID NO: 5120553 - DNA, 20 bp, Homo sapiens
aattatatctaatttataca

SEQ ID NO: 5120554 - DNA, 20 bp, Homo sapiens
aattatatctgaggaattct

SEQ ID NO: 5120555 - DNA, 14 bp, Homo sapiens
aattatatgaagca

SEQ ID NO: 5120556 - DNA, 13 bp, Homo sapiens
aattatatgatat

SEQ ID NO: 5120557 - DNA, 17 bp, Homo sapiens
aattatatgatatgcat

SEQ ID NO: 5120558 - DNA, 18 bp, Homo sapiens
aattatatgatatgcatg

SEQ ID NO: 5120559 - DNA, 19 bp, Homo sapiens
aattatatgatatgcatgt

SEQ ID NO: 5120560 - DNA, 21 bp, Homo sapiens
aattatatgctatttctatat

SEQ ID NO: 5120561 - DNA, 22 bp, Homo sapiens
aattatattatgaataaaattg

SEQ ID NO: 5120562 - DNA, 21 bp, Homo sapiens
aattatattcaatgcatttaa

SEQ ID NO: 5120563 - DNA, 16 bp, Homo sapiens
aattatattctgttta

SEQ ID NO: 5120564 - DNA, 14 bp, Homo sapiens
aattatattgttag

SEQ ID NO: 5120565 - DNA, 19 bp, Homo sapiens
aattatatttctacagaga

SEQ ID NO: 5120566 - DNA, 13 bp, Homo sapiens
aattatatttgaa

SEQ ID NO: 5120567 - DNA, 20 bp, Homo sapiens
aattatatttgtgctatagt

SEQ ID NO: 5120568 - DNA, 23 bp, Homo sapiens
aattatattttgaacaactcgaa

SEQ ID NO: 5120569 - DNA, 14 bp, Homo sapiens
aattatatttttgt

SEQ ID NO: 5120570 - DNA, 15 bp, Homo sapiens
aattatcaaaaaaca

SEQ ID NO: 5120571 - DNA, 21 bp, Homo sapiens
aattatcacaatgtactatat

SEQ ID NO: 5120572 - DNA, 15 bp, Homo sapiens
aattatcatgcgttt

SEQ ID NO: 5120573 - DNA, 23 bp, Homo sapiens
aattatcattgtttgtcctttat

SEQ ID NO: 5120574 - DNA, 14 bp, Homo sapiens
aattatccattacg

SEQ ID NO: 5120575 - DNA, 21 bp, Homo sapiens
aattatccattacgtgcattt

SEQ ID NO: 5120576 - DNA, 22 bp, Homo sapiens
aattatccattacgtgcattta

SEQ ID NO: 5120577 - DNA, 21 bp, Homo sapiens
aattatcccttttcttgacta

SEQ ID NO: 5120578 - DNA, 20 bp, Homo sapiens
aattatcctcaagttgtgtg

SEQ ID NO: 5120579 - DNA, 17 bp, Homo sapiens
aattatcggaagcagtg

SEQ ID NO: 5120580 - DNA, 21 bp, Homo sapiens
aattatcggaagcagtgcctt

SEQ ID NO: 5120581 - DNA, 18 bp, Homo sapiens
aattatctaatttataaa

SEQ ID NO: 5120582 - DNA, 14 bp, Homo sapiens
aattatctatttgt

SEQ ID NO: 5120583 - DNA, 16 bp, Homo sapiens
aattatctatttgtat

SEQ ID NO: 5120584 - DNA, 23 bp, Homo sapiens
aattatctatttgtatatataca

SEQ ID NO: 5120585 - DNA, 19 bp, Homo sapiens
aattatctcaagtaaaaca

SEQ ID NO: 5120586 - DNA, 20 bp, Homo sapiens
aattatctcaagtaaaacaa

SEQ ID NO: 5120587 - DNA, 17 bp, Homo sapiens
aattatctcctaattgt

SEQ ID NO: 5120588 - DNA, 22 bp, Homo sapiens
aattatctgatcgggataacaa

SEQ ID NO: 5120589 - DNA, 17 bp, Homo sapiens
aattatctgttctatgg

SEQ ID NO: 5120590 - DNA, 18 bp, Homo sapiens
aattatcttatctactga

SEQ ID NO: 5120591 - DNA, 15 bp, Homo sapiens
aattatcttggaaaa

SEQ ID NO: 5120592 - DNA, 13 bp, Homo sapiens
aattatctttaaa

SEQ ID NO: 5120593 - DNA, 15 bp, Homo sapiens
aattatctttaaaac

SEQ ID NO: 5120594 - DNA, 20 bp, Homo sapiens
aattatctttagttgaattc

SEQ ID NO: 5120595 - DNA, 11 bp, Homo sapiens
aattatgaaaa

SEQ ID NO: 5120596 - DNA, 12 bp, Homo sapiens
aattatgaaact

SEQ ID NO: 5120597 - DNA, 15 bp, Homo sapiens
aattatgaaactttt

SEQ ID NO: 5120598 - DNA, 20 bp, Homo sapiens
aattatgaatccaacgtgta

SEQ ID NO: 5120599 - DNA, 13 bp, Homo sapiens
aattatgacagtt

SEQ ID NO: 5120600 - DNA, 16 bp, Homo sapiens
aattatgacgtgcaca

SEQ ID NO: 5120601 - DNA, 22 bp, Homo sapiens
aattatgacgtgcacaaacctt

SEQ ID NO: 5120602 - DNA, 19 bp, Homo sapiens
aattatgagaggctgtcat

SEQ ID NO: 5120603 - DNA, 15 bp, Homo sapiens
aattatgaggcattg

SEQ ID NO: 5120604 - DNA, 21 bp, Homo sapiens
aattatgatcctctatttcct

SEQ ID NO: 5120605 - DNA, 12 bp, Homo sapiens
aattatgatgtc

SEQ ID NO: 5120606 - DNA, 15 bp, Homo sapiens
aattatgcaaaagca

SEQ ID NO: 5120607 - DNA, 21 bp, Homo sapiens
aattatgcaattcagtgttcc

SEQ ID NO: 5120608 - DNA, 23 bp, Homo sapiens
aattatgctaacaaactgaaaaa

SEQ ID NO: 5120609 - DNA, 12 bp, Homo sapiens
aattatgctgca

SEQ ID NO: 5120610 - DNA, 18 bp, Homo sapiens
aattatgctgtgaatttt

SEQ ID NO: 5120611 - DNA, 21 bp, Homo sapiens
aattatggaaaaaaaatattc

SEQ ID NO: 5120612 - DNA, 23 bp, Homo sapiens
aattatggagtattttaagtcta

SEQ ID NO: 5120613 - DNA, 18 bp, Homo sapiens
aattatggcatttctatt

SEQ ID NO: 5120614 - DNA, 21 bp, Homo sapiens
aattatgggaacaagtgtaca

SEQ ID NO: 5120615 - DNA, 21 bp, Homo sapiens
aattatgggaataattgcttt

SEQ ID NO: 5120616 - DNA, 21 bp, Homo sapiens
aattatgggagaagtgggggc

SEQ ID NO: 5120617 - DNA, 17 bp, Homo sapiens
aattatggtaaaatttt

SEQ ID NO: 5120618 - DNA, 22 bp, Homo sapiens
aattatggtagcaaattttgga

SEQ ID NO: 5120619 - DNA, 14 bp, Homo sapiens
aattatggtgaaat

SEQ ID NO: 5120620 - DNA, 15 bp, Homo sapiens
aattatggtgaaatt

SEQ ID NO: 5120621 - DNA, 20 bp, Homo sapiens
aattatggttagtagaggta

SEQ ID NO: 5120622 - DNA, 17 bp, Homo sapiens
aattatgtaaataactc

SEQ ID NO: 5120623 - DNA, 15 bp, Homo sapiens
aattatgtaaattat

SEQ ID NO: 5120624 - DNA, 17 bp, Homo sapiens
aattatgtaaattatgt

SEQ ID NO: 5120625 - DNA, 19 bp, Homo sapiens
aattatgtaacctatttat

SEQ ID NO: 5120626 - DNA, 16 bp, Homo sapiens
aattatgtaatatatt

SEQ ID NO: 5120627 - DNA, 18 bp, Homo sapiens
aattatgtcgtaagtcac

SEQ ID NO: 5120628 - DNA, 13 bp, Homo sapiens
aattatgtctctt

SEQ ID NO: 5120629 - DNA, 11 bp, Homo sapiens
aattatgtgac

SEQ ID NO: 5120630 - DNA, 12 bp, Homo sapiens
aattatgtgaca

SEQ ID NO: 5120631 - DNA, 16 bp, Homo sapiens
aattatgtgacaacct

SEQ ID NO: 5120632 - DNA, 20 bp, Homo sapiens
aattatgtgacattttacat

SEQ ID NO: 5120633 - DNA, 12 bp, Homo sapiens
aattatgtgcat

SEQ ID NO: 5120634 - DNA, 22 bp, Homo sapiens
aattatgtgccagatttatgca

SEQ ID NO: 5120635 - DNA, 22 bp, Homo sapiens
aattatgttactgtatttttca

SEQ ID NO: 5120636 - DNA, 19 bp, Homo sapiens
aattatgttattgaaaaaa

SEQ ID NO: 5120637 - DNA, 12 bp, Homo sapiens
aattatgtttct

SEQ ID NO: 5120638 - DNA, 15 bp, Homo sapiens
aattatgtttgaaaa

SEQ ID NO: 5120639 - DNA, 21 bp, Homo sapiens
aatgctgtgccctaaagtgta

SEQ ID NO: 5120640 - DNA, 12 bp, Homo sapiens
aatgctgtgtta

SEQ ID NO: 5120641 - DNA, 13 bp, Homo sapiens
aatgctgttaata

SEQ ID NO: 5120642 - DNA, 20 bp, Homo sapiens
aatgctgttagtaaatttct

SEQ ID NO: 5120643 - DNA, 22 bp, Homo sapiens
aatgctgttagtaaatttctgt

SEQ ID NO: 5120644 - DNA, 18 bp, Homo sapiens
aatgctgttcgttcaaaa

SEQ ID NO: 5120645 - DNA, 15 bp, Homo sapiens
aatgctgttctgatt

SEQ ID NO: 5120646 - DNA, 16 bp, Homo sapiens
aatgctgttgtaaaca

SEQ ID NO: 5120647 - DNA, 14 bp, Homo sapiens
aatgctgtttctaa

SEQ ID NO: 5120648 - DNA, 15 bp, Homo sapiens
aatgctgtttctaag

SEQ ID NO: 5120649 - DNA, 19 bp, Homo sapiens
aatgctgtttctaagaaaa

SEQ ID NO: 5120650 - DNA, 21 bp, Homo sapiens
aatgcttaaagaattcaaatt

SEQ ID NO: 5120651 - DNA, 17 bp, Homo sapiens
aatgcttaaatttcaga

SEQ ID NO: 5120652 - DNA, 21 bp, Homo sapiens
aatgcttaagagggaatgata

SEQ ID NO: 5120653 - DNA, 12 bp, Homo sapiens
aatgcttaagat

SEQ ID NO: 5120654 - DNA, 23 bp, Homo sapiens
aatgcttaataataattgaagaa

SEQ ID NO: 5120655 - DNA, 15 bp, Homo sapiens
aatgcttaatttcta

SEQ ID NO: 5120656 - DNA, 17 bp, Homo sapiens
aatgcttaatttctaaa

SEQ ID NO: 5120657 - DNA, 23 bp, Homo sapiens
aatgcttacctaatttcatttta

SEQ ID NO: 5120658 - DNA, 14 bp, Homo sapiens
aatgcttatggaaa

SEQ ID NO: 5120659 - DNA, 16 bp, Homo sapiens
aatgcttcatcccttt

SEQ ID NO: 5120660 - DNA, 13 bp, Homo sapiens
aatgcttcattat

SEQ ID NO: 5120661 - DNA, 14 bp, Homo sapiens
aatgcttcattatt

SEQ ID NO: 5120662 - DNA, 17 bp, Homo sapiens
aatgcttcattcaatat

SEQ ID NO: 5120663 - DNA, 20 bp, Homo sapiens
aatgcttcattcaatattga

SEQ ID NO: 5120664 - DNA, 20 bp, Homo sapiens
aatgcttccaatcttgcttt

SEQ ID NO: 5120665 - DNA, 21 bp, Homo sapiens
aatgcttccaatcttgctttg

SEQ ID NO: 5120666 - DNA, 22 bp, Homo sapiens
aatgcttccactaccaaaagac

SEQ ID NO: 5120667 - DNA, 21 bp, Homo sapiens
aatgcttcctgacaatcaact

SEQ ID NO: 5120668 - DNA, 21 bp, Homo sapiens
aatgcttcgttttctaaagga

SEQ ID NO: 5120669 - DNA, 18 bp, Homo sapiens
aatgcttctaagtaaata

SEQ ID NO: 5120670 - DNA, 21 bp, Homo sapiens
aatgcttctaagtaaatacaa

SEQ ID NO: 5120671 - DNA, 19 bp, Homo sapiens
aatgcttctgatttagcaa

SEQ ID NO: 5120672 - DNA, 19 bp, Homo sapiens
aatgcttctgcctcagctt

SEQ ID NO: 5120673 - DNA, 17 bp, Homo sapiens
aatgcttctgtagcttc

SEQ ID NO: 5120674 - DNA, 19 bp, Homo sapiens
aatgcttctttcctcttaa

SEQ ID NO: 5120675 - DNA, 16 bp, Homo sapiens
aatgcttgcatggaga

SEQ ID NO: 5120676 - DNA, 18 bp, Homo sapiens
aatgcttgccaagaaatc

SEQ ID NO: 5120677 - DNA, 21 bp, Homo sapiens
aatgcttggaatatctgctgt

SEQ ID NO: 5120678 - DNA, 21 bp, Homo sapiens
aatgcttggcttctcatacgt

SEQ ID NO: 5120679 - DNA, 17 bp, Homo sapiens
aatgctttaaatagttt

SEQ ID NO: 5120680 - DNA, 18 bp, Homo sapiens
aatgctttagcatactag

SEQ ID NO: 5120681 - DNA, 16 bp, Homo sapiens
aatgctttatttgtaa

SEQ ID NO: 5120682 - DNA, 17 bp, Homo sapiens
aatgctttatttgtaaa

SEQ ID NO: 5120683 - DNA, 19 bp, Homo sapiens
aatgctttatttgtaaatt

SEQ ID NO: 5120684 - DNA, 21 bp, Homo sapiens
aatgctttatttgtaaattta

SEQ ID NO: 5120685 - DNA, 12 bp, Homo sapiens
aatgctttcgat

SEQ ID NO: 5120686 - DNA, 11 bp, Homo sapiens
aatgctttctc

SEQ ID NO: 5120687 - DNA, 12 bp, Homo sapiens
aatgctttctca

SEQ ID NO: 5120688 - DNA, 13 bp, Homo sapiens
aatgctttctcat

SEQ ID NO: 5120689 - DNA, 14 bp, Homo sapiens
aatgctttctcatg

SEQ ID NO: 5120690 - DNA, 16 bp, Homo sapiens
aatgctttctctcctc

SEQ ID NO: 5120691 - DNA, 13 bp, Homo sapiens
aatgctttctgaa

SEQ ID NO: 5120692 - DNA, 12 bp, Homo sapiens
aatgctttgaaa

SEQ ID NO: 5120693 - DNA, 12 bp, Homo sapiens
aatgctttgata

SEQ ID NO: 5120694 - DNA, 19 bp, Homo sapiens
aatgctttgataaaatatt

SEQ ID NO: 5120695 - DNA, 18 bp, Homo sapiens
aatgctttgatatttcaa

SEQ ID NO: 5120696 - DNA, 19 bp, Homo sapiens
aatgctttgattgttcata

SEQ ID NO: 5120697 - DNA, 14 bp, Homo sapiens
aatgctttggaaaa

SEQ ID NO: 5120698 - DNA, 20 bp, Homo sapiens
aatgctttgggaactgtgtt

SEQ ID NO: 5120699 - DNA, 20 bp, Homo sapiens
aatgctttgggaggccaagg

SEQ ID NO: 5120700 - DNA, 19 bp, Homo sapiens
aatgctttgtgtgattgaa

SEQ ID NO: 5120701 - DNA, 15 bp, Homo sapiens
aatgcttttaatgaa

SEQ ID NO: 5120702 - DNA, 16 bp, Homo sapiens
aatgcttttagtgtgt

SEQ ID NO: 5120703 - DNA, 21 bp, Homo sapiens
aatgcttttagtgtgtgcata

SEQ ID NO: 5120704 - DNA, 23 bp, Homo sapiens
aatgcttttatatggcccagcct

SEQ ID NO: 5120705 - DNA, 15 bp, Homo sapiens
aatgcttttatattc

SEQ ID NO: 5120706 - DNA, 19 bp, Homo sapiens
aatgcttttatattctaat

SEQ ID NO: 5120707 - DNA, 12 bp, Homo sapiens
aatgcttttcta

SEQ ID NO: 5120708 - DNA, 19 bp, Homo sapiens
aatgcttttctaattaata

SEQ ID NO: 5120709 - DNA, 23 bp, Homo sapiens
aatgcttttctagcaactgttgg

SEQ ID NO: 5120710 - DNA, 19 bp, Homo sapiens
aatgctttttatttctgca

SEQ ID NO: 5120711 - DNA, 11 bp, Homo sapiens
aatgctttttg

SEQ ID NO: 5120712 - DNA, 14 bp, Homo sapiens
aatgctttttgaat

SEQ ID NO: 5120713 - DNA, 17 bp, Homo sapiens
aatgctttttgaatgtt

SEQ ID NO: 5120714 - DNA, 16 bp, Homo sapiens
aatggaaaaaaacata

SEQ ID NO: 5120715 - DNA, 15 bp, Homo sapiens
aatggaaaaatagta

SEQ ID NO: 5120716 - DNA, 15 bp, Homo sapiens
aatggaaaatataca

SEQ ID NO: 5120717 - DNA, 17 bp, Homo sapiens
aatggaaaatatacaag

SEQ ID NO: 5120718 - DNA, 18 bp, Homo sapiens
aatggaaaatatacaagt

SEQ ID NO: 5120719 - DNA, 16 bp, Homo sapiens
aatggaaaatgtatat

SEQ ID NO: 5120720 - DNA, 19 bp, Homo sapiens
aatggaaaattaattctaa

SEQ ID NO: 5120721 - DNA, 17 bp, Homo sapiens
aatggaaacaccactgc

SEQ ID NO: 5120722 - DNA, 16 bp, Homo sapiens
aatggaaacagactca

SEQ ID NO: 5120723 - DNA, 16 bp, Homo sapiens
aatggaaacagggcag

SEQ ID NO: 5120724 - DNA, 18 bp, Homo sapiens
aatggaaacattacagtt

SEQ ID NO: 5120725 - DNA, 19 bp, Homo sapiens
aatggaaaccacaactttt

SEQ ID NO: 5120726 - DNA, 12 bp, Homo sapiens
aatggaaactga

SEQ ID NO: 5120727 - DNA, 13 bp, Homo sapiens
aatggaaagaagg

SEQ ID NO: 5120728 - DNA, 16 bp, Homo sapiens
aatggaaagaaggaaa

SEQ ID NO: 5120729 - DNA, 17 bp, Homo sapiens
aatggaaagaaggaaaa

SEQ ID NO: 5120730 - DNA, 17 bp, Homo sapiens
aatggaaagtcatgcaa

SEQ ID NO: 5120731 - DNA, 20 bp, Homo sapiens
aatggaaatgggcagagcag

SEQ ID NO: 5120732 - DNA, 21 bp, Homo sapiens
aatggaaattaaaactcattt

SEQ ID NO: 5120733 - DNA, 19 bp, Homo sapiens
aatggaacagatttcaaaa

SEQ ID NO: 5120734 - DNA, 14 bp, Homo sapiens
aatggaaccactct

SEQ ID NO: 5120735 - DNA, 18 bp, Homo sapiens
aatggaaccccaccactg

SEQ ID NO: 5120736 - DNA, 22 bp, Homo sapiens
aatggaacctcctttctcttct

SEQ ID NO: 5120737 - DNA, 14 bp, Homo sapiens
aatggaactgaccc

SEQ ID NO: 5120738 - DNA, 13 bp, Homo sapiens
aatggaagaaacc

SEQ ID NO: 5120739 - DNA, 18 bp, Homo sapiens
aatggaagacagctctta

SEQ ID NO: 5120740 - DNA, 14 bp, Homo sapiens
aatggaagagaaat

SEQ ID NO: 5120741 - DNA, 18 bp, Homo sapiens
aatggaagagaaatctca

SEQ ID NO: 5120742 - DNA, 17 bp, Homo sapiens
aatggaagcaaagacaa

SEQ ID NO: 5120743 - DNA, 22 bp, Homo sapiens
aatggaagcaaagacaaaagaa

SEQ ID NO: 5120744 - DNA, 18 bp, Homo sapiens
aatggaataaaaggcttg

SEQ ID NO: 5120745 - DNA, 13 bp, Homo sapiens
aatggaataacta

SEQ ID NO: 5120746 - DNA, 18 bp, Homo sapiens
aatggaataactatctca

SEQ ID NO: 5120747 - DNA, 20 bp, Homo sapiens
aatggaataactatctcact

SEQ ID NO: 5120748 - DNA, 18 bp, Homo sapiens
aatggaatataaatatca

SEQ ID NO: 5120749 - DNA, 16 bp, Homo sapiens
aatggaatcgatttcc

SEQ ID NO: 5120750 - DNA, 12 bp, Homo sapiens
aatggaatgtgg

SEQ ID NO: 5120751 - DNA, 17 bp, Homo sapiens
aatggaattcagtaaca

SEQ ID NO: 5120752 - DNA, 20 bp, Homo sapiens
aatggacaaagctcaggaat

SEQ ID NO: 5120753 - DNA, 20 bp, Homo sapiens
aatggacaaataagtttttg

SEQ ID NO: 5120754 - DNA, 14 bp, Homo sapiens
aatggacacaaatt

SEQ ID NO: 5120755 - DNA, 15 bp, Homo sapiens
aatggacacaaattt

SEQ ID NO: 5120756 - DNA, 12 bp, Homo sapiens
aatggacacttt

SEQ ID NO: 5120757 - DNA, 14 bp, Homo sapiens
aatggacagaatgt

SEQ ID NO: 5120758 - DNA, 20 bp, Homo sapiens
aatggacctatctgtaagag

SEQ ID NO: 5120759 - DNA, 16 bp, Homo sapiens
aatggacgtgttatga

SEQ ID NO: 5120760 - DNA, 18 bp, Homo sapiens
aatggactaagatgaaat

SEQ ID NO: 5120761 - DNA, 19 bp, Homo sapiens
aatggactaagatgaaatg

SEQ ID NO: 5120762 - DNA, 20 bp, Homo sapiens
aatggactgtacaataagtt

SEQ ID NO: 5120763 - DNA, 18 bp, Homo sapiens
aatggactgtgaatttca

SEQ ID NO: 5120764 - DNA, 17 bp, Homo sapiens
aatggactttggaagca

SEQ ID NO: 5120765 - DNA, 15 bp, Homo sapiens
aatggagaaagctgt

SEQ ID NO: 5120766 - DNA, 15 bp, Homo sapiens
aatggagaaatgaag

SEQ ID NO: 5120767 - DNA, 17 bp, Homo sapiens
aatggagaagctgcagg

SEQ ID NO: 5120768 - DNA, 16 bp, Homo sapiens
aatggagaatcacttt

SEQ ID NO: 5120769 - DNA, 22 bp, Homo sapiens
aatggagaattaaaactttgta

SEQ ID NO: 5120770 - DNA, 13 bp, Homo sapiens
aatggagaggaac

SEQ ID NO: 5120771 - DNA, 20 bp, Homo sapiens
aatggagatttgaaggtctg

SEQ ID NO: 5120772 - DNA, 17 bp, Homo sapiens
aatggagcatcaagcca

SEQ ID NO: 5120773 - DNA, 16 bp, Homo sapiens
aatggagcttgtacat

SEQ ID NO: 5120774 - DNA, 23 bp, Homo sapiens
aatggaggaagaacaacaaagac

SEQ ID NO: 5120775 - DNA, 17 bp, Homo sapiens
aatggaggagccaggcc

SEQ ID NO: 5120776 - DNA, 20 bp, Homo sapiens
aatggaggccaagcctgcag

SEQ ID NO: 5120777 - DNA, 21 bp, Homo sapiens
aatggaggccaagcctgcagc

SEQ ID NO: 5120778 - DNA, 12 bp, Homo sapiens
aatggaggcttt

SEQ ID NO: 5120779 - DNA, 14 bp, Homo sapiens
aatggaggcttttc

SEQ ID NO: 5120780 - DNA, 21 bp, Homo sapiens
aatggaggggcagagccagga

SEQ ID NO: 5120781 - DNA, 17 bp, Homo sapiens
aatggaggtcccagccc

SEQ ID NO: 5120782 - DNA, 19 bp, Homo sapiens
aatggaggtcccagccctg

SEQ ID NO: 5120783 - DNA, 18 bp, Homo sapiens
aatggagtaaagtggcaa

SEQ ID NO: 5120784 - DNA, 21 bp, Homo sapiens
aatggagtagacccctggctg

SEQ ID NO: 5120785 - DNA, 22 bp, Homo sapiens
aatggagtcatttgagtctctt

SEQ ID NO: 5120786 - DNA, 15 bp, Homo sapiens
aatggagtccagacc

SEQ ID NO: 5120787 - DNA, 15 bp, Homo sapiens
aatggagtgggagat

SEQ ID NO: 5120788 - DNA, 19 bp, Homo sapiens
aatggagttggagttcatt

SEQ ID NO: 5120789 - DNA, 13 bp, Homo sapiens
aatggataaatca

SEQ ID NO: 5120790 - DNA, 18 bp, Homo sapiens
aatggatataatctgaat

SEQ ID NO: 5120791 - DNA, 23 bp, Homo sapiens
aatggatatagaaaatcttagta

SEQ ID NO: 5120792 - DNA, 14 bp, Homo sapiens
aatggatattatta

SEQ ID NO: 5120793 - DNA, 17 bp, Homo sapiens
aatggatcacaagatgg

SEQ ID NO: 5120794 - DNA, 18 bp, Homo sapiens
aatggatcacaagatgga

SEQ ID NO: 5120795 - DNA, 18 bp, Homo sapiens
aatggatgacaaagaaaa

SEQ ID NO: 5120796 - DNA, 15 bp, Homo sapiens
aatggatgtaatata

SEQ ID NO: 5120797 - DNA, 17 bp, Homo sapiens
aatggatgtaatatagg

SEQ ID NO: 5120798 - DNA, 13 bp, Homo sapiens
aatggattaaatg

SEQ ID NO: 5120799 - DNA, 16 bp, Homo sapiens
aatggattaaatggca

SEQ ID NO: 5120800 - DNA, 17 bp, Homo sapiens
aatggattaaatggcac

SEQ ID NO: 5120801 - DNA, 18 bp, Homo sapiens
aatggattggattattta

SEQ ID NO: 5120802 - DNA, 20 bp, Homo sapiens
aatggattggattatttaat

SEQ ID NO: 5120803 - DNA, 12 bp, Homo sapiens
aatggattgtta

SEQ ID NO: 5120804 - DNA, 19 bp, Homo sapiens
aatggattgttaatttcag

SEQ ID NO: 5120805 - DNA, 21 bp, Homo sapiens
aatggatttgatgctgtttga

SEQ ID NO: 5120806 - DNA, 23 bp, Homo sapiens
aatggcaaagcggttgcttctgg

SEQ ID NO: 5120807 - DNA, 21 bp, Homo sapiens
aatggcaacaaactgcacatg

SEQ ID NO: 5120808 - DNA, 23 bp, Homo sapiens
aatggcacaatctcggctcactg

SEQ ID NO: 5120809 - DNA, 10 bp, Homo sapiens
aatggcacct

SEQ ID NO: 5120810 - DNA, 17 bp, Homo sapiens
aatggcacctgtatacc

SEQ ID NO: 5120811 - DNA, 19 bp, Homo sapiens
aatggcacgatctcagctc

SEQ ID NO: 5120812 - DNA, 22 bp, Homo sapiens
aatggcacgatctcagctcacc

SEQ ID NO: 5120813 - DNA, 11 bp, Homo sapiens
aatggcagagc

SEQ ID NO: 5120814 - DNA, 12 bp, Homo sapiens
aatggcagcaga

SEQ ID NO: 5120815 - DNA, 13 bp, Homo sapiens
aatggcagcaggg

SEQ ID NO: 5120816 - DNA, 13 bp, Homo sapiens
aatggcagctaga

SEQ ID NO: 5120817 - DNA, 19 bp, Homo sapiens
aatggcagctagactggag

SEQ ID NO: 5120818 - DNA, 18 bp, Homo sapiens
aatggcagctagtgcctt

SEQ ID NO: 5120819 - DNA, 19 bp, Homo sapiens
aattatgttttaaacacat

SEQ ID NO: 5120820 - DNA, 20 bp, Homo sapiens
aattatgttttcaactcagg

SEQ ID NO: 5120821 - DNA, 13 bp, Homo sapiens
aattattaaaaat

SEQ ID NO: 5120822 - DNA, 15 bp, Homo sapiens
aattattaaaaatta

SEQ ID NO: 5120823 - DNA, 16 bp, Homo sapiens
aattattaatgaaaat

SEQ ID NO: 5120824 - DNA, 14 bp, Homo sapiens
aattattaatgaat

SEQ ID NO: 5120825 - DNA, 12 bp, Homo sapiens
aattattaattg

SEQ ID NO: 5120826 - DNA, 15 bp, Homo sapiens
aattattacactgta

SEQ ID NO: 5120827 - DNA, 13 bp, Homo sapiens
aattattacttta

SEQ ID NO: 5120828 - DNA, 18 bp, Homo sapiens
aattattactttaaatta

SEQ ID NO: 5120829 - DNA, 22 bp, Homo sapiens
aattattactttaaattatatg

SEQ ID NO: 5120830 - DNA, 13 bp, Homo sapiens
aattattagaaca

SEQ ID NO: 5120831 - DNA, 20 bp, Homo sapiens
aattattagaacattcactt

SEQ ID NO: 5120832 - DNA, 18 bp, Homo sapiens
aattattagcaccagctt

SEQ ID NO: 5120833 - DNA, 16 bp, Homo sapiens
aattattagcatttgt

SEQ ID NO: 5120834 - DNA, 17 bp, Homo sapiens
aattattagcatttgtt

SEQ ID NO: 5120835 - DNA, 23 bp, Homo sapiens
aattattaggagtaattcttttc

SEQ ID NO: 5120836 - DNA, 13 bp, Homo sapiens
aattattataaaa

SEQ ID NO: 5120837 - DNA, 15 bp, Homo sapiens
aattattataaaaat

SEQ ID NO: 5120838 - DNA, 17 bp, Homo sapiens
aattattataaaaatat

SEQ ID NO: 5120839 - DNA, 15 bp, Homo sapiens
aattattatatattt

SEQ ID NO: 5120840 - DNA, 15 bp, Homo sapiens
aattattatattgaa

SEQ ID NO: 5120841 - DNA, 17 bp, Homo sapiens
aattattatcttcttaa

SEQ ID NO: 5120842 - DNA, 23 bp, Homo sapiens
aattattatcttcttaacagttt

SEQ ID NO: 5120843 - DNA, 23 bp, Homo sapiens
aattattatgactcaataaaaga

SEQ ID NO: 5120844 - DNA, 15 bp, Homo sapiens
aattattatttaact

SEQ ID NO: 5120845 - DNA, 16 bp, Homo sapiens
aattattatttaactc

SEQ ID NO: 5120846 - DNA, 16 bp, Homo sapiens
aattattatttatata

SEQ ID NO: 5120847 - DNA, 18 bp, Homo sapiens
aattattatttgtgtttt

SEQ ID NO: 5120848 - DNA, 13 bp, Homo sapiens
aattattatttta

SEQ ID NO: 5120849 - DNA, 20 bp, Homo sapiens
aattattattttaaaatata

SEQ ID NO: 5120850 - DNA, 17 bp, Homo sapiens
aattattcagtgaattt

SEQ ID NO: 5120851 - DNA, 13 bp, Homo sapiens
aattattcagtta

SEQ ID NO: 5120852 - DNA, 17 bp, Homo sapiens
aattattcagttaagaa

SEQ ID NO: 5120853 - DNA, 18 bp, Homo sapiens
aattattcagttaagaaa

SEQ ID NO: 5120854 - DNA, 20 bp, Homo sapiens
aattattcagttaagaaaaa

SEQ ID NO: 5120855 - DNA, 18 bp, Homo sapiens
aattattcctctttgccc

SEQ ID NO: 5120856 - DNA, 19 bp, Homo sapiens
aattattccttcttactct

SEQ ID NO: 5120857 - DNA, 12 bp, Homo sapiens
aattattctaat

SEQ ID NO: 5120858 - DNA, 18 bp, Homo sapiens
aattattctaattttata

SEQ ID NO: 5120859 - DNA, 19 bp, Homo sapiens
aattattctagtcaactgc

SEQ ID NO: 5120860 - DNA, 13 bp, Homo sapiens
aattattctgatt

SEQ ID NO: 5120861 - DNA, 14 bp, Homo sapiens
aattattgacactg

SEQ ID NO: 5120862 - DNA, 19 bp, Homo sapiens
aattattgacactgaactt

SEQ ID NO: 5120863 - DNA, 17 bp, Homo sapiens
aattattgatacaacag

SEQ ID NO: 5120864 - DNA, 22 bp, Homo sapiens
aattattgatacaacaggattt

SEQ ID NO: 5120865 - DNA, 14 bp, Homo sapiens
aattattgattgct

SEQ ID NO: 5120866 - DNA, 21 bp, Homo sapiens
aattattgcactagagaaaat

SEQ ID NO: 5120867 - DNA, 12 bp, Homo sapiens
aattattgctta

SEQ ID NO: 5120868 - DNA, 14 bp, Homo sapiens
aattattggcaaag

SEQ ID NO: 5120869 - DNA, 15 bp, Homo sapiens
aattattggcaaagt

SEQ ID NO: 5120870 - DNA, 17 bp, Homo sapiens
aattattggcaaagttt

SEQ ID NO: 5120871 - DNA, 15 bp, Homo sapiens
aattattggtatatt

SEQ ID NO: 5120872 - DNA, 20 bp, Homo sapiens
aattattggtatatttgtag

SEQ ID NO: 5120873 - DNA, 23 bp, Homo sapiens
aattattggttggtgtgaagaaa

SEQ ID NO: 5120874 - DNA, 11 bp, Homo sapiens
aattattgtaa

SEQ ID NO: 5120875 - DNA, 14 bp, Homo sapiens
aattattgtacact

SEQ ID NO: 5120876 - DNA, 16 bp, Homo sapiens
aattattgtagacatg

SEQ ID NO: 5120877 - DNA, 12 bp, Homo sapiens
aattattgtata

SEQ ID NO: 5120878 - DNA, 16 bp, Homo sapiens
aattattgtgatttcc

SEQ ID NO: 5120879 - DNA, 10 bp, Homo sapiens
aattattgtt

SEQ ID NO: 5120880 - DNA, 22 bp, Homo sapiens
aattatttaaaccgctaaaaga

SEQ ID NO: 5120881 - DNA, 14 bp, Homo sapiens
aattatttaaagaa

SEQ ID NO: 5120882 - DNA, 21 bp, Homo sapiens
aattatttaaataaaatcacc

SEQ ID NO: 5120883 - DNA, 17 bp, Homo sapiens
aattatttaaatgtact

SEQ ID NO: 5120884 - DNA, 18 bp, Homo sapiens
aattatttaaatgtactt

SEQ ID NO: 5120885 - DNA, 19 bp, Homo sapiens
aattatttaatatgcatct

SEQ ID NO: 5120886 - DNA, 14 bp, Homo sapiens
aattatttatattt

SEQ ID NO: 5120887 - DNA, 23 bp, Homo sapiens
aattatttatatttcctgtattg

SEQ ID NO: 5120888 - DNA, 22 bp, Homo sapiens
aattatttattaaatgcccagc

SEQ ID NO: 5120889 - DNA, 20 bp, Homo sapiens
aattatttatttatggagga

SEQ ID NO: 5120890 - DNA, 19 bp, Homo sapiens
aattatttcacaaataata

SEQ ID NO: 5120891 - DNA, 13 bp, Homo sapiens
aattatttcagat

SEQ ID NO: 5120892 - DNA, 23 bp, Homo sapiens
aattatttcatacaaaactgttc

SEQ ID NO: 5120893 - DNA, 22 bp, Homo sapiens
aattatttcatgattagaaatt

SEQ ID NO: 5120894 - DNA, 20 bp, Homo sapiens
aattatttctaaaacattaa

SEQ ID NO: 5120895 - DNA, 18 bp, Homo sapiens
aattatttctttattaac

SEQ ID NO: 5120896 - DNA, 14 bp, Homo sapiens
aattatttgaatga

SEQ ID NO: 5120897 - DNA, 20 bp, Homo sapiens
aattatttgattatttaaga

SEQ ID NO: 5120898 - DNA, 13 bp, Homo sapiens
aattatttgctaa

SEQ ID NO: 5120899 - DNA, 19 bp, Homo sapiens
aattatttgtgtaatagaa

SEQ ID NO: 5120900 - DNA, 21 bp, Homo sapiens
aattatttgttactgtatcct

SEQ ID NO: 5120901 - DNA, 15 bp, Homo sapiens
aattattttaaaata

SEQ ID NO: 5120902 - DNA, 17 bp, Homo sapiens
aattattttaaaatatt

SEQ ID NO: 5120903 - DNA, 19 bp, Homo sapiens
aattattttaaaatattta

SEQ ID NO: 5120904 - DNA, 18 bp, Homo sapiens
aattattttaaacaaaat

SEQ ID NO: 5120905 - DNA, 17 bp, Homo sapiens
aattattttaaattata

SEQ ID NO: 5120906 - DNA, 22 bp, Homo sapiens
aattattttaataatgttgcct

SEQ ID NO: 5120907 - DNA, 19 bp, Homo sapiens
aattattttaatattttgt

SEQ ID NO: 5120908 - DNA, 20 bp, Homo sapiens
aattattttaatattttgta

SEQ ID NO: 5120909 - DNA, 16 bp, Homo sapiens
aattattttaattagg

SEQ ID NO: 5120910 - DNA, 15 bp, Homo sapiens
aattattttatgtca

SEQ ID NO: 5120911 - DNA, 14 bp, Homo sapiens
aattattttctgag

SEQ ID NO: 5120912 - DNA, 22 bp, Homo sapiens
aattattttctttttgtaatta

SEQ ID NO: 5120913 - DNA, 18 bp, Homo sapiens
aattattttgataaatta

SEQ ID NO: 5120914 - DNA, 11 bp, Homo sapiens
aattattttgt

SEQ ID NO: 5120915 - DNA, 18 bp, Homo sapiens
aattattttgttcataca

SEQ ID NO: 5120916 - DNA, 23 bp, Homo sapiens
aattattttgttgtgattttgta

SEQ ID NO: 5120917 - DNA, 17 bp, Homo sapiens
aattatttttaagaaat

SEQ ID NO: 5120918 - DNA, 20 bp, Homo sapiens
aattatttttgagcaggagc

SEQ ID NO: 5120919 - DNA, 21 bp, Homo sapiens
aattatttttgagcaggagca

SEQ ID NO: 5120920 - DNA, 14 bp, Homo sapiens
aattatttttgtgt

SEQ ID NO: 5120921 - DNA, 17 bp, Homo sapiens
aattattttttagataa

SEQ ID NO: 5120922 - DNA, 16 bp, Homo sapiens
aattattttttctatg

SEQ ID NO: 5120923 - DNA, 16 bp, Homo sapiens
aattattttttttctt

SEQ ID NO: 5120924 - DNA, 21 bp, Homo sapiens
aattatttttttttttgttct

SEQ ID NO: 5120925 - DNA, 23 bp, Homo sapiens
aattcaaaaagaactaaatatgc

SEQ ID NO: 5120926 - DNA, 14 bp, Homo sapiens
aattcaaaaagtgt

SEQ ID NO: 5120927 - DNA, 16 bp, Homo sapiens
aattcaaaaagtgttt

SEQ ID NO: 5120928 - DNA, 17 bp, Homo sapiens
aattcaaaaatgtacaa

SEQ ID NO: 5120929 - DNA, 22 bp, Homo sapiens
aattcaaaaatgtacaaaataa

SEQ ID NO: 5120930 - DNA, 13 bp, Homo sapiens
aattcaaaagtaa

SEQ ID NO: 5120931 - DNA, 14 bp, Homo sapiens
aattcaaaagtaag

SEQ ID NO: 5120932 - DNA, 15 bp, Homo sapiens
aattcaaaagtattg

SEQ ID NO: 5120933 - DNA, 22 bp, Homo sapiens
aattcaaaagttccaagagtct

SEQ ID NO: 5120934 - DNA, 23 bp, Homo sapiens
aattcaaaagttccaagagtcta

SEQ ID NO: 5120935 - DNA, 16 bp, Homo sapiens
aattcaaaatactttt

SEQ ID NO: 5120936 - DNA, 20 bp, Homo sapiens
aattcaaacaattcaatcaa

SEQ ID NO: 5120937 - DNA, 13 bp, Homo sapiens
aattcaaaccatt

SEQ ID NO: 5120938 - DNA, 13 bp, Homo sapiens
aattcaaacctaa

SEQ ID NO: 5120939 - DNA, 11 bp, Homo sapiens
aattcaaagaa

SEQ ID NO: 5120940 - DNA, 20 bp, Homo sapiens
aattcaaagaaaaccctaag

SEQ ID NO: 5120941 - DNA, 16 bp, Homo sapiens
aattcaaagataacat

SEQ ID NO: 5120942 - DNA, 19 bp, Homo sapiens
aattcaaagcatggacatt

SEQ ID NO: 5120943 - DNA, 18 bp, Homo sapiens
aattcaaagcatgtcaag

SEQ ID NO: 5120944 - DNA, 15 bp, Homo sapiens
aattcaacacattac

SEQ ID NO: 5120945 - DNA, 16 bp, Homo sapiens
aattcaacacattact

SEQ ID NO: 5120946 - DNA, 17 bp, Homo sapiens
aattcaacatcaaaact

SEQ ID NO: 5120947 - DNA, 19 bp, Homo sapiens
aattcaacatcaaaactta

SEQ ID NO: 5120948 - DNA, 15 bp, Homo sapiens
aattcaactcagact

SEQ ID NO: 5120949 - DNA, 20 bp, Homo sapiens
aattcaactggaaattaaaa

SEQ ID NO: 5120950 - DNA, 21 bp, Homo sapiens
aattcaactggaaattaaaaa

SEQ ID NO: 5120951 - DNA, 12 bp, Homo sapiens
aattcaacttaa

SEQ ID NO: 5120952 - DNA, 21 bp, Homo sapiens
aattcaacttaactatcatct

SEQ ID NO: 5120953 - DNA, 12 bp, Homo sapiens
aattcaagaaaa

SEQ ID NO: 5120954 - DNA, 19 bp, Homo sapiens
aattcaagaaaataaaact

SEQ ID NO: 5120955 - DNA, 18 bp, Homo sapiens
aattcaagaaatgacagt

SEQ ID NO: 5120956 - DNA, 20 bp, Homo sapiens
aattcaagagctagaaaaat

SEQ ID NO: 5120957 - DNA, 23 bp, Homo sapiens
aattcaaggaatttcttaacttc

SEQ ID NO: 5120958 - DNA, 18 bp, Homo sapiens
aattcaaggccacaaaaa

SEQ ID NO: 5120959 - DNA, 13 bp, Homo sapiens
aattcaaggcctt

SEQ ID NO: 5120960 - DNA, 14 bp, Homo sapiens
aattcaatcaaagc

SEQ ID NO: 5120961 - DNA, 11 bp, Homo sapiens
aattcaatgaa

SEQ ID NO: 5120962 - DNA, 12 bp, Homo sapiens
aattcaatgaaa

SEQ ID NO: 5120963 - DNA, 16 bp, Homo sapiens
aattcaatgaaatgga

SEQ ID NO: 5120964 - DNA, 22 bp, Homo sapiens
aattcaatgcaatgaaaacaaa

SEQ ID NO: 5120965 - DNA, 23 bp, Homo sapiens
aattcaatgcttctatcagactc

SEQ ID NO: 5120966 - DNA, 22 bp, Homo sapiens
aattcaatgggtaaataaatgc

SEQ ID NO: 5120967 - DNA, 21 bp, Homo sapiens
aattcaatgtgaacactggca

SEQ ID NO: 5120968 - DNA, 22 bp, Homo sapiens
aattcaatgtgaacactggcac

SEQ ID NO: 5120969 - DNA, 13 bp, Homo sapiens
aattcaattaaaa

SEQ ID NO: 5120970 - DNA, 18 bp, Homo sapiens
aattcaattaaaaccatt

SEQ ID NO: 5120971 - DNA, 15 bp, Homo sapiens
aattcaattcaaagc

SEQ ID NO: 5120972 - DNA, 17 bp, Homo sapiens
aattcaattgtaaattg

SEQ ID NO: 5120973 - DNA, 19 bp, Homo sapiens
aattcaattgtaaattgaa

SEQ ID NO: 5120974 - DNA, 19 bp, Homo sapiens
aattcaatttctcacaata

SEQ ID NO: 5120975 - DNA, 21 bp, Homo sapiens
aattcaatttctcacaataga

SEQ ID NO: 5120976 - DNA, 13 bp, Homo sapiens
aattcacaaagta

SEQ ID NO: 5120977 - DNA, 14 bp, Homo sapiens
aattcacaagctaa

SEQ ID NO: 5120978 - DNA, 15 bp, Homo sapiens
aattcacaagctaac

SEQ ID NO: 5120979 - DNA, 12 bp, Homo sapiens
aattcacacctt

SEQ ID NO: 5120980 - DNA, 15 bp, Homo sapiens
aattcacagcacagt

SEQ ID NO: 5120981 - DNA, 13 bp, Homo sapiens
aattcaccaattt

SEQ ID NO: 5120982 - DNA, 21 bp, Homo sapiens
aattcacctatgttattttgt

SEQ ID NO: 5120983 - DNA, 23 bp, Homo sapiens
aattcacctatgttattttgtgt

SEQ ID NO: 5120984 - DNA, 18 bp, Homo sapiens
aattcacctcagcctgga

SEQ ID NO: 5120985 - DNA, 21 bp, Homo sapiens
aattcacctcagcctggagag

SEQ ID NO: 5120986 - DNA, 22 bp, Homo sapiens
aattcactaatcttgaatgttt

SEQ ID NO: 5120987 - DNA, 20 bp, Homo sapiens
aattcactcaagcactgata

SEQ ID NO: 5120988 - DNA, 17 bp, Homo sapiens
aattcactccagtcaac

SEQ ID NO: 5120989 - DNA, 23 bp, Homo sapiens
aattcactcccacacccaagaag

SEQ ID NO: 5120990 - DNA, 23 bp, Homo sapiens
aattcactctgagtgttttatga

SEQ ID NO: 5120991 - DNA, 21 bp, Homo sapiens
aattcactgtactatcaggtt

SEQ ID NO: 5120992 - DNA, 13 bp, Homo sapiens
aattcactgttga

SEQ ID NO: 5120993 - DNA, 21 bp, Homo sapiens
aattcactgttgaatgcctgt

SEQ ID NO: 5120994 - DNA, 17 bp, Homo sapiens
aattcacttaagttttt

SEQ ID NO: 5120995 - DNA, 16 bp, Homo sapiens
aattcactttcatttt

SEQ ID NO: 5120996 - DNA, 21 bp, Homo sapiens
aattcactttcatttttgata

SEQ ID NO: 5120997 - DNA, 18 bp, Homo sapiens
aattcagaactaaatttt

SEQ ID NO: 5120998 - DNA, 20 bp, Homo sapiens
aatggcaggggaagccttgc

SEQ ID NO: 5120999 - DNA, 13 bp, Homo sapiens
aatggcagtcctg

SEQ ID NO: 5121000 - DNA, 14 bp, Homo sapiens
aatggcagtcctgg

SEQ ID NO: 5121001 - DNA, 18 bp, Homo sapiens
aatggcagtcctggaggc

SEQ ID NO: 5121002 - DNA, 18 bp, Homo sapiens
aatggcagtgagatgtca

SEQ ID NO: 5121003 - DNA, 13 bp, Homo sapiens
aatggcagtttga

SEQ ID NO: 5121004 - DNA, 20 bp, Homo sapiens
aatggcatccagggctgcca

SEQ ID NO: 5121005 - DNA, 21 bp, Homo sapiens
aatggcatctcgttgtaagta

SEQ ID NO: 5121006 - DNA, 20 bp, Homo sapiens
aatggcatgagaaatacaaa

SEQ ID NO: 5121007 - DNA, 17 bp, Homo sapiens
aatggcatggcaggagt

SEQ ID NO: 5121008 - DNA, 22 bp, Homo sapiens
aatggcattattaggtcttaaa

SEQ ID NO: 5121009 - DNA, 16 bp, Homo sapiens
aatggcatttagcaca

SEQ ID NO: 5121010 - DNA, 20 bp, Homo sapiens
aatggcatttagcacagtat

SEQ ID NO: 5121011 - DNA, 21 bp, Homo sapiens
aatggcatttagcacagtatt

SEQ ID NO: 5121012 - DNA, 14 bp, Homo sapiens
aatggccaagtgta

SEQ ID NO: 5121013 - DNA, 16 bp, Homo sapiens
aatggccagagcctct

SEQ ID NO: 5121014 - DNA, 21 bp, Homo sapiens
aatggccagagcctctggccc

SEQ ID NO: 5121015 - DNA, 23 bp, Homo sapiens
aatggccagcccagatggctccc

SEQ ID NO: 5121016 - DNA, 19 bp, Homo sapiens
aatggccaggggccaggag

SEQ ID NO: 5121017 - DNA, 13 bp, Homo sapiens
aatggccagtgct

SEQ ID NO: 5121018 - DNA, 16 bp, Homo sapiens
aatggccagtgctgct

SEQ ID NO: 5121019 - DNA, 18 bp, Homo sapiens
aatggcccggcccctcct

SEQ ID NO: 5121020 - DNA, 16 bp, Homo sapiens
aatggccggctggaaa

SEQ ID NO: 5121021 - DNA, 20 bp, Homo sapiens
aatggcctcatgtggctgga

SEQ ID NO: 5121022 - DNA, 22 bp, Homo sapiens
aatggcctcatgtggctggaag

SEQ ID NO: 5121023 - DNA, 14 bp, Homo sapiens
aatggcctcttaaa

SEQ ID NO: 5121024 - DNA, 22 bp, Homo sapiens
aatggcctgccttgaagccact

SEQ ID NO: 5121025 - DNA, 14 bp, Homo sapiens
aatggccttcatat

SEQ ID NO: 5121026 - DNA, 14 bp, Homo sapiens
aatggccttccata

SEQ ID NO: 5121027 - DNA, 14 bp, Homo sapiens
aatggccttcccgc

SEQ ID NO: 5121028 - DNA, 21 bp, Homo sapiens
aatggccttcccgccggaggc

SEQ ID NO: 5121029 - DNA, 13 bp, Homo sapiens
aatggcctttatt

SEQ ID NO: 5121030 - DNA, 18 bp, Homo sapiens
aatggcgcagtgcctctg

SEQ ID NO: 5121031 - DNA, 21 bp, Homo sapiens
aatggcgcctgctccctccag

SEQ ID NO: 5121032 - DNA, 22 bp, Homo sapiens
aatggcgcgatctcagctcacc

SEQ ID NO: 5121033 - DNA, 16 bp, Homo sapiens
aatggcgtctgctctg

SEQ ID NO: 5121034 - DNA, 16 bp, Homo sapiens
aatggctagtactgta

SEQ ID NO: 5121035 - DNA, 15 bp, Homo sapiens
aatggctatgaacag

SEQ ID NO: 5121036 - DNA, 16 bp, Homo sapiens
aatggctatgaacaga

SEQ ID NO: 5121037 - DNA, 16 bp, Homo sapiens
aatggctatgttttta

SEQ ID NO: 5121038 - DNA, 15 bp, Homo sapiens
aatggctcagatgcc

SEQ ID NO: 5121039 - DNA, 18 bp, Homo sapiens
aatggctcgtgggctctg

SEQ ID NO: 5121040 - DNA, 21 bp, Homo sapiens
aatggctcgtgggctctggct

SEQ ID NO: 5121041 - DNA, 14 bp, Homo sapiens
aatggctctgtgaa

SEQ ID NO: 5121042 - DNA, 16 bp, Homo sapiens
aatggctctgtgaaat

SEQ ID NO: 5121043 - DNA, 19 bp, Homo sapiens
aatggctctgtgaaatcag

SEQ ID NO: 5121044 - DNA, 21 bp, Homo sapiens
aatggctctgtgaaatcagaa

SEQ ID NO: 5121045 - DNA, 18 bp, Homo sapiens
aatggctgacctgacctg

SEQ ID NO: 5121046 - DNA, 16 bp, Homo sapiens
aatggctgataatttt

SEQ ID NO: 5121047 - DNA, 15 bp, Homo sapiens
aatggctgggtcagg

SEQ ID NO: 5121048 - DNA, 13 bp, Homo sapiens
aatggctgtaaac

SEQ ID NO: 5121049 - DNA, 16 bp, Homo sapiens
aatggctgtaaactat

SEQ ID NO: 5121050 - DNA, 18 bp, Homo sapiens
aatggcttacttacaaaa

SEQ ID NO: 5121051 - DNA, 22 bp, Homo sapiens
aatggcttacttacaaaagcag

SEQ ID NO: 5121052 - DNA, 21 bp, Homo sapiens
aatggcttatccagctggtga

SEQ ID NO: 5121053 - DNA, 18 bp, Homo sapiens
aatggcttgtctttgcta

SEQ ID NO: 5121054 - DNA, 15 bp, Homo sapiens
aatggctttgtatag

SEQ ID NO: 5121055 - DNA, 18 bp, Homo sapiens
aatggctttgtcttgaaa

SEQ ID NO: 5121056 - DNA, 16 bp, Homo sapiens
aatgggaaaatatata

SEQ ID NO: 5121057 - DNA, 15 bp, Homo sapiens
aatgggaagactcag

SEQ ID NO: 5121058 - DNA, 19 bp, Homo sapiens
aatgggaatcatggcctct

SEQ ID NO: 5121059 - DNA, 21 bp, Homo sapiens
aatgggaattgcgctcagggg

SEQ ID NO: 5121060 - DNA, 22 bp, Homo sapiens
aatgggacattagcattgagtt

SEQ ID NO: 5121061 - DNA, 21 bp, Homo sapiens
aatgggaccgtgccccacctc

SEQ ID NO: 5121062 - DNA, 14 bp, Homo sapiens
aatgggacctgtgg

SEQ ID NO: 5121063 - DNA, 16 bp, Homo sapiens
aatgggacgaggacat

SEQ ID NO: 5121064 - DNA, 14 bp, Homo sapiens
aatgggactggagt

SEQ ID NO: 5121065 - DNA, 18 bp, Homo sapiens
aatgggagacagcctctt

SEQ ID NO: 5121066 - DNA, 24 bp, Homo sapiens
aatgggagacttgagtgataatag

SEQ ID NO: 5121067 - DNA, 19 bp, Homo sapiens
aatgggagaggcaataaat

SEQ ID NO: 5121068 - DNA, 12 bp, Homo sapiens
aatgggagccag

SEQ ID NO: 5121069 - DNA, 15 bp, Homo sapiens
aatgggagccaggag

SEQ ID NO: 5121070 - DNA, 16 bp, Homo sapiens
aatgggagctgagcag

SEQ ID NO: 5121071 - DNA, 16 bp, Homo sapiens
aatgggaggcctctga

SEQ ID NO: 5121072 - DNA, 19 bp, Homo sapiens
aatgggagggggctccatg

SEQ ID NO: 5121073 - DNA, 16 bp, Homo sapiens
aatgggatcatgaaag

SEQ ID NO: 5121074 - DNA, 12 bp, Homo sapiens
aatgggatctat

SEQ ID NO: 5121075 - DNA, 23 bp, Homo sapiens
aatgggatggtcggatctcacag

SEQ ID NO: 5121076 - DNA, 23 bp, Homo sapiens
aatgggatgtatgaatacagcag

SEQ ID NO: 5121077 - DNA, 15 bp, Homo sapiens
aatgggattttctag

SEQ ID NO: 5121078 - DNA, 23 bp, Homo sapiens
aatgggattttctagtttcctgc

SEQ ID NO: 5121079 - DNA, 19 bp, Homo sapiens
aatgggatttttcttttga

SEQ ID NO: 5121080 - DNA, 12 bp, Homo sapiens
aatgggcacagc

SEQ ID NO: 5121081 - DNA, 23 bp, Homo sapiens
aatgggcactgggatgagccgct

SEQ ID NO: 5121082 - DNA, 19 bp, Homo sapiens
aatgggcacttaaagcttt

SEQ ID NO: 5121083 - DNA, 20 bp, Homo sapiens
aatgggcagctccatcctct

SEQ ID NO: 5121084 - DNA, 15 bp, Homo sapiens
aatgggcaggtggcc

SEQ ID NO: 5121085 - DNA, 17 bp, Homo sapiens
aatgggcagttacatgc

SEQ ID NO: 5121086 - DNA, 19 bp, Homo sapiens
aatgggcatttattttata

SEQ ID NO: 5121087 - DNA, 22 bp, Homo sapiens
aatgggcatttctaaaatgtta

SEQ ID NO: 5121088 - DNA, 16 bp, Homo sapiens
aatgggcattttacaa

SEQ ID NO: 5121089 - DNA, 20 bp, Homo sapiens
aatgggccaattaaaatata

SEQ ID NO: 5121090 - DNA, 14 bp, Homo sapiens
aatgggcctgcctg

SEQ ID NO: 5121091 - DNA, 15 bp, Homo sapiens
aatgggctctccggg

SEQ ID NO: 5121092 - DNA, 21 bp, Homo sapiens
aatgggctgctgtcattttat

SEQ ID NO: 5121093 - DNA, 17 bp, Homo sapiens
aatgggcttagagcagt

SEQ ID NO: 5121094 - DNA, 15 bp, Homo sapiens
aatgggctttaacaa

SEQ ID NO: 5121095 - DNA, 17 bp, Homo sapiens
aatggggaactccccca

SEQ ID NO: 5121096 - DNA, 18 bp, Homo sapiens
aatggggaactcccccag

SEQ ID NO: 5121097 - DNA, 21 bp, Homo sapiens
aatggggaactcccccagagg

SEQ ID NO: 5121098 - DNA, 16 bp, Homo sapiens
aatggggacctggggt

SEQ ID NO: 5121099 - DNA, 18 bp, Homo sapiens
aatggggactctccaggc

SEQ ID NO: 5121100 - DNA, 14 bp, Homo sapiens
aatggggagctggc

SEQ ID NO: 5121101 - DNA, 15 bp, Homo sapiens
aatggggagctggcc

SEQ ID NO: 5121102 - DNA, 16 bp, Homo sapiens
aatggggagctggcct

SEQ ID NO: 5121103 - DNA, 14 bp, Homo sapiens
aatggggattatta

SEQ ID NO: 5121104 - DNA, 14 bp, Homo sapiens
aatggggcagacac

SEQ ID NO: 5121105 - DNA, 14 bp, Homo sapiens
aatggggcgctgga

SEQ ID NO: 5121106 - DNA, 15 bp, Homo sapiens
aatggggcgctggac

SEQ ID NO: 5121107 - DNA, 16 bp, Homo sapiens
aatggggcttgccctg

SEQ ID NO: 5121108 - DNA, 23 bp, Homo sapiens
aatgggggcaggaaagccacatc

SEQ ID NO: 5121109 - DNA, 16 bp, Homo sapiens
aatgggggcctccgct

SEQ ID NO: 5121110 - DNA, 20 bp, Homo sapiens
aatgggggcctcttcaaatt

SEQ ID NO: 5121111 - DNA, 21 bp, Homo sapiens
aatgggggctttcggggaggg

SEQ ID NO: 5121112 - DNA, 22 bp, Homo sapiens
aatgggggctttcggggagggc

SEQ ID NO: 5121113 - DNA, 18 bp, Homo sapiens
aatggggggcgggccagg

SEQ ID NO: 5121114 - DNA, 20 bp, Homo sapiens
aatggggggcgggccagggt

SEQ ID NO: 5121115 - DNA, 18 bp, Homo sapiens
aatggggtcctggccatc

SEQ ID NO: 5121116 - DNA, 14 bp, Homo sapiens
aatggggtgagctc

SEQ ID NO: 5121117 - DNA, 15 bp, Homo sapiens
aatggggtgggccca

SEQ ID NO: 5121118 - DNA, 21 bp, Homo sapiens
aatggggtttgggcccctcag

SEQ ID NO: 5121119 - DNA, 16 bp, Homo sapiens
aatgggtaagggaggg

SEQ ID NO: 5121120 - DNA, 17 bp, Homo sapiens
aatgggtaagggaggga

SEQ ID NO: 5121121 - DNA, 18 bp, Homo sapiens
aatgggtaagggagggaa

SEQ ID NO: 5121122 - DNA, 23 bp, Homo sapiens
aatgggtaagggagggaagggga

SEQ ID NO: 5121123 - DNA, 16 bp, Homo sapiens
aatgggtagcaacagg

SEQ ID NO: 5121124 - DNA, 12 bp, Homo sapiens
aatggtaacttt

SEQ ID NO: 5121125 - DNA, 16 bp, Homo sapiens
aatggtaacttttgta

SEQ ID NO: 5121126 - DNA, 14 bp, Homo sapiens
aatggtaataagca

SEQ ID NO: 5121127 - DNA, 18 bp, Homo sapiens
aatggtaatagaatagca

SEQ ID NO: 5121128 - DNA, 14 bp, Homo sapiens
aatggtaatttagt

SEQ ID NO: 5121129 - DNA, 15 bp, Homo sapiens
aatggtaatttagtg

SEQ ID NO: 5121130 - DNA, 15 bp, Homo sapiens
aatggtaccagataa

SEQ ID NO: 5121131 - DNA, 15 bp, Homo sapiens
aatggtactcccaaa

SEQ ID NO: 5121132 - DNA, 19 bp, Homo sapiens
aatggtactcccaaactga

SEQ ID NO: 5121133 - DNA, 18 bp, Homo sapiens
aatggtactgactttgct

SEQ ID NO: 5121134 - DNA, 16 bp, Homo sapiens
aatggtagcattttaa

SEQ ID NO: 5121135 - DNA, 12 bp, Homo sapiens
aatggtagtttc

SEQ ID NO: 5121136 - DNA, 14 bp, Homo sapiens
aatggtagtttctg

SEQ ID NO: 5121137 - DNA, 16 bp, Homo sapiens
aatggtataaatttca

SEQ ID NO: 5121138 - DNA, 16 bp, Homo sapiens
aatggtatcaaaatta

SEQ ID NO: 5121139 - DNA, 16 bp, Homo sapiens
aatggtatctgttact

SEQ ID NO: 5121140 - DNA, 12 bp, Homo sapiens
aatggtatcttt

SEQ ID NO: 5121141 - DNA, 17 bp, Homo sapiens
aatggtattttttgtga

SEQ ID NO: 5121142 - DNA, 20 bp, Homo sapiens
aatggtccaattagtttcct

SEQ ID NO: 5121143 - DNA, 21 bp, Homo sapiens
aatggtcccaattaagaaatt

SEQ ID NO: 5121144 - DNA, 17 bp, Homo sapiens
aatggtcccatccaggc

SEQ ID NO: 5121145 - DNA, 20 bp, Homo sapiens
aatggtccgtgctaaggact

SEQ ID NO: 5121146 - DNA, 21 bp, Homo sapiens
aatggtctcatctcctttgct

SEQ ID NO: 5121147 - DNA, 13 bp, Homo sapiens
aatggtctggcaa

SEQ ID NO: 5121148 - DNA, 15 bp, Homo sapiens
aatggtctggcaata

SEQ ID NO: 5121149 - DNA, 21 bp, Homo sapiens
aatggtcttctgccagcccat

SEQ ID NO: 5121150 - DNA, 22 bp, Homo sapiens
aatggtctttctaatgtgtgaa

SEQ ID NO: 5121151 - DNA, 18 bp, Homo sapiens
aatggtctttgctccaga

SEQ ID NO: 5121152 - DNA, 22 bp, Homo sapiens
aatggtgaactgtcattacaga

SEQ ID NO: 5121153 - DNA, 12 bp, Homo sapiens
aatggtgactga

SEQ ID NO: 5121154 - DNA, 17 bp, Homo sapiens
aatggtgagaattaaaa

SEQ ID NO: 5121155 - DNA, 18 bp, Homo sapiens
aatggtgatccacccagt

SEQ ID NO: 5121156 - DNA, 13 bp, Homo sapiens
aatggtgatttta

SEQ ID NO: 5121157 - DNA, 15 bp, Homo sapiens
aatggtgcccttgga

SEQ ID NO: 5121158 - DNA, 10 bp, Homo sapiens
aatggtgctt

SEQ ID NO: 5121159 - DNA, 15 bp, Homo sapiens
aatggtgcttccccc

SEQ ID NO: 5121160 - DNA, 12 bp, Homo sapiens
aatggtggagga

SEQ ID NO: 5121161 - DNA, 17 bp, Homo sapiens
aatggtggcttcagctc

SEQ ID NO: 5121162 - DNA, 21 bp, Homo sapiens
aatggtggcttcagctccagc

SEQ ID NO: 5121163 - DNA, 23 bp, Homo sapiens
aatggtggcttcttttctttgta

SEQ ID NO: 5121164 - DNA, 19 bp, Homo sapiens
aatggtgggaaccctcccc

SEQ ID NO: 5121165 - DNA, 19 bp, Homo sapiens
aatggtgggctccagagta

SEQ ID NO: 5121166 - DNA, 23 bp, Homo sapiens
aatggtggtcttctccaccagcc

SEQ ID NO: 5121167 - DNA, 18 bp, Homo sapiens
aatggtggtttgtcatat

SEQ ID NO: 5121168 - DNA, 13 bp, Homo sapiens
aatggtgtacata

SEQ ID NO: 5121169 - DNA, 19 bp, Homo sapiens
aatggtgtagaacactaat

SEQ ID NO: 5121170 - DNA, 14 bp, Homo sapiens
aatggtgtgggaga

SEQ ID NO: 5121171 - DNA, 17 bp, Homo sapiens
aatggtgttactaaagt

SEQ ID NO: 5121172 - DNA, 17 bp, Homo sapiens
aatggtgttatttgaaa

SEQ ID NO: 5121173 - DNA, 22 bp, Homo sapiens
aatggtgttttgtcagacttcc

SEQ ID NO: 5121174 - DNA, 14 bp, Homo sapiens
aatggttaaatttt

SEQ ID NO: 5121175 - DNA, 15 bp, Homo sapiens
aatggttaaatttta

SEQ ID NO: 5121176 - DNA, 17 bp, Homo sapiens
aatggttaaattttaca

SEQ ID NO: 5121177 - DNA, 15 bp, Homo sapiens
aattcagaaggatct

SEQ ID NO: 5121178 - DNA, 21 bp, Homo sapiens
aattcagacaacattatgatc

SEQ ID NO: 5121179 - DNA, 21 bp, Homo sapiens
aattcagacatctgaggtttt

SEQ ID NO: 5121180 - DNA, 19 bp, Homo sapiens
aattcagatcaaaatgcct

SEQ ID NO: 5121181 - DNA, 20 bp, Homo sapiens
aattcagatgttttacgcaa

SEQ ID NO: 5121182 - DNA, 16 bp, Homo sapiens
aattcagattgtttaa

SEQ ID NO: 5121183 - DNA, 18 bp, Homo sapiens
aattcagcaccctgggtg

SEQ ID NO: 5121184 - DNA, 15 bp, Homo sapiens
aattcagcagtttta

SEQ ID NO: 5121185 - DNA, 22 bp, Homo sapiens
aattcagcccaccagccacctc

SEQ ID NO: 5121186 - DNA, 22 bp, Homo sapiens
aattcagcctactgcctcggat

SEQ ID NO: 5121187 - DNA, 13 bp, Homo sapiens
aattcaggactgg

SEQ ID NO: 5121188 - DNA, 15 bp, Homo sapiens
aattcaggcacatgt

SEQ ID NO: 5121189 - DNA, 23 bp, Homo sapiens
aattcagggctttaaacatgatt

SEQ ID NO: 5121190 - DNA, 22 bp, Homo sapiens
aattcagggtggtaaagtatgt

SEQ ID NO: 5121191 - DNA, 21 bp, Homo sapiens
aattcaggtcccagttgctgt

SEQ ID NO: 5121192 - DNA, 16 bp, Homo sapiens
aattcaggtctgtatg

SEQ ID NO: 5121193 - DNA, 17 bp, Homo sapiens
aattcaggtctgtatgt

SEQ ID NO: 5121194 - DNA, 22 bp, Homo sapiens
aattcaggtctgtatgtcatgg

SEQ ID NO: 5121195 - DNA, 20 bp, Homo sapiens
aattcaggtgctagaagcct

SEQ ID NO: 5121196 - DNA, 21 bp, Homo sapiens
aattcaggtgctagaagccta

SEQ ID NO: 5121197 - DNA, 12 bp, Homo sapiens
aattcagtaaca

SEQ ID NO: 5121198 - DNA, 16 bp, Homo sapiens
aattcagtatgtttta

SEQ ID NO: 5121199 - DNA, 23 bp, Homo sapiens
aattcagtatgttttacactgta

SEQ ID NO: 5121200 - DNA, 15 bp, Homo sapiens
aattcagtattttgc

SEQ ID NO: 5121201 - DNA, 21 bp, Homo sapiens
aattcagtcctgggcaaaggt

SEQ ID NO: 5121202 - DNA, 23 bp, Homo sapiens
aattcagtgatgtgcctaaataa

SEQ ID NO: 5121203 - DNA, 16 bp, Homo sapiens
aattcagtgccttcaa

SEQ ID NO: 5121204 - DNA, 16 bp, Homo sapiens
aattcagtgctgtact

SEQ ID NO: 5121205 - DNA, 16 bp, Homo sapiens
aattcagtggacattt

SEQ ID NO: 5121206 - DNA, 20 bp, Homo sapiens
aattcagtgggttcagaacc

SEQ ID NO: 5121207 - DNA, 17 bp, Homo sapiens
aattcagtgtatttcag

SEQ ID NO: 5121208 - DNA, 11 bp, Homo sapiens
aattcagttgt

SEQ ID NO: 5121209 - DNA, 16 bp, Homo sapiens
aattcagtttcacttt

SEQ ID NO: 5121210 - DNA, 18 bp, Homo sapiens
aattcagtttttgtatct

SEQ ID NO: 5121211 - DNA, 19 bp, Homo sapiens
aattcagtttttgtatctt

SEQ ID NO: 5121212 - DNA, 16 bp, Homo sapiens
aattcataaaaataac

SEQ ID NO: 5121213 - DNA, 15 bp, Homo sapiens
aattcataattagaa

SEQ ID NO: 5121214 - DNA, 13 bp, Homo sapiens
aattcatagaata

SEQ ID NO: 5121215 - DNA, 18 bp, Homo sapiens
aattcatataaaagttgc

SEQ ID NO: 5121216 - DNA, 22 bp, Homo sapiens
aattcatataaaagttgcgttt

SEQ ID NO: 5121217 - DNA, 16 bp, Homo sapiens
aattcatataaagtgc

SEQ ID NO: 5121218 - DNA, 23 bp, Homo sapiens
aattcatatttttccttataggg

SEQ ID NO: 5121219 - DNA, 23 bp, Homo sapiens
aattcatcaaatggaagacacat

SEQ ID NO: 5121220 - DNA, 18 bp, Homo sapiens
aattcatcccaactgtct

SEQ ID NO: 5121221 - DNA, 16 bp, Homo sapiens
aattcatctgtctata

SEQ ID NO: 5121222 - DNA, 15 bp, Homo sapiens
aattcatctgtgaat

SEQ ID NO: 5121223 - DNA, 14 bp, Homo sapiens
aattcatctttttt

SEQ ID NO: 5121224 - DNA, 14 bp, Homo sapiens
aattcatgaacttc

SEQ ID NO: 5121225 - DNA, 22 bp, Homo sapiens
aattcatgaagcttactttttt

SEQ ID NO: 5121226 - DNA, 19 bp, Homo sapiens
aattcatgccccagtatta

SEQ ID NO: 5121227 - DNA, 13 bp, Homo sapiens
aattcatgccttt

SEQ ID NO: 5121228 - DNA, 20 bp, Homo sapiens
aattcatggaactttcatac

SEQ ID NO: 5121229 - DNA, 19 bp, Homo sapiens
aattcatggctttttcttt

SEQ ID NO: 5121230 - DNA, 18 bp, Homo sapiens
aattcatgggctgtgtgt

SEQ ID NO: 5121231 - DNA, 19 bp, Homo sapiens
aattcatggtatcttgagt

SEQ ID NO: 5121232 - DNA, 17 bp, Homo sapiens
aattcatggttcaagta

SEQ ID NO: 5121233 - DNA, 18 bp, Homo sapiens
aattcatggttcaagtat

SEQ ID NO: 5121234 - DNA, 17 bp, Homo sapiens
aattcattaaaaacatt

SEQ ID NO: 5121235 - DNA, 19 bp, Homo sapiens
aattcattaaaagttttat

SEQ ID NO: 5121236 - DNA, 14 bp, Homo sapiens
aattcattaaagaa

SEQ ID NO: 5121237 - DNA, 15 bp, Homo sapiens
aattcattaaagaaa

SEQ ID NO: 5121238 - DNA, 22 bp, Homo sapiens
aattcattaaatttctggattt

SEQ ID NO: 5121239 - DNA, 23 bp, Homo sapiens
aattcattaaatttctggatttg

SEQ ID NO: 5121240 - DNA, 17 bp, Homo sapiens
aattcattaatctgttt

SEQ ID NO: 5121241 - DNA, 15 bp, Homo sapiens
aattcattataattt

SEQ ID NO: 5121242 - DNA, 16 bp, Homo sapiens
aattcattcaccagat

SEQ ID NO: 5121243 - DNA, 19 bp, Homo sapiens
aattcattcatacttaaaa

SEQ ID NO: 5121244 - DNA, 15 bp, Homo sapiens
aattcattccatttg

SEQ ID NO: 5121245 - DNA, 17 bp, Homo sapiens
aattcattctggtctct

SEQ ID NO: 5121246 - DNA, 20 bp, Homo sapiens
aattcattgagcagttagct

SEQ ID NO: 5121247 - DNA, 14 bp, Homo sapiens
aattcattggctcc

SEQ ID NO: 5121248 - DNA, 20 bp, Homo sapiens
aattcattgtctcagtgaag

SEQ ID NO: 5121249 - DNA, 16 bp, Homo sapiens
aattcatttaagaaca

SEQ ID NO: 5121250 - DNA, 18 bp, Homo sapiens
aattcatttattaagtat

SEQ ID NO: 5121251 - DNA, 13 bp, Homo sapiens
aattcatttcact

SEQ ID NO: 5121252 - DNA, 15 bp, Homo sapiens
aattcatttcacttt

SEQ ID NO: 5121253 - DNA, 21 bp, Homo sapiens
aattcatttcactttaaagtc

SEQ ID NO: 5121254 - DNA, 12 bp, Homo sapiens
aattcatttcta

SEQ ID NO: 5121255 - DNA, 18 bp, Homo sapiens
aattcatttctagactca

SEQ ID NO: 5121256 - DNA, 19 bp, Homo sapiens
aattcatttctagactcaa

SEQ ID NO: 5121257 - DNA, 13 bp, Homo sapiens
aattcatttgctg

SEQ ID NO: 5121258 - DNA, 16 bp, Homo sapiens
aattcattttctcttt

SEQ ID NO: 5121259 - DNA, 18 bp, Homo sapiens
aattcattttttaaattc

SEQ ID NO: 5121260 - DNA, 17 bp, Homo sapiens
aattccaaacatggttt

SEQ ID NO: 5121261 - DNA, 13 bp, Homo sapiens
aattccaaagatc

SEQ ID NO: 5121262 - DNA, 14 bp, Homo sapiens
aattccaaagcaaa

SEQ ID NO: 5121263 - DNA, 14 bp, Homo sapiens
aattccaaaggaat

SEQ ID NO: 5121264 - DNA, 22 bp, Homo sapiens
aattccaaatttttttcttagg

SEQ ID NO: 5121265 - DNA, 14 bp, Homo sapiens
aattccaacttgaa

SEQ ID NO: 5121266 - DNA, 17 bp, Homo sapiens
aattccaatacattatt

SEQ ID NO: 5121267 - DNA, 21 bp, Homo sapiens
aattccaatatttataattaa

SEQ ID NO: 5121268 - DNA, 17 bp, Homo sapiens
aattccaattaaattta

SEQ ID NO: 5121269 - DNA, 17 bp, Homo sapiens
aattccaatttcaaaat

SEQ ID NO: 5121270 - DNA, 20 bp, Homo sapiens
aattccacaccttttattga

SEQ ID NO: 5121271 - DNA, 13 bp, Homo sapiens
aattccacagctg

SEQ ID NO: 5121272 - DNA, 11 bp, Homo sapiens
aattccacagg

SEQ ID NO: 5121273 - DNA, 19 bp, Homo sapiens
aattccaccagggccagag

SEQ ID NO: 5121274 - DNA, 21 bp, Homo sapiens
aattccacctggaaagccagg

SEQ ID NO: 5121275 - DNA, 22 bp, Homo sapiens
aattccacctggaaagccaggt

SEQ ID NO: 5121276 - DNA, 16 bp, Homo sapiens
aattccactgaaaatt

SEQ ID NO: 5121277 - DNA, 20 bp, Homo sapiens
aattccactgaaaatttaac

SEQ ID NO: 5121278 - DNA, 14 bp, Homo sapiens
aattccactgtcaa

SEQ ID NO: 5121279 - DNA, 21 bp, Homo sapiens
aattccactgtcttgtgtttt

SEQ ID NO: 5121280 - DNA, 14 bp, Homo sapiens
aattccagaatgaa

SEQ ID NO: 5121281 - DNA, 12 bp, Homo sapiens
aattccagagct

SEQ ID NO: 5121282 - DNA, 14 bp, Homo sapiens
aattccagagctgt

SEQ ID NO: 5121283 - DNA, 19 bp, Homo sapiens
aattccagcaataagaaat

SEQ ID NO: 5121284 - DNA, 22 bp, Homo sapiens
aattccagcaataagaaatgaa

SEQ ID NO: 5121285 - DNA, 17 bp, Homo sapiens
aattccaggctgagcca

SEQ ID NO: 5121286 - DNA, 19 bp, Homo sapiens
aattccaggctgagccatg

SEQ ID NO: 5121287 - DNA, 19 bp, Homo sapiens
aattccagttgcaattcat

SEQ ID NO: 5121288 - DNA, 16 bp, Homo sapiens
aattccataaccccag

SEQ ID NO: 5121289 - DNA, 24 bp, Homo sapiens
aattccatagtggaccacttggaa

SEQ ID NO: 5121290 - DNA, 17 bp, Homo sapiens
aattccatatgctccag

SEQ ID NO: 5121291 - DNA, 23 bp, Homo sapiens
aattccatccctaagaattccca

SEQ ID NO: 5121292 - DNA, 14 bp, Homo sapiens
aattccatctatat

SEQ ID NO: 5121293 - DNA, 10 bp, Homo sapiens
aattccatga

SEQ ID NO: 5121294 - DNA, 14 bp, Homo sapiens
aattccattatctt

SEQ ID NO: 5121295 - DNA, 18 bp, Homo sapiens
aattccatttctttctgg

SEQ ID NO: 5121296 - DNA, 19 bp, Homo sapiens
aattcccaacatttcttaa

SEQ ID NO: 5121297 - DNA, 18 bp, Homo sapiens
aattcccagactctgcct

SEQ ID NO: 5121298 - DNA, 16 bp, Homo sapiens
aattcccattttgcaa

SEQ ID NO: 5121299 - DNA, 19 bp, Homo sapiens
aattcccattttgcaaaat

SEQ ID NO: 5121300 - DNA, 12 bp, Homo sapiens
aattccccagat

SEQ ID NO: 5121301 - DNA, 17 bp, Homo sapiens
aattccccttcccttat

SEQ ID NO: 5121302 - DNA, 23 bp, Homo sapiens
aattccctatcttttagttttag

SEQ ID NO: 5121303 - DNA, 22 bp, Homo sapiens
aattccctctctcagcacagcc

SEQ ID NO: 5121304 - DNA, 21 bp, Homo sapiens
aattccctctctctgactctc

SEQ ID NO: 5121305 - DNA, 14 bp, Homo sapiens
aattccctgctgtc

SEQ ID NO: 5121306 - DNA, 14 bp, Homo sapiens
aattccctggggaa

SEQ ID NO: 5121307 - DNA, 22 bp, Homo sapiens
aattccctggggtcaccttcta

SEQ ID NO: 5121308 - DNA, 14 bp, Homo sapiens
aattcccttcctgt

SEQ ID NO: 5121309 - DNA, 22 bp, Homo sapiens
aattcccttcctgttccctcct

SEQ ID NO: 5121310 - DNA, 15 bp, Homo sapiens
aattcccttttaatc

SEQ ID NO: 5121311 - DNA, 17 bp, Homo sapiens
aattccgagtctttctc

SEQ ID NO: 5121312 - DNA, 13 bp, Homo sapiens
aattcctaattct

SEQ ID NO: 5121313 - DNA, 15 bp, Homo sapiens
aattcctaattctat

SEQ ID NO: 5121314 - DNA, 14 bp, Homo sapiens
aattcctacaactt

SEQ ID NO: 5121315 - DNA, 17 bp, Homo sapiens
aattcctacaacttaat

SEQ ID NO: 5121316 - DNA, 12 bp, Homo sapiens
aattcctataag

SEQ ID NO: 5121317 - DNA, 20 bp, Homo sapiens
aattcctcatttgttcatta

SEQ ID NO: 5121318 - DNA, 22 bp, Homo sapiens
aattcctccagagacactgagc

SEQ ID NO: 5121319 - DNA, 16 bp, Homo sapiens
aattcctcctctattt

SEQ ID NO: 5121320 - DNA, 15 bp, Homo sapiens
aattcctccttcccc

SEQ ID NO: 5121321 - DNA, 17 bp, Homo sapiens
aattcctctcaaattca

SEQ ID NO: 5121322 - DNA, 21 bp, Homo sapiens
aattcctctcaaattcagctc

SEQ ID NO: 5121323 - DNA, 23 bp, Homo sapiens
aattcctctcaaattcagctctg

SEQ ID NO: 5121324 - DNA, 21 bp, Homo sapiens
aattcctctcactaaacttta

SEQ ID NO: 5121325 - DNA, 16 bp, Homo sapiens
aattcctcttcattgt

SEQ ID NO: 5121326 - DNA, 14 bp, Homo sapiens
aattcctctttaac

SEQ ID NO: 5121327 - DNA, 22 bp, Homo sapiens
aattcctgctatgacagctggc

SEQ ID NO: 5121328 - DNA, 17 bp, Homo sapiens
aattcctggaacctgga

SEQ ID NO: 5121329 - DNA, 19 bp, Homo sapiens
aattcctggaacctggacc

SEQ ID NO: 5121330 - DNA, 16 bp, Homo sapiens
aattcctggcatgaca

SEQ ID NO: 5121331 - DNA, 22 bp, Homo sapiens
aattcctgtaaccttctatttt

SEQ ID NO: 5121332 - DNA, 14 bp, Homo sapiens
aattcctgtcttcc

SEQ ID NO: 5121333 - DNA, 19 bp, Homo sapiens
aattcctgtttttattatt

SEQ ID NO: 5121334 - DNA, 14 bp, Homo sapiens
aattccttaaatga

SEQ ID NO: 5121335 - DNA, 13 bp, Homo sapiens
aattccttagctt

SEQ ID NO: 5121336 - DNA, 23 bp, Homo sapiens
aattccttagcttagacctcagc

SEQ ID NO: 5121337 - DNA, 21 bp, Homo sapiens
aattccttagtataatattaa

SEQ ID NO: 5121338 - DNA, 21 bp, Homo sapiens
aattccttcgaaaggccttca

SEQ ID NO: 5121339 - DNA, 18 bp, Homo sapiens
aattccttgccccacagt

SEQ ID NO: 5121340 - DNA, 21 bp, Homo sapiens
aattccttggcatgccttcca

SEQ ID NO: 5121341 - DNA, 21 bp, Homo sapiens
aattcctttacaactaaataa

SEQ ID NO: 5121342 - DNA, 19 bp, Homo sapiens
aattccttttctaactctc

SEQ ID NO: 5121343 - DNA, 21 bp, Homo sapiens
aattcgagacaggcagaatca

SEQ ID NO: 5121344 - DNA, 18 bp, Homo sapiens
aattcgagcaaacaactt

SEQ ID NO: 5121345 - DNA, 19 bp, Homo sapiens
aattcgatgcgtattctgt

SEQ ID NO: 5121346 - DNA, 22 bp, Homo sapiens
aattcgcatgtttaatgtgaac

SEQ ID NO: 5121347 - DNA, 21 bp, Homo sapiens
aattcgcccgagctgtttatg

SEQ ID NO: 5121348 - DNA, 19 bp, Homo sapiens
aattcgctttctaaagtta

SEQ ID NO: 5121349 - DNA, 18 bp, Homo sapiens
aattcggtgtgctgccaa

SEQ ID NO: 5121350 - DNA, 22 bp, Homo sapiens
aattcggttgggtaccatgctt

SEQ ID NO: 5121351 - DNA, 23 bp, Homo sapiens
aattcgtacataataagtttcat

SEQ ID NO: 5121352 - DNA, 13 bp, Homo sapiens
aattcgtgtgttt

SEQ ID NO: 5121353 - DNA, 22 bp, Homo sapiens
aattcgtgtgtttttttatgaa

SEQ ID NO: 5121354 - DNA, 22 bp, Homo sapiens
aattcgttgttcccactgaaat

SEQ ID NO: 5121355 - DNA, 13 bp, Homo sapiens
aattcgtttctga

SEQ ID NO: 5121356 - DNA, 19 bp, Homo sapiens
aattctaaaagagaaggga

SEQ ID NO: 5121357 - DNA, 16 bp, Homo sapiens
aattctaaacttagaa

SEQ ID NO: 5121358 - DNA, 23 bp, Homo sapiens
aattctaaacttagaaatatgct

SEQ ID NO: 5121359 - DNA, 16 bp, Homo sapiens
aattctaaattacaaa

SEQ ID NO: 5121360 - DNA, 16 bp, Homo sapiens
aattctaacattaaat

SEQ ID NO: 5121361 - DNA, 22 bp, Homo sapiens
aattctaaccagagcaagcttt

SEQ ID NO: 5121362 - DNA, 14 bp, Homo sapiens
aattctaacttttt

SEQ ID NO: 5121363 - DNA, 19 bp, Homo sapiens
aattctaagattgtacata

SEQ ID NO: 5121364 - DNA, 12 bp, Homo sapiens
aattctaatggt

SEQ ID NO: 5121365 - DNA, 14 bp, Homo sapiens
aattctaatggtaa

SEQ ID NO: 5121366 - DNA, 14 bp, Homo sapiens
aattctaattgtca

SEQ ID NO: 5121367 - DNA, 15 bp, Homo sapiens
aattctacattgtca

SEQ ID NO: 5121368 - DNA, 18 bp, Homo sapiens
aattctaccctgaaagtg

SEQ ID NO: 5121369 - DNA, 16 bp, Homo sapiens
aattctaccctggaaa

SEQ ID NO: 5121370 - DNA, 20 bp, Homo sapiens
aattctactaaatattttat

SEQ ID NO: 5121371 - DNA, 16 bp, Homo sapiens
aattctactaagttat

SEQ ID NO: 5121372 - DNA, 18 bp, Homo sapiens
aattctactaagttattt

SEQ ID NO: 5121373 - DNA, 19 bp, Homo sapiens
aattctactaagttatttt

SEQ ID NO: 5121374 - DNA, 14 bp, Homo sapiens
aattctactggaaa

SEQ ID NO: 5121375 - DNA, 15 bp, Homo sapiens
aattctactggaaaa

SEQ ID NO: 5121376 - DNA, 18 bp, Homo sapiens
aattctactggaaaaaaa

SEQ ID NO: 5121377 - DNA, 14 bp, Homo sapiens
aattctactttgag

SEQ ID NO: 5121378 - DNA, 14 bp, Homo sapiens
aattctagctgtat

SEQ ID NO: 5121379 - DNA, 22 bp, Homo sapiens
aattctagctttgagcttaaga

SEQ ID NO: 5121380 - DNA, 20 bp, Homo sapiens
aattctagcttttttcctcc

SEQ ID NO: 5121381 - DNA, 23 bp, Homo sapiens
aattctagcttttttcctccttt

SEQ ID NO: 5121382 - DNA, 18 bp, Homo sapiens
aattctagtattttatct

SEQ ID NO: 5121383 - DNA, 16 bp, Homo sapiens
aattctagtctctgat

SEQ ID NO: 5121384 - DNA, 12 bp, Homo sapiens
aattctagtgct

SEQ ID NO: 5121385 - DNA, 16 bp, Homo sapiens
aattctagtgctgctg

SEQ ID NO: 5121386 - DNA, 18 bp, Homo sapiens
aattctagtgctgctgaa

SEQ ID NO: 5121387 - DNA, 13 bp, Homo sapiens
aattctataagag

SEQ ID NO: 5121388 - DNA, 21 bp, Homo sapiens
aattctatagagatagatatt

SEQ ID NO: 5121389 - DNA, 15 bp, Homo sapiens
aattctatcctgtga

SEQ ID NO: 5121390 - DNA, 15 bp, Homo sapiens
aattctatgcctgtc

SEQ ID NO: 5121391 - DNA, 13 bp, Homo sapiens
aattctatgttaa

SEQ ID NO: 5121392 - DNA, 14 bp, Homo sapiens
aattctatgttaaa

SEQ ID NO: 5121393 - DNA, 23 bp, Homo sapiens
aattctatgttaaatactgtgca

SEQ ID NO: 5121394 - DNA, 16 bp, Homo sapiens
aattctattgaaaaca

SEQ ID NO: 5121395 - DNA, 16 bp, Homo sapiens
aattctatttctctat

SEQ ID NO: 5121396 - DNA, 14 bp, Homo sapiens
aattctattttgct

SEQ ID NO: 5121397 - DNA, 16 bp, Homo sapiens
aattctattttgctgg

SEQ ID NO: 5121398 - DNA, 17 bp, Homo sapiens
aattctcaacctaccac

SEQ ID NO: 5121399 - DNA, 16 bp, Homo sapiens
aattctcaagacctga

SEQ ID NO: 5121400 - DNA, 13 bp, Homo sapiens
aattctcaagtga

SEQ ID NO: 5121401 - DNA, 19 bp, Homo sapiens
aattctcagaatctcaaat

SEQ ID NO: 5121402 - DNA, 16 bp, Homo sapiens
aattctcatgtgatcc

SEQ ID NO: 5121403 - DNA, 21 bp, Homo sapiens
aattctcatgtgatcctttta

SEQ ID NO: 5121404 - DNA, 14 bp, Homo sapiens
aattctcattatga

SEQ ID NO: 5121405 - DNA, 11 bp, Homo sapiens
aattctccaac

SEQ ID NO: 5121406 - DNA, 18 bp, Homo sapiens
aattctccaggattttaa

SEQ ID NO: 5121407 - DNA, 20 bp, Homo sapiens
aattctcccgcattggtggc

SEQ ID NO: 5121408 - DNA, 19 bp, Homo sapiens
aattctcccgggactctgc

SEQ ID NO: 5121409 - DNA, 18 bp, Homo sapiens
aattctcctgcctttgcc

SEQ ID NO: 5121410 - DNA, 14 bp, Homo sapiens
aattctccttccca

SEQ ID NO: 5121411 - DNA, 11 bp, Homo sapiens
aattctccttt

SEQ ID NO: 5121412 - DNA, 18 bp, Homo sapiens
aattctcgggaaattatt

SEQ ID NO: 5121413 - DNA, 14 bp, Homo sapiens
aattctctctaaaa

SEQ ID NO: 5121414 - DNA, 22 bp, Homo sapiens
aattctctctaaaaataaaatg

SEQ ID NO: 5121415 - DNA, 23 bp, Homo sapiens
aattctctctaaaaataaaatga

SEQ ID NO: 5121416 - DNA, 23 bp, Homo sapiens
aattctcttaatcactactgtat

SEQ ID NO: 5121417 - DNA, 18 bp, Homo sapiens
aattctcttcgctgtgat

SEQ ID NO: 5121418 - DNA, 21 bp, Homo sapiens
aattctcttttcaaacacaca

SEQ ID NO: 5121419 - DNA, 22 bp, Homo sapiens
aattctcttttcaaacacacac

SEQ ID NO: 5121420 - DNA, 16 bp, Homo sapiens
aattctgaaatacttt

SEQ ID NO: 5121421 - DNA, 15 bp, Homo sapiens
aattctgaaccagaa

SEQ ID NO: 5121422 - DNA, 17 bp, Homo sapiens
aattctgaatttgcaaa

SEQ ID NO: 5121423 - DNA, 13 bp, Homo sapiens
aattctgaatttt

SEQ ID NO: 5121424 - DNA, 19 bp, Homo sapiens
aattctgagacatgtgtca

SEQ ID NO: 5121425 - DNA, 20 bp, Homo sapiens
aattctgatgttactgagat

SEQ ID NO: 5121426 - DNA, 13 bp, Homo sapiens
aattctgatttct

SEQ ID NO: 5121427 - DNA, 16 bp, Homo sapiens
aattctgatttctttt

SEQ ID NO: 5121428 - DNA, 13 bp, Homo sapiens
aattctgcaagtt

SEQ ID NO: 5121429 - DNA, 19 bp, Homo sapiens
aattctgcaatgttttcct

SEQ ID NO: 5121430 - DNA, 20 bp, Homo sapiens
aattctgcaatgttttcctt

SEQ ID NO: 5121431 - DNA, 15 bp, Homo sapiens
aattctgcatgtact

SEQ ID NO: 5121432 - DNA, 13 bp, Homo sapiens
aattctgccccca

SEQ ID NO: 5121433 - DNA, 23 bp, Homo sapiens
aattctgccttggttctggccac

SEQ ID NO: 5121434 - DNA, 14 bp, Homo sapiens
aattctgctcctga

SEQ ID NO: 5121435 - DNA, 20 bp, Homo sapiens
aattctgctctaaataaaga

SEQ ID NO: 5121436 - DNA, 12 bp, Homo sapiens
aattctgctgct

SEQ ID NO: 5121437 - DNA, 13 bp, Homo sapiens
aattctgctgctt

SEQ ID NO: 5121438 - DNA, 14 bp, Homo sapiens
aattctgctgcttg

SEQ ID NO: 5121439 - DNA, 20 bp, Homo sapiens
aattctgcttgtgacattaa

SEQ ID NO: 5121440 - DNA, 18 bp, Homo sapiens
aattctggaaatgtcttt

SEQ ID NO: 5121441 - DNA, 13 bp, Homo sapiens
aattctggaagct

SEQ ID NO: 5121442 - DNA, 20 bp, Homo sapiens
aattctggaggaagaagaca

SEQ ID NO: 5121443 - DNA, 14 bp, Homo sapiens
aattctggcccagc

SEQ ID NO: 5121444 - DNA, 17 bp, Homo sapiens
aattctggcccagccaa

SEQ ID NO: 5121445 - DNA, 21 bp, Homo sapiens
aattctggctggtagagcagg

SEQ ID NO: 5121446 - DNA, 15 bp, Homo sapiens
aattctgggaaggga

SEQ ID NO: 5121447 - DNA, 21 bp, Homo sapiens
aattctgggattactgacttt

SEQ ID NO: 5121448 - DNA, 18 bp, Homo sapiens
aattctgggcctaatttt

SEQ ID NO: 5121449 - DNA, 15 bp, Homo sapiens
aattctggtatacat

SEQ ID NO: 5121450 - DNA, 17 bp, Homo sapiens
aattctggtatacattg

SEQ ID NO: 5121451 - DNA, 15 bp, Homo sapiens
aattctggtcctgtt

SEQ ID NO: 5121452 - DNA, 17 bp, Homo sapiens
aattctggtcctgtttt

SEQ ID NO: 5121453 - DNA, 15 bp, Homo sapiens
aattctgtaattaca

SEQ ID NO: 5121454 - DNA, 16 bp, Homo sapiens
aattctgtaattacat

SEQ ID NO: 5121455 - DNA, 14 bp, Homo sapiens
aattctgtaatttg

SEQ ID NO: 5121456 - DNA, 12 bp, Homo sapiens
aattctgtacat

SEQ ID NO: 5121457 - DNA, 19 bp, Homo sapiens
aattctgtacatagcctat

SEQ ID NO: 5121458 - DNA, 21 bp, Homo sapiens
aattctgtacttccaatttat

SEQ ID NO: 5121459 - DNA, 16 bp, Homo sapiens
aattctgtccctgtcc

SEQ ID NO: 5121460 - DNA, 20 bp, Homo sapiens
aattctgtccctgtccctgc

SEQ ID NO: 5121461 - DNA, 23 bp, Homo sapiens
aattctgtggctgccatcagaaa

SEQ ID NO: 5121462 - DNA, 23 bp, Homo sapiens
aattctgtgggtccgataatatc

SEQ ID NO: 5121463 - DNA, 19 bp, Homo sapiens
aattctgttactttgctat

SEQ ID NO: 5121464 - DNA, 16 bp, Homo sapiens
aattctgtttcttgag

SEQ ID NO: 5121465 - DNA, 20 bp, Homo sapiens
aattctgttttgtaaatgta

SEQ ID NO: 5121466 - DNA, 18 bp, Homo sapiens
aattctgtttttaaaaat

SEQ ID NO: 5121467 - DNA, 18 bp, Homo sapiens
aattctgtttttctaggc

SEQ ID NO: 5121468 - DNA, 21 bp, Homo sapiens
aattcttaatttggatctatt

SEQ ID NO: 5121469 - DNA, 16 bp, Homo sapiens
aattcttacagccaag

SEQ ID NO: 5121470 - DNA, 17 bp, Homo sapiens
aattcttacagccaagt

SEQ ID NO: 5121471 - DNA, 19 bp, Homo sapiens
aattcttacctcatttgca

SEQ ID NO: 5121472 - DNA, 21 bp, Homo sapiens
aattcttagcatacattcaga

SEQ ID NO: 5121473 - DNA, 19 bp, Homo sapiens
aattcttattccatattag

SEQ ID NO: 5121474 - DNA, 15 bp, Homo sapiens
aattcttattctttc

SEQ ID NO: 5121475 - DNA, 12 bp, Homo sapiens
aattcttatttt

SEQ ID NO: 5121476 - DNA, 23 bp, Homo sapiens
aattcttattttttaaaaagcta

SEQ ID NO: 5121477 - DNA, 20 bp, Homo sapiens
aattcttcaagaaagaattc

SEQ ID NO: 5121478 - DNA, 24 bp, Homo sapiens
aattcttcaagaaagaattcctgc

SEQ ID NO: 5121479 - DNA, 20 bp, Homo sapiens
aattcttcacatgtaacttt

SEQ ID NO: 5121480 - DNA, 24 bp, Homo sapiens
aattcttcacatgtaactttcgta

SEQ ID NO: 5121481 - DNA, 14 bp, Homo sapiens
aattcttcattata

SEQ ID NO: 5121482 - DNA, 21 bp, Homo sapiens
aattcttccctatctttgcca

SEQ ID NO: 5121483 - DNA, 14 bp, Homo sapiens
aattcttccctggg

SEQ ID NO: 5121484 - DNA, 20 bp, Homo sapiens
aattcttcctctccttccca

SEQ ID NO: 5121485 - DNA, 22 bp, Homo sapiens
aattcttcctgtttgtgtaata

SEQ ID NO: 5121486 - DNA, 13 bp, Homo sapiens
aattcttcctttg

SEQ ID NO: 5121487 - DNA, 15 bp, Homo sapiens
aattcttcctttgta

SEQ ID NO: 5121488 - DNA, 22 bp, Homo sapiens
aattcttctccactttctagcc

SEQ ID NO: 5121489 - DNA, 15 bp, Homo sapiens
aattcttctcctttg

SEQ ID NO: 5121490 - DNA, 22 bp, Homo sapiens
aattcttctcctttgtcaaatg

SEQ ID NO: 5121491 - DNA, 23 bp, Homo sapiens
aattcttctcctttgtcaaatgg

SEQ ID NO: 5121492 - DNA, 15 bp, Homo sapiens
aattcttctgtcctg

SEQ ID NO: 5121493 - DNA, 21 bp, Homo sapiens
aattcttgaaggaaaatgata

SEQ ID NO: 5121494 - DNA, 13 bp, Homo sapiens
aattcttgagaag

SEQ ID NO: 5121495 - DNA, 14 bp, Homo sapiens
aattcttgagaagt

SEQ ID NO: 5121496 - DNA, 14 bp, Homo sapiens
aattcttgatctct

SEQ ID NO: 5121497 - DNA, 15 bp, Homo sapiens
aattcttgatctcta

SEQ ID NO: 5121498 - DNA, 17 bp, Homo sapiens
aattcttgatctctaat

SEQ ID NO: 5121499 - DNA, 19 bp, Homo sapiens
aattcttgatctctaatga

SEQ ID NO: 5121500 - DNA, 20 bp, Homo sapiens
aattcttgcaaagtatccct

SEQ ID NO: 5121501 - DNA, 15 bp, Homo sapiens
aattcttggaatact

SEQ ID NO: 5121502 - DNA, 18 bp, Homo sapiens
aattcttggttgaggaaa

SEQ ID NO: 5121503 - DNA, 18 bp, Homo sapiens
aattcttgtaatttttat

SEQ ID NO: 5121504 - DNA, 17 bp, Homo sapiens
aattctttaaaattaca

SEQ ID NO: 5121505 - DNA, 13 bp, Homo sapiens
aattctttaatga

SEQ ID NO: 5121506 - DNA, 19 bp, Homo sapiens
aattctttacaataaacat

SEQ ID NO: 5121507 - DNA, 13 bp, Homo sapiens
aattctttagatt

SEQ ID NO: 5121508 - DNA, 14 bp, Homo sapiens
aattctttagattt

SEQ ID NO: 5121509 - DNA, 15 bp, Homo sapiens
aattctttagatttt

SEQ ID NO: 5121510 - DNA, 22 bp, Homo sapiens
aattctttagatttttaaattg

SEQ ID NO: 5121511 - DNA, 16 bp, Homo sapiens
aattctttagtactca

SEQ ID NO: 5121512 - DNA, 13 bp, Homo sapiens
aattctttataca

SEQ ID NO: 5121513 - DNA, 19 bp, Homo sapiens
aattctttatacaacagtg

SEQ ID NO: 5121514 - DNA, 22 bp, Homo sapiens
aattctttatacaacagtgcta

SEQ ID NO: 5121515 - DNA, 19 bp, Homo sapiens
aattctttcaatacagata

SEQ ID NO: 5121516 - DNA, 22 bp, Homo sapiens
aattctttcaatacagatatat

SEQ ID NO: 5121517 - DNA, 19 bp, Homo sapiens
aattctttcacttgatgtt

SEQ ID NO: 5121518 - DNA, 22 bp, Homo sapiens
aattctttcctaccttggtcct

SEQ ID NO: 5121519 - DNA, 18 bp, Homo sapiens
aattctttctgtctccct

SEQ ID NO: 5121520 - DNA, 16 bp, Homo sapiens
aattctttgtttatgc

SEQ ID NO: 5121521 - DNA, 15 bp, Homo sapiens
aattctttgtttcct

SEQ ID NO: 5121522 - DNA, 14 bp, Homo sapiens
aattcttttcaaaa

SEQ ID NO: 5121523 - DNA, 13 bp, Homo sapiens
aattcttttctga

SEQ ID NO: 5121524 - DNA, 14 bp, Homo sapiens
aattcttttgaatt

SEQ ID NO: 5121525 - DNA, 13 bp, Homo sapiens
aattctttttcaa

SEQ ID NO: 5121526 - DNA, 14 bp, Homo sapiens
aattctttttcaaa

SEQ ID NO: 5121527 - DNA, 13 bp, Homo sapiens
aattcttttttat

SEQ ID NO: 5121528 - DNA, 16 bp, Homo sapiens
aattcttttttattaa

SEQ ID NO: 5121529 - DNA, 22 bp, Homo sapiens
aattcttttttattaatcactg

SEQ ID NO: 5121530 - DNA, 21 bp, Homo sapiens
aattgaaaaaaattgaaataa

SEQ ID NO: 5121531 - DNA, 19 bp, Homo sapiens
aattgaaaaataaaaacca

SEQ ID NO: 5121532 - DNA, 13 bp, Homo sapiens
aattgaaaacact

SEQ ID NO: 5121533 - DNA, 15 bp, Homo sapiens
aattgaaaacactaa

SEQ ID NO: 5121534 - DNA, 20 bp, Homo sapiens
aatggttaatttttcctgca

SEQ ID NO: 5121535 - DNA, 14 bp, Homo sapiens
aatggttataaaag

SEQ ID NO: 5121536 - DNA, 15 bp, Homo sapiens
aatggttataaaagt

SEQ ID NO: 5121537 - DNA, 19 bp, Homo sapiens
aatggttatgggtcctata

SEQ ID NO: 5121538 - DNA, 14 bp, Homo sapiens
aatggttcatattt

SEQ ID NO: 5121539 - DNA, 19 bp, Homo sapiens
aatggttccatgcctgagg

SEQ ID NO: 5121540 - DNA, 17 bp, Homo sapiens
aatggttgatgatactt

SEQ ID NO: 5121541 - DNA, 23 bp, Homo sapiens
aatggttgatggaaaataaacat

SEQ ID NO: 5121542 - DNA, 13 bp, Homo sapiens
aatggttggtttt

SEQ ID NO: 5121543 - DNA, 12 bp, Homo sapiens
aatggttgtatt

SEQ ID NO: 5121544 - DNA, 16 bp, Homo sapiens
aatggttgtattagat

SEQ ID NO: 5121545 - DNA, 21 bp, Homo sapiens
aatggttgtattagatgttct

SEQ ID NO: 5121546 - DNA, 22 bp, Homo sapiens
aatggttgtgaaatgtaacatg

SEQ ID NO: 5121547 - DNA, 13 bp, Homo sapiens
aatggttgtgtag

SEQ ID NO: 5121548 - DNA, 13 bp, Homo sapiens
aatggtttaacaa

SEQ ID NO: 5121549 - DNA, 22 bp, Homo sapiens
aatggtttaacttctgcctgtg

SEQ ID NO: 5121550 - DNA, 16 bp, Homo sapiens
aatggtttacatgaac

SEQ ID NO: 5121551 - DNA, 19 bp, Homo sapiens
aatggtttactgctgtcat

SEQ ID NO: 5121552 - DNA, 20 bp, Homo sapiens
aatggtttactgctgtcatt

SEQ ID NO: 5121553 - DNA, 16 bp, Homo sapiens
aatggtttcctctgga

SEQ ID NO: 5121554 - DNA, 17 bp, Homo sapiens
aatggtttcctctggat

SEQ ID NO: 5121555 - DNA, 20 bp, Homo sapiens
aatggtttctcattaaactc

SEQ ID NO: 5121556 - DNA, 22 bp, Homo sapiens
aatggtttctcattaaactcta

SEQ ID NO: 5121557 - DNA, 17 bp, Homo sapiens
aatggtttgaatataaa

SEQ ID NO: 5121558 - DNA, 23 bp, Homo sapiens
aatggtttgaatataaacactat

SEQ ID NO: 5121559 - DNA, 22 bp, Homo sapiens
aatggtttgtaaaatccacagc

SEQ ID NO: 5121560 - DNA, 16 bp, Homo sapiens
aatggtttgtcctgat

SEQ ID NO: 5121561 - DNA, 14 bp, Homo sapiens
aatggttttcaaaa

SEQ ID NO: 5121562 - DNA, 13 bp, Homo sapiens
aatggttttcaac

SEQ ID NO: 5121563 - DNA, 17 bp, Homo sapiens
aatggttttcttgtgtg

SEQ ID NO: 5121564 - DNA, 18 bp, Homo sapiens
aatggttttcttgtgtgt

SEQ ID NO: 5121565 - DNA, 21 bp, Homo sapiens
aatggtttttcttttctttat

SEQ ID NO: 5121566 - DNA, 17 bp, Homo sapiens
aatggtttttgttagtt

SEQ ID NO: 5121567 - DNA, 14 bp, Homo sapiens
aatgtaaaaaacaa

SEQ ID NO: 5121568 - DNA, 15 bp, Homo sapiens
aatgtaaaaaacaaa

SEQ ID NO: 5121569 - DNA, 12 bp, Homo sapiens
aatgtaaaaaag

SEQ ID NO: 5121570 - DNA, 23 bp, Homo sapiens
aatgtaaaaaggaatatgaaagt

SEQ ID NO: 5121571 - DNA, 13 bp, Homo sapiens
aatgtaaaaatga

SEQ ID NO: 5121572 - DNA, 14 bp, Homo sapiens
aatgtaaaacacaa

SEQ ID NO: 5121573 - DNA, 14 bp, Homo sapiens
aatgtaaaacacat

SEQ ID NO: 5121574 - DNA, 12 bp, Homo sapiens
aatgtaaaatat

SEQ ID NO: 5121575 - DNA, 14 bp, Homo sapiens
aatgtaaaattcat

SEQ ID NO: 5121576 - DNA, 14 bp, Homo sapiens
aatgtaaactctct

SEQ ID NO: 5121577 - DNA, 16 bp, Homo sapiens
aatgtaaactgtttct

SEQ ID NO: 5121578 - DNA, 20 bp, Homo sapiens
aatgtaaagaacttaaatta

SEQ ID NO: 5121579 - DNA, 22 bp, Homo sapiens
aatgtaaagaacttaaattatg

SEQ ID NO: 5121580 - DNA, 21 bp, Homo sapiens
aatgtaaaggagtcaaaacta

SEQ ID NO: 5121581 - DNA, 19 bp, Homo sapiens
aatgtaaaggtcacttttc

SEQ ID NO: 5121582 - DNA, 12 bp, Homo sapiens
aatgtaaagtct

SEQ ID NO: 5121583 - DNA, 15 bp, Homo sapiens
aatgtaaagtctaga

SEQ ID NO: 5121584 - DNA, 18 bp, Homo sapiens
aatgtaaagttacactgt

SEQ ID NO: 5121585 - DNA, 22 bp, Homo sapiens
aatgtaaagttatgtatttaaa

SEQ ID NO: 5121586 - DNA, 12 bp, Homo sapiens
aatgtaaataaa

SEQ ID NO: 5121587 - DNA, 16 bp, Homo sapiens
aatgtaaataaaacat

SEQ ID NO: 5121588 - DNA, 13 bp, Homo sapiens
aatgtaaataaac

SEQ ID NO: 5121589 - DNA, 22 bp, Homo sapiens
aatgtaaataaactatttatat

SEQ ID NO: 5121590 - DNA, 18 bp, Homo sapiens
aatgtaaatactcatgaa

SEQ ID NO: 5121591 - DNA, 20 bp, Homo sapiens
aatgtaaatattttaaagaa

SEQ ID NO: 5121592 - DNA, 22 bp, Homo sapiens
aatgtaaatattttaaagaatt

SEQ ID NO: 5121593 - DNA, 16 bp, Homo sapiens
aatgtaaatgatttta

SEQ ID NO: 5121594 - DNA, 13 bp, Homo sapiens
aatgtaaatgtct

SEQ ID NO: 5121595 - DNA, 14 bp, Homo sapiens
aatgtaaatgtctc

SEQ ID NO: 5121596 - DNA, 16 bp, Homo sapiens
aatgtaaatgtctcac

SEQ ID NO: 5121597 - DNA, 15 bp, Homo sapiens
aatgtaaatgttatt

SEQ ID NO: 5121598 - DNA, 14 bp, Homo sapiens
aatgtaaattagtt

SEQ ID NO: 5121599 - DNA, 19 bp, Homo sapiens
aatgtaaattagtttgaca

SEQ ID NO: 5121600 - DNA, 14 bp, Homo sapiens
aatgtaaatttata

SEQ ID NO: 5121601 - DNA, 12 bp, Homo sapiens
aatgtaaatttg

SEQ ID NO: 5121602 - DNA, 15 bp, Homo sapiens
aatgtaaatttgtac

SEQ ID NO: 5121603 - DNA, 17 bp, Homo sapiens
aatgtaaatttgtacta

SEQ ID NO: 5121604 - DNA, 16 bp, Homo sapiens
aatgtaacatcataat

SEQ ID NO: 5121605 - DNA, 14 bp, Homo sapiens
aatgtaacatgaag

SEQ ID NO: 5121606 - DNA, 14 bp, Homo sapiens
aatgtaacatgttt

SEQ ID NO: 5121607 - DNA, 12 bp, Homo sapiens
aatgtaactgtt

SEQ ID NO: 5121608 - DNA, 20 bp, Homo sapiens
aatgtaactgttaccattgg

SEQ ID NO: 5121609 - DNA, 14 bp, Homo sapiens
aatgtaacttaatt

SEQ ID NO: 5121610 - DNA, 15 bp, Homo sapiens
aatgtaacttagaga

SEQ ID NO: 5121611 - DNA, 16 bp, Homo sapiens
aatgtaacttattcca

SEQ ID NO: 5121612 - DNA, 18 bp, Homo sapiens
aatgtaagaaaagctgat

SEQ ID NO: 5121613 - DNA, 23 bp, Homo sapiens
aatgtaagaatcattgtaaacat

SEQ ID NO: 5121614 - DNA, 19 bp, Homo sapiens
aatgtaagattatagattc

SEQ ID NO: 5121615 - DNA, 13 bp, Homo sapiens
aatgtaagcaaag

SEQ ID NO: 5121616 - DNA, 22 bp, Homo sapiens
aatgtaagcaaaggctctgaaa

SEQ ID NO: 5121617 - DNA, 16 bp, Homo sapiens
aatgtaagcatacttt

SEQ ID NO: 5121618 - DNA, 15 bp, Homo sapiens
aatgtaagctctact

SEQ ID NO: 5121619 - DNA, 14 bp, Homo sapiens
aatgtaagctgttt

SEQ ID NO: 5121620 - DNA, 17 bp, Homo sapiens
aatgtaaggctgtgtaa

SEQ ID NO: 5121621 - DNA, 23 bp, Homo sapiens
aatgtaagggctataagtagaaa

SEQ ID NO: 5121622 - DNA, 23 bp, Homo sapiens
aatgtaagggtctgttgtaaatg

SEQ ID NO: 5121623 - DNA, 19 bp, Homo sapiens
aatgtaagtaaatgtctgt

SEQ ID NO: 5121624 - DNA, 14 bp, Homo sapiens
aatgtaataataat

SEQ ID NO: 5121625 - DNA, 18 bp, Homo sapiens
aatgtaatagaagcttaa

SEQ ID NO: 5121626 - DNA, 15 bp, Homo sapiens
aatgtaatataatgt

SEQ ID NO: 5121627 - DNA, 19 bp, Homo sapiens
aatgtaatcaatgtttctt

SEQ ID NO: 5121628 - DNA, 22 bp, Homo sapiens
aatgtaatgtttttatttcaat

SEQ ID NO: 5121629 - DNA, 23 bp, Homo sapiens
aatgtaattatgaggtgaaacaa

SEQ ID NO: 5121630 - DNA, 12 bp, Homo sapiens
aatgtaattatt

SEQ ID NO: 5121631 - DNA, 17 bp, Homo sapiens
aatgtaattatttatgt

SEQ ID NO: 5121632 - DNA, 22 bp, Homo sapiens
aatgtaattatttatgtatggt

SEQ ID NO: 5121633 - DNA, 21 bp, Homo sapiens
aatgtaattgattgtatatag

SEQ ID NO: 5121634 - DNA, 18 bp, Homo sapiens
aatgtaattgatttattt

SEQ ID NO: 5121635 - DNA, 13 bp, Homo sapiens
aatgtaattggaa

SEQ ID NO: 5121636 - DNA, 15 bp, Homo sapiens
aatgtaattggaatc

SEQ ID NO: 5121637 - DNA, 19 bp, Homo sapiens
aatgtaattggaatcttca

SEQ ID NO: 5121638 - DNA, 20 bp, Homo sapiens
aatgtaattggaatcttcac

SEQ ID NO: 5121639 - DNA, 15 bp, Homo sapiens
aatgtaattgtaatt

SEQ ID NO: 5121640 - DNA, 18 bp, Homo sapiens
aatgtaatttaatgcctg

SEQ ID NO: 5121641 - DNA, 22 bp, Homo sapiens
aatgtaatttagaaactgattt

SEQ ID NO: 5121642 - DNA, 13 bp, Homo sapiens
aatgtaatttagt

SEQ ID NO: 5121643 - DNA, 13 bp, Homo sapiens
aatgtaatttcag

SEQ ID NO: 5121644 - DNA, 15 bp, Homo sapiens
aatgtaatttcagtt

SEQ ID NO: 5121645 - DNA, 17 bp, Homo sapiens
aatgtacaaaataaagt

SEQ ID NO: 5121646 - DNA, 19 bp, Homo sapiens
aatgtacaagttttgtata

SEQ ID NO: 5121647 - DNA, 19 bp, Homo sapiens
aatgtacaattatgtctct

SEQ ID NO: 5121648 - DNA, 22 bp, Homo sapiens
aatgtacaattatgtctcttga

SEQ ID NO: 5121649 - DNA, 21 bp, Homo sapiens
aatgtacaattttatataatt

SEQ ID NO: 5121650 - DNA, 13 bp, Homo sapiens
aatgtacacagtt

SEQ ID NO: 5121651 - DNA, 20 bp, Homo sapiens
aatgtacaccacatgctatt

SEQ ID NO: 5121652 - DNA, 22 bp, Homo sapiens
aatgtacaccacatgctattgt

SEQ ID NO: 5121653 - DNA, 20 bp, Homo sapiens
aatgtacactaccaaacact

SEQ ID NO: 5121654 - DNA, 11 bp, Homo sapiens
aatgtacactt

SEQ ID NO: 5121655 - DNA, 21 bp, Homo sapiens
aatgtacactttttacagcag

SEQ ID NO: 5121656 - DNA, 18 bp, Homo sapiens
aatgtacagaaaatagct

SEQ ID NO: 5121657 - DNA, 17 bp, Homo sapiens
aatgtacagaggaagct

SEQ ID NO: 5121658 - DNA, 18 bp, Homo sapiens
aatgtacagttgagctca

SEQ ID NO: 5121659 - DNA, 21 bp, Homo sapiens
aatgtacagttgagctcaggt

SEQ ID NO: 5121660 - DNA, 15 bp, Homo sapiens
aatgtacattaatta

SEQ ID NO: 5121661 - DNA, 20 bp, Homo sapiens
aatgtaccatgttgcccaga

SEQ ID NO: 5121662 - DNA, 15 bp, Homo sapiens
aatgtaccttattta

SEQ ID NO: 5121663 - DNA, 15 bp, Homo sapiens
aatgtaccttctttc

SEQ ID NO: 5121664 - DNA, 22 bp, Homo sapiens
aatgtacgctgctgcaggacat

SEQ ID NO: 5121665 - DNA, 15 bp, Homo sapiens
aatgtactaatattt

SEQ ID NO: 5121666 - DNA, 20 bp, Homo sapiens
aatgtactaggatactgctg

SEQ ID NO: 5121667 - DNA, 12 bp, Homo sapiens
aatgtactcaca

SEQ ID NO: 5121668 - DNA, 14 bp, Homo sapiens
aatgtactcacata

SEQ ID NO: 5121669 - DNA, 17 bp, Homo sapiens
aatgtactgaattcttt

SEQ ID NO: 5121670 - DNA, 19 bp, Homo sapiens
aatgtactgaattctttat

SEQ ID NO: 5121671 - DNA, 12 bp, Homo sapiens
aatgtactgcat

SEQ ID NO: 5121672 - DNA, 14 bp, Homo sapiens
aatgtactggtaat

SEQ ID NO: 5121673 - DNA, 20 bp, Homo sapiens
aatgtactggtaattgtaca

SEQ ID NO: 5121674 - DNA, 17 bp, Homo sapiens
aatgtactgtacataaa

SEQ ID NO: 5121675 - DNA, 13 bp, Homo sapiens
aatgtactgtatt

SEQ ID NO: 5121676 - DNA, 16 bp, Homo sapiens
aatgtacttaaatgag

SEQ ID NO: 5121677 - DNA, 17 bp, Homo sapiens
aatgtacttaaatgagt

SEQ ID NO: 5121678 - DNA, 15 bp, Homo sapiens
aatgtacttttggat

SEQ ID NO: 5121679 - DNA, 20 bp, Homo sapiens
aatgtacttttggataagta

SEQ ID NO: 5121680 - DNA, 14 bp, Homo sapiens
aatgtactttttaa

SEQ ID NO: 5121681 - DNA, 17 bp, Homo sapiens
aatgtagaagaaagcaa

SEQ ID NO: 5121682 - DNA, 18 bp, Homo sapiens
aatgtagaagtctttcag

SEQ ID NO: 5121683 - DNA, 17 bp, Homo sapiens
aatgtagaataggcagg

SEQ ID NO: 5121684 - DNA, 20 bp, Homo sapiens
aatgtagaatattcagacaa

SEQ ID NO: 5121685 - DNA, 19 bp, Homo sapiens
aatgtagaatgatttttgc

SEQ ID NO: 5121686 - DNA, 14 bp, Homo sapiens
aatgtagactctga

SEQ ID NO: 5121687 - DNA, 16 bp, Homo sapiens
aatgtagactctgact

SEQ ID NO: 5121688 - DNA, 12 bp, Homo sapiens
aatgtagagggg

SEQ ID NO: 5121689 - DNA, 15 bp, Homo sapiens
aatgtagataagtgt

SEQ ID NO: 5121690 - DNA, 20 bp, Homo sapiens
aatgtagcatctgagaaggc

SEQ ID NO: 5121691 - DNA, 14 bp, Homo sapiens
aatgtagccagccc

SEQ ID NO: 5121692 - DNA, 16 bp, Homo sapiens
aatgtagccctctcca

SEQ ID NO: 5121693 - DNA, 23 bp, Homo sapiens
aatgtagcgacagcattttaagg

SEQ ID NO: 5121694 - DNA, 18 bp, Homo sapiens
aatgtagcgtgtttacat

SEQ ID NO: 5121695 - DNA, 14 bp, Homo sapiens
aatgtagctggttt

SEQ ID NO: 5121696 - DNA, 21 bp, Homo sapiens
aatgtagctggtttcctcatt

SEQ ID NO: 5121697 - DNA, 17 bp, Homo sapiens
aatgtagcttcagtcat

SEQ ID NO: 5121698 - DNA, 20 bp, Homo sapiens
aatgtagcttttatgtgata

SEQ ID NO: 5121699 - DNA, 20 bp, Homo sapiens
aatgtaggcacttttatttt

SEQ ID NO: 5121700 - DNA, 22 bp, Homo sapiens
aatgtaggcacttttattttca

SEQ ID NO: 5121701 - DNA, 14 bp, Homo sapiens
aatgtaggctggct

SEQ ID NO: 5121702 - DNA, 23 bp, Homo sapiens
aatgtagggcagaatagctgata

SEQ ID NO: 5121703 - DNA, 12 bp, Homo sapiens
aatgtagggcct

SEQ ID NO: 5121704 - DNA, 22 bp, Homo sapiens
aatgtagggcctgcatggagaa

SEQ ID NO: 5121705 - DNA, 17 bp, Homo sapiens
aatgtagggttatattt

SEQ ID NO: 5121706 - DNA, 23 bp, Homo sapiens
aatgtagttctgctccagacagg

SEQ ID NO: 5121707 - DNA, 23 bp, Homo sapiens
aatgtagttgtcacactaaaatt

SEQ ID NO: 5121708 - DNA, 22 bp, Homo sapiens
aatgtagttttaaataaagttt

SEQ ID NO: 5121709 - DNA, 22 bp, Homo sapiens
aatgtagttttgtgatgcattt

SEQ ID NO: 5121710 - DNA, 16 bp, Homo sapiens
aatgtataaagattgt

SEQ ID NO: 5121711 - DNA, 18 bp, Homo sapiens
aatgtataaagattgtac

SEQ ID NO: 5121712 - DNA, 15 bp, Homo sapiens
aatgtataaatatac

SEQ ID NO: 5121713 - DNA, 16 bp, Homo sapiens
aattgaaaacactaac

SEQ ID NO: 5121714 - DNA, 14 bp, Homo sapiens
aattgaaaagtaca

SEQ ID NO: 5121715 - DNA, 18 bp, Homo sapiens
aattgaaaagtgttctgt

SEQ ID NO: 5121716 - DNA, 15 bp, Homo sapiens
aattgaaacacagag

SEQ ID NO: 5121717 - DNA, 12 bp, Homo sapiens
aattgaaacact

SEQ ID NO: 5121718 - DNA, 22 bp, Homo sapiens
aattgaaactagttattttata

SEQ ID NO: 5121719 - DNA, 9 bp, Homo sapiens
aattgaaag

SEQ ID NO: 5121720 - DNA, 15 bp, Homo sapiens
aattgaaagaactta

SEQ ID NO: 5121721 - DNA, 10 bp, Homo sapiens
aattgaaagg

SEQ ID NO: 5121722 - DNA, 19 bp, Homo sapiens
aattgaaagggacaagtat

SEQ ID NO: 5121723 - DNA, 12 bp, Homo sapiens
aattgaaagtat

SEQ ID NO: 5121724 - DNA, 20 bp, Homo sapiens
aattgaaagtattcagaaat

SEQ ID NO: 5121725 - DNA, 18 bp, Homo sapiens
aattgaaatttaaaaata

SEQ ID NO: 5121726 - DNA, 21 bp, Homo sapiens
aattgaaatttaaaaataaag

SEQ ID NO: 5121727 - DNA, 16 bp, Homo sapiens
aattgaacaataaagt

SEQ ID NO: 5121728 - DNA, 21 bp, Homo sapiens
aattgaaccgtcaatgtgaaa

SEQ ID NO: 5121729 - DNA, 22 bp, Homo sapiens
aattgaaccgtcaatgtgaaat

SEQ ID NO: 5121730 - DNA, 21 bp, Homo sapiens
aattgaacctttgtgccctat

SEQ ID NO: 5121731 - DNA, 18 bp, Homo sapiens
aattgaacgactgtatat

SEQ ID NO: 5121732 - DNA, 12 bp, Homo sapiens
aattgaagcatg

SEQ ID NO: 5121733 - DNA, 20 bp, Homo sapiens
aattgaagcatgaacgtgga

SEQ ID NO: 5121734 - DNA, 20 bp, Homo sapiens
aattgaaggttgtatgtaaa

SEQ ID NO: 5121735 - DNA, 18 bp, Homo sapiens
aattgaaggtttttgata

SEQ ID NO: 5121736 - DNA, 19 bp, Homo sapiens
aattgaaggtttttgatag

SEQ ID NO: 5121737 - DNA, 17 bp, Homo sapiens
aattgaagtaaactttt

SEQ ID NO: 5121738 - DNA, 22 bp, Homo sapiens
aattgaagtgaaattttgcaga

SEQ ID NO: 5121739 - DNA, 21 bp, Homo sapiens
aattgaagtgtataatataaa

SEQ ID NO: 5121740 - DNA, 17 bp, Homo sapiens
aattgaagtgtcttctg

SEQ ID NO: 5121741 - DNA, 16 bp, Homo sapiens
aattgaagtttcaagt

SEQ ID NO: 5121742 - DNA, 14 bp, Homo sapiens
aattgaataatggt

SEQ ID NO: 5121743 - DNA, 21 bp, Homo sapiens
aattgaataatggtaccagat

SEQ ID NO: 5121744 - DNA, 23 bp, Homo sapiens
aattgaataatggtaccagataa

SEQ ID NO: 5121745 - DNA, 15 bp, Homo sapiens
aattgaatacacaaa

SEQ ID NO: 5121746 - DNA, 19 bp, Homo sapiens
aattgaatagtttatttct

SEQ ID NO: 5121747 - DNA, 21 bp, Homo sapiens
aattgaatagtttatttctgt

SEQ ID NO: 5121748 - DNA, 14 bp, Homo sapiens
aattgaatattatt

SEQ ID NO: 5121749 - DNA, 15 bp, Homo sapiens
aattgaatattattc

SEQ ID NO: 5121750 - DNA, 18 bp, Homo sapiens
aattgaatgcaaaccata

SEQ ID NO: 5121751 - DNA, 15 bp, Homo sapiens
aattgaatggaagca

SEQ ID NO: 5121752 - DNA, 15 bp, Homo sapiens
aattgaatgtacctt

SEQ ID NO: 5121753 - DNA, 14 bp, Homo sapiens
aattgaatttaaca

SEQ ID NO: 5121754 - DNA, 14 bp, Homo sapiens
aattgacaaatgat

SEQ ID NO: 5121755 - DNA, 19 bp, Homo sapiens
aattgacagagtaaaagta

SEQ ID NO: 5121756 - DNA, 18 bp, Homo sapiens
aattgacagatcaagctg

SEQ ID NO: 5121757 - DNA, 18 bp, Homo sapiens
aattgacaggcgaaagaa

SEQ ID NO: 5121758 - DNA, 19 bp, Homo sapiens
aattgacagggaaaatata

SEQ ID NO: 5121759 - DNA, 20 bp, Homo sapiens
aattgacatgaccctctgtc

SEQ ID NO: 5121760 - DNA, 14 bp, Homo sapiens
aattgacatgttgt

SEQ ID NO: 5121761 - DNA, 17 bp, Homo sapiens
aattgacattgaaatct

SEQ ID NO: 5121762 - DNA, 18 bp, Homo sapiens
aattgacattgaaatcta

SEQ ID NO: 5121763 - DNA, 17 bp, Homo sapiens
aattgaccatctgcttt

SEQ ID NO: 5121764 - DNA, 16 bp, Homo sapiens
aattgacccacaagaa

SEQ ID NO: 5121765 - DNA, 19 bp, Homo sapiens
aattgacccacaagaaatg

SEQ ID NO: 5121766 - DNA, 17 bp, Homo sapiens
aattgacccatgttccc

SEQ ID NO: 5121767 - DNA, 23 bp, Homo sapiens
aattgaccgacagctttccagta

SEQ ID NO: 5121768 - DNA, 20 bp, Homo sapiens
aattgacctcaaaagaaaat

SEQ ID NO: 5121769 - DNA, 22 bp, Homo sapiens
aattgaccttgaccattaataa

SEQ ID NO: 5121770 - DNA, 24 bp, Homo sapiens
aattgacggttttttattattgtg

SEQ ID NO: 5121771 - DNA, 17 bp, Homo sapiens
aattgactcttatttat

SEQ ID NO: 5121772 - DNA, 14 bp, Homo sapiens
aattgactgaaatt

SEQ ID NO: 5121773 - DNA, 15 bp, Homo sapiens
aattgactgaaatta

SEQ ID NO: 5121774 - DNA, 14 bp, Homo sapiens
aattgactgcagtt

SEQ ID NO: 5121775 - DNA, 14 bp, Homo sapiens
aattgactgccctc

SEQ ID NO: 5121776 - DNA, 21 bp, Homo sapiens
aattgacttagatattaaaat

SEQ ID NO: 5121777 - DNA, 18 bp, Homo sapiens
aattgacttcgactgtga

SEQ ID NO: 5121778 - DNA, 19 bp, Homo sapiens
aattgagaaaaatatatac

SEQ ID NO: 5121779 - DNA, 13 bp, Homo sapiens
aattgagaaaaga

SEQ ID NO: 5121780 - DNA, 14 bp, Homo sapiens
aattgagaaaagag

SEQ ID NO: 5121781 - DNA, 18 bp, Homo sapiens
aattgagaatagaaattt

SEQ ID NO: 5121782 - DNA, 12 bp, Homo sapiens
aattgagacagt

SEQ ID NO: 5121783 - DNA, 17 bp, Homo sapiens
aattgagactgaaagaa

SEQ ID NO: 5121784 - DNA, 21 bp, Homo sapiens
aattgagactgaaagaaacta

SEQ ID NO: 5121785 - DNA, 22 bp, Homo sapiens
aattgagaggtgggggatgctg

SEQ ID NO: 5121786 - DNA, 23 bp, Homo sapiens
aattgagataatatctgtgaggt

SEQ ID NO: 5121787 - DNA, 19 bp, Homo sapiens
aattgagatgattaaaatg

SEQ ID NO: 5121788 - DNA, 12 bp, Homo sapiens
aattgagcacaa

SEQ ID NO: 5121789 - DNA, 16 bp, Homo sapiens
aattgagcagttcatg

SEQ ID NO: 5121790 - DNA, 22 bp, Homo sapiens
aattgagcagttctgttgcatg

SEQ ID NO: 5121791 - DNA, 19 bp, Homo sapiens
aattgagcgctatgggtgt

SEQ ID NO: 5121792 - DNA, 17 bp, Homo sapiens
aattgagcttgcttctt

SEQ ID NO: 5121793 - DNA, 19 bp, Homo sapiens
aattgaggactatggaaat

SEQ ID NO: 5121794 - DNA, 17 bp, Homo sapiens
aattgagggaagtttga

SEQ ID NO: 5121795 - DNA, 18 bp, Homo sapiens
aattgaggggaggtggcc

SEQ ID NO: 5121796 - DNA, 19 bp, Homo sapiens
aattgaggggaggtggcca

SEQ ID NO: 5121797 - DNA, 15 bp, Homo sapiens
aattgaggttaggaa

SEQ ID NO: 5121798 - DNA, 19 bp, Homo sapiens
aattgaggtttggaagagt

SEQ ID NO: 5121799 - DNA, 21 bp, Homo sapiens
aattgaggtttggaagagtga

SEQ ID NO: 5121800 - DNA, 22 bp, Homo sapiens
aattgagtagctgcatgctgtt

SEQ ID NO: 5121801 - DNA, 22 bp, Homo sapiens
aattgagtctcttttttattct

SEQ ID NO: 5121802 - DNA, 18 bp, Homo sapiens
aattgagtgtttaaagtt

SEQ ID NO: 5121803 - DNA, 17 bp, Homo sapiens
aattgagttaaatcagt

SEQ ID NO: 5121804 - DNA, 21 bp, Homo sapiens
aattgagtttcagaataaaat

SEQ ID NO: 5121805 - DNA, 17 bp, Homo sapiens
aattgagttttcagtgg

SEQ ID NO: 5121806 - DNA, 17 bp, Homo sapiens
aattgataaaagagttc

SEQ ID NO: 5121807 - DNA, 15 bp, Homo sapiens
aattgataataaact

SEQ ID NO: 5121808 - DNA, 19 bp, Homo sapiens
aattgatacttcaggtgct

SEQ ID NO: 5121809 - DNA, 22 bp, Homo sapiens
aattgatattatattaaacata

SEQ ID NO: 5121810 - DNA, 11 bp, Homo sapiens
aattgatattt

SEQ ID NO: 5121811 - DNA, 14 bp, Homo sapiens
aattgatatttctg

SEQ ID NO: 5121812 - DNA, 14 bp, Homo sapiens
aattgatcattcat

SEQ ID NO: 5121813 - DNA, 16 bp, Homo sapiens
aattgatgtatatgtt

SEQ ID NO: 5121814 - DNA, 20 bp, Homo sapiens
aattgatgtatatgtttata

SEQ ID NO: 5121815 - DNA, 12 bp, Homo sapiens
aattgatgttga

SEQ ID NO: 5121816 - DNA, 18 bp, Homo sapiens
aattgatgttttacgtgc

SEQ ID NO: 5121817 - DNA, 21 bp, Homo sapiens
aattgatgttttacgtgcaaa

SEQ ID NO: 5121818 - DNA, 22 bp, Homo sapiens
aattgatgttttacgtgcaaac

SEQ ID NO: 5121819 - DNA, 23 bp, Homo sapiens
aattgatgttttacgtgcaaaca

SEQ ID NO: 5121820 - DNA, 17 bp, Homo sapiens
aattgattaaaatctct

SEQ ID NO: 5121821 - DNA, 21 bp, Homo sapiens
aattgattaaactgtatgtct

SEQ ID NO: 5121822 - DNA, 21 bp, Homo sapiens
aattgattcaagattggacat

SEQ ID NO: 5121823 - DNA, 19 bp, Homo sapiens
aattgattgtcagccacct

SEQ ID NO: 5121824 - DNA, 12 bp, Homo sapiens
aattgatttctt

SEQ ID NO: 5121825 - DNA, 22 bp, Homo sapiens
aattgatttcttttcttcctgg

SEQ ID NO: 5121826 - DNA, 17 bp, Homo sapiens
aattgattttttttctc

SEQ ID NO: 5121827 - DNA, 20 bp, Homo sapiens
aattgattttttttctctct

SEQ ID NO: 5121828 - DNA, 11 bp, Homo sapiens
aattgcaacaa

SEQ ID NO: 5121829 - DNA, 14 bp, Homo sapiens
aattgcacaaatac

SEQ ID NO: 5121830 - DNA, 21 bp, Homo sapiens
aattgcacaatattgaacttt

SEQ ID NO: 5121831 - DNA, 13 bp, Homo sapiens
aattgcacaattt

SEQ ID NO: 5121832 - DNA, 14 bp, Homo sapiens
aattgcacaatttg

SEQ ID NO: 5121833 - DNA, 17 bp, Homo sapiens
aattgcacaatttgagc

SEQ ID NO: 5121834 - DNA, 20 bp, Homo sapiens
aattgcacaccttggaattc

SEQ ID NO: 5121835 - DNA, 18 bp, Homo sapiens
aattgcacagaagtcctg

SEQ ID NO: 5121836 - DNA, 20 bp, Homo sapiens
aattgcacagagcacactta

SEQ ID NO: 5121837 - DNA, 14 bp, Homo sapiens
aattgcacgtgcaa

SEQ ID NO: 5121838 - DNA, 17 bp, Homo sapiens
aattgcacgtttggtga

SEQ ID NO: 5121839 - DNA, 13 bp, Homo sapiens
aattgcactaaat

SEQ ID NO: 5121840 - DNA, 14 bp, Homo sapiens
aattgcactctaaa

SEQ ID NO: 5121841 - DNA, 18 bp, Homo sapiens
aattgcactgaagttttt

SEQ ID NO: 5121842 - DNA, 14 bp, Homo sapiens
aattgcacttttaa

SEQ ID NO: 5121843 - DNA, 14 bp, Homo sapiens
aattgcagaactaa

SEQ ID NO: 5121844 - DNA, 17 bp, Homo sapiens
aattgcagaattcaaaa

SEQ ID NO: 5121845 - DNA, 13 bp, Homo sapiens
aattgcagactgt

SEQ ID NO: 5121846 - DNA, 13 bp, Homo sapiens
aattgcagtcatt

SEQ ID NO: 5121847 - DNA, 14 bp, Homo sapiens
aattgcagtcattt

SEQ ID NO: 5121848 - DNA, 17 bp, Homo sapiens
aattgcagtcatttggt

SEQ ID NO: 5121849 - DNA, 20 bp, Homo sapiens
aattgcagtttacagtattt

SEQ ID NO: 5121850 - DNA, 20 bp, Homo sapiens
aattgcagtttcatgtatgt

SEQ ID NO: 5121851 - DNA, 15 bp, Homo sapiens
aattgcataaagcat

SEQ ID NO: 5121852 - DNA, 14 bp, Homo sapiens
aattgcatgaaact

SEQ ID NO: 5121853 - DNA, 19 bp, Homo sapiens
aattgcatgaaactaggct

SEQ ID NO: 5121854 - DNA, 22 bp, Homo sapiens
aattgcatgccatctccaccct

SEQ ID NO: 5121855 - DNA, 11 bp, Homo sapiens
aattgcattga

SEQ ID NO: 5121856 - DNA, 21 bp, Homo sapiens
aattgcattgctaccaagttt

SEQ ID NO: 5121857 - DNA, 12 bp, Homo sapiens
aattgcatttgt

SEQ ID NO: 5121858 - DNA, 21 bp, Homo sapiens
aattgccaaaaagtgaaataa

SEQ ID NO: 5121859 - DNA, 23 bp, Homo sapiens
aattgccaaaaagtgaaataatg

SEQ ID NO: 5121860 - DNA, 14 bp, Homo sapiens
aattgccaaaatat

SEQ ID NO: 5121861 - DNA, 18 bp, Homo sapiens
aattgccacataattcat

SEQ ID NO: 5121862 - DNA, 13 bp, Homo sapiens
aattgccagcaaa

SEQ ID NO: 5121863 - DNA, 19 bp, Homo sapiens
aattgccagcaaataaata

SEQ ID NO: 5121864 - DNA, 17 bp, Homo sapiens
aattgccagcttttata

SEQ ID NO: 5121865 - DNA, 12 bp, Homo sapiens
aattgccatatt

SEQ ID NO: 5121866 - DNA, 13 bp, Homo sapiens
aattgccatattg

SEQ ID NO: 5121867 - DNA, 17 bp, Homo sapiens
aattgccatattgcaca

SEQ ID NO: 5121868 - DNA, 23 bp, Homo sapiens
aattgcctagaaatatctttctc

SEQ ID NO: 5121869 - DNA, 19 bp, Homo sapiens
aattgcctataatacttgc

SEQ ID NO: 5121870 - DNA, 21 bp, Homo sapiens
aattgcctataatacttgcaa

SEQ ID NO: 5121871 - DNA, 15 bp, Homo sapiens
aattgcctcccttcc

SEQ ID NO: 5121872 - DNA, 16 bp, Homo sapiens
aattgcctcccttcct

SEQ ID NO: 5121873 - DNA, 17 bp, Homo sapiens
aattgcctcccttcctc

SEQ ID NO: 5121874 - DNA, 21 bp, Homo sapiens
aattgcctccttatttatcaa

SEQ ID NO: 5121875 - DNA, 16 bp, Homo sapiens
aattgcctcttgcagg

SEQ ID NO: 5121876 - DNA, 22 bp, Homo sapiens
aattgcctgaaacccatttact

SEQ ID NO: 5121877 - DNA, 15 bp, Homo sapiens
aattgcctgacgaac

SEQ ID NO: 5121878 - DNA, 19 bp, Homo sapiens
aattgcctgcagagagaag

SEQ ID NO: 5121879 - DNA, 19 bp, Homo sapiens
aattgcctgccatggctgt

SEQ ID NO: 5121880 - DNA, 14 bp, Homo sapiens
aattgcgttggtct

SEQ ID NO: 5121881 - DNA, 18 bp, Homo sapiens
aattgcgttggtctctgc

SEQ ID NO: 5121882 - DNA, 14 bp, Homo sapiens
aattgctatgttac

SEQ ID NO: 5121883 - DNA, 17 bp, Homo sapiens
aattgctcaaaaaagag

SEQ ID NO: 5121884 - DNA, 13 bp, Homo sapiens
aattgctcacagt

SEQ ID NO: 5121885 - DNA, 19 bp, Homo sapiens
aattgctcctaactccacc

SEQ ID NO: 5121886 - DNA, 20 bp, Homo sapiens
aattgctctgtgtatatctc

SEQ ID NO: 5121887 - DNA, 19 bp, Homo sapiens
aattgctgactgtagcttt

SEQ ID NO: 5121888 - DNA, 14 bp, Homo sapiens
aattgctgagatgt

SEQ ID NO: 5121889 - DNA, 20 bp, Homo sapiens
aattgctgagatgtttagta

SEQ ID NO: 5121890 - DNA, 23 bp, Homo sapiens
aattgctgaggagctcagggctg

SEQ ID NO: 5121891 - DNA, 21 bp, Homo sapiens
aattgcttacatttttacaat

SEQ ID NO: 5121892 - DNA, 16 bp, Homo sapiens
aatgtataaatataca

SEQ ID NO: 5121893 - DNA, 14 bp, Homo sapiens
aatgtataagttga

SEQ ID NO: 5121894 - DNA, 18 bp, Homo sapiens
aatgtataattaacttaa

SEQ ID NO: 5121895 - DNA, 17 bp, Homo sapiens
aatgtatacaatgcact

SEQ ID NO: 5121896 - DNA, 14 bp, Homo sapiens
aatgtatacaccaa

SEQ ID NO: 5121897 - DNA, 13 bp, Homo sapiens
aatgtatagtaaa

SEQ ID NO: 5121898 - DNA, 16 bp, Homo sapiens
aatgtatagtatttga

SEQ ID NO: 5121899 - DNA, 18 bp, Homo sapiens
aatgtatagtatttgaaa

SEQ ID NO: 5121900 - DNA, 16 bp, Homo sapiens
aatgtatataaagtac

SEQ ID NO: 5121901 - DNA, 13 bp, Homo sapiens
aatgtatatacac

SEQ ID NO: 5121902 - DNA, 18 bp, Homo sapiens
aatgtatatacacatata

SEQ ID NO: 5121903 - DNA, 19 bp, Homo sapiens
aatgtatatacacatatac

SEQ ID NO: 5121904 - DNA, 13 bp, Homo sapiens
aatgtatatgcac

SEQ ID NO: 5121905 - DNA, 16 bp, Homo sapiens
aatgtatattcccaca

SEQ ID NO: 5121906 - DNA, 12 bp, Homo sapiens
aatgtatatttg

SEQ ID NO: 5121907 - DNA, 17 bp, Homo sapiens
aatgtatatttgctgca

SEQ ID NO: 5121908 - DNA, 14 bp, Homo sapiens
aatgtatattttta

SEQ ID NO: 5121909 - DNA, 14 bp, Homo sapiens
aatgtatcaggaaa

SEQ ID NO: 5121910 - DNA, 16 bp, Homo sapiens
aatgtatcatagaaat

SEQ ID NO: 5121911 - DNA, 13 bp, Homo sapiens
aatgtatcatttt

SEQ ID NO: 5121912 - DNA, 20 bp, Homo sapiens
aatgtatcatttttgtgcac

SEQ ID NO: 5121913 - DNA, 22 bp, Homo sapiens
aatgtatcatttttgtgcacag

SEQ ID NO: 5121914 - DNA, 14 bp, Homo sapiens
aatgtatccagagg

SEQ ID NO: 5121915 - DNA, 13 bp, Homo sapiens
aatgtatctaaga

SEQ ID NO: 5121916 - DNA, 14 bp, Homo sapiens
aatgtatctaagaa

SEQ ID NO: 5121917 - DNA, 17 bp, Homo sapiens
aatgtatctatttgtac

SEQ ID NO: 5121918 - DNA, 21 bp, Homo sapiens
aatgtatctatttgtacaatt

SEQ ID NO: 5121919 - DNA, 22 bp, Homo sapiens
aatgtatctatttgtacaattt

SEQ ID NO: 5121920 - DNA, 22 bp, Homo sapiens
aatgtatctgagtattgaatga

SEQ ID NO: 5121921 - DNA, 12 bp, Homo sapiens
aatgtatcttaa

SEQ ID NO: 5121922 - DNA, 14 bp, Homo sapiens
aatgtatcttaaag

SEQ ID NO: 5121923 - DNA, 18 bp, Homo sapiens
aatgtatcttaaaggaca

SEQ ID NO: 5121924 - DNA, 22 bp, Homo sapiens
aatgtatcttaaaggacataaa

SEQ ID NO: 5121925 - DNA, 12 bp, Homo sapiens
aatgtatcttat

SEQ ID NO: 5121926 - DNA, 15 bp, Homo sapiens
aatgtatcttattta

SEQ ID NO: 5121927 - DNA, 16 bp, Homo sapiens
aatgtatcttatttat

SEQ ID NO: 5121928 - DNA, 19 bp, Homo sapiens
aatgtatcttatttatata

SEQ ID NO: 5121929 - DNA, 18 bp, Homo sapiens
aatgtatgctatcctctt

SEQ ID NO: 5121930 - DNA, 14 bp, Homo sapiens
aatgtatgtacaat

SEQ ID NO: 5121931 - DNA, 17 bp, Homo sapiens
aatgtatgtacaataca

SEQ ID NO: 5121932 - DNA, 19 bp, Homo sapiens
aatgtatgtaggagctgca

SEQ ID NO: 5121933 - DNA, 14 bp, Homo sapiens
aatgtatgtatcat

SEQ ID NO: 5121934 - DNA, 15 bp, Homo sapiens
aatgtatgtatcatc

SEQ ID NO: 5121935 - DNA, 15 bp, Homo sapiens
aatgtatgtcagtgc

SEQ ID NO: 5121936 - DNA, 12 bp, Homo sapiens
aatgtatgtgaa

SEQ ID NO: 5121937 - DNA, 15 bp, Homo sapiens
aatgtatgtgaaagt

SEQ ID NO: 5121938 - DNA, 21 bp, Homo sapiens
aatgtatgtgaaagtgtaaaa

SEQ ID NO: 5121939 - DNA, 13 bp, Homo sapiens
aatgtatgtgcac

SEQ ID NO: 5121940 - DNA, 18 bp, Homo sapiens
aatgtatgtgcactgtca

SEQ ID NO: 5121941 - DNA, 23 bp, Homo sapiens
aatgtatgtgtctcccaggtgca

SEQ ID NO: 5121942 - DNA, 12 bp, Homo sapiens
aatgtatgtgtg

SEQ ID NO: 5121943 - DNA, 15 bp, Homo sapiens
aatgtatgtgtggct

SEQ ID NO: 5121944 - DNA, 19 bp, Homo sapiens
aatgtattaatctgtttgt

SEQ ID NO: 5121945 - DNA, 16 bp, Homo sapiens
aatgtattataacttt

SEQ ID NO: 5121946 - DNA, 12 bp, Homo sapiens
aatgtattcaag

SEQ ID NO: 5121947 - DNA, 17 bp, Homo sapiens
aatgtattcaagcaaac

SEQ ID NO: 5121948 - DNA, 20 bp, Homo sapiens
aatgtattcatatttgtact

SEQ ID NO: 5121949 - DNA, 15 bp, Homo sapiens
aatgtattcattctt

SEQ ID NO: 5121950 - DNA, 17 bp, Homo sapiens
aatgtattcctttaaaa

SEQ ID NO: 5121951 - DNA, 20 bp, Homo sapiens
aatgtattcctttaaaatat

SEQ ID NO: 5121952 - DNA, 21 bp, Homo sapiens
aatgtattcctttaaaatatt

SEQ ID NO: 5121953 - DNA, 17 bp, Homo sapiens
aatgtattcttttatat

SEQ ID NO: 5121954 - DNA, 19 bp, Homo sapiens
aatgtattgattacaaata

SEQ ID NO: 5121955 - DNA, 14 bp, Homo sapiens
aatgtattgattca

SEQ ID NO: 5121956 - DNA, 22 bp, Homo sapiens
aatgtattgtaccttttaacac

SEQ ID NO: 5121957 - DNA, 19 bp, Homo sapiens
aatgtattgttctgtttgt

SEQ ID NO: 5121958 - DNA, 20 bp, Homo sapiens
aatgtattgttctgtttgtg

SEQ ID NO: 5121959 - DNA, 14 bp, Homo sapiens
aatgtatttaatta

SEQ ID NO: 5121960 - DNA, 22 bp, Homo sapiens
aatgtatttagctacagcttgt

SEQ ID NO: 5121961 - DNA, 22 bp, Homo sapiens
aatgtatttatgtgtatatttg

SEQ ID NO: 5121962 - DNA, 17 bp, Homo sapiens
aatgtatttgatttata

SEQ ID NO: 5121963 - DNA, 12 bp, Homo sapiens
aatgtattttaa

SEQ ID NO: 5121964 - DNA, 14 bp, Homo sapiens
aatgtattttaact

SEQ ID NO: 5121965 - DNA, 13 bp, Homo sapiens
aatgtattttaca

SEQ ID NO: 5121966 - DNA, 16 bp, Homo sapiens
aatgtattttattgta

SEQ ID NO: 5121967 - DNA, 22 bp, Homo sapiens
aatgtattttcatagatgtgtt

SEQ ID NO: 5121968 - DNA, 13 bp, Homo sapiens
aatgtattttctt

SEQ ID NO: 5121969 - DNA, 12 bp, Homo sapiens
aatgtattttga

SEQ ID NO: 5121970 - DNA, 19 bp, Homo sapiens
aatgtattttgaaaacact

SEQ ID NO: 5121971 - DNA, 21 bp, Homo sapiens
aatgtattttgaaaacactta

SEQ ID NO: 5121972 - DNA, 23 bp, Homo sapiens
aatgtattttggaagacatatat

SEQ ID NO: 5121973 - DNA, 21 bp, Homo sapiens
aatgtattttggttgctgatg

SEQ ID NO: 5121974 - DNA, 18 bp, Homo sapiens
aatgtcaaaaatatttag

SEQ ID NO: 5121975 - DNA, 14 bp, Homo sapiens
aatgtcaaaagtag

SEQ ID NO: 5121976 - DNA, 23 bp, Homo sapiens
aatgtcaacctttgtaagaaaac

SEQ ID NO: 5121977 - DNA, 21 bp, Homo sapiens
aatgtcaactgtgtctctgaa

SEQ ID NO: 5121978 - DNA, 13 bp, Homo sapiens
aatgtcaagaaat

SEQ ID NO: 5121979 - DNA, 21 bp, Homo sapiens
aatgtcaagaaattctgctgt

SEQ ID NO: 5121980 - DNA, 17 bp, Homo sapiens
aatgtcaaggaagactt

SEQ ID NO: 5121981 - DNA, 17 bp, Homo sapiens
aatgtcaatttttaact

SEQ ID NO: 5121982 - DNA, 19 bp, Homo sapiens
aatgtcacaaattgatcaa

SEQ ID NO: 5121983 - DNA, 21 bp, Homo sapiens
aatgtcacaacatggtgctac

SEQ ID NO: 5121984 - DNA, 18 bp, Homo sapiens
aatgtcacaattatgtgc

SEQ ID NO: 5121985 - DNA, 15 bp, Homo sapiens
aatgtcacaggcagg

SEQ ID NO: 5121986 - DNA, 17 bp, Homo sapiens
aatgtcacagtaatgca

SEQ ID NO: 5121987 - DNA, 20 bp, Homo sapiens
aatgtcaccaccttcccagc

SEQ ID NO: 5121988 - DNA, 19 bp, Homo sapiens
aatgtcacgtactgtctga

SEQ ID NO: 5121989 - DNA, 16 bp, Homo sapiens
aatgtcactgaagtga

SEQ ID NO: 5121990 - DNA, 21 bp, Homo sapiens
aatgtcagaaaaacaataaga

SEQ ID NO: 5121991 - DNA, 13 bp, Homo sapiens
aatgtcagaaaat

SEQ ID NO: 5121992 - DNA, 19 bp, Homo sapiens
aatgtcagaaaccagttat

SEQ ID NO: 5121993 - DNA, 22 bp, Homo sapiens
aatgtcagactttgctgcattt

SEQ ID NO: 5121994 - DNA, 13 bp, Homo sapiens
aatgtcagagcta

SEQ ID NO: 5121995 - DNA, 22 bp, Homo sapiens
aatgtcagagctatgttccctc

SEQ ID NO: 5121996 - DNA, 18 bp, Homo sapiens
aatgtcagatttctggtt

SEQ ID NO: 5121997 - DNA, 20 bp, Homo sapiens
aatgtcagtagtgctaatgc

SEQ ID NO: 5121998 - DNA, 23 bp, Homo sapiens
aatgtcagtctacaggcctttca

SEQ ID NO: 5121999 - DNA, 13 bp, Homo sapiens
aatgtcagtgtga

SEQ ID NO: 5122000 - DNA, 18 bp, Homo sapiens
aatgtcagtgtttgggaa

SEQ ID NO: 5122001 - DNA, 22 bp, Homo sapiens
aatgtcagttgttatttattga

SEQ ID NO: 5122002 - DNA, 23 bp, Homo sapiens
aatgtcataaagtgagaaaactg

SEQ ID NO: 5122003 - DNA, 12 bp, Homo sapiens
aatgtcataaat

SEQ ID NO: 5122004 - DNA, 20 bp, Homo sapiens
aatgtcataaattactgttt

SEQ ID NO: 5122005 - DNA, 17 bp, Homo sapiens
aatgtcatcagaacttt

SEQ ID NO: 5122006 - DNA, 17 bp, Homo sapiens
aatgtcatgctgcctta

SEQ ID NO: 5122007 - DNA, 12 bp, Homo sapiens
aatgtcattaca

SEQ ID NO: 5122008 - DNA, 17 bp, Homo sapiens
aatgtcattacatagaa

SEQ ID NO: 5122009 - DNA, 15 bp, Homo sapiens
aatgtcattatttga

SEQ ID NO: 5122010 - DNA, 17 bp, Homo sapiens
aatgtcattgctaaaaa

SEQ ID NO: 5122011 - DNA, 16 bp, Homo sapiens
aatgtcatttcataca

SEQ ID NO: 5122012 - DNA, 13 bp, Homo sapiens
aatgtcatttgct

SEQ ID NO: 5122013 - DNA, 16 bp, Homo sapiens
aatgtcatttgctaat

SEQ ID NO: 5122014 - DNA, 14 bp, Homo sapiens
aatgtcattttggt

SEQ ID NO: 5122015 - DNA, 13 bp, Homo sapiens
aatgtccaaaatt

SEQ ID NO: 5122016 - DNA, 16 bp, Homo sapiens
aatgtccaaaatttat

SEQ ID NO: 5122017 - DNA, 18 bp, Homo sapiens
aatgtccaaaatttatat

SEQ ID NO: 5122018 - DNA, 19 bp, Homo sapiens
aatgtccaaaatttatatt

SEQ ID NO: 5122019 - DNA, 20 bp, Homo sapiens
aatgtccaaaatttatattt

SEQ ID NO: 5122020 - DNA, 23 bp, Homo sapiens
aatgtccaactaaaaacaaaccc

SEQ ID NO: 5122021 - DNA, 20 bp, Homo sapiens
aatgtccagtaagatcactg

SEQ ID NO: 5122022 - DNA, 22 bp, Homo sapiens
aatgtccagtaagatcactgtt

SEQ ID NO: 5122023 - DNA, 18 bp, Homo sapiens
aatgtccatgatggaata

SEQ ID NO: 5122024 - DNA, 12 bp, Homo sapiens
aatgtcccagag

SEQ ID NO: 5122025 - DNA, 14 bp, Homo sapiens
aatgtcccagaggc

SEQ ID NO: 5122026 - DNA, 19 bp, Homo sapiens
aatgtcccccatcatgtgg

SEQ ID NO: 5122027 - DNA, 16 bp, Homo sapiens
aatgtcccctcaaact

SEQ ID NO: 5122028 - DNA, 18 bp, Homo sapiens
aatgtcccctcaaactca

SEQ ID NO: 5122029 - DNA, 19 bp, Homo sapiens
aatgtccctctcttggcta

SEQ ID NO: 5122030 - DNA, 14 bp, Homo sapiens
aatgtcctcagagg

SEQ ID NO: 5122031 - DNA, 18 bp, Homo sapiens
aatgtcctccagaagcct

SEQ ID NO: 5122032 - DNA, 14 bp, Homo sapiens
aatgtcctctttga

SEQ ID NO: 5122033 - DNA, 21 bp, Homo sapiens
aatgtcctgaatccagcattg

SEQ ID NO: 5122034 - DNA, 22 bp, Homo sapiens
aatgtcctgtggtgacaggccc

SEQ ID NO: 5122035 - DNA, 15 bp, Homo sapiens
aatgtccttattctt

SEQ ID NO: 5122036 - DNA, 16 bp, Homo sapiens
aatgtccttattcttg

SEQ ID NO: 5122037 - DNA, 14 bp, Homo sapiens
aatgtcctttctca

SEQ ID NO: 5122038 - DNA, 15 bp, Homo sapiens
aatgtcgatcaagag

SEQ ID NO: 5122039 - DNA, 15 bp, Homo sapiens
aatgtctaaaattgt

SEQ ID NO: 5122040 - DNA, 16 bp, Homo sapiens
aatgtctaatgtattt

SEQ ID NO: 5122041 - DNA, 14 bp, Homo sapiens
aatgtctaattttc

SEQ ID NO: 5122042 - DNA, 13 bp, Homo sapiens
aatgtctagattt

SEQ ID NO: 5122043 - DNA, 22 bp, Homo sapiens
aatgtctagttgtaacaccatg

SEQ ID NO: 5122044 - DNA, 16 bp, Homo sapiens
aatgtctagtttctag

SEQ ID NO: 5122045 - DNA, 23 bp, Homo sapiens
aatgtctataaatggtgtcataa

SEQ ID NO: 5122046 - DNA, 16 bp, Homo sapiens
aatgtctattattatg

SEQ ID NO: 5122047 - DNA, 13 bp, Homo sapiens
aatgtctatttcc

SEQ ID NO: 5122048 - DNA, 20 bp, Homo sapiens
aatgtctcaagtgcaatgcc

SEQ ID NO: 5122049 - DNA, 16 bp, Homo sapiens
aatgtctcactgttct

SEQ ID NO: 5122050 - DNA, 22 bp, Homo sapiens
aatgtctcactttactttcaag

SEQ ID NO: 5122051 - DNA, 20 bp, Homo sapiens
aatgtctcagttttcagcta

SEQ ID NO: 5122052 - DNA, 21 bp, Homo sapiens
aatgtctcctttgctcttgcc

SEQ ID NO: 5122053 - DNA, 16 bp, Homo sapiens
aatgtctcttcctctg

SEQ ID NO: 5122054 - DNA, 20 bp, Homo sapiens
aatgtctctttaatgtcaca

SEQ ID NO: 5122055 - DNA, 16 bp, Homo sapiens
aatgtctgacacatta

SEQ ID NO: 5122056 - DNA, 18 bp, Homo sapiens
aatgtctgcactgaggat

SEQ ID NO: 5122057 - DNA, 15 bp, Homo sapiens
aatgtctgcagccct

SEQ ID NO: 5122058 - DNA, 21 bp, Homo sapiens
aatgtctgcagccctgagaaa

SEQ ID NO: 5122059 - DNA, 16 bp, Homo sapiens
aatgtctgctgaggag

SEQ ID NO: 5122060 - DNA, 13 bp, Homo sapiens
aatgtctgctggt

SEQ ID NO: 5122061 - DNA, 17 bp, Homo sapiens
aatgtctgctggtattt

SEQ ID NO: 5122062 - DNA, 22 bp, Homo sapiens
aatgtctggagaataattcttt

SEQ ID NO: 5122063 - DNA, 20 bp, Homo sapiens
aatgtctggagaccaccagg

SEQ ID NO: 5122064 - DNA, 12 bp, Homo sapiens
aatgtctggagt

SEQ ID NO: 5122065 - DNA, 20 bp, Homo sapiens
aatgtctggtgtttgtcatg

SEQ ID NO: 5122066 - DNA, 20 bp, Homo sapiens
aatgtctgtcagaagacact

SEQ ID NO: 5122067 - DNA, 12 bp, Homo sapiens
aatgtctgtgaa

SEQ ID NO: 5122068 - DNA, 10 bp, Homo sapiens
aatgtctgtt

SEQ ID NO: 5122069 - DNA, 23 bp, Homo sapiens
aatgtctgtttattaactactga

SEQ ID NO: 5122070 - DNA, 19 bp, Homo sapiens
aatgtcttcaaggcttcag

SEQ ID NO: 5122071 - DNA, 23 bp, Homo sapiens
aatgtcttcagtggaacacaaat

SEQ ID NO: 5122072 - DNA, 13 bp, Homo sapiens
aattgcttattta

SEQ ID NO: 5122073 - DNA, 19 bp, Homo sapiens
aattgcttctaaaacaata

SEQ ID NO: 5122074 - DNA, 21 bp, Homo sapiens
aattgcttctctaaaacagca

SEQ ID NO: 5122075 - DNA, 15 bp, Homo sapiens
aattgcttgaaagaa

SEQ ID NO: 5122076 - DNA, 17 bp, Homo sapiens
aattgcttgaaagaaaa

SEQ ID NO: 5122077 - DNA, 19 bp, Homo sapiens
aattgcttgaacccaggag

SEQ ID NO: 5122078 - DNA, 23 bp, Homo sapiens
aattgcttgaacctgtgaggaag

SEQ ID NO: 5122079 - DNA, 14 bp, Homo sapiens
aattgcttgagcct

SEQ ID NO: 5122080 - DNA, 23 bp, Homo sapiens
aattgcttggttgtaattaaatt

SEQ ID NO: 5122081 - DNA, 19 bp, Homo sapiens
aattgcttgtttgcttcaa

SEQ ID NO: 5122082 - DNA, 13 bp, Homo sapiens
aattgctttacag

SEQ ID NO: 5122083 - DNA, 10 bp, Homo sapiens
aattgctttg

SEQ ID NO: 5122084 - DNA, 11 bp, Homo sapiens
aattgctttga

SEQ ID NO: 5122085 - DNA, 14 bp, Homo sapiens
aattgctttgaagc

SEQ ID NO: 5122086 - DNA, 14 bp, Homo sapiens
aattgctttgccaa

SEQ ID NO: 5122087 - DNA, 23 bp, Homo sapiens
aattgctttgccaaaataccaga

SEQ ID NO: 5122088 - DNA, 16 bp, Homo sapiens
aattgctttgtgactt

SEQ ID NO: 5122089 - DNA, 20 bp, Homo sapiens
aattgcttttgaaaaacaac

SEQ ID NO: 5122090 - DNA, 15 bp, Homo sapiens
aattggaaaagacta

SEQ ID NO: 5122091 - DNA, 15 bp, Homo sapiens
aattggaaagcaggt

SEQ ID NO: 5122092 - DNA, 16 bp, Homo sapiens
aattggaacaaagtga

SEQ ID NO: 5122093 - DNA, 20 bp, Homo sapiens
aattggaagctgccctgccc

SEQ ID NO: 5122094 - DNA, 20 bp, Homo sapiens
aattggaatcttcacctcag

SEQ ID NO: 5122095 - DNA, 18 bp, Homo sapiens
aattggaatttaaaaata

SEQ ID NO: 5122096 - DNA, 14 bp, Homo sapiens
aattggacttttat

SEQ ID NO: 5122097 - DNA, 20 bp, Homo sapiens
aattggagaaaagcacttaa

SEQ ID NO: 5122098 - DNA, 17 bp, Homo sapiens
aattggagaagatttat

SEQ ID NO: 5122099 - DNA, 15 bp, Homo sapiens
aattggagcagggac

SEQ ID NO: 5122100 - DNA, 17 bp, Homo sapiens
aattggagctcattttc

SEQ ID NO: 5122101 - DNA, 16 bp, Homo sapiens
aattggagtatctaaa

SEQ ID NO: 5122102 - DNA, 19 bp, Homo sapiens
aattggagtcgtgttgtca

SEQ ID NO: 5122103 - DNA, 16 bp, Homo sapiens
aattggatattgatga

SEQ ID NO: 5122104 - DNA, 15 bp, Homo sapiens
aattggattacagta

SEQ ID NO: 5122105 - DNA, 14 bp, Homo sapiens
aattggattatttt

SEQ ID NO: 5122106 - DNA, 17 bp, Homo sapiens
aattggatttcctaata

SEQ ID NO: 5122107 - DNA, 20 bp, Homo sapiens
aattggatttgtaattaaat

SEQ ID NO: 5122108 - DNA, 21 bp, Homo sapiens
aattggcagccctatttcagt

SEQ ID NO: 5122109 - DNA, 15 bp, Homo sapiens
aattggcaggataag

SEQ ID NO: 5122110 - DNA, 15 bp, Homo sapiens
aattggcagtgactt

SEQ ID NO: 5122111 - DNA, 23 bp, Homo sapiens
aattggcatggaaatttaaagca

SEQ ID NO: 5122112 - DNA, 14 bp, Homo sapiens
aattggcattttaa

SEQ ID NO: 5122113 - DNA, 11 bp, Homo sapiens
aattggccatg

SEQ ID NO: 5122114 - DNA, 16 bp, Homo sapiens
aattggccttcgattt

SEQ ID NO: 5122115 - DNA, 17 bp, Homo sapiens
aattggctcctttccca

SEQ ID NO: 5122116 - DNA, 21 bp, Homo sapiens
aattggcttttgaatcaaaga

SEQ ID NO: 5122117 - DNA, 22 bp, Homo sapiens
aattgggaacattatcacaatt

SEQ ID NO: 5122118 - DNA, 16 bp, Homo sapiens
aattgggaagctgggg

SEQ ID NO: 5122119 - DNA, 15 bp, Homo sapiens
aattgggacctggtt

SEQ ID NO: 5122120 - DNA, 21 bp, Homo sapiens
aattgggagcttgggaatgga

SEQ ID NO: 5122121 - DNA, 15 bp, Homo sapiens
aattgggatctgtct

SEQ ID NO: 5122122 - DNA, 19 bp, Homo sapiens
aattgggattttaaaaaca

SEQ ID NO: 5122123 - DNA, 20 bp, Homo sapiens
aattgggcttcaatcactgt

SEQ ID NO: 5122124 - DNA, 18 bp, Homo sapiens
aattggggaagaaaaaat

SEQ ID NO: 5122125 - DNA, 15 bp, Homo sapiens
aattggggagggaga

SEQ ID NO: 5122126 - DNA, 16 bp, Homo sapiens
aattggggattcttaa

SEQ ID NO: 5122127 - DNA, 23 bp, Homo sapiens
aattggggattgagttgtaaaga

SEQ ID NO: 5122128 - DNA, 23 bp, Homo sapiens
aattgggtggggggcttcataca

SEQ ID NO: 5122129 - DNA, 21 bp, Homo sapiens
aattgggtgtgccctggctcc

SEQ ID NO: 5122130 - DNA, 13 bp, Homo sapiens
aattgggttcatg

SEQ ID NO: 5122131 - DNA, 15 bp, Homo sapiens
aattggtaaaaacag

SEQ ID NO: 5122132 - DNA, 17 bp, Homo sapiens
aattggtaaaaacagca

SEQ ID NO: 5122133 - DNA, 20 bp, Homo sapiens
aattggtaaaactcactgtg

SEQ ID NO: 5122134 - DNA, 18 bp, Homo sapiens
aattggtaattgaatgga

SEQ ID NO: 5122135 - DNA, 15 bp, Homo sapiens
aattggtaccttgca

SEQ ID NO: 5122136 - DNA, 19 bp, Homo sapiens
aattggtacttttaaaaac

SEQ ID NO: 5122137 - DNA, 23 bp, Homo sapiens
aattggtacttttaaaaacataa

SEQ ID NO: 5122138 - DNA, 18 bp, Homo sapiens
aattggtatcaagaaagt

SEQ ID NO: 5122139 - DNA, 16 bp, Homo sapiens
aattggtcatggtaga

SEQ ID NO: 5122140 - DNA, 14 bp, Homo sapiens
aattggtcattcct

SEQ ID NO: 5122141 - DNA, 17 bp, Homo sapiens
aattggtctgaaaggct

SEQ ID NO: 5122142 - DNA, 21 bp, Homo sapiens
aattggtgacaatgtcacata

SEQ ID NO: 5122143 - DNA, 16 bp, Homo sapiens
aattggtgataagtgg

SEQ ID NO: 5122144 - DNA, 17 bp, Homo sapiens
aattggtgataagtgga

SEQ ID NO: 5122145 - DNA, 18 bp, Homo sapiens
aattggtgataagtggaa

SEQ ID NO: 5122146 - DNA, 20 bp, Homo sapiens
aattggtgcttcagccctgg

SEQ ID NO: 5122147 - DNA, 13 bp, Homo sapiens
aattggtgtatat

SEQ ID NO: 5122148 - DNA, 14 bp, Homo sapiens
aattggtgtcattt

SEQ ID NO: 5122149 - DNA, 15 bp, Homo sapiens
aattggtgtgcctta

SEQ ID NO: 5122150 - DNA, 14 bp, Homo sapiens
aattggttaatgaa

SEQ ID NO: 5122151 - DNA, 15 bp, Homo sapiens
aattggttaatgaaa

SEQ ID NO: 5122152 - DNA, 17 bp, Homo sapiens
aattggttaatgaaaaa

SEQ ID NO: 5122153 - DNA, 15 bp, Homo sapiens
aattggttctttatt

SEQ ID NO: 5122154 - DNA, 21 bp, Homo sapiens
aattggttggagaatttaggt

SEQ ID NO: 5122155 - DNA, 16 bp, Homo sapiens
aattggttgtatataa

SEQ ID NO: 5122156 - DNA, 17 bp, Homo sapiens
aattgtaaaactgaggc

SEQ ID NO: 5122157 - DNA, 15 bp, Homo sapiens
aattgtaaactgtac

SEQ ID NO: 5122158 - DNA, 21 bp, Homo sapiens
aattgtaaagtaaaagctata

SEQ ID NO: 5122159 - DNA, 19 bp, Homo sapiens
aattgtaaatattttgata

SEQ ID NO: 5122160 - DNA, 19 bp, Homo sapiens
aattgtaacctgcattttt

SEQ ID NO: 5122161 - DNA, 18 bp, Homo sapiens
aattgtaagccagagtca

SEQ ID NO: 5122162 - DNA, 19 bp, Homo sapiens
aattgtaagccagagtcaa

SEQ ID NO: 5122163 - DNA, 18 bp, Homo sapiens
aattgtaaggtattgcaa

SEQ ID NO: 5122164 - DNA, 11 bp, Homo sapiens
aattgtaatag

SEQ ID NO: 5122165 - DNA, 13 bp, Homo sapiens
aattgtaatctga

SEQ ID NO: 5122166 - DNA, 17 bp, Homo sapiens
aattgtaattaataata

SEQ ID NO: 5122167 - DNA, 16 bp, Homo sapiens
aattgtaatttgggaa

SEQ ID NO: 5122168 - DNA, 23 bp, Homo sapiens
aattgtacaaaaaagttataaga

SEQ ID NO: 5122169 - DNA, 23 bp, Homo sapiens
aattgtacaaggtatttacacat

SEQ ID NO: 5122170 - DNA, 12 bp, Homo sapiens
aattgtacaata

SEQ ID NO: 5122171 - DNA, 20 bp, Homo sapiens
aattgtaccatcattttatt

SEQ ID NO: 5122172 - DNA, 18 bp, Homo sapiens
aattgtactaatctgaga

SEQ ID NO: 5122173 - DNA, 15 bp, Homo sapiens
aattgtactttgaaa

SEQ ID NO: 5122174 - DNA, 16 bp, Homo sapiens
aattgtagaacataga

SEQ ID NO: 5122175 - DNA, 21 bp, Homo sapiens
aattgtagcccagttggtcaa

SEQ ID NO: 5122176 - DNA, 13 bp, Homo sapiens
aattgtagctttt

SEQ ID NO: 5122177 - DNA, 18 bp, Homo sapiens
aattgtagttctgtgtac

SEQ ID NO: 5122178 - DNA, 23 bp, Homo sapiens
aattgtagttctgtgtacttttt

SEQ ID NO: 5122179 - DNA, 17 bp, Homo sapiens
aattgtataaaacagtg

SEQ ID NO: 5122180 - DNA, 15 bp, Homo sapiens
aattgtataacaggt

SEQ ID NO: 5122181 - DNA, 20 bp, Homo sapiens
aattgtatacattttgttat

SEQ ID NO: 5122182 - DNA, 18 bp, Homo sapiens
aattgtataccaatgtgt

SEQ ID NO: 5122183 - DNA, 13 bp, Homo sapiens
aattgtatagaga

SEQ ID NO: 5122184 - DNA, 15 bp, Homo sapiens
aattgtatatatatg

SEQ ID NO: 5122185 - DNA, 17 bp, Homo sapiens
aattgtatatatatgtg

SEQ ID NO: 5122186 - DNA, 20 bp, Homo sapiens
aattgtatatatatgtgaac

SEQ ID NO: 5122187 - DNA, 19 bp, Homo sapiens
aattgtatatcattttgcc

SEQ ID NO: 5122188 - DNA, 12 bp, Homo sapiens
aattgtatattc

SEQ ID NO: 5122189 - DNA, 17 bp, Homo sapiens
aattgtatcagaggcct

SEQ ID NO: 5122190 - DNA, 20 bp, Homo sapiens
aattgtatcagaggcctata

SEQ ID NO: 5122191 - DNA, 24 bp, Homo sapiens
aattgtatcatttgaacaactagg

SEQ ID NO: 5122192 - DNA, 22 bp, Homo sapiens
aattgtatcgtatagctgtatt

SEQ ID NO: 5122193 - DNA, 23 bp, Homo sapiens
aattgtatctacattaaaatgac

SEQ ID NO: 5122194 - DNA, 13 bp, Homo sapiens
aattgtatctagt

SEQ ID NO: 5122195 - DNA, 20 bp, Homo sapiens
aattgtatcttattataaaa

SEQ ID NO: 5122196 - DNA, 14 bp, Homo sapiens
aattgtatgaaaat

SEQ ID NO: 5122197 - DNA, 12 bp, Homo sapiens
aattgtatgtta

SEQ ID NO: 5122198 - DNA, 19 bp, Homo sapiens
aattgtattaattatttaa

SEQ ID NO: 5122199 - DNA, 16 bp, Homo sapiens
aattgtattttagtaa

SEQ ID NO: 5122200 - DNA, 14 bp, Homo sapiens
aattgtatttttgt

SEQ ID NO: 5122201 - DNA, 22 bp, Homo sapiens
aattgtatttttgtatgtggca

SEQ ID NO: 5122202 - DNA, 14 bp, Homo sapiens
aattgtcaaaattg

SEQ ID NO: 5122203 - DNA, 15 bp, Homo sapiens
aattgtcaaatgtca

SEQ ID NO: 5122204 - DNA, 18 bp, Homo sapiens
aattgtcacatcaagcat

SEQ ID NO: 5122205 - DNA, 15 bp, Homo sapiens
aattgtcacatctat

SEQ ID NO: 5122206 - DNA, 16 bp, Homo sapiens
aattgtcagcatgaca

SEQ ID NO: 5122207 - DNA, 20 bp, Homo sapiens
aattgtcattatttttgtta

SEQ ID NO: 5122208 - DNA, 11 bp, Homo sapiens
aattgtccctt

SEQ ID NO: 5122209 - DNA, 18 bp, Homo sapiens
aattgtcccttaaacaaa

SEQ ID NO: 5122210 - DNA, 15 bp, Homo sapiens
aattgtcctgtgtct

SEQ ID NO: 5122211 - DNA, 13 bp, Homo sapiens
aattgtccttgaa

SEQ ID NO: 5122212 - DNA, 20 bp, Homo sapiens
aattgtccttgaagcttgta

SEQ ID NO: 5122213 - DNA, 23 bp, Homo sapiens
aattgtcgaaaagagtcttccaa

SEQ ID NO: 5122214 - DNA, 17 bp, Homo sapiens
aattgtcgggggagaga

SEQ ID NO: 5122215 - DNA, 17 bp, Homo sapiens
aattgtctaaaatgtca

SEQ ID NO: 5122216 - DNA, 18 bp, Homo sapiens
aattgtctaaaatgtcag

SEQ ID NO: 5122217 - DNA, 19 bp, Homo sapiens
aattgtctaaaatgtcagt

SEQ ID NO: 5122218 - DNA, 20 bp, Homo sapiens
aattgtctagggtgttctgt

SEQ ID NO: 5122219 - DNA, 14 bp, Homo sapiens
aattgtctatttat

SEQ ID NO: 5122220 - DNA, 17 bp, Homo sapiens
aattgtctatttatctt

SEQ ID NO: 5122221 - DNA, 21 bp, Homo sapiens
aattgtctatttatcttttat

SEQ ID NO: 5122222 - DNA, 21 bp, Homo sapiens
aattgtctcaaagcatcaaat

SEQ ID NO: 5122223 - DNA, 18 bp, Homo sapiens
aattgtctcaacgcctcc

SEQ ID NO: 5122224 - DNA, 20 bp, Homo sapiens
aattgtctcaacgcctcccc

SEQ ID NO: 5122225 - DNA, 12 bp, Homo sapiens
aattgtctcttc

SEQ ID NO: 5122226 - DNA, 22 bp, Homo sapiens
aattgtctgtctgctcttattt

SEQ ID NO: 5122227 - DNA, 19 bp, Homo sapiens
aattgtcttaatggatgaa

SEQ ID NO: 5122228 - DNA, 19 bp, Homo sapiens
aattgtctttaatttctgt

SEQ ID NO: 5122229 - DNA, 20 bp, Homo sapiens
aattgtcttttgtcatgtgg

SEQ ID NO: 5122230 - DNA, 21 bp, Homo sapiens
aattgtcttttttttcctttg

SEQ ID NO: 5122231 - DNA, 12 bp, Homo sapiens
aattgtgaaaaa

SEQ ID NO: 5122232 - DNA, 19 bp, Homo sapiens
aattgtgatatttgacaga

SEQ ID NO: 5122233 - DNA, 18 bp, Homo sapiens
aattgtgattagacagaa

SEQ ID NO: 5122234 - DNA, 22 bp, Homo sapiens
aattgtgcaaaggataaatttt

SEQ ID NO: 5122235 - DNA, 17 bp, Homo sapiens
aattgtgcataatgctt

SEQ ID NO: 5122236 - DNA, 18 bp, Homo sapiens
aattgtgcataatgcttt

SEQ ID NO: 5122237 - DNA, 21 bp, Homo sapiens
aattgtgcataatgctttgga

SEQ ID NO: 5122238 - DNA, 17 bp, Homo sapiens
aattgtgccaaagatag

SEQ ID NO: 5122239 - DNA, 22 bp, Homo sapiens
aattgtgccaaagatagcagaa

SEQ ID NO: 5122240 - DNA, 12 bp, Homo sapiens
aattgtgcccct

SEQ ID NO: 5122241 - DNA, 20 bp, Homo sapiens
aattgtgccgagaaaagcat

SEQ ID NO: 5122242 - DNA, 21 bp, Homo sapiens
aattgtgcgacttcacaaaat

SEQ ID NO: 5122243 - DNA, 14 bp, Homo sapiens
aattgtgctgccat

SEQ ID NO: 5122244 - DNA, 12 bp, Homo sapiens
aattgtgcttct

SEQ ID NO: 5122245 - DNA, 22 bp, Homo sapiens
aattgtgctttcaccagaattt

SEQ ID NO: 5122246 - DNA, 13 bp, Homo sapiens
aattgtggagagg

SEQ ID NO: 5122247 - DNA, 19 bp, Homo sapiens
aattgtggagaggagagaa

SEQ ID NO: 5122248 - DNA, 15 bp, Homo sapiens
aattgtggattaatg

SEQ ID NO: 5122249 - DNA, 15 bp, Homo sapiens
aattgtggattataa

SEQ ID NO: 5122250 - DNA, 23 bp, Homo sapiens
aattgtggattataaaaaatgta

SEQ ID NO: 5122251 - DNA, 21 bp, Homo sapiens
aatgtcttcatgttgatgtgt

SEQ ID NO: 5122252 - DNA, 17 bp, Homo sapiens
aatgtcttcatttcatt

SEQ ID NO: 5122253 - DNA, 17 bp, Homo sapiens
aatgtcttctagaatat

SEQ ID NO: 5122254 - DNA, 22 bp, Homo sapiens
aatgtcttctgtattcacttat

SEQ ID NO: 5122255 - DNA, 18 bp, Homo sapiens
aatgtcttcttattttgg

SEQ ID NO: 5122256 - DNA, 19 bp, Homo sapiens
aatgtcttgagctctatta

SEQ ID NO: 5122257 - DNA, 22 bp, Homo sapiens
aatgtcttgctgttgacatatt

SEQ ID NO: 5122258 - DNA, 14 bp, Homo sapiens
aatgtcttggtctt

SEQ ID NO: 5122259 - DNA, 11 bp, Homo sapiens
aatgtcttgtg

SEQ ID NO: 5122260 - DNA, 22 bp, Homo sapiens
aatgtcttgtgtatttctctgt

SEQ ID NO: 5122261 - DNA, 13 bp, Homo sapiens
aatgtcttgttaa

SEQ ID NO: 5122262 - DNA, 18 bp, Homo sapiens
aatgtcttgttaatattc

SEQ ID NO: 5122263 - DNA, 17 bp, Homo sapiens
aatgtctttaatgcaat

SEQ ID NO: 5122264 - DNA, 20 bp, Homo sapiens
aatgtctttaatgcaatata

SEQ ID NO: 5122265 - DNA, 17 bp, Homo sapiens
aatgtctttctattcat

SEQ ID NO: 5122266 - DNA, 16 bp, Homo sapiens
aatgtctttgtaagtc

SEQ ID NO: 5122267 - DNA, 18 bp, Homo sapiens
aatgtctttgttggaaaa

SEQ ID NO: 5122268 - DNA, 17 bp, Homo sapiens
aatgtcttttcaaaagg

SEQ ID NO: 5122269 - DNA, 12 bp, Homo sapiens
aatgtcttttga

SEQ ID NO: 5122270 - DNA, 17 bp, Homo sapiens
aatgtcttttgaatatt

SEQ ID NO: 5122271 - DNA, 20 bp, Homo sapiens
aatgtcttttttcaaacttt

SEQ ID NO: 5122272 - DNA, 22 bp, Homo sapiens
aatgtcttttttttaatgtgct

SEQ ID NO: 5122273 - DNA, 22 bp, Homo sapiens
aatgtgaaaaaaaaaagtaatt

SEQ ID NO: 5122274 - DNA, 14 bp, Homo sapiens
aatgtgaaaaagga

SEQ ID NO: 5122275 - DNA, 15 bp, Homo sapiens
aatgtgaaaaaggaa

SEQ ID NO: 5122276 - DNA, 21 bp, Homo sapiens
aatgtgaaaagtatcactcta

SEQ ID NO: 5122277 - DNA, 19 bp, Homo sapiens
aatgtgaaacacatgccag

SEQ ID NO: 5122278 - DNA, 22 bp, Homo sapiens
aatgtgaaacatccgttttcat

SEQ ID NO: 5122279 - DNA, 16 bp, Homo sapiens
aatgtgaaactgagac

SEQ ID NO: 5122280 - DNA, 22 bp, Homo sapiens
aatgtgaaactggattaaactt

SEQ ID NO: 5122281 - DNA, 16 bp, Homo sapiens
aatgtgaaagattatt

SEQ ID NO: 5122282 - DNA, 20 bp, Homo sapiens
aatgtgaaataaagagttct

SEQ ID NO: 5122283 - DNA, 16 bp, Homo sapiens
aatgtgaaatctcaga

SEQ ID NO: 5122284 - DNA, 15 bp, Homo sapiens
aatgtgaaatgcttt

SEQ ID NO: 5122285 - DNA, 16 bp, Homo sapiens
aatgtgaaatgtaact

SEQ ID NO: 5122286 - DNA, 19 bp, Homo sapiens
aatgtgaaatttttccaca

SEQ ID NO: 5122287 - DNA, 17 bp, Homo sapiens
aatgtgaactagctgga

SEQ ID NO: 5122288 - DNA, 22 bp, Homo sapiens
aatgtgaacttgtagctgtaaa

SEQ ID NO: 5122289 - DNA, 19 bp, Homo sapiens
aatgtgaagaggtctgatt

SEQ ID NO: 5122290 - DNA, 16 bp, Homo sapiens
aatgtgaagatgcatt

SEQ ID NO: 5122291 - DNA, 13 bp, Homo sapiens
aatgtgaagcctt

SEQ ID NO: 5122292 - DNA, 17 bp, Homo sapiens
aatgtgaaggcccaaga

SEQ ID NO: 5122293 - DNA, 16 bp, Homo sapiens
aatgtgaagttcatct

SEQ ID NO: 5122294 - DNA, 20 bp, Homo sapiens
aatgtgaagttcatcttgca

SEQ ID NO: 5122295 - DNA, 17 bp, Homo sapiens
aatgtgaatctcttaat

SEQ ID NO: 5122296 - DNA, 12 bp, Homo sapiens
aatgtgaattac

SEQ ID NO: 5122297 - DNA, 22 bp, Homo sapiens
aatgtgaatttttgcctatctt

SEQ ID NO: 5122298 - DNA, 20 bp, Homo sapiens
aatgtgacatgttgctcttt

SEQ ID NO: 5122299 - DNA, 14 bp, Homo sapiens
aatgtgactcaaga

SEQ ID NO: 5122300 - DNA, 14 bp, Homo sapiens
aatgtgactttgaa

SEQ ID NO: 5122301 - DNA, 15 bp, Homo sapiens
aatgtgagaaatgtc

SEQ ID NO: 5122302 - DNA, 15 bp, Homo sapiens
aatgtgagaagccag

SEQ ID NO: 5122303 - DNA, 13 bp, Homo sapiens
aatgtgagacagc

SEQ ID NO: 5122304 - DNA, 14 bp, Homo sapiens
aatgtgagacagca

SEQ ID NO: 5122305 - DNA, 16 bp, Homo sapiens
aatgtgagacagcaag

SEQ ID NO: 5122306 - DNA, 17 bp, Homo sapiens
aatgtgagacagcaagt

SEQ ID NO: 5122307 - DNA, 18 bp, Homo sapiens
aatgtgagctataatgtt

SEQ ID NO: 5122308 - DNA, 19 bp, Homo sapiens
aatgtgaggaactcacata

SEQ ID NO: 5122309 - DNA, 14 bp, Homo sapiens
aatgtgagggtttg

SEQ ID NO: 5122310 - DNA, 18 bp, Homo sapiens
aatgtgagggtttgtaat

SEQ ID NO: 5122311 - DNA, 17 bp, Homo sapiens
aatgtgagtagttacta

SEQ ID NO: 5122312 - DNA, 16 bp, Homo sapiens
aatgtgagtcccagag

SEQ ID NO: 5122313 - DNA, 21 bp, Homo sapiens
aatgtgataatatattgctaa

SEQ ID NO: 5122314 - DNA, 19 bp, Homo sapiens
aatgtgatataaacagctt

SEQ ID NO: 5122315 - DNA, 20 bp, Homo sapiens
aatgtgatcaactgttcagg

SEQ ID NO: 5122316 - DNA, 19 bp, Homo sapiens
aatgtgatcatctttgctg

SEQ ID NO: 5122317 - DNA, 16 bp, Homo sapiens
aatgtgatgaatactg

SEQ ID NO: 5122318 - DNA, 20 bp, Homo sapiens
aatgtgatgcttataataaa

SEQ ID NO: 5122319 - DNA, 21 bp, Homo sapiens
aatgtgatggatggcacaatg

SEQ ID NO: 5122320 - DNA, 16 bp, Homo sapiens
aatgtgatgttctaag

SEQ ID NO: 5122321 - DNA, 17 bp, Homo sapiens
aatgtgatgttctaagg

SEQ ID NO: 5122322 - DNA, 14 bp, Homo sapiens
aatgtgattggtaa

SEQ ID NO: 5122323 - DNA, 17 bp, Homo sapiens
aatgtgatttgtcttcc

SEQ ID NO: 5122324 - DNA, 20 bp, Homo sapiens
aatgtgattttatggtgatg

SEQ ID NO: 5122325 - DNA, 17 bp, Homo sapiens
aatgtgatttttttata

SEQ ID NO: 5122326 - DNA, 23 bp, Homo sapiens
aatgtgcaagagtatactttgta

SEQ ID NO: 5122327 - DNA, 18 bp, Homo sapiens
aatgtgcaatttgtaaat

SEQ ID NO: 5122328 - DNA, 17 bp, Homo sapiens
aatgtgcactttatcct

SEQ ID NO: 5122329 - DNA, 20 bp, Homo sapiens
aatgtgcagatgcaattgtt

SEQ ID NO: 5122330 - DNA, 21 bp, Homo sapiens
aatgtgcagggatattgcctt

SEQ ID NO: 5122331 - DNA, 23 bp, Homo sapiens
aatgtgcagggatattgccttat

SEQ ID NO: 5122332 - DNA, 15 bp, Homo sapiens
aatgtgcagtgtctt

SEQ ID NO: 5122333 - DNA, 23 bp, Homo sapiens
aatgtgcattcttttaaaagaca

SEQ ID NO: 5122334 - DNA, 14 bp, Homo sapiens
aatgtgccacctgt

SEQ ID NO: 5122335 - DNA, 18 bp, Homo sapiens
aatgtgccatactaatga

SEQ ID NO: 5122336 - DNA, 18 bp, Homo sapiens
aatgtgccatttttttca

SEQ ID NO: 5122337 - DNA, 21 bp, Homo sapiens
aatgtgcccagtcatgacatt

SEQ ID NO: 5122338 - DNA, 19 bp, Homo sapiens
aatgtgccctcttaagtgt

SEQ ID NO: 5122339 - DNA, 11 bp, Homo sapiens
aatgtgcctgg

SEQ ID NO: 5122340 - DNA, 20 bp, Homo sapiens
aatgtgcctggctctgattc

SEQ ID NO: 5122341 - DNA, 18 bp, Homo sapiens
aatgtgctcaaattacta

SEQ ID NO: 5122342 - DNA, 14 bp, Homo sapiens
aatgtgctgcaaag

SEQ ID NO: 5122343 - DNA, 21 bp, Homo sapiens
aatgtgctggtgaacactgtg

SEQ ID NO: 5122344 - DNA, 12 bp, Homo sapiens
aatgtgctgtgt

SEQ ID NO: 5122345 - DNA, 16 bp, Homo sapiens
aatgtgctgtgtaaag

SEQ ID NO: 5122346 - DNA, 17 bp, Homo sapiens
aatgtgctgtgtaaagt

SEQ ID NO: 5122347 - DNA, 19 bp, Homo sapiens
aatgtgctgtgtaaagtta

SEQ ID NO: 5122348 - DNA, 15 bp, Homo sapiens
aatgtgcttcattgt

SEQ ID NO: 5122349 - DNA, 15 bp, Homo sapiens
aatgtgcttccgaga

SEQ ID NO: 5122350 - DNA, 14 bp, Homo sapiens
aatgtgctttattt

SEQ ID NO: 5122351 - DNA, 14 bp, Homo sapiens
aatgtgcttttcca

SEQ ID NO: 5122352 - DNA, 20 bp, Homo sapiens
aatgtgcttttccatctaaa

SEQ ID NO: 5122353 - DNA, 16 bp, Homo sapiens
aatgtggaagaaaatg

SEQ ID NO: 5122354 - DNA, 21 bp, Homo sapiens
aatgtggaaggaaaatatttc

SEQ ID NO: 5122355 - DNA, 11 bp, Homo sapiens
aatgtggagaa

SEQ ID NO: 5122356 - DNA, 20 bp, Homo sapiens
aatgtggagtctccctctga

SEQ ID NO: 5122357 - DNA, 20 bp, Homo sapiens
aatgtggataaaactgtgta

SEQ ID NO: 5122358 - DNA, 19 bp, Homo sapiens
aatgtggatagctgccttt

SEQ ID NO: 5122359 - DNA, 17 bp, Homo sapiens
aatgtggcaagtttgca

SEQ ID NO: 5122360 - DNA, 16 bp, Homo sapiens
aatgtggcagctgtct

SEQ ID NO: 5122361 - DNA, 16 bp, Homo sapiens
aatgtggccacttatt

SEQ ID NO: 5122362 - DNA, 18 bp, Homo sapiens
aatgtggccatttcacca

SEQ ID NO: 5122363 - DNA, 14 bp, Homo sapiens
aatgtggccgggca

SEQ ID NO: 5122364 - DNA, 17 bp, Homo sapiens
aatgtggcctaaaaatg

SEQ ID NO: 5122365 - DNA, 20 bp, Homo sapiens
aatgtggcctaaaaatgcaa

SEQ ID NO: 5122366 - DNA, 16 bp, Homo sapiens
aatgtggctgtaaaac

SEQ ID NO: 5122367 - DNA, 21 bp, Homo sapiens
aatgtggcttgagaaatatgg

SEQ ID NO: 5122368 - DNA, 13 bp, Homo sapiens
aatgtgggctatg

SEQ ID NO: 5122369 - DNA, 22 bp, Homo sapiens
aatgtgggctgcccctcgcaca

SEQ ID NO: 5122370 - DNA, 19 bp, Homo sapiens
aatgtgggtgaagtgcctg

SEQ ID NO: 5122371 - DNA, 16 bp, Homo sapiens
aatgtggtcctattta

SEQ ID NO: 5122372 - DNA, 16 bp, Homo sapiens
aatgtggtctcaggat

SEQ ID NO: 5122373 - DNA, 17 bp, Homo sapiens
aatgtggtgacacctcc

SEQ ID NO: 5122374 - DNA, 17 bp, Homo sapiens
aatgtggtggcaataaa

SEQ ID NO: 5122375 - DNA, 20 bp, Homo sapiens
aatgtggtggcaataaatgt

SEQ ID NO: 5122376 - DNA, 18 bp, Homo sapiens
aatgtggttatttctctg

SEQ ID NO: 5122377 - DNA, 17 bp, Homo sapiens
aatgtggttttcctgaa

SEQ ID NO: 5122378 - DNA, 16 bp, Homo sapiens
aatgtgtaaaattgga

SEQ ID NO: 5122379 - DNA, 12 bp, Homo sapiens
aatgtgtaaatg

SEQ ID NO: 5122380 - DNA, 15 bp, Homo sapiens
aatgtgtaattttga

SEQ ID NO: 5122381 - DNA, 15 bp, Homo sapiens
aatgtgtaattttgt

SEQ ID NO: 5122382 - DNA, 15 bp, Homo sapiens
aatgtgtacagtgaa

SEQ ID NO: 5122383 - DNA, 20 bp, Homo sapiens
aatgtgtacagtgaacaaat

SEQ ID NO: 5122384 - DNA, 18 bp, Homo sapiens
aatgtgtacagtgaattg

SEQ ID NO: 5122385 - DNA, 14 bp, Homo sapiens
aatgtgtataaaca

SEQ ID NO: 5122386 - DNA, 21 bp, Homo sapiens
aatgtgtatctatttatatat

SEQ ID NO: 5122387 - DNA, 20 bp, Homo sapiens
aatgtgtatttcttaagaat

SEQ ID NO: 5122388 - DNA, 22 bp, Homo sapiens
aatgtgtatttcttaagaattc

SEQ ID NO: 5122389 - DNA, 20 bp, Homo sapiens
aatgtgtcagaataggaaaa

SEQ ID NO: 5122390 - DNA, 12 bp, Homo sapiens
aatgtgtccaag

SEQ ID NO: 5122391 - DNA, 23 bp, Homo sapiens
aatgtgtcctatctatcttccaa

SEQ ID NO: 5122392 - DNA, 22 bp, Homo sapiens
aatgtgtcctcctgctctgctt

SEQ ID NO: 5122393 - DNA, 19 bp, Homo sapiens
aatgtgtctctgctttcct

SEQ ID NO: 5122394 - DNA, 20 bp, Homo sapiens
aatgtgtctctgctttcctt

SEQ ID NO: 5122395 - DNA, 10 bp, Homo sapiens
aatgtgtctg

SEQ ID NO: 5122396 - DNA, 19 bp, Homo sapiens
aatgtgtctgcaacatgga

SEQ ID NO: 5122397 - DNA, 15 bp, Homo sapiens
aatgtgtctgtggac

SEQ ID NO: 5122398 - DNA, 17 bp, Homo sapiens
aatgtgtctgtgttgct

SEQ ID NO: 5122399 - DNA, 11 bp, Homo sapiens
aatgtgtcttt

SEQ ID NO: 5122400 - DNA, 13 bp, Homo sapiens
aatgtgtctttag

SEQ ID NO: 5122401 - DNA, 23 bp, Homo sapiens
aatgtgtctttagatagccctgt

SEQ ID NO: 5122402 - DNA, 18 bp, Homo sapiens
aatgtgtctttctaagaa

SEQ ID NO: 5122403 - DNA, 22 bp, Homo sapiens
aatgtgtctttctttttggaca

SEQ ID NO: 5122404 - DNA, 13 bp, Homo sapiens
aatgtgtgaaaaa

SEQ ID NO: 5122405 - DNA, 22 bp, Homo sapiens
aatgtgtgaaaaagatgccaat

SEQ ID NO: 5122406 - DNA, 18 bp, Homo sapiens
aatgtgtgagtgcatgta

SEQ ID NO: 5122407 - DNA, 19 bp, Homo sapiens
aatgtgtgccatagagttt

SEQ ID NO: 5122408 - DNA, 20 bp, Homo sapiens
aatgtgtgctttattgaatt

SEQ ID NO: 5122409 - DNA, 23 bp, Homo sapiens
aatgtgtggattgcctctgaaaa

SEQ ID NO: 5122410 - DNA, 18 bp, Homo sapiens
aatgtgtgggatcattgc

SEQ ID NO: 5122411 - DNA, 13 bp, Homo sapiens
aatgtgtgggccc

SEQ ID NO: 5122412 - DNA, 12 bp, Homo sapiens
aatgtgtgtatg

SEQ ID NO: 5122413 - DNA, 15 bp, Homo sapiens
aatgtgtgtatgtgt

SEQ ID NO: 5122414 - DNA, 21 bp, Homo sapiens
aatgtgtgtatgtgtatttat

SEQ ID NO: 5122415 - DNA, 16 bp, Homo sapiens
aatgtgtgtcaattta

SEQ ID NO: 5122416 - DNA, 22 bp, Homo sapiens
aatgtgtgtggttttttttcta

SEQ ID NO: 5122417 - DNA, 21 bp, Homo sapiens
aatgtgtgtgtgtggcagggg

SEQ ID NO: 5122418 - DNA, 18 bp, Homo sapiens
aatgtgtgttcctgcttt

SEQ ID NO: 5122419 - DNA, 16 bp, Homo sapiens
aatgtgtgttgtgtga

SEQ ID NO: 5122420 - DNA, 14 bp, Homo sapiens
aatgtgttcttttc

SEQ ID NO: 5122421 - DNA, 20 bp, Homo sapiens
aatgtgttcttttctccttt

SEQ ID NO: 5122422 - DNA, 22 bp, Homo sapiens
aatgtgttcttttctcctttac

SEQ ID NO: 5122423 - DNA, 16 bp, Homo sapiens
aatgtgttgaaactgc

SEQ ID NO: 5122424 - DNA, 22 bp, Homo sapiens
aatgtgttgatttgagaaattt

SEQ ID NO: 5122425 - DNA, 16 bp, Homo sapiens
aatgtgttggaaactg

SEQ ID NO: 5122426 - DNA, 17 bp, Homo sapiens
aatgtgttggaaactgt

SEQ ID NO: 5122427 - DNA, 19 bp, Homo sapiens
aatgtgttggacaaatgtg

SEQ ID NO: 5122428 - DNA, 21 bp, Homo sapiens
aatgtgttggacaaatgtgaa

SEQ ID NO: 5122429 - DNA, 11 bp, Homo sapiens
aattgtggcta

SEQ ID NO: 5122430 - DNA, 19 bp, Homo sapiens
aattgtggctatcctgatt

SEQ ID NO: 5122431 - DNA, 21 bp, Homo sapiens
aattgtgggataatctgtatt

SEQ ID NO: 5122432 - DNA, 15 bp, Homo sapiens
aattgtgggcaaaag

SEQ ID NO: 5122433 - DNA, 18 bp, Homo sapiens
aattgtggtagaaatttt

SEQ ID NO: 5122434 - DNA, 16 bp, Homo sapiens
aattgtggtgtcttac

SEQ ID NO: 5122435 - DNA, 23 bp, Homo sapiens
aattgtgtaaaaaatggaaaaaa

SEQ ID NO: 5122436 - DNA, 15 bp, Homo sapiens
aattgtgtacaaagt

SEQ ID NO: 5122437 - DNA, 22 bp, Homo sapiens
aattgtgtagagtgtttgtgag

SEQ ID NO: 5122438 - DNA, 15 bp, Homo sapiens
aattgtgtagccttt

SEQ ID NO: 5122439 - DNA, 14 bp, Homo sapiens
aattgtgtatatgt

SEQ ID NO: 5122440 - DNA, 19 bp, Homo sapiens
aattgtgtatatgttggtt

SEQ ID NO: 5122441 - DNA, 19 bp, Homo sapiens
aattgtgtattgatgcaat

SEQ ID NO: 5122442 - DNA, 21 bp, Homo sapiens
aattgtgtattgatgcaatat

SEQ ID NO: 5122443 - DNA, 23 bp, Homo sapiens
aattgtgtatttaaaaaaaagaa

SEQ ID NO: 5122444 - DNA, 13 bp, Homo sapiens
aattgtgtatttt

SEQ ID NO: 5122445 - DNA, 13 bp, Homo sapiens
aattgtgtctgca

SEQ ID NO: 5122446 - DNA, 23 bp, Homo sapiens
aattgtgtgaaaggtacttcaaa

SEQ ID NO: 5122447 - DNA, 18 bp, Homo sapiens
aattgtgtgaacttggaa

SEQ ID NO: 5122448 - DNA, 18 bp, Homo sapiens
aattgtgtggagaagtgt

SEQ ID NO: 5122449 - DNA, 20 bp, Homo sapiens
aattgtgtggagaagtgtgt

SEQ ID NO: 5122450 - DNA, 21 bp, Homo sapiens
aattgtgtgtgctctgcttca

SEQ ID NO: 5122451 - DNA, 19 bp, Homo sapiens
aattgtgtttacattttat

SEQ ID NO: 5122452 - DNA, 15 bp, Homo sapiens
aattgtgtttgctaa

SEQ ID NO: 5122453 - DNA, 15 bp, Homo sapiens
aattgttaaatttaa

SEQ ID NO: 5122454 - DNA, 16 bp, Homo sapiens
aattgttaaccttgta

SEQ ID NO: 5122455 - DNA, 11 bp, Homo sapiens
aattgttacaa

SEQ ID NO: 5122456 - DNA, 16 bp, Homo sapiens
aattgttacaaattgt

SEQ ID NO: 5122457 - DNA, 18 bp, Homo sapiens
aattgttacaagtgttct

SEQ ID NO: 5122458 - DNA, 13 bp, Homo sapiens
aattgttacaatt

SEQ ID NO: 5122459 - DNA, 14 bp, Homo sapiens
aattgttacaattt

SEQ ID NO: 5122460 - DNA, 18 bp, Homo sapiens
aattgttacccatttgaa

SEQ ID NO: 5122461 - DNA, 16 bp, Homo sapiens
aattgttactccatat

SEQ ID NO: 5122462 - DNA, 17 bp, Homo sapiens
aattgttatgtaaacat

SEQ ID NO: 5122463 - DNA, 22 bp, Homo sapiens
aattgttatgtaaacatcataa

SEQ ID NO: 5122464 - DNA, 15 bp, Homo sapiens
aattgttatttcaat

SEQ ID NO: 5122465 - DNA, 20 bp, Homo sapiens
aattgttccttgcttttata

SEQ ID NO: 5122466 - DNA, 14 bp, Homo sapiens
aattgttctgggtg

SEQ ID NO: 5122467 - DNA, 16 bp, Homo sapiens
aattgttcttaaaacc

SEQ ID NO: 5122468 - DNA, 23 bp, Homo sapiens
aattgttcttgggagaaaatcaa

SEQ ID NO: 5122469 - DNA, 19 bp, Homo sapiens
aattgttgaaactaaagca

SEQ ID NO: 5122470 - DNA, 14 bp, Homo sapiens
aattgttgaatgta

SEQ ID NO: 5122471 - DNA, 17 bp, Homo sapiens
aattgttgaatgtattc

SEQ ID NO: 5122472 - DNA, 20 bp, Homo sapiens
aattgttgaatgtattcttt

SEQ ID NO: 5122473 - DNA, 14 bp, Homo sapiens
aattgttgacaaat

SEQ ID NO: 5122474 - DNA, 13 bp, Homo sapiens
aattgttgacagt

SEQ ID NO: 5122475 - DNA, 17 bp, Homo sapiens
aattgttgactaaaatg

SEQ ID NO: 5122476 - DNA, 18 bp, Homo sapiens
aattgttgactaaaatgc

SEQ ID NO: 5122477 - DNA, 21 bp, Homo sapiens
aattgttgattaatttgagaa

SEQ ID NO: 5122478 - DNA, 16 bp, Homo sapiens
aattgttgtatatcac

SEQ ID NO: 5122479 - DNA, 22 bp, Homo sapiens
aattgttgtatatcactaaaag

SEQ ID NO: 5122480 - DNA, 20 bp, Homo sapiens
aattgttgtccggtttactt

SEQ ID NO: 5122481 - DNA, 23 bp, Homo sapiens
aattgttgtccggtttactttaa

SEQ ID NO: 5122482 - DNA, 23 bp, Homo sapiens
aattgttgttctgttaactgaat

SEQ ID NO: 5122483 - DNA, 12 bp, Homo sapiens
aattgttgtttc

SEQ ID NO: 5122484 - DNA, 21 bp, Homo sapiens
aattgttgtttctttctagtg

SEQ ID NO: 5122485 - DNA, 17 bp, Homo sapiens
aattgttgtttgtatgt

SEQ ID NO: 5122486 - DNA, 13 bp, Homo sapiens
aattgtttaagaa

SEQ ID NO: 5122487 - DNA, 22 bp, Homo sapiens
aattgtttaccatagaaagatg

SEQ ID NO: 5122488 - DNA, 14 bp, Homo sapiens
aattgtttagaaat

SEQ ID NO: 5122489 - DNA, 18 bp, Homo sapiens
aattgtttataatggcaa

SEQ ID NO: 5122490 - DNA, 14 bp, Homo sapiens
aattgtttatacac

SEQ ID NO: 5122491 - DNA, 19 bp, Homo sapiens
aattgtttatacacaactt

SEQ ID NO: 5122492 - DNA, 20 bp, Homo sapiens
aattgtttcaaaataaaaac

SEQ ID NO: 5122493 - DNA, 14 bp, Homo sapiens
aattgtttcagaat

SEQ ID NO: 5122494 - DNA, 21 bp, Homo sapiens
aattgtttcagagtcacagtt

SEQ ID NO: 5122495 - DNA, 17 bp, Homo sapiens
aattgtttccaaagtgc

SEQ ID NO: 5122496 - DNA, 11 bp, Homo sapiens
aattgtttctt

SEQ ID NO: 5122497 - DNA, 19 bp, Homo sapiens
aattgtttggcttcctcct

SEQ ID NO: 5122498 - DNA, 22 bp, Homo sapiens
aattgtttggggatgagaaagg

SEQ ID NO: 5122499 - DNA, 18 bp, Homo sapiens
aattgttttaatctgaaa

SEQ ID NO: 5122500 - DNA, 19 bp, Homo sapiens
aattgttttaatctgaaat

SEQ ID NO: 5122501 - DNA, 17 bp, Homo sapiens
aattgttttaccagctc

SEQ ID NO: 5122502 - DNA, 22 bp, Homo sapiens
aattgttttatctgaattttta

SEQ ID NO: 5122503 - DNA, 13 bp, Homo sapiens
aattgttttcact

SEQ ID NO: 5122504 - DNA, 19 bp, Homo sapiens
aattgtttttataaaaaca

SEQ ID NO: 5122505 - DNA, 20 bp, Homo sapiens
aattgtttttataaaaacat

SEQ ID NO: 5122506 - DNA, 22 bp, Homo sapiens
aattgtttttgaatttaaataa

SEQ ID NO: 5122507 - DNA, 19 bp, Homo sapiens
aattgttttttaaagcaag

SEQ ID NO: 5122508 - DNA, 14 bp, Homo sapiens
aattgttttttatc

SEQ ID NO: 5122509 - DNA, 17 bp, Homo sapiens
aattgttttttatcttt

SEQ ID NO: 5122510 - DNA, 14 bp, Homo sapiens
aatttaaaaaaata

SEQ ID NO: 5122511 - DNA, 17 bp, Homo sapiens
aatttaaaaaaatacag

SEQ ID NO: 5122512 - DNA, 14 bp, Homo sapiens
aatttaaaaaagtt

SEQ ID NO: 5122513 - DNA, 16 bp, Homo sapiens
aatttaaaaataggta

SEQ ID NO: 5122514 - DNA, 15 bp, Homo sapiens
aatttaaaaatatat

SEQ ID NO: 5122515 - DNA, 19 bp, Homo sapiens
aatttaaaactgttatttt

SEQ ID NO: 5122516 - DNA, 20 bp, Homo sapiens
aatttaaaagcagagcattt

SEQ ID NO: 5122517 - DNA, 15 bp, Homo sapiens
aatttaaaagtaaaa

SEQ ID NO: 5122518 - DNA, 13 bp, Homo sapiens
aatttaaaagtct

SEQ ID NO: 5122519 - DNA, 16 bp, Homo sapiens
aatttaaaataaataa

SEQ ID NO: 5122520 - DNA, 22 bp, Homo sapiens
aatttaaaataaataaactttg

SEQ ID NO: 5122521 - DNA, 13 bp, Homo sapiens
aatttaaaatata

SEQ ID NO: 5122522 - DNA, 22 bp, Homo sapiens
aatttaaaatcattcaatatct

SEQ ID NO: 5122523 - DNA, 19 bp, Homo sapiens
aatttaaaattaagtagaa

SEQ ID NO: 5122524 - DNA, 20 bp, Homo sapiens
aatttaaaattaatcttgct

SEQ ID NO: 5122525 - DNA, 20 bp, Homo sapiens
aatttaaacaggcccagcat

SEQ ID NO: 5122526 - DNA, 22 bp, Homo sapiens
aatttaaacattaaaaatggaa

SEQ ID NO: 5122527 - DNA, 16 bp, Homo sapiens
aatttaaacatttgtt

SEQ ID NO: 5122528 - DNA, 13 bp, Homo sapiens
aatttaaaccagc

SEQ ID NO: 5122529 - DNA, 16 bp, Homo sapiens
aatttaaaccagcaga

SEQ ID NO: 5122530 - DNA, 22 bp, Homo sapiens
aatttaaactataagcaagaag

SEQ ID NO: 5122531 - DNA, 13 bp, Homo sapiens
aatttaaactgtg

SEQ ID NO: 5122532 - DNA, 16 bp, Homo sapiens
aatttaaactgtgttt

SEQ ID NO: 5122533 - DNA, 20 bp, Homo sapiens
aatttaaagaaaaaaatgtc

SEQ ID NO: 5122534 - DNA, 20 bp, Homo sapiens
aatttaaagaagtatgggaa

SEQ ID NO: 5122535 - DNA, 12 bp, Homo sapiens
aatttaaagata

SEQ ID NO: 5122536 - DNA, 13 bp, Homo sapiens
aatttaaagatat

SEQ ID NO: 5122537 - DNA, 12 bp, Homo sapiens
aatttaaagcag

SEQ ID NO: 5122538 - DNA, 15 bp, Homo sapiens
aatttaaagccacaa

SEQ ID NO: 5122539 - DNA, 19 bp, Homo sapiens
aatttaaaggaaacactaa

SEQ ID NO: 5122540 - DNA, 22 bp, Homo sapiens
aatttaaagttgtttgtgcctt

SEQ ID NO: 5122541 - DNA, 13 bp, Homo sapiens
aatttaaataaag

SEQ ID NO: 5122542 - DNA, 18 bp, Homo sapiens
aatttaaataaagttact

SEQ ID NO: 5122543 - DNA, 13 bp, Homo sapiens
aatttaaatagca

SEQ ID NO: 5122544 - DNA, 16 bp, Homo sapiens
aatttaaatagctttt

SEQ ID NO: 5122545 - DNA, 14 bp, Homo sapiens
aatttaaatataat

SEQ ID NO: 5122546 - DNA, 22 bp, Homo sapiens
aatttaaatgaaagaaaattga

SEQ ID NO: 5122547 - DNA, 17 bp, Homo sapiens
aatttaaatgatattta

SEQ ID NO: 5122548 - DNA, 17 bp, Homo sapiens
aatttaaatgctttgtt

SEQ ID NO: 5122549 - DNA, 13 bp, Homo sapiens
aatttaaatgttt

SEQ ID NO: 5122550 - DNA, 20 bp, Homo sapiens
aatttaaattctttttcaaa

SEQ ID NO: 5122551 - DNA, 14 bp, Homo sapiens
aatttaacaaacta

SEQ ID NO: 5122552 - DNA, 17 bp, Homo sapiens
aatttaacaaactaaaa

SEQ ID NO: 5122553 - DNA, 19 bp, Homo sapiens
aatttaacatagtaattct

SEQ ID NO: 5122554 - DNA, 21 bp, Homo sapiens
aatttaacatctgcagtgttc

SEQ ID NO: 5122555 - DNA, 18 bp, Homo sapiens
aatttaaccataaatcaa

SEQ ID NO: 5122556 - DNA, 14 bp, Homo sapiens
aatttaactaattt

SEQ ID NO: 5122557 - DNA, 15 bp, Homo sapiens
aatttaactaattta

SEQ ID NO: 5122558 - DNA, 18 bp, Homo sapiens
aatttaactaatttaaac

SEQ ID NO: 5122559 - DNA, 21 bp, Homo sapiens
aatttaactaatttaaaccag

SEQ ID NO: 5122560 - DNA, 21 bp, Homo sapiens
aatttaactacccttaattac

SEQ ID NO: 5122561 - DNA, 21 bp, Homo sapiens
aatttaactagacacagataa

SEQ ID NO: 5122562 - DNA, 13 bp, Homo sapiens
aatttaactgcat

SEQ ID NO: 5122563 - DNA, 22 bp, Homo sapiens
aatttaactgcatatagataat

SEQ ID NO: 5122564 - DNA, 17 bp, Homo sapiens
aatttaacttttaaaga

SEQ ID NO: 5122565 - DNA, 19 bp, Homo sapiens
aatttaagaaaacaagtat

SEQ ID NO: 5122566 - DNA, 20 bp, Homo sapiens
aatttaagcacaaaaaattt

SEQ ID NO: 5122567 - DNA, 13 bp, Homo sapiens
aatttaagcattg

SEQ ID NO: 5122568 - DNA, 18 bp, Homo sapiens
aatttaagccaataaata

SEQ ID NO: 5122569 - DNA, 21 bp, Homo sapiens
aatttaagccaataaataata

SEQ ID NO: 5122570 - DNA, 17 bp, Homo sapiens
aatttaaggaacacaga

SEQ ID NO: 5122571 - DNA, 15 bp, Homo sapiens
aatttaagggctcag

SEQ ID NO: 5122572 - DNA, 16 bp, Homo sapiens
aatttaagtgacacag

SEQ ID NO: 5122573 - DNA, 16 bp, Homo sapiens
aatttaagtgcgtgtg

SEQ ID NO: 5122574 - DNA, 20 bp, Homo sapiens
aatttaagtgcgtgtgtaga

SEQ ID NO: 5122575 - DNA, 17 bp, Homo sapiens
aatttaagttctattca

SEQ ID NO: 5122576 - DNA, 19 bp, Homo sapiens
aatttaagttggctagagc

SEQ ID NO: 5122577 - DNA, 24 bp, Homo sapiens
aatttaagttttgacaagctggct

SEQ ID NO: 5122578 - DNA, 19 bp, Homo sapiens
aatttaataaaaacttcag

SEQ ID NO: 5122579 - DNA, 15 bp, Homo sapiens
aatttaatatactgc

SEQ ID NO: 5122580 - DNA, 16 bp, Homo sapiens
aatttaatatactgca

SEQ ID NO: 5122581 - DNA, 14 bp, Homo sapiens
aatttaatgaaaag

SEQ ID NO: 5122582 - DNA, 17 bp, Homo sapiens
aatttaatgacttttga

SEQ ID NO: 5122583 - DNA, 14 bp, Homo sapiens
aatttaatgcatgt

SEQ ID NO: 5122584 - DNA, 20 bp, Homo sapiens
aatttaatggactgtgaatt

SEQ ID NO: 5122585 - DNA, 17 bp, Homo sapiens
aatttaatgtaaataaa

SEQ ID NO: 5122586 - DNA, 18 bp, Homo sapiens
aatttaatgtaaataaaa

SEQ ID NO: 5122587 - DNA, 19 bp, Homo sapiens
aatttaatgtaaataaaac

SEQ ID NO: 5122588 - DNA, 14 bp, Homo sapiens
aatttaatgtctag

SEQ ID NO: 5122589 - DNA, 13 bp, Homo sapiens
aatttaattaaag

SEQ ID NO: 5122590 - DNA, 23 bp, Homo sapiens
aatttaattaatcgaaatgaatt

SEQ ID NO: 5122591 - DNA, 18 bp, Homo sapiens
aatttaattacaaacaat

SEQ ID NO: 5122592 - DNA, 16 bp, Homo sapiens
aatttaattatttgtt

SEQ ID NO: 5122593 - DNA, 15 bp, Homo sapiens
aatttaattcttatt

SEQ ID NO: 5122594 - DNA, 21 bp, Homo sapiens
aatttaatttgtaaaacttct

SEQ ID NO: 5122595 - DNA, 22 bp, Homo sapiens
aatttaatttgtaaaacttctg

SEQ ID NO: 5122596 - DNA, 12 bp, Homo sapiens
aatttaattttt

SEQ ID NO: 5122597 - DNA, 14 bp, Homo sapiens
aatttaatttttcc

SEQ ID NO: 5122598 - DNA, 16 bp, Homo sapiens
aatttacaaaaatata

SEQ ID NO: 5122599 - DNA, 18 bp, Homo sapiens
aatttacaaaaatataaa

SEQ ID NO: 5122600 - DNA, 17 bp, Homo sapiens
aatttacaaacctctca

SEQ ID NO: 5122601 - DNA, 20 bp, Homo sapiens
aatttacaaacctctcagca

SEQ ID NO: 5122602 - DNA, 14 bp, Homo sapiens
aatttacaaagtgt

SEQ ID NO: 5122603 - DNA, 15 bp, Homo sapiens
aatttacaaagtgtg

SEQ ID NO: 5122604 - DNA, 20 bp, Homo sapiens
aatttacaagagctgttcat

SEQ ID NO: 5122605 - DNA, 23 bp, Homo sapiens
aatttacacagtgagactgtaca

SEQ ID NO: 5122606 - DNA, 17 bp, Homo sapiens
aatttacacatcttaaa

SEQ ID NO: 5122607 - DNA, 14 bp, Homo sapiens
aatttacagtgata

SEQ ID NO: 5122608 - DNA, 23 bp, Homo sapiens
aatgtgttggacaaatgtgaaga

SEQ ID NO: 5122609 - DNA, 23 bp, Homo sapiens
aatgtgttgttccaaatactaat

SEQ ID NO: 5122610 - DNA, 13 bp, Homo sapiens
aatgtgtttcaaa

SEQ ID NO: 5122611 - DNA, 23 bp, Homo sapiens
aatgtgtttccttttcaggagat

SEQ ID NO: 5122612 - DNA, 15 bp, Homo sapiens
aatgtgtttctggta

SEQ ID NO: 5122613 - DNA, 14 bp, Homo sapiens
aatgtgttttctgt

SEQ ID NO: 5122614 - DNA, 17 bp, Homo sapiens
aatgtgttttgtctttt

SEQ ID NO: 5122615 - DNA, 17 bp, Homo sapiens
aatgtgtttttctatat

SEQ ID NO: 5122616 - DNA, 21 bp, Homo sapiens
aatgttaaaacataaacacat

SEQ ID NO: 5122617 - DNA, 22 bp, Homo sapiens
aatgttaaaacataaacacatt

SEQ ID NO: 5122618 - DNA, 18 bp, Homo sapiens
aatgttaaaatattgatt

SEQ ID NO: 5122619 - DNA, 19 bp, Homo sapiens
aatgttaaaatattgattt

SEQ ID NO: 5122620 - DNA, 16 bp, Homo sapiens
aatgttaaaatgtgtt

SEQ ID NO: 5122621 - DNA, 15 bp, Homo sapiens
aatgttaaagatgta

SEQ ID NO: 5122622 - DNA, 21 bp, Homo sapiens
aatgttaaagatgtagcaaac

SEQ ID NO: 5122623 - DNA, 13 bp, Homo sapiens
aatgttaaaggga

SEQ ID NO: 5122624 - DNA, 15 bp, Homo sapiens
aatgttaaataaatt

SEQ ID NO: 5122625 - DNA, 13 bp, Homo sapiens
aatgttaacaact

SEQ ID NO: 5122626 - DNA, 14 bp, Homo sapiens
aatgttaacatgcg

SEQ ID NO: 5122627 - DNA, 16 bp, Homo sapiens
aatgttaactttcaaa

SEQ ID NO: 5122628 - DNA, 12 bp, Homo sapiens
aatgttaagaaa

SEQ ID NO: 5122629 - DNA, 13 bp, Homo sapiens
aatgttaagaaat

SEQ ID NO: 5122630 - DNA, 12 bp, Homo sapiens
aatgttaagaat

SEQ ID NO: 5122631 - DNA, 14 bp, Homo sapiens
aatgttaagaattg

SEQ ID NO: 5122632 - DNA, 18 bp, Homo sapiens
aatgttaaggaaactctt

SEQ ID NO: 5122633 - DNA, 22 bp, Homo sapiens
aatgttaaggaaactcttatct

SEQ ID NO: 5122634 - DNA, 21 bp, Homo sapiens
aatgttaaggacttctgcagc

SEQ ID NO: 5122635 - DNA, 22 bp, Homo sapiens
aatgttaataaagcccgcgtct

SEQ ID NO: 5122636 - DNA, 16 bp, Homo sapiens
aatgttaataaaggtt

SEQ ID NO: 5122637 - DNA, 23 bp, Homo sapiens
aatgttaattcagcactgatttc

SEQ ID NO: 5122638 - DNA, 18 bp, Homo sapiens
aatgttaatttattttgc

SEQ ID NO: 5122639 - DNA, 20 bp, Homo sapiens
aatgttaatttattttgctc

SEQ ID NO: 5122640 - DNA, 21 bp, Homo sapiens
aatgttaattttttggtacaa

SEQ ID NO: 5122641 - DNA, 13 bp, Homo sapiens
aatgttacaaaaa

SEQ ID NO: 5122642 - DNA, 15 bp, Homo sapiens
aatgttacagaatct

SEQ ID NO: 5122643 - DNA, 14 bp, Homo sapiens
aatgttacatctgt

SEQ ID NO: 5122644 - DNA, 17 bp, Homo sapiens
aatgttaccagacttca

SEQ ID NO: 5122645 - DNA, 19 bp, Homo sapiens
aatgttacctaattattac

SEQ ID NO: 5122646 - DNA, 16 bp, Homo sapiens
aatgttacctctgaat

SEQ ID NO: 5122647 - DNA, 21 bp, Homo sapiens
aatgttactcagatataagag

SEQ ID NO: 5122648 - DNA, 23 bp, Homo sapiens
aatgttactcagatataagagaa

SEQ ID NO: 5122649 - DNA, 13 bp, Homo sapiens
aatgttactgatc

SEQ ID NO: 5122650 - DNA, 18 bp, Homo sapiens
aatgttactgatcatgca

SEQ ID NO: 5122651 - DNA, 19 bp, Homo sapiens
aatgttactgatcatgcat

SEQ ID NO: 5122652 - DNA, 20 bp, Homo sapiens
aatgttagagtaatgaaatg

SEQ ID NO: 5122653 - DNA, 15 bp, Homo sapiens
aatgttagatagtta

SEQ ID NO: 5122654 - DNA, 13 bp, Homo sapiens
aatgttagatatt

SEQ ID NO: 5122655 - DNA, 18 bp, Homo sapiens
aatgttagatattgctac

SEQ ID NO: 5122656 - DNA, 23 bp, Homo sapiens
aatgttaggggtatttaatgtat

SEQ ID NO: 5122657 - DNA, 16 bp, Homo sapiens
aatgttagtcattgtt

SEQ ID NO: 5122658 - DNA, 13 bp, Homo sapiens
aatgttagttcta

SEQ ID NO: 5122659 - DNA, 17 bp, Homo sapiens
aatgttatatcatcaat

SEQ ID NO: 5122660 - DNA, 15 bp, Homo sapiens
aatgttatcctcttg

SEQ ID NO: 5122661 - DNA, 19 bp, Homo sapiens
aatgttatcttatactgta

SEQ ID NO: 5122662 - DNA, 16 bp, Homo sapiens
aatgttatcttctcaa

SEQ ID NO: 5122663 - DNA, 22 bp, Homo sapiens
aatgttatgttgtgttctaata

SEQ ID NO: 5122664 - DNA, 20 bp, Homo sapiens
aatgttattgtcctcacctt

SEQ ID NO: 5122665 - DNA, 12 bp, Homo sapiens
aatgttatttct

SEQ ID NO: 5122666 - DNA, 15 bp, Homo sapiens
aatgttatttctgca

SEQ ID NO: 5122667 - DNA, 22 bp, Homo sapiens
aatgttatttgttattttcagt

SEQ ID NO: 5122668 - DNA, 16 bp, Homo sapiens
aatgttattttccttc

SEQ ID NO: 5122669 - DNA, 19 bp, Homo sapiens
aatgttattttccttctga

SEQ ID NO: 5122670 - DNA, 21 bp, Homo sapiens
aatgttattttccttctgaag

SEQ ID NO: 5122671 - DNA, 20 bp, Homo sapiens
aatgttattttttaattatt

SEQ ID NO: 5122672 - DNA, 14 bp, Homo sapiens
aatgttcaaattca

SEQ ID NO: 5122673 - DNA, 16 bp, Homo sapiens
aatgttcactgaataa

SEQ ID NO: 5122674 - DNA, 21 bp, Homo sapiens
aatgttcaggagagtaaaaat

SEQ ID NO: 5122675 - DNA, 22 bp, Homo sapiens
aatgttcattgtaatgttactg

SEQ ID NO: 5122676 - DNA, 24 bp, Homo sapiens
aatgttcattgtaatgttactgat

SEQ ID NO: 5122677 - DNA, 20 bp, Homo sapiens
aatgttcattttctctgtat

SEQ ID NO: 5122678 - DNA, 17 bp, Homo sapiens
aatgttcattttgaaaa

SEQ ID NO: 5122679 - DNA, 21 bp, Homo sapiens
aatgttcccaagtaggcattc

SEQ ID NO: 5122680 - DNA, 15 bp, Homo sapiens
aatgttccctgcacc

SEQ ID NO: 5122681 - DNA, 20 bp, Homo sapiens
aatgttccctgcaccctgga

SEQ ID NO: 5122682 - DNA, 17 bp, Homo sapiens
aatgttccgttcatctg

SEQ ID NO: 5122683 - DNA, 18 bp, Homo sapiens
aatgttccgttcatctga

SEQ ID NO: 5122684 - DNA, 20 bp, Homo sapiens
aatgttccttttttgtatat

SEQ ID NO: 5122685 - DNA, 16 bp, Homo sapiens
aatgttcgtattctat

SEQ ID NO: 5122686 - DNA, 16 bp, Homo sapiens
aatgttctaaattcta

SEQ ID NO: 5122687 - DNA, 21 bp, Homo sapiens
aatgttctaagtttctaagat

SEQ ID NO: 5122688 - DNA, 23 bp, Homo sapiens
aatgttctaagtttctaagattc

SEQ ID NO: 5122689 - DNA, 16 bp, Homo sapiens
aatgttctatataatt

SEQ ID NO: 5122690 - DNA, 20 bp, Homo sapiens
aatgttctatggttatgaaa

SEQ ID NO: 5122691 - DNA, 21 bp, Homo sapiens
aatgttctctcttctccacct

SEQ ID NO: 5122692 - DNA, 12 bp, Homo sapiens
aatgttctctgg

SEQ ID NO: 5122693 - DNA, 15 bp, Homo sapiens
aatgttctgaatttc

SEQ ID NO: 5122694 - DNA, 19 bp, Homo sapiens
aatgttctgctaaatttca

SEQ ID NO: 5122695 - DNA, 12 bp, Homo sapiens
aatgttctgtga

SEQ ID NO: 5122696 - DNA, 15 bp, Homo sapiens
aatgttctgttgtaa

SEQ ID NO: 5122697 - DNA, 23 bp, Homo sapiens
aatgttctgttgtaaagagtgga

SEQ ID NO: 5122698 - DNA, 15 bp, Homo sapiens
aatgttcttggtgtt

SEQ ID NO: 5122699 - DNA, 18 bp, Homo sapiens
aatgttcttggttcccat

SEQ ID NO: 5122700 - DNA, 10 bp, Homo sapiens
aatgttcttt

SEQ ID NO: 5122701 - DNA, 15 bp, Homo sapiens
aatgttctttaatgt

SEQ ID NO: 5122702 - DNA, 16 bp, Homo sapiens
aatgttctttatatac

SEQ ID NO: 5122703 - DNA, 17 bp, Homo sapiens
aatgttctttggaaagt

SEQ ID NO: 5122704 - DNA, 12 bp, Homo sapiens
aatgttgaaaag

SEQ ID NO: 5122705 - DNA, 15 bp, Homo sapiens
aatgttgaatgtatt

SEQ ID NO: 5122706 - DNA, 20 bp, Homo sapiens
aatgttgacctttgaggtct

SEQ ID NO: 5122707 - DNA, 21 bp, Homo sapiens
aatgttgacctttgaggtcta

SEQ ID NO: 5122708 - DNA, 22 bp, Homo sapiens
aatgttgatttctagttattta

SEQ ID NO: 5122709 - DNA, 17 bp, Homo sapiens
aatgttgcacatcattc

SEQ ID NO: 5122710 - DNA, 17 bp, Homo sapiens
aatgttgcccacattaa

SEQ ID NO: 5122711 - DNA, 17 bp, Homo sapiens
aatgttgctgaaaaatg

SEQ ID NO: 5122712 - DNA, 23 bp, Homo sapiens
aatgttgctttaacctgaacctt

SEQ ID NO: 5122713 - DNA, 21 bp, Homo sapiens
aatgttggaactctgtgcagg

SEQ ID NO: 5122714 - DNA, 20 bp, Homo sapiens
aatgttggagcagcaggcct

SEQ ID NO: 5122715 - DNA, 16 bp, Homo sapiens
aatgttggataaggaa

SEQ ID NO: 5122716 - DNA, 22 bp, Homo sapiens
aatgttggatttataaatgcta

SEQ ID NO: 5122717 - DNA, 23 bp, Homo sapiens
aatgttggctagtctgtgcctca

SEQ ID NO: 5122718 - DNA, 13 bp, Homo sapiens
aatgttggctgcg

SEQ ID NO: 5122719 - DNA, 13 bp, Homo sapiens
aatgttgggaaag

SEQ ID NO: 5122720 - DNA, 16 bp, Homo sapiens
aatgttgggatttata

SEQ ID NO: 5122721 - DNA, 21 bp, Homo sapiens
aatgttgggatttatatctat

SEQ ID NO: 5122722 - DNA, 23 bp, Homo sapiens
aatgttggtgtgaaacaaattaa

SEQ ID NO: 5122723 - DNA, 15 bp, Homo sapiens
aatgttggtttactt

SEQ ID NO: 5122724 - DNA, 17 bp, Homo sapiens
aatgttgtacttgaaaa

SEQ ID NO: 5122725 - DNA, 14 bp, Homo sapiens
aatgttgtagtgtc

SEQ ID NO: 5122726 - DNA, 16 bp, Homo sapiens
aatgttgtatttgtta

SEQ ID NO: 5122727 - DNA, 18 bp, Homo sapiens
aatgttgtgaataattac

SEQ ID NO: 5122728 - DNA, 17 bp, Homo sapiens
aatgttgtgtgttgcac

SEQ ID NO: 5122729 - DNA, 15 bp, Homo sapiens
aatgttgttaaatgc

SEQ ID NO: 5122730 - DNA, 19 bp, Homo sapiens
aatgttgttgtctatttgt

SEQ ID NO: 5122731 - DNA, 21 bp, Homo sapiens
aatgttgttgtctatttgtct

SEQ ID NO: 5122732 - DNA, 15 bp, Homo sapiens
aatgtttaaacattt

SEQ ID NO: 5122733 - DNA, 15 bp, Homo sapiens
aatgtttaaaccttt

SEQ ID NO: 5122734 - DNA, 14 bp, Homo sapiens
aatgtttaaatata

SEQ ID NO: 5122735 - DNA, 18 bp, Homo sapiens
aatgtttaaatcatgtat

SEQ ID NO: 5122736 - DNA, 15 bp, Homo sapiens
aatgtttaataaagc

SEQ ID NO: 5122737 - DNA, 18 bp, Homo sapiens
aatgtttaataaagcttt

SEQ ID NO: 5122738 - DNA, 21 bp, Homo sapiens
aatgtttaatagaaaattaaa

SEQ ID NO: 5122739 - DNA, 16 bp, Homo sapiens
aatgtttaatcatata

SEQ ID NO: 5122740 - DNA, 20 bp, Homo sapiens
aatgtttaatcatataaata

SEQ ID NO: 5122741 - DNA, 16 bp, Homo sapiens
aatgtttaatggtgaa

SEQ ID NO: 5122742 - DNA, 23 bp, Homo sapiens
aatgtttacactctttgtaagag

SEQ ID NO: 5122743 - DNA, 22 bp, Homo sapiens
aatgtttacagatccccaagcc

SEQ ID NO: 5122744 - DNA, 21 bp, Homo sapiens
aatgtttacagggagcctcct

SEQ ID NO: 5122745 - DNA, 19 bp, Homo sapiens
aatgtttactatagaccaa

SEQ ID NO: 5122746 - DNA, 16 bp, Homo sapiens
aatgtttactgtatca

SEQ ID NO: 5122747 - DNA, 20 bp, Homo sapiens
aatgtttagcagatttaaga

SEQ ID NO: 5122748 - DNA, 14 bp, Homo sapiens
aatgtttataactc

SEQ ID NO: 5122749 - DNA, 14 bp, Homo sapiens
aatgtttatacaga

SEQ ID NO: 5122750 - DNA, 15 bp, Homo sapiens
aatgtttatacagag

SEQ ID NO: 5122751 - DNA, 15 bp, Homo sapiens
aatgtttatgagcca

SEQ ID NO: 5122752 - DNA, 16 bp, Homo sapiens
aatgtttatgagccag

SEQ ID NO: 5122753 - DNA, 17 bp, Homo sapiens
aatgtttatgagccaga

SEQ ID NO: 5122754 - DNA, 21 bp, Homo sapiens
aatgtttatgcaaggaaggaa

SEQ ID NO: 5122755 - DNA, 21 bp, Homo sapiens
aatgtttatgttctcagaatc

SEQ ID NO: 5122756 - DNA, 21 bp, Homo sapiens
aatgtttatttagctctgaag

SEQ ID NO: 5122757 - DNA, 17 bp, Homo sapiens
aatgtttatttttgctc

SEQ ID NO: 5122758 - DNA, 14 bp, Homo sapiens
aatgtttcactatg

SEQ ID NO: 5122759 - DNA, 23 bp, Homo sapiens
aatgtttcactatgattttctat

SEQ ID NO: 5122760 - DNA, 23 bp, Homo sapiens
aatgtttcatgaagaaaaaattt

SEQ ID NO: 5122761 - DNA, 21 bp, Homo sapiens
aatgtttcattttcattaaaa

SEQ ID NO: 5122762 - DNA, 12 bp, Homo sapiens
aatgtttccccc

SEQ ID NO: 5122763 - DNA, 17 bp, Homo sapiens
aatgtttcccccactcc

SEQ ID NO: 5122764 - DNA, 15 bp, Homo sapiens
aatgtttcctccaaa

SEQ ID NO: 5122765 - DNA, 12 bp, Homo sapiens
aatgtttctaag

SEQ ID NO: 5122766 - DNA, 18 bp, Homo sapiens
aatgtttctgatttctga

SEQ ID NO: 5122767 - DNA, 16 bp, Homo sapiens
aatgtttctggacatt

SEQ ID NO: 5122768 - DNA, 20 bp, Homo sapiens
aatgtttcttcatttctctg

SEQ ID NO: 5122769 - DNA, 21 bp, Homo sapiens
aatgtttcttcatttctctgc

SEQ ID NO: 5122770 - DNA, 22 bp, Homo sapiens
aatgtttcttctaggttctaaa

SEQ ID NO: 5122771 - DNA, 14 bp, Homo sapiens
aatgtttctttttc

SEQ ID NO: 5122772 - DNA, 20 bp, Homo sapiens
aatgtttgaggagcatgttt

SEQ ID NO: 5122773 - DNA, 22 bp, Homo sapiens
aatgtttgaggagcatgttttg

SEQ ID NO: 5122774 - DNA, 23 bp, Homo sapiens
aatgtttgaggagcatgttttgt

SEQ ID NO: 5122775 - DNA, 13 bp, Homo sapiens
aatgtttgatgtc

SEQ ID NO: 5122776 - DNA, 13 bp, Homo sapiens
aatgtttgattta

SEQ ID NO: 5122777 - DNA, 23 bp, Homo sapiens
aatgtttgccctgttcaaagtac

SEQ ID NO: 5122778 - DNA, 22 bp, Homo sapiens
aatgtttgctttacgtattttg

SEQ ID NO: 5122779 - DNA, 13 bp, Homo sapiens
aatgtttggaaag

SEQ ID NO: 5122780 - DNA, 21 bp, Homo sapiens
aatgtttggcatgtaaatgta

SEQ ID NO: 5122781 - DNA, 20 bp, Homo sapiens
aatgtttgggatattaaaac

SEQ ID NO: 5122782 - DNA, 21 bp, Homo sapiens
aatgtttgggatattaaaaca

SEQ ID NO: 5122783 - DNA, 23 bp, Homo sapiens
aatgtttgggggaaaaaaaagaa

SEQ ID NO: 5122784 - DNA, 22 bp, Homo sapiens
aatgtttgtactttttaatgtt

SEQ ID NO: 5122785 - DNA, 20 bp, Homo sapiens
aatttacagtgatagaacaa

SEQ ID NO: 5122786 - DNA, 15 bp, Homo sapiens
aatttacatactctg

SEQ ID NO: 5122787 - DNA, 19 bp, Homo sapiens
aatttacatactctgctta

SEQ ID NO: 5122788 - DNA, 22 bp, Homo sapiens
aatttacatcagaagtttgcat

SEQ ID NO: 5122789 - DNA, 16 bp, Homo sapiens
aatttacatcatttct

SEQ ID NO: 5122790 - DNA, 22 bp, Homo sapiens
aatttacatttaatacagataa

SEQ ID NO: 5122791 - DNA, 18 bp, Homo sapiens
aatttaccacaaaagcaa

SEQ ID NO: 5122792 - DNA, 18 bp, Homo sapiens
aatttaccacaggatgca

SEQ ID NO: 5122793 - DNA, 15 bp, Homo sapiens
aatttaccagaaata

SEQ ID NO: 5122794 - DNA, 17 bp, Homo sapiens
aatttaccagaaatatt

SEQ ID NO: 5122795 - DNA, 21 bp, Homo sapiens
aatttaccattattttacagt

SEQ ID NO: 5122796 - DNA, 22 bp, Homo sapiens
aatttaccctcttgaatataat

SEQ ID NO: 5122797 - DNA, 18 bp, Homo sapiens
aatttacctaagattaca

SEQ ID NO: 5122798 - DNA, 21 bp, Homo sapiens
aatttacctaagattacaaat

SEQ ID NO: 5122799 - DNA, 22 bp, Homo sapiens
aatttacctctcattagaaagg

SEQ ID NO: 5122800 - DNA, 16 bp, Homo sapiens
aatttacctgatttct

SEQ ID NO: 5122801 - DNA, 20 bp, Homo sapiens
aatttacctttaaaataata

SEQ ID NO: 5122802 - DNA, 20 bp, Homo sapiens
aatttacctttttttagtta

SEQ ID NO: 5122803 - DNA, 23 bp, Homo sapiens
aatttacgtatatttcattgaat

SEQ ID NO: 5122804 - DNA, 23 bp, Homo sapiens
aatttacgtcttgagaaatacta

SEQ ID NO: 5122805 - DNA, 22 bp, Homo sapiens
aatttactacaatatgtacatt

SEQ ID NO: 5122806 - DNA, 13 bp, Homo sapiens
aatttactatata

SEQ ID NO: 5122807 - DNA, 15 bp, Homo sapiens
aatttactatgtaaa

SEQ ID NO: 5122808 - DNA, 19 bp, Homo sapiens
aatttactatgtaaatgct

SEQ ID NO: 5122809 - DNA, 20 bp, Homo sapiens
aatttactatgtaaatgctt

SEQ ID NO: 5122810 - DNA, 19 bp, Homo sapiens
aatttactgatgagagaat

SEQ ID NO: 5122811 - DNA, 21 bp, Homo sapiens
aatttactgtcttaaatcagt

SEQ ID NO: 5122812 - DNA, 16 bp, Homo sapiens
aatttacttaagtgtt

SEQ ID NO: 5122813 - DNA, 19 bp, Homo sapiens
aatttacttaagtgttcat

SEQ ID NO: 5122814 - DNA, 15 bp, Homo sapiens
aatttactttacaca

SEQ ID NO: 5122815 - DNA, 17 bp, Homo sapiens
aatttactttctgcacc

SEQ ID NO: 5122816 - DNA, 17 bp, Homo sapiens
aatttactttgtagact

SEQ ID NO: 5122817 - DNA, 18 bp, Homo sapiens
aatttactttgtagactg

SEQ ID NO: 5122818 - DNA, 18 bp, Homo sapiens
aatttacttttaataaag

SEQ ID NO: 5122819 - DNA, 13 bp, Homo sapiens
aatttacttttta

SEQ ID NO: 5122820 - DNA, 15 bp, Homo sapiens
aatttagaaaaagaa

SEQ ID NO: 5122821 - DNA, 16 bp, Homo sapiens
aatttagaaaaagaac

SEQ ID NO: 5122822 - DNA, 18 bp, Homo sapiens
aatttagaaactgaaaaa

SEQ ID NO: 5122823 - DNA, 18 bp, Homo sapiens
aatttagaaactgatttc

SEQ ID NO: 5122824 - DNA, 20 bp, Homo sapiens
aatttagaaactgatttctt

SEQ ID NO: 5122825 - DNA, 13 bp, Homo sapiens
aatttagaaataa

SEQ ID NO: 5122826 - DNA, 22 bp, Homo sapiens
aatttagaaataaaagatgata

SEQ ID NO: 5122827 - DNA, 12 bp, Homo sapiens
aatttagaagaa

SEQ ID NO: 5122828 - DNA, 19 bp, Homo sapiens
aatttagacaaagccttaa

SEQ ID NO: 5122829 - DNA, 17 bp, Homo sapiens
aatttagacttcaagca

SEQ ID NO: 5122830 - DNA, 17 bp, Homo sapiens
aatttagaggataaata

SEQ ID NO: 5122831 - DNA, 20 bp, Homo sapiens
aatttagaggataaataata

SEQ ID NO: 5122832 - DNA, 17 bp, Homo sapiens
aatttagatattttcca

SEQ ID NO: 5122833 - DNA, 23 bp, Homo sapiens
aatttagatattttccatatatt

SEQ ID NO: 5122834 - DNA, 15 bp, Homo sapiens
aatttagattgtaaa

SEQ ID NO: 5122835 - DNA, 17 bp, Homo sapiens
aatttagatttaattta

SEQ ID NO: 5122836 - DNA, 22 bp, Homo sapiens
aatttagcaaactgatgctgag

SEQ ID NO: 5122837 - DNA, 17 bp, Homo sapiens
aatttagcagtccattt

SEQ ID NO: 5122838 - DNA, 18 bp, Homo sapiens
aatttagcagtccatttt

SEQ ID NO: 5122839 - DNA, 19 bp, Homo sapiens
aatttagccaataaagaaa

SEQ ID NO: 5122840 - DNA, 18 bp, Homo sapiens
aatttagccctttaaaac

SEQ ID NO: 5122841 - DNA, 16 bp, Homo sapiens
aatttaggaatgctca

SEQ ID NO: 5122842 - DNA, 18 bp, Homo sapiens
aatttagggtactaaatt

SEQ ID NO: 5122843 - DNA, 21 bp, Homo sapiens
aatttagggtactaaatttaa

SEQ ID NO: 5122844 - DNA, 17 bp, Homo sapiens
aatttagggtgttaaac

SEQ ID NO: 5122845 - DNA, 20 bp, Homo sapiens
aatttaggtaaataaagctc

SEQ ID NO: 5122846 - DNA, 18 bp, Homo sapiens
aatttaggtttttattag

SEQ ID NO: 5122847 - DNA, 20 bp, Homo sapiens
aatttaggtttttattagta

SEQ ID NO: 5122848 - DNA, 15 bp, Homo sapiens
aatttagtaaaccaa

SEQ ID NO: 5122849 - DNA, 18 bp, Homo sapiens
aatttagtaaataaacaa

SEQ ID NO: 5122850 - DNA, 15 bp, Homo sapiens
aatttagtaaatgtt

SEQ ID NO: 5122851 - DNA, 18 bp, Homo sapiens
aatttagtacactatgtt

SEQ ID NO: 5122852 - DNA, 21 bp, Homo sapiens
aatttagtctaacacagttga

SEQ ID NO: 5122853 - DNA, 21 bp, Homo sapiens
aatttagtgatcttagcatag

SEQ ID NO: 5122854 - DNA, 15 bp, Homo sapiens
aatttagtggattaa

SEQ ID NO: 5122855 - DNA, 14 bp, Homo sapiens
aatttagtgtatat

SEQ ID NO: 5122856 - DNA, 19 bp, Homo sapiens
aatttagtgtatatgtgat

SEQ ID NO: 5122857 - DNA, 16 bp, Homo sapiens
aatttagttaataaaa

SEQ ID NO: 5122858 - DNA, 15 bp, Homo sapiens
aatttagttattgat

SEQ ID NO: 5122859 - DNA, 22 bp, Homo sapiens
aatttagttgagcatagagaac

SEQ ID NO: 5122860 - DNA, 12 bp, Homo sapiens
aatttagtttca

SEQ ID NO: 5122861 - DNA, 21 bp, Homo sapiens
aatttagtttcatataaagta

SEQ ID NO: 5122862 - DNA, 14 bp, Homo sapiens
aatttagtttgtta

SEQ ID NO: 5122863 - DNA, 18 bp, Homo sapiens
aatttagtttgttaaagc

SEQ ID NO: 5122864 - DNA, 16 bp, Homo sapiens
aatttataaaaaggtg

SEQ ID NO: 5122865 - DNA, 14 bp, Homo sapiens
aatttataaaatta

SEQ ID NO: 5122866 - DNA, 16 bp, Homo sapiens
aatttataaagaaaaa

SEQ ID NO: 5122867 - DNA, 19 bp, Homo sapiens
aatttataaagaaaaatag

SEQ ID NO: 5122868 - DNA, 17 bp, Homo sapiens
aatttataacagttata

SEQ ID NO: 5122869 - DNA, 23 bp, Homo sapiens
aatttataacgtgttcaatattt

SEQ ID NO: 5122870 - DNA, 19 bp, Homo sapiens
aatttataacgttctcagt

SEQ ID NO: 5122871 - DNA, 22 bp, Homo sapiens
aatttataagcattgccattga

SEQ ID NO: 5122872 - DNA, 13 bp, Homo sapiens
aatttataatgta

SEQ ID NO: 5122873 - DNA, 19 bp, Homo sapiens
aatttataatgtatttgaa

SEQ ID NO: 5122874 - DNA, 12 bp, Homo sapiens
aatttataattc

SEQ ID NO: 5122875 - DNA, 13 bp, Homo sapiens
aatttatacaaaa

SEQ ID NO: 5122876 - DNA, 15 bp, Homo sapiens
aatttatacaaaata

SEQ ID NO: 5122877 - DNA, 17 bp, Homo sapiens
aatttatacaaaataat

SEQ ID NO: 5122878 - DNA, 22 bp, Homo sapiens
aatttatacaaaataatttaac

SEQ ID NO: 5122879 - DNA, 16 bp, Homo sapiens
aatttatacaaagaaa

SEQ ID NO: 5122880 - DNA, 15 bp, Homo sapiens
aatttatacaatatc

SEQ ID NO: 5122881 - DNA, 16 bp, Homo sapiens
aatttatacaggtcat

SEQ ID NO: 5122882 - DNA, 17 bp, Homo sapiens
aatttatacaggtcata

SEQ ID NO: 5122883 - DNA, 18 bp, Homo sapiens
aatttatacctcaatttt

SEQ ID NO: 5122884 - DNA, 19 bp, Homo sapiens
aatttatacttaaaaaatc

SEQ ID NO: 5122885 - DNA, 21 bp, Homo sapiens
aatttataggcagatctttaa

SEQ ID NO: 5122886 - DNA, 18 bp, Homo sapiens
aatttatagtaatgagtt

SEQ ID NO: 5122887 - DNA, 15 bp, Homo sapiens
aatttatagtttata

SEQ ID NO: 5122888 - DNA, 11 bp, Homo sapiens
aatttatataa

SEQ ID NO: 5122889 - DNA, 14 bp, Homo sapiens
aatttatataaagt

SEQ ID NO: 5122890 - DNA, 16 bp, Homo sapiens
aatttatataactgtt

SEQ ID NO: 5122891 - DNA, 23 bp, Homo sapiens
aatttatatcaggtgtataaatg

SEQ ID NO: 5122892 - DNA, 20 bp, Homo sapiens
aatttatatctaatatgaag

SEQ ID NO: 5122893 - DNA, 18 bp, Homo sapiens
aatttatatctttatgca

SEQ ID NO: 5122894 - DNA, 20 bp, Homo sapiens
aatttatatctttatgcaaa

SEQ ID NO: 5122895 - DNA, 22 bp, Homo sapiens
aatttatatctttatgcaaaaa

SEQ ID NO: 5122896 - DNA, 14 bp, Homo sapiens
aatttatatgaaaa

SEQ ID NO: 5122897 - DNA, 16 bp, Homo sapiens
aatttatatgcatgca

SEQ ID NO: 5122898 - DNA, 15 bp, Homo sapiens
aatttatatgcttca

SEQ ID NO: 5122899 - DNA, 22 bp, Homo sapiens
aatttatatgcttcacatagca

SEQ ID NO: 5122900 - DNA, 16 bp, Homo sapiens
aatttatattatccat

SEQ ID NO: 5122901 - DNA, 16 bp, Homo sapiens
aatttatattgtaaat

SEQ ID NO: 5122902 - DNA, 22 bp, Homo sapiens
aatttatcaactgtcaaatatg

SEQ ID NO: 5122903 - DNA, 17 bp, Homo sapiens
aatttatcacacttctg

SEQ ID NO: 5122904 - DNA, 17 bp, Homo sapiens
aatttatcagattgctt

SEQ ID NO: 5122905 - DNA, 12 bp, Homo sapiens
aatttatcattt

SEQ ID NO: 5122906 - DNA, 14 bp, Homo sapiens
aatttatcatttta

SEQ ID NO: 5122907 - DNA, 23 bp, Homo sapiens
aatttatccctttacaatgtgaa

SEQ ID NO: 5122908 - DNA, 19 bp, Homo sapiens
aatttatcctgaaatttca

SEQ ID NO: 5122909 - DNA, 21 bp, Homo sapiens
aatttatctaaattaaagcct

SEQ ID NO: 5122910 - DNA, 21 bp, Homo sapiens
aatttatcttaagttctatga

SEQ ID NO: 5122911 - DNA, 22 bp, Homo sapiens
aatttatcttccatatgctctt

SEQ ID NO: 5122912 - DNA, 19 bp, Homo sapiens
aatttatcttgtctctggg

SEQ ID NO: 5122913 - DNA, 19 bp, Homo sapiens
aatttatgaagcagattta

SEQ ID NO: 5122914 - DNA, 20 bp, Homo sapiens
aatttatgaagcagatttat

SEQ ID NO: 5122915 - DNA, 13 bp, Homo sapiens
aatttatgactag

SEQ ID NO: 5122916 - DNA, 22 bp, Homo sapiens
aatttatgcacttataaggtgt

SEQ ID NO: 5122917 - DNA, 13 bp, Homo sapiens
aatttatgcattt

SEQ ID NO: 5122918 - DNA, 14 bp, Homo sapiens
aatttatgcatttc

SEQ ID NO: 5122919 - DNA, 19 bp, Homo sapiens
aatttatgcatttcattca

SEQ ID NO: 5122920 - DNA, 20 bp, Homo sapiens
aatttatgcatttcattcaa

SEQ ID NO: 5122921 - DNA, 21 bp, Homo sapiens
aatttatgcatttcattcaaa

SEQ ID NO: 5122922 - DNA, 22 bp, Homo sapiens
aatttatgcatttcattcaaat

SEQ ID NO: 5122923 - DNA, 15 bp, Homo sapiens
aatttattaaaatga

SEQ ID NO: 5122924 - DNA, 22 bp, Homo sapiens
aatttattacaaatcagaactt

SEQ ID NO: 5122925 - DNA, 19 bp, Homo sapiens
aatttattacttgttgcaa

SEQ ID NO: 5122926 - DNA, 21 bp, Homo sapiens
aatttattagtttaaaatgca

SEQ ID NO: 5122927 - DNA, 21 bp, Homo sapiens
aatttattatatatttacaga

SEQ ID NO: 5122928 - DNA, 13 bp, Homo sapiens
aatttattatggc

SEQ ID NO: 5122929 - DNA, 13 bp, Homo sapiens
aatttattatgtg

SEQ ID NO: 5122930 - DNA, 21 bp, Homo sapiens
aatttattcaattcctctggg

SEQ ID NO: 5122931 - DNA, 19 bp, Homo sapiens
aatttattctacttttaaa

SEQ ID NO: 5122932 - DNA, 23 bp, Homo sapiens
aatttattctcaggtaatcattt

SEQ ID NO: 5122933 - DNA, 13 bp, Homo sapiens
aatttattctgat

SEQ ID NO: 5122934 - DNA, 14 bp, Homo sapiens
aatttattctgata

SEQ ID NO: 5122935 - DNA, 18 bp, Homo sapiens
aatttattgcacattgtt

SEQ ID NO: 5122936 - DNA, 20 bp, Homo sapiens
aatttattgcacattgttca

SEQ ID NO: 5122937 - DNA, 21 bp, Homo sapiens
aatttattggcagccaaggaa

SEQ ID NO: 5122938 - DNA, 21 bp, Homo sapiens
aatttattggcttttctgatc

SEQ ID NO: 5122939 - DNA, 17 bp, Homo sapiens
aatttatttagttttta

SEQ ID NO: 5122940 - DNA, 17 bp, Homo sapiens
aatttatttattaagat

SEQ ID NO: 5122941 - DNA, 19 bp, Homo sapiens
aatttatttcaataaatct

SEQ ID NO: 5122942 - DNA, 20 bp, Homo sapiens
aatttatttcaataaatctt

SEQ ID NO: 5122943 - DNA, 17 bp, Homo sapiens
aatttatttcatccagt

SEQ ID NO: 5122944 - DNA, 20 bp, Homo sapiens
aatttatttccactaaaaat

SEQ ID NO: 5122945 - DNA, 14 bp, Homo sapiens
aatttatttcccca

SEQ ID NO: 5122946 - DNA, 19 bp, Homo sapiens
aatttatttcctagttctg

SEQ ID NO: 5122947 - DNA, 22 bp, Homo sapiens
aatttatttcctagttctgtag

SEQ ID NO: 5122948 - DNA, 17 bp, Homo sapiens
aatttatttcttaacct

SEQ ID NO: 5122949 - DNA, 18 bp, Homo sapiens
aatttatttcttaacctt

SEQ ID NO: 5122950 - DNA, 12 bp, Homo sapiens
aatttatttgtt

SEQ ID NO: 5122951 - DNA, 22 bp, Homo sapiens
aatttattttataagaaaaact

SEQ ID NO: 5122952 - DNA, 16 bp, Homo sapiens
aatttattttgctccc

SEQ ID NO: 5122953 - DNA, 18 bp, Homo sapiens
aatttattttgctcttgt

SEQ ID NO: 5122954 - DNA, 23 bp, Homo sapiens
aatttattttgtgaacacttttg

SEQ ID NO: 5122955 - DNA, 15 bp, Homo sapiens
aatttatttttgcat

SEQ ID NO: 5122956 - DNA, 20 bp, Homo sapiens
aatttatttttgcatggcac

SEQ ID NO: 5122957 - DNA, 17 bp, Homo sapiens
aatttcaaaagaacatt

SEQ ID NO: 5122958 - DNA, 15 bp, Homo sapiens
aatttcaaaatgcat

SEQ ID NO: 5122959 - DNA, 19 bp, Homo sapiens
aatttcaaaatgcatgtga

SEQ ID NO: 5122960 - DNA, 15 bp, Homo sapiens
aatttcaaacatttg

SEQ ID NO: 5122961 - DNA, 14 bp, Homo sapiens
aatgtttgtatttt

SEQ ID NO: 5122962 - DNA, 18 bp, Homo sapiens
aatgtttgtcagtaaata

SEQ ID NO: 5122963 - DNA, 21 bp, Homo sapiens
aatgtttgtcagtaaatactc

SEQ ID NO: 5122964 - DNA, 20 bp, Homo sapiens
aatgtttgtctcagttggaa

SEQ ID NO: 5122965 - DNA, 21 bp, Homo sapiens
aatgtttgtgatattaaattt

SEQ ID NO: 5122966 - DNA, 18 bp, Homo sapiens
aatgtttgttaaaaataa

SEQ ID NO: 5122967 - DNA, 15 bp, Homo sapiens
aatgtttgttattta

SEQ ID NO: 5122968 - DNA, 14 bp, Homo sapiens
aatgttttaaactc

SEQ ID NO: 5122969 - DNA, 14 bp, Homo sapiens
aatgttttaaattc

SEQ ID NO: 5122970 - DNA, 17 bp, Homo sapiens
aatgttttacattccat

SEQ ID NO: 5122971 - DNA, 17 bp, Homo sapiens
aatgttttatactgttt

SEQ ID NO: 5122972 - DNA, 12 bp, Homo sapiens
aatgttttatga

SEQ ID NO: 5122973 - DNA, 19 bp, Homo sapiens
aatgttttatgacattttt

SEQ ID NO: 5122974 - DNA, 19 bp, Homo sapiens
aatgttttatttatcaaaa

SEQ ID NO: 5122975 - DNA, 14 bp, Homo sapiens
aatgttttcagcta

SEQ ID NO: 5122976 - DNA, 20 bp, Homo sapiens
aatgttttcattatgttcat

SEQ ID NO: 5122977 - DNA, 13 bp, Homo sapiens
aatgttttcattt

SEQ ID NO: 5122978 - DNA, 18 bp, Homo sapiens
aatgttttcttttctgtg

SEQ ID NO: 5122979 - DNA, 12 bp, Homo sapiens
aatgttttgctt

SEQ ID NO: 5122980 - DNA, 18 bp, Homo sapiens
aatgttttgggaaacact

SEQ ID NO: 5122981 - DNA, 12 bp, Homo sapiens
aatgttttgtaa

SEQ ID NO: 5122982 - DNA, 14 bp, Homo sapiens
aatgttttgtaaac

SEQ ID NO: 5122983 - DNA, 16 bp, Homo sapiens
aatgttttgtaaacat

SEQ ID NO: 5122984 - DNA, 18 bp, Homo sapiens
aatgttttgtaaacattt

SEQ ID NO: 5122985 - DNA, 19 bp, Homo sapiens
aatgttttgtaaacattta

SEQ ID NO: 5122986 - DNA, 14 bp, Homo sapiens
aatgttttgtacaa

SEQ ID NO: 5122987 - DNA, 17 bp, Homo sapiens
aatgttttgtacaatta

SEQ ID NO: 5122988 - DNA, 21 bp, Homo sapiens
aatgtttttagaacatgtaaa

SEQ ID NO: 5122989 - DNA, 17 bp, Homo sapiens
aatgtttttatttttgt

SEQ ID NO: 5122990 - DNA, 21 bp, Homo sapiens
aatgtttttcatccattccta

SEQ ID NO: 5122991 - DNA, 20 bp, Homo sapiens
aatgtttttccctccccaga

SEQ ID NO: 5122992 - DNA, 15 bp, Homo sapiens
aatgtttttctcaaa

SEQ ID NO: 5122993 - DNA, 19 bp, Homo sapiens
aatgttttttggaaattca

SEQ ID NO: 5122994 - DNA, 20 bp, Homo sapiens
aattaaaaaaaaaaaacttt

SEQ ID NO: 5122995 - DNA, 21 bp, Homo sapiens
aattaaaaaaaaagatctgtt

SEQ ID NO: 5122996 - DNA, 18 bp, Homo sapiens
aattaaaaaaaagaagag

SEQ ID NO: 5122997 - DNA, 14 bp, Homo sapiens
aattaaaaaagaaa

SEQ ID NO: 5122998 - DNA, 13 bp, Homo sapiens
aattaaaaaagat

SEQ ID NO: 5122999 - DNA, 18 bp, Homo sapiens
aattaaaaaagataaaca

SEQ ID NO: 5123000 - DNA, 20 bp, Homo sapiens
aattaaaaaagataaacaca

SEQ ID NO: 5123001 - DNA, 24 bp, Homo sapiens
aattaaaaaagataaacacaagat

SEQ ID NO: 5123002 - DNA, 11 bp, Homo sapiens
aattaaaaaat

SEQ ID NO: 5123003 - DNA, 13 bp, Homo sapiens
aattaaaaaatca

SEQ ID NO: 5123004 - DNA, 15 bp, Homo sapiens
aattaaaaaatcaaa

SEQ ID NO: 5123005 - DNA, 21 bp, Homo sapiens
aattaaaaacacctaagtgac

SEQ ID NO: 5123006 - DNA, 21 bp, Homo sapiens
aattaaaaaccactgaacatt

SEQ ID NO: 5123007 - DNA, 20 bp, Homo sapiens
aattaaaaacgaaaacctga

SEQ ID NO: 5123008 - DNA, 12 bp, Homo sapiens
aattaaaaactt

SEQ ID NO: 5123009 - DNA, 15 bp, Homo sapiens
aattaaaaactttaa

SEQ ID NO: 5123010 - DNA, 14 bp, Homo sapiens
aattaaaaactttc

SEQ ID NO: 5123011 - DNA, 15 bp, Homo sapiens
aattaaaaactttca

SEQ ID NO: 5123012 - DNA, 23 bp, Homo sapiens
aattaaaaagacacttttaccga

SEQ ID NO: 5123013 - DNA, 15 bp, Homo sapiens
aattaaaaagattct

SEQ ID NO: 5123014 - DNA, 19 bp, Homo sapiens
aattaaaaagattcttttt

SEQ ID NO: 5123015 - DNA, 23 bp, Homo sapiens
aattaaaaagattctttttctga

SEQ ID NO: 5123016 - DNA, 20 bp, Homo sapiens
aattaaaaagttgggaaaat

SEQ ID NO: 5123017 - DNA, 15 bp, Homo sapiens
aattaaaacaaaaca

SEQ ID NO: 5123018 - DNA, 16 bp, Homo sapiens
aattaaaacaaatata

SEQ ID NO: 5123019 - DNA, 19 bp, Homo sapiens
aattaaaacaaatatacat

SEQ ID NO: 5123020 - DNA, 12 bp, Homo sapiens
aattaaaacaat

SEQ ID NO: 5123021 - DNA, 14 bp, Homo sapiens
aattaaaacaatgt

SEQ ID NO: 5123022 - DNA, 18 bp, Homo sapiens
aattaaaacacaacatct

SEQ ID NO: 5123023 - DNA, 19 bp, Homo sapiens
aattaaaacatatttcatt

SEQ ID NO: 5123024 - DNA, 14 bp, Homo sapiens
aattaaaacgaaaa

SEQ ID NO: 5123025 - DNA, 14 bp, Homo sapiens
aattaaaactcatt

SEQ ID NO: 5123026 - DNA, 14 bp, Homo sapiens
aattaaaacttctt

SEQ ID NO: 5123027 - DNA, 17 bp, Homo sapiens
aattaaaactttgtaga

SEQ ID NO: 5123028 - DNA, 18 bp, Homo sapiens
aattaaaagttgaatttt

SEQ ID NO: 5123029 - DNA, 12 bp, Homo sapiens
aattaaaatagg

SEQ ID NO: 5123030 - DNA, 20 bp, Homo sapiens
aattaaaatattatttgata

SEQ ID NO: 5123031 - DNA, 13 bp, Homo sapiens
aattaaaatctgg

SEQ ID NO: 5123032 - DNA, 15 bp, Homo sapiens
aattaaaatctggaa

SEQ ID NO: 5123033 - DNA, 20 bp, Homo sapiens
aattaaaatgcccatttgtg

SEQ ID NO: 5123034 - DNA, 15 bp, Homo sapiens
aattaaaatttaaca

SEQ ID NO: 5123035 - DNA, 15 bp, Homo sapiens
aattaaaatttatct

SEQ ID NO: 5123036 - DNA, 17 bp, Homo sapiens
aattaaaatttatctta

SEQ ID NO: 5123037 - DNA, 23 bp, Homo sapiens
aattaaaatttatcttaagttct

SEQ ID NO: 5123038 - DNA, 18 bp, Homo sapiens
aattaaaattttatgaca

SEQ ID NO: 5123039 - DNA, 19 bp, Homo sapiens
aattaaacaaattccttcc

SEQ ID NO: 5123040 - DNA, 20 bp, Homo sapiens
aattaaacaaattccttccc

SEQ ID NO: 5123041 - DNA, 19 bp, Homo sapiens
aattaaacaatttatttta

SEQ ID NO: 5123042 - DNA, 16 bp, Homo sapiens
aattaaacagctggtc

SEQ ID NO: 5123043 - DNA, 18 bp, Homo sapiens
aattaaacagctggtcct

SEQ ID NO: 5123044 - DNA, 16 bp, Homo sapiens
aattaaactagtttaa

SEQ ID NO: 5123045 - DNA, 12 bp, Homo sapiens
aattaaactgaa

SEQ ID NO: 5123046 - DNA, 12 bp, Homo sapiens
aattaaactgat

SEQ ID NO: 5123047 - DNA, 15 bp, Homo sapiens
aattaaactgatggg

SEQ ID NO: 5123048 - DNA, 12 bp, Homo sapiens
aattaaacttag

SEQ ID NO: 5123049 - DNA, 16 bp, Homo sapiens
aattaaacttccaaag

SEQ ID NO: 5123050 - DNA, 19 bp, Homo sapiens
aattaaacttttaattcat

SEQ ID NO: 5123051 - DNA, 18 bp, Homo sapiens
aattaaagaaaattgcca

SEQ ID NO: 5123052 - DNA, 19 bp, Homo sapiens
aattaaagaaaattgccaa

SEQ ID NO: 5123053 - DNA, 13 bp, Homo sapiens
aattaaagaaata

SEQ ID NO: 5123054 - DNA, 16 bp, Homo sapiens
aattaaagacatttaa

SEQ ID NO: 5123055 - DNA, 16 bp, Homo sapiens
aattaaagatgccata

SEQ ID NO: 5123056 - DNA, 18 bp, Homo sapiens
aattaaagatgccatagc

SEQ ID NO: 5123057 - DNA, 24 bp, Homo sapiens
aattaaagatgccatagcataata

SEQ ID NO: 5123058 - DNA, 17 bp, Homo sapiens
aattaaagccttaagca

SEQ ID NO: 5123059 - DNA, 18 bp, Homo sapiens
aattaaagccttaagcac

SEQ ID NO: 5123060 - DNA, 14 bp, Homo sapiens
aattaaagcctttg

SEQ ID NO: 5123061 - DNA, 12 bp, Homo sapiens
aattaaagtatg

SEQ ID NO: 5123062 - DNA, 14 bp, Homo sapiens
aattaaagtatgca

SEQ ID NO: 5123063 - DNA, 12 bp, Homo sapiens
aattaaagtcta

SEQ ID NO: 5123064 - DNA, 15 bp, Homo sapiens
aattaaagtctacac

SEQ ID NO: 5123065 - DNA, 17 bp, Homo sapiens
aattaaagtgctgttta

SEQ ID NO: 5123066 - DNA, 18 bp, Homo sapiens
aattaaagtgtccattga

SEQ ID NO: 5123067 - DNA, 14 bp, Homo sapiens
aattaaataaactg

SEQ ID NO: 5123068 - DNA, 20 bp, Homo sapiens
aattaaataaataaataaga

SEQ ID NO: 5123069 - DNA, 14 bp, Homo sapiens
aattaaataaatga

SEQ ID NO: 5123070 - DNA, 15 bp, Homo sapiens
aattaaataaattac

SEQ ID NO: 5123071 - DNA, 15 bp, Homo sapiens
aattaaataaatttt

SEQ ID NO: 5123072 - DNA, 14 bp, Homo sapiens
aattaaataatttt

SEQ ID NO: 5123073 - DNA, 17 bp, Homo sapiens
aattaaataattttaca

SEQ ID NO: 5123074 - DNA, 11 bp, Homo sapiens
aattaaatagt

SEQ ID NO: 5123075 - DNA, 15 bp, Homo sapiens
aattaaatagtgtga

SEQ ID NO: 5123076 - DNA, 19 bp, Homo sapiens
aattaaatatatgtatgta

SEQ ID NO: 5123077 - DNA, 14 bp, Homo sapiens
aattaaatatttat

SEQ ID NO: 5123078 - DNA, 15 bp, Homo sapiens
aattaaatatttatt

SEQ ID NO: 5123079 - DNA, 18 bp, Homo sapiens
aattaaatccaactttca

SEQ ID NO: 5123080 - DNA, 17 bp, Homo sapiens
aattaaatgaaatactt

SEQ ID NO: 5123081 - DNA, 14 bp, Homo sapiens
aattaaatgatatt

SEQ ID NO: 5123082 - DNA, 20 bp, Homo sapiens
aattaaatgccactttttca

SEQ ID NO: 5123083 - DNA, 12 bp, Homo sapiens
aattaaatgtat

SEQ ID NO: 5123084 - DNA, 14 bp, Homo sapiens
aattaaattaggaa

SEQ ID NO: 5123085 - DNA, 21 bp, Homo sapiens
aattaaattgggcttcaatca

SEQ ID NO: 5123086 - DNA, 14 bp, Homo sapiens
aattaaatttgatg

SEQ ID NO: 5123087 - DNA, 14 bp, Homo sapiens
aattaaattttaat

SEQ ID NO: 5123088 - DNA, 13 bp, Homo sapiens
aattaaattttag

SEQ ID NO: 5123089 - DNA, 19 bp, Homo sapiens
aattaaatttttaaaatct

SEQ ID NO: 5123090 - DNA, 20 bp, Homo sapiens
aattaaatttttaaaatctg

SEQ ID NO: 5123091 - DNA, 12 bp, Homo sapiens
aattaacaaatt

SEQ ID NO: 5123092 - DNA, 12 bp, Homo sapiens
aattaacaagaa

SEQ ID NO: 5123093 - DNA, 14 bp, Homo sapiens
aattaacacagtgt

SEQ ID NO: 5123094 - DNA, 12 bp, Homo sapiens
aattaacactgc

SEQ ID NO: 5123095 - DNA, 16 bp, Homo sapiens
aattaacatataatat

SEQ ID NO: 5123096 - DNA, 18 bp, Homo sapiens
aattaacatataatatat

SEQ ID NO: 5123097 - DNA, 13 bp, Homo sapiens
aattaacatatat

SEQ ID NO: 5123098 - DNA, 15 bp, Homo sapiens
aattaacatatgtca

SEQ ID NO: 5123099 - DNA, 15 bp, Homo sapiens
aattaacattatatt

SEQ ID NO: 5123100 - DNA, 20 bp, Homo sapiens
aattaaccaaggtagaatga

SEQ ID NO: 5123101 - DNA, 14 bp, Homo sapiens
aattaaccatttaa

SEQ ID NO: 5123102 - DNA, 16 bp, Homo sapiens
aattaaccatttaata

SEQ ID NO: 5123103 - DNA, 22 bp, Homo sapiens
aattaaccatttaataaagaaa

SEQ ID NO: 5123104 - DNA, 14 bp, Homo sapiens
aattaacctggtgc

SEQ ID NO: 5123105 - DNA, 17 bp, Homo sapiens
aattaacctttcaggaa

SEQ ID NO: 5123106 - DNA, 17 bp, Homo sapiens
aattaactaaggaaata

SEQ ID NO: 5123107 - DNA, 14 bp, Homo sapiens
aattaactctggac

SEQ ID NO: 5123108 - DNA, 15 bp, Homo sapiens
aattaactgaagcaa

SEQ ID NO: 5123109 - DNA, 18 bp, Homo sapiens
aattaactgggtaatgaa

SEQ ID NO: 5123110 - DNA, 15 bp, Homo sapiens
aattaactgtaaact

SEQ ID NO: 5123111 - DNA, 12 bp, Homo sapiens
aattaactgtat

SEQ ID NO: 5123112 - DNA, 17 bp, Homo sapiens
aattaacttgagtttta

SEQ ID NO: 5123113 - DNA, 13 bp, Homo sapiens
aattaacttttat

SEQ ID NO: 5123114 - DNA, 18 bp, Homo sapiens
aattaacttttataaact

SEQ ID NO: 5123115 - DNA, 20 bp, Homo sapiens
aattaagaaatactcatgtg

SEQ ID NO: 5123116 - DNA, 23 bp, Homo sapiens
aattaagaaatactcatgtgcaa

SEQ ID NO: 5123117 - DNA, 16 bp, Homo sapiens
aattaagaagaaacta

SEQ ID NO: 5123118 - DNA, 13 bp, Homo sapiens
aattaagaagtac

SEQ ID NO: 5123119 - DNA, 21 bp, Homo sapiens
aattaagaatatgtttccttg

SEQ ID NO: 5123120 - DNA, 11 bp, Homo sapiens
aattaagaatg

SEQ ID NO: 5123121 - DNA, 13 bp, Homo sapiens
aattaagacaaaa

SEQ ID NO: 5123122 - DNA, 18 bp, Homo sapiens
aattaagacaaaaagcct

SEQ ID NO: 5123123 - DNA, 17 bp, Homo sapiens
aattaagagatacattc

SEQ ID NO: 5123124 - DNA, 15 bp, Homo sapiens
aattaagatttcctt

SEQ ID NO: 5123125 - DNA, 15 bp, Homo sapiens
aattaagcaaatgtt

SEQ ID NO: 5123126 - DNA, 16 bp, Homo sapiens
aattaagcattttgaa

SEQ ID NO: 5123127 - DNA, 22 bp, Homo sapiens
aattaagccctaaggtcctaag

SEQ ID NO: 5123128 - DNA, 14 bp, Homo sapiens
aattaaggaaatgt

SEQ ID NO: 5123129 - DNA, 20 bp, Homo sapiens
aattaaggaacataaatctt

SEQ ID NO: 5123130 - DNA, 16 bp, Homo sapiens
aattaaggattttatg

SEQ ID NO: 5123131 - DNA, 21 bp, Homo sapiens
aattaaggcaactgaacaaaa

SEQ ID NO: 5123132 - DNA, 16 bp, Homo sapiens
aattaaggcataagaa

SEQ ID NO: 5123133 - DNA, 16 bp, Homo sapiens
aattaaggcatttgtt

SEQ ID NO: 5123134 - DNA, 18 bp, Homo sapiens
aattaagggccagaaaaa

SEQ ID NO: 5123135 - DNA, 18 bp, Homo sapiens
aattaagggccgatttaa

SEQ ID NO: 5123136 - DNA, 19 bp, Homo sapiens
aattaagggttaccccacc

SEQ ID NO: 5123137 - DNA, 17 bp, Homo sapiens
aattaaggtacatcatt

SEQ ID NO: 5123138 - DNA, 13 bp, Homo sapiens
aattaaggtgttt

SEQ ID NO: 5123139 - DNA, 15 bp, Homo sapiens
aattaaggtgtttga

SEQ ID NO: 5123140 - DNA, 12 bp, Homo sapiens
aattaagtaaac

SEQ ID NO: 5123141 - DNA, 16 bp, Homo sapiens
aattaagtactatgta

SEQ ID NO: 5123142 - DNA, 17 bp, Homo sapiens
aattaagtactatgtat

SEQ ID NO: 5123143 - DNA, 12 bp, Homo sapiens
aattaagtagaa

SEQ ID NO: 5123144 - DNA, 22 bp, Homo sapiens
aatttcaaagaaaacagaccag

SEQ ID NO: 5123145 - DNA, 20 bp, Homo sapiens
aatttcaagaatgtttcagt

SEQ ID NO: 5123146 - DNA, 23 bp, Homo sapiens
aatttcaagaatgtttcagttat

SEQ ID NO: 5123147 - DNA, 13 bp, Homo sapiens
aatttcaagctta

SEQ ID NO: 5123148 - DNA, 15 bp, Homo sapiens
aatttcaagcttatt

SEQ ID NO: 5123149 - DNA, 22 bp, Homo sapiens
aatttcaagcttattttggaga

SEQ ID NO: 5123150 - DNA, 15 bp, Homo sapiens
aatttcaaggttcta

SEQ ID NO: 5123151 - DNA, 17 bp, Homo sapiens
aatttcaaggttctaac

SEQ ID NO: 5123152 - DNA, 22 bp, Homo sapiens
aatttcaagtttaataaaatag

SEQ ID NO: 5123153 - DNA, 21 bp, Homo sapiens
aatttcaataacctttcactt

SEQ ID NO: 5123154 - DNA, 19 bp, Homo sapiens
aatttcaatcaaccaaagt

SEQ ID NO: 5123155 - DNA, 20 bp, Homo sapiens
aatttcaatcaaccaaagtt

SEQ ID NO: 5123156 - DNA, 18 bp, Homo sapiens
aatttcaatgcttctttt

SEQ ID NO: 5123157 - DNA, 13 bp, Homo sapiens
aatttcaattttt

SEQ ID NO: 5123158 - DNA, 21 bp, Homo sapiens
aatttcaatttttaaatttct

SEQ ID NO: 5123159 - DNA, 18 bp, Homo sapiens
aatttcacgattcatttt

SEQ ID NO: 5123160 - DNA, 21 bp, Homo sapiens
aatttcacgtcataggaagtt

SEQ ID NO: 5123161 - DNA, 14 bp, Homo sapiens
aatttcacttgaaa

SEQ ID NO: 5123162 - DNA, 23 bp, Homo sapiens
aatttcagactcccattcctgaa

SEQ ID NO: 5123163 - DNA, 21 bp, Homo sapiens
aatttcagctagttaataatt

SEQ ID NO: 5123164 - DNA, 13 bp, Homo sapiens
aatttcaggaaaa

SEQ ID NO: 5123165 - DNA, 21 bp, Homo sapiens
aatttcaggaggaatactgaa

SEQ ID NO: 5123166 - DNA, 12 bp, Homo sapiens
aatttcagggtg

SEQ ID NO: 5123167 - DNA, 20 bp, Homo sapiens
aatttcaggttttgtaaaga

SEQ ID NO: 5123168 - DNA, 22 bp, Homo sapiens
aatttcaggttttgtaaagatg

SEQ ID NO: 5123169 - DNA, 16 bp, Homo sapiens
aatttcagtataaaga

SEQ ID NO: 5123170 - DNA, 19 bp, Homo sapiens
aatttcagtcaattctgat

SEQ ID NO: 5123171 - DNA, 23 bp, Homo sapiens
aatttcagtcctgtagttttatt

SEQ ID NO: 5123172 - DNA, 13 bp, Homo sapiens
aatttcagtgtaa

SEQ ID NO: 5123173 - DNA, 21 bp, Homo sapiens
aatttcagttttaaaaatgaa

SEQ ID NO: 5123174 - DNA, 20 bp, Homo sapiens
aatttcataattctgaaaca

SEQ ID NO: 5123175 - DNA, 15 bp, Homo sapiens
aatttcatatctaca

SEQ ID NO: 5123176 - DNA, 16 bp, Homo sapiens
aatttcatatgctgta

SEQ ID NO: 5123177 - DNA, 16 bp, Homo sapiens
aatttcatgattggct

SEQ ID NO: 5123178 - DNA, 18 bp, Homo sapiens
aatttcattcaatttaag

SEQ ID NO: 5123179 - DNA, 14 bp, Homo sapiens
aatttcattccaaa

SEQ ID NO: 5123180 - DNA, 12 bp, Homo sapiens
aatttcattgca

SEQ ID NO: 5123181 - DNA, 13 bp, Homo sapiens
aatttcattgcac

SEQ ID NO: 5123182 - DNA, 23 bp, Homo sapiens
aatttcattgcactttcctttca

SEQ ID NO: 5123183 - DNA, 19 bp, Homo sapiens
aatttcatttccagcattt

SEQ ID NO: 5123184 - DNA, 18 bp, Homo sapiens
aatttccaaaataatcta

SEQ ID NO: 5123185 - DNA, 15 bp, Homo sapiens
aatttccagagaaga

SEQ ID NO: 5123186 - DNA, 18 bp, Homo sapiens
aatttccaggaaaaaata

SEQ ID NO: 5123187 - DNA, 24 bp, Homo sapiens
aatttccagtgagcttatcatgct

SEQ ID NO: 5123188 - DNA, 22 bp, Homo sapiens
aatttccatttacttaagactt

SEQ ID NO: 5123189 - DNA, 15 bp, Homo sapiens
aatttcccaaagcag

SEQ ID NO: 5123190 - DNA, 22 bp, Homo sapiens
aatttcccacaccccagcgcct

SEQ ID NO: 5123191 - DNA, 22 bp, Homo sapiens
aatttcccacaccgtgtaaacc

SEQ ID NO: 5123192 - DNA, 13 bp, Homo sapiens
aatttcccaccca

SEQ ID NO: 5123193 - DNA, 14 bp, Homo sapiens
aatttcccaggacc

SEQ ID NO: 5123194 - DNA, 21 bp, Homo sapiens
aatttcccaggaccctgaagg

SEQ ID NO: 5123195 - DNA, 15 bp, Homo sapiens
aatttccccaacagt

SEQ ID NO: 5123196 - DNA, 17 bp, Homo sapiens
aatttccccaacagtgt

SEQ ID NO: 5123197 - DNA, 19 bp, Homo sapiens
aatttccccaacagtgtga

SEQ ID NO: 5123198 - DNA, 18 bp, Homo sapiens
aatttcccccacctgcag

SEQ ID NO: 5123199 - DNA, 17 bp, Homo sapiens
aatttcccctaatcttt

SEQ ID NO: 5123200 - DNA, 12 bp, Homo sapiens
aatttccctcag

SEQ ID NO: 5123201 - DNA, 16 bp, Homo sapiens
aatttccctcaggttc

SEQ ID NO: 5123202 - DNA, 17 bp, Homo sapiens
aatttcctaatgagata

SEQ ID NO: 5123203 - DNA, 12 bp, Homo sapiens
aatttcctcact

SEQ ID NO: 5123204 - DNA, 18 bp, Homo sapiens
aatttcctctccactgct

SEQ ID NO: 5123205 - DNA, 21 bp, Homo sapiens
aatttcctctccactgctgga

SEQ ID NO: 5123206 - DNA, 18 bp, Homo sapiens
aatttcctgggagctttt

SEQ ID NO: 5123207 - DNA, 21 bp, Homo sapiens
aatttcctgggagcttttgta

SEQ ID NO: 5123208 - DNA, 19 bp, Homo sapiens
aatttcctgtaatatattt

SEQ ID NO: 5123209 - DNA, 14 bp, Homo sapiens
aatttcctgtgagg

SEQ ID NO: 5123210 - DNA, 21 bp, Homo sapiens
aatttcctgttggatttgttt

SEQ ID NO: 5123211 - DNA, 22 bp, Homo sapiens
aatttcctgtttgaaatatcat

SEQ ID NO: 5123212 - DNA, 16 bp, Homo sapiens
aatttccttcaggttt

SEQ ID NO: 5123213 - DNA, 17 bp, Homo sapiens
aatttccttctgttaag

SEQ ID NO: 5123214 - DNA, 21 bp, Homo sapiens
aatttccttctgttaagaaag

SEQ ID NO: 5123215 - DNA, 21 bp, Homo sapiens
aatttcctttatatttagtga

SEQ ID NO: 5123216 - DNA, 14 bp, Homo sapiens
aatttcctttttga

SEQ ID NO: 5123217 - DNA, 22 bp, Homo sapiens
aatttcctttttgacactgaaa

SEQ ID NO: 5123218 - DNA, 20 bp, Homo sapiens
aatttcggattttttccaaa

SEQ ID NO: 5123219 - DNA, 20 bp, Homo sapiens
aatttcgttgtccaatttgt

SEQ ID NO: 5123220 - DNA, 22 bp, Homo sapiens
aatttctaaaaaacagaggcca

SEQ ID NO: 5123221 - DNA, 17 bp, Homo sapiens
aatttctaaaaagatta

SEQ ID NO: 5123222 - DNA, 15 bp, Homo sapiens
aatttctaatgttta

SEQ ID NO: 5123223 - DNA, 16 bp, Homo sapiens
aatttctaatttcaag

SEQ ID NO: 5123224 - DNA, 16 bp, Homo sapiens
aatttctaccatttca

SEQ ID NO: 5123225 - DNA, 22 bp, Homo sapiens
aatttctagcctgcactttgat

SEQ ID NO: 5123226 - DNA, 22 bp, Homo sapiens
aatttctaggactgaattatga

SEQ ID NO: 5123227 - DNA, 23 bp, Homo sapiens
aatttctaggactgaattatgaa

SEQ ID NO: 5123228 - DNA, 16 bp, Homo sapiens
aatttctatcagcctt

SEQ ID NO: 5123229 - DNA, 23 bp, Homo sapiens
aatttctatgaaggatccatctt

SEQ ID NO: 5123230 - DNA, 12 bp, Homo sapiens
aatttctatggc

SEQ ID NO: 5123231 - DNA, 15 bp, Homo sapiens
aatttctattaaagg

SEQ ID NO: 5123232 - DNA, 22 bp, Homo sapiens
aatttctcacaatagacagaaa

SEQ ID NO: 5123233 - DNA, 11 bp, Homo sapiens
aatttctcccc

SEQ ID NO: 5123234 - DNA, 12 bp, Homo sapiens
aatttctcccca

SEQ ID NO: 5123235 - DNA, 19 bp, Homo sapiens
aatttctccccagggtgga

SEQ ID NO: 5123236 - DNA, 20 bp, Homo sapiens
aatttctcctcccttccttt

SEQ ID NO: 5123237 - DNA, 15 bp, Homo sapiens
aatttctgaagaagt

SEQ ID NO: 5123238 - DNA, 21 bp, Homo sapiens
aatttctgccaataaattcta

SEQ ID NO: 5123239 - DNA, 17 bp, Homo sapiens
aatttctgccatttcat

SEQ ID NO: 5123240 - DNA, 17 bp, Homo sapiens
aatttctgccctgagcc

SEQ ID NO: 5123241 - DNA, 19 bp, Homo sapiens
aatttctgccctgagccct

SEQ ID NO: 5123242 - DNA, 19 bp, Homo sapiens
aatttctgctgtggtctat

SEQ ID NO: 5123243 - DNA, 13 bp, Homo sapiens
aatttctggcctc

SEQ ID NO: 5123244 - DNA, 16 bp, Homo sapiens
aatttctggcctccta

SEQ ID NO: 5123245 - DNA, 17 bp, Homo sapiens
aatttctgggatattta

SEQ ID NO: 5123246 - DNA, 13 bp, Homo sapiens
aatttctggtttg

SEQ ID NO: 5123247 - DNA, 15 bp, Homo sapiens
aatttctgtacattt

SEQ ID NO: 5123248 - DNA, 18 bp, Homo sapiens
aatttctgtacatttgca

SEQ ID NO: 5123249 - DNA, 13 bp, Homo sapiens
aatttctgtcctt

SEQ ID NO: 5123250 - DNA, 22 bp, Homo sapiens
aatttctgtgtctaaatttctt

SEQ ID NO: 5123251 - DNA, 15 bp, Homo sapiens
aatttcttaacttct

SEQ ID NO: 5123252 - DNA, 16 bp, Homo sapiens
aatttcttaacttctt

SEQ ID NO: 5123253 - DNA, 20 bp, Homo sapiens
aatttcttactaaacatttt

SEQ ID NO: 5123254 - DNA, 15 bp, Homo sapiens
aatttcttatgtgac

SEQ ID NO: 5123255 - DNA, 18 bp, Homo sapiens
aatttcttatgtgacatt

SEQ ID NO: 5123256 - DNA, 21 bp, Homo sapiens
aatttcttcatgtgatgtcat

SEQ ID NO: 5123257 - DNA, 18 bp, Homo sapiens
aatttcttctcaaagggt

SEQ ID NO: 5123258 - DNA, 23 bp, Homo sapiens
aatttcttctgtagctattcttt

SEQ ID NO: 5123259 - DNA, 17 bp, Homo sapiens
aatttcttgcaatttga

SEQ ID NO: 5123260 - DNA, 18 bp, Homo sapiens
aatttctttaaaaaagaa

SEQ ID NO: 5123261 - DNA, 17 bp, Homo sapiens
aatttctttaaatgtgt

SEQ ID NO: 5123262 - DNA, 19 bp, Homo sapiens
aatttctttaaatgtgtat

SEQ ID NO: 5123263 - DNA, 21 bp, Homo sapiens
aatttctttaaatgtgtattt

SEQ ID NO: 5123264 - DNA, 15 bp, Homo sapiens
aatttctttgcctgt

SEQ ID NO: 5123265 - DNA, 19 bp, Homo sapiens
aatttctttgtcattcaag

SEQ ID NO: 5123266 - DNA, 12 bp, Homo sapiens
aatttctttgtt

SEQ ID NO: 5123267 - DNA, 12 bp, Homo sapiens
aatttcttttcc

SEQ ID NO: 5123268 - DNA, 23 bp, Homo sapiens
aatttcttttccttcattcatag

SEQ ID NO: 5123269 - DNA, 11 bp, Homo sapiens
aatttcttttg

SEQ ID NO: 5123270 - DNA, 12 bp, Homo sapiens
aatttgaaaaaa

SEQ ID NO: 5123271 - DNA, 18 bp, Homo sapiens
aatttgaaaataattgtt

SEQ ID NO: 5123272 - DNA, 14 bp, Homo sapiens
aatttgaaacacaa

SEQ ID NO: 5123273 - DNA, 15 bp, Homo sapiens
aatttgaaacacaag

SEQ ID NO: 5123274 - DNA, 23 bp, Homo sapiens
aatttgaaacacaagaattacac

SEQ ID NO: 5123275 - DNA, 20 bp, Homo sapiens
aatttgaaacactttgcata

SEQ ID NO: 5123276 - DNA, 12 bp, Homo sapiens
aatttgaaacat

SEQ ID NO: 5123277 - DNA, 21 bp, Homo sapiens
aatttgaaacattgcttttaa

SEQ ID NO: 5123278 - DNA, 18 bp, Homo sapiens
aatttgaaaccaggacat

SEQ ID NO: 5123279 - DNA, 15 bp, Homo sapiens
aatttgaaaggaaaa

SEQ ID NO: 5123280 - DNA, 21 bp, Homo sapiens
aatttgaaatcaccttttcta

SEQ ID NO: 5123281 - DNA, 23 bp, Homo sapiens
aatttgaaatcaccttttctaaa

SEQ ID NO: 5123282 - DNA, 16 bp, Homo sapiens
aatttgaaccaaaaca

SEQ ID NO: 5123283 - DNA, 15 bp, Homo sapiens
aatttgaactttgga

SEQ ID NO: 5123284 - DNA, 16 bp, Homo sapiens
aatttgaactttggaa

SEQ ID NO: 5123285 - DNA, 21 bp, Homo sapiens
aatttgaagatgtggatccct

SEQ ID NO: 5123286 - DNA, 13 bp, Homo sapiens
aatttgaaggtac

SEQ ID NO: 5123287 - DNA, 22 bp, Homo sapiens
aatttgaagtattagacttcta

SEQ ID NO: 5123288 - DNA, 19 bp, Homo sapiens
aatttgaataaaaatctta

SEQ ID NO: 5123289 - DNA, 16 bp, Homo sapiens
aatttgaataataaat

SEQ ID NO: 5123290 - DNA, 20 bp, Homo sapiens
aatttgaataataaatcgat

SEQ ID NO: 5123291 - DNA, 15 bp, Homo sapiens
aatttgaatctgagt

SEQ ID NO: 5123292 - DNA, 13 bp, Homo sapiens
aatttgaatgaaa

SEQ ID NO: 5123293 - DNA, 14 bp, Homo sapiens
aatttgaatgaaaa

SEQ ID NO: 5123294 - DNA, 22 bp, Homo sapiens
aatttgaatggattaaatggca

SEQ ID NO: 5123295 - DNA, 15 bp, Homo sapiens
aatttgacattgtca

SEQ ID NO: 5123296 - DNA, 17 bp, Homo sapiens
aatttgacattgtcaga

SEQ ID NO: 5123297 - DNA, 22 bp, Homo sapiens
aatttgacattgtcagaatgtt

SEQ ID NO: 5123298 - DNA, 19 bp, Homo sapiens
aatttgacttggcataatt

SEQ ID NO: 5123299 - DNA, 18 bp, Homo sapiens
aatttgacttttctgtaa

SEQ ID NO: 5123300 - DNA, 15 bp, Homo sapiens
aatttgagaattatt

SEQ ID NO: 5123301 - DNA, 16 bp, Homo sapiens
aatttgagactgaaat

SEQ ID NO: 5123302 - DNA, 18 bp, Homo sapiens
aatttgagagttcacaga

SEQ ID NO: 5123303 - DNA, 15 bp, Homo sapiens
aatttgagcaattca

SEQ ID NO: 5123304 - DNA, 13 bp, Homo sapiens
aatttgaggacaa

SEQ ID NO: 5123305 - DNA, 14 bp, Homo sapiens
aatttgaggacaac

SEQ ID NO: 5123306 - DNA, 24 bp, Homo sapiens
aatttgagtaatctgatcgttctt

SEQ ID NO: 5123307 - DNA, 17 bp, Homo sapiens
aatttgataaaaaccca

SEQ ID NO: 5123308 - DNA, 12 bp, Homo sapiens
aatttgataaac

SEQ ID NO: 5123309 - DNA, 17 bp, Homo sapiens
aatttgataatcagttt

SEQ ID NO: 5123310 - DNA, 14 bp, Homo sapiens
aatttgataatgac

SEQ ID NO: 5123311 - DNA, 16 bp, Homo sapiens
aatttgataatgacac

SEQ ID NO: 5123312 - DNA, 17 bp, Homo sapiens
aatttgataatgacact

SEQ ID NO: 5123313 - DNA, 20 bp, Homo sapiens
aatttgatacatatgtgaat

SEQ ID NO: 5123314 - DNA, 12 bp, Homo sapiens
aatttgatactt

SEQ ID NO: 5123315 - DNA, 20 bp, Homo sapiens
aatttgatacttatattttc

SEQ ID NO: 5123316 - DNA, 21 bp, Homo sapiens
aatttgatagtattgtgcata

SEQ ID NO: 5123317 - DNA, 16 bp, Homo sapiens
aatttgatatgtgaac

SEQ ID NO: 5123318 - DNA, 16 bp, Homo sapiens
aatttgatgaaagctg

SEQ ID NO: 5123319 - DNA, 17 bp, Homo sapiens
aatttgatgaaagctga

SEQ ID NO: 5123320 - DNA, 19 bp, Homo sapiens
aatttgatgcccaatatat

SEQ ID NO: 5123321 - DNA, 18 bp, Homo sapiens
aatttgatggtgaatatt

SEQ ID NO: 5123322 - DNA, 13 bp, Homo sapiens
aattaagtagaac

SEQ ID NO: 5123323 - DNA, 16 bp, Homo sapiens
aattaagtatatatat

SEQ ID NO: 5123324 - DNA, 14 bp, Homo sapiens
aattaagtatctga

SEQ ID NO: 5123325 - DNA, 15 bp, Homo sapiens
aattaagttacaatt

SEQ ID NO: 5123326 - DNA, 22 bp, Homo sapiens
aattaagttagggaatggcaca

SEQ ID NO: 5123327 - DNA, 12 bp, Homo sapiens
aattaagttatt

SEQ ID NO: 5123328 - DNA, 16 bp, Homo sapiens
aattaagtttgtgaat

SEQ ID NO: 5123329 - DNA, 19 bp, Homo sapiens
aattaagttttaaataaac

SEQ ID NO: 5123330 - DNA, 11 bp, Homo sapiens
aattaataaat

SEQ ID NO: 5123331 - DNA, 19 bp, Homo sapiens
aattaataatatgtactaa

SEQ ID NO: 5123332 - DNA, 14 bp, Homo sapiens
aattaatacagagt

SEQ ID NO: 5123333 - DNA, 15 bp, Homo sapiens
aattaatacagagta

SEQ ID NO: 5123334 - DNA, 15 bp, Homo sapiens
aattaatacattcta

SEQ ID NO: 5123335 - DNA, 23 bp, Homo sapiens
aattaatagccaaagatttcata

SEQ ID NO: 5123336 - DNA, 13 bp, Homo sapiens
aattaatagcttt

SEQ ID NO: 5123337 - DNA, 14 bp, Homo sapiens
aattaatagtttgt

SEQ ID NO: 5123338 - DNA, 13 bp, Homo sapiens
aattaatatatta

SEQ ID NO: 5123339 - DNA, 21 bp, Homo sapiens
aattaatatggtgtatttttc

SEQ ID NO: 5123340 - DNA, 23 bp, Homo sapiens
aattaatatggtgtatttttcca

SEQ ID NO: 5123341 - DNA, 13 bp, Homo sapiens
aattaatatttgt

SEQ ID NO: 5123342 - DNA, 15 bp, Homo sapiens
aattaatatttgtgc

SEQ ID NO: 5123343 - DNA, 19 bp, Homo sapiens
aattaatatttgtgctttg

SEQ ID NO: 5123344 - DNA, 13 bp, Homo sapiens
aattaatcaagta

SEQ ID NO: 5123345 - DNA, 16 bp, Homo sapiens
aattaatctagaaaat

SEQ ID NO: 5123346 - DNA, 19 bp, Homo sapiens
aattaatctagaaaatgaa

SEQ ID NO: 5123347 - DNA, 14 bp, Homo sapiens
aattaatcttaatt

SEQ ID NO: 5123348 - DNA, 21 bp, Homo sapiens
aattaatcttgcttcattgtt

SEQ ID NO: 5123349 - DNA, 15 bp, Homo sapiens
aattaatcttttaaa

SEQ ID NO: 5123350 - DNA, 16 bp, Homo sapiens
aattaatgaaatatct

SEQ ID NO: 5123351 - DNA, 18 bp, Homo sapiens
aattaatgcagatttctc

SEQ ID NO: 5123352 - DNA, 18 bp, Homo sapiens
aattaatggcttcgttaa

SEQ ID NO: 5123353 - DNA, 22 bp, Homo sapiens
aattaatggtttattctttgca

SEQ ID NO: 5123354 - DNA, 14 bp, Homo sapiens
aattaatgtaataa

SEQ ID NO: 5123355 - DNA, 16 bp, Homo sapiens
aattaatgtaataaag

SEQ ID NO: 5123356 - DNA, 15 bp, Homo sapiens
aattaatgtgtaaaa

SEQ ID NO: 5123357 - DNA, 19 bp, Homo sapiens
aattaatgtgtaaaattgg

SEQ ID NO: 5123358 - DNA, 20 bp, Homo sapiens
aattaatgtgtgtctgaaga

SEQ ID NO: 5123359 - DNA, 22 bp, Homo sapiens
aattaatgttccagtttgaaga

SEQ ID NO: 5123360 - DNA, 13 bp, Homo sapiens
aattaatgtttgt

SEQ ID NO: 5123361 - DNA, 13 bp, Homo sapiens
aattaattaagta

SEQ ID NO: 5123362 - DNA, 13 bp, Homo sapiens
aattaattaggaa

SEQ ID NO: 5123363 - DNA, 23 bp, Homo sapiens
aattaattcctgtttgtctacat

SEQ ID NO: 5123364 - DNA, 13 bp, Homo sapiens
aattaattcttta

SEQ ID NO: 5123365 - DNA, 23 bp, Homo sapiens
aattaattctttatcacatgttg

SEQ ID NO: 5123366 - DNA, 22 bp, Homo sapiens
aattaattgctggagactacaa

SEQ ID NO: 5123367 - DNA, 13 bp, Homo sapiens
aattaattggcag

SEQ ID NO: 5123368 - DNA, 17 bp, Homo sapiens
aattaattggcagcaga

SEQ ID NO: 5123369 - DNA, 15 bp, Homo sapiens
aattaattgtaatct

SEQ ID NO: 5123370 - DNA, 21 bp, Homo sapiens
aattaatttggacattatttc

SEQ ID NO: 5123371 - DNA, 13 bp, Homo sapiens
aattaatttggag

SEQ ID NO: 5123372 - DNA, 14 bp, Homo sapiens
aattaatttgtgaa

SEQ ID NO: 5123373 - DNA, 12 bp, Homo sapiens
aattaattttac

SEQ ID NO: 5123374 - DNA, 18 bp, Homo sapiens
aattaatttttcaatttc

SEQ ID NO: 5123375 - DNA, 19 bp, Homo sapiens
aattaatttttcaatttct

SEQ ID NO: 5123376 - DNA, 18 bp, Homo sapiens
aattaatttttttattgt

SEQ ID NO: 5123377 - DNA, 23 bp, Homo sapiens
aattaatttttttattgtttaaa

SEQ ID NO: 5123378 - DNA, 18 bp, Homo sapiens
aattacaaaaaaaaattt

SEQ ID NO: 5123379 - DNA, 23 bp, Homo sapiens
aattacaaaacctatttttcctt

SEQ ID NO: 5123380 - DNA, 12 bp, Homo sapiens
aattacaaacaa

SEQ ID NO: 5123381 - DNA, 13 bp, Homo sapiens
aattacaaagttc

SEQ ID NO: 5123382 - DNA, 15 bp, Homo sapiens
aattacaactaaatt

SEQ ID NO: 5123383 - DNA, 15 bp, Homo sapiens
aattacaagccctgg

SEQ ID NO: 5123384 - DNA, 15 bp, Homo sapiens
aattacaagtttcag

SEQ ID NO: 5123385 - DNA, 16 bp, Homo sapiens
aattacaagtttcagt

SEQ ID NO: 5123386 - DNA, 17 bp, Homo sapiens
aattacaagtttcagta

SEQ ID NO: 5123387 - DNA, 12 bp, Homo sapiens
aattacaataca

SEQ ID NO: 5123388 - DNA, 23 bp, Homo sapiens
aattacaattgtcatttataaaa

SEQ ID NO: 5123389 - DNA, 15 bp, Homo sapiens
aattacaattttatc

SEQ ID NO: 5123390 - DNA, 23 bp, Homo sapiens
aattacacagtaagtcatttaac

SEQ ID NO: 5123391 - DNA, 18 bp, Homo sapiens
aattacaccacaagtatc

SEQ ID NO: 5123392 - DNA, 22 bp, Homo sapiens
aattacaccacaagtatctaaa

SEQ ID NO: 5123393 - DNA, 16 bp, Homo sapiens
aattacacttgtcttt

SEQ ID NO: 5123394 - DNA, 17 bp, Homo sapiens
aattacagactctgatt

SEQ ID NO: 5123395 - DNA, 18 bp, Homo sapiens
aattacagagatataaat

SEQ ID NO: 5123396 - DNA, 21 bp, Homo sapiens
aattacagagatataaatgaa

SEQ ID NO: 5123397 - DNA, 12 bp, Homo sapiens
aattacagatgt

SEQ ID NO: 5123398 - DNA, 15 bp, Homo sapiens
aattacagatgtgaa

SEQ ID NO: 5123399 - DNA, 16 bp, Homo sapiens
aattacagcaaaaagg

SEQ ID NO: 5123400 - DNA, 14 bp, Homo sapiens
aattacagctttta

SEQ ID NO: 5123401 - DNA, 11 bp, Homo sapiens
aattacaggaa

SEQ ID NO: 5123402 - DNA, 19 bp, Homo sapiens
aattacaggaagtactgga

SEQ ID NO: 5123403 - DNA, 21 bp, Homo sapiens
aattacagggaagaaatcaag

SEQ ID NO: 5123404 - DNA, 20 bp, Homo sapiens
aattacaggttccttttgaa

SEQ ID NO: 5123405 - DNA, 19 bp, Homo sapiens
aattacagtgcctaaaata

SEQ ID NO: 5123406 - DNA, 11 bp, Homo sapiens
aattacagttc

SEQ ID NO: 5123407 - DNA, 13 bp, Homo sapiens
aattacataagtt

SEQ ID NO: 5123408 - DNA, 15 bp, Homo sapiens
aattacatacagatt

SEQ ID NO: 5123409 - DNA, 19 bp, Homo sapiens
aattacatatttgactctt

SEQ ID NO: 5123410 - DNA, 14 bp, Homo sapiens
aattacatgcatga

SEQ ID NO: 5123411 - DNA, 24 bp, Homo sapiens
aattacatggaacttttctgtaat

SEQ ID NO: 5123412 - DNA, 23 bp, Homo sapiens
aattacattcctaactagaatta

SEQ ID NO: 5123413 - DNA, 12 bp, Homo sapiens
aattacatttgt

SEQ ID NO: 5123414 - DNA, 19 bp, Homo sapiens
aattacatttgtaatttaa

SEQ ID NO: 5123415 - DNA, 17 bp, Homo sapiens
aattacattttatatgt

SEQ ID NO: 5123416 - DNA, 17 bp, Homo sapiens
aattacatttttaagct

SEQ ID NO: 5123417 - DNA, 14 bp, Homo sapiens
aattaccaagagaa

SEQ ID NO: 5123418 - DNA, 16 bp, Homo sapiens
aattaccaagagaagg

SEQ ID NO: 5123419 - DNA, 16 bp, Homo sapiens
aattaccagaaagata

SEQ ID NO: 5123420 - DNA, 22 bp, Homo sapiens
aattaccagtaaagtgtaacat

SEQ ID NO: 5123421 - DNA, 18 bp, Homo sapiens
aattaccattaattacat

SEQ ID NO: 5123422 - DNA, 18 bp, Homo sapiens
aattaccatttgttaata

SEQ ID NO: 5123423 - DNA, 18 bp, Homo sapiens
aattaccccctcctccag

SEQ ID NO: 5123424 - DNA, 21 bp, Homo sapiens
aattacctgataagggagagg

SEQ ID NO: 5123425 - DNA, 14 bp, Homo sapiens
aattacctgtataa

SEQ ID NO: 5123426 - DNA, 16 bp, Homo sapiens
aattacctgtataatg

SEQ ID NO: 5123427 - DNA, 22 bp, Homo sapiens
aattacctgtcatctgggccac

SEQ ID NO: 5123428 - DNA, 17 bp, Homo sapiens
aattacctgtgtgagat

SEQ ID NO: 5123429 - DNA, 16 bp, Homo sapiens
aattacctttaatttt

SEQ ID NO: 5123430 - DNA, 17 bp, Homo sapiens
aattacctttaatttta

SEQ ID NO: 5123431 - DNA, 17 bp, Homo sapiens
aattacgataaggaaga

SEQ ID NO: 5123432 - DNA, 20 bp, Homo sapiens
aattacggtgtacagtttaa

SEQ ID NO: 5123433 - DNA, 23 bp, Homo sapiens
aattacggtgtacagtttaacag

SEQ ID NO: 5123434 - DNA, 16 bp, Homo sapiens
aattacgtatgcaagt

SEQ ID NO: 5123435 - DNA, 22 bp, Homo sapiens
aattacgttcttacaagcttaa

SEQ ID NO: 5123436 - DNA, 19 bp, Homo sapiens
aattacgtttgttattcct

SEQ ID NO: 5123437 - DNA, 15 bp, Homo sapiens
aattactaacttcta

SEQ ID NO: 5123438 - DNA, 16 bp, Homo sapiens
aattactaacttctaa

SEQ ID NO: 5123439 - DNA, 17 bp, Homo sapiens
aattactaacttctaaa

SEQ ID NO: 5123440 - DNA, 18 bp, Homo sapiens
aattactaacttctaaaa

SEQ ID NO: 5123441 - DNA, 21 bp, Homo sapiens
aattactaacttctaaaactg

SEQ ID NO: 5123442 - DNA, 23 bp, Homo sapiens
aattactaacttctaaaactgta

SEQ ID NO: 5123443 - DNA, 15 bp, Homo sapiens
aattactaattctag

SEQ ID NO: 5123444 - DNA, 17 bp, Homo sapiens
aattactacaaaatttg

SEQ ID NO: 5123445 - DNA, 16 bp, Homo sapiens
aattactacaaatgga

SEQ ID NO: 5123446 - DNA, 16 bp, Homo sapiens
aattactactaggtaa

SEQ ID NO: 5123447 - DNA, 17 bp, Homo sapiens
aattactatagcaaagt

SEQ ID NO: 5123448 - DNA, 13 bp, Homo sapiens
aattactatctgt

SEQ ID NO: 5123449 - DNA, 20 bp, Homo sapiens
aattactatctgttgaaaag

SEQ ID NO: 5123450 - DNA, 22 bp, Homo sapiens
aattactattcttggttcttat

SEQ ID NO: 5123451 - DNA, 12 bp, Homo sapiens
aattactccaaa

SEQ ID NO: 5123452 - DNA, 16 bp, Homo sapiens
aattactgataaaaat

SEQ ID NO: 5123453 - DNA, 18 bp, Homo sapiens
aattactgatatcagagt

SEQ ID NO: 5123454 - DNA, 23 bp, Homo sapiens
aattactgcactcttaaacagca

SEQ ID NO: 5123455 - DNA, 12 bp, Homo sapiens
aattactggaat

SEQ ID NO: 5123456 - DNA, 21 bp, Homo sapiens
aattactggaattcttctgca

SEQ ID NO: 5123457 - DNA, 14 bp, Homo sapiens
aattactgtacaca

SEQ ID NO: 5123458 - DNA, 16 bp, Homo sapiens
aattactgtgagaact

SEQ ID NO: 5123459 - DNA, 11 bp, Homo sapiens
aattactgtgt

SEQ ID NO: 5123460 - DNA, 13 bp, Homo sapiens
aattactgtttga

SEQ ID NO: 5123461 - DNA, 19 bp, Homo sapiens
aattactgttttatgttga

SEQ ID NO: 5123462 - DNA, 22 bp, Homo sapiens
aattacttaaattttaaagcct

SEQ ID NO: 5123463 - DNA, 17 bp, Homo sapiens
aattacttaatgtgatg

SEQ ID NO: 5123464 - DNA, 11 bp, Homo sapiens
aattacttctc

SEQ ID NO: 5123465 - DNA, 16 bp, Homo sapiens
aattacttcttagtat

SEQ ID NO: 5123466 - DNA, 13 bp, Homo sapiens
aattactttaaca

SEQ ID NO: 5123467 - DNA, 18 bp, Homo sapiens
aattactttattataaaa

SEQ ID NO: 5123468 - DNA, 17 bp, Homo sapiens
aattactttcagaatgt

SEQ ID NO: 5123469 - DNA, 22 bp, Homo sapiens
aattactttggggctaatttaa

SEQ ID NO: 5123470 - DNA, 14 bp, Homo sapiens
aattacttttaaat

SEQ ID NO: 5123471 - DNA, 17 bp, Homo sapiens
aattacttttaaatatt

SEQ ID NO: 5123472 - DNA, 12 bp, Homo sapiens
aattagaaaaaa

SEQ ID NO: 5123473 - DNA, 16 bp, Homo sapiens
aattagaaaaggaaat

SEQ ID NO: 5123474 - DNA, 16 bp, Homo sapiens
aattagaaaatattct

SEQ ID NO: 5123475 - DNA, 16 bp, Homo sapiens
aattagaaaatcctat

SEQ ID NO: 5123476 - DNA, 12 bp, Homo sapiens
aattagaaaatt

SEQ ID NO: 5123477 - DNA, 13 bp, Homo sapiens
aattagaaaatta

SEQ ID NO: 5123478 - DNA, 18 bp, Homo sapiens
aattagaaatattaaaga

SEQ ID NO: 5123479 - DNA, 18 bp, Homo sapiens
aattagaaattggctgga

SEQ ID NO: 5123480 - DNA, 14 bp, Homo sapiens
aattagaacaatag

SEQ ID NO: 5123481 - DNA, 19 bp, Homo sapiens
aattagaacaatagctatt

SEQ ID NO: 5123482 - DNA, 21 bp, Homo sapiens
aattagaacttgaatactttg

SEQ ID NO: 5123483 - DNA, 13 bp, Homo sapiens
aattagaagagcc

SEQ ID NO: 5123484 - DNA, 22 bp, Homo sapiens
aattagaagccatcctaaggtg

SEQ ID NO: 5123485 - DNA, 19 bp, Homo sapiens
aattagaatgaatttatct

SEQ ID NO: 5123486 - DNA, 17 bp, Homo sapiens
aattagacctttatttt

SEQ ID NO: 5123487 - DNA, 15 bp, Homo sapiens
aattagactgtgatt

SEQ ID NO: 5123488 - DNA, 19 bp, Homo sapiens
aattagactgtgattcaga

SEQ ID NO: 5123489 - DNA, 17 bp, Homo sapiens
aattagacttgaaatac

SEQ ID NO: 5123490 - DNA, 15 bp, Homo sapiens
aattagagaactgga

SEQ ID NO: 5123491 - DNA, 16 bp, Homo sapiens
aattagagaagctgaa

SEQ ID NO: 5123492 - DNA, 23 bp, Homo sapiens
aattagataaattgtagggcttt

SEQ ID NO: 5123493 - DNA, 16 bp, Homo sapiens
aattagatccattaat

SEQ ID NO: 5123494 - DNA, 17 bp, Homo sapiens
aattagatccattaatt

SEQ ID NO: 5123495 - DNA, 23 bp, Homo sapiens
aattagatccattaatttaaatg

SEQ ID NO: 5123496 - DNA, 17 bp, Homo sapiens
aattagatgcatgttga

SEQ ID NO: 5123497 - DNA, 15 bp, Homo sapiens
aattagatgtttata

SEQ ID NO: 5123498 - DNA, 16 bp, Homo sapiens
aattagatgtttatat

SEQ ID NO: 5123499 - DNA, 19 bp, Homo sapiens
aattagatgtttatatcaa

SEQ ID NO: 5123500 - DNA, 14 bp, Homo sapiens
aattagattagaaa

SEQ ID NO: 5123501 - DNA, 15 bp, Homo sapiens
aattagattatttct

SEQ ID NO: 5123502 - DNA, 16 bp, Homo sapiens
aattagattatttctg

SEQ ID NO: 5123503 - DNA, 23 bp, Homo sapiens
aatttgatggtgaatattacatt

SEQ ID NO: 5123504 - DNA, 12 bp, Homo sapiens
aatttgatgtgg

SEQ ID NO: 5123505 - DNA, 13 bp, Homo sapiens
aatttgattaaca

SEQ ID NO: 5123506 - DNA, 20 bp, Homo sapiens
aatttgattgactgcccatt

SEQ ID NO: 5123507 - DNA, 13 bp, Homo sapiens
aatttgattgatt

SEQ ID NO: 5123508 - DNA, 16 bp, Homo sapiens
aatttgattgatttga

SEQ ID NO: 5123509 - DNA, 20 bp, Homo sapiens
aatttgattgatttgaagaa

SEQ ID NO: 5123510 - DNA, 15 bp, Homo sapiens
aatttgattgctttg

SEQ ID NO: 5123511 - DNA, 13 bp, Homo sapiens
aatttgatttcca

SEQ ID NO: 5123512 - DNA, 12 bp, Homo sapiens
aatttgcaaagt

SEQ ID NO: 5123513 - DNA, 15 bp, Homo sapiens
aatttgcaaagtact

SEQ ID NO: 5123514 - DNA, 17 bp, Homo sapiens
aatttgcaaagtactgt

SEQ ID NO: 5123515 - DNA, 22 bp, Homo sapiens
aatttgcaacaggggaggaaaa

SEQ ID NO: 5123516 - DNA, 15 bp, Homo sapiens
aatttgcaacatata

SEQ ID NO: 5123517 - DNA, 16 bp, Homo sapiens
aatttgcaacatataa

SEQ ID NO: 5123518 - DNA, 18 bp, Homo sapiens
aatttgcaaccatcagaa

SEQ ID NO: 5123519 - DNA, 18 bp, Homo sapiens
aatttgcaagtcatggct

SEQ ID NO: 5123520 - DNA, 20 bp, Homo sapiens
aatttgcacaatatttcttt

SEQ ID NO: 5123521 - DNA, 21 bp, Homo sapiens
aatttgcacacaaaacatctt

SEQ ID NO: 5123522 - DNA, 17 bp, Homo sapiens
aatttgcaccatcatgt

SEQ ID NO: 5123523 - DNA, 17 bp, Homo sapiens
aatttgcacctttgtct

SEQ ID NO: 5123524 - DNA, 20 bp, Homo sapiens
aatttgcactttcaggaaca

SEQ ID NO: 5123525 - DNA, 14 bp, Homo sapiens
aatttgcatactta

SEQ ID NO: 5123526 - DNA, 23 bp, Homo sapiens
aatttgcatattctattgtatta

SEQ ID NO: 5123527 - DNA, 15 bp, Homo sapiens
aatttgcattaaatt

SEQ ID NO: 5123528 - DNA, 16 bp, Homo sapiens
aatttgcattactctg

SEQ ID NO: 5123529 - DNA, 21 bp, Homo sapiens
aatttgccaaaataatgtctt

SEQ ID NO: 5123530 - DNA, 24 bp, Homo sapiens
aatttgccatgacatttcatctgg

SEQ ID NO: 5123531 - DNA, 12 bp, Homo sapiens
aatttgccatta

SEQ ID NO: 5123532 - DNA, 14 bp, Homo sapiens
aatttgcccctggc

SEQ ID NO: 5123533 - DNA, 15 bp, Homo sapiens
aatttgccctcccat

SEQ ID NO: 5123534 - DNA, 22 bp, Homo sapiens
aatttgcctgtaacaagccaga

SEQ ID NO: 5123535 - DNA, 15 bp, Homo sapiens
aatttgcgtaactaa

SEQ ID NO: 5123536 - DNA, 24 bp, Homo sapiens
aatttgctatttacaaatgaagta

SEQ ID NO: 5123537 - DNA, 14 bp, Homo sapiens
aatttgctgccaaa

SEQ ID NO: 5123538 - DNA, 16 bp, Homo sapiens
aatttgcttcactcaa

SEQ ID NO: 5123539 - DNA, 16 bp, Homo sapiens
aatttgctttaattaa

SEQ ID NO: 5123540 - DNA, 17 bp, Homo sapiens
aatttggaaactaataa

SEQ ID NO: 5123541 - DNA, 20 bp, Homo sapiens
aatttggaaactaataaaat

SEQ ID NO: 5123542 - DNA, 22 bp, Homo sapiens
aatttggaaactaataaaatat

SEQ ID NO: 5123543 - DNA, 23 bp, Homo sapiens
aatttggaaactaataaaatatt

SEQ ID NO: 5123544 - DNA, 16 bp, Homo sapiens
aatttggaacttacaa

SEQ ID NO: 5123545 - DNA, 21 bp, Homo sapiens
aatttggacattatttcgtgt

SEQ ID NO: 5123546 - DNA, 19 bp, Homo sapiens
aatttggatcatgttatga

SEQ ID NO: 5123547 - DNA, 22 bp, Homo sapiens
aatttggatcatgttatgattt

SEQ ID NO: 5123548 - DNA, 14 bp, Homo sapiens
aatttggatctatt

SEQ ID NO: 5123549 - DNA, 17 bp, Homo sapiens
aatttggatctatttat

SEQ ID NO: 5123550 - DNA, 22 bp, Homo sapiens
aatttggatctcttcttaatgt

SEQ ID NO: 5123551 - DNA, 12 bp, Homo sapiens
aatttggattta

SEQ ID NO: 5123552 - DNA, 22 bp, Homo sapiens
aatttggatttacgactgaaga

SEQ ID NO: 5123553 - DNA, 14 bp, Homo sapiens
aatttggcattgat

SEQ ID NO: 5123554 - DNA, 13 bp, Homo sapiens
aatttggcccaga

SEQ ID NO: 5123555 - DNA, 14 bp, Homo sapiens
aatttggcccagag

SEQ ID NO: 5123556 - DNA, 18 bp, Homo sapiens
aatttggcctgcactaat

SEQ ID NO: 5123557 - DNA, 17 bp, Homo sapiens
aatttggccttaagaac

SEQ ID NO: 5123558 - DNA, 20 bp, Homo sapiens
aatttggccttaagaactgt

SEQ ID NO: 5123559 - DNA, 17 bp, Homo sapiens
aatttgggaacataaaa

SEQ ID NO: 5123560 - DNA, 16 bp, Homo sapiens
aatttgggagggtgag

SEQ ID NO: 5123561 - DNA, 17 bp, Homo sapiens
aatttgggatactaaag

SEQ ID NO: 5123562 - DNA, 11 bp, Homo sapiens
aatttgggcag

SEQ ID NO: 5123563 - DNA, 13 bp, Homo sapiens
aatttgggcagat

SEQ ID NO: 5123564 - DNA, 19 bp, Homo sapiens
aatttgggcctcttgtaca

SEQ ID NO: 5123565 - DNA, 16 bp, Homo sapiens
aatttgggcttcctgt

SEQ ID NO: 5123566 - DNA, 23 bp, Homo sapiens
aatttggggacagattcagtctt

SEQ ID NO: 5123567 - DNA, 19 bp, Homo sapiens
aatttgggggacatgctaa

SEQ ID NO: 5123568 - DNA, 18 bp, Homo sapiens
aatttgggggacttacat

SEQ ID NO: 5123569 - DNA, 13 bp, Homo sapiens
aatttggtacaca

SEQ ID NO: 5123570 - DNA, 17 bp, Homo sapiens
aatttggtacacatgtg

SEQ ID NO: 5123571 - DNA, 19 bp, Homo sapiens
aatttggtacacatgtgtt

SEQ ID NO: 5123572 - DNA, 18 bp, Homo sapiens
aatttggtagatgacaaa

SEQ ID NO: 5123573 - DNA, 20 bp, Homo sapiens
aatttggtagatgacaaata

SEQ ID NO: 5123574 - DNA, 14 bp, Homo sapiens
aatttggtataatt

SEQ ID NO: 5123575 - DNA, 14 bp, Homo sapiens
aatttggtcatttg

SEQ ID NO: 5123576 - DNA, 16 bp, Homo sapiens
aatttggtcatttggc

SEQ ID NO: 5123577 - DNA, 15 bp, Homo sapiens
aatttggtctgtata

SEQ ID NO: 5123578 - DNA, 22 bp, Homo sapiens
aatttggtcttagctttacatt

SEQ ID NO: 5123579 - DNA, 21 bp, Homo sapiens
aatttggtgtggctgtattca

SEQ ID NO: 5123580 - DNA, 23 bp, Homo sapiens
aatttgtaaaaacagcattgctt

SEQ ID NO: 5123581 - DNA, 16 bp, Homo sapiens
aatttgtaaaacttct

SEQ ID NO: 5123582 - DNA, 20 bp, Homo sapiens
aatttgtaaaatgttctctt

SEQ ID NO: 5123583 - DNA, 18 bp, Homo sapiens
aatttgtaaacttctgaa

SEQ ID NO: 5123584 - DNA, 20 bp, Homo sapiens
aatttgtaaacttctgaaga

SEQ ID NO: 5123585 - DNA, 16 bp, Homo sapiens
aatttgtaaatgattt

SEQ ID NO: 5123586 - DNA, 20 bp, Homo sapiens
aatttgtaaatgattttaat

SEQ ID NO: 5123587 - DNA, 20 bp, Homo sapiens
aatttgtaagcaacttgctt

SEQ ID NO: 5123588 - DNA, 22 bp, Homo sapiens
aatttgtaagcaacttgcttct

SEQ ID NO: 5123589 - DNA, 23 bp, Homo sapiens
aatttgtaagcaacttgcttcta

SEQ ID NO: 5123590 - DNA, 13 bp, Homo sapiens
aatttgtaagttt

SEQ ID NO: 5123591 - DNA, 14 bp, Homo sapiens
aatttgtaagtttc

SEQ ID NO: 5123592 - DNA, 23 bp, Homo sapiens
aatttgtaagtttcaggtgacat

SEQ ID NO: 5123593 - DNA, 22 bp, Homo sapiens
aatttgtaataaaactatttgt

SEQ ID NO: 5123594 - DNA, 22 bp, Homo sapiens
aatttgtaatgattttggaact

SEQ ID NO: 5123595 - DNA, 18 bp, Homo sapiens
aatttgtaatgtcttgag

SEQ ID NO: 5123596 - DNA, 20 bp, Homo sapiens
aatttgtaatgtcttgagct

SEQ ID NO: 5123597 - DNA, 15 bp, Homo sapiens
aatttgtaattttag

SEQ ID NO: 5123598 - DNA, 16 bp, Homo sapiens
aatttgtaattttagt

SEQ ID NO: 5123599 - DNA, 14 bp, Homo sapiens
aatttgtacaatgg

SEQ ID NO: 5123600 - DNA, 16 bp, Homo sapiens
aatttgtacaatggtt

SEQ ID NO: 5123601 - DNA, 21 bp, Homo sapiens
aatttgtactattagcaagaa

SEQ ID NO: 5123602 - DNA, 19 bp, Homo sapiens
aatttgtactatttaactg

SEQ ID NO: 5123603 - DNA, 18 bp, Homo sapiens
aatttgtacttcttattg

SEQ ID NO: 5123604 - DNA, 12 bp, Homo sapiens
aatttgtacttt

SEQ ID NO: 5123605 - DNA, 23 bp, Homo sapiens
aatttgtataaagcattactctt

SEQ ID NO: 5123606 - DNA, 23 bp, Homo sapiens
aatttgtataacccatatctgtg

SEQ ID NO: 5123607 - DNA, 14 bp, Homo sapiens
aatttgtatatcat

SEQ ID NO: 5123608 - DNA, 14 bp, Homo sapiens
aatttgtatctgaa

SEQ ID NO: 5123609 - DNA, 16 bp, Homo sapiens
aatttgtatgctaaat

SEQ ID NO: 5123610 - DNA, 19 bp, Homo sapiens
aatttgtatgctaaatgag

SEQ ID NO: 5123611 - DNA, 10 bp, Homo sapiens
aatttgtcag

SEQ ID NO: 5123612 - DNA, 20 bp, Homo sapiens
aatttgtcagcgttctacca

SEQ ID NO: 5123613 - DNA, 14 bp, Homo sapiens
aatttgtcattttg

SEQ ID NO: 5123614 - DNA, 15 bp, Homo sapiens
aatttgtccattgta

SEQ ID NO: 5123615 - DNA, 18 bp, Homo sapiens
aatttgtccattgtaaat

SEQ ID NO: 5123616 - DNA, 13 bp, Homo sapiens
aatttgtccattt

SEQ ID NO: 5123617 - DNA, 18 bp, Homo sapiens
aatttgtccatttaaaaa

SEQ ID NO: 5123618 - DNA, 22 bp, Homo sapiens
aatttgtctggactagaaaatc

SEQ ID NO: 5123619 - DNA, 16 bp, Homo sapiens
aatttgtcttgcctta

SEQ ID NO: 5123620 - DNA, 14 bp, Homo sapiens
aatttgtctttcaa

SEQ ID NO: 5123621 - DNA, 16 bp, Homo sapiens
aatttgtgaaagtggc

SEQ ID NO: 5123622 - DNA, 13 bp, Homo sapiens
aatttgtgaatat

SEQ ID NO: 5123623 - DNA, 18 bp, Homo sapiens
aatttgtgaatatatttt

SEQ ID NO: 5123624 - DNA, 13 bp, Homo sapiens
aatttgtgaattt

SEQ ID NO: 5123625 - DNA, 14 bp, Homo sapiens
aatttgtgaatttg

SEQ ID NO: 5123626 - DNA, 14 bp, Homo sapiens
aatttgtgatacaa

SEQ ID NO: 5123627 - DNA, 20 bp, Homo sapiens
aatttgtgcatcagaaaatg

SEQ ID NO: 5123628 - DNA, 16 bp, Homo sapiens
aatttgtggtgatttg

SEQ ID NO: 5123629 - DNA, 17 bp, Homo sapiens
aatttgtgtaatattac

SEQ ID NO: 5123630 - DNA, 13 bp, Homo sapiens
aatttgtgtagat

SEQ ID NO: 5123631 - DNA, 19 bp, Homo sapiens
aatttgtgtgcttcacaca

SEQ ID NO: 5123632 - DNA, 19 bp, Homo sapiens
aatttgtgttgaaggaact

SEQ ID NO: 5123633 - DNA, 12 bp, Homo sapiens
aatttgttaatt

SEQ ID NO: 5123634 - DNA, 21 bp, Homo sapiens
aatttgttaattcctatgaag

SEQ ID NO: 5123635 - DNA, 19 bp, Homo sapiens
aatttgttatacttcaaaa

SEQ ID NO: 5123636 - DNA, 14 bp, Homo sapiens
aatttgttcttgta

SEQ ID NO: 5123637 - DNA, 16 bp, Homo sapiens
aatttgttcttgtatt

SEQ ID NO: 5123638 - DNA, 21 bp, Homo sapiens
aatttgttcttgtatttattg

SEQ ID NO: 5123639 - DNA, 21 bp, Homo sapiens
aatttgttggagatgcagcct

SEQ ID NO: 5123640 - DNA, 21 bp, Homo sapiens
aatttgttgtcatgtgtatga

SEQ ID NO: 5123641 - DNA, 15 bp, Homo sapiens
aatttgttgtttgtt

SEQ ID NO: 5123642 - DNA, 19 bp, Homo sapiens
aatttgtttaaaattctct

SEQ ID NO: 5123643 - DNA, 21 bp, Homo sapiens
aatttgtttaaagaataaagt

SEQ ID NO: 5123644 - DNA, 21 bp, Homo sapiens
aatttgtttaatctacattat

SEQ ID NO: 5123645 - DNA, 11 bp, Homo sapiens
aatttgtttct

SEQ ID NO: 5123646 - DNA, 15 bp, Homo sapiens
aatttgtttgacaat

SEQ ID NO: 5123647 - DNA, 13 bp, Homo sapiens
aatttgtttgtat

SEQ ID NO: 5123648 - DNA, 15 bp, Homo sapiens
aatttgtttgtgaca

SEQ ID NO: 5123649 - DNA, 16 bp, Homo sapiens
aatttgtttgtgcttc

SEQ ID NO: 5123650 - DNA, 21 bp, Homo sapiens
aatttgttttcatttgtataa

SEQ ID NO: 5123651 - DNA, 22 bp, Homo sapiens
aatttgttttgctgagagcata

SEQ ID NO: 5123652 - DNA, 21 bp, Homo sapiens
aattttaaaaaagatggattt

SEQ ID NO: 5123653 - DNA, 23 bp, Homo sapiens
aattttaaaaaagggagtttttg

SEQ ID NO: 5123654 - DNA, 15 bp, Homo sapiens
aattttaaaaaataa

SEQ ID NO: 5123655 - DNA, 15 bp, Homo sapiens
aattttaaaaagcag

SEQ ID NO: 5123656 - DNA, 14 bp, Homo sapiens
aattttaaaaatac

SEQ ID NO: 5123657 - DNA, 21 bp, Homo sapiens
aattttaaaaatgaatcctac

SEQ ID NO: 5123658 - DNA, 14 bp, Homo sapiens
aattttaaaaatgg

SEQ ID NO: 5123659 - DNA, 22 bp, Homo sapiens
aattttaaaagcatatataaaa

SEQ ID NO: 5123660 - DNA, 19 bp, Homo sapiens
aattttaaaatgtagaaga

SEQ ID NO: 5123661 - DNA, 21 bp, Homo sapiens
aattttaaaatgtagaagaaa

SEQ ID NO: 5123662 - DNA, 17 bp, Homo sapiens
aattttaaaattgcagc

SEQ ID NO: 5123663 - DNA, 21 bp, Homo sapiens
aattttaaagcctgaaaattc

SEQ ID NO: 5123664 - DNA, 23 bp, Homo sapiens
aattttaaagcctgaaaattcca

SEQ ID NO: 5123665 - DNA, 18 bp, Homo sapiens
aattttaaagtaaaaggc

SEQ ID NO: 5123666 - DNA, 14 bp, Homo sapiens
aattttaaagtatg

SEQ ID NO: 5123667 - DNA, 18 bp, Homo sapiens
aattttaaagtatgcatt

SEQ ID NO: 5123668 - DNA, 13 bp, Homo sapiens
aattttaaagtgc

SEQ ID NO: 5123669 - DNA, 17 bp, Homo sapiens
aattttaaagtgcaaaa

SEQ ID NO: 5123670 - DNA, 17 bp, Homo sapiens
aattttaaagtggttct

SEQ ID NO: 5123671 - DNA, 16 bp, Homo sapiens
aattttaaagttctta

SEQ ID NO: 5123672 - DNA, 18 bp, Homo sapiens
aattttaaataaaagtga

SEQ ID NO: 5123673 - DNA, 22 bp, Homo sapiens
aattttaaataaaagtgatcaa

SEQ ID NO: 5123674 - DNA, 15 bp, Homo sapiens
aattttaaataacct

SEQ ID NO: 5123675 - DNA, 15 bp, Homo sapiens
aattttaaataagat

SEQ ID NO: 5123676 - DNA, 19 bp, Homo sapiens
aattttaacagacatgtat

SEQ ID NO: 5123677 - DNA, 13 bp, Homo sapiens
aattttaacattt

SEQ ID NO: 5123678 - DNA, 21 bp, Homo sapiens
aattttaacgtaactctttct

SEQ ID NO: 5123679 - DNA, 13 bp, Homo sapiens
aattttaactgta

SEQ ID NO: 5123680 - DNA, 22 bp, Homo sapiens
aattttaacttttaaggttgaa

SEQ ID NO: 5123681 - DNA, 18 bp, Homo sapiens
aattagattatttctgta

SEQ ID NO: 5123682 - DNA, 21 bp, Homo sapiens
aattagattatttctgtattt

SEQ ID NO: 5123683 - DNA, 13 bp, Homo sapiens
aattagatttctc

SEQ ID NO: 5123684 - DNA, 13 bp, Homo sapiens
aattagatttgtg

SEQ ID NO: 5123685 - DNA, 21 bp, Homo sapiens
aattagattttaaaacttcat

SEQ ID NO: 5123686 - DNA, 14 bp, Homo sapiens
aattagcagaatgg

SEQ ID NO: 5123687 - DNA, 20 bp, Homo sapiens
aattagcagaatggagaaag

SEQ ID NO: 5123688 - DNA, 16 bp, Homo sapiens
aattagcatattaata

SEQ ID NO: 5123689 - DNA, 15 bp, Homo sapiens
aattagcatgcaagc

SEQ ID NO: 5123690 - DNA, 18 bp, Homo sapiens
aattagcatgcaagcttg

SEQ ID NO: 5123691 - DNA, 15 bp, Homo sapiens
aattagcatgctgct

SEQ ID NO: 5123692 - DNA, 13 bp, Homo sapiens
aattagcattctg

SEQ ID NO: 5123693 - DNA, 18 bp, Homo sapiens
aattagccaaccaggcta

SEQ ID NO: 5123694 - DNA, 15 bp, Homo sapiens
aattagccaagtgtg

SEQ ID NO: 5123695 - DNA, 15 bp, Homo sapiens
aattagccacatgta

SEQ ID NO: 5123696 - DNA, 14 bp, Homo sapiens
aattagccaggtgt

SEQ ID NO: 5123697 - DNA, 17 bp, Homo sapiens
aattagccagtaatcct

SEQ ID NO: 5123698 - DNA, 20 bp, Homo sapiens
aattagcctaagatatactt

SEQ ID NO: 5123699 - DNA, 22 bp, Homo sapiens
aattagctctcgcctcaggctt

SEQ ID NO: 5123700 - DNA, 13 bp, Homo sapiens
aattagctctggg

SEQ ID NO: 5123701 - DNA, 15 bp, Homo sapiens
aattagctctggggg

SEQ ID NO: 5123702 - DNA, 14 bp, Homo sapiens
aattagctgggcgt

SEQ ID NO: 5123703 - DNA, 16 bp, Homo sapiens
aattagctgtgtgaaa

SEQ ID NO: 5123704 - DNA, 17 bp, Homo sapiens
aattagcttggggccag

SEQ ID NO: 5123705 - DNA, 16 bp, Homo sapiens
aattaggaaggccatg

SEQ ID NO: 5123706 - DNA, 22 bp, Homo sapiens
aattaggaagtgtaacagctga

SEQ ID NO: 5123707 - DNA, 12 bp, Homo sapiens
aattaggaatta

SEQ ID NO: 5123708 - DNA, 16 bp, Homo sapiens
aattaggataactaaa

SEQ ID NO: 5123709 - DNA, 22 bp, Homo sapiens
aattaggataactaaaattctg

SEQ ID NO: 5123710 - DNA, 16 bp, Homo sapiens
aattaggatctatgca

SEQ ID NO: 5123711 - DNA, 20 bp, Homo sapiens
aattaggcaaggctatgtga

SEQ ID NO: 5123712 - DNA, 23 bp, Homo sapiens
aattaggcaaggctatgtgatta

SEQ ID NO: 5123713 - DNA, 16 bp, Homo sapiens
aattaggctgtaacta

SEQ ID NO: 5123714 - DNA, 18 bp, Homo sapiens
aattagggctctaatttc

SEQ ID NO: 5123715 - DNA, 17 bp, Homo sapiens
aattaggggttaaagca

SEQ ID NO: 5123716 - DNA, 17 bp, Homo sapiens
aattaggggttgctaag

SEQ ID NO: 5123717 - DNA, 20 bp, Homo sapiens
aattaggggttgctaagaag

SEQ ID NO: 5123718 - DNA, 21 bp, Homo sapiens
aattagggtacatttataatt

SEQ ID NO: 5123719 - DNA, 13 bp, Homo sapiens
aattaggtcaagt

SEQ ID NO: 5123720 - DNA, 22 bp, Homo sapiens
aattaggtcaagttcatagttt

SEQ ID NO: 5123721 - DNA, 23 bp, Homo sapiens
aattaggtgtactgtactgaaga

SEQ ID NO: 5123722 - DNA, 24 bp, Homo sapiens
aattaggtgtactgtactgaagaa

SEQ ID NO: 5123723 - DNA, 14 bp, Homo sapiens
aattaggttaacat

SEQ ID NO: 5123724 - DNA, 16 bp, Homo sapiens
aattaggttaacattg

SEQ ID NO: 5123725 - DNA, 14 bp, Homo sapiens
aattaggttgaaac

SEQ ID NO: 5123726 - DNA, 15 bp, Homo sapiens
aattaggttgaaaca

SEQ ID NO: 5123727 - DNA, 18 bp, Homo sapiens
aattaggttgaaacatat

SEQ ID NO: 5123728 - DNA, 16 bp, Homo sapiens
aattaggttttgtaca

SEQ ID NO: 5123729 - DNA, 17 bp, Homo sapiens
aattaggttttgtacaa

SEQ ID NO: 5123730 - DNA, 13 bp, Homo sapiens
aattagtacagta

SEQ ID NO: 5123731 - DNA, 14 bp, Homo sapiens
aattagtacagtag

SEQ ID NO: 5123732 - DNA, 20 bp, Homo sapiens
aattagtacagtagcttaaa

SEQ ID NO: 5123733 - DNA, 23 bp, Homo sapiens
aattagtacagtagcttaaataa

SEQ ID NO: 5123734 - DNA, 21 bp, Homo sapiens
aattagtaggctcatttactg

SEQ ID NO: 5123735 - DNA, 22 bp, Homo sapiens
aattagtaggctcatttactgt

SEQ ID NO: 5123736 - DNA, 15 bp, Homo sapiens
aattagtatgtctgt

SEQ ID NO: 5123737 - DNA, 18 bp, Homo sapiens
aattagtatttatttaat

SEQ ID NO: 5123738 - DNA, 17 bp, Homo sapiens
aattagtcctcacagcc

SEQ ID NO: 5123739 - DNA, 20 bp, Homo sapiens
aattagtcctcacagcctag

SEQ ID NO: 5123740 - DNA, 22 bp, Homo sapiens
aattagtcgggcatgagtctgt

SEQ ID NO: 5123741 - DNA, 15 bp, Homo sapiens
aattagtctttttct

SEQ ID NO: 5123742 - DNA, 23 bp, Homo sapiens
aattagtgaaccaaaaatagaaa

SEQ ID NO: 5123743 - DNA, 15 bp, Homo sapiens
aattagtgaagttct

SEQ ID NO: 5123744 - DNA, 23 bp, Homo sapiens
aattagtgaccattattcacagg

SEQ ID NO: 5123745 - DNA, 16 bp, Homo sapiens
aattagtgagattaaa

SEQ ID NO: 5123746 - DNA, 15 bp, Homo sapiens
aattagtgccactta

SEQ ID NO: 5123747 - DNA, 20 bp, Homo sapiens
aattagtgccacttaatgta

SEQ ID NO: 5123748 - DNA, 18 bp, Homo sapiens
aattagtgctaagtgtga

SEQ ID NO: 5123749 - DNA, 21 bp, Homo sapiens
aattagtgctaagtgtgaact

SEQ ID NO: 5123750 - DNA, 23 bp, Homo sapiens
aattagtggatttttttgtcatt

SEQ ID NO: 5123751 - DNA, 18 bp, Homo sapiens
aattagtggtcataaaat

SEQ ID NO: 5123752 - DNA, 22 bp, Homo sapiens
aattagtgtccaactccaagtg

SEQ ID NO: 5123753 - DNA, 20 bp, Homo sapiens
aattagtgtgacagtttcca

SEQ ID NO: 5123754 - DNA, 21 bp, Homo sapiens
aattagtgtgacagtttccaa

SEQ ID NO: 5123755 - DNA, 15 bp, Homo sapiens
aattagtgttttcat

SEQ ID NO: 5123756 - DNA, 23 bp, Homo sapiens
aattagttatgacagccatttgt

SEQ ID NO: 5123757 - DNA, 12 bp, Homo sapiens
aattagttcagc

SEQ ID NO: 5123758 - DNA, 14 bp, Homo sapiens
aattagttgcattg

SEQ ID NO: 5123759 - DNA, 19 bp, Homo sapiens
aattagttggtttgtgtga

SEQ ID NO: 5123760 - DNA, 21 bp, Homo sapiens
aattagttgtgtactctggcc

SEQ ID NO: 5123761 - DNA, 16 bp, Homo sapiens
aattagtttaaaatga

SEQ ID NO: 5123762 - DNA, 21 bp, Homo sapiens
aattagtttaaaatgaagcaa

SEQ ID NO: 5123763 - DNA, 16 bp, Homo sapiens
aattagtttacctcat

SEQ ID NO: 5123764 - DNA, 20 bp, Homo sapiens
aattagtttatattactctc

SEQ ID NO: 5123765 - DNA, 13 bp, Homo sapiens
aattagtttcctt

SEQ ID NO: 5123766 - DNA, 14 bp, Homo sapiens
aattagtttccttt

SEQ ID NO: 5123767 - DNA, 15 bp, Homo sapiens
aattagtttgacact

SEQ ID NO: 5123768 - DNA, 22 bp, Homo sapiens
aattagtttgttatagttgaag

SEQ ID NO: 5123769 - DNA, 17 bp, Homo sapiens
aattagttttatatgct

SEQ ID NO: 5123770 - DNA, 15 bp, Homo sapiens
aattataaaaaatta

SEQ ID NO: 5123771 - DNA, 16 bp, Homo sapiens
aattataaaaaattaa

SEQ ID NO: 5123772 - DNA, 19 bp, Homo sapiens
aattataaaattgaaaaca

SEQ ID NO: 5123773 - DNA, 20 bp, Homo sapiens
aattataaaattgaaaacac

SEQ ID NO: 5123774 - DNA, 14 bp, Homo sapiens
aattataaacagca

SEQ ID NO: 5123775 - DNA, 18 bp, Homo sapiens
aattataaacagcagggt

SEQ ID NO: 5123776 - DNA, 15 bp, Homo sapiens
aattataaactttta

SEQ ID NO: 5123777 - DNA, 14 bp, Homo sapiens
aattataaatgttt

SEQ ID NO: 5123778 - DNA, 23 bp, Homo sapiens
aattataacagttatatttttgt

SEQ ID NO: 5123779 - DNA, 17 bp, Homo sapiens
aattataactagacatc

SEQ ID NO: 5123780 - DNA, 13 bp, Homo sapiens
aattataactatt

SEQ ID NO: 5123781 - DNA, 17 bp, Homo sapiens
aattataactattacag

SEQ ID NO: 5123782 - DNA, 20 bp, Homo sapiens
aattataactgtaaagatgt

SEQ ID NO: 5123783 - DNA, 23 bp, Homo sapiens
aattataacttaaaatattttat

SEQ ID NO: 5123784 - DNA, 15 bp, Homo sapiens
aattataagatgtca

SEQ ID NO: 5123785 - DNA, 16 bp, Homo sapiens
aattataaggactgca

SEQ ID NO: 5123786 - DNA, 17 bp, Homo sapiens
aattataaggactgcat

SEQ ID NO: 5123787 - DNA, 17 bp, Homo sapiens
aattataataaaggtca

SEQ ID NO: 5123788 - DNA, 20 bp, Homo sapiens
aattataatctcatttcaat

SEQ ID NO: 5123789 - DNA, 21 bp, Homo sapiens
aattatacagacctaatatca

SEQ ID NO: 5123790 - DNA, 23 bp, Homo sapiens
aattataccagtgttaagtgaca

SEQ ID NO: 5123791 - DNA, 18 bp, Homo sapiens
aattatacgtacatacac

SEQ ID NO: 5123792 - DNA, 17 bp, Homo sapiens
aattatactttgttgtt

SEQ ID NO: 5123793 - DNA, 19 bp, Homo sapiens
aattatagagcctcaattt

SEQ ID NO: 5123794 - DNA, 21 bp, Homo sapiens
aattatagagcctcaattttg

SEQ ID NO: 5123795 - DNA, 17 bp, Homo sapiens
aattatagctctaatgt

SEQ ID NO: 5123796 - DNA, 18 bp, Homo sapiens
aattataggaagttcttt

SEQ ID NO: 5123797 - DNA, 21 bp, Homo sapiens
aattataggagccttaatttt

SEQ ID NO: 5123798 - DNA, 14 bp, Homo sapiens
aattatagtagctt

SEQ ID NO: 5123799 - DNA, 22 bp, Homo sapiens
aattatagtgatgtaatcttga

SEQ ID NO: 5123800 - DNA, 13 bp, Homo sapiens
aattatagtttca

SEQ ID NO: 5123801 - DNA, 21 bp, Homo sapiens
aattatagtttctgaggcttt

SEQ ID NO: 5123802 - DNA, 16 bp, Homo sapiens
aattatagtttgacag

SEQ ID NO: 5123803 - DNA, 18 bp, Homo sapiens
aattatagtttgacaggg

SEQ ID NO: 5123804 - DNA, 19 bp, Homo sapiens
aattatataactgtatttg

SEQ ID NO: 5123805 - DNA, 16 bp, Homo sapiens
aattatataagtattc

SEQ ID NO: 5123806 - DNA, 14 bp, Homo sapiens
aattatataatttt

SEQ ID NO: 5123807 - DNA, 17 bp, Homo sapiens
aattatatatttctaac

SEQ ID NO: 5123808 - DNA, 11 bp, Homo sapiens
aattatatcta

SEQ ID NO: 5123809 - DNA, 13 bp, Homo sapiens
aattatatctaat

SEQ ID NO: 5123810 - DNA, 17 bp, Homo sapiens
aattatatctaatttat

SEQ ID NO: 5123811 - DNA, 23 bp, Homo sapiens
aattatatctgaggaattctgta

SEQ ID NO: 5123812 - DNA, 21 bp, Homo sapiens
aattatatctgtggtcttcaa

SEQ ID NO: 5123813 - DNA, 13 bp, Homo sapiens
aattatatctgtt

SEQ ID NO: 5123814 - DNA, 19 bp, Homo sapiens
aattatatgaagcagaatg

SEQ ID NO: 5123815 - DNA, 15 bp, Homo sapiens
aattatatgatatgc

SEQ ID NO: 5123816 - DNA, 16 bp, Homo sapiens
aattatatgatatgca

SEQ ID NO: 5123817 - DNA, 16 bp, Homo sapiens
aattatatgtatattg

SEQ ID NO: 5123818 - DNA, 15 bp, Homo sapiens
aattatattatgaat

SEQ ID NO: 5123819 - DNA, 19 bp, Homo sapiens
aattatattcaatgcattt

SEQ ID NO: 5123820 - DNA, 21 bp, Homo sapiens
aattatattgttagtggactt

SEQ ID NO: 5123821 - DNA, 12 bp, Homo sapiens
aattatatttct

SEQ ID NO: 5123822 - DNA, 23 bp, Homo sapiens
aattatatttgtgctatagtatt

SEQ ID NO: 5123823 - DNA, 14 bp, Homo sapiens
aattatattttgaa

SEQ ID NO: 5123824 - DNA, 22 bp, Homo sapiens
aattatatttttgtaaatagta

SEQ ID NO: 5123825 - DNA, 15 bp, Homo sapiens
aattatcaaaaagct

SEQ ID NO: 5123826 - DNA, 15 bp, Homo sapiens
aattatcaagctaat

SEQ ID NO: 5123827 - DNA, 19 bp, Homo sapiens
aattatcaagctaataaaa

SEQ ID NO: 5123828 - DNA, 19 bp, Homo sapiens
aattatcaagtctgttttg

SEQ ID NO: 5123829 - DNA, 20 bp, Homo sapiens
aattatcaatatctaatata

SEQ ID NO: 5123830 - DNA, 16 bp, Homo sapiens
aattatcagcaaagaa

SEQ ID NO: 5123831 - DNA, 20 bp, Homo sapiens
aattatcagcaaagaaaaaa

SEQ ID NO: 5123832 - DNA, 21 bp, Homo sapiens
aattatcagttatattttgct

SEQ ID NO: 5123833 - DNA, 18 bp, Homo sapiens
aattatcatgcgttttat

SEQ ID NO: 5123834 - DNA, 16 bp, Homo sapiens
aattatcatgggaaaa

SEQ ID NO: 5123835 - DNA, 15 bp, Homo sapiens
aattatcattgtttg

SEQ ID NO: 5123836 - DNA, 15 bp, Homo sapiens
aattatccagagttt

SEQ ID NO: 5123837 - DNA, 17 bp, Homo sapiens
aattatccattacgtgc

SEQ ID NO: 5123838 - DNA, 15 bp, Homo sapiens
aattatcccttttct

SEQ ID NO: 5123839 - DNA, 16 bp, Homo sapiens
aattatcctctttgta

SEQ ID NO: 5123840 - DNA, 21 bp, Homo sapiens
aattatcctgaactcttctgc

SEQ ID NO: 5123841 - DNA, 17 bp, Homo sapiens
aattatcgggaacagtg

SEQ ID NO: 5123842 - DNA, 19 bp, Homo sapiens
aattatcgggaacagtgtt

SEQ ID NO: 5123843 - DNA, 23 bp, Homo sapiens
aattatcgggaacagtgtttccc

SEQ ID NO: 5123844 - DNA, 15 bp, Homo sapiens
aattatctatagcta

SEQ ID NO: 5123845 - DNA, 23 bp, Homo sapiens
aattatctatagctaagtacaca

SEQ ID NO: 5123846 - DNA, 12 bp, Homo sapiens
aattatctattt

SEQ ID NO: 5123847 - DNA, 14 bp, Homo sapiens
aattatctcaagta

SEQ ID NO: 5123848 - DNA, 17 bp, Homo sapiens
aattatctcaagtaaaa

SEQ ID NO: 5123849 - DNA, 13 bp, Homo sapiens
aattatctgaata

SEQ ID NO: 5123850 - DNA, 17 bp, Homo sapiens
aattatctgaatattag

SEQ ID NO: 5123851 - DNA, 21 bp, Homo sapiens
aattatctgaatattagatgc

SEQ ID NO: 5123852 - DNA, 15 bp, Homo sapiens
aattatctgcattta

SEQ ID NO: 5123853 - DNA, 15 bp, Homo sapiens
aattatctgggcatg

SEQ ID NO: 5123854 - DNA, 14 bp, Homo sapiens
aattatctgttcta

SEQ ID NO: 5123855 - DNA, 23 bp, Homo sapiens
aattatcttatctactgactgaa

SEQ ID NO: 5123856 - DNA, 16 bp, Homo sapiens
aattatcttatttaat

SEQ ID NO: 5123857 - DNA, 19 bp, Homo sapiens
aattatcttgatacattca

SEQ ID NO: 5123858 - DNA, 14 bp, Homo sapiens
aattatcttggaaa

SEQ ID NO: 5123859 - DNA, 17 bp, Homo sapiens
aattttaagaaggcatt

SEQ ID NO: 5123860 - DNA, 20 bp, Homo sapiens
aattttaagcctttgttgaa

SEQ ID NO: 5123861 - DNA, 23 bp, Homo sapiens
aattttaagcctttgttgaactg

SEQ ID NO: 5123862 - DNA, 23 bp, Homo sapiens
aattttaagctaggaaaagaaat

SEQ ID NO: 5123863 - DNA, 17 bp, Homo sapiens
aattttaagttatttta

SEQ ID NO: 5123864 - DNA, 13 bp, Homo sapiens
aattttaagttct

SEQ ID NO: 5123865 - DNA, 16 bp, Homo sapiens
aattttaatattttat

SEQ ID NO: 5123866 - DNA, 22 bp, Homo sapiens
aattttaatccacagtatgtta

SEQ ID NO: 5123867 - DNA, 18 bp, Homo sapiens
aattttaatgatggtgtt

SEQ ID NO: 5123868 - DNA, 14 bp, Homo sapiens
aattttaatgctgt

SEQ ID NO: 5123869 - DNA, 19 bp, Homo sapiens
aattttaatgctgtttcta

SEQ ID NO: 5123870 - DNA, 21 bp, Homo sapiens
aattttaatgctgtttctaag

SEQ ID NO: 5123871 - DNA, 14 bp, Homo sapiens
aattttaatgtgaa

SEQ ID NO: 5123872 - DNA, 22 bp, Homo sapiens
aattttaatgtgaagacatttt

SEQ ID NO: 5123873 - DNA, 23 bp, Homo sapiens
aattttaatgttaactttcaaat

SEQ ID NO: 5123874 - DNA, 18 bp, Homo sapiens
aattttaattcaagaaat

SEQ ID NO: 5123875 - DNA, 23 bp, Homo sapiens
aattttacaataaactttttgaa

SEQ ID NO: 5123876 - DNA, 13 bp, Homo sapiens
aattttacacatt

SEQ ID NO: 5123877 - DNA, 19 bp, Homo sapiens
aattttacacgcttttgtg

SEQ ID NO: 5123878 - DNA, 12 bp, Homo sapiens
aattttacattt

SEQ ID NO: 5123879 - DNA, 23 bp, Homo sapiens
aattttaccaagttatataaaga

SEQ ID NO: 5123880 - DNA, 18 bp, Homo sapiens
aattttacctattctgaa

SEQ ID NO: 5123881 - DNA, 22 bp, Homo sapiens
aattttacgacctgtctgttct

SEQ ID NO: 5123882 - DNA, 18 bp, Homo sapiens
aattttactgacagaaat

SEQ ID NO: 5123883 - DNA, 19 bp, Homo sapiens
aattttactgacagaaatg

SEQ ID NO: 5123884 - DNA, 23 bp, Homo sapiens
aattttactgtgaaaaaaaattt

SEQ ID NO: 5123885 - DNA, 21 bp, Homo sapiens
aattttacttttgttctgtat

SEQ ID NO: 5123886 - DNA, 15 bp, Homo sapiens
aattttactttttat

SEQ ID NO: 5123887 - DNA, 20 bp, Homo sapiens
aattttactttttatttcta

SEQ ID NO: 5123888 - DNA, 14 bp, Homo sapiens
aattttagaaagaa

SEQ ID NO: 5123889 - DNA, 15 bp, Homo sapiens
aattttagaaagaaa

SEQ ID NO: 5123890 - DNA, 21 bp, Homo sapiens
aattttagaaagaaaattata

SEQ ID NO: 5123891 - DNA, 16 bp, Homo sapiens
aattttagaaatattc

SEQ ID NO: 5123892 - DNA, 13 bp, Homo sapiens
aattttagaactt

SEQ ID NO: 5123893 - DNA, 15 bp, Homo sapiens
aattttagaacttta

SEQ ID NO: 5123894 - DNA, 14 bp, Homo sapiens
aattttagagcata

SEQ ID NO: 5123895 - DNA, 15 bp, Homo sapiens
aattttagagcatac

SEQ ID NO: 5123896 - DNA, 14 bp, Homo sapiens
aattttagatatta

SEQ ID NO: 5123897 - DNA, 19 bp, Homo sapiens
aattttagtagagacaggg

SEQ ID NO: 5123898 - DNA, 23 bp, Homo sapiens
aattttagtgacagctctgcctg

SEQ ID NO: 5123899 - DNA, 21 bp, Homo sapiens
aattttagtgtgccttccaaa

SEQ ID NO: 5123900 - DNA, 16 bp, Homo sapiens
aattttagtttttcat

SEQ ID NO: 5123901 - DNA, 15 bp, Homo sapiens
aattttataaacaaa

SEQ ID NO: 5123902 - DNA, 21 bp, Homo sapiens
aattttataaggctgactctt

SEQ ID NO: 5123903 - DNA, 15 bp, Homo sapiens
aattttataatctgc

SEQ ID NO: 5123904 - DNA, 19 bp, Homo sapiens
aattttatagtagtgggaa

SEQ ID NO: 5123905 - DNA, 13 bp, Homo sapiens
aattttatattct

SEQ ID NO: 5123906 - DNA, 14 bp, Homo sapiens
aattttatccctca

SEQ ID NO: 5123907 - DNA, 23 bp, Homo sapiens
aattttatctgtataagctgtaa

SEQ ID NO: 5123908 - DNA, 12 bp, Homo sapiens
aattttatgaac

SEQ ID NO: 5123909 - DNA, 20 bp, Homo sapiens
aattttatgaactgcatgta

SEQ ID NO: 5123910 - DNA, 18 bp, Homo sapiens
aattttatggcactattt

SEQ ID NO: 5123911 - DNA, 14 bp, Homo sapiens
aattttatgtgtta

SEQ ID NO: 5123912 - DNA, 21 bp, Homo sapiens
aattttattaaacaattttgt

SEQ ID NO: 5123913 - DNA, 13 bp, Homo sapiens
aattttattatag

SEQ ID NO: 5123914 - DNA, 12 bp, Homo sapiens
aattttattcct

SEQ ID NO: 5123915 - DNA, 11 bp, Homo sapiens
aattttattga

SEQ ID NO: 5123916 - DNA, 23 bp, Homo sapiens
aattttattggtaggatttatat

SEQ ID NO: 5123917 - DNA, 22 bp, Homo sapiens
aattttattttaaaatttcata

SEQ ID NO: 5123918 - DNA, 23 bp, Homo sapiens
aattttattttgtgctcatttaa

SEQ ID NO: 5123919 - DNA, 14 bp, Homo sapiens
aattttatttttct

SEQ ID NO: 5123920 - DNA, 16 bp, Homo sapiens
aattttatttttctgt

SEQ ID NO: 5123921 - DNA, 15 bp, Homo sapiens
aattttcaagagaag

SEQ ID NO: 5123922 - DNA, 20 bp, Homo sapiens
aattttcaagagaagaaaaa

SEQ ID NO: 5123923 - DNA, 19 bp, Homo sapiens
aattttcaagcatctcctg

SEQ ID NO: 5123924 - DNA, 17 bp, Homo sapiens
aattttcaaggccttca

SEQ ID NO: 5123925 - DNA, 12 bp, Homo sapiens
aattttcacaaa

SEQ ID NO: 5123926 - DNA, 14 bp, Homo sapiens
aattttcacatgaa

SEQ ID NO: 5123927 - DNA, 17 bp, Homo sapiens
aattttcacatgaacat

SEQ ID NO: 5123928 - DNA, 21 bp, Homo sapiens
aattttcacatgaacatactg

SEQ ID NO: 5123929 - DNA, 13 bp, Homo sapiens
aattttcactgct

SEQ ID NO: 5123930 - DNA, 18 bp, Homo sapiens
aattttcacttttggcaa

SEQ ID NO: 5123931 - DNA, 20 bp, Homo sapiens
aattttcagaattaatgcat

SEQ ID NO: 5123932 - DNA, 16 bp, Homo sapiens
aattttcagagacttt

SEQ ID NO: 5123933 - DNA, 15 bp, Homo sapiens
aattttcatattaaa

SEQ ID NO: 5123934 - DNA, 18 bp, Homo sapiens
aattttcatctaggattt

SEQ ID NO: 5123935 - DNA, 17 bp, Homo sapiens
aattttcattggatgca

SEQ ID NO: 5123936 - DNA, 18 bp, Homo sapiens
aattttccaagtaaagtg

SEQ ID NO: 5123937 - DNA, 23 bp, Homo sapiens
aattttccacgcagttctttcca

SEQ ID NO: 5123938 - DNA, 20 bp, Homo sapiens
aattttccattaatttcaac

SEQ ID NO: 5123939 - DNA, 15 bp, Homo sapiens
aattttccatttatt

SEQ ID NO: 5123940 - DNA, 19 bp, Homo sapiens
aattttcctaataaagttc

SEQ ID NO: 5123941 - DNA, 18 bp, Homo sapiens
aattttcctcaatcacac

SEQ ID NO: 5123942 - DNA, 19 bp, Homo sapiens
aattttcctcctaaacaaa

SEQ ID NO: 5123943 - DNA, 20 bp, Homo sapiens
aattttcctctaattaaaat

SEQ ID NO: 5123944 - DNA, 23 bp, Homo sapiens
aattttcctgtcctctttcagct

SEQ ID NO: 5123945 - DNA, 13 bp, Homo sapiens
aattttcctgtga

SEQ ID NO: 5123946 - DNA, 22 bp, Homo sapiens
aattttcctgtggaataaagat

SEQ ID NO: 5123947 - DNA, 20 bp, Homo sapiens
aattttccttcagatatttt

SEQ ID NO: 5123948 - DNA, 14 bp, Homo sapiens
aattttccttgaag

SEQ ID NO: 5123949 - DNA, 17 bp, Homo sapiens
aattttccttgaagccg

SEQ ID NO: 5123950 - DNA, 15 bp, Homo sapiens
aattttctaaaagct

SEQ ID NO: 5123951 - DNA, 16 bp, Homo sapiens
aattttctaaaagctt

SEQ ID NO: 5123952 - DNA, 21 bp, Homo sapiens
aattttctaaaagctttcatg

SEQ ID NO: 5123953 - DNA, 14 bp, Homo sapiens
aattttctaagaca

SEQ ID NO: 5123954 - DNA, 23 bp, Homo sapiens
aattttctaagacagtttttata

SEQ ID NO: 5123955 - DNA, 18 bp, Homo sapiens
aattttctagactttctg

SEQ ID NO: 5123956 - DNA, 13 bp, Homo sapiens
aattttctatgtg

SEQ ID NO: 5123957 - DNA, 13 bp, Homo sapiens
aattttctccctt

SEQ ID NO: 5123958 - DNA, 17 bp, Homo sapiens
aattttctctaaactgt

SEQ ID NO: 5123959 - DNA, 22 bp, Homo sapiens
aattttctctaaactgtttctt

SEQ ID NO: 5123960 - DNA, 20 bp, Homo sapiens
aattttctgcagctgtttca

SEQ ID NO: 5123961 - DNA, 22 bp, Homo sapiens
aattttctggaatacatgaaat

SEQ ID NO: 5123962 - DNA, 21 bp, Homo sapiens
aattttctgtgttctgaagtc

SEQ ID NO: 5123963 - DNA, 14 bp, Homo sapiens
aattttcttcagtt

SEQ ID NO: 5123964 - DNA, 22 bp, Homo sapiens
aattttcttcatgcaatgacat

SEQ ID NO: 5123965 - DNA, 12 bp, Homo sapiens
aattttcttctt

SEQ ID NO: 5123966 - DNA, 19 bp, Homo sapiens
aattttctttcatacatta

SEQ ID NO: 5123967 - DNA, 22 bp, Homo sapiens
aattttgaaaagtaatatttat

SEQ ID NO: 5123968 - DNA, 22 bp, Homo sapiens
aattttgaaatgattcatcttt

SEQ ID NO: 5123969 - DNA, 21 bp, Homo sapiens
aattttgaataaataaatgta

SEQ ID NO: 5123970 - DNA, 16 bp, Homo sapiens
aattttgacactatat

SEQ ID NO: 5123971 - DNA, 16 bp, Homo sapiens
aattttgagattaaga

SEQ ID NO: 5123972 - DNA, 15 bp, Homo sapiens
aattttgaggtcttt

SEQ ID NO: 5123973 - DNA, 17 bp, Homo sapiens
aattttgaggtctttta

SEQ ID NO: 5123974 - DNA, 17 bp, Homo sapiens
aattttgagtacagaat

SEQ ID NO: 5123975 - DNA, 17 bp, Homo sapiens
aattttgagttgccaca

SEQ ID NO: 5123976 - DNA, 11 bp, Homo sapiens
aattttgatat

SEQ ID NO: 5123977 - DNA, 17 bp, Homo sapiens
aattttgatctttttat

SEQ ID NO: 5123978 - DNA, 14 bp, Homo sapiens
aattttgatgtttt

SEQ ID NO: 5123979 - DNA, 20 bp, Homo sapiens
aattttgcaaatataaacat

SEQ ID NO: 5123980 - DNA, 18 bp, Homo sapiens
aattttgcaaatctgtta

SEQ ID NO: 5123981 - DNA, 15 bp, Homo sapiens
aattttgcagcagaa

SEQ ID NO: 5123982 - DNA, 18 bp, Homo sapiens
aattttgcagcagaagcc

SEQ ID NO: 5123983 - DNA, 11 bp, Homo sapiens
aattttgcata

SEQ ID NO: 5123984 - DNA, 18 bp, Homo sapiens
aattttgcatactgaaaa

SEQ ID NO: 5123985 - DNA, 19 bp, Homo sapiens
aattttgcatactgaaaat

SEQ ID NO: 5123986 - DNA, 22 bp, Homo sapiens
aattttgcatattctctatttt

SEQ ID NO: 5123987 - DNA, 15 bp, Homo sapiens
aattttgcatttagt

SEQ ID NO: 5123988 - DNA, 17 bp, Homo sapiens
aattttgctaactgggt

SEQ ID NO: 5123989 - DNA, 22 bp, Homo sapiens
aattttgctggaattcctaact

SEQ ID NO: 5123990 - DNA, 18 bp, Homo sapiens
aattttgcttttaattaa

SEQ ID NO: 5123991 - DNA, 11 bp, Homo sapiens
aattttggaat

SEQ ID NO: 5123992 - DNA, 19 bp, Homo sapiens
aattttggaataatttcta

SEQ ID NO: 5123993 - DNA, 12 bp, Homo sapiens
aattttggaatt

SEQ ID NO: 5123994 - DNA, 12 bp, Homo sapiens
aattttggattt

SEQ ID NO: 5123995 - DNA, 23 bp, Homo sapiens
aattttggccctacctgtaactt

SEQ ID NO: 5123996 - DNA, 13 bp, Homo sapiens
aattttggtaaat

SEQ ID NO: 5123997 - DNA, 21 bp, Homo sapiens
aattttggtgatgtaaaacag

SEQ ID NO: 5123998 - DNA, 18 bp, Homo sapiens
aattttggttgtattctt

SEQ ID NO: 5123999 - DNA, 23 bp, Homo sapiens
aattttggttgtattctttgatg

SEQ ID NO: 5124000 - DNA, 17 bp, Homo sapiens
aattttggttttctact

SEQ ID NO: 5124001 - DNA, 16 bp, Homo sapiens
aattttggtttttcaa

SEQ ID NO: 5124002 - DNA, 18 bp, Homo sapiens
aattttgtaaaacaatgc

SEQ ID NO: 5124003 - DNA, 19 bp, Homo sapiens
aattttgtaaaacaatgcc

SEQ ID NO: 5124004 - DNA, 20 bp, Homo sapiens
aattttgtaaaacaatgcca

SEQ ID NO: 5124005 - DNA, 17 bp, Homo sapiens
aattttgtaaaggtgaa

SEQ ID NO: 5124006 - DNA, 12 bp, Homo sapiens
aattttgtaaga

SEQ ID NO: 5124007 - DNA, 14 bp, Homo sapiens
aattttgtaagtat

SEQ ID NO: 5124008 - DNA, 13 bp, Homo sapiens
aattttgtaatga

SEQ ID NO: 5124009 - DNA, 12 bp, Homo sapiens
aattttgtaatt

SEQ ID NO: 5124010 - DNA, 14 bp, Homo sapiens
aattttgtacatac

SEQ ID NO: 5124011 - DNA, 22 bp, Homo sapiens
aattttgtacatactgtatttt

SEQ ID NO: 5124012 - DNA, 16 bp, Homo sapiens
aattttgtatgccaat

SEQ ID NO: 5124013 - DNA, 13 bp, Homo sapiens
aattttgtatgtc

SEQ ID NO: 5124014 - DNA, 22 bp, Homo sapiens
aattttgtatgtcaataacttt

SEQ ID NO: 5124015 - DNA, 20 bp, Homo sapiens
aattttgtattaatttctga

SEQ ID NO: 5124016 - DNA, 12 bp, Homo sapiens
aattttgtattt

SEQ ID NO: 5124017 - DNA, 11 bp, Homo sapiens
aattttgtcac

SEQ ID NO: 5124018 - DNA, 15 bp, Homo sapiens
aattttgtcctaata

SEQ ID NO: 5124019 - DNA, 23 bp, Homo sapiens
aattttgtcctaatatatacata

SEQ ID NO: 5124020 - DNA, 14 bp, Homo sapiens
aattttgtcctttc

SEQ ID NO: 5124021 - DNA, 20 bp, Homo sapiens
aattttgtctattaaagata

SEQ ID NO: 5124022 - DNA, 18 bp, Homo sapiens
aattttgtcttaagtgtt

SEQ ID NO: 5124023 - DNA, 19 bp, Homo sapiens
aattttgtcttaagtgttt

SEQ ID NO: 5124024 - DNA, 13 bp, Homo sapiens
aattttgtgcaaa

SEQ ID NO: 5124025 - DNA, 17 bp, Homo sapiens
aattttgtgcaaaaagg

SEQ ID NO: 5124026 - DNA, 18 bp, Homo sapiens
aattttgtgcaaaaagga

SEQ ID NO: 5124027 - DNA, 15 bp, Homo sapiens
aattttgtgcattct

SEQ ID NO: 5124028 - DNA, 17 bp, Homo sapiens
aattttgtgcattcttt

SEQ ID NO: 5124029 - DNA, 21 bp, Homo sapiens
aattttgtgcattctttggta

SEQ ID NO: 5124030 - DNA, 16 bp, Homo sapiens
aattttgtgcccccat

SEQ ID NO: 5124031 - DNA, 22 bp, Homo sapiens
aattttgtgtaagaaatacaga

SEQ ID NO: 5124032 - DNA, 20 bp, Homo sapiens
aattttgttaagaatttcaa

SEQ ID NO: 5124033 - DNA, 12 bp, Homo sapiens
aattttgttcct

SEQ ID NO: 5124034 - DNA, 13 bp, Homo sapiens
aattttgttcctg

SEQ ID NO: 5124035 - DNA, 15 bp, Homo sapiens
aattttgttctctgg

SEQ ID NO: 5124036 - DNA, 17 bp, Homo sapiens
aattttgttctctggga

SEQ ID NO: 5124037 - DNA, 21 bp, Homo sapiens
aattttgttctctgggagaaa

SEQ ID NO: 5124038 - DNA, 16 bp, Homo sapiens
aattatctttaaaact

SEQ ID NO: 5124039 - DNA, 15 bp, Homo sapiens
aattatctttagttg

SEQ ID NO: 5124040 - DNA, 23 bp, Homo sapiens
aattatgaaaaaatgttcaaatt

SEQ ID NO: 5124041 - DNA, 20 bp, Homo sapiens
aattatgaaaatgtaagtta

SEQ ID NO: 5124042 - DNA, 20 bp, Homo sapiens
aattatgaaactaatcttaa

SEQ ID NO: 5124043 - DNA, 13 bp, Homo sapiens
aattatgaaactt

SEQ ID NO: 5124044 - DNA, 21 bp, Homo sapiens
aattatgaagctcatatcctt

SEQ ID NO: 5124045 - DNA, 12 bp, Homo sapiens
aattatgaatga

SEQ ID NO: 5124046 - DNA, 12 bp, Homo sapiens
aattatgacaat

SEQ ID NO: 5124047 - DNA, 23 bp, Homo sapiens
aattatgacgtgcacaaaccttc

SEQ ID NO: 5124048 - DNA, 17 bp, Homo sapiens
aattatgagattggttt

SEQ ID NO: 5124049 - DNA, 22 bp, Homo sapiens
aattatgatggaagacaggaaa

SEQ ID NO: 5124050 - DNA, 13 bp, Homo sapiens
aattatgatttgg

SEQ ID NO: 5124051 - DNA, 18 bp, Homo sapiens
aattatgcactaaatatg

SEQ ID NO: 5124052 - DNA, 19 bp, Homo sapiens
aattatgccttttttgatc

SEQ ID NO: 5124053 - DNA, 17 bp, Homo sapiens
aattatgctaacaaact

SEQ ID NO: 5124054 - DNA, 23 bp, Homo sapiens
aattatggatacgtgttttgaat

SEQ ID NO: 5124055 - DNA, 15 bp, Homo sapiens
aattatggcatttct

SEQ ID NO: 5124056 - DNA, 21 bp, Homo sapiens
aattatggcccagggggctaa

SEQ ID NO: 5124057 - DNA, 13 bp, Homo sapiens
aattatgggaaac

SEQ ID NO: 5124058 - DNA, 20 bp, Homo sapiens
aattatgggaacaagtgtac

SEQ ID NO: 5124059 - DNA, 22 bp, Homo sapiens
aattatgggaataattgctttt

SEQ ID NO: 5124060 - DNA, 23 bp, Homo sapiens
aattatggtctggggtaaaattg

SEQ ID NO: 5124061 - DNA, 14 bp, Homo sapiens
aattatgtaaataa

SEQ ID NO: 5124062 - DNA, 17 bp, Homo sapiens
aattatgtaaattatca

SEQ ID NO: 5124063 - DNA, 20 bp, Homo sapiens
aattatgtaatatattgtac

SEQ ID NO: 5124064 - DNA, 13 bp, Homo sapiens
aattatgtaccat

SEQ ID NO: 5124065 - DNA, 16 bp, Homo sapiens
aattatgtagctcttt

SEQ ID NO: 5124066 - DNA, 14 bp, Homo sapiens
aattatgtataaac

SEQ ID NO: 5124067 - DNA, 15 bp, Homo sapiens
aattatgtatgttta

SEQ ID NO: 5124068 - DNA, 16 bp, Homo sapiens
aattatgtatgtttac

SEQ ID NO: 5124069 - DNA, 19 bp, Homo sapiens
aattatgtcaaatggatgt

SEQ ID NO: 5124070 - DNA, 16 bp, Homo sapiens
aattatgtgaaatgct

SEQ ID NO: 5124071 - DNA, 19 bp, Homo sapiens
aattatgtgacaacctttg

SEQ ID NO: 5124072 - DNA, 22 bp, Homo sapiens
aattatgtgacattttacatta

SEQ ID NO: 5124073 - DNA, 20 bp, Homo sapiens
aattatgtgtagttataaac

SEQ ID NO: 5124074 - DNA, 15 bp, Homo sapiens
aattatgttaaacta

SEQ ID NO: 5124075 - DNA, 19 bp, Homo sapiens
aattatgttaaactagcat

SEQ ID NO: 5124076 - DNA, 14 bp, Homo sapiens
aattatgttactgt

SEQ ID NO: 5124077 - DNA, 16 bp, Homo sapiens
aattatgttattgaaa

SEQ ID NO: 5124078 - DNA, 17 bp, Homo sapiens
aattatgttattgaaaa

SEQ ID NO: 5124079 - DNA, 19 bp, Homo sapiens
aattatgttgaaaagagta

SEQ ID NO: 5124080 - DNA, 14 bp, Homo sapiens
aattatgtttacct

SEQ ID NO: 5124081 - DNA, 14 bp, Homo sapiens
aattatgtttatat

SEQ ID NO: 5124082 - DNA, 18 bp, Homo sapiens
aattatgtttatataaat

SEQ ID NO: 5124083 - DNA, 22 bp, Homo sapiens
aattatgtttgaaaataggatt

SEQ ID NO: 5124084 - DNA, 18 bp, Homo sapiens
aattatgttttaaacaca

SEQ ID NO: 5124085 - DNA, 22 bp, Homo sapiens
aattatgtttttattaagatta

SEQ ID NO: 5124086 - DNA, 17 bp, Homo sapiens
aattattaaaaattata

SEQ ID NO: 5124087 - DNA, 19 bp, Homo sapiens
aattattaataccaaatat

SEQ ID NO: 5124088 - DNA, 19 bp, Homo sapiens
aattattacactgtaagaa

SEQ ID NO: 5124089 - DNA, 14 bp, Homo sapiens
aattattacagtgt

SEQ ID NO: 5124090 - DNA, 23 bp, Homo sapiens
aattattacagtgtttatccttt

SEQ ID NO: 5124091 - DNA, 15 bp, Homo sapiens
aattattacatcttt

SEQ ID NO: 5124092 - DNA, 19 bp, Homo sapiens
aattattacatctttatta

SEQ ID NO: 5124093 - DNA, 21 bp, Homo sapiens
aattattagaacattcacttt

SEQ ID NO: 5124094 - DNA, 14 bp, Homo sapiens
aattattagcattt

SEQ ID NO: 5124095 - DNA, 20 bp, Homo sapiens
aattattagtttacatcatt

SEQ ID NO: 5124096 - DNA, 20 bp, Homo sapiens
aattattatgtctcaaaata

SEQ ID NO: 5124097 - DNA, 20 bp, Homo sapiens
aattattattattattttcc

SEQ ID NO: 5124098 - DNA, 13 bp, Homo sapiens
aattattattctt

SEQ ID NO: 5124099 - DNA, 21 bp, Homo sapiens
aattattattcttcataacaa

SEQ ID NO: 5124100 - DNA, 13 bp, Homo sapiens
aattattatttat

SEQ ID NO: 5124101 - DNA, 21 bp, Homo sapiens
aattattatttatatatgtat

SEQ ID NO: 5124102 - DNA, 22 bp, Homo sapiens
aattattatttatatatgtatt

SEQ ID NO: 5124103 - DNA, 12 bp, Homo sapiens
aattattatttg

SEQ ID NO: 5124104 - DNA, 16 bp, Homo sapiens
aattattatttggccc

SEQ ID NO: 5124105 - DNA, 14 bp, Homo sapiens
aattattcaattta

SEQ ID NO: 5124106 - DNA, 15 bp, Homo sapiens
aattattcagtgaat

SEQ ID NO: 5124107 - DNA, 17 bp, Homo sapiens
aattattccaaaccaaa

SEQ ID NO: 5124108 - DNA, 12 bp, Homo sapiens
aattattcccat

SEQ ID NO: 5124109 - DNA, 12 bp, Homo sapiens
aattattctagt

SEQ ID NO: 5124110 - DNA, 14 bp, Homo sapiens
aattattctagtca

SEQ ID NO: 5124111 - DNA, 18 bp, Homo sapiens
aattattctagtcaactg

SEQ ID NO: 5124112 - DNA, 20 bp, Homo sapiens
aattattctataatttccat

SEQ ID NO: 5124113 - DNA, 16 bp, Homo sapiens
aattattctgattctt

SEQ ID NO: 5124114 - DNA, 15 bp, Homo sapiens
aattattgacactga

SEQ ID NO: 5124115 - DNA, 13 bp, Homo sapiens
aattattgatata

SEQ ID NO: 5124116 - DNA, 15 bp, Homo sapiens
aattattgatgaaaa

SEQ ID NO: 5124117 - DNA, 18 bp, Homo sapiens
aattattgatgattttgt

SEQ ID NO: 5124118 - DNA, 17 bp, Homo sapiens
aattattgggctctttt

SEQ ID NO: 5124119 - DNA, 15 bp, Homo sapiens
aattattgtaaactt

SEQ ID NO: 5124120 - DNA, 18 bp, Homo sapiens
aattattgtaatgtaata

SEQ ID NO: 5124121 - DNA, 15 bp, Homo sapiens
aattattgtacacta

SEQ ID NO: 5124122 - DNA, 21 bp, Homo sapiens
aattattgtacatttatagtt

SEQ ID NO: 5124123 - DNA, 20 bp, Homo sapiens
aattattgtttatattttca

SEQ ID NO: 5124124 - DNA, 19 bp, Homo sapiens
aattatttaaagtgtggaa

SEQ ID NO: 5124125 - DNA, 17 bp, Homo sapiens
aattatttaaataaaat

SEQ ID NO: 5124126 - DNA, 23 bp, Homo sapiens
aattatttaactaattaaaaaat

SEQ ID NO: 5124127 - DNA, 16 bp, Homo sapiens
aattatttaatatgca

SEQ ID NO: 5124128 - DNA, 14 bp, Homo sapiens
aattatttacaaaa

SEQ ID NO: 5124129 - DNA, 22 bp, Homo sapiens
aattatttatattactgaattg

SEQ ID NO: 5124130 - DNA, 22 bp, Homo sapiens
aattatttatatttcctgtatt

SEQ ID NO: 5124131 - DNA, 18 bp, Homo sapiens
aattatttattattaaga

SEQ ID NO: 5124132 - DNA, 21 bp, Homo sapiens
aattatttattttaatgtatt

SEQ ID NO: 5124133 - DNA, 11 bp, Homo sapiens
aattatttcaa

SEQ ID NO: 5124134 - DNA, 12 bp, Homo sapiens
aattatttcaat

SEQ ID NO: 5124135 - DNA, 13 bp, Homo sapiens
aattatttcagaa

SEQ ID NO: 5124136 - DNA, 17 bp, Homo sapiens
aattatttcagaaatgt

SEQ ID NO: 5124137 - DNA, 19 bp, Homo sapiens
aattatttcagattcctca

SEQ ID NO: 5124138 - DNA, 22 bp, Homo sapiens
aattatttctgtcacagtaaaa

SEQ ID NO: 5124139 - DNA, 17 bp, Homo sapiens
aattatttcttaattat

SEQ ID NO: 5124140 - DNA, 12 bp, Homo sapiens
aattatttgaag

SEQ ID NO: 5124141 - DNA, 14 bp, Homo sapiens
aattatttgattat

SEQ ID NO: 5124142 - DNA, 19 bp, Homo sapiens
aattatttgcaggtcttta

SEQ ID NO: 5124143 - DNA, 14 bp, Homo sapiens
aattatttgcatat

SEQ ID NO: 5124144 - DNA, 12 bp, Homo sapiens
aattatttgcta

SEQ ID NO: 5124145 - DNA, 14 bp, Homo sapiens
aattattttaaaca

SEQ ID NO: 5124146 - DNA, 18 bp, Homo sapiens
aattattttaaattataa

SEQ ID NO: 5124147 - DNA, 12 bp, Homo sapiens
aattattttaat

SEQ ID NO: 5124148 - DNA, 13 bp, Homo sapiens
aattattttcatc

SEQ ID NO: 5124149 - DNA, 23 bp, Homo sapiens
aattattttctccaaataaaaat

SEQ ID NO: 5124150 - DNA, 20 bp, Homo sapiens
aattattttgataaattact

SEQ ID NO: 5124151 - DNA, 19 bp, Homo sapiens
aattattttggatctatca

SEQ ID NO: 5124152 - DNA, 19 bp, Homo sapiens
aattattttggtactttta

SEQ ID NO: 5124153 - DNA, 21 bp, Homo sapiens
aattattttgttactgtctgt

SEQ ID NO: 5124154 - DNA, 22 bp, Homo sapiens
aattattttgttactgtctgta

SEQ ID NO: 5124155 - DNA, 22 bp, Homo sapiens
aattattttgttcatacatatt

SEQ ID NO: 5124156 - DNA, 17 bp, Homo sapiens
aattatttttacagttc

SEQ ID NO: 5124157 - DNA, 15 bp, Homo sapiens
aattattttttagat

SEQ ID NO: 5124158 - DNA, 15 bp, Homo sapiens
aattattttttctat

SEQ ID NO: 5124159 - DNA, 23 bp, Homo sapiens
aattattttttgcatcatttaaa

SEQ ID NO: 5124160 - DNA, 16 bp, Homo sapiens
aattatttttttaaac

SEQ ID NO: 5124161 - DNA, 18 bp, Homo sapiens
aattatttttttaaactt

SEQ ID NO: 5124162 - DNA, 20 bp, Homo sapiens
aattatttttttaaacttca

SEQ ID NO: 5124163 - DNA, 14 bp, Homo sapiens
aattcaaaaagaac

SEQ ID NO: 5124164 - DNA, 18 bp, Homo sapiens
aattcaaaaagaactaaa

SEQ ID NO: 5124165 - DNA, 17 bp, Homo sapiens
aattcaaaaataaatta

SEQ ID NO: 5124166 - DNA, 18 bp, Homo sapiens
aattcaaaaataaattag

SEQ ID NO: 5124167 - DNA, 13 bp, Homo sapiens
aattcaaaaatgt

SEQ ID NO: 5124168 - DNA, 12 bp, Homo sapiens
aattcaaaagct

SEQ ID NO: 5124169 - DNA, 12 bp, Homo sapiens
aattcaaaagta

SEQ ID NO: 5124170 - DNA, 16 bp, Homo sapiens
aattcaaaagtaagaa

SEQ ID NO: 5124171 - DNA, 22 bp, Homo sapiens
aattcaaaagtattgaaagcca

SEQ ID NO: 5124172 - DNA, 13 bp, Homo sapiens
aattcaaaatgct

SEQ ID NO: 5124173 - DNA, 15 bp, Homo sapiens
aattcaaaccattta

SEQ ID NO: 5124174 - DNA, 16 bp, Homo sapiens
aattcaaacctaagtt

SEQ ID NO: 5124175 - DNA, 12 bp, Homo sapiens
aattcaaagata

SEQ ID NO: 5124176 - DNA, 13 bp, Homo sapiens
aattcaaagcttg

SEQ ID NO: 5124177 - DNA, 17 bp, Homo sapiens
aattcaaagcttgtgaa

SEQ ID NO: 5124178 - DNA, 13 bp, Homo sapiens
aattcaaatttgt

SEQ ID NO: 5124179 - DNA, 14 bp, Homo sapiens
aattcaacaatgtg

SEQ ID NO: 5124180 - DNA, 21 bp, Homo sapiens
aattcaaccactgtaaaatga

SEQ ID NO: 5124181 - DNA, 13 bp, Homo sapiens
aattcaactctgt

SEQ ID NO: 5124182 - DNA, 14 bp, Homo sapiens
aattcaactctgtg

SEQ ID NO: 5124183 - DNA, 16 bp, Homo sapiens
aattcaactggaaatt

SEQ ID NO: 5124184 - DNA, 12 bp, Homo sapiens
aattcaagaagt

SEQ ID NO: 5124185 - DNA, 16 bp, Homo sapiens
aattcaagaagtattt

SEQ ID NO: 5124186 - DNA, 16 bp, Homo sapiens
aattcaagctgagaaa

SEQ ID NO: 5124187 - DNA, 19 bp, Homo sapiens
aattcaaggagatataaaa

SEQ ID NO: 5124188 - DNA, 22 bp, Homo sapiens
aattcaagttaccaatgtaaca

SEQ ID NO: 5124189 - DNA, 15 bp, Homo sapiens
aattcaatacaaaca

SEQ ID NO: 5124190 - DNA, 18 bp, Homo sapiens
aattcaatagtaatataa

SEQ ID NO: 5124191 - DNA, 16 bp, Homo sapiens
aattcaatcaaagcta

SEQ ID NO: 5124192 - DNA, 17 bp, Homo sapiens
aattcaatcctactttt

SEQ ID NO: 5124193 - DNA, 15 bp, Homo sapiens
aattcaatgaaatgg

SEQ ID NO: 5124194 - DNA, 22 bp, Homo sapiens
aattcaatgccgcaacatatag

SEQ ID NO: 5124195 - DNA, 19 bp, Homo sapiens
aattcaatgggtaaataaa

SEQ ID NO: 5124196 - DNA, 17 bp, Homo sapiens
aattcaattaaaaccat

SEQ ID NO: 5124197 - DNA, 19 bp, Homo sapiens
aattcaattcatagaataa

SEQ ID NO: 5124198 - DNA, 15 bp, Homo sapiens
aattcaattcatgta

SEQ ID NO: 5124199 - DNA, 16 bp, Homo sapiens
aattcaattcatgtaa

SEQ ID NO: 5124200 - DNA, 18 bp, Homo sapiens
aattcaattcatgtaaca

SEQ ID NO: 5124201 - DNA, 15 bp, Homo sapiens
aattcaattttaaag

SEQ ID NO: 5124202 - DNA, 13 bp, Homo sapiens
aattcacaaactt

SEQ ID NO: 5124203 - DNA, 14 bp, Homo sapiens
aattcacaaacttt

SEQ ID NO: 5124204 - DNA, 17 bp, Homo sapiens
aattcacagcctttctg

SEQ ID NO: 5124205 - DNA, 21 bp, Homo sapiens
aattcacatgatgcacttcaa

SEQ ID NO: 5124206 - DNA, 16 bp, Homo sapiens
aattcacattttctca

SEQ ID NO: 5124207 - DNA, 17 bp, Homo sapiens
aattcacattttctcaa

SEQ ID NO: 5124208 - DNA, 17 bp, Homo sapiens
aattcaccaaaagttca

SEQ ID NO: 5124209 - DNA, 17 bp, Homo sapiens
aattcaccaaagtattt

SEQ ID NO: 5124210 - DNA, 17 bp, Homo sapiens
aattcaccacagacttt

SEQ ID NO: 5124211 - DNA, 23 bp, Homo sapiens
aattcaccagtgttcctgaagct

SEQ ID NO: 5124212 - DNA, 13 bp, Homo sapiens
aattcacccactc

SEQ ID NO: 5124213 - DNA, 13 bp, Homo sapiens
aattcacccctcc

SEQ ID NO: 5124214 - DNA, 14 bp, Homo sapiens
aattcacccctccc

SEQ ID NO: 5124215 - DNA, 22 bp, Homo sapiens
aattcacccctcccacctcttt

SEQ ID NO: 5124216 - DNA, 19 bp, Homo sapiens
aattcacgttctagtgaaa

SEQ ID NO: 5124217 - DNA, 21 bp, Homo sapiens
aattcactaatcttgaatgtt

SEQ ID NO: 5124218 - DNA, 23 bp, Homo sapiens
aattttgttctctgggagaaaat

SEQ ID NO: 5124219 - DNA, 22 bp, Homo sapiens
aattttgttgaaaatggtttca

SEQ ID NO: 5124220 - DNA, 15 bp, Homo sapiens
aattttgtttctgta

SEQ ID NO: 5124221 - DNA, 13 bp, Homo sapiens
aattttgttttaa

SEQ ID NO: 5124222 - DNA, 20 bp, Homo sapiens
aattttgttttaaactgtga

SEQ ID NO: 5124223 - DNA, 19 bp, Homo sapiens
aattttgttttcttgattt

SEQ ID NO: 5124224 - DNA, 22 bp, Homo sapiens
aattttgtttttattttcaaga

SEQ ID NO: 5124225 - DNA, 17 bp, Homo sapiens
aatttttaaaaagattt

SEQ ID NO: 5124226 - DNA, 19 bp, Homo sapiens
aatttttaaaactgcattt

SEQ ID NO: 5124227 - DNA, 20 bp, Homo sapiens
aatttttaaaatacttgttt

SEQ ID NO: 5124228 - DNA, 13 bp, Homo sapiens
aatttttaaagta

SEQ ID NO: 5124229 - DNA, 19 bp, Homo sapiens
aatttttaaagtatatatt

SEQ ID NO: 5124230 - DNA, 20 bp, Homo sapiens
aatttttaaagtatatattt

SEQ ID NO: 5124231 - DNA, 22 bp, Homo sapiens
aatttttaaagtatatatttat

SEQ ID NO: 5124232 - DNA, 12 bp, Homo sapiens
aatttttaagag

SEQ ID NO: 5124233 - DNA, 14 bp, Homo sapiens
aatttttaagagaa

SEQ ID NO: 5124234 - DNA, 13 bp, Homo sapiens
aatttttaagtgt

SEQ ID NO: 5124235 - DNA, 15 bp, Homo sapiens
aatttttaagtgtca

SEQ ID NO: 5124236 - DNA, 11 bp, Homo sapiens
aatttttaata

SEQ ID NO: 5124237 - DNA, 13 bp, Homo sapiens
aatttttaatgac

SEQ ID NO: 5124238 - DNA, 14 bp, Homo sapiens
aatttttaatgact

SEQ ID NO: 5124239 - DNA, 12 bp, Homo sapiens
aatttttaatgt

SEQ ID NO: 5124240 - DNA, 22 bp, Homo sapiens
aatttttaccacttctgtttag

SEQ ID NO: 5124241 - DNA, 22 bp, Homo sapiens
aatttttaccctaatgtcttca

SEQ ID NO: 5124242 - DNA, 15 bp, Homo sapiens
aatttttacctaatc

SEQ ID NO: 5124243 - DNA, 17 bp, Homo sapiens
aatttttacctttatct

SEQ ID NO: 5124244 - DNA, 13 bp, Homo sapiens
aatttttactcag

SEQ ID NO: 5124245 - DNA, 17 bp, Homo sapiens
aatttttactcaggctt

SEQ ID NO: 5124246 - DNA, 17 bp, Homo sapiens
aatttttagatattcat

SEQ ID NO: 5124247 - DNA, 16 bp, Homo sapiens
aatttttaggcaaaga

SEQ ID NO: 5124248 - DNA, 12 bp, Homo sapiens
aatttttataaa

SEQ ID NO: 5124249 - DNA, 13 bp, Homo sapiens
aatttttatacat

SEQ ID NO: 5124250 - DNA, 21 bp, Homo sapiens
aatttttatacatatcagaaa

SEQ ID NO: 5124251 - DNA, 23 bp, Homo sapiens
aatttttatacatatcagaaaag

SEQ ID NO: 5124252 - DNA, 22 bp, Homo sapiens
aatttttatatttaattattaa

SEQ ID NO: 5124253 - DNA, 21 bp, Homo sapiens
aatttttattatttgttttcc

SEQ ID NO: 5124254 - DNA, 13 bp, Homo sapiens
aatttttattcat

SEQ ID NO: 5124255 - DNA, 15 bp, Homo sapiens
aatttttatttattt

SEQ ID NO: 5124256 - DNA, 18 bp, Homo sapiens
aatttttattttcaccct

SEQ ID NO: 5124257 - DNA, 15 bp, Homo sapiens
aatttttatttttct

SEQ ID NO: 5124258 - DNA, 15 bp, Homo sapiens
aatttttatttttga

SEQ ID NO: 5124259 - DNA, 22 bp, Homo sapiens
aatttttatttttggcaaagcc

SEQ ID NO: 5124260 - DNA, 21 bp, Homo sapiens
aatttttcatctcttcaatca

SEQ ID NO: 5124261 - DNA, 20 bp, Homo sapiens
aatttttcattgatatgaaa

SEQ ID NO: 5124262 - DNA, 16 bp, Homo sapiens
aatttttcccagtatt

SEQ ID NO: 5124263 - DNA, 10 bp, Homo sapiens
aatttttcct

SEQ ID NO: 5124264 - DNA, 13 bp, Homo sapiens
aatttttcctatg

SEQ ID NO: 5124265 - DNA, 16 bp, Homo sapiens
aatttttcctgcatgt

SEQ ID NO: 5124266 - DNA, 20 bp, Homo sapiens
aatttttcctgcatgttctg

SEQ ID NO: 5124267 - DNA, 12 bp, Homo sapiens
aatttttccttt

SEQ ID NO: 5124268 - DNA, 12 bp, Homo sapiens
aatttttctgta

SEQ ID NO: 5124269 - DNA, 22 bp, Homo sapiens
aatttttctgtacttcagtatg

SEQ ID NO: 5124270 - DNA, 21 bp, Homo sapiens
aatttttcttaagacagagtc

SEQ ID NO: 5124271 - DNA, 20 bp, Homo sapiens
aatttttcttacacatttta

SEQ ID NO: 5124272 - DNA, 18 bp, Homo sapiens
aatttttcttttctttct

SEQ ID NO: 5124273 - DNA, 17 bp, Homo sapiens
aatttttgaaaaatatt

SEQ ID NO: 5124274 - DNA, 18 bp, Homo sapiens
aatttttgaaaaatattg

SEQ ID NO: 5124275 - DNA, 14 bp, Homo sapiens
aatttttgaaaagc

SEQ ID NO: 5124276 - DNA, 23 bp, Homo sapiens
aatttttgaaaagctgctaacta

SEQ ID NO: 5124277 - DNA, 13 bp, Homo sapiens
aatttttgatact

SEQ ID NO: 5124278 - DNA, 12 bp, Homo sapiens
aatttttgcaaa

SEQ ID NO: 5124279 - DNA, 17 bp, Homo sapiens
aatttttgcaataatgc

SEQ ID NO: 5124280 - DNA, 18 bp, Homo sapiens
aatttttgcaataatgca

SEQ ID NO: 5124281 - DNA, 19 bp, Homo sapiens
aatttttgcaataatgcag

SEQ ID NO: 5124282 - DNA, 17 bp, Homo sapiens
aatttttgccttcatta

SEQ ID NO: 5124283 - DNA, 18 bp, Homo sapiens
aatttttgctgttttcag

SEQ ID NO: 5124284 - DNA, 18 bp, Homo sapiens
aatttttgcttaacatta

SEQ ID NO: 5124285 - DNA, 19 bp, Homo sapiens
aatttttggattgacagta

SEQ ID NO: 5124286 - DNA, 22 bp, Homo sapiens
aatttttggattgacagtaact

SEQ ID NO: 5124287 - DNA, 23 bp, Homo sapiens
aatttttggattgacagtaactt

SEQ ID NO: 5124288 - DNA, 18 bp, Homo sapiens
aatttttggttgaataaa

SEQ ID NO: 5124289 - DNA, 21 bp, Homo sapiens
aatttttggtttatgactttg

SEQ ID NO: 5124290 - DNA, 14 bp, Homo sapiens
aatttttgtaaatc

SEQ ID NO: 5124291 - DNA, 16 bp, Homo sapiens
aatttttgtaagaaaa

SEQ ID NO: 5124292 - DNA, 14 bp, Homo sapiens
aatttttgtacatt

SEQ ID NO: 5124293 - DNA, 18 bp, Homo sapiens
aatttttgtataaggtga

SEQ ID NO: 5124294 - DNA, 12 bp, Homo sapiens
aatttttgttct

SEQ ID NO: 5124295 - DNA, 21 bp, Homo sapiens
aatttttgtttttaaattatt

SEQ ID NO: 5124296 - DNA, 21 bp, Homo sapiens
aattttttaaaaaaaatttgt

SEQ ID NO: 5124297 - DNA, 16 bp, Homo sapiens
aattttttaaaccact

SEQ ID NO: 5124298 - DNA, 21 bp, Homo sapiens
aattttttaagggatgttgca

SEQ ID NO: 5124299 - DNA, 23 bp, Homo sapiens
aattttttaattatttaaatgta

SEQ ID NO: 5124300 - DNA, 14 bp, Homo sapiens
aattttttaatttc

SEQ ID NO: 5124301 - DNA, 16 bp, Homo sapiens
aattttttacaagagt

SEQ ID NO: 5124302 - DNA, 18 bp, Homo sapiens
aattttttattcttgtga

SEQ ID NO: 5124303 - DNA, 21 bp, Homo sapiens
aattttttattcttgtgaata

SEQ ID NO: 5124304 - DNA, 20 bp, Homo sapiens
aattttttcctgctagtgta

SEQ ID NO: 5124305 - DNA, 19 bp, Homo sapiens
aattttttctctaggaaat

SEQ ID NO: 5124306 - DNA, 22 bp, Homo sapiens
aattttttctctaggaaatatt

SEQ ID NO: 5124307 - DNA, 19 bp, Homo sapiens
aattttttgaaatgggcat

SEQ ID NO: 5124308 - DNA, 20 bp, Homo sapiens
aattttttgacctattttag

SEQ ID NO: 5124309 - DNA, 13 bp, Homo sapiens
aattttttgactt

SEQ ID NO: 5124310 - DNA, 19 bp, Homo sapiens
aattttttgagtaattcta

SEQ ID NO: 5124311 - DNA, 17 bp, Homo sapiens
aattttttgcagtcttt

SEQ ID NO: 5124312 - DNA, 17 bp, Homo sapiens
aattttttgttgacatt

SEQ ID NO: 5124313 - DNA, 22 bp, Homo sapiens
aattttttgttgacattagtct

SEQ ID NO: 5124314 - DNA, 15 bp, Homo sapiens
aatttttttaaattt

SEQ ID NO: 5124315 - DNA, 19 bp, Homo sapiens
aatttttttaaccaaaggt

SEQ ID NO: 5124316 - DNA, 19 bp, Homo sapiens
aatttttttaatttacaaa

SEQ ID NO: 5124317 - DNA, 20 bp, Homo sapiens
aatttttttaattttgtatt

SEQ ID NO: 5124318 - DNA, 15 bp, Homo sapiens
aatttttttagaaag

SEQ ID NO: 5124319 - DNA, 19 bp, Homo sapiens
aatttttttattgtttaaa

SEQ ID NO: 5124320 - DNA, 15 bp, Homo sapiens
aatttttttcaatat

SEQ ID NO: 5124321 - DNA, 19 bp, Homo sapiens
aatttttttcaatatttat

SEQ ID NO: 5124322 - DNA, 20 bp, Homo sapiens
aatttttttctgcacagctt

SEQ ID NO: 5124323 - DNA, 17 bp, Homo sapiens
aatttttttgagacaga

SEQ ID NO: 5124324 - DNA, 21 bp, Homo sapiens
aatttttttgtaaaggaaata

SEQ ID NO: 5124325 - DNA, 16 bp, Homo sapiens
aatttttttgtaataa

SEQ ID NO: 5124326 - DNA, 16 bp, Homo sapiens
aatttttttgtcttta

SEQ ID NO: 5124327 - DNA, 19 bp, Homo sapiens
aattttttttaaaatagaa

SEQ ID NO: 5124328 - DNA, 16 bp, Homo sapiens
aattttttttaaagaa

SEQ ID NO: 5124329 - DNA, 14 bp, Homo sapiens
aattttttttaaca

SEQ ID NO: 5124330 - DNA, 15 bp, Homo sapiens
aattttttttaacat

SEQ ID NO: 5124331 - DNA, 17 bp, Homo sapiens
aattttttttaacattc

SEQ ID NO: 5124332 - DNA, 20 bp, Homo sapiens
aattttttttcatgctttat

SEQ ID NO: 5124333 - DNA, 21 bp, Homo sapiens
aattttttttccgtaaatgtc

SEQ ID NO: 5124334 - DNA, 23 bp, Homo sapiens
aattttttttccgtaaatgtctg

SEQ ID NO: 5124335 - DNA, 22 bp, Homo sapiens
aattttttttctgaacaaaagc

SEQ ID NO: 5124336 - DNA, 19 bp, Homo sapiens
aattttttttggtcaaatt

SEQ ID NO: 5124337 - DNA, 22 bp, Homo sapiens
aattttttttggttgtttgctg

SEQ ID NO: 5124338 - DNA, 22 bp, Homo sapiens
aatttttttttattttgctttg

SEQ ID NO: 5124339 - DNA, 20 bp, Homo sapiens
aatttttttttcctggaatt

SEQ ID NO: 5124340 - DNA, 22 bp, Homo sapiens
aattttttttttaaacaatgaa

SEQ ID NO: 5124341 - DNA, 21 bp, Homo sapiens
aattttttttttaaatgattc

SEQ ID NO: 5124342 - DNA, 19 bp, Homo sapiens
acaaaaaaaaaatttgcca

SEQ ID NO: 5124343 - DNA, 19 bp, Homo sapiens
acaaaaaaaaagttttatt

SEQ ID NO: 5124344 - DNA, 14 bp, Homo sapiens
acaaaaaaaaattt

SEQ ID NO: 5124345 - DNA, 14 bp, Homo sapiens
acaaaaaaaagaac

SEQ ID NO: 5124346 - DNA, 23 bp, Homo sapiens
acaaaaaaaagtgtattgcaagt

SEQ ID NO: 5124347 - DNA, 19 bp, Homo sapiens
acaaaaaaaccacaaaggc

SEQ ID NO: 5124348 - DNA, 23 bp, Homo sapiens
acaaaaaaacctcttaatattct

SEQ ID NO: 5124349 - DNA, 12 bp, Homo sapiens
acaaaaaaagtt

SEQ ID NO: 5124350 - DNA, 21 bp, Homo sapiens
acaaaaaaagtttgttacttt

SEQ ID NO: 5124351 - DNA, 21 bp, Homo sapiens
acaaaaaaatacctcaggaaa

SEQ ID NO: 5124352 - DNA, 23 bp, Homo sapiens
acaaaaaaatacctcaggaaaga

SEQ ID NO: 5124353 - DNA, 13 bp, Homo sapiens
acaaaaaaatctg

SEQ ID NO: 5124354 - DNA, 18 bp, Homo sapiens
acaaaaaaatctgcagaa

SEQ ID NO: 5124355 - DNA, 22 bp, Homo sapiens
acaaaaaaatgttcattgtaga

SEQ ID NO: 5124356 - DNA, 17 bp, Homo sapiens
acaaaaaaatttaaaat

SEQ ID NO: 5124357 - DNA, 13 bp, Homo sapiens
acaaaaaacaata

SEQ ID NO: 5124358 - DNA, 17 bp, Homo sapiens
acaaaaaacaatattta

SEQ ID NO: 5124359 - DNA, 18 bp, Homo sapiens
acaaaaaacagattctat

SEQ ID NO: 5124360 - DNA, 15 bp, Homo sapiens
acaaaaaactcccct

SEQ ID NO: 5124361 - DNA, 20 bp, Homo sapiens
acaaaaaagaaaagtagaaa

SEQ ID NO: 5124362 - DNA, 21 bp, Homo sapiens
acaaaaaagacttgagacaat

SEQ ID NO: 5124363 - DNA, 11 bp, Homo sapiens
acaaaaaagtg

SEQ ID NO: 5124364 - DNA, 11 bp, Homo sapiens
acaaaaaataa

SEQ ID NO: 5124365 - DNA, 19 bp, Homo sapiens
acaaaaaatattcatctgt

SEQ ID NO: 5124366 - DNA, 13 bp, Homo sapiens
acaaaaacaagac

SEQ ID NO: 5124367 - DNA, 12 bp, Homo sapiens
acaaaaacacaa

SEQ ID NO: 5124368 - DNA, 15 bp, Homo sapiens
acaaaaacacaaata

SEQ ID NO: 5124369 - DNA, 13 bp, Homo sapiens
acaaaaacacagc

SEQ ID NO: 5124370 - DNA, 14 bp, Homo sapiens
acaaaaacacagca

SEQ ID NO: 5124371 - DNA, 20 bp, Homo sapiens
acaaaaacaggtatatactt

SEQ ID NO: 5124372 - DNA, 22 bp, Homo sapiens
acaaaaacaggtatatactttg

SEQ ID NO: 5124373 - DNA, 20 bp, Homo sapiens
acaaaaaccaaatgtttatt

SEQ ID NO: 5124374 - DNA, 13 bp, Homo sapiens
acaaaaactaaaa

SEQ ID NO: 5124375 - DNA, 15 bp, Homo sapiens
acaaaaactttccat

SEQ ID NO: 5124376 - DNA, 17 bp, Homo sapiens
acaaaaagaaagctgtg

SEQ ID NO: 5124377 - DNA, 17 bp, Homo sapiens
acaaaaagaaatgtcaa

SEQ ID NO: 5124378 - DNA, 13 bp, Homo sapiens
acaaaaagaacaa

SEQ ID NO: 5124379 - DNA, 12 bp, Homo sapiens
acaaaaagaaga

SEQ ID NO: 5124380 - DNA, 14 bp, Homo sapiens
acaaaaagacatgg

SEQ ID NO: 5124381 - DNA, 17 bp, Homo sapiens
acaaaaagacatggaag

SEQ ID NO: 5124382 - DNA, 13 bp, Homo sapiens
acaaaaagagctt

SEQ ID NO: 5124383 - DNA, 20 bp, Homo sapiens
acaaaaagccaaacaagcct

SEQ ID NO: 5124384 - DNA, 15 bp, Homo sapiens
acaaaaagcttcccc

SEQ ID NO: 5124385 - DNA, 17 bp, Homo sapiens
acaaaaaggagcgggca

SEQ ID NO: 5124386 - DNA, 20 bp, Homo sapiens
acaaaaaggagcgggcaggg

SEQ ID NO: 5124387 - DNA, 16 bp, Homo sapiens
acaaaaaggcaaatat

SEQ ID NO: 5124388 - DNA, 19 bp, Homo sapiens
acaaaaaggcaaatattga

SEQ ID NO: 5124389 - DNA, 23 bp, Homo sapiens
acaaaaagtaacacagtggactt

SEQ ID NO: 5124390 - DNA, 10 bp, Homo sapiens
acaaaaagtc

SEQ ID NO: 5124391 - DNA, 18 bp, Homo sapiens
acaaaaagtttccatatg

SEQ ID NO: 5124392 - DNA, 15 bp, Homo sapiens
acaaaaatagaatat

SEQ ID NO: 5124393 - DNA, 17 bp, Homo sapiens
acaaaaatattttccta

SEQ ID NO: 5124394 - DNA, 22 bp, Homo sapiens
acaaaaatgaaagcatgtctca

SEQ ID NO: 5124395 - DNA, 11 bp, Homo sapiens
acaaaaatggg

SEQ ID NO: 5124396 - DNA, 22 bp, Homo sapiens
aattcactccagtcaacagatt

SEQ ID NO: 5124397 - DNA, 12 bp, Homo sapiens
aattcactctga

SEQ ID NO: 5124398 - DNA, 19 bp, Homo sapiens
aattcacttaagtttttcc

SEQ ID NO: 5124399 - DNA, 15 bp, Homo sapiens
aattcacttagggtc

SEQ ID NO: 5124400 - DNA, 17 bp, Homo sapiens
aattcagacaacattat

SEQ ID NO: 5124401 - DNA, 18 bp, Homo sapiens
aattcagacaacattatg

SEQ ID NO: 5124402 - DNA, 22 bp, Homo sapiens
aattcagacctggaatgtaagt

SEQ ID NO: 5124403 - DNA, 14 bp, Homo sapiens
aattcagagtcctt

SEQ ID NO: 5124404 - DNA, 16 bp, Homo sapiens
aattcagataatggta

SEQ ID NO: 5124405 - DNA, 22 bp, Homo sapiens
aattcagataatggtaatttag

SEQ ID NO: 5124406 - DNA, 16 bp, Homo sapiens
aattcagattgtcttg

SEQ ID NO: 5124407 - DNA, 17 bp, Homo sapiens
aattcagattgtcttgc

SEQ ID NO: 5124408 - DNA, 13 bp, Homo sapiens
aattcagattgtt

SEQ ID NO: 5124409 - DNA, 12 bp, Homo sapiens
aattcagcaccc

SEQ ID NO: 5124410 - DNA, 15 bp, Homo sapiens
aattcagcactgatt

SEQ ID NO: 5124411 - DNA, 20 bp, Homo sapiens
aattcagcactgatttcaca

SEQ ID NO: 5124412 - DNA, 14 bp, Homo sapiens
aattcagcatttga

SEQ ID NO: 5124413 - DNA, 20 bp, Homo sapiens
aattcagctcagcttcttcc

SEQ ID NO: 5124414 - DNA, 12 bp, Homo sapiens
aattcagctcct

SEQ ID NO: 5124415 - DNA, 13 bp, Homo sapiens
aattcagctgccc

SEQ ID NO: 5124416 - DNA, 11 bp, Homo sapiens
aattcaggaag

SEQ ID NO: 5124417 - DNA, 12 bp, Homo sapiens
aattcaggactc

SEQ ID NO: 5124418 - DNA, 15 bp, Homo sapiens
aattcaggactggct

SEQ ID NO: 5124419 - DNA, 16 bp, Homo sapiens
aattcaggactggctc

SEQ ID NO: 5124420 - DNA, 20 bp, Homo sapiens
aattcaggactggctcaccc

SEQ ID NO: 5124421 - DNA, 16 bp, Homo sapiens
aattcaggcacatgtg

SEQ ID NO: 5124422 - DNA, 20 bp, Homo sapiens
aattcaggcatattttaact

SEQ ID NO: 5124423 - DNA, 20 bp, Homo sapiens
aattcagggctttaaacatg

SEQ ID NO: 5124424 - DNA, 18 bp, Homo sapiens
aattcagtctcagctgct

SEQ ID NO: 5124425 - DNA, 15 bp, Homo sapiens
aattcagtctctgaa

SEQ ID NO: 5124426 - DNA, 21 bp, Homo sapiens
aattcagtcttttctctgaaa

SEQ ID NO: 5124427 - DNA, 16 bp, Homo sapiens
aattcagtgacaaaat

SEQ ID NO: 5124428 - DNA, 17 bp, Homo sapiens
aattcagtggtcttatt

SEQ ID NO: 5124429 - DNA, 19 bp, Homo sapiens
aattcagtgtatttcagtt

SEQ ID NO: 5124430 - DNA, 18 bp, Homo sapiens
aattcagttataaagtca

SEQ ID NO: 5124431 - DNA, 17 bp, Homo sapiens
aattcagttgttagtgt

SEQ ID NO: 5124432 - DNA, 16 bp, Homo sapiens
aattcagtttcataaa

SEQ ID NO: 5124433 - DNA, 14 bp, Homo sapiens
aattcagttttttt

SEQ ID NO: 5124434 - DNA, 16 bp, Homo sapiens
aattcataaaaacaag

SEQ ID NO: 5124435 - DNA, 17 bp, Homo sapiens
aattcataaaaataacc

SEQ ID NO: 5124436 - DNA, 17 bp, Homo sapiens
aattcataaatctattc

SEQ ID NO: 5124437 - DNA, 17 bp, Homo sapiens
aattcataataaatttt

SEQ ID NO: 5124438 - DNA, 17 bp, Homo sapiens
aattcataatcactcta

SEQ ID NO: 5124439 - DNA, 14 bp, Homo sapiens
aattcataattaga

SEQ ID NO: 5124440 - DNA, 23 bp, Homo sapiens
aattcataattagaacaatagct

SEQ ID NO: 5124441 - DNA, 18 bp, Homo sapiens
aattcatacctgtgaata

SEQ ID NO: 5124442 - DNA, 19 bp, Homo sapiens
aattcatactctgttgcct

SEQ ID NO: 5124443 - DNA, 23 bp, Homo sapiens
aattcatactctgttgcctcctc

SEQ ID NO: 5124444 - DNA, 18 bp, Homo sapiens
aattcatagtaagattga

SEQ ID NO: 5124445 - DNA, 16 bp, Homo sapiens
aattcatatttatgaa

SEQ ID NO: 5124446 - DNA, 17 bp, Homo sapiens
aattcatatttttcctt

SEQ ID NO: 5124447 - DNA, 13 bp, Homo sapiens
aattcatcagaat

SEQ ID NO: 5124448 - DNA, 15 bp, Homo sapiens
aattcatcccctccc

SEQ ID NO: 5124449 - DNA, 14 bp, Homo sapiens
aattcatcttttaa

SEQ ID NO: 5124450 - DNA, 18 bp, Homo sapiens
aattcatcttttaatcat

SEQ ID NO: 5124451 - DNA, 19 bp, Homo sapiens
aattcatctttttttttct

SEQ ID NO: 5124452 - DNA, 17 bp, Homo sapiens
aattcatgcctttcata

SEQ ID NO: 5124453 - DNA, 14 bp, Homo sapiens
aattcatggaactt

SEQ ID NO: 5124454 - DNA, 19 bp, Homo sapiens
aattcatggaactttcata

SEQ ID NO: 5124455 - DNA, 14 bp, Homo sapiens
aattcatggctttt

SEQ ID NO: 5124456 - DNA, 18 bp, Homo sapiens
aattcatggtatcttgag

SEQ ID NO: 5124457 - DNA, 21 bp, Homo sapiens
aattcatggttttaaagctaa

SEQ ID NO: 5124458 - DNA, 20 bp, Homo sapiens
aattcatgtaacagttgtgt

SEQ ID NO: 5124459 - DNA, 18 bp, Homo sapiens
aattcatgtacagcatgc

SEQ ID NO: 5124460 - DNA, 14 bp, Homo sapiens
aattcatgtttctt

SEQ ID NO: 5124461 - DNA, 19 bp, Homo sapiens
aattcattaaaaacatttt

SEQ ID NO: 5124462 - DNA, 14 bp, Homo sapiens
aattcattaaaagt

SEQ ID NO: 5124463 - DNA, 17 bp, Homo sapiens
aattcattaaaagtttt

SEQ ID NO: 5124464 - DNA, 17 bp, Homo sapiens
aattcattaaagaaaaa

SEQ ID NO: 5124465 - DNA, 14 bp, Homo sapiens
aattcattaatctg

SEQ ID NO: 5124466 - DNA, 18 bp, Homo sapiens
aattcattaatctgtttg

SEQ ID NO: 5124467 - DNA, 16 bp, Homo sapiens
aattcattcatactta

SEQ ID NO: 5124468 - DNA, 14 bp, Homo sapiens
aattcattccattt

SEQ ID NO: 5124469 - DNA, 21 bp, Homo sapiens
aattcattccatttgctgatt

SEQ ID NO: 5124470 - DNA, 20 bp, Homo sapiens
aattcattctggaggggcag

SEQ ID NO: 5124471 - DNA, 18 bp, Homo sapiens
aattcattgtctcagtga

SEQ ID NO: 5124472 - DNA, 19 bp, Homo sapiens
aattcattgtctcagtgaa

SEQ ID NO: 5124473 - DNA, 18 bp, Homo sapiens
aattcattgttttgcaaa

SEQ ID NO: 5124474 - DNA, 13 bp, Homo sapiens
aattcatttaaga

SEQ ID NO: 5124475 - DNA, 14 bp, Homo sapiens
aattcatttaagaa

SEQ ID NO: 5124476 - DNA, 16 bp, Homo sapiens
aattcatttcacttta

SEQ ID NO: 5124477 - DNA, 18 bp, Homo sapiens
aattcatttcactttaaa

SEQ ID NO: 5124478 - DNA, 13 bp, Homo sapiens
aattcatttctaa

SEQ ID NO: 5124479 - DNA, 11 bp, Homo sapiens
aattcatttgg

SEQ ID NO: 5124480 - DNA, 12 bp, Homo sapiens
aattcatttgta

SEQ ID NO: 5124481 - DNA, 13 bp, Homo sapiens
aattcatttgtat

SEQ ID NO: 5124482 - DNA, 14 bp, Homo sapiens
aattccaaaatcca

SEQ ID NO: 5124483 - DNA, 17 bp, Homo sapiens
aattccaaagatctgaa

SEQ ID NO: 5124484 - DNA, 15 bp, Homo sapiens
aattccaaagcaaaa

SEQ ID NO: 5124485 - DNA, 13 bp, Homo sapiens
aattccaaagtct

SEQ ID NO: 5124486 - DNA, 16 bp, Homo sapiens
aattccaactcacttt

SEQ ID NO: 5124487 - DNA, 17 bp, Homo sapiens
aattccaactcctgatg

SEQ ID NO: 5124488 - DNA, 18 bp, Homo sapiens
aattccaactcctgatgc

SEQ ID NO: 5124489 - DNA, 18 bp, Homo sapiens
aattccaacttgaaggat

SEQ ID NO: 5124490 - DNA, 22 bp, Homo sapiens
aattccaacttgaaggattgca

SEQ ID NO: 5124491 - DNA, 18 bp, Homo sapiens
aattccaagaaaatatca

SEQ ID NO: 5124492 - DNA, 12 bp, Homo sapiens
aattccaaggag

SEQ ID NO: 5124493 - DNA, 14 bp, Homo sapiens
aattccaagtgtat

SEQ ID NO: 5124494 - DNA, 18 bp, Homo sapiens
aattccaagtgtatttta

SEQ ID NO: 5124495 - DNA, 13 bp, Homo sapiens
aattccaatacat

SEQ ID NO: 5124496 - DNA, 14 bp, Homo sapiens
aattccaatattta

SEQ ID NO: 5124497 - DNA, 19 bp, Homo sapiens
aattccaatatttataatt

SEQ ID NO: 5124498 - DNA, 22 bp, Homo sapiens
aattccaatatttataattaaa

SEQ ID NO: 5124499 - DNA, 16 bp, Homo sapiens
aattccaattaaattt

SEQ ID NO: 5124500 - DNA, 14 bp, Homo sapiens
aattccaatttcaa

SEQ ID NO: 5124501 - DNA, 19 bp, Homo sapiens
aattccaatttcaaaatgt

SEQ ID NO: 5124502 - DNA, 16 bp, Homo sapiens
aattccacaccctcac

SEQ ID NO: 5124503 - DNA, 16 bp, Homo sapiens
aattccacatcatgtt

SEQ ID NO: 5124504 - DNA, 14 bp, Homo sapiens
aattccaccaggat

SEQ ID NO: 5124505 - DNA, 16 bp, Homo sapiens
aattccaccagggcca

SEQ ID NO: 5124506 - DNA, 21 bp, Homo sapiens
aattccaccagggccagagca

SEQ ID NO: 5124507 - DNA, 22 bp, Homo sapiens
aattccaccagggccagagcag

SEQ ID NO: 5124508 - DNA, 15 bp, Homo sapiens
aattccacccctcct

SEQ ID NO: 5124509 - DNA, 23 bp, Homo sapiens
aattccacctggaaagccaggtt

SEQ ID NO: 5124510 - DNA, 21 bp, Homo sapiens
aattccactggacttgagctt

SEQ ID NO: 5124511 - DNA, 20 bp, Homo sapiens
aattccactgtcttgtgttt

SEQ ID NO: 5124512 - DNA, 20 bp, Homo sapiens
aattccagaaaggatattta

SEQ ID NO: 5124513 - DNA, 19 bp, Homo sapiens
aattccagaggactctgct

SEQ ID NO: 5124514 - DNA, 13 bp, Homo sapiens
aattccagcaata

SEQ ID NO: 5124515 - DNA, 20 bp, Homo sapiens
aattccagcaataagaaatg

SEQ ID NO: 5124516 - DNA, 16 bp, Homo sapiens
aattccaggaaccaaa

SEQ ID NO: 5124517 - DNA, 13 bp, Homo sapiens
aattccaggctga

SEQ ID NO: 5124518 - DNA, 20 bp, Homo sapiens
aattccaggctgagccatga

SEQ ID NO: 5124519 - DNA, 18 bp, Homo sapiens
aattccagggaaccagag

SEQ ID NO: 5124520 - DNA, 22 bp, Homo sapiens
aattccaggtgtgcacagaaaa

SEQ ID NO: 5124521 - DNA, 23 bp, Homo sapiens
aattccaggtgtgcacagaaaac

SEQ ID NO: 5124522 - DNA, 23 bp, Homo sapiens
aattccagttatttatttccaaa

SEQ ID NO: 5124523 - DNA, 20 bp, Homo sapiens
aattccatacttctctcaga

SEQ ID NO: 5124524 - DNA, 18 bp, Homo sapiens
aattccatagctcaataa

SEQ ID NO: 5124525 - DNA, 22 bp, Homo sapiens
aattccatatatccttttcttc

SEQ ID NO: 5124526 - DNA, 16 bp, Homo sapiens
aattccatcttgtaaa

SEQ ID NO: 5124527 - DNA, 16 bp, Homo sapiens
aattccatgaatcgct

SEQ ID NO: 5124528 - DNA, 14 bp, Homo sapiens
aattccatgaatgt

SEQ ID NO: 5124529 - DNA, 16 bp, Homo sapiens
aattccatgaatgttc

SEQ ID NO: 5124530 - DNA, 17 bp, Homo sapiens
aattcccattttgcaaa

SEQ ID NO: 5124531 - DNA, 21 bp, Homo sapiens
aattcccattttgcaaaattt

SEQ ID NO: 5124532 - DNA, 22 bp, Homo sapiens
aattcccattttgcaaaatttc

SEQ ID NO: 5124533 - DNA, 14 bp, Homo sapiens
aattccccaccctg

SEQ ID NO: 5124534 - DNA, 20 bp, Homo sapiens
aattcccgttttgtcacttt

SEQ ID NO: 5124535 - DNA, 16 bp, Homo sapiens
aattccctccccctcc

SEQ ID NO: 5124536 - DNA, 13 bp, Homo sapiens
aattccctctgga

SEQ ID NO: 5124537 - DNA, 18 bp, Homo sapiens
aattccctgaaaaactag

SEQ ID NO: 5124538 - DNA, 13 bp, Homo sapiens
aattccctgctgt

SEQ ID NO: 5124539 - DNA, 20 bp, Homo sapiens
aattccctggcctttcatat

SEQ ID NO: 5124540 - DNA, 19 bp, Homo sapiens
aattcccttctttttcatc

SEQ ID NO: 5124541 - DNA, 10 bp, Homo sapiens
aattcctaca

SEQ ID NO: 5124542 - DNA, 22 bp, Homo sapiens
aattcctacaacttaatggaaa

SEQ ID NO: 5124543 - DNA, 13 bp, Homo sapiens
aattcctacagca

SEQ ID NO: 5124544 - DNA, 15 bp, Homo sapiens
aattcctacagcact

SEQ ID NO: 5124545 - DNA, 19 bp, Homo sapiens
aattcctacagcactactg

SEQ ID NO: 5124546 - DNA, 22 bp, Homo sapiens
aattcctacctcttcacctgac

SEQ ID NO: 5124547 - DNA, 17 bp, Homo sapiens
aattcctagctgtaaat

SEQ ID NO: 5124548 - DNA, 15 bp, Homo sapiens
aattcctataaggaa

SEQ ID NO: 5124549 - DNA, 21 bp, Homo sapiens
aattcctatatcctgtgactg

SEQ ID NO: 5124550 - DNA, 22 bp, Homo sapiens
aattcctattgtgatttgactg

SEQ ID NO: 5124551 - DNA, 21 bp, Homo sapiens
aattcctcatcctcagatgct

SEQ ID NO: 5124552 - DNA, 14 bp, Homo sapiens
aattcctcatttgt

SEQ ID NO: 5124553 - DNA, 23 bp, Homo sapiens
aattcctcatttgttcattaaac

SEQ ID NO: 5124554 - DNA, 19 bp, Homo sapiens
aattcctccagagacactg

SEQ ID NO: 5124555 - DNA, 21 bp, Homo sapiens
aattcctccagagacactgag

SEQ ID NO: 5124556 - DNA, 17 bp, Homo sapiens
aattcctcctctattta

SEQ ID NO: 5124557 - DNA, 14 bp, Homo sapiens
aattcctcctgtct

SEQ ID NO: 5124558 - DNA, 13 bp, Homo sapiens
aattcctctggga

SEQ ID NO: 5124559 - DNA, 14 bp, Homo sapiens
aattcctctgggaa

SEQ ID NO: 5124560 - DNA, 17 bp, Homo sapiens
aattcctctttgctttg

SEQ ID NO: 5124561 - DNA, 19 bp, Homo sapiens
aattcctctttgctttgct

SEQ ID NO: 5124562 - DNA, 16 bp, Homo sapiens
aattcctgaagccaga

SEQ ID NO: 5124563 - DNA, 10 bp, Homo sapiens
aattcctgga

SEQ ID NO: 5124564 - DNA, 18 bp, Homo sapiens
aattcctggaacctggac

SEQ ID NO: 5124565 - DNA, 11 bp, Homo sapiens
aattcctgggc

SEQ ID NO: 5124566 - DNA, 23 bp, Homo sapiens
aattcctgggctcaagcagtcct

SEQ ID NO: 5124567 - DNA, 21 bp, Homo sapiens
aattcctgtagcatcttctgg

SEQ ID NO: 5124568 - DNA, 20 bp, Homo sapiens
aattcctgtcttccaaattg

SEQ ID NO: 5124569 - DNA, 14 bp, Homo sapiens
aattcctgtgctca

SEQ ID NO: 5124570 - DNA, 13 bp, Homo sapiens
aattcctgttttt

SEQ ID NO: 5124571 - DNA, 19 bp, Homo sapiens
aattccttatcctagcctt

SEQ ID NO: 5124572 - DNA, 20 bp, Homo sapiens
aattccttctcttttttcag

SEQ ID NO: 5124573 - DNA, 22 bp, Homo sapiens
aattccttctcttttttcagag

SEQ ID NO: 5124574 - DNA, 23 bp, Homo sapiens
aattccttgccccacagttgtgt

SEQ ID NO: 5124575 - DNA, 14 bp, Homo sapiens
aattcctttcagag

SEQ ID NO: 5124576 - DNA, 14 bp, Homo sapiens
acaaaaattaggta

SEQ ID NO: 5124577 - DNA, 11 bp, Homo sapiens
acaaaaattat

SEQ ID NO: 5124578 - DNA, 12 bp, Homo sapiens
acaaaaattatc

SEQ ID NO: 5124579 - DNA, 22 bp, Homo sapiens
acaaaaattatttttttttttg

SEQ ID NO: 5124580 - DNA, 13 bp, Homo sapiens
acaaaaatttatt

SEQ ID NO: 5124581 - DNA, 11 bp, Homo sapiens
acaaaacaaaa

SEQ ID NO: 5124582 - DNA, 16 bp, Homo sapiens
acaaaacaaaacaaaa

SEQ ID NO: 5124583 - DNA, 17 bp, Homo sapiens
acaaaacaaaacaacat

SEQ ID NO: 5124584 - DNA, 13 bp, Homo sapiens
acaaaacaaactc

SEQ ID NO: 5124585 - DNA, 19 bp, Homo sapiens
acaaaacaaagcaattctt

SEQ ID NO: 5124586 - DNA, 12 bp, Homo sapiens
acaaaacaaatc

SEQ ID NO: 5124587 - DNA, 20 bp, Homo sapiens
acaaaacaacaacaatacaa

SEQ ID NO: 5124588 - DNA, 13 bp, Homo sapiens
acaaaacaacagc

SEQ ID NO: 5124589 - DNA, 16 bp, Homo sapiens
acaaaacaagaaagaa

SEQ ID NO: 5124590 - DNA, 19 bp, Homo sapiens
acaaaacaatccccatcag

SEQ ID NO: 5124591 - DNA, 14 bp, Homo sapiens
acaaaacatttttg

SEQ ID NO: 5124592 - DNA, 14 bp, Homo sapiens
acaaaaccaaaagt

SEQ ID NO: 5124593 - DNA, 13 bp, Homo sapiens
acaaaaccaagcc

SEQ ID NO: 5124594 - DNA, 23 bp, Homo sapiens
acaaaaccacctggttgaatata

SEQ ID NO: 5124595 - DNA, 12 bp, Homo sapiens
acaaaaccagct

SEQ ID NO: 5124596 - DNA, 13 bp, Homo sapiens
acaaaaccagctg

SEQ ID NO: 5124597 - DNA, 14 bp, Homo sapiens
acaaaaccagctgc

SEQ ID NO: 5124598 - DNA, 17 bp, Homo sapiens
acaaaacccatgcattt

SEQ ID NO: 5124599 - DNA, 17 bp, Homo sapiens
acaaaacctatttttcc

SEQ ID NO: 5124600 - DNA, 19 bp, Homo sapiens
acaaaacctatttttcctt

SEQ ID NO: 5124601 - DNA, 10 bp, Homo sapiens
acaaaactat

SEQ ID NO: 5124602 - DNA, 22 bp, Homo sapiens
acaaaactatcctatgccttca

SEQ ID NO: 5124603 - DNA, 17 bp, Homo sapiens
acaaaactctgtataag

SEQ ID NO: 5124604 - DNA, 18 bp, Homo sapiens
acaaaactctgtataagt

SEQ ID NO: 5124605 - DNA, 13 bp, Homo sapiens
acaaaactcttaa

SEQ ID NO: 5124606 - DNA, 17 bp, Homo sapiens
acaaaactggaactgtt

SEQ ID NO: 5124607 - DNA, 19 bp, Homo sapiens
acaaaactgtaactgcatt

SEQ ID NO: 5124608 - DNA, 11 bp, Homo sapiens
acaaaactgtt

SEQ ID NO: 5124609 - DNA, 19 bp, Homo sapiens
acaaaactgttcttttgca

SEQ ID NO: 5124610 - DNA, 22 bp, Homo sapiens
acaaaactgttcttttgcattt

SEQ ID NO: 5124611 - DNA, 13 bp, Homo sapiens
acaaaacttcctg

SEQ ID NO: 5124612 - DNA, 14 bp, Homo sapiens
acaaaacttgaaag

SEQ ID NO: 5124613 - DNA, 14 bp, Homo sapiens
acaaaacttgcatc

SEQ ID NO: 5124614 - DNA, 15 bp, Homo sapiens
acaaaacttgcatct

SEQ ID NO: 5124615 - DNA, 14 bp, Homo sapiens
acaaaacttttcta

SEQ ID NO: 5124616 - DNA, 14 bp, Homo sapiens
acaaaagaaactta

SEQ ID NO: 5124617 - DNA, 13 bp, Homo sapiens
acaaaagaatttt

SEQ ID NO: 5124618 - DNA, 9 bp, Homo sapiens
acaaaagac

SEQ ID NO: 5124619 - DNA, 16 bp, Homo sapiens
acaaaagagcagcatt

SEQ ID NO: 5124620 - DNA, 13 bp, Homo sapiens
acaaaagagcagt

SEQ ID NO: 5124621 - DNA, 18 bp, Homo sapiens
acaaaagagcatggatgc

SEQ ID NO: 5124622 - DNA, 23 bp, Homo sapiens
acaaaagaggagcacttccaaaa

SEQ ID NO: 5124623 - DNA, 14 bp, Homo sapiens
acaaaagatacaaa

SEQ ID NO: 5124624 - DNA, 14 bp, Homo sapiens
acaaaagatatgaa

SEQ ID NO: 5124625 - DNA, 21 bp, Homo sapiens
acaaaagatgtatccttccaa

SEQ ID NO: 5124626 - DNA, 12 bp, Homo sapiens
acaaaagattta

SEQ ID NO: 5124627 - DNA, 16 bp, Homo sapiens
acaaaagcaaaatttt

SEQ ID NO: 5124628 - DNA, 17 bp, Homo sapiens
acaaaagcaaagatgca

SEQ ID NO: 5124629 - DNA, 18 bp, Homo sapiens
acaaaagcacttactttt

SEQ ID NO: 5124630 - DNA, 14 bp, Homo sapiens
acaaaagcagccct

SEQ ID NO: 5124631 - DNA, 15 bp, Homo sapiens
acaaaagcagccctc

SEQ ID NO: 5124632 - DNA, 18 bp, Homo sapiens
acaaaagcagcttttagt

SEQ ID NO: 5124633 - DNA, 22 bp, Homo sapiens
acaaaagcatgtgagactggtt

SEQ ID NO: 5124634 - DNA, 22 bp, Homo sapiens
acaaaagcgattattattttag

SEQ ID NO: 5124635 - DNA, 20 bp, Homo sapiens
acaaaagctgtaaattacta

SEQ ID NO: 5124636 - DNA, 16 bp, Homo sapiens
acaaaagctgtgtctc

SEQ ID NO: 5124637 - DNA, 15 bp, Homo sapiens
acaaaagctttttaa

SEQ ID NO: 5124638 - DNA, 23 bp, Homo sapiens
acaaaagctttttaaaatttaga

SEQ ID NO: 5124639 - DNA, 22 bp, Homo sapiens
acaaaaggaaaataaatgaaca

SEQ ID NO: 5124640 - DNA, 17 bp, Homo sapiens
acaaaaggaagactgga

SEQ ID NO: 5124641 - DNA, 21 bp, Homo sapiens
acaaaaggagaagaggaacat

SEQ ID NO: 5124642 - DNA, 17 bp, Homo sapiens
acaaaaggctggatgtg

SEQ ID NO: 5124643 - DNA, 21 bp, Homo sapiens
acaaaaggctggatgtgcttt

SEQ ID NO: 5124644 - DNA, 23 bp, Homo sapiens
acaaaaggctggatgtgctttca

SEQ ID NO: 5124645 - DNA, 12 bp, Homo sapiens
acaaaaggcttt

SEQ ID NO: 5124646 - DNA, 19 bp, Homo sapiens
acaaaagggaaaaaagcaa

SEQ ID NO: 5124647 - DNA, 11 bp, Homo sapiens
acaaaagggtc

SEQ ID NO: 5124648 - DNA, 13 bp, Homo sapiens
acaaaagggtcag

SEQ ID NO: 5124649 - DNA, 13 bp, Homo sapiens
acaaaagggtgta

SEQ ID NO: 5124650 - DNA, 19 bp, Homo sapiens
acaaaagggtgtatagtgt

SEQ ID NO: 5124651 - DNA, 17 bp, Homo sapiens
acaaaagtacattgctt

SEQ ID NO: 5124652 - DNA, 17 bp, Homo sapiens
acaaaagtaccatagaa

SEQ ID NO: 5124653 - DNA, 16 bp, Homo sapiens
acaaaagtatattcaa

SEQ ID NO: 5124654 - DNA, 16 bp, Homo sapiens
acaaaagttcaacctc

SEQ ID NO: 5124655 - DNA, 20 bp, Homo sapiens
acaaaagttgtttaataagt

SEQ ID NO: 5124656 - DNA, 21 bp, Homo sapiens
acaaaagttgtttaataagta

SEQ ID NO: 5124657 - DNA, 16 bp, Homo sapiens
acaaaataaaataata

SEQ ID NO: 5124658 - DNA, 16 bp, Homo sapiens
acaaaataaaattatg

SEQ ID NO: 5124659 - DNA, 14 bp, Homo sapiens
acaaaataaacaaa

SEQ ID NO: 5124660 - DNA, 12 bp, Homo sapiens
acaaaataaagt

SEQ ID NO: 5124661 - DNA, 18 bp, Homo sapiens
acaaaataaagtgtgtgt

SEQ ID NO: 5124662 - DNA, 16 bp, Homo sapiens
acaaaataacatttga

SEQ ID NO: 5124663 - DNA, 22 bp, Homo sapiens
acaaaataaccaatcctggaca

SEQ ID NO: 5124664 - DNA, 10 bp, Homo sapiens
acaaaataat

SEQ ID NO: 5124665 - DNA, 12 bp, Homo sapiens
acaaaataattt

SEQ ID NO: 5124666 - DNA, 16 bp, Homo sapiens
acaaaataatttaact

SEQ ID NO: 5124667 - DNA, 19 bp, Homo sapiens
acaaaataatttaactaat

SEQ ID NO: 5124668 - DNA, 21 bp, Homo sapiens
acaaaataatttaactaattt

SEQ ID NO: 5124669 - DNA, 19 bp, Homo sapiens
acaaaataccaccctacaa

SEQ ID NO: 5124670 - DNA, 19 bp, Homo sapiens
acaaaatactatgtgggac

SEQ ID NO: 5124671 - DNA, 15 bp, Homo sapiens
acaaaatagaagctg

SEQ ID NO: 5124672 - DNA, 18 bp, Homo sapiens
acaaaatagaagctgtag

SEQ ID NO: 5124673 - DNA, 22 bp, Homo sapiens
acaaaatatttatttgttttgg

SEQ ID NO: 5124674 - DNA, 16 bp, Homo sapiens
acaaaatatttcccat

SEQ ID NO: 5124675 - DNA, 19 bp, Homo sapiens
acaaaatctaatgttgtct

SEQ ID NO: 5124676 - DNA, 17 bp, Homo sapiens
acaaaatctgttgccac

SEQ ID NO: 5124677 - DNA, 13 bp, Homo sapiens
acaaaatgaaaaa

SEQ ID NO: 5124678 - DNA, 18 bp, Homo sapiens
acaaaatgaaaatatctt

SEQ ID NO: 5124679 - DNA, 15 bp, Homo sapiens
acaaaatgccttttt

SEQ ID NO: 5124680 - DNA, 10 bp, Homo sapiens
acaaaatgga

SEQ ID NO: 5124681 - DNA, 13 bp, Homo sapiens
acaaaatggaata

SEQ ID NO: 5124682 - DNA, 15 bp, Homo sapiens
acaaaatggaatact

SEQ ID NO: 5124683 - DNA, 21 bp, Homo sapiens
acaaaatgggactgctgaaga

SEQ ID NO: 5124684 - DNA, 18 bp, Homo sapiens
acaaaatgggaggaggaa

SEQ ID NO: 5124685 - DNA, 23 bp, Homo sapiens
acaaaatggtcctatttttgtga

SEQ ID NO: 5124686 - DNA, 20 bp, Homo sapiens
acaaaatgtaactgttacca

SEQ ID NO: 5124687 - DNA, 23 bp, Homo sapiens
acaaaatgtaactgttaccattg

SEQ ID NO: 5124688 - DNA, 19 bp, Homo sapiens
acaaaatgtagaatattca

SEQ ID NO: 5124689 - DNA, 21 bp, Homo sapiens
acaaaatgtagaatattcaga

SEQ ID NO: 5124690 - DNA, 22 bp, Homo sapiens
acaaaatgtagaatattcagac

SEQ ID NO: 5124691 - DNA, 14 bp, Homo sapiens
acaaaatgtagaca

SEQ ID NO: 5124692 - DNA, 20 bp, Homo sapiens
acaaaatgtagggttataat

SEQ ID NO: 5124693 - DNA, 22 bp, Homo sapiens
acaaaatgtctcagttttcagc

SEQ ID NO: 5124694 - DNA, 22 bp, Homo sapiens
acaaaatgtgtgcttggaaaat

SEQ ID NO: 5124695 - DNA, 19 bp, Homo sapiens
acaaaattagaaaggacaa

SEQ ID NO: 5124696 - DNA, 16 bp, Homo sapiens
acaaaattatttgtaa

SEQ ID NO: 5124697 - DNA, 14 bp, Homo sapiens
acaaaattccatta

SEQ ID NO: 5124698 - DNA, 20 bp, Homo sapiens
acaaaattcgacctgattta

SEQ ID NO: 5124699 - DNA, 20 bp, Homo sapiens
acaaaattgacagctttcta

SEQ ID NO: 5124700 - DNA, 20 bp, Homo sapiens
acaaaattgcaatttcttag

SEQ ID NO: 5124701 - DNA, 15 bp, Homo sapiens
acaaaattgtaagcc

SEQ ID NO: 5124702 - DNA, 22 bp, Homo sapiens
acaaaattgtaagccagagtca

SEQ ID NO: 5124703 - DNA, 15 bp, Homo sapiens
acaaaatttagtttt

SEQ ID NO: 5124704 - DNA, 23 bp, Homo sapiens
acaaaatttgaataataaatcga

SEQ ID NO: 5124705 - DNA, 14 bp, Homo sapiens
acaaaatttgagaa

SEQ ID NO: 5124706 - DNA, 15 bp, Homo sapiens
acaaaattttatttt

SEQ ID NO: 5124707 - DNA, 22 bp, Homo sapiens
acaaaattttattttgtgctca

SEQ ID NO: 5124708 - DNA, 12 bp, Homo sapiens
acaaacaaaaaa

SEQ ID NO: 5124709 - DNA, 14 bp, Homo sapiens
acaaacaaaagcat

SEQ ID NO: 5124710 - DNA, 10 bp, Homo sapiens
acaaacaaac

SEQ ID NO: 5124711 - DNA, 16 bp, Homo sapiens
acaaacaaacaatgca

SEQ ID NO: 5124712 - DNA, 18 bp, Homo sapiens
acaaacaacctgccacaa

SEQ ID NO: 5124713 - DNA, 13 bp, Homo sapiens
acaaacaagatac

SEQ ID NO: 5124714 - DNA, 13 bp, Homo sapiens
acaaacaatgaaa

SEQ ID NO: 5124715 - DNA, 18 bp, Homo sapiens
acaaacaatggaaactga

SEQ ID NO: 5124716 - DNA, 18 bp, Homo sapiens
acaaacaattaactgagc

SEQ ID NO: 5124717 - DNA, 11 bp, Homo sapiens
acaaacacaca

SEQ ID NO: 5124718 - DNA, 13 bp, Homo sapiens
acaaacacacaca

SEQ ID NO: 5124719 - DNA, 17 bp, Homo sapiens
acaaacacacacaaaag

SEQ ID NO: 5124720 - DNA, 15 bp, Homo sapiens
acaaacacattgtta

SEQ ID NO: 5124721 - DNA, 17 bp, Homo sapiens
acaaacacattgttatt

SEQ ID NO: 5124722 - DNA, 13 bp, Homo sapiens
acaaacacctcct

SEQ ID NO: 5124723 - DNA, 22 bp, Homo sapiens
acaaacactgcagaacagcatc

SEQ ID NO: 5124724 - DNA, 13 bp, Homo sapiens
acaaacactgcca

SEQ ID NO: 5124725 - DNA, 16 bp, Homo sapiens
acaaacagaaacacaa

SEQ ID NO: 5124726 - DNA, 16 bp, Homo sapiens
acaaacaggaatgtct

SEQ ID NO: 5124727 - DNA, 11 bp, Homo sapiens
acaaacaggat

SEQ ID NO: 5124728 - DNA, 14 bp, Homo sapiens
acaaacagtatttc

SEQ ID NO: 5124729 - DNA, 21 bp, Homo sapiens
acaaacagtgaatttaagcat

SEQ ID NO: 5124730 - DNA, 14 bp, Homo sapiens
acaaacatcactct

SEQ ID NO: 5124731 - DNA, 14 bp, Homo sapiens
acaaacatgaccct

SEQ ID NO: 5124732 - DNA, 17 bp, Homo sapiens
acaaacatggaaaacag

SEQ ID NO: 5124733 - DNA, 19 bp, Homo sapiens
acaaacatgtggttaatgc

SEQ ID NO: 5124734 - DNA, 14 bp, Homo sapiens
acaaacattagtat

SEQ ID NO: 5124735 - DNA, 13 bp, Homo sapiens
acaaacattgctg

SEQ ID NO: 5124736 - DNA, 12 bp, Homo sapiens
acaaacattttt

SEQ ID NO: 5124737 - DNA, 16 bp, Homo sapiens
acaaacatttttcaac

SEQ ID NO: 5124738 - DNA, 20 bp, Homo sapiens
acaaaccacaactgacacag

SEQ ID NO: 5124739 - DNA, 21 bp, Homo sapiens
acaaaccacaactgacacagg

SEQ ID NO: 5124740 - DNA, 18 bp, Homo sapiens
acaaaccaccaggactga

SEQ ID NO: 5124741 - DNA, 21 bp, Homo sapiens
acaaaccaccaggactgaaag

SEQ ID NO: 5124742 - DNA, 14 bp, Homo sapiens
acaaaccactgtac

SEQ ID NO: 5124743 - DNA, 19 bp, Homo sapiens
acaaaccagcaacttttct

SEQ ID NO: 5124744 - DNA, 14 bp, Homo sapiens
acaaaccagcctgg

SEQ ID NO: 5124745 - DNA, 22 bp, Homo sapiens
acaaaccaggtcaccatcctca

SEQ ID NO: 5124746 - DNA, 15 bp, Homo sapiens
acaaaccatctggtg

SEQ ID NO: 5124747 - DNA, 21 bp, Homo sapiens
acaaaccatctggtgcctttc

SEQ ID NO: 5124748 - DNA, 14 bp, Homo sapiens
acaaaccatgcaaa

SEQ ID NO: 5124749 - DNA, 14 bp, Homo sapiens
acaaaccatttcca

SEQ ID NO: 5124750 - DNA, 20 bp, Homo sapiens
acaaaccattttattttttg

SEQ ID NO: 5124751 - DNA, 13 bp, Homo sapiens
acaaaccctgggg

SEQ ID NO: 5124752 - DNA, 21 bp, Homo sapiens
acaaaccctggggactctgct

SEQ ID NO: 5124753 - DNA, 20 bp, Homo sapiens
acaaaccgaaaatggacatt

SEQ ID NO: 5124754 - DNA, 14 bp, Homo sapiens
acaaacctaaaaat

SEQ ID NO: 5124755 - DNA, 17 bp, Homo sapiens
acaaacctactgcccac

SEQ ID NO: 5124756 - DNA, 13 bp, Homo sapiens
acaaacctctcag

SEQ ID NO: 5124757 - DNA, 14 bp, Homo sapiens
acaaacctgcctgg

SEQ ID NO: 5124758 - DNA, 14 bp, Homo sapiens
acaaaccttctttt

SEQ ID NO: 5124759 - DNA, 15 bp, Homo sapiens
aattcgaaccaggaa

SEQ ID NO: 5124760 - DNA, 23 bp, Homo sapiens
aattcgaaccaggaaatggaacc

SEQ ID NO: 5124761 - DNA, 22 bp, Homo sapiens
aattcgagacaggcagaatcag

SEQ ID NO: 5124762 - DNA, 13 bp, Homo sapiens
aattcgagcaaac

SEQ ID NO: 5124763 - DNA, 14 bp, Homo sapiens
aattcgagcaaaca

SEQ ID NO: 5124764 - DNA, 17 bp, Homo sapiens
aattcgatgccccccta

SEQ ID NO: 5124765 - DNA, 20 bp, Homo sapiens
aattcgatgcgtattctgtg

SEQ ID NO: 5124766 - DNA, 15 bp, Homo sapiens
aattcgcagtgatat

SEQ ID NO: 5124767 - DNA, 14 bp, Homo sapiens
aattcgcatgttta

SEQ ID NO: 5124768 - DNA, 18 bp, Homo sapiens
aattcgctgcaacctgtt

SEQ ID NO: 5124769 - DNA, 17 bp, Homo sapiens
aattcggggcctgctgg

SEQ ID NO: 5124770 - DNA, 18 bp, Homo sapiens
aattcggggcctgctgga

SEQ ID NO: 5124771 - DNA, 15 bp, Homo sapiens
aattcgtgttatgaa

SEQ ID NO: 5124772 - DNA, 17 bp, Homo sapiens
aattcgtttctgacata

SEQ ID NO: 5124773 - DNA, 13 bp, Homo sapiens
aattctaaactta

SEQ ID NO: 5124774 - DNA, 20 bp, Homo sapiens
aattctaaataaatttccca

SEQ ID NO: 5124775 - DNA, 16 bp, Homo sapiens
aattctaaatgctggt

SEQ ID NO: 5124776 - DNA, 18 bp, Homo sapiens
aattctaacattaaatca

SEQ ID NO: 5124777 - DNA, 17 bp, Homo sapiens
aattctaacccaggtat

SEQ ID NO: 5124778 - DNA, 18 bp, Homo sapiens
aattctaaggagttttgt

SEQ ID NO: 5124779 - DNA, 16 bp, Homo sapiens
aattctaagttattta

SEQ ID NO: 5124780 - DNA, 15 bp, Homo sapiens
aattctaataatgca

SEQ ID NO: 5124781 - DNA, 18 bp, Homo sapiens
aattctaatggtaacttt

SEQ ID NO: 5124782 - DNA, 22 bp, Homo sapiens
aattctaatggtaacttttgta

SEQ ID NO: 5124783 - DNA, 22 bp, Homo sapiens
aattctacaggatggggacact

SEQ ID NO: 5124784 - DNA, 14 bp, Homo sapiens
aattctacagtttc

SEQ ID NO: 5124785 - DNA, 23 bp, Homo sapiens
aattctaccaaggtcttcttaat

SEQ ID NO: 5124786 - DNA, 23 bp, Homo sapiens
aattctaccctggaaaagtgtta

SEQ ID NO: 5124787 - DNA, 17 bp, Homo sapiens
aattctacctccttgtg

SEQ ID NO: 5124788 - DNA, 21 bp, Homo sapiens
aattctacctccttgtgttgc

SEQ ID NO: 5124789 - DNA, 17 bp, Homo sapiens
aattctactaagttatt

SEQ ID NO: 5124790 - DNA, 14 bp, Homo sapiens
aattctagatcaga

SEQ ID NO: 5124791 - DNA, 14 bp, Homo sapiens
aattctagcttttt

SEQ ID NO: 5124792 - DNA, 17 bp, Homo sapiens
aattctagcttttttcc

SEQ ID NO: 5124793 - DNA, 21 bp, Homo sapiens
aattctaggatgaacaatgta

SEQ ID NO: 5124794 - DNA, 17 bp, Homo sapiens
aattctagtctctgatt

SEQ ID NO: 5124795 - DNA, 17 bp, Homo sapiens
aattctagtgctgctga

SEQ ID NO: 5124796 - DNA, 21 bp, Homo sapiens
aattctagtgctgctgaagat

SEQ ID NO: 5124797 - DNA, 14 bp, Homo sapiens
aattctataaaaac

SEQ ID NO: 5124798 - DNA, 19 bp, Homo sapiens
aattctataagagacaaag

SEQ ID NO: 5124799 - DNA, 13 bp, Homo sapiens
aattctatgcctg

SEQ ID NO: 5124800 - DNA, 19 bp, Homo sapiens
aattctatgttaaatactg

SEQ ID NO: 5124801 - DNA, 20 bp, Homo sapiens
aattctatgttaaatactgt

SEQ ID NO: 5124802 - DNA, 23 bp, Homo sapiens
aattctattaaagtgctaaggtt

SEQ ID NO: 5124803 - DNA, 15 bp, Homo sapiens
aattctatttctcta

SEQ ID NO: 5124804 - DNA, 16 bp, Homo sapiens
aattctcaaagtttta

SEQ ID NO: 5124805 - DNA, 15 bp, Homo sapiens
aattctcaaataata

SEQ ID NO: 5124806 - DNA, 22 bp, Homo sapiens
aattctcaagacctgagtattt

SEQ ID NO: 5124807 - DNA, 14 bp, Homo sapiens
aattctcacatccc

SEQ ID NO: 5124808 - DNA, 13 bp, Homo sapiens
aattctcatgtga

SEQ ID NO: 5124809 - DNA, 19 bp, Homo sapiens
aattctcatgtgatccttt

SEQ ID NO: 5124810 - DNA, 18 bp, Homo sapiens
aattctcattaaaagaat

SEQ ID NO: 5124811 - DNA, 18 bp, Homo sapiens
aattctcattatgaagat

SEQ ID NO: 5124812 - DNA, 19 bp, Homo sapiens
aattctcattatgaagatg

SEQ ID NO: 5124813 - DNA, 21 bp, Homo sapiens
aattctcattatgaagatgtt

SEQ ID NO: 5124814 - DNA, 15 bp, Homo sapiens
aattctccactgtgc

SEQ ID NO: 5124815 - DNA, 15 bp, Homo sapiens
aattctcccctccct

SEQ ID NO: 5124816 - DNA, 16 bp, Homo sapiens
aattctcccctccctc

SEQ ID NO: 5124817 - DNA, 20 bp, Homo sapiens
aattctccctatcttgtgaa

SEQ ID NO: 5124818 - DNA, 23 bp, Homo sapiens
aattctccctggcattgtttcca

SEQ ID NO: 5124819 - DNA, 16 bp, Homo sapiens
aattctcctgcctcag

SEQ ID NO: 5124820 - DNA, 13 bp, Homo sapiens
aattctcctggag

SEQ ID NO: 5124821 - DNA, 18 bp, Homo sapiens
aattctcgattctttgaa

SEQ ID NO: 5124822 - DNA, 16 bp, Homo sapiens
aattctctcaagactt

SEQ ID NO: 5124823 - DNA, 20 bp, Homo sapiens
aattctctgtggaatgaata

SEQ ID NO: 5124824 - DNA, 14 bp, Homo sapiens
aattctctgttcct

SEQ ID NO: 5124825 - DNA, 15 bp, Homo sapiens
aattctcttaaataa

SEQ ID NO: 5124826 - DNA, 21 bp, Homo sapiens
aattctcttaatcactactgt

SEQ ID NO: 5124827 - DNA, 17 bp, Homo sapiens
aattctcttacccagaa

SEQ ID NO: 5124828 - DNA, 23 bp, Homo sapiens
aattctcttccaaccatttatct

SEQ ID NO: 5124829 - DNA, 14 bp, Homo sapiens
aattctctttcaaa

SEQ ID NO: 5124830 - DNA, 11 bp, Homo sapiens
aattctgaaac

SEQ ID NO: 5124831 - DNA, 15 bp, Homo sapiens
aattctgaaacaact

SEQ ID NO: 5124832 - DNA, 11 bp, Homo sapiens
aattctgaaat

SEQ ID NO: 5124833 - DNA, 15 bp, Homo sapiens
aattctgaaggggaa

SEQ ID NO: 5124834 - DNA, 23 bp, Homo sapiens
aattctgaaggggaaaacctcag

SEQ ID NO: 5124835 - DNA, 14 bp, Homo sapiens
aattctgaatttgc

SEQ ID NO: 5124836 - DNA, 18 bp, Homo sapiens
aattctgaatttgcaaag

SEQ ID NO: 5124837 - DNA, 13 bp, Homo sapiens
aattctgactgtc

SEQ ID NO: 5124838 - DNA, 21 bp, Homo sapiens
aattctgactgtccaggagct

SEQ ID NO: 5124839 - DNA, 22 bp, Homo sapiens
aattctgactgtccaggagcta

SEQ ID NO: 5124840 - DNA, 21 bp, Homo sapiens
aattctgagaaaacttctttt

SEQ ID NO: 5124841 - DNA, 13 bp, Homo sapiens
aattctgagggaa

SEQ ID NO: 5124842 - DNA, 18 bp, Homo sapiens
aattctgaggtaagtgta

SEQ ID NO: 5124843 - DNA, 19 bp, Homo sapiens
aattctgatcaatcatttt

SEQ ID NO: 5124844 - DNA, 10 bp, Homo sapiens
aattctgatg

SEQ ID NO: 5124845 - DNA, 21 bp, Homo sapiens
aattctgatgctaggttgttt

SEQ ID NO: 5124846 - DNA, 19 bp, Homo sapiens
aattctgatgttactgaga

SEQ ID NO: 5124847 - DNA, 22 bp, Homo sapiens
aattctgatgtttctgtgaaat

SEQ ID NO: 5124848 - DNA, 16 bp, Homo sapiens
aattctgattcttcta

SEQ ID NO: 5124849 - DNA, 15 bp, Homo sapiens
aattctgattgattt

SEQ ID NO: 5124850 - DNA, 15 bp, Homo sapiens
aattctgatttcttt

SEQ ID NO: 5124851 - DNA, 13 bp, Homo sapiens
aattctgcatgta

SEQ ID NO: 5124852 - DNA, 22 bp, Homo sapiens
aattctgcattgagaaactgaa

SEQ ID NO: 5124853 - DNA, 23 bp, Homo sapiens
aattctgcctgcctcctccctcc

SEQ ID NO: 5124854 - DNA, 16 bp, Homo sapiens
aattctgctacctcac

SEQ ID NO: 5124855 - DNA, 12 bp, Homo sapiens
aattctgctcct

SEQ ID NO: 5124856 - DNA, 19 bp, Homo sapiens
aattctgctctaaataaag

SEQ ID NO: 5124857 - DNA, 21 bp, Homo sapiens
aattctgctctaaataaagac

SEQ ID NO: 5124858 - DNA, 13 bp, Homo sapiens
aattctgctgtta

SEQ ID NO: 5124859 - DNA, 22 bp, Homo sapiens
aattctgcttgtgacattaaaa

SEQ ID NO: 5124860 - DNA, 12 bp, Homo sapiens
aattctggaagc

SEQ ID NO: 5124861 - DNA, 17 bp, Homo sapiens
aattctggaagctgatt

SEQ ID NO: 5124862 - DNA, 15 bp, Homo sapiens
aattctggcccagcc

SEQ ID NO: 5124863 - DNA, 12 bp, Homo sapiens
aattctgggtgc

SEQ ID NO: 5124864 - DNA, 20 bp, Homo sapiens
aattctgggttcatttgtga

SEQ ID NO: 5124865 - DNA, 21 bp, Homo sapiens
aattctggtatacattgaatt

SEQ ID NO: 5124866 - DNA, 17 bp, Homo sapiens
aattctgtaatttgaat

SEQ ID NO: 5124867 - DNA, 20 bp, Homo sapiens
aattctgtacatagcctata

SEQ ID NO: 5124868 - DNA, 21 bp, Homo sapiens
aattctgtacatagcctatat

SEQ ID NO: 5124869 - DNA, 14 bp, Homo sapiens
aattctgtatagat

SEQ ID NO: 5124870 - DNA, 11 bp, Homo sapiens
aattctgtccc

SEQ ID NO: 5124871 - DNA, 15 bp, Homo sapiens
aattctgtccctgtc

SEQ ID NO: 5124872 - DNA, 23 bp, Homo sapiens
aattctgtccctgtccctgcccc

SEQ ID NO: 5124873 - DNA, 22 bp, Homo sapiens
aattctgtcttgttcattttga

SEQ ID NO: 5124874 - DNA, 17 bp, Homo sapiens
aattctgtgatattttc

SEQ ID NO: 5124875 - DNA, 16 bp, Homo sapiens
aattctgtgccttgtt

SEQ ID NO: 5124876 - DNA, 20 bp, Homo sapiens
aattctgttacacaatatgt

SEQ ID NO: 5124877 - DNA, 18 bp, Homo sapiens
aattctgttagctgctca

SEQ ID NO: 5124878 - DNA, 19 bp, Homo sapiens
aattctgttagctgctcac

SEQ ID NO: 5124879 - DNA, 22 bp, Homo sapiens
aattctgttcatttgttattct

SEQ ID NO: 5124880 - DNA, 17 bp, Homo sapiens
aattctgttctaaaact

SEQ ID NO: 5124881 - DNA, 22 bp, Homo sapiens
aattctgttggtgccacgcttt

SEQ ID NO: 5124882 - DNA, 22 bp, Homo sapiens
aattctgttgtaatttaatgac

SEQ ID NO: 5124883 - DNA, 17 bp, Homo sapiens
aattctgttgttccatt

SEQ ID NO: 5124884 - DNA, 15 bp, Homo sapiens
aattctgtttatgtt

SEQ ID NO: 5124885 - DNA, 12 bp, Homo sapiens
aattctgtttct

SEQ ID NO: 5124886 - DNA, 13 bp, Homo sapiens
aattctgtttctt

SEQ ID NO: 5124887 - DNA, 11 bp, Homo sapiens
aattcttaaaa

SEQ ID NO: 5124888 - DNA, 18 bp, Homo sapiens
aattcttaaaaaattgaa

SEQ ID NO: 5124889 - DNA, 14 bp, Homo sapiens
aattcttaaaacta

SEQ ID NO: 5124890 - DNA, 21 bp, Homo sapiens
aattcttaaaactataacatt

SEQ ID NO: 5124891 - DNA, 14 bp, Homo sapiens
aattcttaaaatat

SEQ ID NO: 5124892 - DNA, 14 bp, Homo sapiens
aattcttaagtctt

SEQ ID NO: 5124893 - DNA, 23 bp, Homo sapiens
aattcttaatttggatctattta

SEQ ID NO: 5124894 - DNA, 17 bp, Homo sapiens
aattcttacaaacatgt

SEQ ID NO: 5124895 - DNA, 18 bp, Homo sapiens
aattcttaccctgtacat

SEQ ID NO: 5124896 - DNA, 21 bp, Homo sapiens
aattcttaccgaaatgaaaat

SEQ ID NO: 5124897 - DNA, 22 bp, Homo sapiens
aattcttaccgaaatgaaaatg

SEQ ID NO: 5124898 - DNA, 13 bp, Homo sapiens
aattcttacctca

SEQ ID NO: 5124899 - DNA, 20 bp, Homo sapiens
aattcttacctcatttgcat

SEQ ID NO: 5124900 - DNA, 20 bp, Homo sapiens
aattcttataggctagactt

SEQ ID NO: 5124901 - DNA, 10 bp, Homo sapiens
aattcttatg

SEQ ID NO: 5124902 - DNA, 18 bp, Homo sapiens
aattcttatgactaaatt

SEQ ID NO: 5124903 - DNA, 21 bp, Homo sapiens
aattcttattactagactgcc

SEQ ID NO: 5124904 - DNA, 22 bp, Homo sapiens
aattcttattccatattagaaa

SEQ ID NO: 5124905 - DNA, 23 bp, Homo sapiens
aattcttattccatattagaaaa

SEQ ID NO: 5124906 - DNA, 15 bp, Homo sapiens
aattcttatttctgt

SEQ ID NO: 5124907 - DNA, 18 bp, Homo sapiens
aattcttattttagaaat

SEQ ID NO: 5124908 - DNA, 19 bp, Homo sapiens
aattcttcaagaaagaatt

SEQ ID NO: 5124909 - DNA, 23 bp, Homo sapiens
aattcttcacctaagtctctgtg

SEQ ID NO: 5124910 - DNA, 23 bp, Homo sapiens
aattcttcacctgttatgtatga

SEQ ID NO: 5124911 - DNA, 20 bp, Homo sapiens
aattcttcagcgtaaaatgg

SEQ ID NO: 5124912 - DNA, 21 bp, Homo sapiens
aattcttcagcgtaaaatggt

SEQ ID NO: 5124913 - DNA, 18 bp, Homo sapiens
aattcttcaggtggaaaa

SEQ ID NO: 5124914 - DNA, 20 bp, Homo sapiens
aattcttcagttggttgtgt

SEQ ID NO: 5124915 - DNA, 19 bp, Homo sapiens
aattcttcattatagtaaa

SEQ ID NO: 5124916 - DNA, 21 bp, Homo sapiens
aattcttccaaaggatcttat

SEQ ID NO: 5124917 - DNA, 11 bp, Homo sapiens
aattcttccct

SEQ ID NO: 5124918 - DNA, 13 bp, Homo sapiens
aattcttccctgg

SEQ ID NO: 5124919 - DNA, 15 bp, Homo sapiens
aattcttcctctcct

SEQ ID NO: 5124920 - DNA, 16 bp, Homo sapiens
aattcttcctctcctt

SEQ ID NO: 5124921 - DNA, 20 bp, Homo sapiens
aattcttctcctttgtcaaa

SEQ ID NO: 5124922 - DNA, 21 bp, Homo sapiens
aattcttctcctttgtcaaat

SEQ ID NO: 5124923 - DNA, 23 bp, Homo sapiens
aattcttctgaactcaaactgag

SEQ ID NO: 5124924 - DNA, 21 bp, Homo sapiens
aattcttgaaagaattttcct

SEQ ID NO: 5124925 - DNA, 15 bp, Homo sapiens
aattcttgaaggaaa

SEQ ID NO: 5124926 - DNA, 14 bp, Homo sapiens
aattcttgaataaa

SEQ ID NO: 5124927 - DNA, 16 bp, Homo sapiens
aattcttgatctctaa

SEQ ID NO: 5124928 - DNA, 18 bp, Homo sapiens
aattcttgatctctaatg

SEQ ID NO: 5124929 - DNA, 14 bp, Homo sapiens
aattcttgcaaagt

SEQ ID NO: 5124930 - DNA, 21 bp, Homo sapiens
aattcttgccaaatataaata

SEQ ID NO: 5124931 - DNA, 16 bp, Homo sapiens
aattcttgccaagcaa

SEQ ID NO: 5124932 - DNA, 15 bp, Homo sapiens
aattcttgcttgagg

SEQ ID NO: 5124933 - DNA, 13 bp, Homo sapiens
aattcttggaata

SEQ ID NO: 5124934 - DNA, 20 bp, Homo sapiens
aattcttggttgaggaaaca

SEQ ID NO: 5124935 - DNA, 14 bp, Homo sapiens
aattcttgtatatt

SEQ ID NO: 5124936 - DNA, 19 bp, Homo sapiens
aattctttaatgattccta

SEQ ID NO: 5124937 - DNA, 17 bp, Homo sapiens
acaaaccttcttttcaa

SEQ ID NO: 5124938 - DNA, 21 bp, Homo sapiens
acaaaccttcttttcaatgca

SEQ ID NO: 5124939 - DNA, 22 bp, Homo sapiens
acaaaccttcttttcaatgcaa

SEQ ID NO: 5124940 - DNA, 17 bp, Homo sapiens
acaaaccttgccttgaa

SEQ ID NO: 5124941 - DNA, 18 bp, Homo sapiens
acaaacgtaatttgttat

SEQ ID NO: 5124942 - DNA, 16 bp, Homo sapiens
acaaacgtgtttttta

SEQ ID NO: 5124943 - DNA, 14 bp, Homo sapiens
acaaacgtttgaca

SEQ ID NO: 5124944 - DNA, 14 bp, Homo sapiens
acaaactaaaaata

SEQ ID NO: 5124945 - DNA, 14 bp, Homo sapiens
acaaactaaacttt

SEQ ID NO: 5124946 - DNA, 21 bp, Homo sapiens
acaaactacagacctgctttt

SEQ ID NO: 5124947 - DNA, 14 bp, Homo sapiens
acaaactatttcag

SEQ ID NO: 5124948 - DNA, 16 bp, Homo sapiens
acaaactatttcagaa

SEQ ID NO: 5124949 - DNA, 19 bp, Homo sapiens
acaaactatttcagaatat

SEQ ID NO: 5124950 - DNA, 22 bp, Homo sapiens
acaaactatttcttatatatgt

SEQ ID NO: 5124951 - DNA, 23 bp, Homo sapiens
acaaactcactcagtaaaacata

SEQ ID NO: 5124952 - DNA, 17 bp, Homo sapiens
acaaactcagatccttg

SEQ ID NO: 5124953 - DNA, 15 bp, Homo sapiens
acaaactcagatctc

SEQ ID NO: 5124954 - DNA, 20 bp, Homo sapiens
acaaactcgttttttacaaa

SEQ ID NO: 5124955 - DNA, 14 bp, Homo sapiens
acaaactcttcagt

SEQ ID NO: 5124956 - DNA, 14 bp, Homo sapiens
acaaactgaaaaat

SEQ ID NO: 5124957 - DNA, 19 bp, Homo sapiens
acaaactgaagataatgaa

SEQ ID NO: 5124958 - DNA, 22 bp, Homo sapiens
acaaactgatgcgaaaacttga

SEQ ID NO: 5124959 - DNA, 17 bp, Homo sapiens
acaaactgatttctcac

SEQ ID NO: 5124960 - DNA, 13 bp, Homo sapiens
acaaactgcaata

SEQ ID NO: 5124961 - DNA, 14 bp, Homo sapiens
acaaactgcaatag

SEQ ID NO: 5124962 - DNA, 16 bp, Homo sapiens
acaaactgcaatagag

SEQ ID NO: 5124963 - DNA, 20 bp, Homo sapiens
acaaactgcaatagagactg

SEQ ID NO: 5124964 - DNA, 16 bp, Homo sapiens
acaaactgcacatgat

SEQ ID NO: 5124965 - DNA, 13 bp, Homo sapiens
acaaactgcctgt

SEQ ID NO: 5124966 - DNA, 15 bp, Homo sapiens
acaaactgcttcctt

SEQ ID NO: 5124967 - DNA, 17 bp, Homo sapiens
acaaactggtattctgt

SEQ ID NO: 5124968 - DNA, 23 bp, Homo sapiens
acaaactggtttgaaatttttga

SEQ ID NO: 5124969 - DNA, 13 bp, Homo sapiens
acaaactgtaaat

SEQ ID NO: 5124970 - DNA, 23 bp, Homo sapiens
acaaactgtcgtctttttccaaa

SEQ ID NO: 5124971 - DNA, 12 bp, Homo sapiens
acaaactgtgaa

SEQ ID NO: 5124972 - DNA, 16 bp, Homo sapiens
acaaactgtgaaaata

SEQ ID NO: 5124973 - DNA, 16 bp, Homo sapiens
acaaactgtgtaactg

SEQ ID NO: 5124974 - DNA, 21 bp, Homo sapiens
acaaacttctcgcaactgaag

SEQ ID NO: 5124975 - DNA, 16 bp, Homo sapiens
acaaacttgatttctt

SEQ ID NO: 5124976 - DNA, 22 bp, Homo sapiens
acaaacttggacaacacggagc

SEQ ID NO: 5124977 - DNA, 21 bp, Homo sapiens
acaaactttagggtaaaaatt

SEQ ID NO: 5124978 - DNA, 17 bp, Homo sapiens
acaaactttcaagtatt

SEQ ID NO: 5124979 - DNA, 22 bp, Homo sapiens
acaaactttcaagtattatatt

SEQ ID NO: 5124980 - DNA, 15 bp, Homo sapiens
acaaactttgttttt

SEQ ID NO: 5124981 - DNA, 16 bp, Homo sapiens
acaaagaaaaaagaag

SEQ ID NO: 5124982 - DNA, 22 bp, Homo sapiens
acaaagaaaaattaattaggaa

SEQ ID NO: 5124983 - DNA, 16 bp, Homo sapiens
acaaagaaaatgagaa

SEQ ID NO: 5124984 - DNA, 18 bp, Homo sapiens
acaaagaaacaaaatata

SEQ ID NO: 5124985 - DNA, 18 bp, Homo sapiens
acaaagaaacaaagatgt

SEQ ID NO: 5124986 - DNA, 17 bp, Homo sapiens
acaaagaaacaaagcaa

SEQ ID NO: 5124987 - DNA, 18 bp, Homo sapiens
acaaagaaactttttaat

SEQ ID NO: 5124988 - DNA, 16 bp, Homo sapiens
acaaagaaattatgtg

SEQ ID NO: 5124989 - DNA, 20 bp, Homo sapiens
acaaagaacctaacatttat

SEQ ID NO: 5124990 - DNA, 12 bp, Homo sapiens
acaaagaacctt

SEQ ID NO: 5124991 - DNA, 15 bp, Homo sapiens
acaaagaagaaagct

SEQ ID NO: 5124992 - DNA, 17 bp, Homo sapiens
acaaagaaggaaaagag

SEQ ID NO: 5124993 - DNA, 11 bp, Homo sapiens
acaaagacagg

SEQ ID NO: 5124994 - DNA, 15 bp, Homo sapiens
acaaagacagggaat

SEQ ID NO: 5124995 - DNA, 12 bp, Homo sapiens
acaaagacatgg

SEQ ID NO: 5124996 - DNA, 14 bp, Homo sapiens
acaaagacatggaa

SEQ ID NO: 5124997 - DNA, 11 bp, Homo sapiens
acaaagacatt

SEQ ID NO: 5124998 - DNA, 17 bp, Homo sapiens
acaaagacattcttccc

SEQ ID NO: 5124999 - DNA, 13 bp, Homo sapiens
acaaagacattga

SEQ ID NO: 5125000 - DNA, 20 bp, Homo sapiens
acaaagactccttgtggact

SEQ ID NO: 5125001 - DNA, 18 bp, Homo sapiens
acaaagagaataaagact

SEQ ID NO: 5125002 - DNA, 17 bp, Homo sapiens
acaaagagacaaagctt

SEQ ID NO: 5125003 - DNA, 14 bp, Homo sapiens
acaaagaggacacc

SEQ ID NO: 5125004 - DNA, 20 bp, Homo sapiens
acaaagaggattagacagta

SEQ ID NO: 5125005 - DNA, 14 bp, Homo sapiens
acaaagagtgaaat

SEQ ID NO: 5125006 - DNA, 17 bp, Homo sapiens
acaaagagtgaaatatt

SEQ ID NO: 5125007 - DNA, 16 bp, Homo sapiens
acaaagagttcaagaa

SEQ ID NO: 5125008 - DNA, 22 bp, Homo sapiens
acaaagataacgcaggagagag

SEQ ID NO: 5125009 - DNA, 17 bp, Homo sapiens
acaaagatatcttttct

SEQ ID NO: 5125010 - DNA, 15 bp, Homo sapiens
acaaagatcaaatga

SEQ ID NO: 5125011 - DNA, 24 bp, Homo sapiens
acaaagatgtttgtcagatatgat

SEQ ID NO: 5125012 - DNA, 21 bp, Homo sapiens
acaaagattctccacttggcc

SEQ ID NO: 5125013 - DNA, 14 bp, Homo sapiens
acaaagattgagaa

SEQ ID NO: 5125014 - DNA, 16 bp, Homo sapiens
acaaagattgagaagc

SEQ ID NO: 5125015 - DNA, 17 bp, Homo sapiens
acaaagcaaatttcatt

SEQ ID NO: 5125016 - DNA, 16 bp, Homo sapiens
acaaagcacagtgtta

SEQ ID NO: 5125017 - DNA, 18 bp, Homo sapiens
acaaagcacagtttgaac

SEQ ID NO: 5125018 - DNA, 15 bp, Homo sapiens
acaaagcaccctgta

SEQ ID NO: 5125019 - DNA, 13 bp, Homo sapiens
acaaagcagccac

SEQ ID NO: 5125020 - DNA, 15 bp, Homo sapiens
acaaagcaggagtgg

SEQ ID NO: 5125021 - DNA, 18 bp, Homo sapiens
acaaagcaggagtggaag

SEQ ID NO: 5125022 - DNA, 21 bp, Homo sapiens
acaaagcagtatataataact

SEQ ID NO: 5125023 - DNA, 17 bp, Homo sapiens
acaaagcataatcaata

SEQ ID NO: 5125024 - DNA, 20 bp, Homo sapiens
acaaagcatcattgtaaatt

SEQ ID NO: 5125025 - DNA, 16 bp, Homo sapiens
acaaagcatgctcagt

SEQ ID NO: 5125026 - DNA, 19 bp, Homo sapiens
acaaagcatgggaaaaaga

SEQ ID NO: 5125027 - DNA, 20 bp, Homo sapiens
acaaagccaaacaaaactga

SEQ ID NO: 5125028 - DNA, 13 bp, Homo sapiens
acaaagccctgtc

SEQ ID NO: 5125029 - DNA, 14 bp, Homo sapiens
acaaagccctgtcc

SEQ ID NO: 5125030 - DNA, 23 bp, Homo sapiens
acaaagccttaagcaaattttgt

SEQ ID NO: 5125031 - DNA, 12 bp, Homo sapiens
acaaagccttac

SEQ ID NO: 5125032 - DNA, 23 bp, Homo sapiens
acaaagccttatcaagtgtcttc

SEQ ID NO: 5125033 - DNA, 20 bp, Homo sapiens
acaaagcgagatcccatctc

SEQ ID NO: 5125034 - DNA, 18 bp, Homo sapiens
acaaagcggctttctaat

SEQ ID NO: 5125035 - DNA, 16 bp, Homo sapiens
acaaagctaaatacat

SEQ ID NO: 5125036 - DNA, 20 bp, Homo sapiens
acaaagctaaatacatggaa

SEQ ID NO: 5125037 - DNA, 22 bp, Homo sapiens
acaaagctaggatggttctgtg

SEQ ID NO: 5125038 - DNA, 15 bp, Homo sapiens
acaaagctatttaag

SEQ ID NO: 5125039 - DNA, 16 bp, Homo sapiens
acaaagctatttaagt

SEQ ID NO: 5125040 - DNA, 22 bp, Homo sapiens
acaaagctctgaattcaggtcc

SEQ ID NO: 5125041 - DNA, 23 bp, Homo sapiens
acaaagctctgaattcaggtccc

SEQ ID NO: 5125042 - DNA, 13 bp, Homo sapiens
acaaagctgctaa

SEQ ID NO: 5125043 - DNA, 23 bp, Homo sapiens
acaaagctgctaaatctcctatt

SEQ ID NO: 5125044 - DNA, 17 bp, Homo sapiens
acaaagctgttaaactg

SEQ ID NO: 5125045 - DNA, 19 bp, Homo sapiens
acaaagctgttaaactgtt

SEQ ID NO: 5125046 - DNA, 23 bp, Homo sapiens
acaaagcttctatcccaggaggt

SEQ ID NO: 5125047 - DNA, 19 bp, Homo sapiens
acaaagctttgctacaaat

SEQ ID NO: 5125048 - DNA, 22 bp, Homo sapiens
acaaagctttgctacaaattta

SEQ ID NO: 5125049 - DNA, 13 bp, Homo sapiens
acaaaggaaaaag

SEQ ID NO: 5125050 - DNA, 24 bp, Homo sapiens
acaaaggaaaactcttggcctctg

SEQ ID NO: 5125051 - DNA, 11 bp, Homo sapiens
acaaaggaagt

SEQ ID NO: 5125052 - DNA, 14 bp, Homo sapiens
acaaaggacaaaaa

SEQ ID NO: 5125053 - DNA, 20 bp, Homo sapiens
acaaaggagcattaagccca

SEQ ID NO: 5125054 - DNA, 15 bp, Homo sapiens
acaaaggagcctgtg

SEQ ID NO: 5125055 - DNA, 23 bp, Homo sapiens
acaaaggagcctgtgaacccagg

SEQ ID NO: 5125056 - DNA, 22 bp, Homo sapiens
acaaaggagccttgataatact

SEQ ID NO: 5125057 - DNA, 21 bp, Homo sapiens
acaaaggaggacaagaccctc

SEQ ID NO: 5125058 - DNA, 16 bp, Homo sapiens
acaaaggatgaagaac

SEQ ID NO: 5125059 - DNA, 20 bp, Homo sapiens
acaaaggattaattgctgca

SEQ ID NO: 5125060 - DNA, 16 bp, Homo sapiens
acaaaggcaagactct

SEQ ID NO: 5125061 - DNA, 19 bp, Homo sapiens
acaaaggcaagttaagaga

SEQ ID NO: 5125062 - DNA, 23 bp, Homo sapiens
acaaaggcaagttaagagaaact

SEQ ID NO: 5125063 - DNA, 14 bp, Homo sapiens
acaaaggcagctgt

SEQ ID NO: 5125064 - DNA, 17 bp, Homo sapiens
acaaaggccaaactgct

SEQ ID NO: 5125065 - DNA, 12 bp, Homo sapiens
acaaaggcccag

SEQ ID NO: 5125066 - DNA, 18 bp, Homo sapiens
acaaaggctgacattcac

SEQ ID NO: 5125067 - DNA, 18 bp, Homo sapiens
acaaaggcttattaattt

SEQ ID NO: 5125068 - DNA, 17 bp, Homo sapiens
acaaagggaaagcctct

SEQ ID NO: 5125069 - DNA, 22 bp, Homo sapiens
acaaagggaagcagagcctggg

SEQ ID NO: 5125070 - DNA, 12 bp, Homo sapiens
acaaagggacac

SEQ ID NO: 5125071 - DNA, 19 bp, Homo sapiens
acaaagggacacacagtga

SEQ ID NO: 5125072 - DNA, 18 bp, Homo sapiens
acaaagggagggagcaag

SEQ ID NO: 5125073 - DNA, 18 bp, Homo sapiens
acaaagggattctccagg

SEQ ID NO: 5125074 - DNA, 22 bp, Homo sapiens
acaaagggcacagcatctgtag

SEQ ID NO: 5125075 - DNA, 16 bp, Homo sapiens
acaaagggcaggcctg

SEQ ID NO: 5125076 - DNA, 15 bp, Homo sapiens
acaaagggccatcgt

SEQ ID NO: 5125077 - DNA, 15 bp, Homo sapiens
acaaaggggaaagaa

SEQ ID NO: 5125078 - DNA, 14 bp, Homo sapiens
acaaaggggagaag

SEQ ID NO: 5125079 - DNA, 20 bp, Homo sapiens
acaaaggggagaagggccag

SEQ ID NO: 5125080 - DNA, 19 bp, Homo sapiens
acaaaggggatcataaagt

SEQ ID NO: 5125081 - DNA, 17 bp, Homo sapiens
acaaagggttttaatgt

SEQ ID NO: 5125082 - DNA, 22 bp, Homo sapiens
acaaaggtgaaaattgtttgta

SEQ ID NO: 5125083 - DNA, 19 bp, Homo sapiens
acaaaggtggaataaacat

SEQ ID NO: 5125084 - DNA, 24 bp, Homo sapiens
acaaaggtggaataaacattaatt

SEQ ID NO: 5125085 - DNA, 12 bp, Homo sapiens
acaaaggtggta

SEQ ID NO: 5125086 - DNA, 15 bp, Homo sapiens
acaaaggttccattc

SEQ ID NO: 5125087 - DNA, 18 bp, Homo sapiens
acaaaggttccattcagt

SEQ ID NO: 5125088 - DNA, 21 bp, Homo sapiens
acaaaggttccattcagtgca

SEQ ID NO: 5125089 - DNA, 18 bp, Homo sapiens
acaaaggtttaaatgaac

SEQ ID NO: 5125090 - DNA, 21 bp, Homo sapiens
acaaaggttttcctcttctat

SEQ ID NO: 5125091 - DNA, 14 bp, Homo sapiens
acaaagtaaaatga

SEQ ID NO: 5125092 - DNA, 14 bp, Homo sapiens
acaaagtaaataca

SEQ ID NO: 5125093 - DNA, 20 bp, Homo sapiens
acaaagtaaatacaagactg

SEQ ID NO: 5125094 - DNA, 21 bp, Homo sapiens
acaaagtaaatacaagactgt

SEQ ID NO: 5125095 - DNA, 22 bp, Homo sapiens
acaaagtaaatacaagactgtt

SEQ ID NO: 5125096 - DNA, 15 bp, Homo sapiens
acaaagtaatttctt

SEQ ID NO: 5125097 - DNA, 17 bp, Homo sapiens
acaaagtacagaaaaat

SEQ ID NO: 5125098 - DNA, 23 bp, Homo sapiens
acaaagtactctttaacatacaa

SEQ ID NO: 5125099 - DNA, 17 bp, Homo sapiens
acaaagtagagaagtat

SEQ ID NO: 5125100 - DNA, 22 bp, Homo sapiens
acaaagtatatttaaggattat

SEQ ID NO: 5125101 - DNA, 15 bp, Homo sapiens
acaaagtattaagca

SEQ ID NO: 5125102 - DNA, 22 bp, Homo sapiens
acaaagtcaataaaagagctgt

SEQ ID NO: 5125103 - DNA, 16 bp, Homo sapiens
acaaagtcacagtcgt

SEQ ID NO: 5125104 - DNA, 17 bp, Homo sapiens
acaaagtctaaggaaga

SEQ ID NO: 5125105 - DNA, 15 bp, Homo sapiens
acaaagtctccagcc

SEQ ID NO: 5125106 - DNA, 22 bp, Homo sapiens
acaaagtgaaattagtattttg

SEQ ID NO: 5125107 - DNA, 12 bp, Homo sapiens
acaaagtgcaaa

SEQ ID NO: 5125108 - DNA, 14 bp, Homo sapiens
acaaagtgcaaagc

SEQ ID NO: 5125109 - DNA, 16 bp, Homo sapiens
acaaagtgcaaagctg

SEQ ID NO: 5125110 - DNA, 18 bp, Homo sapiens
acaaagtgcaaagctgct

SEQ ID NO: 5125111 - DNA, 23 bp, Homo sapiens
acaaagtgcaaagctgcttgaat

SEQ ID NO: 5125112 - DNA, 23 bp, Homo sapiens
acaaagtgccaaagaaagtggtc

SEQ ID NO: 5125113 - DNA, 23 bp, Homo sapiens
acaaagtgccgtgataatttttg

SEQ ID NO: 5125114 - DNA, 15 bp, Homo sapiens
acaaagtggaaggaa

SEQ ID NO: 5125115 - DNA, 12 bp, Homo sapiens
aattctttagat

SEQ ID NO: 5125116 - DNA, 21 bp, Homo sapiens
aattctttatcccattttatc

SEQ ID NO: 5125117 - DNA, 16 bp, Homo sapiens
aattctttatttctgt

SEQ ID NO: 5125118 - DNA, 13 bp, Homo sapiens
aattctttcaagt

SEQ ID NO: 5125119 - DNA, 17 bp, Homo sapiens
aattctttcaatacaga

SEQ ID NO: 5125120 - DNA, 18 bp, Homo sapiens
aattctttcaatacagat

SEQ ID NO: 5125121 - DNA, 21 bp, Homo sapiens
aattctttcaatacagatata

SEQ ID NO: 5125122 - DNA, 12 bp, Homo sapiens
aattctttctat

SEQ ID NO: 5125123 - DNA, 19 bp, Homo sapiens
aattctttctattttcaca

SEQ ID NO: 5125124 - DNA, 22 bp, Homo sapiens
aattctttctattttcacaatt

SEQ ID NO: 5125125 - DNA, 12 bp, Homo sapiens
aattctttctca

SEQ ID NO: 5125126 - DNA, 15 bp, Homo sapiens
aattctttctgtctc

SEQ ID NO: 5125127 - DNA, 21 bp, Homo sapiens
aattctttctgttgaaaagca

SEQ ID NO: 5125128 - DNA, 23 bp, Homo sapiens
aattcttttatctttattttagt

SEQ ID NO: 5125129 - DNA, 17 bp, Homo sapiens
aattcttttcctctctt

SEQ ID NO: 5125130 - DNA, 14 bp, Homo sapiens
aattcttttctgag

SEQ ID NO: 5125131 - DNA, 15 bp, Homo sapiens
aattcttttctgagg

SEQ ID NO: 5125132 - DNA, 18 bp, Homo sapiens
aattcttttctgtttctg

SEQ ID NO: 5125133 - DNA, 11 bp, Homo sapiens
aattcttttga

SEQ ID NO: 5125134 - DNA, 17 bp, Homo sapiens
aattcttttgaaagatg

SEQ ID NO: 5125135 - DNA, 23 bp, Homo sapiens
aattcttttgaaagatggtaatc

SEQ ID NO: 5125136 - DNA, 17 bp, Homo sapiens
aattcttttgaattgtt

SEQ ID NO: 5125137 - DNA, 22 bp, Homo sapiens
aattctttttcaaaaattacac

SEQ ID NO: 5125138 - DNA, 14 bp, Homo sapiens
aattcttttttatt

SEQ ID NO: 5125139 - DNA, 22 bp, Homo sapiens
aattgaaaaaagtggaaaacat

SEQ ID NO: 5125140 - DNA, 23 bp, Homo sapiens
aattgaaaaacaattttctgtaa

SEQ ID NO: 5125141 - DNA, 17 bp, Homo sapiens
aattgaaaaactcttta

SEQ ID NO: 5125142 - DNA, 21 bp, Homo sapiens
aattgaaaacactaacaaaat

SEQ ID NO: 5125143 - DNA, 18 bp, Homo sapiens
aattgaaaactttggaga

SEQ ID NO: 5125144 - DNA, 18 bp, Homo sapiens
aattgaaactagttattt

SEQ ID NO: 5125145 - DNA, 21 bp, Homo sapiens
aattgaaagcactatgaattt

SEQ ID NO: 5125146 - DNA, 17 bp, Homo sapiens
aattgaaaggcattctc

SEQ ID NO: 5125147 - DNA, 22 bp, Homo sapiens
aattgaaagggacaagtatcat

SEQ ID NO: 5125148 - DNA, 14 bp, Homo sapiens
aattgaaagtattc

SEQ ID NO: 5125149 - DNA, 13 bp, Homo sapiens
aattgaaatttaa

SEQ ID NO: 5125150 - DNA, 21 bp, Homo sapiens
aattgaaatttttaaatcatt

SEQ ID NO: 5125151 - DNA, 17 bp, Homo sapiens
aattgaacaataaagtt

SEQ ID NO: 5125152 - DNA, 21 bp, Homo sapiens
aattgaacttaaataaatgtc

SEQ ID NO: 5125153 - DNA, 23 bp, Homo sapiens
aattgaagagagatatatctgaa

SEQ ID NO: 5125154 - DNA, 20 bp, Homo sapiens
aattgaagagatttcaacat

SEQ ID NO: 5125155 - DNA, 21 bp, Homo sapiens
aattgaagagatttcaacata

SEQ ID NO: 5125156 - DNA, 13 bp, Homo sapiens
aattgaagcatga

SEQ ID NO: 5125157 - DNA, 18 bp, Homo sapiens
aattgaagccagaccatg

SEQ ID NO: 5125158 - DNA, 18 bp, Homo sapiens
aattgaagctttacttta

SEQ ID NO: 5125159 - DNA, 20 bp, Homo sapiens
aattgaagctttactttaga

SEQ ID NO: 5125160 - DNA, 22 bp, Homo sapiens
aattgaagctttactttagaat

SEQ ID NO: 5125161 - DNA, 21 bp, Homo sapiens
aattgaaggtttttgatagca

SEQ ID NO: 5125162 - DNA, 18 bp, Homo sapiens
aattgaagtaaacttttt

SEQ ID NO: 5125163 - DNA, 21 bp, Homo sapiens
aattgaagtacttaattgaag

SEQ ID NO: 5125164 - DNA, 16 bp, Homo sapiens
aattgaagtcatcata

SEQ ID NO: 5125165 - DNA, 20 bp, Homo sapiens
aattgaagtgtataatataa

SEQ ID NO: 5125166 - DNA, 20 bp, Homo sapiens
aattgaagtttcaagtttta

SEQ ID NO: 5125167 - DNA, 22 bp, Homo sapiens
aattgaataatggtaccagata

SEQ ID NO: 5125168 - DNA, 16 bp, Homo sapiens
aattgaatacacaaat

SEQ ID NO: 5125169 - DNA, 21 bp, Homo sapiens
aattgaatcagtataaacaaa

SEQ ID NO: 5125170 - DNA, 21 bp, Homo sapiens
aattgaattcgtttctgacat

SEQ ID NO: 5125171 - DNA, 20 bp, Homo sapiens
aattgacaagctaggaaaga

SEQ ID NO: 5125172 - DNA, 20 bp, Homo sapiens
aattgacactatatatttct

SEQ ID NO: 5125173 - DNA, 23 bp, Homo sapiens
aattgacactatatatttcttaa

SEQ ID NO: 5125174 - DNA, 23 bp, Homo sapiens
aattgacagatgaaaggagacaa

SEQ ID NO: 5125175 - DNA, 16 bp, Homo sapiens
aattgacatgaccctc

SEQ ID NO: 5125176 - DNA, 20 bp, Homo sapiens
aattgacatgttgtcacatt

SEQ ID NO: 5125177 - DNA, 12 bp, Homo sapiens
aattgacattct

SEQ ID NO: 5125178 - DNA, 16 bp, Homo sapiens
aattgaccaagtgatg

SEQ ID NO: 5125179 - DNA, 18 bp, Homo sapiens
aattgaccatctgctttt

SEQ ID NO: 5125180 - DNA, 21 bp, Homo sapiens
aattgacccacaagaaatgaa

SEQ ID NO: 5125181 - DNA, 17 bp, Homo sapiens
aattgaccctagccaga

SEQ ID NO: 5125182 - DNA, 15 bp, Homo sapiens
aattgactcaaatct

SEQ ID NO: 5125183 - DNA, 13 bp, Homo sapiens
aattgactgaaat

SEQ ID NO: 5125184 - DNA, 18 bp, Homo sapiens
aattgactgaaattactt

SEQ ID NO: 5125185 - DNA, 21 bp, Homo sapiens
aattgactgatgattttcctt

SEQ ID NO: 5125186 - DNA, 14 bp, Homo sapiens
aattgactgtcact

SEQ ID NO: 5125187 - DNA, 14 bp, Homo sapiens
aattgacttagata

SEQ ID NO: 5125188 - DNA, 21 bp, Homo sapiens
aattgacttatttatataaat

SEQ ID NO: 5125189 - DNA, 19 bp, Homo sapiens
aattgacttctattttcct

SEQ ID NO: 5125190 - DNA, 23 bp, Homo sapiens
aattgagaaaaatatatactaaa

SEQ ID NO: 5125191 - DNA, 12 bp, Homo sapiens
aattgagaaaca

SEQ ID NO: 5125192 - DNA, 20 bp, Homo sapiens
aattgagaagcgtatgtttt

SEQ ID NO: 5125193 - DNA, 15 bp, Homo sapiens
aattgagaaggaaaa

SEQ ID NO: 5125194 - DNA, 18 bp, Homo sapiens
aattgagaataagaattt

SEQ ID NO: 5125195 - DNA, 17 bp, Homo sapiens
aattgagaatagaaatt

SEQ ID NO: 5125196 - DNA, 11 bp, Homo sapiens
aattgagaatg

SEQ ID NO: 5125197 - DNA, 18 bp, Homo sapiens
aattgagactgaaagaaa

SEQ ID NO: 5125198 - DNA, 22 bp, Homo sapiens
aattgagagaatggaaaacaga

SEQ ID NO: 5125199 - DNA, 15 bp, Homo sapiens
aattgagagctttat

SEQ ID NO: 5125200 - DNA, 15 bp, Homo sapiens
aattgagattagagg

SEQ ID NO: 5125201 - DNA, 17 bp, Homo sapiens
aattgagcctaaaaata

SEQ ID NO: 5125202 - DNA, 23 bp, Homo sapiens
aattgagcctaaaaataaagcac

SEQ ID NO: 5125203 - DNA, 13 bp, Homo sapiens
aattgagcttaca

SEQ ID NO: 5125204 - DNA, 19 bp, Homo sapiens
aattgaggaaaaactgaca

SEQ ID NO: 5125205 - DNA, 17 bp, Homo sapiens
aattgaggcttacagta

SEQ ID NO: 5125206 - DNA, 17 bp, Homo sapiens
aattgaggggattaata

SEQ ID NO: 5125207 - DNA, 16 bp, Homo sapiens
aattgagtaattctag

SEQ ID NO: 5125208 - DNA, 15 bp, Homo sapiens
aattgagttaaatca

SEQ ID NO: 5125209 - DNA, 22 bp, Homo sapiens
aattgagtttcagaataaaatt

SEQ ID NO: 5125210 - DNA, 16 bp, Homo sapiens
aattgataaaagagtt

SEQ ID NO: 5125211 - DNA, 14 bp, Homo sapiens
aattgataataaac

SEQ ID NO: 5125212 - DNA, 14 bp, Homo sapiens
aattgatacttcag

SEQ ID NO: 5125213 - DNA, 22 bp, Homo sapiens
aattgatagcaggtgtaataag

SEQ ID NO: 5125214 - DNA, 19 bp, Homo sapiens
aattgatccttaaccaata

SEQ ID NO: 5125215 - DNA, 13 bp, Homo sapiens
aattgatctgttt

SEQ ID NO: 5125216 - DNA, 16 bp, Homo sapiens
aattgatctgttttgg

SEQ ID NO: 5125217 - DNA, 13 bp, Homo sapiens
aattgatcttttt

SEQ ID NO: 5125218 - DNA, 21 bp, Homo sapiens
aattgatgatgttgtaaaatg

SEQ ID NO: 5125219 - DNA, 13 bp, Homo sapiens
aattgatggacta

SEQ ID NO: 5125220 - DNA, 21 bp, Homo sapiens
aattgatgtcggtcatagttt

SEQ ID NO: 5125221 - DNA, 14 bp, Homo sapiens
aattgatgtgatta

SEQ ID NO: 5125222 - DNA, 13 bp, Homo sapiens
aattgatgttgat

SEQ ID NO: 5125223 - DNA, 14 bp, Homo sapiens
aattgatgttgatg

SEQ ID NO: 5125224 - DNA, 17 bp, Homo sapiens
aattgatgttgatgcaa

SEQ ID NO: 5125225 - DNA, 13 bp, Homo sapiens
aattgatgtttta

SEQ ID NO: 5125226 - DNA, 20 bp, Homo sapiens
aattgatgttttacgtgcaa

SEQ ID NO: 5125227 - DNA, 14 bp, Homo sapiens
aattgattaaaatc

SEQ ID NO: 5125228 - DNA, 14 bp, Homo sapiens
aattgattattctg

SEQ ID NO: 5125229 - DNA, 18 bp, Homo sapiens
aattgattgaattaaatc

SEQ ID NO: 5125230 - DNA, 23 bp, Homo sapiens
aattgattgggcacatcatttca

SEQ ID NO: 5125231 - DNA, 15 bp, Homo sapiens
aattgattgtcagcc

SEQ ID NO: 5125232 - DNA, 13 bp, Homo sapiens
aattgatttccaa

SEQ ID NO: 5125233 - DNA, 21 bp, Homo sapiens
aattgatttcttttcttcctg

SEQ ID NO: 5125234 - DNA, 16 bp, Homo sapiens
aattgatttgcattga

SEQ ID NO: 5125235 - DNA, 14 bp, Homo sapiens
aattgattttgaac

SEQ ID NO: 5125236 - DNA, 21 bp, Homo sapiens
aattgatttttaaacagcagg

SEQ ID NO: 5125237 - DNA, 19 bp, Homo sapiens
aattgatttttctcttcat

SEQ ID NO: 5125238 - DNA, 20 bp, Homo sapiens
aattgcaaaaacatagaaat

SEQ ID NO: 5125239 - DNA, 17 bp, Homo sapiens
aattgcaaaactagaca

SEQ ID NO: 5125240 - DNA, 19 bp, Homo sapiens
aattgcaaaactagacaaa

SEQ ID NO: 5125241 - DNA, 14 bp, Homo sapiens
aattgcaacaatgc

SEQ ID NO: 5125242 - DNA, 16 bp, Homo sapiens
aattgcaacaatgcaa

SEQ ID NO: 5125243 - DNA, 23 bp, Homo sapiens
aattgcaacaatgcaaaagccaa

SEQ ID NO: 5125244 - DNA, 15 bp, Homo sapiens
aattgcaagggaaga

SEQ ID NO: 5125245 - DNA, 18 bp, Homo sapiens
aattgcaatatataagac

SEQ ID NO: 5125246 - DNA, 13 bp, Homo sapiens
aattgcaatttct

SEQ ID NO: 5125247 - DNA, 15 bp, Homo sapiens
aattgcacaaataca

SEQ ID NO: 5125248 - DNA, 16 bp, Homo sapiens
aattgcacaaatacaa

SEQ ID NO: 5125249 - DNA, 21 bp, Homo sapiens
aattgcacaatttgagcaatt

SEQ ID NO: 5125250 - DNA, 20 bp, Homo sapiens
aattgcacagaagtcctgta

SEQ ID NO: 5125251 - DNA, 14 bp, Homo sapiens
aattgcacatctaa

SEQ ID NO: 5125252 - DNA, 22 bp, Homo sapiens
aattgcacgcggagtgagtttt

SEQ ID NO: 5125253 - DNA, 17 bp, Homo sapiens
aattgcactcatgtgga

SEQ ID NO: 5125254 - DNA, 13 bp, Homo sapiens
aattgcactgaag

SEQ ID NO: 5125255 - DNA, 20 bp, Homo sapiens
aattgcactgaagtttttga

SEQ ID NO: 5125256 - DNA, 21 bp, Homo sapiens
aattgcactgaagtttttgaa

SEQ ID NO: 5125257 - DNA, 23 bp, Homo sapiens
aattgcactgaagtttttgaaat

SEQ ID NO: 5125258 - DNA, 21 bp, Homo sapiens
aattgcagtaaagtcttgtct

SEQ ID NO: 5125259 - DNA, 16 bp, Homo sapiens
aattgcataaagcata

SEQ ID NO: 5125260 - DNA, 16 bp, Homo sapiens
aattgcatactttgta

SEQ ID NO: 5125261 - DNA, 22 bp, Homo sapiens
aattgcatactttgtattttga

SEQ ID NO: 5125262 - DNA, 19 bp, Homo sapiens
aattgcatcagttcattga

SEQ ID NO: 5125263 - DNA, 23 bp, Homo sapiens
aattgcatcagttcattgacctc

SEQ ID NO: 5125264 - DNA, 15 bp, Homo sapiens
aattgcatgaaaata

SEQ ID NO: 5125265 - DNA, 22 bp, Homo sapiens
aattgcatgctgctttaattgt

SEQ ID NO: 5125266 - DNA, 21 bp, Homo sapiens
aattgcattcattgacttcag

SEQ ID NO: 5125267 - DNA, 20 bp, Homo sapiens
aattgcattctgaatgaata

SEQ ID NO: 5125268 - DNA, 21 bp, Homo sapiens
aattgcatttctatgccattt

SEQ ID NO: 5125269 - DNA, 17 bp, Homo sapiens
aattgcatttttacctt

SEQ ID NO: 5125270 - DNA, 23 bp, Homo sapiens
aattgccaacataagttaataga

SEQ ID NO: 5125271 - DNA, 15 bp, Homo sapiens
aattgccaatcttgt

SEQ ID NO: 5125272 - DNA, 16 bp, Homo sapiens
aattgccaatcttgtt

SEQ ID NO: 5125273 - DNA, 23 bp, Homo sapiens
aattgccacctctaacagcacca

SEQ ID NO: 5125274 - DNA, 12 bp, Homo sapiens
aattgccagctg

SEQ ID NO: 5125275 - DNA, 19 bp, Homo sapiens
aattgccatagaaagtata

SEQ ID NO: 5125276 - DNA, 20 bp, Homo sapiens
aattgccatagaaagtataa

SEQ ID NO: 5125277 - DNA, 20 bp, Homo sapiens
aattgccatgtacagtatgt

SEQ ID NO: 5125278 - DNA, 22 bp, Homo sapiens
aattgccattttattaaacatt

SEQ ID NO: 5125279 - DNA, 17 bp, Homo sapiens
aattgccctatgctgtg

SEQ ID NO: 5125280 - DNA, 14 bp, Homo sapiens
aattgccctgccag

SEQ ID NO: 5125281 - DNA, 15 bp, Homo sapiens
aattgccctgttgcc

SEQ ID NO: 5125282 - DNA, 15 bp, Homo sapiens
aattgcctacattta

SEQ ID NO: 5125283 - DNA, 20 bp, Homo sapiens
aattgcctataatacttgca

SEQ ID NO: 5125284 - DNA, 22 bp, Homo sapiens
aattgcctataatacttgcaac

SEQ ID NO: 5125285 - DNA, 13 bp, Homo sapiens
aattgcctccctt

SEQ ID NO: 5125286 - DNA, 23 bp, Homo sapiens
aattgcctgacgaactccttgat

SEQ ID NO: 5125287 - DNA, 14 bp, Homo sapiens
aattgcctgatttg

SEQ ID NO: 5125288 - DNA, 13 bp, Homo sapiens
aattgcctgttaa

SEQ ID NO: 5125289 - DNA, 15 bp, Homo sapiens
aattgcctgttcata

SEQ ID NO: 5125290 - DNA, 15 bp, Homo sapiens
aattgcctttaaaac

SEQ ID NO: 5125291 - DNA, 14 bp, Homo sapiens
aattgcctttctgt

SEQ ID NO: 5125292 - DNA, 20 bp, Homo sapiens
acaaagtgggtactttctga

SEQ ID NO: 5125293 - DNA, 13 bp, Homo sapiens
acaaagtgttgaa

SEQ ID NO: 5125294 - DNA, 16 bp, Homo sapiens
acaaagtgttgaaaat

SEQ ID NO: 5125295 - DNA, 18 bp, Homo sapiens
acaaagttacaaattcaa

SEQ ID NO: 5125296 - DNA, 14 bp, Homo sapiens
acaaagttcactgt

SEQ ID NO: 5125297 - DNA, 18 bp, Homo sapiens
acaaagttcactgtttat

SEQ ID NO: 5125298 - DNA, 22 bp, Homo sapiens
acaaagttgattaagaaaggaa

SEQ ID NO: 5125299 - DNA, 19 bp, Homo sapiens
acaaagtttaccagaaagc

SEQ ID NO: 5125300 - DNA, 18 bp, Homo sapiens
acaaagtttatcttggcc

SEQ ID NO: 5125301 - DNA, 19 bp, Homo sapiens
acaaagtttcagagtatat

SEQ ID NO: 5125302 - DNA, 12 bp, Homo sapiens
acaaataaacag

SEQ ID NO: 5125303 - DNA, 17 bp, Homo sapiens
acaaataaacagttgtt

SEQ ID NO: 5125304 - DNA, 11 bp, Homo sapiens
acaaataaacc

SEQ ID NO: 5125305 - DNA, 15 bp, Homo sapiens
acaaataaacctgag

SEQ ID NO: 5125306 - DNA, 17 bp, Homo sapiens
acaaataaacctgaggc

SEQ ID NO: 5125307 - DNA, 18 bp, Homo sapiens
acaaataaacctgaggca

SEQ ID NO: 5125308 - DNA, 14 bp, Homo sapiens
acaaataaagatgg

SEQ ID NO: 5125309 - DNA, 18 bp, Homo sapiens
acaaataaatagttgctc

SEQ ID NO: 5125310 - DNA, 23 bp, Homo sapiens
acaaataacaacttttttttctt

SEQ ID NO: 5125311 - DNA, 16 bp, Homo sapiens
acaaataagattaata

SEQ ID NO: 5125312 - DNA, 11 bp, Homo sapiens
acaaataattt

SEQ ID NO: 5125313 - DNA, 15 bp, Homo sapiens
acaaatacacataca

SEQ ID NO: 5125314 - DNA, 16 bp, Homo sapiens
acaaatacacatacat

SEQ ID NO: 5125315 - DNA, 14 bp, Homo sapiens
acaaatacatgtgt

SEQ ID NO: 5125316 - DNA, 22 bp, Homo sapiens
acaaatacattcaaattctttt

SEQ ID NO: 5125317 - DNA, 15 bp, Homo sapiens
acaaataccagagca

SEQ ID NO: 5125318 - DNA, 12 bp, Homo sapiens
acaaatacctcc

SEQ ID NO: 5125319 - DNA, 22 bp, Homo sapiens
acaaatacctccattaaatggt

SEQ ID NO: 5125320 - DNA, 16 bp, Homo sapiens
acaaatactaaaaaga

SEQ ID NO: 5125321 - DNA, 14 bp, Homo sapiens
acaaatactcatgt

SEQ ID NO: 5125322 - DNA, 16 bp, Homo sapiens
acaaatactcatgtgt

SEQ ID NO: 5125323 - DNA, 15 bp, Homo sapiens
acaaatactcttagg

SEQ ID NO: 5125324 - DNA, 17 bp, Homo sapiens
acaaatactcttaggaa

SEQ ID NO: 5125325 - DNA, 23 bp, Homo sapiens
acaaatactcttaggaagagaaa

SEQ ID NO: 5125326 - DNA, 16 bp, Homo sapiens
acaaatactgcctagt

SEQ ID NO: 5125327 - DNA, 15 bp, Homo sapiens
acaaatacttattca

SEQ ID NO: 5125328 - DNA, 16 bp, Homo sapiens
acaaatacttattcat

SEQ ID NO: 5125329 - DNA, 15 bp, Homo sapiens
acaaatacttccata

SEQ ID NO: 5125330 - DNA, 13 bp, Homo sapiens
acaaatagaaaat

SEQ ID NO: 5125331 - DNA, 22 bp, Homo sapiens
acaaataggtagagtcattcat

SEQ ID NO: 5125332 - DNA, 21 bp, Homo sapiens
acaaatagtaggcaagatggc

SEQ ID NO: 5125333 - DNA, 20 bp, Homo sapiens
acaaatagtgcaactatgaa

SEQ ID NO: 5125334 - DNA, 19 bp, Homo sapiens
acaaatagtgctaataaag

SEQ ID NO: 5125335 - DNA, 16 bp, Homo sapiens
acaaatataagaataa

SEQ ID NO: 5125336 - DNA, 18 bp, Homo sapiens
acaaatatactcatttgg

SEQ ID NO: 5125337 - DNA, 22 bp, Homo sapiens
acaaatatgaaaaatgtaaata

SEQ ID NO: 5125338 - DNA, 15 bp, Homo sapiens
acaaatatgctttgg

SEQ ID NO: 5125339 - DNA, 19 bp, Homo sapiens
acaaatattcactggcccc

SEQ ID NO: 5125340 - DNA, 13 bp, Homo sapiens
acaaatattcaga

SEQ ID NO: 5125341 - DNA, 19 bp, Homo sapiens
acaaatattgcttggacta

SEQ ID NO: 5125342 - DNA, 22 bp, Homo sapiens
acaaatattgtcatctttttct

SEQ ID NO: 5125343 - DNA, 22 bp, Homo sapiens
acaaatattgttaccatgaaga

SEQ ID NO: 5125344 - DNA, 18 bp, Homo sapiens
acaaatatttattttctt

SEQ ID NO: 5125345 - DNA, 23 bp, Homo sapiens
acaaatatttattttctttctgt

SEQ ID NO: 5125346 - DNA, 13 bp, Homo sapiens
acaaatatttcac

SEQ ID NO: 5125347 - DNA, 20 bp, Homo sapiens
acaaatatttctagacactt

SEQ ID NO: 5125348 - DNA, 13 bp, Homo sapiens
acaaatattttca

SEQ ID NO: 5125349 - DNA, 14 bp, Homo sapiens
acaaatattttcat

SEQ ID NO: 5125350 - DNA, 17 bp, Homo sapiens
acaaatcacacctctgg

SEQ ID NO: 5125351 - DNA, 23 bp, Homo sapiens
acaaatcagaagtcatcttgcta

SEQ ID NO: 5125352 - DNA, 12 bp, Homo sapiens
acaaatcagtaa

SEQ ID NO: 5125353 - DNA, 13 bp, Homo sapiens
acaaatcagtaat

SEQ ID NO: 5125354 - DNA, 16 bp, Homo sapiens
acaaatcagtaatttt

SEQ ID NO: 5125355 - DNA, 15 bp, Homo sapiens
acaaatcataatgta

SEQ ID NO: 5125356 - DNA, 18 bp, Homo sapiens
acaaatcattttgatgta

SEQ ID NO: 5125357 - DNA, 21 bp, Homo sapiens
acaaatccaaaggaaagaata

SEQ ID NO: 5125358 - DNA, 12 bp, Homo sapiens
acaaatccacga

SEQ ID NO: 5125359 - DNA, 17 bp, Homo sapiens
acaaatcgtttctcaga

SEQ ID NO: 5125360 - DNA, 15 bp, Homo sapiens
acaaatctataaata

SEQ ID NO: 5125361 - DNA, 23 bp, Homo sapiens
acaaatctatattaaagtgttat

SEQ ID NO: 5125362 - DNA, 21 bp, Homo sapiens
acaaatctatgccactcagaa

SEQ ID NO: 5125363 - DNA, 14 bp, Homo sapiens
acaaatctatttaa

SEQ ID NO: 5125364 - DNA, 12 bp, Homo sapiens
acaaatctcaga

SEQ ID NO: 5125365 - DNA, 16 bp, Homo sapiens
acaaatctcagaacct

SEQ ID NO: 5125366 - DNA, 15 bp, Homo sapiens
acaaatctgtataaa

SEQ ID NO: 5125367 - DNA, 18 bp, Homo sapiens
acaaatctgtataaatgt

SEQ ID NO: 5125368 - DNA, 17 bp, Homo sapiens
acaaatctgtgtatatt

SEQ ID NO: 5125369 - DNA, 19 bp, Homo sapiens
acaaatcttgggtgggtga

SEQ ID NO: 5125370 - DNA, 15 bp, Homo sapiens
acaaatctttccata

SEQ ID NO: 5125371 - DNA, 11 bp, Homo sapiens
acaaatgaaaa

SEQ ID NO: 5125372 - DNA, 14 bp, Homo sapiens
acaaatgaaaacaa

SEQ ID NO: 5125373 - DNA, 21 bp, Homo sapiens
acaaatgaaagagaaaatata

SEQ ID NO: 5125374 - DNA, 21 bp, Homo sapiens
acaaatgaaatttaattacaa

SEQ ID NO: 5125375 - DNA, 21 bp, Homo sapiens
acaaatgaagaaagtcaaaaa

SEQ ID NO: 5125376 - DNA, 20 bp, Homo sapiens
acaaatgaagtatttcatgt

SEQ ID NO: 5125377 - DNA, 19 bp, Homo sapiens
acaaatgacagattctgac

SEQ ID NO: 5125378 - DNA, 17 bp, Homo sapiens
acaaatgactgtctctt

SEQ ID NO: 5125379 - DNA, 16 bp, Homo sapiens
acaaatgactttatta

SEQ ID NO: 5125380 - DNA, 21 bp, Homo sapiens
acaaatgattgcttttaaaat

SEQ ID NO: 5125381 - DNA, 18 bp, Homo sapiens
acaaatgcagacacacaa

SEQ ID NO: 5125382 - DNA, 16 bp, Homo sapiens
acaaatgcagtgtatt

SEQ ID NO: 5125383 - DNA, 16 bp, Homo sapiens
acaaatgcatctttga

SEQ ID NO: 5125384 - DNA, 15 bp, Homo sapiens
acaaatgcatttagt

SEQ ID NO: 5125385 - DNA, 16 bp, Homo sapiens
acaaatgccacacatc

SEQ ID NO: 5125386 - DNA, 20 bp, Homo sapiens
acaaatgccacacatcaccc

SEQ ID NO: 5125387 - DNA, 19 bp, Homo sapiens
acaaatgccttgaactgtt

SEQ ID NO: 5125388 - DNA, 23 bp, Homo sapiens
acaaatgccttgaactgttgtct

SEQ ID NO: 5125389 - DNA, 21 bp, Homo sapiens
acaaatgctcaaagaaatcta

SEQ ID NO: 5125390 - DNA, 22 bp, Homo sapiens
acaaatgctgcgcccttcccca

SEQ ID NO: 5125391 - DNA, 21 bp, Homo sapiens
acaaatgctggggtcatataa

SEQ ID NO: 5125392 - DNA, 12 bp, Homo sapiens
acaaatgcttta

SEQ ID NO: 5125393 - DNA, 15 bp, Homo sapiens
acaaatggaagagaa

SEQ ID NO: 5125394 - DNA, 15 bp, Homo sapiens
acaaatggacatagg

SEQ ID NO: 5125395 - DNA, 22 bp, Homo sapiens
acaaatggctacatctccaaat

SEQ ID NO: 5125396 - DNA, 19 bp, Homo sapiens
acaaatggctgtaaaacta

SEQ ID NO: 5125397 - DNA, 21 bp, Homo sapiens
acaaatgggactgatgtcatc

SEQ ID NO: 5125398 - DNA, 22 bp, Homo sapiens
acaaatgggactgatgtcatct

SEQ ID NO: 5125399 - DNA, 19 bp, Homo sapiens
acaaatgggttaatcctga

SEQ ID NO: 5125400 - DNA, 18 bp, Homo sapiens
acaaatgtaaacattttc

SEQ ID NO: 5125401 - DNA, 12 bp, Homo sapiens
acaaatgtcatt

SEQ ID NO: 5125402 - DNA, 14 bp, Homo sapiens
acaaatgtcattgt

SEQ ID NO: 5125403 - DNA, 16 bp, Homo sapiens
acaaatgtcattgtct

SEQ ID NO: 5125404 - DNA, 17 bp, Homo sapiens
acaaatgtcctcagagg

SEQ ID NO: 5125405 - DNA, 15 bp, Homo sapiens
acaaatgtgaagatg

SEQ ID NO: 5125406 - DNA, 12 bp, Homo sapiens
acaaatgtgata

SEQ ID NO: 5125407 - DNA, 14 bp, Homo sapiens
acaaatgtgatttt

SEQ ID NO: 5125408 - DNA, 17 bp, Homo sapiens
acaaatgtgctctatgt

SEQ ID NO: 5125409 - DNA, 18 bp, Homo sapiens
acaaatgtgctctatgtc

SEQ ID NO: 5125410 - DNA, 14 bp, Homo sapiens
acaaatgtgtatgt

SEQ ID NO: 5125411 - DNA, 21 bp, Homo sapiens
acaaatgtgtatttttgttgc

SEQ ID NO: 5125412 - DNA, 18 bp, Homo sapiens
acaaatgtgtcccagtga

SEQ ID NO: 5125413 - DNA, 14 bp, Homo sapiens
acaaatgtgtgact

SEQ ID NO: 5125414 - DNA, 22 bp, Homo sapiens
acaaatgtgtgggtttttaaaa

SEQ ID NO: 5125415 - DNA, 18 bp, Homo sapiens
acaaatgtgtttttctat

SEQ ID NO: 5125416 - DNA, 23 bp, Homo sapiens
acaaatgttcatatttattgatt

SEQ ID NO: 5125417 - DNA, 15 bp, Homo sapiens
acaaatgtttataac

SEQ ID NO: 5125418 - DNA, 22 bp, Homo sapiens
acaaatgtttataactctaggg

SEQ ID NO: 5125419 - DNA, 23 bp, Homo sapiens
acaaatgtttataactctaggga

SEQ ID NO: 5125420 - DNA, 13 bp, Homo sapiens
acaaatgttttaa

SEQ ID NO: 5125421 - DNA, 22 bp, Homo sapiens
acaaatgttttagtaaaaaaga

SEQ ID NO: 5125422 - DNA, 17 bp, Homo sapiens
acaaatgttttcattta

SEQ ID NO: 5125423 - DNA, 13 bp, Homo sapiens
acaaatgttttgc

SEQ ID NO: 5125424 - DNA, 14 bp, Homo sapiens
acaaatgttttgct

SEQ ID NO: 5125425 - DNA, 16 bp, Homo sapiens
acaaattaaaaagatt

SEQ ID NO: 5125426 - DNA, 21 bp, Homo sapiens
acaaattaaaaagattctttt

SEQ ID NO: 5125427 - DNA, 15 bp, Homo sapiens
acaaattaatatttg

SEQ ID NO: 5125428 - DNA, 17 bp, Homo sapiens
acaaattaatatttgtg

SEQ ID NO: 5125429 - DNA, 20 bp, Homo sapiens
acaaattaatatttgtgctt

SEQ ID NO: 5125430 - DNA, 18 bp, Homo sapiens
acaaattacaaaaggctc

SEQ ID NO: 5125431 - DNA, 22 bp, Homo sapiens
acaaattagaaaatgttattta

SEQ ID NO: 5125432 - DNA, 15 bp, Homo sapiens
acaaattagaggaga

SEQ ID NO: 5125433 - DNA, 19 bp, Homo sapiens
acaaattagcatgcaagct

SEQ ID NO: 5125434 - DNA, 16 bp, Homo sapiens
acaaattataatgtat

SEQ ID NO: 5125435 - DNA, 17 bp, Homo sapiens
acaaattataatgtatt

SEQ ID NO: 5125436 - DNA, 10 bp, Homo sapiens
acaaattatg

SEQ ID NO: 5125437 - DNA, 22 bp, Homo sapiens
acaaattcaagagctagaaaaa

SEQ ID NO: 5125438 - DNA, 22 bp, Homo sapiens
acaaattcaaggagatataaaa

SEQ ID NO: 5125439 - DNA, 15 bp, Homo sapiens
acaaattcagtctct

SEQ ID NO: 5125440 - DNA, 21 bp, Homo sapiens
acaaattcagtggacatttgt

SEQ ID NO: 5125441 - DNA, 17 bp, Homo sapiens
acaaattcctttcagag

SEQ ID NO: 5125442 - DNA, 18 bp, Homo sapiens
acaaattcctttcagagt

SEQ ID NO: 5125443 - DNA, 21 bp, Homo sapiens
acaaattctgaatattttttg

SEQ ID NO: 5125444 - DNA, 13 bp, Homo sapiens
acaaattctttag

SEQ ID NO: 5125445 - DNA, 23 bp, Homo sapiens
acaaattctttagtactcaatgt

SEQ ID NO: 5125446 - DNA, 15 bp, Homo sapiens
acaaattgagacagt

SEQ ID NO: 5125447 - DNA, 12 bp, Homo sapiens
acaaattgcatt

SEQ ID NO: 5125448 - DNA, 14 bp, Homo sapiens
acaaatttaaaaca

SEQ ID NO: 5125449 - DNA, 20 bp, Homo sapiens
acaaatttagccaataaaga

SEQ ID NO: 5125450 - DNA, 13 bp, Homo sapiens
acaaatttataaa

SEQ ID NO: 5125451 - DNA, 14 bp, Homo sapiens
acaaatttataaag

SEQ ID NO: 5125452 - DNA, 18 bp, Homo sapiens
acaaatttatgcatttca

SEQ ID NO: 5125453 - DNA, 22 bp, Homo sapiens
acaaatttatgcatttcattca

SEQ ID NO: 5125454 - DNA, 16 bp, Homo sapiens
acaaatttcattgcac

SEQ ID NO: 5125455 - DNA, 21 bp, Homo sapiens
acaaatttggccttaagaact

SEQ ID NO: 5125456 - DNA, 22 bp, Homo sapiens
acaaatttggccttaagaactg

SEQ ID NO: 5125457 - DNA, 17 bp, Homo sapiens
acaaattttcaagttta

SEQ ID NO: 5125458 - DNA, 15 bp, Homo sapiens
acaaattttcacaat

SEQ ID NO: 5125459 - DNA, 20 bp, Homo sapiens
acaaattttcccagtgaata

SEQ ID NO: 5125460 - DNA, 15 bp, Homo sapiens
acaaattttgcatat

SEQ ID NO: 5125461 - DNA, 16 bp, Homo sapiens
acaaattttgcatatt

SEQ ID NO: 5125462 - DNA, 16 bp, Homo sapiens
acaaattttgtataac

SEQ ID NO: 5125463 - DNA, 15 bp, Homo sapiens
acaaatttttactca

SEQ ID NO: 5125464 - DNA, 18 bp, Homo sapiens
acaaatttttatttctaa

SEQ ID NO: 5125465 - DNA, 14 bp, Homo sapiens
acaaatttttctgt

SEQ ID NO: 5125466 - DNA, 16 bp, Homo sapiens
acaaatttttctgtgg

SEQ ID NO: 5125467 - DNA, 17 bp, Homo sapiens
acaaattttttaatttc

SEQ ID NO: 5125468 - DNA, 23 bp, Homo sapiens
acaaattttttaatttccaaaat

SEQ ID NO: 5125469 - DNA, 9 bp, Homo sapiens
acaacaaaa

SEQ ID NO: 5125470 - DNA, 14 bp, Homo sapiens
acaacaaaaaataa

SEQ ID NO: 5125471 - DNA, 19 bp, Homo sapiens
aattgcctttctgtgttta

SEQ ID NO: 5125472 - DNA, 13 bp, Homo sapiens
aattgcctttgag

SEQ ID NO: 5125473 - DNA, 23 bp, Homo sapiens
aattgccttttttctgtataaat

SEQ ID NO: 5125474 - DNA, 14 bp, Homo sapiens
aattgcgctcaggg

SEQ ID NO: 5125475 - DNA, 15 bp, Homo sapiens
aattgcgctcagggg

SEQ ID NO: 5125476 - DNA, 16 bp, Homo sapiens
aattgcgctcaggggc

SEQ ID NO: 5125477 - DNA, 20 bp, Homo sapiens
aattgcgctcaggggctcca

SEQ ID NO: 5125478 - DNA, 15 bp, Homo sapiens
aattgctaacaattg

SEQ ID NO: 5125479 - DNA, 14 bp, Homo sapiens
aattgctaattctg

SEQ ID NO: 5125480 - DNA, 15 bp, Homo sapiens
aattgctaattctga

SEQ ID NO: 5125481 - DNA, 16 bp, Homo sapiens
aattgctacatctaaa

SEQ ID NO: 5125482 - DNA, 19 bp, Homo sapiens
aattgctagtcagggtgaa

SEQ ID NO: 5125483 - DNA, 12 bp, Homo sapiens
aattgctataaa

SEQ ID NO: 5125484 - DNA, 13 bp, Homo sapiens
aattgctatgtta

SEQ ID NO: 5125485 - DNA, 21 bp, Homo sapiens
aattgctatgttactattttc

SEQ ID NO: 5125486 - DNA, 15 bp, Homo sapiens
aattgctattttatt

SEQ ID NO: 5125487 - DNA, 17 bp, Homo sapiens
aattgctcacagttatt

SEQ ID NO: 5125488 - DNA, 18 bp, Homo sapiens
aattgctcataagcaata

SEQ ID NO: 5125489 - DNA, 15 bp, Homo sapiens
aattgctccattcct

SEQ ID NO: 5125490 - DNA, 23 bp, Homo sapiens
aattgctcctgcatgcaactaat

SEQ ID NO: 5125491 - DNA, 21 bp, Homo sapiens
aattgctctatgcctcagttt

SEQ ID NO: 5125492 - DNA, 19 bp, Homo sapiens
aattgctctgtgtatatct

SEQ ID NO: 5125493 - DNA, 21 bp, Homo sapiens
aattgctctgtgtatatctct

SEQ ID NO: 5125494 - DNA, 23 bp, Homo sapiens
aattgctcttggctgtgaaaaga

SEQ ID NO: 5125495 - DNA, 23 bp, Homo sapiens
aattgctctttcacaggtagcct

SEQ ID NO: 5125496 - DNA, 21 bp, Homo sapiens
aattgctgaagggcattcttt

SEQ ID NO: 5125497 - DNA, 19 bp, Homo sapiens
aattgctgaggagctcagg

SEQ ID NO: 5125498 - DNA, 21 bp, Homo sapiens
aattgctggaacccaggaggt

SEQ ID NO: 5125499 - DNA, 17 bp, Homo sapiens
aattgctggatgcattt

SEQ ID NO: 5125500 - DNA, 19 bp, Homo sapiens
aattgctggatgcattttt

SEQ ID NO: 5125501 - DNA, 18 bp, Homo sapiens
aattgctgttgaaagcaa

SEQ ID NO: 5125502 - DNA, 20 bp, Homo sapiens
aattgctgttgaaagcaaaa

SEQ ID NO: 5125503 - DNA, 17 bp, Homo sapiens
aattgcttaaaagacat

SEQ ID NO: 5125504 - DNA, 19 bp, Homo sapiens
aattgcttaccaaaggata

SEQ ID NO: 5125505 - DNA, 19 bp, Homo sapiens
aattgcttactcattaaaa

SEQ ID NO: 5125506 - DNA, 23 bp, Homo sapiens
aattgcttactttggaatacatt

SEQ ID NO: 5125507 - DNA, 14 bp, Homo sapiens
aattgcttctaaaa

SEQ ID NO: 5125508 - DNA, 20 bp, Homo sapiens
aattgcttgaacccaggagg

SEQ ID NO: 5125509 - DNA, 16 bp, Homo sapiens
aattgcttgaacctgt

SEQ ID NO: 5125510 - DNA, 21 bp, Homo sapiens
aattgcttgagcatgcccaaa

SEQ ID NO: 5125511 - DNA, 16 bp, Homo sapiens
aattgcttgtttgctt

SEQ ID NO: 5125512 - DNA, 17 bp, Homo sapiens
aattgctttaaatctta

SEQ ID NO: 5125513 - DNA, 13 bp, Homo sapiens
aattgctttgaag

SEQ ID NO: 5125514 - DNA, 15 bp, Homo sapiens
aattgctttgccaaa

SEQ ID NO: 5125515 - DNA, 21 bp, Homo sapiens
aattgctttgccaaaatacca

SEQ ID NO: 5125516 - DNA, 16 bp, Homo sapiens
aattgctttgtgcctt

SEQ ID NO: 5125517 - DNA, 16 bp, Homo sapiens
aattgcttttgttgtg

SEQ ID NO: 5125518 - DNA, 17 bp, Homo sapiens
aattgcttttttaaata

SEQ ID NO: 5125519 - DNA, 13 bp, Homo sapiens
aattggaaagact

SEQ ID NO: 5125520 - DNA, 17 bp, Homo sapiens
aattggaacaaagtgaa

SEQ ID NO: 5125521 - DNA, 14 bp, Homo sapiens
aattggaactgcaa

SEQ ID NO: 5125522 - DNA, 16 bp, Homo sapiens
aattggaaggagaggg

SEQ ID NO: 5125523 - DNA, 19 bp, Homo sapiens
aattggaatcttcacctca

SEQ ID NO: 5125524 - DNA, 22 bp, Homo sapiens
aattggacagttttgatacaaa

SEQ ID NO: 5125525 - DNA, 18 bp, Homo sapiens
aattggaccatcctattt

SEQ ID NO: 5125526 - DNA, 17 bp, Homo sapiens
aattggactctgtcaca

SEQ ID NO: 5125527 - DNA, 19 bp, Homo sapiens
aattggagaaaagcactta

SEQ ID NO: 5125528 - DNA, 23 bp, Homo sapiens
aattggagggtcttgaggggaag

SEQ ID NO: 5125529 - DNA, 20 bp, Homo sapiens
aattggagtatctaaagcca

SEQ ID NO: 5125530 - DNA, 22 bp, Homo sapiens
aattggagtctcaaaatcaact

SEQ ID NO: 5125531 - DNA, 22 bp, Homo sapiens
aattggatattgatgaaatcat

SEQ ID NO: 5125532 - DNA, 14 bp, Homo sapiens
aattggattattac

SEQ ID NO: 5125533 - DNA, 23 bp, Homo sapiens
aattggcagattgttttttccta

SEQ ID NO: 5125534 - DNA, 11 bp, Homo sapiens
aattggcagca

SEQ ID NO: 5125535 - DNA, 19 bp, Homo sapiens
aattggcagcacccactca

SEQ ID NO: 5125536 - DNA, 16 bp, Homo sapiens
aattggcagtgacttt

SEQ ID NO: 5125537 - DNA, 15 bp, Homo sapiens
aattggccagagcct

SEQ ID NO: 5125538 - DNA, 23 bp, Homo sapiens
aattggccagaggaaatctgaat

SEQ ID NO: 5125539 - DNA, 14 bp, Homo sapiens
aattggccatgtcg

SEQ ID NO: 5125540 - DNA, 12 bp, Homo sapiens
aattggcctgaa

SEQ ID NO: 5125541 - DNA, 12 bp, Homo sapiens
aattggctcctt

SEQ ID NO: 5125542 - DNA, 16 bp, Homo sapiens
aattggctcctttccc

SEQ ID NO: 5125543 - DNA, 22 bp, Homo sapiens
aattggcttattttttaaaata

SEQ ID NO: 5125544 - DNA, 15 bp, Homo sapiens
aattggcttccttga

SEQ ID NO: 5125545 - DNA, 16 bp, Homo sapiens
aattgggacaacagtg

SEQ ID NO: 5125546 - DNA, 18 bp, Homo sapiens
aattgggatctgtcttgg

SEQ ID NO: 5125547 - DNA, 23 bp, Homo sapiens
aattgggattttaaaaacatgag

SEQ ID NO: 5125548 - DNA, 16 bp, Homo sapiens
aattgggcactattta

SEQ ID NO: 5125549 - DNA, 16 bp, Homo sapiens
aattgggccagctttt

SEQ ID NO: 5125550 - DNA, 19 bp, Homo sapiens
aattgggcccttagaatgt

SEQ ID NO: 5125551 - DNA, 13 bp, Homo sapiens
aattggggaggga

SEQ ID NO: 5125552 - DNA, 17 bp, Homo sapiens
aattggggattcttaaa

SEQ ID NO: 5125553 - DNA, 20 bp, Homo sapiens
aattggggattcttaaagtt

SEQ ID NO: 5125554 - DNA, 22 bp, Homo sapiens
aattgggggggtgcccggggat

SEQ ID NO: 5125555 - DNA, 21 bp, Homo sapiens
aattgggtggggggcttcata

SEQ ID NO: 5125556 - DNA, 22 bp, Homo sapiens
aattgggtggggggcttcatac

SEQ ID NO: 5125557 - DNA, 15 bp, Homo sapiens
aattgggttcacagc

SEQ ID NO: 5125558 - DNA, 15 bp, Homo sapiens
aattgggttcatgat

SEQ ID NO: 5125559 - DNA, 20 bp, Homo sapiens
aattgggttcatgatgcagt

SEQ ID NO: 5125560 - DNA, 21 bp, Homo sapiens
aattggtaaaactcactgtga

SEQ ID NO: 5125561 - DNA, 20 bp, Homo sapiens
aattggtattatcaaagcat

SEQ ID NO: 5125562 - DNA, 20 bp, Homo sapiens
aattggtcatggtagatttt

SEQ ID NO: 5125563 - DNA, 23 bp, Homo sapiens
aattggtctaccaagtaagacat

SEQ ID NO: 5125564 - DNA, 20 bp, Homo sapiens
aattggtgctatttgaagaa

SEQ ID NO: 5125565 - DNA, 21 bp, Homo sapiens
aattggtgctatttgaagaaa

SEQ ID NO: 5125566 - DNA, 16 bp, Homo sapiens
aattggtgggaagcaa

SEQ ID NO: 5125567 - DNA, 19 bp, Homo sapiens
aattggtgtaatggggcag

SEQ ID NO: 5125568 - DNA, 14 bp, Homo sapiens
aattggtgtatatc

SEQ ID NO: 5125569 - DNA, 15 bp, Homo sapiens
aattggtgtcatttt

SEQ ID NO: 5125570 - DNA, 16 bp, Homo sapiens
aattggttaatgaaaa

SEQ ID NO: 5125571 - DNA, 22 bp, Homo sapiens
aattggttaatgaaaaatctga

SEQ ID NO: 5125572 - DNA, 20 bp, Homo sapiens
aattggttattaaactgaat

SEQ ID NO: 5125573 - DNA, 15 bp, Homo sapiens
aattggttgtatata

SEQ ID NO: 5125574 - DNA, 18 bp, Homo sapiens
aattggtttaaactttta

SEQ ID NO: 5125575 - DNA, 19 bp, Homo sapiens
aattggtttaaacttttat

SEQ ID NO: 5125576 - DNA, 17 bp, Homo sapiens
aattggttttccagagg

SEQ ID NO: 5125577 - DNA, 21 bp, Homo sapiens
aattgtaaaattgtatagaga

SEQ ID NO: 5125578 - DNA, 16 bp, Homo sapiens
aattgtaaacagaaat

SEQ ID NO: 5125579 - DNA, 23 bp, Homo sapiens
aattgtaaacagaaattgcaata

SEQ ID NO: 5125580 - DNA, 14 bp, Homo sapiens
aattgtaaactgta

SEQ ID NO: 5125581 - DNA, 19 bp, Homo sapiens
aattgtaaaggtgatgaat

SEQ ID NO: 5125582 - DNA, 21 bp, Homo sapiens
aattgtaaaggtgatgaattt

SEQ ID NO: 5125583 - DNA, 20 bp, Homo sapiens
aattgtaaagtaaatgaaag

SEQ ID NO: 5125584 - DNA, 13 bp, Homo sapiens
aattgtaaatttt

SEQ ID NO: 5125585 - DNA, 15 bp, Homo sapiens
aattgtaaattttag

SEQ ID NO: 5125586 - DNA, 16 bp, Homo sapiens
aattgtaactgttctt

SEQ ID NO: 5125587 - DNA, 16 bp, Homo sapiens
aattgtaagccagagt

SEQ ID NO: 5125588 - DNA, 12 bp, Homo sapiens
aattgtaaggaa

SEQ ID NO: 5125589 - DNA, 10 bp, Homo sapiens
aattgtaagt

SEQ ID NO: 5125590 - DNA, 14 bp, Homo sapiens
aattgtaattatat

SEQ ID NO: 5125591 - DNA, 13 bp, Homo sapiens
aattgtacaaaaa

SEQ ID NO: 5125592 - DNA, 14 bp, Homo sapiens
aattgtacaaaaaa

SEQ ID NO: 5125593 - DNA, 13 bp, Homo sapiens
aattgtacaaaat

SEQ ID NO: 5125594 - DNA, 19 bp, Homo sapiens
aattgtacaaaattaagca

SEQ ID NO: 5125595 - DNA, 20 bp, Homo sapiens
aattgtacaaaattaagcaa

SEQ ID NO: 5125596 - DNA, 18 bp, Homo sapiens
aattgtacattccctgca

SEQ ID NO: 5125597 - DNA, 15 bp, Homo sapiens
aattgtacattttgt

SEQ ID NO: 5125598 - DNA, 19 bp, Homo sapiens
aattgtaccatcattttat

SEQ ID NO: 5125599 - DNA, 23 bp, Homo sapiens
aattgtacccttcttgtctctct

SEQ ID NO: 5125600 - DNA, 23 bp, Homo sapiens
aattgtacctatttctgatgatg

SEQ ID NO: 5125601 - DNA, 16 bp, Homo sapiens
aattgtactttgaaaa

SEQ ID NO: 5125602 - DNA, 21 bp, Homo sapiens
aattgtagaacatagatgcta

SEQ ID NO: 5125603 - DNA, 17 bp, Homo sapiens
aattgtagactgatgtt

SEQ ID NO: 5125604 - DNA, 19 bp, Homo sapiens
aattgtagatggaaatcag

SEQ ID NO: 5125605 - DNA, 18 bp, Homo sapiens
aattgtagtaattgctct

SEQ ID NO: 5125606 - DNA, 20 bp, Homo sapiens
aattgtagttctgtgtactt

SEQ ID NO: 5125607 - DNA, 21 bp, Homo sapiens
aattgtagttctgtgtacttt

SEQ ID NO: 5125608 - DNA, 10 bp, Homo sapiens
aattgtataa

SEQ ID NO: 5125609 - DNA, 16 bp, Homo sapiens
aattgtataacaggtt

SEQ ID NO: 5125610 - DNA, 18 bp, Homo sapiens
aattgtataacaggttat

SEQ ID NO: 5125611 - DNA, 19 bp, Homo sapiens
aattgtataagtcaagcac

SEQ ID NO: 5125612 - DNA, 14 bp, Homo sapiens
aattgtatacattt

SEQ ID NO: 5125613 - DNA, 22 bp, Homo sapiens
aattgtatacattttgttatag

SEQ ID NO: 5125614 - DNA, 15 bp, Homo sapiens
aattgtatagagata

SEQ ID NO: 5125615 - DNA, 16 bp, Homo sapiens
aattgtatatatatgt

SEQ ID NO: 5125616 - DNA, 14 bp, Homo sapiens
aattgtatattcac

SEQ ID NO: 5125617 - DNA, 14 bp, Homo sapiens
aattgtatattgta

SEQ ID NO: 5125618 - DNA, 21 bp, Homo sapiens
aattgtatcgtatagctgtat

SEQ ID NO: 5125619 - DNA, 11 bp, Homo sapiens
aattgtatcta

SEQ ID NO: 5125620 - DNA, 20 bp, Homo sapiens
aattgtatctacattaaaat

SEQ ID NO: 5125621 - DNA, 18 bp, Homo sapiens
aattgtatgaaaatcctt

SEQ ID NO: 5125622 - DNA, 18 bp, Homo sapiens
aattgtatggtgataaaa

SEQ ID NO: 5125623 - DNA, 22 bp, Homo sapiens
aattgtatgttaagttacttca

SEQ ID NO: 5125624 - DNA, 18 bp, Homo sapiens
aattgtattgaaaacact

SEQ ID NO: 5125625 - DNA, 23 bp, Homo sapiens
aattgtatttatgtatgtaaata

SEQ ID NO: 5125626 - DNA, 11 bp, Homo sapiens
aattgtatttt

SEQ ID NO: 5125627 - DNA, 19 bp, Homo sapiens
aattgtatttttgttgttg

SEQ ID NO: 5125628 - DNA, 18 bp, Homo sapiens
aattgtcagcaatttaac

SEQ ID NO: 5125629 - DNA, 23 bp, Homo sapiens
aattgtcatgactttcagattgt

SEQ ID NO: 5125630 - DNA, 11 bp, Homo sapiens
aattgtcatgg

SEQ ID NO: 5125631 - DNA, 16 bp, Homo sapiens
aattgtccatgtgctt

SEQ ID NO: 5125632 - DNA, 17 bp, Homo sapiens
aattgtccgtgttcata

SEQ ID NO: 5125633 - DNA, 16 bp, Homo sapiens
aattgtccttgaagct

SEQ ID NO: 5125634 - DNA, 17 bp, Homo sapiens
aattgtccttgaagctt

SEQ ID NO: 5125635 - DNA, 12 bp, Homo sapiens
aattgtctattt

SEQ ID NO: 5125636 - DNA, 22 bp, Homo sapiens
aattgtctcaaagcatcaaata

SEQ ID NO: 5125637 - DNA, 16 bp, Homo sapiens
aattgtctctgggctg

SEQ ID NO: 5125638 - DNA, 15 bp, Homo sapiens
aattgtcttaaaacc

SEQ ID NO: 5125639 - DNA, 16 bp, Homo sapiens
aattgtcttcatgtac

SEQ ID NO: 5125640 - DNA, 17 bp, Homo sapiens
aattgtcttcatgtaca

SEQ ID NO: 5125641 - DNA, 23 bp, Homo sapiens
aattgtcttttagacaactagat

SEQ ID NO: 5125642 - DNA, 21 bp, Homo sapiens
aattgtgaacagccaaaagct

SEQ ID NO: 5125643 - DNA, 24 bp, Homo sapiens
aattgtgaacatgatagttaaact

SEQ ID NO: 5125644 - DNA, 16 bp, Homo sapiens
aattgtgaattgataa

SEQ ID NO: 5125645 - DNA, 20 bp, Homo sapiens
aattgtgagaattactgttt

SEQ ID NO: 5125646 - DNA, 11 bp, Homo sapiens
aattgtgatgt

SEQ ID NO: 5125647 - DNA, 13 bp, Homo sapiens
aattgtgcaaaat

SEQ ID NO: 5125648 - DNA, 19 bp, Homo sapiens
aattgtgcaaaggataaat

SEQ ID NO: 5125649 - DNA, 11 bp, Homo sapiens
acaacaaaaat

SEQ ID NO: 5125650 - DNA, 17 bp, Homo sapiens
acaacaaagaggacacc

SEQ ID NO: 5125651 - DNA, 15 bp, Homo sapiens
acaacaaagcatgct

SEQ ID NO: 5125652 - DNA, 19 bp, Homo sapiens
acaacaaagtgcttccttt

SEQ ID NO: 5125653 - DNA, 17 bp, Homo sapiens
acaacaaataatttaag

SEQ ID NO: 5125654 - DNA, 19 bp, Homo sapiens
acaacaaataatttaagtt

SEQ ID NO: 5125655 - DNA, 21 bp, Homo sapiens
acaacaaataatttaagttgg

SEQ ID NO: 5125656 - DNA, 15 bp, Homo sapiens
acaacaacaaaatga

SEQ ID NO: 5125657 - DNA, 15 bp, Homo sapiens
acaacaacaacaata

SEQ ID NO: 5125658 - DNA, 15 bp, Homo sapiens
acaacaacaataaca

SEQ ID NO: 5125659 - DNA, 15 bp, Homo sapiens
acaacaacaataata

SEQ ID NO: 5125660 - DNA, 14 bp, Homo sapiens
acaacaacaataca

SEQ ID NO: 5125661 - DNA, 15 bp, Homo sapiens
acaacaacctggtca

SEQ ID NO: 5125662 - DNA, 15 bp, Homo sapiens
acaacaagaaactgt

SEQ ID NO: 5125663 - DNA, 12 bp, Homo sapiens
acaacaagaaca

SEQ ID NO: 5125664 - DNA, 17 bp, Homo sapiens
acaacaagcaaactgaa

SEQ ID NO: 5125665 - DNA, 21 bp, Homo sapiens
acaacaagcaaactgaaatta

SEQ ID NO: 5125666 - DNA, 12 bp, Homo sapiens
acaacaaggacc

SEQ ID NO: 5125667 - DNA, 15 bp, Homo sapiens
acaacaaggaccctg

SEQ ID NO: 5125668 - DNA, 9 bp, Homo sapiens
acaacaata

SEQ ID NO: 5125669 - DNA, 15 bp, Homo sapiens
acaacaataactttt

SEQ ID NO: 5125670 - DNA, 17 bp, Homo sapiens
acaacaatacaacaaga

SEQ ID NO: 5125671 - DNA, 20 bp, Homo sapiens
acaacaatcccagcatctga

SEQ ID NO: 5125672 - DNA, 16 bp, Homo sapiens
acaacaatctggagat

SEQ ID NO: 5125673 - DNA, 18 bp, Homo sapiens
acaacaattggtaaaact

SEQ ID NO: 5125674 - DNA, 14 bp, Homo sapiens
acaacacaaagaga

SEQ ID NO: 5125675 - DNA, 16 bp, Homo sapiens
acaacacaagaaaact

SEQ ID NO: 5125676 - DNA, 14 bp, Homo sapiens
acaacacacacaca

SEQ ID NO: 5125677 - DNA, 23 bp, Homo sapiens
acaacacacacacacacaaaaca

SEQ ID NO: 5125678 - DNA, 18 bp, Homo sapiens
acaacacattgaaactgt

SEQ ID NO: 5125679 - DNA, 19 bp, Homo sapiens
acaacaccaaaaaatatct

SEQ ID NO: 5125680 - DNA, 21 bp, Homo sapiens
acaacaccagccccacttctg

SEQ ID NO: 5125681 - DNA, 14 bp, Homo sapiens
acaacaccaggact

SEQ ID NO: 5125682 - DNA, 15 bp, Homo sapiens
acaacaccaggactt

SEQ ID NO: 5125683 - DNA, 22 bp, Homo sapiens
acaacaccttcctcctgcagac

SEQ ID NO: 5125684 - DNA, 17 bp, Homo sapiens
acaacactaatacacta

SEQ ID NO: 5125685 - DNA, 20 bp, Homo sapiens
acaacactcatcacacttca

SEQ ID NO: 5125686 - DNA, 21 bp, Homo sapiens
acaacactcattgacctgagg

SEQ ID NO: 5125687 - DNA, 23 bp, Homo sapiens
acaacactcattgacctgaggcc

SEQ ID NO: 5125688 - DNA, 21 bp, Homo sapiens
acaacactgattcctggagag

SEQ ID NO: 5125689 - DNA, 12 bp, Homo sapiens
acaacagaaaga

SEQ ID NO: 5125690 - DNA, 19 bp, Homo sapiens
acaacagaataaagcagcc

SEQ ID NO: 5125691 - DNA, 17 bp, Homo sapiens
acaacagagacagtgaa

SEQ ID NO: 5125692 - DNA, 22 bp, Homo sapiens
acaacagagactgaaatgtgtt

SEQ ID NO: 5125693 - DNA, 16 bp, Homo sapiens
acaacagatttgtgaa

SEQ ID NO: 5125694 - DNA, 14 bp, Homo sapiens
acaacagcaacaac

SEQ ID NO: 5125695 - DNA, 15 bp, Homo sapiens
acaacagcacacagg

SEQ ID NO: 5125696 - DNA, 15 bp, Homo sapiens
acaacagcacgtgca

SEQ ID NO: 5125697 - DNA, 15 bp, Homo sapiens
acaacagcagtctcc

SEQ ID NO: 5125698 - DNA, 16 bp, Homo sapiens
acaacagccaacagct

SEQ ID NO: 5125699 - DNA, 24 bp, Homo sapiens
acaacagccaacagctacaacagc

SEQ ID NO: 5125700 - DNA, 14 bp, Homo sapiens
acaacagcctgggg

SEQ ID NO: 5125701 - DNA, 23 bp, Homo sapiens
acaacagctctcgttctccttcc

SEQ ID NO: 5125702 - DNA, 16 bp, Homo sapiens
acaacagctgaagcac

SEQ ID NO: 5125703 - DNA, 14 bp, Homo sapiens
acaacagctgcctg

SEQ ID NO: 5125704 - DNA, 15 bp, Homo sapiens
acaacaggagagaga

SEQ ID NO: 5125705 - DNA, 18 bp, Homo sapiens
acaacaggattttcaagt

SEQ ID NO: 5125706 - DNA, 12 bp, Homo sapiens
acaacaggcatt

SEQ ID NO: 5125707 - DNA, 17 bp, Homo sapiens
acaacaggttttcacca

SEQ ID NO: 5125708 - DNA, 12 bp, Homo sapiens
acaacagtaaca

SEQ ID NO: 5125709 - DNA, 18 bp, Homo sapiens
acaacagtcagccagctt

SEQ ID NO: 5125710 - DNA, 17 bp, Homo sapiens
acaacagtgctaaaaat

SEQ ID NO: 5125711 - DNA, 22 bp, Homo sapiens
acaacagtgctttgtaaattgt

SEQ ID NO: 5125712 - DNA, 19 bp, Homo sapiens
acaacagttctgagctgta

SEQ ID NO: 5125713 - DNA, 15 bp, Homo sapiens
acaacatatcagact

SEQ ID NO: 5125714 - DNA, 13 bp, Homo sapiens
acaacatatttgg

SEQ ID NO: 5125715 - DNA, 20 bp, Homo sapiens
acaacatcaccagtgccacg

SEQ ID NO: 5125716 - DNA, 12 bp, Homo sapiens
acaacatcagaa

SEQ ID NO: 5125717 - DNA, 23 bp, Homo sapiens
acaacatccaagtggcctccgtc

SEQ ID NO: 5125718 - DNA, 16 bp, Homo sapiens
acaacatccatgtcct

SEQ ID NO: 5125719 - DNA, 17 bp, Homo sapiens
acaacatccatgtccta

SEQ ID NO: 5125720 - DNA, 17 bp, Homo sapiens
acaacatcccacagtgg

SEQ ID NO: 5125721 - DNA, 20 bp, Homo sapiens
acaacatcctcagaaccatt

SEQ ID NO: 5125722 - DNA, 21 bp, Homo sapiens
acaacatcgcaatagtttttt

SEQ ID NO: 5125723 - DNA, 17 bp, Homo sapiens
acaacatcttaaatctt

SEQ ID NO: 5125724 - DNA, 17 bp, Homo sapiens
acaacatctttttctac

SEQ ID NO: 5125725 - DNA, 21 bp, Homo sapiens
acaacatgaggccactggaga

SEQ ID NO: 5125726 - DNA, 12 bp, Homo sapiens
acaacatgcaca

SEQ ID NO: 5125727 - DNA, 22 bp, Homo sapiens
acaacatgcacattcatcctca

SEQ ID NO: 5125728 - DNA, 15 bp, Homo sapiens
acaacatggcttctc

SEQ ID NO: 5125729 - DNA, 22 bp, Homo sapiens
acaacatgtataatatttttaa

SEQ ID NO: 5125730 - DNA, 14 bp, Homo sapiens
acaacattgcattg

SEQ ID NO: 5125731 - DNA, 18 bp, Homo sapiens
acaacatttagtttaaac

SEQ ID NO: 5125732 - DNA, 23 bp, Homo sapiens
acaacatttatttcaaactattg

SEQ ID NO: 5125733 - DNA, 20 bp, Homo sapiens
acaacatttctatagccaaa

SEQ ID NO: 5125734 - DNA, 18 bp, Homo sapiens
acaacattttaatacaga

SEQ ID NO: 5125735 - DNA, 14 bp, Homo sapiens
acaacattttcttg

SEQ ID NO: 5125736 - DNA, 21 bp, Homo sapiens
acaaccaagcgcatccaatct

SEQ ID NO: 5125737 - DNA, 17 bp, Homo sapiens
acaaccacagtgccacc

SEQ ID NO: 5125738 - DNA, 22 bp, Homo sapiens
acaaccacggtcacacctcact

SEQ ID NO: 5125739 - DNA, 21 bp, Homo sapiens
acaaccactgggatcagctgg

SEQ ID NO: 5125740 - DNA, 13 bp, Homo sapiens
acaaccagccaca

SEQ ID NO: 5125741 - DNA, 18 bp, Homo sapiens
acaaccagccacacagag

SEQ ID NO: 5125742 - DNA, 21 bp, Homo sapiens
acaaccatactttatatatgt

SEQ ID NO: 5125743 - DNA, 16 bp, Homo sapiens
acaaccatagaactgt

SEQ ID NO: 5125744 - DNA, 16 bp, Homo sapiens
acaaccatatttagca

SEQ ID NO: 5125745 - DNA, 21 bp, Homo sapiens
acaaccatgcaaattgtgaaa

SEQ ID NO: 5125746 - DNA, 22 bp, Homo sapiens
acaaccatgcaaattgtgaaat

SEQ ID NO: 5125747 - DNA, 22 bp, Homo sapiens
acaaccatgtcatttcagaagt

SEQ ID NO: 5125748 - DNA, 18 bp, Homo sapiens
acaaccattaaagtcaga

SEQ ID NO: 5125749 - DNA, 19 bp, Homo sapiens
acaacccaatctggctggt

SEQ ID NO: 5125750 - DNA, 23 bp, Homo sapiens
acaaccccccatcacaaacttaa

SEQ ID NO: 5125751 - DNA, 16 bp, Homo sapiens
acaaccccctccaccc

SEQ ID NO: 5125752 - DNA, 16 bp, Homo sapiens
acaaccctaccctggc

SEQ ID NO: 5125753 - DNA, 15 bp, Homo sapiens
acaaccctctggaag

SEQ ID NO: 5125754 - DNA, 13 bp, Homo sapiens
acaaccctggcct

SEQ ID NO: 5125755 - DNA, 15 bp, Homo sapiens
acaaccctggcctca

SEQ ID NO: 5125756 - DNA, 19 bp, Homo sapiens
acaaccctgtgtaacaact

SEQ ID NO: 5125757 - DNA, 20 bp, Homo sapiens
acaaccgatgctccagccaa

SEQ ID NO: 5125758 - DNA, 16 bp, Homo sapiens
acaaccggttatcagt

SEQ ID NO: 5125759 - DNA, 22 bp, Homo sapiens
acaaccgtcctgctgtccctgt

SEQ ID NO: 5125760 - DNA, 13 bp, Homo sapiens
acaaccgttggaa

SEQ ID NO: 5125761 - DNA, 13 bp, Homo sapiens
acaacctaaaaaa

SEQ ID NO: 5125762 - DNA, 18 bp, Homo sapiens
acaacctcaccaaactag

SEQ ID NO: 5125763 - DNA, 20 bp, Homo sapiens
acaacctcaccaaactagta

SEQ ID NO: 5125764 - DNA, 14 bp, Homo sapiens
acaacctccacctt

SEQ ID NO: 5125765 - DNA, 15 bp, Homo sapiens
acaacctccctcttg

SEQ ID NO: 5125766 - DNA, 16 bp, Homo sapiens
acaacctctctgatct

SEQ ID NO: 5125767 - DNA, 16 bp, Homo sapiens
acaacctgaaagacaa

SEQ ID NO: 5125768 - DNA, 15 bp, Homo sapiens
acaacctgaaattta

SEQ ID NO: 5125769 - DNA, 14 bp, Homo sapiens
acaacctgaaccta

SEQ ID NO: 5125770 - DNA, 22 bp, Homo sapiens
acaacctgagccttttcttata

SEQ ID NO: 5125771 - DNA, 18 bp, Homo sapiens
acaacctgagttcaagtc

SEQ ID NO: 5125772 - DNA, 18 bp, Homo sapiens
acaacctgcccctcccca

SEQ ID NO: 5125773 - DNA, 18 bp, Homo sapiens
acaacctggccagaggca

SEQ ID NO: 5125774 - DNA, 18 bp, Homo sapiens
acaacctggtgcatcgaa

SEQ ID NO: 5125775 - DNA, 13 bp, Homo sapiens
acaacctgtgcag

SEQ ID NO: 5125776 - DNA, 20 bp, Homo sapiens
acaaccttcagctttatttt

SEQ ID NO: 5125777 - DNA, 23 bp, Homo sapiens
acaaccttcatttaaaaaggttt

SEQ ID NO: 5125778 - DNA, 22 bp, Homo sapiens
acaacctttcccatttcgtgta

SEQ ID NO: 5125779 - DNA, 13 bp, Homo sapiens
acaacctttctgt

SEQ ID NO: 5125780 - DNA, 15 bp, Homo sapiens
acaacctttgtgtaa

SEQ ID NO: 5125781 - DNA, 16 bp, Homo sapiens
acaacgagccttttca

SEQ ID NO: 5125782 - DNA, 14 bp, Homo sapiens
acaacgaggaagcc

SEQ ID NO: 5125783 - DNA, 15 bp, Homo sapiens
acaacgaggaagccc

SEQ ID NO: 5125784 - DNA, 17 bp, Homo sapiens
acaacgatgaatttctt

SEQ ID NO: 5125785 - DNA, 22 bp, Homo sapiens
acaacgatgaatttcttctaat

SEQ ID NO: 5125786 - DNA, 19 bp, Homo sapiens
acaacgcataggaaaagaa

SEQ ID NO: 5125787 - DNA, 20 bp, Homo sapiens
acaacgctctaccctgcagc

SEQ ID NO: 5125788 - DNA, 13 bp, Homo sapiens
acaacggaggcct

SEQ ID NO: 5125789 - DNA, 20 bp, Homo sapiens
acaacggagtcaaaaattaa

SEQ ID NO: 5125790 - DNA, 16 bp, Homo sapiens
acaacgtaaaaataaa

SEQ ID NO: 5125791 - DNA, 18 bp, Homo sapiens
acaacgtaaaaataaaag

SEQ ID NO: 5125792 - DNA, 15 bp, Homo sapiens
acaacgtctttttgt

SEQ ID NO: 5125793 - DNA, 20 bp, Homo sapiens
acaacgtctttttgtttgtt

SEQ ID NO: 5125794 - DNA, 15 bp, Homo sapiens
acaacgtgcattgtg

SEQ ID NO: 5125795 - DNA, 18 bp, Homo sapiens
acaacgtgctctttgttt

SEQ ID NO: 5125796 - DNA, 15 bp, Homo sapiens
acaactaaaaataaa

SEQ ID NO: 5125797 - DNA, 17 bp, Homo sapiens
acaactaaaaataaatt

SEQ ID NO: 5125798 - DNA, 19 bp, Homo sapiens
acaactaaaaataaattaa

SEQ ID NO: 5125799 - DNA, 11 bp, Homo sapiens
acaactaaaat

SEQ ID NO: 5125800 - DNA, 17 bp, Homo sapiens
acaactaaattattatg

SEQ ID NO: 5125801 - DNA, 17 bp, Homo sapiens
acaactaacaatgcctt

SEQ ID NO: 5125802 - DNA, 22 bp, Homo sapiens
acaactaagtgatttgtatgtc

SEQ ID NO: 5125803 - DNA, 14 bp, Homo sapiens
acaactaatcaaga

SEQ ID NO: 5125804 - DNA, 17 bp, Homo sapiens
acaactaatcaagagtg

SEQ ID NO: 5125805 - DNA, 20 bp, Homo sapiens
acaactacagaaaaaccaga

SEQ ID NO: 5125806 - DNA, 12 bp, Homo sapiens
acaactagattt

SEQ ID NO: 5125807 - DNA, 16 bp, Homo sapiens
acaactaggacctcat

SEQ ID NO: 5125808 - DNA, 16 bp, Homo sapiens
acaactaggcttcagc

SEQ ID NO: 5125809 - DNA, 19 bp, Homo sapiens
acaactaggcttcagcata

SEQ ID NO: 5125810 - DNA, 13 bp, Homo sapiens
acaactatattgt

SEQ ID NO: 5125811 - DNA, 16 bp, Homo sapiens
acaactatcaattctt

SEQ ID NO: 5125812 - DNA, 15 bp, Homo sapiens
acaactatgaaatcg

SEQ ID NO: 5125813 - DNA, 17 bp, Homo sapiens
acaactatgtaatttat

SEQ ID NO: 5125814 - DNA, 18 bp, Homo sapiens
acaactatttactttttt

SEQ ID NO: 5125815 - DNA, 17 bp, Homo sapiens
acaactatttcggcctt

SEQ ID NO: 5125816 - DNA, 16 bp, Homo sapiens
acaactattttcagat

SEQ ID NO: 5125817 - DNA, 20 bp, Homo sapiens
acaactattttcagatgtga

SEQ ID NO: 5125818 - DNA, 14 bp, Homo sapiens
acaactatttttgt

SEQ ID NO: 5125819 - DNA, 16 bp, Homo sapiens
acaactcattttcata

SEQ ID NO: 5125820 - DNA, 14 bp, Homo sapiens
acaactccagccac

SEQ ID NO: 5125821 - DNA, 20 bp, Homo sapiens
acaactccagccacccagcc

SEQ ID NO: 5125822 - DNA, 12 bp, Homo sapiens
acaactccccca

SEQ ID NO: 5125823 - DNA, 19 bp, Homo sapiens
acaactcccccaccgccca

SEQ ID NO: 5125824 - DNA, 21 bp, Homo sapiens
acaactccctgaacctcagtt

SEQ ID NO: 5125825 - DNA, 14 bp, Homo sapiens
acaactcccttgca

SEQ ID NO: 5125826 - DNA, 16 bp, Homo sapiens
acaactctagaaatgc

SEQ ID NO: 5125827 - DNA, 19 bp, Homo sapiens
acaactgaaacctaggaag

SEQ ID NO: 5125828 - DNA, 14 bp, Homo sapiens
acaactgaaatgtg

SEQ ID NO: 5125829 - DNA, 16 bp, Homo sapiens
aattgtgcataatgct

SEQ ID NO: 5125830 - DNA, 19 bp, Homo sapiens
aattgtgctccaaatgtct

SEQ ID NO: 5125831 - DNA, 16 bp, Homo sapiens
aattgtgctgccattt

SEQ ID NO: 5125832 - DNA, 19 bp, Homo sapiens
aattgtgctgccatttgat

SEQ ID NO: 5125833 - DNA, 16 bp, Homo sapiens
aattgtgctttcacca

SEQ ID NO: 5125834 - DNA, 18 bp, Homo sapiens
aattgtggagaggagaga

SEQ ID NO: 5125835 - DNA, 23 bp, Homo sapiens
aattgtggatcttgagctctgct

SEQ ID NO: 5125836 - DNA, 13 bp, Homo sapiens
aattgtggattaa

SEQ ID NO: 5125837 - DNA, 20 bp, Homo sapiens
aattgtggattataaaaaat

SEQ ID NO: 5125838 - DNA, 18 bp, Homo sapiens
aattgtgggcataaactg

SEQ ID NO: 5125839 - DNA, 17 bp, Homo sapiens
aattgtgggtctatttc

SEQ ID NO: 5125840 - DNA, 16 bp, Homo sapiens
aattgtggtagaaatt

SEQ ID NO: 5125841 - DNA, 17 bp, Homo sapiens
aattgtggtagaaattt

SEQ ID NO: 5125842 - DNA, 16 bp, Homo sapiens
aattgtggttgtgttc

SEQ ID NO: 5125843 - DNA, 17 bp, Homo sapiens
aattgtggtttatatat

SEQ ID NO: 5125844 - DNA, 13 bp, Homo sapiens
aattgtgtaactg

SEQ ID NO: 5125845 - DNA, 16 bp, Homo sapiens
aattgtgtaactgttc

SEQ ID NO: 5125846 - DNA, 21 bp, Homo sapiens
aattgtgtagcctttttgtat

SEQ ID NO: 5125847 - DNA, 23 bp, Homo sapiens
aattgtgtagtaatgttttttag

SEQ ID NO: 5125848 - DNA, 17 bp, Homo sapiens
aattgtgtatatatctt

SEQ ID NO: 5125849 - DNA, 18 bp, Homo sapiens
aattgtgtatatatctta

SEQ ID NO: 5125850 - DNA, 21 bp, Homo sapiens
aattgtgtatatgttggttta

SEQ ID NO: 5125851 - DNA, 22 bp, Homo sapiens
aattgtgtatttaaaaaaaaga

SEQ ID NO: 5125852 - DNA, 19 bp, Homo sapiens
aattgtgtgatatttcaga

SEQ ID NO: 5125853 - DNA, 21 bp, Homo sapiens
aattgtgtgatatttcagaaa

SEQ ID NO: 5125854 - DNA, 23 bp, Homo sapiens
aattgtgtgatatttcagaaata

SEQ ID NO: 5125855 - DNA, 23 bp, Homo sapiens
aattgtgtggagaactcagtgcc

SEQ ID NO: 5125856 - DNA, 15 bp, Homo sapiens
aattgtgtggagaag

SEQ ID NO: 5125857 - DNA, 21 bp, Homo sapiens
aattgtgttcttaaaatattg

SEQ ID NO: 5125858 - DNA, 20 bp, Homo sapiens
aattgtgtttacattttatg

SEQ ID NO: 5125859 - DNA, 21 bp, Homo sapiens
aattgtgtttacattttatgg

SEQ ID NO: 5125860 - DNA, 22 bp, Homo sapiens
aattgtgtttacattttatggt

SEQ ID NO: 5125861 - DNA, 13 bp, Homo sapiens
aattgtgtttaga

SEQ ID NO: 5125862 - DNA, 21 bp, Homo sapiens
aattgtgtttataattttaaa

SEQ ID NO: 5125863 - DNA, 20 bp, Homo sapiens
aattgtgtttattttttaaa

SEQ ID NO: 5125864 - DNA, 20 bp, Homo sapiens
aattgtgttttaattgtaaa

SEQ ID NO: 5125865 - DNA, 20 bp, Homo sapiens
aattgttaaatttaaaaata

SEQ ID NO: 5125866 - DNA, 17 bp, Homo sapiens
aattgttaatcaaagat

SEQ ID NO: 5125867 - DNA, 15 bp, Homo sapiens
aattgttaatgtgat

SEQ ID NO: 5125868 - DNA, 17 bp, Homo sapiens
aattgttacaagtgttc

SEQ ID NO: 5125869 - DNA, 23 bp, Homo sapiens
aattgttacccatttgaaagaat

SEQ ID NO: 5125870 - DNA, 15 bp, Homo sapiens
aattgttataattag

SEQ ID NO: 5125871 - DNA, 16 bp, Homo sapiens
aattgttatgaaaatc

SEQ ID NO: 5125872 - DNA, 19 bp, Homo sapiens
aattgttatgtaaacatca

SEQ ID NO: 5125873 - DNA, 15 bp, Homo sapiens
aattgttcctctttg

SEQ ID NO: 5125874 - DNA, 15 bp, Homo sapiens
aattgttccttgctt

SEQ ID NO: 5125875 - DNA, 11 bp, Homo sapiens
aattgttcttg

SEQ ID NO: 5125876 - DNA, 20 bp, Homo sapiens
aattgttgaaagctttgaaa

SEQ ID NO: 5125877 - DNA, 18 bp, Homo sapiens
aattgttgaaattttgca

SEQ ID NO: 5125878 - DNA, 20 bp, Homo sapiens
aattgttgaaattttgcaaa

SEQ ID NO: 5125879 - DNA, 23 bp, Homo sapiens
aattgttgaaattttgcaaatat

SEQ ID NO: 5125880 - DNA, 21 bp, Homo sapiens
aattgttgaacaggtgttttt

SEQ ID NO: 5125881 - DNA, 15 bp, Homo sapiens
aattgttgaatgtat

SEQ ID NO: 5125882 - DNA, 18 bp, Homo sapiens
aattgttgacagttctga

SEQ ID NO: 5125883 - DNA, 17 bp, Homo sapiens
aattgttgagatacttt

SEQ ID NO: 5125884 - DNA, 15 bp, Homo sapiens
aattgttgatatttt

SEQ ID NO: 5125885 - DNA, 17 bp, Homo sapiens
aattgttgatattttcc

SEQ ID NO: 5125886 - DNA, 19 bp, Homo sapiens
aattgttgattaatttgag

SEQ ID NO: 5125887 - DNA, 21 bp, Homo sapiens
aattgttgtatatcactaaaa

SEQ ID NO: 5125888 - DNA, 13 bp, Homo sapiens
aattgttgttctg

SEQ ID NO: 5125889 - DNA, 23 bp, Homo sapiens
aattgttgtttctttctagtggt

SEQ ID NO: 5125890 - DNA, 13 bp, Homo sapiens
aattgttgtttgt

SEQ ID NO: 5125891 - DNA, 14 bp, Homo sapiens
aattgttgtttgta

SEQ ID NO: 5125892 - DNA, 22 bp, Homo sapiens
aattgttgtttgtatgtataat

SEQ ID NO: 5125893 - DNA, 23 bp, Homo sapiens
aattgttgtttgtatgtataatt

SEQ ID NO: 5125894 - DNA, 13 bp, Homo sapiens
aattgtttaaaaa

SEQ ID NO: 5125895 - DNA, 14 bp, Homo sapiens
aattgtttagattt

SEQ ID NO: 5125896 - DNA, 14 bp, Homo sapiens
aattgtttataatg

SEQ ID NO: 5125897 - DNA, 17 bp, Homo sapiens
aattgtttatatggata

SEQ ID NO: 5125898 - DNA, 18 bp, Homo sapiens
aattgtttatatggataa

SEQ ID NO: 5125899 - DNA, 21 bp, Homo sapiens
aattgtttatgtgttatgaac

SEQ ID NO: 5125900 - DNA, 21 bp, Homo sapiens
aattgtttcagtttttttaaa

SEQ ID NO: 5125901 - DNA, 16 bp, Homo sapiens
aattgtttcatatctg

SEQ ID NO: 5125902 - DNA, 12 bp, Homo sapiens
aattgtttccaa

SEQ ID NO: 5125903 - DNA, 18 bp, Homo sapiens
aattgtttccaaagtgca

SEQ ID NO: 5125904 - DNA, 23 bp, Homo sapiens
aattgtttcctaaatcagcattt

SEQ ID NO: 5125905 - DNA, 20 bp, Homo sapiens
aattgtttggcttcctcctg

SEQ ID NO: 5125906 - DNA, 21 bp, Homo sapiens
aattgtttggcttcctcctga

SEQ ID NO: 5125907 - DNA, 20 bp, Homo sapiens
aattgtttgtaagtgaagtg

SEQ ID NO: 5125908 - DNA, 13 bp, Homo sapiens
aattgttttacct

SEQ ID NO: 5125909 - DNA, 19 bp, Homo sapiens
aattgttttatctgaattt

SEQ ID NO: 5125910 - DNA, 17 bp, Homo sapiens
aattgttttcacttgta

SEQ ID NO: 5125911 - DNA, 18 bp, Homo sapiens
aattgttttcacttgtat

SEQ ID NO: 5125912 - DNA, 19 bp, Homo sapiens
aattgttttcacttgtatt

SEQ ID NO: 5125913 - DNA, 15 bp, Homo sapiens
aattgttttctttaa

SEQ ID NO: 5125914 - DNA, 19 bp, Homo sapiens
aattgttttctttaaagat

SEQ ID NO: 5125915 - DNA, 20 bp, Homo sapiens
aattgttttgcactttttta

SEQ ID NO: 5125916 - DNA, 12 bp, Homo sapiens
aattgttttgct

SEQ ID NO: 5125917 - DNA, 16 bp, Homo sapiens
aattgttttggaataa

SEQ ID NO: 5125918 - DNA, 22 bp, Homo sapiens
aattgtttttaatttgaatcag

SEQ ID NO: 5125919 - DNA, 22 bp, Homo sapiens
aattgtttttagaaatttattc

SEQ ID NO: 5125920 - DNA, 16 bp, Homo sapiens
aattgtttttataaaa

SEQ ID NO: 5125921 - DNA, 13 bp, Homo sapiens
aattgtttttccc

SEQ ID NO: 5125922 - DNA, 23 bp, Homo sapiens
aattgtttttgaatttaaataaa

SEQ ID NO: 5125923 - DNA, 20 bp, Homo sapiens
aattgttttttaaagcaagt

SEQ ID NO: 5125924 - DNA, 18 bp, Homo sapiens
aattgttttttaatttaa

SEQ ID NO: 5125925 - DNA, 19 bp, Homo sapiens
aattgttttttatcttttc

SEQ ID NO: 5125926 - DNA, 12 bp, Homo sapiens
aatttaaaaaac

SEQ ID NO: 5125927 - DNA, 13 bp, Homo sapiens
aatttaaaaaagt

SEQ ID NO: 5125928 - DNA, 13 bp, Homo sapiens
aatttaaaaaata

SEQ ID NO: 5125929 - DNA, 17 bp, Homo sapiens
aatttaaaaagcaaaaa

SEQ ID NO: 5125930 - DNA, 15 bp, Homo sapiens
aatttaaaaataaag

SEQ ID NO: 5125931 - DNA, 17 bp, Homo sapiens
aatttaaaaatatattt

SEQ ID NO: 5125932 - DNA, 13 bp, Homo sapiens
aatttaaaaatct

SEQ ID NO: 5125933 - DNA, 17 bp, Homo sapiens
aatttaaaaatctttca

SEQ ID NO: 5125934 - DNA, 22 bp, Homo sapiens
aatttaaaaatgagtgtgaagg

SEQ ID NO: 5125935 - DNA, 11 bp, Homo sapiens
aatttaaaaca

SEQ ID NO: 5125936 - DNA, 12 bp, Homo sapiens
aatttaaaacaa

SEQ ID NO: 5125937 - DNA, 16 bp, Homo sapiens
aatttaaaacaaacaa

SEQ ID NO: 5125938 - DNA, 19 bp, Homo sapiens
aatttaaaacacagtattg

SEQ ID NO: 5125939 - DNA, 23 bp, Homo sapiens
aatttaaaacacagtattgtaga

SEQ ID NO: 5125940 - DNA, 23 bp, Homo sapiens
aatttaaaactgttatttttaca

SEQ ID NO: 5125941 - DNA, 13 bp, Homo sapiens
aatttaaaagcag

SEQ ID NO: 5125942 - DNA, 17 bp, Homo sapiens
aatttaaaataaataaa

SEQ ID NO: 5125943 - DNA, 21 bp, Homo sapiens
aatttaaaataaataaacttt

SEQ ID NO: 5125944 - DNA, 19 bp, Homo sapiens
aatttaaaataattatata

SEQ ID NO: 5125945 - DNA, 16 bp, Homo sapiens
aatttaaaatgtagtt

SEQ ID NO: 5125946 - DNA, 18 bp, Homo sapiens
aatttaaaatgtagtttt

SEQ ID NO: 5125947 - DNA, 16 bp, Homo sapiens
aatttaaaattacgtt

SEQ ID NO: 5125948 - DNA, 10 bp, Homo sapiens
aatttaaaca

SEQ ID NO: 5125949 - DNA, 19 bp, Homo sapiens
aatttaaacaggcccagca

SEQ ID NO: 5125950 - DNA, 14 bp, Homo sapiens
aatttaaacattaa

SEQ ID NO: 5125951 - DNA, 22 bp, Homo sapiens
aatttaaacatttgttcctgga

SEQ ID NO: 5125952 - DNA, 12 bp, Homo sapiens
aatttaaactgt

SEQ ID NO: 5125953 - DNA, 16 bp, Homo sapiens
aatttaaagaaacact

SEQ ID NO: 5125954 - DNA, 20 bp, Homo sapiens
aatttaaagaaacactaaat

SEQ ID NO: 5125955 - DNA, 21 bp, Homo sapiens
aatttaaagaaacactaaatt

SEQ ID NO: 5125956 - DNA, 17 bp, Homo sapiens
aatttaaagatattgtt

SEQ ID NO: 5125957 - DNA, 19 bp, Homo sapiens
aatttaaagcaggttcttg

SEQ ID NO: 5125958 - DNA, 18 bp, Homo sapiens
aatttaaagctgtttcta

SEQ ID NO: 5125959 - DNA, 12 bp, Homo sapiens
aatttaaaggct

SEQ ID NO: 5125960 - DNA, 18 bp, Homo sapiens
aatttaaagggtgtactt

SEQ ID NO: 5125961 - DNA, 10 bp, Homo sapiens
aatttaaagt

SEQ ID NO: 5125962 - DNA, 19 bp, Homo sapiens
aatttaaatataattctgt

SEQ ID NO: 5125963 - DNA, 12 bp, Homo sapiens
aatttaaatgaa

SEQ ID NO: 5125964 - DNA, 16 bp, Homo sapiens
aatttaaatgaaagaa

SEQ ID NO: 5125965 - DNA, 15 bp, Homo sapiens
aatttaaatgatatt

SEQ ID NO: 5125966 - DNA, 16 bp, Homo sapiens
aatttaaatgatattt

SEQ ID NO: 5125967 - DNA, 15 bp, Homo sapiens
aatttaaatggcttt

SEQ ID NO: 5125968 - DNA, 22 bp, Homo sapiens
aatttaaatggcttttgccaca

SEQ ID NO: 5125969 - DNA, 13 bp, Homo sapiens
aatttaaatgtta

SEQ ID NO: 5125970 - DNA, 14 bp, Homo sapiens
aatttaaattgtta

SEQ ID NO: 5125971 - DNA, 11 bp, Homo sapiens
aatttaaattt

SEQ ID NO: 5125972 - DNA, 17 bp, Homo sapiens
aatttaaatttaaagat

SEQ ID NO: 5125973 - DNA, 15 bp, Homo sapiens
aatttaacaatgcga

SEQ ID NO: 5125974 - DNA, 17 bp, Homo sapiens
aatttaacaatgcgaat

SEQ ID NO: 5125975 - DNA, 17 bp, Homo sapiens
aatttaacagaagttgt

SEQ ID NO: 5125976 - DNA, 19 bp, Homo sapiens
aatttaacatctgcagtgt

SEQ ID NO: 5125977 - DNA, 17 bp, Homo sapiens
aatttaaccagcaacat

SEQ ID NO: 5125978 - DNA, 13 bp, Homo sapiens
aatttaaccataa

SEQ ID NO: 5125979 - DNA, 17 bp, Homo sapiens
aatttaaccataaatca

SEQ ID NO: 5125980 - DNA, 23 bp, Homo sapiens
aatttaactacccttaattactt

SEQ ID NO: 5125981 - DNA, 20 bp, Homo sapiens
aatttaactactaagaataa

SEQ ID NO: 5125982 - DNA, 12 bp, Homo sapiens
aatttaactgca

SEQ ID NO: 5125983 - DNA, 15 bp, Homo sapiens
aatttaactgcatat

SEQ ID NO: 5125984 - DNA, 18 bp, Homo sapiens
aatttaactgcatataga

SEQ ID NO: 5125985 - DNA, 18 bp, Homo sapiens
aatttaacttaactctta

SEQ ID NO: 5125986 - DNA, 17 bp, Homo sapiens
aatttaagaaataactt

SEQ ID NO: 5125987 - DNA, 20 bp, Homo sapiens
aatttaagcatgagtggcct

SEQ ID NO: 5125988 - DNA, 16 bp, Homo sapiens
aatttaagcattgttt

SEQ ID NO: 5125989 - DNA, 23 bp, Homo sapiens
aatttaagccaataaataatatt

SEQ ID NO: 5125990 - DNA, 20 bp, Homo sapiens
aatttaaggagggacaagaa

SEQ ID NO: 5125991 - DNA, 13 bp, Homo sapiens
aatttaaggcaaa

SEQ ID NO: 5125992 - DNA, 15 bp, Homo sapiens
aatttaaggcttaaa

SEQ ID NO: 5125993 - DNA, 21 bp, Homo sapiens
aatttaaggtctgtttgctgt

SEQ ID NO: 5125994 - DNA, 20 bp, Homo sapiens
aatttaagtgacacagacat

SEQ ID NO: 5125995 - DNA, 12 bp, Homo sapiens
aatttaagtttt

SEQ ID NO: 5125996 - DNA, 17 bp, Homo sapiens
aatttaataaaaaggaa

SEQ ID NO: 5125997 - DNA, 19 bp, Homo sapiens
aatttaataaaaaggaata

SEQ ID NO: 5125998 - DNA, 17 bp, Homo sapiens
aatttaataacttttta

SEQ ID NO: 5125999 - DNA, 15 bp, Homo sapiens
aatttaatatttact

SEQ ID NO: 5126000 - DNA, 12 bp, Homo sapiens
aatttaatgaaa

SEQ ID NO: 5126001 - DNA, 15 bp, Homo sapiens
aatttaatgctgcct

SEQ ID NO: 5126002 - DNA, 17 bp, Homo sapiens
aatttaatgctgccttt

SEQ ID NO: 5126003 - DNA, 11 bp, Homo sapiens
aatttaatggg

SEQ ID NO: 5126004 - DNA, 23 bp, Homo sapiens
aatttaatggggtctgtaaatac

SEQ ID NO: 5126005 - DNA, 20 bp, Homo sapiens
aatttaatgtaaataaaaca

SEQ ID NO: 5126006 - DNA, 20 bp, Homo sapiens
aatttaatgtattaatctgt

SEQ ID NO: 5126007 - DNA, 13 bp, Homo sapiens
aatttaatgtttc

SEQ ID NO: 5126008 - DNA, 15 bp, Homo sapiens
acaactgacacagga

SEQ ID NO: 5126009 - DNA, 17 bp, Homo sapiens
acaactgagatgttaaa

SEQ ID NO: 5126010 - DNA, 19 bp, Homo sapiens
acaactgagtccttaaaca

SEQ ID NO: 5126011 - DNA, 21 bp, Homo sapiens
acaactgatcatttgcagctg

SEQ ID NO: 5126012 - DNA, 21 bp, Homo sapiens
acaactgcaataacttctgac

SEQ ID NO: 5126013 - DNA, 20 bp, Homo sapiens
acaactgccaaataaaatgt

SEQ ID NO: 5126014 - DNA, 20 bp, Homo sapiens
acaactggaatagttttttt

SEQ ID NO: 5126015 - DNA, 17 bp, Homo sapiens
acaactgtaaagcaaat

SEQ ID NO: 5126016 - DNA, 20 bp, Homo sapiens
acaactgtgaatatgagaaa

SEQ ID NO: 5126017 - DNA, 13 bp, Homo sapiens
acaactgtgactg

SEQ ID NO: 5126018 - DNA, 14 bp, Homo sapiens
acaactgtgactgt

SEQ ID NO: 5126019 - DNA, 18 bp, Homo sapiens
acaactgtggataaattt

SEQ ID NO: 5126020 - DNA, 15 bp, Homo sapiens
acaacttagctcagg

SEQ ID NO: 5126021 - DNA, 22 bp, Homo sapiens
acaacttataggtgaatgagta

SEQ ID NO: 5126022 - DNA, 20 bp, Homo sapiens
acaacttatttaaaaatatt

SEQ ID NO: 5126023 - DNA, 16 bp, Homo sapiens
acaacttcagcagggg

SEQ ID NO: 5126024 - DNA, 17 bp, Homo sapiens
acaacttgattttttca

SEQ ID NO: 5126025 - DNA, 15 bp, Homo sapiens
acaacttgctactta

SEQ ID NO: 5126026 - DNA, 13 bp, Homo sapiens
acaacttgctcct

SEQ ID NO: 5126027 - DNA, 15 bp, Homo sapiens
acaacttgctccttt

SEQ ID NO: 5126028 - DNA, 13 bp, Homo sapiens
acaacttggcatt

SEQ ID NO: 5126029 - DNA, 14 bp, Homo sapiens
acaacttgggttct

SEQ ID NO: 5126030 - DNA, 17 bp, Homo sapiens
acaacttgtatttccaa

SEQ ID NO: 5126031 - DNA, 22 bp, Homo sapiens
acaacttgtctattacctgtta

SEQ ID NO: 5126032 - DNA, 17 bp, Homo sapiens
acaacttgtgttctatt

SEQ ID NO: 5126033 - DNA, 17 bp, Homo sapiens
acaactttaagaggaca

SEQ ID NO: 5126034 - DNA, 23 bp, Homo sapiens
acaactttaccataaagccttta

SEQ ID NO: 5126035 - DNA, 22 bp, Homo sapiens
acaactttatgtagagaaaagg

SEQ ID NO: 5126036 - DNA, 14 bp, Homo sapiens
acaactttcagtgg

SEQ ID NO: 5126037 - DNA, 15 bp, Homo sapiens
acaactttcagtggc

SEQ ID NO: 5126038 - DNA, 16 bp, Homo sapiens
acaactttctcttgta

SEQ ID NO: 5126039 - DNA, 15 bp, Homo sapiens
acaactttgcaaatt

SEQ ID NO: 5126040 - DNA, 15 bp, Homo sapiens
acaacttttaaccaa

SEQ ID NO: 5126041 - DNA, 20 bp, Homo sapiens
acaacttttaaccaaacaat

SEQ ID NO: 5126042 - DNA, 19 bp, Homo sapiens
acaacttttccctcactgt

SEQ ID NO: 5126043 - DNA, 11 bp, Homo sapiens
acaacttttct

SEQ ID NO: 5126044 - DNA, 13 bp, Homo sapiens
acaacttttctgc

SEQ ID NO: 5126045 - DNA, 17 bp, Homo sapiens
acaacttttgttttctg

SEQ ID NO: 5126046 - DNA, 18 bp, Homo sapiens
acaacttttgttttctga

SEQ ID NO: 5126047 - DNA, 20 bp, Homo sapiens
acaacttttgttttctgatg

SEQ ID NO: 5126048 - DNA, 14 bp, Homo sapiens
acaactttttaaat

SEQ ID NO: 5126049 - DNA, 20 bp, Homo sapiens
acaacttttttttctttttt

SEQ ID NO: 5126050 - DNA, 20 bp, Homo sapiens
acaagaaaaataaagaaaag

SEQ ID NO: 5126051 - DNA, 23 bp, Homo sapiens
acaagaaaaataaagaaaagatg

SEQ ID NO: 5126052 - DNA, 19 bp, Homo sapiens
acaagaaacgtgtcacact

SEQ ID NO: 5126053 - DNA, 12 bp, Homo sapiens
acaagaaactgt

SEQ ID NO: 5126054 - DNA, 21 bp, Homo sapiens
acaagaaactgtccaaatgct

SEQ ID NO: 5126055 - DNA, 18 bp, Homo sapiens
acaagaaactttggaagc

SEQ ID NO: 5126056 - DNA, 14 bp, Homo sapiens
acaagaaagaaatg

SEQ ID NO: 5126057 - DNA, 21 bp, Homo sapiens
acaagaaaggagagtcttgca

SEQ ID NO: 5126058 - DNA, 17 bp, Homo sapiens
acaagaaagtttcccca

SEQ ID NO: 5126059 - DNA, 13 bp, Homo sapiens
acaagaaataaat

SEQ ID NO: 5126060 - DNA, 16 bp, Homo sapiens
acaagaaatccctgtt

SEQ ID NO: 5126061 - DNA, 21 bp, Homo sapiens
acaagaaatccctgtttaata

SEQ ID NO: 5126062 - DNA, 15 bp, Homo sapiens
acaagaaatgaaagc

SEQ ID NO: 5126063 - DNA, 13 bp, Homo sapiens
acaagaaatgctt

SEQ ID NO: 5126064 - DNA, 11 bp, Homo sapiens
acaagaaatgg

SEQ ID NO: 5126065 - DNA, 20 bp, Homo sapiens
acaagaactcctcccaccca

SEQ ID NO: 5126066 - DNA, 13 bp, Homo sapiens
acaagaagaaata

SEQ ID NO: 5126067 - DNA, 14 bp, Homo sapiens
acaagaagaagggc

SEQ ID NO: 5126068 - DNA, 21 bp, Homo sapiens
acaagaaggccagcccactgg

SEQ ID NO: 5126069 - DNA, 21 bp, Homo sapiens
acaagaaggtggaaggcagtg

SEQ ID NO: 5126070 - DNA, 14 bp, Homo sapiens
acaagaagtttatt

SEQ ID NO: 5126071 - DNA, 17 bp, Homo sapiens
acaagaatcacctcaaa

SEQ ID NO: 5126072 - DNA, 12 bp, Homo sapiens
acaagaatctag

SEQ ID NO: 5126073 - DNA, 23 bp, Homo sapiens
acaagaatgaaggtttttgtaaa

SEQ ID NO: 5126074 - DNA, 12 bp, Homo sapiens
acaagaatgcat

SEQ ID NO: 5126075 - DNA, 15 bp, Homo sapiens
acaagaatgcattga

SEQ ID NO: 5126076 - DNA, 23 bp, Homo sapiens
acaagaatggatcacaagatgga

SEQ ID NO: 5126077 - DNA, 16 bp, Homo sapiens
acaagaattacactaa

SEQ ID NO: 5126078 - DNA, 21 bp, Homo sapiens
acaagacagcagagccatctg

SEQ ID NO: 5126079 - DNA, 19 bp, Homo sapiens
acaagaccaccacttcgaa

SEQ ID NO: 5126080 - DNA, 18 bp, Homo sapiens
acaagaccacgtttctaa

SEQ ID NO: 5126081 - DNA, 15 bp, Homo sapiens
acaagacccccagca

SEQ ID NO: 5126082 - DNA, 15 bp, Homo sapiens
acaagaccctctcag

SEQ ID NO: 5126083 - DNA, 18 bp, Homo sapiens
acaagaccgccccagggc

SEQ ID NO: 5126084 - DNA, 22 bp, Homo sapiens
acaagactgacgccagggtatg

SEQ ID NO: 5126085 - DNA, 13 bp, Homo sapiens
acaagactgcaca

SEQ ID NO: 5126086 - DNA, 23 bp, Homo sapiens
acaagactgcctccctctcttcc

SEQ ID NO: 5126087 - DNA, 18 bp, Homo sapiens
acaagactggcccagtgc

SEQ ID NO: 5126088 - DNA, 15 bp, Homo sapiens
acaagactgtaaatt

SEQ ID NO: 5126089 - DNA, 16 bp, Homo sapiens
acaagactgtcattag

SEQ ID NO: 5126090 - DNA, 20 bp, Homo sapiens
acaagactttccccatactc

SEQ ID NO: 5126091 - DNA, 14 bp, Homo sapiens
acaagagaaaaagc

SEQ ID NO: 5126092 - DNA, 17 bp, Homo sapiens
acaagagaagcattctc

SEQ ID NO: 5126093 - DNA, 21 bp, Homo sapiens
acaagagaccaactttttcat

SEQ ID NO: 5126094 - DNA, 14 bp, Homo sapiens
acaagagactgctt

SEQ ID NO: 5126095 - DNA, 15 bp, Homo sapiens
acaagagatctacac

SEQ ID NO: 5126096 - DNA, 16 bp, Homo sapiens
acaagagatctacaca

SEQ ID NO: 5126097 - DNA, 13 bp, Homo sapiens
acaagagatggga

SEQ ID NO: 5126098 - DNA, 12 bp, Homo sapiens
acaagagcaaaa

SEQ ID NO: 5126099 - DNA, 14 bp, Homo sapiens
acaagagcagcctg

SEQ ID NO: 5126100 - DNA, 15 bp, Homo sapiens
acaagagcagcctgt

SEQ ID NO: 5126101 - DNA, 19 bp, Homo sapiens
acaagagcagcctgtggca

SEQ ID NO: 5126102 - DNA, 20 bp, Homo sapiens
acaagagcagcctgtggcat

SEQ ID NO: 5126103 - DNA, 17 bp, Homo sapiens
acaagagcccaggcctc

SEQ ID NO: 5126104 - DNA, 17 bp, Homo sapiens
acaagagcgaaactccg

SEQ ID NO: 5126105 - DNA, 13 bp, Homo sapiens
acaagagctcctt

SEQ ID NO: 5126106 - DNA, 15 bp, Homo sapiens
acaagagctgttatg

SEQ ID NO: 5126107 - DNA, 20 bp, Homo sapiens
acaagagctgttatgctgtt

SEQ ID NO: 5126108 - DNA, 21 bp, Homo sapiens
acaagagctgttatgctgttt

SEQ ID NO: 5126109 - DNA, 17 bp, Homo sapiens
acaagaggacacaatgg

SEQ ID NO: 5126110 - DNA, 21 bp, Homo sapiens
acaagaggattgtaaaatgca

SEQ ID NO: 5126111 - DNA, 23 bp, Homo sapiens
acaagaggcttccctagtttaca

SEQ ID NO: 5126112 - DNA, 22 bp, Homo sapiens
acaagagggaatagtatagaca

SEQ ID NO: 5126113 - DNA, 18 bp, Homo sapiens
acaagagggcaaagctga

SEQ ID NO: 5126114 - DNA, 21 bp, Homo sapiens
acaagagtatgtggcaaaaca

SEQ ID NO: 5126115 - DNA, 16 bp, Homo sapiens
acaagagtctgtattc

SEQ ID NO: 5126116 - DNA, 12 bp, Homo sapiens
acaagagtgatt

SEQ ID NO: 5126117 - DNA, 18 bp, Homo sapiens
acaagagtttatttccaa

SEQ ID NO: 5126118 - DNA, 17 bp, Homo sapiens
acaagataagcttccag

SEQ ID NO: 5126119 - DNA, 14 bp, Homo sapiens
acaagataccaggc

SEQ ID NO: 5126120 - DNA, 23 bp, Homo sapiens
acaagatattatgtataaaatgt

SEQ ID NO: 5126121 - DNA, 12 bp, Homo sapiens
acaagatattta

SEQ ID NO: 5126122 - DNA, 18 bp, Homo sapiens
acaagatatttatatgtt

SEQ ID NO: 5126123 - DNA, 14 bp, Homo sapiens
acaagatccatttg

SEQ ID NO: 5126124 - DNA, 19 bp, Homo sapiens
acaagatccatttgccttt

SEQ ID NO: 5126125 - DNA, 15 bp, Homo sapiens
acaagatctttcagg

SEQ ID NO: 5126126 - DNA, 20 bp, Homo sapiens
acaagatctttcaggaaaga

SEQ ID NO: 5126127 - DNA, 22 bp, Homo sapiens
acaagatggaaaataaattata

SEQ ID NO: 5126128 - DNA, 18 bp, Homo sapiens
acaagatggaatttatca

SEQ ID NO: 5126129 - DNA, 20 bp, Homo sapiens
acaagatggagaaacaacaa

SEQ ID NO: 5126130 - DNA, 20 bp, Homo sapiens
acaagatggcgaccaccaaa

SEQ ID NO: 5126131 - DNA, 21 bp, Homo sapiens
acaagatggcgaccaccaaag

SEQ ID NO: 5126132 - DNA, 23 bp, Homo sapiens
acaagatggcgaccaccaaagtc

SEQ ID NO: 5126133 - DNA, 24 bp, Homo sapiens
acaagatggcgaccaccaaagtca

SEQ ID NO: 5126134 - DNA, 14 bp, Homo sapiens
acaagatgggacag

SEQ ID NO: 5126135 - DNA, 16 bp, Homo sapiens
acaagatgggacagca

SEQ ID NO: 5126136 - DNA, 15 bp, Homo sapiens
acaagatgtgggcct

SEQ ID NO: 5126137 - DNA, 17 bp, Homo sapiens
acaagattcccagagac

SEQ ID NO: 5126138 - DNA, 23 bp, Homo sapiens
acaagattggtgtttttttctat

SEQ ID NO: 5126139 - DNA, 19 bp, Homo sapiens
acaagatttccctaaaaat

SEQ ID NO: 5126140 - DNA, 19 bp, Homo sapiens
acaagatttcctactttct

SEQ ID NO: 5126141 - DNA, 20 bp, Homo sapiens
acaagattttaaagacatgt

SEQ ID NO: 5126142 - DNA, 20 bp, Homo sapiens
acaagattttttaattgttt

SEQ ID NO: 5126143 - DNA, 16 bp, Homo sapiens
acaagcaaacccagac

SEQ ID NO: 5126144 - DNA, 17 bp, Homo sapiens
acaagcaaaccttctca

SEQ ID NO: 5126145 - DNA, 20 bp, Homo sapiens
acaagcaaatataaacagca

SEQ ID NO: 5126146 - DNA, 17 bp, Homo sapiens
acaagcaacataaaaca

SEQ ID NO: 5126147 - DNA, 14 bp, Homo sapiens
acaagcaacccaaa

SEQ ID NO: 5126148 - DNA, 22 bp, Homo sapiens
acaagcacaattgatctctttt

SEQ ID NO: 5126149 - DNA, 22 bp, Homo sapiens
acaagcacagacattaaacctg

SEQ ID NO: 5126150 - DNA, 18 bp, Homo sapiens
acaagcaccccagacctc

SEQ ID NO: 5126151 - DNA, 17 bp, Homo sapiens
acaagcactattttata

SEQ ID NO: 5126152 - DNA, 15 bp, Homo sapiens
acaagcagacacaca

SEQ ID NO: 5126153 - DNA, 16 bp, Homo sapiens
acaagcagacacacac

SEQ ID NO: 5126154 - DNA, 19 bp, Homo sapiens
acaagcagatactgctgtg

SEQ ID NO: 5126155 - DNA, 14 bp, Homo sapiens
acaagcagtccctt

SEQ ID NO: 5126156 - DNA, 15 bp, Homo sapiens
acaagcatatttgag

SEQ ID NO: 5126157 - DNA, 18 bp, Homo sapiens
acaagcatcatggatcaa

SEQ ID NO: 5126158 - DNA, 19 bp, Homo sapiens
acaagcatgcagctttgca

SEQ ID NO: 5126159 - DNA, 14 bp, Homo sapiens
acaagcatgtctct

SEQ ID NO: 5126160 - DNA, 15 bp, Homo sapiens
acaagcatgtctctc

SEQ ID NO: 5126161 - DNA, 22 bp, Homo sapiens
acaagcatgtctctctgccaag

SEQ ID NO: 5126162 - DNA, 22 bp, Homo sapiens
acaagcattccttagcagctca

SEQ ID NO: 5126163 - DNA, 18 bp, Homo sapiens
acaagccaaaagtccctc

SEQ ID NO: 5126164 - DNA, 22 bp, Homo sapiens
acaagccagaacttgaccctga

SEQ ID NO: 5126165 - DNA, 12 bp, Homo sapiens
acaagccagagc

SEQ ID NO: 5126166 - DNA, 14 bp, Homo sapiens
acaagccaggccct

SEQ ID NO: 5126167 - DNA, 17 bp, Homo sapiens
acaagccaggccctctc

SEQ ID NO: 5126168 - DNA, 11 bp, Homo sapiens
acaagccaggg

SEQ ID NO: 5126169 - DNA, 19 bp, Homo sapiens
acaagcccaaatttaattt

SEQ ID NO: 5126170 - DNA, 13 bp, Homo sapiens
acaagcccacagc

SEQ ID NO: 5126171 - DNA, 11 bp, Homo sapiens
acaagcccagg

SEQ ID NO: 5126172 - DNA, 20 bp, Homo sapiens
acaagcccaggacactgcct

SEQ ID NO: 5126173 - DNA, 14 bp, Homo sapiens
acaagccccaggca

SEQ ID NO: 5126174 - DNA, 17 bp, Homo sapiens
acaagcccccccttcca

SEQ ID NO: 5126175 - DNA, 18 bp, Homo sapiens
acaagcccccccttccac

SEQ ID NO: 5126176 - DNA, 20 bp, Homo sapiens
acaagccctgcttgctggaa

SEQ ID NO: 5126177 - DNA, 20 bp, Homo sapiens
acaagccctgcttttgcata

SEQ ID NO: 5126178 - DNA, 11 bp, Homo sapiens
acaagccctgg

SEQ ID NO: 5126179 - DNA, 14 bp, Homo sapiens
acaagccctggcaa

SEQ ID NO: 5126180 - DNA, 16 bp, Homo sapiens
acaagccgtgttttat

SEQ ID NO: 5126181 - DNA, 21 bp, Homo sapiens
acaagcctcctgtacctcagt

SEQ ID NO: 5126182 - DNA, 18 bp, Homo sapiens
acaagcctctgcccaggc

SEQ ID NO: 5126183 - DNA, 20 bp, Homo sapiens
acaagcctctgcccaggcac

SEQ ID NO: 5126184 - DNA, 23 bp, Homo sapiens
acaagcctctgcccaggcactgc

SEQ ID NO: 5126185 - DNA, 21 bp, Homo sapiens
acaagcctgaaagtaatttca

SEQ ID NO: 5126186 - DNA, 14 bp, Homo sapiens
acaagcctgagaac

SEQ ID NO: 5126187 - DNA, 17 bp, Homo sapiens
aatttaattaatcgaaa

SEQ ID NO: 5126188 - DNA, 13 bp, Homo sapiens
aatttaattcaaa

SEQ ID NO: 5126189 - DNA, 15 bp, Homo sapiens
aatttaattcaaagt

SEQ ID NO: 5126190 - DNA, 19 bp, Homo sapiens
aatttaattcatgtttctt

SEQ ID NO: 5126191 - DNA, 14 bp, Homo sapiens
aatttaattgcttt

SEQ ID NO: 5126192 - DNA, 17 bp, Homo sapiens
aatttaattgctttgaa

SEQ ID NO: 5126193 - DNA, 22 bp, Homo sapiens
aatttaattgtgtaactgttct

SEQ ID NO: 5126194 - DNA, 12 bp, Homo sapiens
aatttaatttat

SEQ ID NO: 5126195 - DNA, 13 bp, Homo sapiens
aatttaatttatg

SEQ ID NO: 5126196 - DNA, 15 bp, Homo sapiens
aatttaatttatgtg

SEQ ID NO: 5126197 - DNA, 18 bp, Homo sapiens
aatttaatttttcctttt

SEQ ID NO: 5126198 - DNA, 21 bp, Homo sapiens
aatttacaaaaatataaaata

SEQ ID NO: 5126199 - DNA, 16 bp, Homo sapiens
aatttacaaaatttat

SEQ ID NO: 5126200 - DNA, 16 bp, Homo sapiens
aatttacaaagtgtgt

SEQ ID NO: 5126201 - DNA, 17 bp, Homo sapiens
aatttacaaagtgtgta

SEQ ID NO: 5126202 - DNA, 22 bp, Homo sapiens
aatttacaagatattattaatt

SEQ ID NO: 5126203 - DNA, 15 bp, Homo sapiens
aatttacacatctta

SEQ ID NO: 5126204 - DNA, 18 bp, Homo sapiens
aatttacacatcttaaaa

SEQ ID NO: 5126205 - DNA, 18 bp, Homo sapiens
aatttacagagacagaaa

SEQ ID NO: 5126206 - DNA, 21 bp, Homo sapiens
aatttacatcagaagtttgca

SEQ ID NO: 5126207 - DNA, 14 bp, Homo sapiens
aatttacatggcaa

SEQ ID NO: 5126208 - DNA, 14 bp, Homo sapiens
aatttacatttatc

SEQ ID NO: 5126209 - DNA, 21 bp, Homo sapiens
aatttaccacaaaagcaaaat

SEQ ID NO: 5126210 - DNA, 23 bp, Homo sapiens
aatttaccatcaaacaaatcatt

SEQ ID NO: 5126211 - DNA, 14 bp, Homo sapiens
aatttacctaagat

SEQ ID NO: 5126212 - DNA, 17 bp, Homo sapiens
aatttacctaagattac

SEQ ID NO: 5126213 - DNA, 23 bp, Homo sapiens
aatttacctctcattagaaaggc

SEQ ID NO: 5126214 - DNA, 23 bp, Homo sapiens
aatttacctcttatgagctccat

SEQ ID NO: 5126215 - DNA, 19 bp, Homo sapiens
aatttacgtcttgagaaat

SEQ ID NO: 5126216 - DNA, 20 bp, Homo sapiens
aatttacgtcttgagaaata

SEQ ID NO: 5126217 - DNA, 16 bp, Homo sapiens
aatttactaatttatt

SEQ ID NO: 5126218 - DNA, 17 bp, Homo sapiens
aatttactacaatatgt

SEQ ID NO: 5126219 - DNA, 15 bp, Homo sapiens
aatttactatatata

SEQ ID NO: 5126220 - DNA, 19 bp, Homo sapiens
aatttactatatatatatg

SEQ ID NO: 5126221 - DNA, 22 bp, Homo sapiens
aatttactcacagcacttgttt

SEQ ID NO: 5126222 - DNA, 12 bp, Homo sapiens
aatttactctgt

SEQ ID NO: 5126223 - DNA, 14 bp, Homo sapiens
aatttactgattcc

SEQ ID NO: 5126224 - DNA, 14 bp, Homo sapiens
aatttactggccac

SEQ ID NO: 5126225 - DNA, 17 bp, Homo sapiens
aatttacttaagtgttc

SEQ ID NO: 5126226 - DNA, 15 bp, Homo sapiens
aatttacttgttttg

SEQ ID NO: 5126227 - DNA, 12 bp, Homo sapiens
aatttactttaa

SEQ ID NO: 5126228 - DNA, 15 bp, Homo sapiens
aatttactttaaact

SEQ ID NO: 5126229 - DNA, 18 bp, Homo sapiens
aatttactttaaactaca

SEQ ID NO: 5126230 - DNA, 14 bp, Homo sapiens
aatttactttcttc

SEQ ID NO: 5126231 - DNA, 18 bp, Homo sapiens
aatttactttcttcacca

SEQ ID NO: 5126232 - DNA, 15 bp, Homo sapiens
aatttactttggaaa

SEQ ID NO: 5126233 - DNA, 14 bp, Homo sapiens
aatttactttgtag

SEQ ID NO: 5126234 - DNA, 12 bp, Homo sapiens
aatttactttta

SEQ ID NO: 5126235 - DNA, 13 bp, Homo sapiens
aatttacttttaa

SEQ ID NO: 5126236 - DNA, 17 bp, Homo sapiens
aatttactttttaaaca

SEQ ID NO: 5126237 - DNA, 22 bp, Homo sapiens
aatttactttttaaacagtgtt

SEQ ID NO: 5126238 - DNA, 21 bp, Homo sapiens
aatttagaaaaagaacatgca

SEQ ID NO: 5126239 - DNA, 15 bp, Homo sapiens
aatttagaaaaagtc

SEQ ID NO: 5126240 - DNA, 12 bp, Homo sapiens
aatttagaaact

SEQ ID NO: 5126241 - DNA, 15 bp, Homo sapiens
aatttagaaactgaa

SEQ ID NO: 5126242 - DNA, 17 bp, Homo sapiens
aatttagaaactgaaaa

SEQ ID NO: 5126243 - DNA, 15 bp, Homo sapiens
aatttagaaatattc

SEQ ID NO: 5126244 - DNA, 16 bp, Homo sapiens
aatttagaaatattca

SEQ ID NO: 5126245 - DNA, 14 bp, Homo sapiens
aatttagaaatcat

SEQ ID NO: 5126246 - DNA, 15 bp, Homo sapiens
aatttagaaatcatt

SEQ ID NO: 5126247 - DNA, 15 bp, Homo sapiens
aatttagaatgaata

SEQ ID NO: 5126248 - DNA, 20 bp, Homo sapiens
aatttagacaacctgaaatt

SEQ ID NO: 5126249 - DNA, 16 bp, Homo sapiens
aatttagaccttttcc

SEQ ID NO: 5126250 - DNA, 15 bp, Homo sapiens
aatttagatattttc

SEQ ID NO: 5126251 - DNA, 19 bp, Homo sapiens
aatttagatattttccata

SEQ ID NO: 5126252 - DNA, 12 bp, Homo sapiens
aatttagatctt

SEQ ID NO: 5126253 - DNA, 14 bp, Homo sapiens
aatttagatcttat

SEQ ID NO: 5126254 - DNA, 17 bp, Homo sapiens
aatttagatcttatatt

SEQ ID NO: 5126255 - DNA, 17 bp, Homo sapiens
aatttagatgaatttag

SEQ ID NO: 5126256 - DNA, 13 bp, Homo sapiens
aatttagcaaact

SEQ ID NO: 5126257 - DNA, 20 bp, Homo sapiens
aatttagcagtccatttttg

SEQ ID NO: 5126258 - DNA, 13 bp, Homo sapiens
aatttagcattgt

SEQ ID NO: 5126259 - DNA, 14 bp, Homo sapiens
aatttagcattgta

SEQ ID NO: 5126260 - DNA, 17 bp, Homo sapiens
aatttaggggtagaaaa

SEQ ID NO: 5126261 - DNA, 16 bp, Homo sapiens
aatttagggtactaaa

SEQ ID NO: 5126262 - DNA, 15 bp, Homo sapiens
aatttaggtaaataa

SEQ ID NO: 5126263 - DNA, 20 bp, Homo sapiens
aatttagtaaaccaatccta

SEQ ID NO: 5126264 - DNA, 16 bp, Homo sapiens
aatttagtaaatgtta

SEQ ID NO: 5126265 - DNA, 16 bp, Homo sapiens
aatttagtaagtgacc

SEQ ID NO: 5126266 - DNA, 12 bp, Homo sapiens
aatttagtatta

SEQ ID NO: 5126267 - DNA, 15 bp, Homo sapiens
aatttagtcattatt

SEQ ID NO: 5126268 - DNA, 23 bp, Homo sapiens
aatttagtgatcttagcatagct

SEQ ID NO: 5126269 - DNA, 18 bp, Homo sapiens
aatttagtggatggaata

SEQ ID NO: 5126270 - DNA, 21 bp, Homo sapiens
aatttagtggatggaatatca

SEQ ID NO: 5126271 - DNA, 17 bp, Homo sapiens
aatttagtgtatatgtg

SEQ ID NO: 5126272 - DNA, 16 bp, Homo sapiens
aatttagtgtatccat

SEQ ID NO: 5126273 - DNA, 22 bp, Homo sapiens
aatttagtgtttttttatttct

SEQ ID NO: 5126274 - DNA, 13 bp, Homo sapiens
aatttagttgttt

SEQ ID NO: 5126275 - DNA, 22 bp, Homo sapiens
aatttagtttcatataaagtat

SEQ ID NO: 5126276 - DNA, 21 bp, Homo sapiens
aatttagtttgtactcagtgg

SEQ ID NO: 5126277 - DNA, 15 bp, Homo sapiens
aatttagtttgttaa

SEQ ID NO: 5126278 - DNA, 23 bp, Homo sapiens
aatttagtttgttaaagcctgtt

SEQ ID NO: 5126279 - DNA, 15 bp, Homo sapiens
aatttataaaattag

SEQ ID NO: 5126280 - DNA, 21 bp, Homo sapiens
aatttataaaattagaaagca

SEQ ID NO: 5126281 - DNA, 11 bp, Homo sapiens
aatttataaca

SEQ ID NO: 5126282 - DNA, 19 bp, Homo sapiens
aatttataagcattgccat

SEQ ID NO: 5126283 - DNA, 20 bp, Homo sapiens
aatttataagcattgccatt

SEQ ID NO: 5126284 - DNA, 21 bp, Homo sapiens
aatttataatataaatatatg

SEQ ID NO: 5126285 - DNA, 19 bp, Homo sapiens
aatttataatgaatacttt

SEQ ID NO: 5126286 - DNA, 23 bp, Homo sapiens
aatttataatgaatactttctta

SEQ ID NO: 5126287 - DNA, 15 bp, Homo sapiens
aatttataatgatta

SEQ ID NO: 5126288 - DNA, 14 bp, Homo sapiens
aatttataattaca

SEQ ID NO: 5126289 - DNA, 18 bp, Homo sapiens
aatttatacaaaataatt

SEQ ID NO: 5126290 - DNA, 19 bp, Homo sapiens
aatttatacaaaataattt

SEQ ID NO: 5126291 - DNA, 20 bp, Homo sapiens
aatttatacaaaataattta

SEQ ID NO: 5126292 - DNA, 17 bp, Homo sapiens
aatttatacttaaaaaa

SEQ ID NO: 5126293 - DNA, 19 bp, Homo sapiens
aatttataggcagatcttt

SEQ ID NO: 5126294 - DNA, 22 bp, Homo sapiens
aatttataggcagatctttaaa

SEQ ID NO: 5126295 - DNA, 23 bp, Homo sapiens
aatttataggcagatctttaaat

SEQ ID NO: 5126296 - DNA, 15 bp, Homo sapiens
aatttatagtaatga

SEQ ID NO: 5126297 - DNA, 17 bp, Homo sapiens
aatttatagtttataca

SEQ ID NO: 5126298 - DNA, 12 bp, Homo sapiens
aatttatataaa

SEQ ID NO: 5126299 - DNA, 22 bp, Homo sapiens
aatttatatagcaagtgctatt

SEQ ID NO: 5126300 - DNA, 14 bp, Homo sapiens
aatttatatcttta

SEQ ID NO: 5126301 - DNA, 19 bp, Homo sapiens
aatttatatctttatgcaa

SEQ ID NO: 5126302 - DNA, 16 bp, Homo sapiens
aatttatatgtatatt

SEQ ID NO: 5126303 - DNA, 16 bp, Homo sapiens
aatttatattccattt

SEQ ID NO: 5126304 - DNA, 16 bp, Homo sapiens
aatttatatttagtaa

SEQ ID NO: 5126305 - DNA, 17 bp, Homo sapiens
aatttatattttagaaa

SEQ ID NO: 5126306 - DNA, 13 bp, Homo sapiens
aatttatcaaaaa

SEQ ID NO: 5126307 - DNA, 17 bp, Homo sapiens
aatttatcaaaaaacaa

SEQ ID NO: 5126308 - DNA, 20 bp, Homo sapiens
aatttatcagattgcttttg

SEQ ID NO: 5126309 - DNA, 22 bp, Homo sapiens
aatttatcagattgcttttgtg

SEQ ID NO: 5126310 - DNA, 21 bp, Homo sapiens
aatttatcatgttttataatt

SEQ ID NO: 5126311 - DNA, 18 bp, Homo sapiens
aatttatccaattttgat

SEQ ID NO: 5126312 - DNA, 23 bp, Homo sapiens
aatttatcctgaaatttcagatt

SEQ ID NO: 5126313 - DNA, 12 bp, Homo sapiens
aatttatctaaa

SEQ ID NO: 5126314 - DNA, 13 bp, Homo sapiens
aatttatctgaat

SEQ ID NO: 5126315 - DNA, 14 bp, Homo sapiens
aatttatctgttgt

SEQ ID NO: 5126316 - DNA, 14 bp, Homo sapiens
aatttatcttaagt

SEQ ID NO: 5126317 - DNA, 18 bp, Homo sapiens
aatttatcttgtctctgg

SEQ ID NO: 5126318 - DNA, 14 bp, Homo sapiens
aatttatctttacc

SEQ ID NO: 5126319 - DNA, 18 bp, Homo sapiens
aatttatctttaccaaaa

SEQ ID NO: 5126320 - DNA, 19 bp, Homo sapiens
aatttatctttaccaaaaa

SEQ ID NO: 5126321 - DNA, 21 bp, Homo sapiens
aatttatgagtgttaataaaa

SEQ ID NO: 5126322 - DNA, 23 bp, Homo sapiens
aatttatgcagagacagctgttt

SEQ ID NO: 5126323 - DNA, 16 bp, Homo sapiens
aatttatgcatttcat

SEQ ID NO: 5126324 - DNA, 14 bp, Homo sapiens
aatttatggtttct

SEQ ID NO: 5126325 - DNA, 19 bp, Homo sapiens
aatttatgtaaggtttttt

SEQ ID NO: 5126326 - DNA, 15 bp, Homo sapiens
aatttatgtcatttt

SEQ ID NO: 5126327 - DNA, 19 bp, Homo sapiens
aatttatgtcattttcaga

SEQ ID NO: 5126328 - DNA, 12 bp, Homo sapiens
aatttattaaat

SEQ ID NO: 5126329 - DNA, 16 bp, Homo sapiens
aatttattaagtctgg

SEQ ID NO: 5126330 - DNA, 16 bp, Homo sapiens
aatttattaatctaaa

SEQ ID NO: 5126331 - DNA, 17 bp, Homo sapiens
aatttattaattgcttt

SEQ ID NO: 5126332 - DNA, 18 bp, Homo sapiens
aatttattaattgctttg

SEQ ID NO: 5126333 - DNA, 16 bp, Homo sapiens
aatttattagtttaaa

SEQ ID NO: 5126334 - DNA, 19 bp, Homo sapiens
aatttattatatatttaca

SEQ ID NO: 5126335 - DNA, 22 bp, Homo sapiens
aatttattatatatttacagaa

SEQ ID NO: 5126336 - DNA, 14 bp, Homo sapiens
aatttattatggca

SEQ ID NO: 5126337 - DNA, 17 bp, Homo sapiens
aatttattatggcacat

SEQ ID NO: 5126338 - DNA, 22 bp, Homo sapiens
aatttattattaaatcagtttt

SEQ ID NO: 5126339 - DNA, 14 bp, Homo sapiens
aatttattcaagaa

SEQ ID NO: 5126340 - DNA, 12 bp, Homo sapiens
aatttattcaat

SEQ ID NO: 5126341 - DNA, 16 bp, Homo sapiens
aatttattcacatata

SEQ ID NO: 5126342 - DNA, 13 bp, Homo sapiens
aatttattcttat

SEQ ID NO: 5126343 - DNA, 23 bp, Homo sapiens
aatttattgaggaaaaatatgtg

SEQ ID NO: 5126344 - DNA, 14 bp, Homo sapiens
aatttattgcacaa

SEQ ID NO: 5126345 - DNA, 15 bp, Homo sapiens
aatttattgcacaaa

SEQ ID NO: 5126346 - DNA, 12 bp, Homo sapiens
aatttattgccg

SEQ ID NO: 5126347 - DNA, 12 bp, Homo sapiens
aatttattggca

SEQ ID NO: 5126348 - DNA, 14 bp, Homo sapiens
aatttattggcagc

SEQ ID NO: 5126349 - DNA, 14 bp, Homo sapiens
aatttattggggtg

SEQ ID NO: 5126350 - DNA, 18 bp, Homo sapiens
aatttattggggtgacct

SEQ ID NO: 5126351 - DNA, 20 bp, Homo sapiens
aatttattgtaccaaagctg

SEQ ID NO: 5126352 - DNA, 21 bp, Homo sapiens
aatttattgtaccaaagctgt

SEQ ID NO: 5126353 - DNA, 22 bp, Homo sapiens
aatttattgtaccaaagctgtt

SEQ ID NO: 5126354 - DNA, 19 bp, Homo sapiens
aatttattgtctgtctaca

SEQ ID NO: 5126355 - DNA, 14 bp, Homo sapiens
aatttattgtcttt

SEQ ID NO: 5126356 - DNA, 15 bp, Homo sapiens
aatttattgtcttta

SEQ ID NO: 5126357 - DNA, 12 bp, Homo sapiens
aatttatttaat

SEQ ID NO: 5126358 - DNA, 17 bp, Homo sapiens
aatttatttatactatt

SEQ ID NO: 5126359 - DNA, 20 bp, Homo sapiens
aatttatttatactatttag

SEQ ID NO: 5126360 - DNA, 13 bp, Homo sapiens
aatttatttatgt

SEQ ID NO: 5126361 - DNA, 12 bp, Homo sapiens
aatttatttcaa

SEQ ID NO: 5126362 - DNA, 14 bp, Homo sapiens
aatttatttcaata

SEQ ID NO: 5126363 - DNA, 16 bp, Homo sapiens
aatttatttcatccag

SEQ ID NO: 5126364 - DNA, 14 bp, Homo sapiens
aatttatttccact

SEQ ID NO: 5126365 - DNA, 21 bp, Homo sapiens
aatttatttccactaaaaata

SEQ ID NO: 5126366 - DNA, 13 bp, Homo sapiens
aatttatttgcaa

SEQ ID NO: 5126367 - DNA, 16 bp, Homo sapiens
aatttattttataaga

SEQ ID NO: 5126368 - DNA, 17 bp, Homo sapiens
acaagcctgagaactga

SEQ ID NO: 5126369 - DNA, 22 bp, Homo sapiens
acaagcctgagggaaaggccag

SEQ ID NO: 5126370 - DNA, 23 bp, Homo sapiens
acaagcctgagggaaaggccagc

SEQ ID NO: 5126371 - DNA, 14 bp, Homo sapiens
acaagcctggagga

SEQ ID NO: 5126372 - DNA, 18 bp, Homo sapiens
acaagcctggcaacacac

SEQ ID NO: 5126373 - DNA, 22 bp, Homo sapiens
acaagcgtcacttctcctgctg

SEQ ID NO: 5126374 - DNA, 18 bp, Homo sapiens
acaagcgtgagccactgc

SEQ ID NO: 5126375 - DNA, 15 bp, Homo sapiens
acaagctacatatgt

SEQ ID NO: 5126376 - DNA, 18 bp, Homo sapiens
acaagctaggaaagagga

SEQ ID NO: 5126377 - DNA, 23 bp, Homo sapiens
acaagctaggaaagaggaggcag

SEQ ID NO: 5126378 - DNA, 14 bp, Homo sapiens
acaagctatgggaa

SEQ ID NO: 5126379 - DNA, 23 bp, Homo sapiens
acaagctattccctcaaatctga

SEQ ID NO: 5126380 - DNA, 16 bp, Homo sapiens
acaagctcatccctgg

SEQ ID NO: 5126381 - DNA, 18 bp, Homo sapiens
acaagctcatccctggac

SEQ ID NO: 5126382 - DNA, 19 bp, Homo sapiens
acaagctcatccctggact

SEQ ID NO: 5126383 - DNA, 15 bp, Homo sapiens
acaagctccaagctc

SEQ ID NO: 5126384 - DNA, 17 bp, Homo sapiens
acaagctccaagctccc

SEQ ID NO: 5126385 - DNA, 19 bp, Homo sapiens
acaagctccaagctcccag

SEQ ID NO: 5126386 - DNA, 18 bp, Homo sapiens
acaagctccatttaaaca

SEQ ID NO: 5126387 - DNA, 15 bp, Homo sapiens
acaagctccctggtg

SEQ ID NO: 5126388 - DNA, 22 bp, Homo sapiens
acaagctctcgggactagctgc

SEQ ID NO: 5126389 - DNA, 14 bp, Homo sapiens
acaagctcttgttt

SEQ ID NO: 5126390 - DNA, 16 bp, Homo sapiens
acaagctcttgtttct

SEQ ID NO: 5126391 - DNA, 14 bp, Homo sapiens
acaagctgacttgg

SEQ ID NO: 5126392 - DNA, 12 bp, Homo sapiens
acaagctgagca

SEQ ID NO: 5126393 - DNA, 17 bp, Homo sapiens
acaagctgatagtgttt

SEQ ID NO: 5126394 - DNA, 22 bp, Homo sapiens
acaagctgcaccctcaggcagg

SEQ ID NO: 5126395 - DNA, 23 bp, Homo sapiens
acaagctgcaccctcaggcaggt

SEQ ID NO: 5126396 - DNA, 16 bp, Homo sapiens
acaagctgcctccctg

SEQ ID NO: 5126397 - DNA, 13 bp, Homo sapiens
acaagctgcctct

SEQ ID NO: 5126398 - DNA, 13 bp, Homo sapiens
acaagctgtatca

SEQ ID NO: 5126399 - DNA, 17 bp, Homo sapiens
acaagctgtatcactgc

SEQ ID NO: 5126400 - DNA, 13 bp, Homo sapiens
acaagctgtccct

SEQ ID NO: 5126401 - DNA, 19 bp, Homo sapiens
acaagctgtccctgcaggg

SEQ ID NO: 5126402 - DNA, 12 bp, Homo sapiens
acaagctgtgca

SEQ ID NO: 5126403 - DNA, 20 bp, Homo sapiens
acaagctgttgaccaggcac

SEQ ID NO: 5126404 - DNA, 17 bp, Homo sapiens
acaagcttcaaagccat

SEQ ID NO: 5126405 - DNA, 16 bp, Homo sapiens
acaagcttctgagacg

SEQ ID NO: 5126406 - DNA, 19 bp, Homo sapiens
acaagcttgtatatacata

SEQ ID NO: 5126407 - DNA, 15 bp, Homo sapiens
acaaggaaaacagta

SEQ ID NO: 5126408 - DNA, 16 bp, Homo sapiens
acaaggaaaacagtaa

SEQ ID NO: 5126409 - DNA, 23 bp, Homo sapiens
acaaggaaaatctatatttgtct

SEQ ID NO: 5126410 - DNA, 14 bp, Homo sapiens
acaaggaagaaatt

SEQ ID NO: 5126411 - DNA, 23 bp, Homo sapiens
acaaggaaggaaaagaaagaaga

SEQ ID NO: 5126412 - DNA, 17 bp, Homo sapiens
acaaggaaggtggtggg

SEQ ID NO: 5126413 - DNA, 23 bp, Homo sapiens
acaaggaataaatgagagggaat

SEQ ID NO: 5126414 - DNA, 23 bp, Homo sapiens
acaaggaatttccctgtgtggat

SEQ ID NO: 5126415 - DNA, 16 bp, Homo sapiens
acaaggacaactttat

SEQ ID NO: 5126416 - DNA, 14 bp, Homo sapiens
acaaggacacgcgc

SEQ ID NO: 5126417 - DNA, 19 bp, Homo sapiens
acaaggaccctgttttcca

SEQ ID NO: 5126418 - DNA, 22 bp, Homo sapiens
acaaggaccctgttttccacac

SEQ ID NO: 5126419 - DNA, 21 bp, Homo sapiens
acaaggagagcggaggaggaa

SEQ ID NO: 5126420 - DNA, 14 bp, Homo sapiens
acaaggagatttct

SEQ ID NO: 5126421 - DNA, 15 bp, Homo sapiens
acaaggagatttctt

SEQ ID NO: 5126422 - DNA, 15 bp, Homo sapiens
acaaggagctcaccc

SEQ ID NO: 5126423 - DNA, 20 bp, Homo sapiens
acaaggagctcaccctgccc

SEQ ID NO: 5126424 - DNA, 18 bp, Homo sapiens
acaaggagctttcttgtt

SEQ ID NO: 5126425 - DNA, 22 bp, Homo sapiens
acaaggagctttcttgtttctt

SEQ ID NO: 5126426 - DNA, 17 bp, Homo sapiens
acaaggagggcctctgg

SEQ ID NO: 5126427 - DNA, 20 bp, Homo sapiens
acaaggagggcctctggtgt

SEQ ID NO: 5126428 - DNA, 13 bp, Homo sapiens
acaaggagtgccc

SEQ ID NO: 5126429 - DNA, 15 bp, Homo sapiens
acaaggagtgcccgc

SEQ ID NO: 5126430 - DNA, 17 bp, Homo sapiens
acaaggatagatgctgg

SEQ ID NO: 5126431 - DNA, 22 bp, Homo sapiens
acaaggatagatgctggcccag

SEQ ID NO: 5126432 - DNA, 17 bp, Homo sapiens
acaaggattgctactgt

SEQ ID NO: 5126433 - DNA, 20 bp, Homo sapiens
acaaggcacttcatgtaaag

SEQ ID NO: 5126434 - DNA, 22 bp, Homo sapiens
acaaggcacttgtcactatgct

SEQ ID NO: 5126435 - DNA, 18 bp, Homo sapiens
acaaggcagcaaggcccg

SEQ ID NO: 5126436 - DNA, 21 bp, Homo sapiens
acaaggcagcaaggcccgagc

SEQ ID NO: 5126437 - DNA, 19 bp, Homo sapiens
acaaggcagcctgaacact

SEQ ID NO: 5126438 - DNA, 22 bp, Homo sapiens
acaaggcaggaggagctgataa

SEQ ID NO: 5126439 - DNA, 13 bp, Homo sapiens
acaaggcaggcct

SEQ ID NO: 5126440 - DNA, 21 bp, Homo sapiens
acaaggcatgtagggggagcc

SEQ ID NO: 5126441 - DNA, 23 bp, Homo sapiens
acaaggcattcagcagtttctga

SEQ ID NO: 5126442 - DNA, 19 bp, Homo sapiens
acaaggccagaaaaagaag

SEQ ID NO: 5126443 - DNA, 20 bp, Homo sapiens
acaaggccagaaaaagaaga

SEQ ID NO: 5126444 - DNA, 19 bp, Homo sapiens
acaaggccagcacccaaag

SEQ ID NO: 5126445 - DNA, 21 bp, Homo sapiens
acaaggccagcacccaaaggg

SEQ ID NO: 5126446 - DNA, 18 bp, Homo sapiens
acaaggccatctgggctc

SEQ ID NO: 5126447 - DNA, 11 bp, Homo sapiens
acaaggcccag

SEQ ID NO: 5126448 - DNA, 18 bp, Homo sapiens
acaaggcccagccctggg

SEQ ID NO: 5126449 - DNA, 13 bp, Homo sapiens
acaaggccccaga

SEQ ID NO: 5126450 - DNA, 17 bp, Homo sapiens
acaaggccccagagact

SEQ ID NO: 5126451 - DNA, 18 bp, Homo sapiens
acaaggccctttaacttg

SEQ ID NO: 5126452 - DNA, 20 bp, Homo sapiens
acaaggccctttaacttgtc

SEQ ID NO: 5126453 - DNA, 12 bp, Homo sapiens
acaaggcctggt

SEQ ID NO: 5126454 - DNA, 14 bp, Homo sapiens
acaaggctggccag

SEQ ID NO: 5126455 - DNA, 13 bp, Homo sapiens
acaaggctgggca

SEQ ID NO: 5126456 - DNA, 23 bp, Homo sapiens
acaaggctgggcacctctagtgc

SEQ ID NO: 5126457 - DNA, 14 bp, Homo sapiens
acaaggctgtgcca

SEQ ID NO: 5126458 - DNA, 20 bp, Homo sapiens
acaaggctgtgccaggctgg

SEQ ID NO: 5126459 - DNA, 17 bp, Homo sapiens
acaaggcttaaaagagt

SEQ ID NO: 5126460 - DNA, 17 bp, Homo sapiens
acaaggcttgctgcaga

SEQ ID NO: 5126461 - DNA, 12 bp, Homo sapiens
acaagggaaggg

SEQ ID NO: 5126462 - DNA, 22 bp, Homo sapiens
acaagggaaggggcctccctcc

SEQ ID NO: 5126463 - DNA, 18 bp, Homo sapiens
acaagggagagacctcat

SEQ ID NO: 5126464 - DNA, 14 bp, Homo sapiens
acaagggaggcagt

SEQ ID NO: 5126465 - DNA, 11 bp, Homo sapiens
acaagggattc

SEQ ID NO: 5126466 - DNA, 16 bp, Homo sapiens
acaagggattctggga

SEQ ID NO: 5126467 - DNA, 18 bp, Homo sapiens
acaagggattctgggaag

SEQ ID NO: 5126468 - DNA, 16 bp, Homo sapiens
acaagggcagtggagg

SEQ ID NO: 5126469 - DNA, 22 bp, Homo sapiens
acaaggggatccagtgtgtaaa

SEQ ID NO: 5126470 - DNA, 14 bp, Homo sapiens
acaaggggcccagt

SEQ ID NO: 5126471 - DNA, 22 bp, Homo sapiens
acaaggggcccttggagcgtgg

SEQ ID NO: 5126472 - DNA, 16 bp, Homo sapiens
acaaggggcttttccc

SEQ ID NO: 5126473 - DNA, 14 bp, Homo sapiens
acaaggggtggaag

SEQ ID NO: 5126474 - DNA, 15 bp, Homo sapiens
acaaggggtggaagg

SEQ ID NO: 5126475 - DNA, 18 bp, Homo sapiens
acaagggtctagggagag

SEQ ID NO: 5126476 - DNA, 14 bp, Homo sapiens
acaaggtaattgtt

SEQ ID NO: 5126477 - DNA, 22 bp, Homo sapiens
acaaggtaattgttttttaaag

SEQ ID NO: 5126478 - DNA, 21 bp, Homo sapiens
acaaggtaggctgcaaaatta

SEQ ID NO: 5126479 - DNA, 14 bp, Homo sapiens
acaaggtagttttt

SEQ ID NO: 5126480 - DNA, 16 bp, Homo sapiens
acaaggtagtttttac

SEQ ID NO: 5126481 - DNA, 19 bp, Homo sapiens
acaaggtcaaagttctggt

SEQ ID NO: 5126482 - DNA, 14 bp, Homo sapiens
acaaggtccactcc

SEQ ID NO: 5126483 - DNA, 20 bp, Homo sapiens
acaaggtccactccctgctc

SEQ ID NO: 5126484 - DNA, 16 bp, Homo sapiens
acaaggtctttaaagt

SEQ ID NO: 5126485 - DNA, 20 bp, Homo sapiens
acaaggtgcacagacctcag

SEQ ID NO: 5126486 - DNA, 22 bp, Homo sapiens
acaaggtgccctttagccagat

SEQ ID NO: 5126487 - DNA, 12 bp, Homo sapiens
acaaggtgctaa

SEQ ID NO: 5126488 - DNA, 15 bp, Homo sapiens
acaaggtgctaacat

SEQ ID NO: 5126489 - DNA, 19 bp, Homo sapiens
acaaggtgctaacatagat

SEQ ID NO: 5126490 - DNA, 17 bp, Homo sapiens
acaaggtgctcagacat

SEQ ID NO: 5126491 - DNA, 14 bp, Homo sapiens
acaaggtgggcagg

SEQ ID NO: 5126492 - DNA, 13 bp, Homo sapiens
acaaggtgttcat

SEQ ID NO: 5126493 - DNA, 14 bp, Homo sapiens
acaaggttgctgtt

SEQ ID NO: 5126494 - DNA, 16 bp, Homo sapiens
acaagtaaaactgtgg

SEQ ID NO: 5126495 - DNA, 22 bp, Homo sapiens
acaagtaaagctagacaaaggc

SEQ ID NO: 5126496 - DNA, 13 bp, Homo sapiens
acaagtaacaaaa

SEQ ID NO: 5126497 - DNA, 13 bp, Homo sapiens
acaagtaactcag

SEQ ID NO: 5126498 - DNA, 23 bp, Homo sapiens
acaagtaagagactcagcctgca

SEQ ID NO: 5126499 - DNA, 13 bp, Homo sapiens
acaagtaatgaat

SEQ ID NO: 5126500 - DNA, 16 bp, Homo sapiens
acaagtaatgaatttt

SEQ ID NO: 5126501 - DNA, 17 bp, Homo sapiens
acaagtaatgaatttta

SEQ ID NO: 5126502 - DNA, 14 bp, Homo sapiens
acaagtaatgtaaa

SEQ ID NO: 5126503 - DNA, 13 bp, Homo sapiens
acaagtaatgtat

SEQ ID NO: 5126504 - DNA, 16 bp, Homo sapiens
acaagtaatttcagtg

SEQ ID NO: 5126505 - DNA, 18 bp, Homo sapiens
acaagtactggtaagatt

SEQ ID NO: 5126506 - DNA, 16 bp, Homo sapiens
acaagtaggagacaca

SEQ ID NO: 5126507 - DNA, 18 bp, Homo sapiens
acaagtagttcatgagta

SEQ ID NO: 5126508 - DNA, 20 bp, Homo sapiens
acaagtagttctgtatttga

SEQ ID NO: 5126509 - DNA, 13 bp, Homo sapiens
acaagtatataat

SEQ ID NO: 5126510 - DNA, 18 bp, Homo sapiens
acaagtatatacttttaa

SEQ ID NO: 5126511 - DNA, 18 bp, Homo sapiens
acaagtatcatctaaata

SEQ ID NO: 5126512 - DNA, 23 bp, Homo sapiens
acaagtatgaataaagacaccta

SEQ ID NO: 5126513 - DNA, 22 bp, Homo sapiens
acaagtatgaatattactctca

SEQ ID NO: 5126514 - DNA, 21 bp, Homo sapiens
acaagtattctacctaaatct

SEQ ID NO: 5126515 - DNA, 11 bp, Homo sapiens
acaagtattta

SEQ ID NO: 5126516 - DNA, 17 bp, Homo sapiens
acaagtatttattccca

SEQ ID NO: 5126517 - DNA, 17 bp, Homo sapiens
acaagtatttgttaatt

SEQ ID NO: 5126518 - DNA, 19 bp, Homo sapiens
acaagtcacggtctaaaca

SEQ ID NO: 5126519 - DNA, 18 bp, Homo sapiens
acaagtcatggtcacagt

SEQ ID NO: 5126520 - DNA, 21 bp, Homo sapiens
acaagtcattttaactttatc

SEQ ID NO: 5126521 - DNA, 21 bp, Homo sapiens
acaagtcctggatgttgtgtg

SEQ ID NO: 5126522 - DNA, 16 bp, Homo sapiens
acaagtcctgtgaatt

SEQ ID NO: 5126523 - DNA, 17 bp, Homo sapiens
acaagtctaaacaatga

SEQ ID NO: 5126524 - DNA, 18 bp, Homo sapiens
acaagtctaaacaatgaa

SEQ ID NO: 5126525 - DNA, 18 bp, Homo sapiens
acaagtctagtcttctgg

SEQ ID NO: 5126526 - DNA, 20 bp, Homo sapiens
acaagtctgcatttcatatt

SEQ ID NO: 5126527 - DNA, 15 bp, Homo sapiens
acaagtctttctcct

SEQ ID NO: 5126528 - DNA, 18 bp, Homo sapiens
acaagtctttctcctctt

SEQ ID NO: 5126529 - DNA, 12 bp, Homo sapiens
acaagtgaaaac

SEQ ID NO: 5126530 - DNA, 23 bp, Homo sapiens
acaagtgaaataacaaaatggac

SEQ ID NO: 5126531 - DNA, 21 bp, Homo sapiens
acaagtgaatctttctcctgg

SEQ ID NO: 5126532 - DNA, 18 bp, Homo sapiens
acaagtgactgtatctgt

SEQ ID NO: 5126533 - DNA, 18 bp, Homo sapiens
acaagtgataatacagat

SEQ ID NO: 5126534 - DNA, 18 bp, Homo sapiens
acaagtgattttcattgt

SEQ ID NO: 5126535 - DNA, 14 bp, Homo sapiens
acaagtgccctcca

SEQ ID NO: 5126536 - DNA, 16 bp, Homo sapiens
acaagtgctcaagcag

SEQ ID NO: 5126537 - DNA, 18 bp, Homo sapiens
acaagtgctcagttccaa

SEQ ID NO: 5126538 - DNA, 18 bp, Homo sapiens
acaagtggactcagggca

SEQ ID NO: 5126539 - DNA, 19 bp, Homo sapiens
acaagtggactcagggcag

SEQ ID NO: 5126540 - DNA, 14 bp, Homo sapiens
acaagtggaggggg

SEQ ID NO: 5126541 - DNA, 22 bp, Homo sapiens
acaagtggagggggtgtctgga

SEQ ID NO: 5126542 - DNA, 13 bp, Homo sapiens
acaagtggcctta

SEQ ID NO: 5126543 - DNA, 19 bp, Homo sapiens
acaagtggctccccacctg

SEQ ID NO: 5126544 - DNA, 18 bp, Homo sapiens
acaagtgtaataaatcaa

SEQ ID NO: 5126545 - DNA, 13 bp, Homo sapiens
acaagtgtaatga

SEQ ID NO: 5126546 - DNA, 18 bp, Homo sapiens
aatttattttataagaaa

SEQ ID NO: 5126547 - DNA, 21 bp, Homo sapiens
aatttattttataagaaaaac

SEQ ID NO: 5126548 - DNA, 17 bp, Homo sapiens
aatttattttgctccct

SEQ ID NO: 5126549 - DNA, 18 bp, Homo sapiens
aatttattttgctccctc

SEQ ID NO: 5126550 - DNA, 13 bp, Homo sapiens
aatttattttgta

SEQ ID NO: 5126551 - DNA, 14 bp, Homo sapiens
aatttattttgtga

SEQ ID NO: 5126552 - DNA, 15 bp, Homo sapiens
aatttattttgtgaa

SEQ ID NO: 5126553 - DNA, 19 bp, Homo sapiens
aatttatttttaagaaaga

SEQ ID NO: 5126554 - DNA, 16 bp, Homo sapiens
aatttcaaaaatataa

SEQ ID NO: 5126555 - DNA, 17 bp, Homo sapiens
aatttcaaaagacatgt

SEQ ID NO: 5126556 - DNA, 15 bp, Homo sapiens
aatttcaaaatacat

SEQ ID NO: 5126557 - DNA, 12 bp, Homo sapiens
aatttcaaaatg

SEQ ID NO: 5126558 - DNA, 18 bp, Homo sapiens
aatttcaaaatgcatgtg

SEQ ID NO: 5126559 - DNA, 22 bp, Homo sapiens
aatttcaaaatgcatgtgattg

SEQ ID NO: 5126560 - DNA, 16 bp, Homo sapiens
aatttcaaacttttga

SEQ ID NO: 5126561 - DNA, 22 bp, Homo sapiens
aatttcaaacttttgaaagatg

SEQ ID NO: 5126562 - DNA, 13 bp, Homo sapiens
aatttcaaataga

SEQ ID NO: 5126563 - DNA, 18 bp, Homo sapiens
aatttcaaatagaatatg

SEQ ID NO: 5126564 - DNA, 11 bp, Homo sapiens
aatttcaaatg

SEQ ID NO: 5126565 - DNA, 19 bp, Homo sapiens
aatttcaaccagcattcat

SEQ ID NO: 5126566 - DNA, 23 bp, Homo sapiens
aatttcaacgcctgcctttggca

SEQ ID NO: 5126567 - DNA, 18 bp, Homo sapiens
aatttcaagaatgtttca

SEQ ID NO: 5126568 - DNA, 21 bp, Homo sapiens
aatttcaagaatgtttcagtt

SEQ ID NO: 5126569 - DNA, 17 bp, Homo sapiens
aatttcaagcttatttt

SEQ ID NO: 5126570 - DNA, 16 bp, Homo sapiens
aatttcaagtcttcct

SEQ ID NO: 5126571 - DNA, 21 bp, Homo sapiens
aatttcaataaaagataaatt

SEQ ID NO: 5126572 - DNA, 13 bp, Homo sapiens
aatttcaatgctt

SEQ ID NO: 5126573 - DNA, 16 bp, Homo sapiens
aatttcaatgcttctt

SEQ ID NO: 5126574 - DNA, 23 bp, Homo sapiens
aatttcaatgcttcttttagtca

SEQ ID NO: 5126575 - DNA, 15 bp, Homo sapiens
aatttcaatttttaa

SEQ ID NO: 5126576 - DNA, 14 bp, Homo sapiens
aatttcacagttct

SEQ ID NO: 5126577 - DNA, 18 bp, Homo sapiens
aatttcacagttctgtaa

SEQ ID NO: 5126578 - DNA, 19 bp, Homo sapiens
aatttcacagttctgtaat

SEQ ID NO: 5126579 - DNA, 17 bp, Homo sapiens
aatttcacatggacttt

SEQ ID NO: 5126580 - DNA, 14 bp, Homo sapiens
aatttcacattaat

SEQ ID NO: 5126581 - DNA, 18 bp, Homo sapiens
aatttcaccccattttct

SEQ ID NO: 5126582 - DNA, 21 bp, Homo sapiens
aatttcaccccattttctgtg

SEQ ID NO: 5126583 - DNA, 16 bp, Homo sapiens
aatttcactgtctttt

SEQ ID NO: 5126584 - DNA, 17 bp, Homo sapiens
aatttcactgtctttta

SEQ ID NO: 5126585 - DNA, 16 bp, Homo sapiens
aatttcactttagaag

SEQ ID NO: 5126586 - DNA, 21 bp, Homo sapiens
aatttcagaaactaagaatca

SEQ ID NO: 5126587 - DNA, 13 bp, Homo sapiens
aatttcagactcc

SEQ ID NO: 5126588 - DNA, 22 bp, Homo sapiens
aatttcagctagttaataattc

SEQ ID NO: 5126589 - DNA, 12 bp, Homo sapiens
aatttcaggaaa

SEQ ID NO: 5126590 - DNA, 14 bp, Homo sapiens
aatttcaggattaa

SEQ ID NO: 5126591 - DNA, 22 bp, Homo sapiens
aatttcaggattaactaaagaa

SEQ ID NO: 5126592 - DNA, 21 bp, Homo sapiens
aatttcaggcattttgttcta

SEQ ID NO: 5126593 - DNA, 19 bp, Homo sapiens
aatttcaggctccccagat

SEQ ID NO: 5126594 - DNA, 17 bp, Homo sapiens
aatttcaggttgttggt

SEQ ID NO: 5126595 - DNA, 16 bp, Homo sapiens
aatttcagtaagatca

SEQ ID NO: 5126596 - DNA, 20 bp, Homo sapiens
aatttcagtcaattctgatg

SEQ ID NO: 5126597 - DNA, 21 bp, Homo sapiens
aatttcagtgggaaatatgcc

SEQ ID NO: 5126598 - DNA, 22 bp, Homo sapiens
aatttcatacctatcatcttaa

SEQ ID NO: 5126599 - DNA, 21 bp, Homo sapiens
aatttcatactatttagattt

SEQ ID NO: 5126600 - DNA, 18 bp, Homo sapiens
aatttcatagctgtactt

SEQ ID NO: 5126601 - DNA, 21 bp, Homo sapiens
aatttcatagctgtacttctt

SEQ ID NO: 5126602 - DNA, 23 bp, Homo sapiens
aatttcatcactaaaagaaaatc

SEQ ID NO: 5126603 - DNA, 18 bp, Homo sapiens
aatttcatgattggctta

SEQ ID NO: 5126604 - DNA, 13 bp, Homo sapiens
aatttcatgcaca

SEQ ID NO: 5126605 - DNA, 13 bp, Homo sapiens
aatttcatgtata

SEQ ID NO: 5126606 - DNA, 16 bp, Homo sapiens
aatttcattcaattta

SEQ ID NO: 5126607 - DNA, 16 bp, Homo sapiens
aatttcattctcttga

SEQ ID NO: 5126608 - DNA, 15 bp, Homo sapiens
aatttcattgcactt

SEQ ID NO: 5126609 - DNA, 17 bp, Homo sapiens
aatttcattgcactttc

SEQ ID NO: 5126610 - DNA, 15 bp, Homo sapiens
aatttcatttccagc

SEQ ID NO: 5126611 - DNA, 22 bp, Homo sapiens
aatttcatttccagcattttta

SEQ ID NO: 5126612 - DNA, 11 bp, Homo sapiens
aatttccaaaa

SEQ ID NO: 5126613 - DNA, 22 bp, Homo sapiens
aatttccagaactgcacaatga

SEQ ID NO: 5126614 - DNA, 11 bp, Homo sapiens
aatttccagag

SEQ ID NO: 5126615 - DNA, 20 bp, Homo sapiens
aatttccagtacctttgtca

SEQ ID NO: 5126616 - DNA, 18 bp, Homo sapiens
aatttccatgatacaaag

SEQ ID NO: 5126617 - DNA, 21 bp, Homo sapiens
aatttccattcttttaaatgg

SEQ ID NO: 5126618 - DNA, 21 bp, Homo sapiens
aatttccatttacttaagact

SEQ ID NO: 5126619 - DNA, 19 bp, Homo sapiens
aatttcccaattaggaagt

SEQ ID NO: 5126620 - DNA, 18 bp, Homo sapiens
aatttcccacccatctcc

SEQ ID NO: 5126621 - DNA, 17 bp, Homo sapiens
aatttcccagttaaaga

SEQ ID NO: 5126622 - DNA, 18 bp, Homo sapiens
aatttcccagttaaagat

SEQ ID NO: 5126623 - DNA, 19 bp, Homo sapiens
aatttcccagttaaagatt

SEQ ID NO: 5126624 - DNA, 22 bp, Homo sapiens
aatttccccaacagtgtgaagt

SEQ ID NO: 5126625 - DNA, 19 bp, Homo sapiens
aatttccccctaaaccaac

SEQ ID NO: 5126626 - DNA, 18 bp, Homo sapiens
aatttccccctgttctta

SEQ ID NO: 5126627 - DNA, 18 bp, Homo sapiens
aatttcccctaatctttt

SEQ ID NO: 5126628 - DNA, 15 bp, Homo sapiens
aatttccctcaggtt

SEQ ID NO: 5126629 - DNA, 12 bp, Homo sapiens
aatttccctggg

SEQ ID NO: 5126630 - DNA, 17 bp, Homo sapiens
aatttcccttcttgcat

SEQ ID NO: 5126631 - DNA, 15 bp, Homo sapiens
aatttcctatctgta

SEQ ID NO: 5126632 - DNA, 16 bp, Homo sapiens
aatttcctcactgcct

SEQ ID NO: 5126633 - DNA, 22 bp, Homo sapiens
aatttcctcactgcctggtaaa

SEQ ID NO: 5126634 - DNA, 20 bp, Homo sapiens
aatttcctgctgaaaataac

SEQ ID NO: 5126635 - DNA, 15 bp, Homo sapiens
aatttcctgtaatat

SEQ ID NO: 5126636 - DNA, 20 bp, Homo sapiens
aatttcctgttggatttgtt

SEQ ID NO: 5126637 - DNA, 19 bp, Homo sapiens
aatttccttctgttaagaa

SEQ ID NO: 5126638 - DNA, 20 bp, Homo sapiens
aatttccttctgttaagaaa

SEQ ID NO: 5126639 - DNA, 22 bp, Homo sapiens
aatttccttctgttaagaaagg

SEQ ID NO: 5126640 - DNA, 16 bp, Homo sapiens
aatttcctttatattt

SEQ ID NO: 5126641 - DNA, 15 bp, Homo sapiens
aatttcctttttgac

SEQ ID NO: 5126642 - DNA, 18 bp, Homo sapiens
aatttcctttttgacact

SEQ ID NO: 5126643 - DNA, 19 bp, Homo sapiens
aatttcctttttgacactg

SEQ ID NO: 5126644 - DNA, 21 bp, Homo sapiens
aatttcctttttgacactgaa

SEQ ID NO: 5126645 - DNA, 23 bp, Homo sapiens
aatttcgccttaaactctggaca

SEQ ID NO: 5126646 - DNA, 19 bp, Homo sapiens
aatttcgcttcttagaaca

SEQ ID NO: 5126647 - DNA, 15 bp, Homo sapiens
aatttctaaagataa

SEQ ID NO: 5126648 - DNA, 16 bp, Homo sapiens
aatttctaaagataat

SEQ ID NO: 5126649 - DNA, 23 bp, Homo sapiens
aatttctaaagataatattactg

SEQ ID NO: 5126650 - DNA, 20 bp, Homo sapiens
aatttctaagaagttacttt

SEQ ID NO: 5126651 - DNA, 17 bp, Homo sapiens
aatttctaatgtttact

SEQ ID NO: 5126652 - DNA, 14 bp, Homo sapiens
aatttctaccagat

SEQ ID NO: 5126653 - DNA, 18 bp, Homo sapiens
aatttctaccatttcaga

SEQ ID NO: 5126654 - DNA, 11 bp, Homo sapiens
aatttctacta

SEQ ID NO: 5126655 - DNA, 14 bp, Homo sapiens
aatttctactgagc

SEQ ID NO: 5126656 - DNA, 18 bp, Homo sapiens
aatttctataaatttaag

SEQ ID NO: 5126657 - DNA, 15 bp, Homo sapiens
aatttctattaatat

SEQ ID NO: 5126658 - DNA, 23 bp, Homo sapiens
aatttctcatgttccttttgaaa

SEQ ID NO: 5126659 - DNA, 19 bp, Homo sapiens
aatttctcccagtcattta

SEQ ID NO: 5126660 - DNA, 19 bp, Homo sapiens
aatttctctcaatttgggt

SEQ ID NO: 5126661 - DNA, 22 bp, Homo sapiens
aatttctgccaataaattctaa

SEQ ID NO: 5126662 - DNA, 13 bp, Homo sapiens
aatttctgccata

SEQ ID NO: 5126663 - DNA, 13 bp, Homo sapiens
aatttctgccctg

SEQ ID NO: 5126664 - DNA, 12 bp, Homo sapiens
aatttctgcctt

SEQ ID NO: 5126665 - DNA, 18 bp, Homo sapiens
aatttctgctgtggtcta

SEQ ID NO: 5126666 - DNA, 21 bp, Homo sapiens
aatttctgcttttgcatcttt

SEQ ID NO: 5126667 - DNA, 15 bp, Homo sapiens
aatttctggaagaaa

SEQ ID NO: 5126668 - DNA, 17 bp, Homo sapiens
aatttctggaagaaagg

SEQ ID NO: 5126669 - DNA, 18 bp, Homo sapiens
aatttctggaagaaaggc

SEQ ID NO: 5126670 - DNA, 23 bp, Homo sapiens
aatttctggaagattcttactgt

SEQ ID NO: 5126671 - DNA, 16 bp, Homo sapiens
aatttctggcaaatat

SEQ ID NO: 5126672 - DNA, 21 bp, Homo sapiens
aatttctggcaaatattttgt

SEQ ID NO: 5126673 - DNA, 22 bp, Homo sapiens
aatttctggcaaatattttgtc

SEQ ID NO: 5126674 - DNA, 19 bp, Homo sapiens
aatttctgggatatttaac

SEQ ID NO: 5126675 - DNA, 20 bp, Homo sapiens
aatttctgggatatttaact

SEQ ID NO: 5126676 - DNA, 17 bp, Homo sapiens
aatttctggtgcacagg

SEQ ID NO: 5126677 - DNA, 18 bp, Homo sapiens
aatttctggtttgcctga

SEQ ID NO: 5126678 - DNA, 16 bp, Homo sapiens
aatttctgtcagaatg

SEQ ID NO: 5126679 - DNA, 13 bp, Homo sapiens
aatttctgtccag

SEQ ID NO: 5126680 - DNA, 20 bp, Homo sapiens
aatttctgtgccctcctgac

SEQ ID NO: 5126681 - DNA, 17 bp, Homo sapiens
aatttctgttgttttaa

SEQ ID NO: 5126682 - DNA, 12 bp, Homo sapiens
aatttcttaact

SEQ ID NO: 5126683 - DNA, 14 bp, Homo sapiens
aatttcttcaaaat

SEQ ID NO: 5126684 - DNA, 19 bp, Homo sapiens
aatttcttcaaaatgtata

SEQ ID NO: 5126685 - DNA, 20 bp, Homo sapiens
aatttcttcactgttgaaaa

SEQ ID NO: 5126686 - DNA, 23 bp, Homo sapiens
aatttcttccacgtaattcaatt

SEQ ID NO: 5126687 - DNA, 13 bp, Homo sapiens
aatttcttcctat

SEQ ID NO: 5126688 - DNA, 14 bp, Homo sapiens
aatttcttccttcc

SEQ ID NO: 5126689 - DNA, 23 bp, Homo sapiens
aatttcttctcctggagttgcat

SEQ ID NO: 5126690 - DNA, 21 bp, Homo sapiens
aatttcttctggtagtgtcag

SEQ ID NO: 5126691 - DNA, 22 bp, Homo sapiens
aatttcttctttagatgccaaa

SEQ ID NO: 5126692 - DNA, 15 bp, Homo sapiens
aatttcttgcaattt

SEQ ID NO: 5126693 - DNA, 24 bp, Homo sapiens
aatttcttgctctatctctcaaaa

SEQ ID NO: 5126694 - DNA, 13 bp, Homo sapiens
aatttcttgctgc

SEQ ID NO: 5126695 - DNA, 22 bp, Homo sapiens
aatttcttggcaaattttaaaa

SEQ ID NO: 5126696 - DNA, 20 bp, Homo sapiens
aatttcttggtaagaagccg

SEQ ID NO: 5126697 - DNA, 15 bp, Homo sapiens
aatttctttaaatgt

SEQ ID NO: 5126698 - DNA, 16 bp, Homo sapiens
aatttcttttattaat

SEQ ID NO: 5126699 - DNA, 17 bp, Homo sapiens
aatttcttttattaata

SEQ ID NO: 5126700 - DNA, 22 bp, Homo sapiens
aatttctttttggtaaatatga

SEQ ID NO: 5126701 - DNA, 19 bp, Homo sapiens
aatttcttttttcctctga

SEQ ID NO: 5126702 - DNA, 22 bp, Homo sapiens
aatttctttttttcctttttaa

SEQ ID NO: 5126703 - DNA, 21 bp, Homo sapiens
aatttgaaaaatgcataataa

SEQ ID NO: 5126704 - DNA, 23 bp, Homo sapiens
aatttgaaaacataatctgcaaa

SEQ ID NO: 5126705 - DNA, 15 bp, Homo sapiens
aatttgaaaatgtcc

SEQ ID NO: 5126706 - DNA, 15 bp, Homo sapiens
aatttgaaacacttt

SEQ ID NO: 5126707 - DNA, 19 bp, Homo sapiens
aatttgaaagtttccttat

SEQ ID NO: 5126708 - DNA, 13 bp, Homo sapiens
aatttgaaatcta

SEQ ID NO: 5126709 - DNA, 22 bp, Homo sapiens
aatttgaacaggtcaaagatgt

SEQ ID NO: 5126710 - DNA, 12 bp, Homo sapiens
aatttgaacttt

SEQ ID NO: 5126711 - DNA, 18 bp, Homo sapiens
aatttgaagaattaatga

SEQ ID NO: 5126712 - DNA, 23 bp, Homo sapiens
aatttgaagaattaatgacaaca

SEQ ID NO: 5126713 - DNA, 17 bp, Homo sapiens
aatttgaagacttcaaa

SEQ ID NO: 5126714 - DNA, 14 bp, Homo sapiens
aatttgaagtaatg

SEQ ID NO: 5126715 - DNA, 19 bp, Homo sapiens
aatttgaataaactctccc

SEQ ID NO: 5126716 - DNA, 17 bp, Homo sapiens
aatttgaataagcagaa

SEQ ID NO: 5126717 - DNA, 17 bp, Homo sapiens
aatttgaataataaatc

SEQ ID NO: 5126718 - DNA, 12 bp, Homo sapiens
aatttgaatcag

SEQ ID NO: 5126719 - DNA, 12 bp, Homo sapiens
aatttgaatgaa

SEQ ID NO: 5126720 - DNA, 14 bp, Homo sapiens
aatttgaatggatt

SEQ ID NO: 5126721 - DNA, 16 bp, Homo sapiens
aatttgaattgggtcc

SEQ ID NO: 5126722 - DNA, 13 bp, Homo sapiens
aatttgaattttg

SEQ ID NO: 5126723 - DNA, 17 bp, Homo sapiens
aatttgactaattttac

SEQ ID NO: 5126724 - DNA, 15 bp, Homo sapiens
aatttgagaagaaat

SEQ ID NO: 5126725 - DNA, 15 bp, Homo sapiens
aatttgagactgaaa

SEQ ID NO: 5126726 - DNA, 18 bp, Homo sapiens
aatttgagagaaatatga

SEQ ID NO: 5126727 - DNA, 20 bp, Homo sapiens
aatttgagagaaatatgaag

SEQ ID NO: 5126728 - DNA, 17 bp, Homo sapiens
aatttgagatacaaaca

SEQ ID NO: 5126729 - DNA, 14 bp, Homo sapiens
aatttgagcaattc

SEQ ID NO: 5126730 - DNA, 19 bp, Homo sapiens
aatttgagcaattcatttc

SEQ ID NO: 5126731 - DNA, 21 bp, Homo sapiens
aatttgagcaattcatttcac

SEQ ID NO: 5126732 - DNA, 22 bp, Homo sapiens
aatttgagcaattcatttcact

SEQ ID NO: 5126733 - DNA, 17 bp, Homo sapiens
aatttgagccatttaaa

SEQ ID NO: 5126734 - DNA, 24 bp, Homo sapiens
aatttgagccatttaaagaccaat

SEQ ID NO: 5126735 - DNA, 14 bp, Homo sapiens
aatttgagcttgtg

SEQ ID NO: 5126736 - DNA, 18 bp, Homo sapiens
aatttgaggagggaatga

SEQ ID NO: 5126737 - DNA, 22 bp, Homo sapiens
aatttgaggtctacattcttgg

SEQ ID NO: 5126738 - DNA, 21 bp, Homo sapiens
aatttgaggtctagagagaac

SEQ ID NO: 5126739 - DNA, 19 bp, Homo sapiens
aatttgagtgtatatatat

SEQ ID NO: 5126740 - DNA, 20 bp, Homo sapiens
aatttgagttggatcatcta

SEQ ID NO: 5126741 - DNA, 17 bp, Homo sapiens
aatttgagtttgctgtt

SEQ ID NO: 5126742 - DNA, 20 bp, Homo sapiens
aatttgagtttgctgtttta

SEQ ID NO: 5126743 - DNA, 15 bp, Homo sapiens
aatttgataatgaca

SEQ ID NO: 5126744 - DNA, 17 bp, Homo sapiens
aatttgatacaaaatgc

SEQ ID NO: 5126745 - DNA, 18 bp, Homo sapiens
aatttgatacataataaa

SEQ ID NO: 5126746 - DNA, 13 bp, Homo sapiens
aatttgatactta

SEQ ID NO: 5126747 - DNA, 18 bp, Homo sapiens
aatttgatacttatattt

SEQ ID NO: 5126748 - DNA, 18 bp, Homo sapiens
aatttgatcgttccagtt

SEQ ID NO: 5126749 - DNA, 17 bp, Homo sapiens
aatttgatgatgttaaa

SEQ ID NO: 5126750 - DNA, 21 bp, Homo sapiens
aatttgatgatgttaaatgta

SEQ ID NO: 5126751 - DNA, 22 bp, Homo sapiens
aatttgatgcccagataatata

SEQ ID NO: 5126752 - DNA, 19 bp, Homo sapiens
aatttgatggtgaatatta

SEQ ID NO: 5126753 - DNA, 17 bp, Homo sapiens
aatttgattattaacat

SEQ ID NO: 5126754 - DNA, 15 bp, Homo sapiens
aatttgattctaaat

SEQ ID NO: 5126755 - DNA, 14 bp, Homo sapiens
aatttgattctatg

SEQ ID NO: 5126756 - DNA, 18 bp, Homo sapiens
aatttgattgctttgctg

SEQ ID NO: 5126757 - DNA, 10 bp, Homo sapiens
aatttgcaaa

SEQ ID NO: 5126758 - DNA, 13 bp, Homo sapiens
aatttgcaaagta

SEQ ID NO: 5126759 - DNA, 14 bp, Homo sapiens
aatttgcaaagtac

SEQ ID NO: 5126760 - DNA, 18 bp, Homo sapiens
aatttgcaaagtactgta

SEQ ID NO: 5126761 - DNA, 17 bp, Homo sapiens
aatttgcacacaaaaca

SEQ ID NO: 5126762 - DNA, 22 bp, Homo sapiens
aatttgcacatcttggctatgt

SEQ ID NO: 5126763 - DNA, 12 bp, Homo sapiens
aatttgcacatt

SEQ ID NO: 5126764 - DNA, 16 bp, Homo sapiens
aatttgcacattaaat

SEQ ID NO: 5126765 - DNA, 14 bp, Homo sapiens
aatttgcactgtta

SEQ ID NO: 5126766 - DNA, 16 bp, Homo sapiens
aatttgcactgtttaa

SEQ ID NO: 5126767 - DNA, 15 bp, Homo sapiens
aatttgcagcttcca

SEQ ID NO: 5126768 - DNA, 16 bp, Homo sapiens
aatttgcatattctat

SEQ ID NO: 5126769 - DNA, 17 bp, Homo sapiens
aatttgcatattctatt

SEQ ID NO: 5126770 - DNA, 21 bp, Homo sapiens
aatttgcatgaaagcacaagg

SEQ ID NO: 5126771 - DNA, 11 bp, Homo sapiens
aatttgcatgt

SEQ ID NO: 5126772 - DNA, 17 bp, Homo sapiens
aatttgcattaaattac

SEQ ID NO: 5126773 - DNA, 18 bp, Homo sapiens
aatttgcattaaattcac

SEQ ID NO: 5126774 - DNA, 21 bp, Homo sapiens
aatttgcattaaattcacaaa

SEQ ID NO: 5126775 - DNA, 13 bp, Homo sapiens
aatttgcattact

SEQ ID NO: 5126776 - DNA, 21 bp, Homo sapiens
aatttgcattactctggtgga

SEQ ID NO: 5126777 - DNA, 20 bp, Homo sapiens
aatttgccaaaataatgtct

SEQ ID NO: 5126778 - DNA, 17 bp, Homo sapiens
aatttgccagaggacca

SEQ ID NO: 5126779 - DNA, 16 bp, Homo sapiens
aatttgccagttttat

SEQ ID NO: 5126780 - DNA, 20 bp, Homo sapiens
aatttgccatgacatttcat

SEQ ID NO: 5126781 - DNA, 14 bp, Homo sapiens
aatttgccattggt

SEQ ID NO: 5126782 - DNA, 17 bp, Homo sapiens
aatttgcccctggcaaa

SEQ ID NO: 5126783 - DNA, 22 bp, Homo sapiens
aatttgcccctggcaaatgcac

SEQ ID NO: 5126784 - DNA, 14 bp, Homo sapiens
aatttgcctctgtc

SEQ ID NO: 5126785 - DNA, 23 bp, Homo sapiens
aatttgctctgtggtaagagata

SEQ ID NO: 5126786 - DNA, 16 bp, Homo sapiens
aatttgctgaaaacat

SEQ ID NO: 5126787 - DNA, 22 bp, Homo sapiens
aatttgctgaaaacattacatg

SEQ ID NO: 5126788 - DNA, 12 bp, Homo sapiens
aatttgctgctg

SEQ ID NO: 5126789 - DNA, 13 bp, Homo sapiens
aatttgctgctga

SEQ ID NO: 5126790 - DNA, 22 bp, Homo sapiens
aatttgctggaacacaaagacc

SEQ ID NO: 5126791 - DNA, 13 bp, Homo sapiens
aatttgctttaat

SEQ ID NO: 5126792 - DNA, 15 bp, Homo sapiens
aatttgctttacata

SEQ ID NO: 5126793 - DNA, 9 bp, Homo sapiens
aatttggaa

SEQ ID NO: 5126794 - DNA, 17 bp, Homo sapiens
aatttggaagaaaacta

SEQ ID NO: 5126795 - DNA, 15 bp, Homo sapiens
aatttggaattctgt

SEQ ID NO: 5126796 - DNA, 19 bp, Homo sapiens
aatttggaccattttcctg

SEQ ID NO: 5126797 - DNA, 18 bp, Homo sapiens
aatttggagcacaaaatt

SEQ ID NO: 5126798 - DNA, 20 bp, Homo sapiens
aatttggagcacaaaattca

SEQ ID NO: 5126799 - DNA, 21 bp, Homo sapiens
aatttggataataaaaattgt

SEQ ID NO: 5126800 - DNA, 23 bp, Homo sapiens
aatttggataataaaaattgtag

SEQ ID NO: 5126801 - DNA, 13 bp, Homo sapiens
aatttggcaattt

SEQ ID NO: 5126802 - DNA, 18 bp, Homo sapiens
aatttggcaattttgtgg

SEQ ID NO: 5126803 - DNA, 15 bp, Homo sapiens
aatttggccatgaaa

SEQ ID NO: 5126804 - DNA, 16 bp, Homo sapiens
aatttggccatgaaag

SEQ ID NO: 5126805 - DNA, 15 bp, Homo sapiens
aatttggctttcaca

SEQ ID NO: 5126806 - DNA, 16 bp, Homo sapiens
aatttgggaacataaa

SEQ ID NO: 5126807 - DNA, 22 bp, Homo sapiens
aatttgggaaggtttgtgtttt

SEQ ID NO: 5126808 - DNA, 21 bp, Homo sapiens
aatttgggagaagcaaatata

SEQ ID NO: 5126809 - DNA, 22 bp, Homo sapiens
aatttgggagaagcaaatatag

SEQ ID NO: 5126810 - DNA, 19 bp, Homo sapiens
aatttgggatactaaagta

SEQ ID NO: 5126811 - DNA, 14 bp, Homo sapiens
aatttgggatgctg

SEQ ID NO: 5126812 - DNA, 15 bp, Homo sapiens
aatttgggcatctct

SEQ ID NO: 5126813 - DNA, 23 bp, Homo sapiens
aatttgggctaaaacttagaaaa

SEQ ID NO: 5126814 - DNA, 22 bp, Homo sapiens
aatttggggacagattcagtct

SEQ ID NO: 5126815 - DNA, 24 bp, Homo sapiens
aatttggggacagattcagtcttg

SEQ ID NO: 5126816 - DNA, 18 bp, Homo sapiens
aatttgggggaaaattta

SEQ ID NO: 5126817 - DNA, 15 bp, Homo sapiens
aatttgggtttttaa

SEQ ID NO: 5126818 - DNA, 15 bp, Homo sapiens
aatttggtacacatg

SEQ ID NO: 5126819 - DNA, 16 bp, Homo sapiens
aatttggtacacatgt

SEQ ID NO: 5126820 - DNA, 23 bp, Homo sapiens
aatttggtacacatgtgttatct

SEQ ID NO: 5126821 - DNA, 19 bp, Homo sapiens
aatttggtgtggctgtatt

SEQ ID NO: 5126822 - DNA, 16 bp, Homo sapiens
aatttggttctaatag

SEQ ID NO: 5126823 - DNA, 22 bp, Homo sapiens
aatttggttctaatagaactca

SEQ ID NO: 5126824 - DNA, 17 bp, Homo sapiens
aatttggttctaggccg

SEQ ID NO: 5126825 - DNA, 19 bp, Homo sapiens
aatttggtttaaaaataca

SEQ ID NO: 5126826 - DNA, 16 bp, Homo sapiens
aatttggtttgttaat

SEQ ID NO: 5126827 - DNA, 17 bp, Homo sapiens
aatttggtttgttaatt

SEQ ID NO: 5126828 - DNA, 21 bp, Homo sapiens
aatttggttttcacattggaa

SEQ ID NO: 5126829 - DNA, 15 bp, Homo sapiens
aatttggtttttact

SEQ ID NO: 5126830 - DNA, 22 bp, Homo sapiens
aatttggtttttactcaaccaa

SEQ ID NO: 5126831 - DNA, 22 bp, Homo sapiens
aatttgtaaaaacagcattgct

SEQ ID NO: 5126832 - DNA, 17 bp, Homo sapiens
aatttgtaaaacttctg

SEQ ID NO: 5126833 - DNA, 19 bp, Homo sapiens
aatttgtaaaacttctgct

SEQ ID NO: 5126834 - DNA, 12 bp, Homo sapiens
aatttgtaaact

SEQ ID NO: 5126835 - DNA, 16 bp, Homo sapiens
aatttgtaaacttctg

SEQ ID NO: 5126836 - DNA, 13 bp, Homo sapiens
aatttgtaaatga

SEQ ID NO: 5126837 - DNA, 15 bp, Homo sapiens
aatttgtaaatgatt

SEQ ID NO: 5126838 - DNA, 13 bp, Homo sapiens
aatttgtaatata

SEQ ID NO: 5126839 - DNA, 23 bp, Homo sapiens
aatttgtaatatatcctgtttgt

SEQ ID NO: 5126840 - DNA, 13 bp, Homo sapiens
aatttgtacaatg

SEQ ID NO: 5126841 - DNA, 19 bp, Homo sapiens
aatttgtacaatggtttat

SEQ ID NO: 5126842 - DNA, 12 bp, Homo sapiens
aatttgtacttc

SEQ ID NO: 5126843 - DNA, 15 bp, Homo sapiens
aatttgtataaaatg

SEQ ID NO: 5126844 - DNA, 21 bp, Homo sapiens
aatttgtatcatgttttacta

SEQ ID NO: 5126845 - DNA, 12 bp, Homo sapiens
aatttgtatctg

SEQ ID NO: 5126846 - DNA, 20 bp, Homo sapiens
aatttgtatctgaaggagat

SEQ ID NO: 5126847 - DNA, 15 bp, Homo sapiens
aatttgtattaaaaa

SEQ ID NO: 5126848 - DNA, 19 bp, Homo sapiens
aatttgtattaaaaagcct

SEQ ID NO: 5126849 - DNA, 12 bp, Homo sapiens
aatttgtatttt

SEQ ID NO: 5126850 - DNA, 14 bp, Homo sapiens
aatttgtcactgga

SEQ ID NO: 5126851 - DNA, 16 bp, Homo sapiens
aatttgtcagcgttct

SEQ ID NO: 5126852 - DNA, 20 bp, Homo sapiens
aatttgtcatgttactaaat

SEQ ID NO: 5126853 - DNA, 16 bp, Homo sapiens
aatttgtcattttgaa

SEQ ID NO: 5126854 - DNA, 19 bp, Homo sapiens
aatttgtcattttgaagct

SEQ ID NO: 5126855 - DNA, 22 bp, Homo sapiens
aatttgtccaatggctgtaaac

SEQ ID NO: 5126856 - DNA, 20 bp, Homo sapiens
aatttgtccatttaaaaatg

SEQ ID NO: 5126857 - DNA, 21 bp, Homo sapiens
aatttgtccatttaaaaatga

SEQ ID NO: 5126858 - DNA, 20 bp, Homo sapiens
aatttgtcgggttctcccat

SEQ ID NO: 5126859 - DNA, 13 bp, Homo sapiens
aatttgtctccta

SEQ ID NO: 5126860 - DNA, 13 bp, Homo sapiens
aatttgtcttaaa

SEQ ID NO: 5126861 - DNA, 20 bp, Homo sapiens
aatttgtcttaaaaatttat

SEQ ID NO: 5126862 - DNA, 12 bp, Homo sapiens
aatttgtctttc

SEQ ID NO: 5126863 - DNA, 18 bp, Homo sapiens
aatttgtctttttgtata

SEQ ID NO: 5126864 - DNA, 19 bp, Homo sapiens
aatttgtgaactgtcatga

SEQ ID NO: 5126865 - DNA, 12 bp, Homo sapiens
aatttgtgaatt

SEQ ID NO: 5126866 - DNA, 20 bp, Homo sapiens
aatttgtgatacaatgctgt

SEQ ID NO: 5126867 - DNA, 19 bp, Homo sapiens
aatttgtggtaaagtagtt

SEQ ID NO: 5126868 - DNA, 14 bp, Homo sapiens
aatttgtggtgatt

SEQ ID NO: 5126869 - DNA, 18 bp, Homo sapiens
aatttgtggttgtagaag

SEQ ID NO: 5126870 - DNA, 14 bp, Homo sapiens
aatttgtgtaaatt

SEQ ID NO: 5126871 - DNA, 19 bp, Homo sapiens
aatttgtgtaataaagtgt

SEQ ID NO: 5126872 - DNA, 15 bp, Homo sapiens
aatttgtgtgcttca

SEQ ID NO: 5126873 - DNA, 14 bp, Homo sapiens
aatttgtgtggata

SEQ ID NO: 5126874 - DNA, 14 bp, Homo sapiens
aatttgtgtgtttt

SEQ ID NO: 5126875 - DNA, 23 bp, Homo sapiens
aatttgtgtgtttttagctgtga

SEQ ID NO: 5126876 - DNA, 14 bp, Homo sapiens
aatttgttaatata

SEQ ID NO: 5126877 - DNA, 14 bp, Homo sapiens
aatttgttaattcc

SEQ ID NO: 5126878 - DNA, 15 bp, Homo sapiens
aatttgttcttgtat

SEQ ID NO: 5126879 - DNA, 18 bp, Homo sapiens
aatttgttgaaattatgt

SEQ ID NO: 5126880 - DNA, 12 bp, Homo sapiens
aatttgttgcat

SEQ ID NO: 5126881 - DNA, 18 bp, Homo sapiens
aatttgtttaaaattctc

SEQ ID NO: 5126882 - DNA, 23 bp, Homo sapiens
aatttgtttaatctacattataa

SEQ ID NO: 5126883 - DNA, 17 bp, Homo sapiens
aatttgtttaattaaat

SEQ ID NO: 5126884 - DNA, 22 bp, Homo sapiens
aatttgtttacttgtaaattga

SEQ ID NO: 5126885 - DNA, 21 bp, Homo sapiens
aatttgtttagaagtacgttt

SEQ ID NO: 5126886 - DNA, 15 bp, Homo sapiens
aatttgtttcatcta

SEQ ID NO: 5126887 - DNA, 17 bp, Homo sapiens
aatttgtttgtattttt

SEQ ID NO: 5126888 - DNA, 16 bp, Homo sapiens
aatttgttttagccat

SEQ ID NO: 5126889 - DNA, 17 bp, Homo sapiens
aatttgttttagccatt

SEQ ID NO: 5126890 - DNA, 14 bp, Homo sapiens
aatttgttttcatt

SEQ ID NO: 5126891 - DNA, 17 bp, Homo sapiens
aatttgtttttcttatc

SEQ ID NO: 5126892 - DNA, 16 bp, Homo sapiens
aatttgtttttgcatt

SEQ ID NO: 5126893 - DNA, 17 bp, Homo sapiens
aatttgtttttgcattt

SEQ ID NO: 5126894 - DNA, 14 bp, Homo sapiens
aattttaaaaaata

SEQ ID NO: 5126895 - DNA, 18 bp, Homo sapiens
aattttaaaaaataacat

SEQ ID NO: 5126896 - DNA, 20 bp, Homo sapiens
aattttaaaaaataacatat

SEQ ID NO: 5126897 - DNA, 17 bp, Homo sapiens
aattttaaaaatgaatc

SEQ ID NO: 5126898 - DNA, 21 bp, Homo sapiens
aattttaaaacatgctgttta

SEQ ID NO: 5126899 - DNA, 14 bp, Homo sapiens
aattttaaaagtca

SEQ ID NO: 5126900 - DNA, 20 bp, Homo sapiens
aattttaaaagttgggaaaa

SEQ ID NO: 5126901 - DNA, 22 bp, Homo sapiens
aattttaaaatctgagggaaat

SEQ ID NO: 5126902 - DNA, 13 bp, Homo sapiens
aattttaaaattg

SEQ ID NO: 5126903 - DNA, 16 bp, Homo sapiens
acaagtgtaatgaata

SEQ ID NO: 5126904 - DNA, 21 bp, Homo sapiens
acaagtgtaggccaccattat

SEQ ID NO: 5126905 - DNA, 12 bp, Homo sapiens
acaagtgtctaa

SEQ ID NO: 5126906 - DNA, 20 bp, Homo sapiens
acaagtgtgtggccccgccc

SEQ ID NO: 5126907 - DNA, 21 bp, Homo sapiens
acaagtgttcttaggtttact

SEQ ID NO: 5126908 - DNA, 19 bp, Homo sapiens
acaagtgttttagatgtta

SEQ ID NO: 5126909 - DNA, 22 bp, Homo sapiens
acaagtgttttagatgttacta

SEQ ID NO: 5126910 - DNA, 19 bp, Homo sapiens
acaagttaagattcttggt

SEQ ID NO: 5126911 - DNA, 20 bp, Homo sapiens
acaagttaaggtatctggta

SEQ ID NO: 5126912 - DNA, 11 bp, Homo sapiens
acaagttatta

SEQ ID NO: 5126913 - DNA, 16 bp, Homo sapiens
acaagttatttaaatc

SEQ ID NO: 5126914 - DNA, 20 bp, Homo sapiens
acaagttccaacatgcaata

SEQ ID NO: 5126915 - DNA, 16 bp, Homo sapiens
acaagttccagctggt

SEQ ID NO: 5126916 - DNA, 20 bp, Homo sapiens
acaagttccattatgaaaat

SEQ ID NO: 5126917 - DNA, 22 bp, Homo sapiens
acaagttccattatgaaaatct

SEQ ID NO: 5126918 - DNA, 17 bp, Homo sapiens
acaagttccctggagaa

SEQ ID NO: 5126919 - DNA, 17 bp, Homo sapiens
acaagttctttttaaaa

SEQ ID NO: 5126920 - DNA, 11 bp, Homo sapiens
acaagttgcct

SEQ ID NO: 5126921 - DNA, 16 bp, Homo sapiens
acaagttgctttgtta

SEQ ID NO: 5126922 - DNA, 18 bp, Homo sapiens
acaagttgcttttacctg

SEQ ID NO: 5126923 - DNA, 17 bp, Homo sapiens
acaagttggagtcactc

SEQ ID NO: 5126924 - DNA, 19 bp, Homo sapiens
acaagttggctagaagaaa

SEQ ID NO: 5126925 - DNA, 23 bp, Homo sapiens
acaagttggctagaagaaagtaa

SEQ ID NO: 5126926 - DNA, 15 bp, Homo sapiens
acaagttgtgtttga

SEQ ID NO: 5126927 - DNA, 16 bp, Homo sapiens
acaagttgttaaaaca

SEQ ID NO: 5126928 - DNA, 17 bp, Homo sapiens
acaagttgttaaaacat

SEQ ID NO: 5126929 - DNA, 13 bp, Homo sapiens
acaagttgttatt

SEQ ID NO: 5126930 - DNA, 14 bp, Homo sapiens
acaagtttaaaaat

SEQ ID NO: 5126931 - DNA, 16 bp, Homo sapiens
acaagtttatatatat

SEQ ID NO: 5126932 - DNA, 13 bp, Homo sapiens
acaagtttcagac

SEQ ID NO: 5126933 - DNA, 16 bp, Homo sapiens
acaagtttcagacagg

SEQ ID NO: 5126934 - DNA, 12 bp, Homo sapiens
acaagtttcagt

SEQ ID NO: 5126935 - DNA, 13 bp, Homo sapiens
acaagtttcagta

SEQ ID NO: 5126936 - DNA, 20 bp, Homo sapiens
acaagtttcagtaatagctg

SEQ ID NO: 5126937 - DNA, 14 bp, Homo sapiens
acaagtttgctaaa

SEQ ID NO: 5126938 - DNA, 21 bp, Homo sapiens
acaagtttgctaaaagaagag

SEQ ID NO: 5126939 - DNA, 14 bp, Homo sapiens
acaagttttagaaa

SEQ ID NO: 5126940 - DNA, 21 bp, Homo sapiens
acaagttttcataagcacact

SEQ ID NO: 5126941 - DNA, 16 bp, Homo sapiens
acaagttttggcagcc

SEQ ID NO: 5126942 - DNA, 16 bp, Homo sapiens
acaagtttttctgtca

SEQ ID NO: 5126943 - DNA, 17 bp, Homo sapiens
acaagtttttttgttca

SEQ ID NO: 5126944 - DNA, 18 bp, Homo sapiens
acaataaaaacaactttc

SEQ ID NO: 5126945 - DNA, 21 bp, Homo sapiens
acaataaaaacaactttcact

SEQ ID NO: 5126946 - DNA, 23 bp, Homo sapiens
acaataaaaaccaaactctgtgt

SEQ ID NO: 5126947 - DNA, 18 bp, Homo sapiens
acaataaaacaaataaat

SEQ ID NO: 5126948 - DNA, 13 bp, Homo sapiens
acaataaaacatt

SEQ ID NO: 5126949 - DNA, 15 bp, Homo sapiens
acaataaaacattat

SEQ ID NO: 5126950 - DNA, 14 bp, Homo sapiens
acaataaaacattc

SEQ ID NO: 5126951 - DNA, 15 bp, Homo sapiens
acaataaaagagctt

SEQ ID NO: 5126952 - DNA, 16 bp, Homo sapiens
acaataaaagagcttt

SEQ ID NO: 5126953 - DNA, 15 bp, Homo sapiens
acaataaaatattat

SEQ ID NO: 5126954 - DNA, 20 bp, Homo sapiens
acaataaaattttttttcat

SEQ ID NO: 5126955 - DNA, 21 bp, Homo sapiens
acaataaaattttttttcatg

SEQ ID NO: 5126956 - DNA, 23 bp, Homo sapiens
acaataaaattttttttcatgtt

SEQ ID NO: 5126957 - DNA, 13 bp, Homo sapiens
acaataaacagct

SEQ ID NO: 5126958 - DNA, 20 bp, Homo sapiens
acaataaaccaaacccagcc

SEQ ID NO: 5126959 - DNA, 12 bp, Homo sapiens
acaataaacctc

SEQ ID NO: 5126960 - DNA, 12 bp, Homo sapiens
acaataaactgg

SEQ ID NO: 5126961 - DNA, 17 bp, Homo sapiens
acaataaagatacatga

SEQ ID NO: 5126962 - DNA, 21 bp, Homo sapiens
acaataaagcagtcctgttca

SEQ ID NO: 5126963 - DNA, 19 bp, Homo sapiens
acaataaagcattttgcaa

SEQ ID NO: 5126964 - DNA, 19 bp, Homo sapiens
acaataaagggagaatggt

SEQ ID NO: 5126965 - DNA, 23 bp, Homo sapiens
acaataaagggagaatggtgctg

SEQ ID NO: 5126966 - DNA, 13 bp, Homo sapiens
acaataaagtgta

SEQ ID NO: 5126967 - DNA, 17 bp, Homo sapiens
acaataaagtttattat

SEQ ID NO: 5126968 - DNA, 18 bp, Homo sapiens
acaataaagtttgctttc

SEQ ID NO: 5126969 - DNA, 13 bp, Homo sapiens
acaataaatagac

SEQ ID NO: 5126970 - DNA, 14 bp, Homo sapiens
acaataaatatact

SEQ ID NO: 5126971 - DNA, 16 bp, Homo sapiens
acaataaatattctgc

SEQ ID NO: 5126972 - DNA, 15 bp, Homo sapiens
acaataaatgaatga

SEQ ID NO: 5126973 - DNA, 11 bp, Homo sapiens
acaataaatgc

SEQ ID NO: 5126974 - DNA, 12 bp, Homo sapiens
acaataaatggc

SEQ ID NO: 5126975 - DNA, 23 bp, Homo sapiens
acaataaatggccagtgctgctt

SEQ ID NO: 5126976 - DNA, 16 bp, Homo sapiens
acaataaatgtattca

SEQ ID NO: 5126977 - DNA, 18 bp, Homo sapiens
acaataaatgtattcaaa

SEQ ID NO: 5126978 - DNA, 15 bp, Homo sapiens
acaataacaacaatg

SEQ ID NO: 5126979 - DNA, 17 bp, Homo sapiens
acaataactactgtgtt

SEQ ID NO: 5126980 - DNA, 15 bp, Homo sapiens
acaataactcctccc

SEQ ID NO: 5126981 - DNA, 14 bp, Homo sapiens
acaataacttctta

SEQ ID NO: 5126982 - DNA, 16 bp, Homo sapiens
acaataagaacaagtt

SEQ ID NO: 5126983 - DNA, 16 bp, Homo sapiens
acaataagaatgaatc

SEQ ID NO: 5126984 - DNA, 18 bp, Homo sapiens
acaataagagtctccttc

SEQ ID NO: 5126985 - DNA, 16 bp, Homo sapiens
acaataagcaaaaaca

SEQ ID NO: 5126986 - DNA, 21 bp, Homo sapiens
acaataagcagaggtggaaaa

SEQ ID NO: 5126987 - DNA, 21 bp, Homo sapiens
acaataagcgttaagggcaga

SEQ ID NO: 5126988 - DNA, 14 bp, Homo sapiens
acaataaggaagga

SEQ ID NO: 5126989 - DNA, 22 bp, Homo sapiens
acaataagtaaatccacaggct

SEQ ID NO: 5126990 - DNA, 12 bp, Homo sapiens
acaataataaaa

SEQ ID NO: 5126991 - DNA, 15 bp, Homo sapiens
acaataataaaaagt

SEQ ID NO: 5126992 - DNA, 14 bp, Homo sapiens
acaataataaagat

SEQ ID NO: 5126993 - DNA, 18 bp, Homo sapiens
acaataataaatcctcag

SEQ ID NO: 5126994 - DNA, 13 bp, Homo sapiens
acaataataaatg

SEQ ID NO: 5126995 - DNA, 18 bp, Homo sapiens
acaataatattgttgtat

SEQ ID NO: 5126996 - DNA, 23 bp, Homo sapiens
acaataatattgttgtataattt

SEQ ID NO: 5126997 - DNA, 13 bp, Homo sapiens
acaataatatttc

SEQ ID NO: 5126998 - DNA, 15 bp, Homo sapiens
acaataatatttcaa

SEQ ID NO: 5126999 - DNA, 19 bp, Homo sapiens
acaataatctctatttgag

SEQ ID NO: 5127000 - DNA, 17 bp, Homo sapiens
acaataatgagttcact

SEQ ID NO: 5127001 - DNA, 12 bp, Homo sapiens
acaataatgcaa

SEQ ID NO: 5127002 - DNA, 22 bp, Homo sapiens
acaataatgtaatttagtctaa

SEQ ID NO: 5127003 - DNA, 17 bp, Homo sapiens
acaataatgtactcaca

SEQ ID NO: 5127004 - DNA, 19 bp, Homo sapiens
acaataatttgttttcatt

SEQ ID NO: 5127005 - DNA, 14 bp, Homo sapiens
acaataattttcta

SEQ ID NO: 5127006 - DNA, 12 bp, Homo sapiens
acaatacaaatg

SEQ ID NO: 5127007 - DNA, 14 bp, Homo sapiens
acaatacaaatgga

SEQ ID NO: 5127008 - DNA, 13 bp, Homo sapiens
acaatacaatgta

SEQ ID NO: 5127009 - DNA, 14 bp, Homo sapiens
acaatacaatgtac

SEQ ID NO: 5127010 - DNA, 22 bp, Homo sapiens
acaatacaatgtacaattatgt

SEQ ID NO: 5127011 - DNA, 18 bp, Homo sapiens
acaatacagtattataga

SEQ ID NO: 5127012 - DNA, 18 bp, Homo sapiens
acaatacatgttttcact

SEQ ID NO: 5127013 - DNA, 20 bp, Homo sapiens
acaataccagaagtgaatta

SEQ ID NO: 5127014 - DNA, 14 bp, Homo sapiens
acaataccttattt

SEQ ID NO: 5127015 - DNA, 18 bp, Homo sapiens
acaatactaaataaacat

SEQ ID NO: 5127016 - DNA, 18 bp, Homo sapiens
acaatactcataatgtga

SEQ ID NO: 5127017 - DNA, 21 bp, Homo sapiens
acaatactcataatgtgaagt

SEQ ID NO: 5127018 - DNA, 19 bp, Homo sapiens
acaatactccctttaaaga

SEQ ID NO: 5127019 - DNA, 14 bp, Homo sapiens
acaatactgttcta

SEQ ID NO: 5127020 - DNA, 21 bp, Homo sapiens
acaatacttgcattccagagt

SEQ ID NO: 5127021 - DNA, 15 bp, Homo sapiens
acaatagacagaaac

SEQ ID NO: 5127022 - DNA, 17 bp, Homo sapiens
acaatagacagaaacag

SEQ ID NO: 5127023 - DNA, 19 bp, Homo sapiens
acaatagccgatatcagaa

SEQ ID NO: 5127024 - DNA, 12 bp, Homo sapiens
acaatagctatt

SEQ ID NO: 5127025 - DNA, 17 bp, Homo sapiens
acaatagctattgcatg

SEQ ID NO: 5127026 - DNA, 20 bp, Homo sapiens
acaatagctattgcatgtaa

SEQ ID NO: 5127027 - DNA, 19 bp, Homo sapiens
acaatagctttaccctcag

SEQ ID NO: 5127028 - DNA, 23 bp, Homo sapiens
acaataggagtggtgatttgaaa

SEQ ID NO: 5127029 - DNA, 19 bp, Homo sapiens
acaatagggctaaatgttt

SEQ ID NO: 5127030 - DNA, 22 bp, Homo sapiens
acaatagggctgataatgtaat

SEQ ID NO: 5127031 - DNA, 13 bp, Homo sapiens
acaataggtcttt

SEQ ID NO: 5127032 - DNA, 18 bp, Homo sapiens
acaataggtctttctctc

SEQ ID NO: 5127033 - DNA, 18 bp, Homo sapiens
acaataggtgcttattct

SEQ ID NO: 5127034 - DNA, 16 bp, Homo sapiens
acaatagtatacattt

SEQ ID NO: 5127035 - DNA, 17 bp, Homo sapiens
acaatagtatacatttt

SEQ ID NO: 5127036 - DNA, 14 bp, Homo sapiens
acaatagtatttct

SEQ ID NO: 5127037 - DNA, 18 bp, Homo sapiens
acaatagtatttctcctt

SEQ ID NO: 5127038 - DNA, 24 bp, Homo sapiens
acaatagtatttctcctttgcaat

SEQ ID NO: 5127039 - DNA, 18 bp, Homo sapiens
acaatagtttttaaaaga

SEQ ID NO: 5127040 - DNA, 21 bp, Homo sapiens
acaatataagagcttccaatt

SEQ ID NO: 5127041 - DNA, 10 bp, Homo sapiens
acaatatata

SEQ ID NO: 5127042 - DNA, 15 bp, Homo sapiens
acaatatataaaaat

SEQ ID NO: 5127043 - DNA, 18 bp, Homo sapiens
acaatatataaaaatata

SEQ ID NO: 5127044 - DNA, 18 bp, Homo sapiens
acaatatatagaattgta

SEQ ID NO: 5127045 - DNA, 21 bp, Homo sapiens
acaatatatattatatatatc

SEQ ID NO: 5127046 - DNA, 19 bp, Homo sapiens
acaatatatgatatataaa

SEQ ID NO: 5127047 - DNA, 15 bp, Homo sapiens
acaatatcatatcat

SEQ ID NO: 5127048 - DNA, 17 bp, Homo sapiens
acaatatcattttcctg

SEQ ID NO: 5127049 - DNA, 20 bp, Homo sapiens
acaatatcattttcctggga

SEQ ID NO: 5127050 - DNA, 19 bp, Homo sapiens
acaatatccaatgaagaag

SEQ ID NO: 5127051 - DNA, 15 bp, Homo sapiens
acaatatgaaaagga

SEQ ID NO: 5127052 - DNA, 15 bp, Homo sapiens
acaatatgaatacag

SEQ ID NO: 5127053 - DNA, 19 bp, Homo sapiens
acaatatgagtaatgttta

SEQ ID NO: 5127054 - DNA, 22 bp, Homo sapiens
acaatatgagtaatgtttaaga

SEQ ID NO: 5127055 - DNA, 20 bp, Homo sapiens
acaatatgattgcactaaat

SEQ ID NO: 5127056 - DNA, 17 bp, Homo sapiens
acaatatgattttaaat

SEQ ID NO: 5127057 - DNA, 17 bp, Homo sapiens
acaatatgtacatttct

SEQ ID NO: 5127058 - DNA, 16 bp, Homo sapiens
acaatatgtatgcttt

SEQ ID NO: 5127059 - DNA, 22 bp, Homo sapiens
acaatatgtatgctttttacct

SEQ ID NO: 5127060 - DNA, 14 bp, Homo sapiens
acaatatgtgagtg

SEQ ID NO: 5127061 - DNA, 21 bp, Homo sapiens
acaatatgtgttttttaatat

SEQ ID NO: 5127062 - DNA, 15 bp, Homo sapiens
acaatatgttagatt

SEQ ID NO: 5127063 - DNA, 20 bp, Homo sapiens
acaatattaattataataaa

SEQ ID NO: 5127064 - DNA, 21 bp, Homo sapiens
acaatattaattataataaag

SEQ ID NO: 5127065 - DNA, 15 bp, Homo sapiens
acaatattatgaaat

SEQ ID NO: 5127066 - DNA, 12 bp, Homo sapiens
acaatattatgt

SEQ ID NO: 5127067 - DNA, 19 bp, Homo sapiens
acaatattcagtggtgaaa

SEQ ID NO: 5127068 - DNA, 23 bp, Homo sapiens
acaatattcagtggtgaaatctt

SEQ ID NO: 5127069 - DNA, 18 bp, Homo sapiens
acaatattgattgggaaa

SEQ ID NO: 5127070 - DNA, 23 bp, Homo sapiens
acaatattgtatactaccatagt

SEQ ID NO: 5127071 - DNA, 16 bp, Homo sapiens
acaatatttaaaattt

SEQ ID NO: 5127072 - DNA, 16 bp, Homo sapiens
acaatatttcttttgt

SEQ ID NO: 5127073 - DNA, 18 bp, Homo sapiens
acaatatttgtgtgctaa

SEQ ID NO: 5127074 - DNA, 18 bp, Homo sapiens
acaatattttaagcatta

SEQ ID NO: 5127075 - DNA, 12 bp, Homo sapiens
acaatattttat

SEQ ID NO: 5127076 - DNA, 16 bp, Homo sapiens
acaatcaaaacacact

SEQ ID NO: 5127077 - DNA, 14 bp, Homo sapiens
acaatcaaaggaaa

SEQ ID NO: 5127078 - DNA, 19 bp, Homo sapiens
acaatcaaaggaaaatagt

SEQ ID NO: 5127079 - DNA, 13 bp, Homo sapiens
acaatcaaatctc

SEQ ID NO: 5127080 - DNA, 21 bp, Homo sapiens
acaatcaaatctcctgctgat

SEQ ID NO: 5127081 - DNA, 12 bp, Homo sapiens
acaatcacactc

SEQ ID NO: 5127082 - DNA, 23 bp, Homo sapiens
acaatcactaaatatctagtgct

SEQ ID NO: 5127083 - DNA, 15 bp, Homo sapiens
aattttaaaattgca

SEQ ID NO: 5127084 - DNA, 21 bp, Homo sapiens
aattttaaaattggtatattt

SEQ ID NO: 5127085 - DNA, 13 bp, Homo sapiens
aattttaaagcaa

SEQ ID NO: 5127086 - DNA, 13 bp, Homo sapiens
aattttaaagcca

SEQ ID NO: 5127087 - DNA, 15 bp, Homo sapiens
aattttaaagccatt

SEQ ID NO: 5127088 - DNA, 19 bp, Homo sapiens
aattttaaagcctgaaaat

SEQ ID NO: 5127089 - DNA, 13 bp, Homo sapiens
aattttaaagtat

SEQ ID NO: 5127090 - DNA, 16 bp, Homo sapiens
aattttaaagtatgca

SEQ ID NO: 5127091 - DNA, 19 bp, Homo sapiens
aattttaaagtcagtgttg

SEQ ID NO: 5127092 - DNA, 13 bp, Homo sapiens
aattttaaagttc

SEQ ID NO: 5127093 - DNA, 15 bp, Homo sapiens
aattttaaagttctt

SEQ ID NO: 5127094 - DNA, 12 bp, Homo sapiens
aattttaaataa

SEQ ID NO: 5127095 - DNA, 17 bp, Homo sapiens
aattttaaataaaagtg

SEQ ID NO: 5127096 - DNA, 19 bp, Homo sapiens
aattttaaataatgtattt

SEQ ID NO: 5127097 - DNA, 23 bp, Homo sapiens
aattttaaataatgtatttactt

SEQ ID NO: 5127098 - DNA, 13 bp, Homo sapiens
aattttaaatgca

SEQ ID NO: 5127099 - DNA, 12 bp, Homo sapiens
aattttaaatta

SEQ ID NO: 5127100 - DNA, 22 bp, Homo sapiens
aattttaacaaacgcattaaga

SEQ ID NO: 5127101 - DNA, 23 bp, Homo sapiens
aattttaacaaacgcattaagag

SEQ ID NO: 5127102 - DNA, 14 bp, Homo sapiens
aattttaacacaca

SEQ ID NO: 5127103 - DNA, 16 bp, Homo sapiens
aattttaacatttgat

SEQ ID NO: 5127104 - DNA, 14 bp, Homo sapiens
aattttaacatttt

SEQ ID NO: 5127105 - DNA, 20 bp, Homo sapiens
aattttaacttttgggattt

SEQ ID NO: 5127106 - DNA, 18 bp, Homo sapiens
aattttaagattcctttt

SEQ ID NO: 5127107 - DNA, 12 bp, Homo sapiens
aattttaagtgc

SEQ ID NO: 5127108 - DNA, 19 bp, Homo sapiens
aattttaagtgctttgtaa

SEQ ID NO: 5127109 - DNA, 15 bp, Homo sapiens
aattttaatcccctg

SEQ ID NO: 5127110 - DNA, 23 bp, Homo sapiens
aattttaatgatggtgttaaagc

SEQ ID NO: 5127111 - DNA, 18 bp, Homo sapiens
aattttaatgctgtttct

SEQ ID NO: 5127112 - DNA, 20 bp, Homo sapiens
aattttaatgctgtttctaa

SEQ ID NO: 5127113 - DNA, 13 bp, Homo sapiens
aattttaatgtga

SEQ ID NO: 5127114 - DNA, 16 bp, Homo sapiens
aattttaatgttaact

SEQ ID NO: 5127115 - DNA, 22 bp, Homo sapiens
aattttaattcaagaaatgaca

SEQ ID NO: 5127116 - DNA, 16 bp, Homo sapiens
aattttaatttctaca

SEQ ID NO: 5127117 - DNA, 20 bp, Homo sapiens
aattttacacgcttttgtga

SEQ ID NO: 5127118 - DNA, 21 bp, Homo sapiens
aattttacactctgtattgaa

SEQ ID NO: 5127119 - DNA, 16 bp, Homo sapiens
aattttacagcccttg

SEQ ID NO: 5127120 - DNA, 16 bp, Homo sapiens
aattttacatgacaga

SEQ ID NO: 5127121 - DNA, 20 bp, Homo sapiens
aattttacatggctggagct

SEQ ID NO: 5127122 - DNA, 21 bp, Homo sapiens
aattttacatgtctcatattt

SEQ ID NO: 5127123 - DNA, 14 bp, Homo sapiens
aattttaccaagtt

SEQ ID NO: 5127124 - DNA, 13 bp, Homo sapiens
aattttactgtga

SEQ ID NO: 5127125 - DNA, 16 bp, Homo sapiens
aattttactgtgaaaa

SEQ ID NO: 5127126 - DNA, 17 bp, Homo sapiens
aattttagaaagaaaat

SEQ ID NO: 5127127 - DNA, 23 bp, Homo sapiens
aattttagaaagaaaattatatt

SEQ ID NO: 5127128 - DNA, 16 bp, Homo sapiens
aattttagagaaactt

SEQ ID NO: 5127129 - DNA, 15 bp, Homo sapiens
aattttagcttttgt

SEQ ID NO: 5127130 - DNA, 23 bp, Homo sapiens
aattttaggcactcttaaatgat

SEQ ID NO: 5127131 - DNA, 18 bp, Homo sapiens
aattttagtaatttccta

SEQ ID NO: 5127132 - DNA, 19 bp, Homo sapiens
aattttagtaatttcctag

SEQ ID NO: 5127133 - DNA, 18 bp, Homo sapiens
aattttagtagttactaa

SEQ ID NO: 5127134 - DNA, 14 bp, Homo sapiens
aattttagtattca

SEQ ID NO: 5127135 - DNA, 21 bp, Homo sapiens
aattttataagcaaatttcaa

SEQ ID NO: 5127136 - DNA, 16 bp, Homo sapiens
aattttataatgtcat

SEQ ID NO: 5127137 - DNA, 21 bp, Homo sapiens
aattttatactttccctaccc

SEQ ID NO: 5127138 - DNA, 19 bp, Homo sapiens
aattttataggactgttct

SEQ ID NO: 5127139 - DNA, 18 bp, Homo sapiens
aattttatataattctga

SEQ ID NO: 5127140 - DNA, 20 bp, Homo sapiens
aattttatatcattggatga

SEQ ID NO: 5127141 - DNA, 12 bp, Homo sapiens
aattttatatgt

SEQ ID NO: 5127142 - DNA, 15 bp, Homo sapiens
aattttatatgtaag

SEQ ID NO: 5127143 - DNA, 18 bp, Homo sapiens
aattttatattcagtgaa

SEQ ID NO: 5127144 - DNA, 13 bp, Homo sapiens
aattttatctgta

SEQ ID NO: 5127145 - DNA, 15 bp, Homo sapiens
aattttatctgtata

SEQ ID NO: 5127146 - DNA, 19 bp, Homo sapiens
aattttatctgtataagct

SEQ ID NO: 5127147 - DNA, 19 bp, Homo sapiens
aattttatctgtttcctga

SEQ ID NO: 5127148 - DNA, 22 bp, Homo sapiens
aattttatgaactgcatgtata

SEQ ID NO: 5127149 - DNA, 13 bp, Homo sapiens
aattttatgtatt

SEQ ID NO: 5127150 - DNA, 22 bp, Homo sapiens
aattttatgtcatatatcaaat

SEQ ID NO: 5127151 - DNA, 22 bp, Homo sapiens
aattttattaaaagagtagaaa

SEQ ID NO: 5127152 - DNA, 20 bp, Homo sapiens
aattttattagacattctct

SEQ ID NO: 5127153 - DNA, 13 bp, Homo sapiens
aattttattatta

SEQ ID NO: 5127154 - DNA, 21 bp, Homo sapiens
aattttatttgttctttttct

SEQ ID NO: 5127155 - DNA, 23 bp, Homo sapiens
aattttatttgttctttttctga

SEQ ID NO: 5127156 - DNA, 14 bp, Homo sapiens
aattttattttaaa

SEQ ID NO: 5127157 - DNA, 19 bp, Homo sapiens
aattttattttaaaatttc

SEQ ID NO: 5127158 - DNA, 23 bp, Homo sapiens
aattttattttgctgagttgttc

SEQ ID NO: 5127159 - DNA, 20 bp, Homo sapiens
aattttattttttttctgta

SEQ ID NO: 5127160 - DNA, 19 bp, Homo sapiens
aattttcaagcaaagtatt

SEQ ID NO: 5127161 - DNA, 14 bp, Homo sapiens
aattttcaaggcct

SEQ ID NO: 5127162 - DNA, 15 bp, Homo sapiens
aattttcaaggcctt

SEQ ID NO: 5127163 - DNA, 21 bp, Homo sapiens
aattttcaaggccttcagttt

SEQ ID NO: 5127164 - DNA, 22 bp, Homo sapiens
aattttcaaggccttcagttta

SEQ ID NO: 5127165 - DNA, 15 bp, Homo sapiens
aattttcaagtaatt

SEQ ID NO: 5127166 - DNA, 14 bp, Homo sapiens
aattttcaagttta

SEQ ID NO: 5127167 - DNA, 22 bp, Homo sapiens
aattttcacaaaatgtctcagt

SEQ ID NO: 5127168 - DNA, 12 bp, Homo sapiens
aattttcacaat

SEQ ID NO: 5127169 - DNA, 15 bp, Homo sapiens
aattttcactgctgc

SEQ ID NO: 5127170 - DNA, 14 bp, Homo sapiens
aattttcactgtgt

SEQ ID NO: 5127171 - DNA, 19 bp, Homo sapiens
aattttcagacacattttt

SEQ ID NO: 5127172 - DNA, 14 bp, Homo sapiens
aattttcagatttg

SEQ ID NO: 5127173 - DNA, 17 bp, Homo sapiens
aattttcagatttgcac

SEQ ID NO: 5127174 - DNA, 12 bp, Homo sapiens
aattttcagcat

SEQ ID NO: 5127175 - DNA, 17 bp, Homo sapiens
aattttcagctgcaagg

SEQ ID NO: 5127176 - DNA, 20 bp, Homo sapiens
aattttcagttctatttaaa

SEQ ID NO: 5127177 - DNA, 10 bp, Homo sapiens
aattttcatt

SEQ ID NO: 5127178 - DNA, 20 bp, Homo sapiens
aattttcattaaacttgaag

SEQ ID NO: 5127179 - DNA, 15 bp, Homo sapiens
aattttcattttaca

SEQ ID NO: 5127180 - DNA, 14 bp, Homo sapiens
aattttcattttca

SEQ ID NO: 5127181 - DNA, 19 bp, Homo sapiens
aattttcattttgcactga

SEQ ID NO: 5127182 - DNA, 14 bp, Homo sapiens
aattttcattttta

SEQ ID NO: 5127183 - DNA, 15 bp, Homo sapiens
aattttccacgcagt

SEQ ID NO: 5127184 - DNA, 23 bp, Homo sapiens
aattttccagagaagcctatttt

SEQ ID NO: 5127185 - DNA, 16 bp, Homo sapiens
aattttccataagcta

SEQ ID NO: 5127186 - DNA, 23 bp, Homo sapiens
aattttcctcaatcacactacac

SEQ ID NO: 5127187 - DNA, 11 bp, Homo sapiens
aattttccttt

SEQ ID NO: 5127188 - DNA, 20 bp, Homo sapiens
aattttcctttaatatgaaa

SEQ ID NO: 5127189 - DNA, 18 bp, Homo sapiens
aattttcctttgtcattt

SEQ ID NO: 5127190 - DNA, 11 bp, Homo sapiens
aattttctaag

SEQ ID NO: 5127191 - DNA, 16 bp, Homo sapiens
aattttctagaatact

SEQ ID NO: 5127192 - DNA, 19 bp, Homo sapiens
aattttctagaatactaat

SEQ ID NO: 5127193 - DNA, 12 bp, Homo sapiens
aattttctagac

SEQ ID NO: 5127194 - DNA, 20 bp, Homo sapiens
aattttctagactttctgtt

SEQ ID NO: 5127195 - DNA, 17 bp, Homo sapiens
aattttctcaaaagcat

SEQ ID NO: 5127196 - DNA, 22 bp, Homo sapiens
aattttctccctttatgtatct

SEQ ID NO: 5127197 - DNA, 23 bp, Homo sapiens
aattttctccttggtttgctagt

SEQ ID NO: 5127198 - DNA, 18 bp, Homo sapiens
aattttctctaaactgtt

SEQ ID NO: 5127199 - DNA, 13 bp, Homo sapiens
aattttctctcca

SEQ ID NO: 5127200 - DNA, 20 bp, Homo sapiens
aattttctctttaggagaaa

SEQ ID NO: 5127201 - DNA, 12 bp, Homo sapiens
aattttctgcag

SEQ ID NO: 5127202 - DNA, 13 bp, Homo sapiens
aattttctgcagc

SEQ ID NO: 5127203 - DNA, 17 bp, Homo sapiens
aattttctgcagctgtt

SEQ ID NO: 5127204 - DNA, 22 bp, Homo sapiens
aattttctggaaaatgcttctt

SEQ ID NO: 5127205 - DNA, 16 bp, Homo sapiens
aattttctgtaatctt

SEQ ID NO: 5127206 - DNA, 13 bp, Homo sapiens
aattttctgtatt

SEQ ID NO: 5127207 - DNA, 14 bp, Homo sapiens
aattttctgtattt

SEQ ID NO: 5127208 - DNA, 13 bp, Homo sapiens
aattttctgttca

SEQ ID NO: 5127209 - DNA, 13 bp, Homo sapiens
aattttcttcatg

SEQ ID NO: 5127210 - DNA, 14 bp, Homo sapiens
aattttcttcatgc

SEQ ID NO: 5127211 - DNA, 21 bp, Homo sapiens
aattttcttgatgactggaat

SEQ ID NO: 5127212 - DNA, 22 bp, Homo sapiens
aattttctttagcttttaccaa

SEQ ID NO: 5127213 - DNA, 12 bp, Homo sapiens
aattttctttca

SEQ ID NO: 5127214 - DNA, 18 bp, Homo sapiens
aattttctttcatacatt

SEQ ID NO: 5127215 - DNA, 21 bp, Homo sapiens
aattttctttcatacattata

SEQ ID NO: 5127216 - DNA, 16 bp, Homo sapiens
aattttctttgtttct

SEQ ID NO: 5127217 - DNA, 23 bp, Homo sapiens
aattttcttttaagcatttgtat

SEQ ID NO: 5127218 - DNA, 14 bp, Homo sapiens
aattttctttttgt

SEQ ID NO: 5127219 - DNA, 20 bp, Homo sapiens
aattttgaaaagtaatattt

SEQ ID NO: 5127220 - DNA, 17 bp, Homo sapiens
aattttgaaatgattca

SEQ ID NO: 5127221 - DNA, 20 bp, Homo sapiens
aattttgaagtgctgtttat

SEQ ID NO: 5127222 - DNA, 13 bp, Homo sapiens
aattttgaccata

SEQ ID NO: 5127223 - DNA, 17 bp, Homo sapiens
aattttgacttaatgtg

SEQ ID NO: 5127224 - DNA, 15 bp, Homo sapiens
aattttgagaaaaat

SEQ ID NO: 5127225 - DNA, 19 bp, Homo sapiens
aattttgagaaaaatagag

SEQ ID NO: 5127226 - DNA, 21 bp, Homo sapiens
aattttgaggtcttttacata

SEQ ID NO: 5127227 - DNA, 20 bp, Homo sapiens
aattttgagttctacataag

SEQ ID NO: 5127228 - DNA, 23 bp, Homo sapiens
aattttgataaaaatttagaaca

SEQ ID NO: 5127229 - DNA, 16 bp, Homo sapiens
aattttgatagtggga

SEQ ID NO: 5127230 - DNA, 22 bp, Homo sapiens
aattttgatatacattgtgtga

SEQ ID NO: 5127231 - DNA, 23 bp, Homo sapiens
aattttgatctttttatattctt

SEQ ID NO: 5127232 - DNA, 20 bp, Homo sapiens
aattttgattaaccttttca

SEQ ID NO: 5127233 - DNA, 18 bp, Homo sapiens
aattttgcaaatataaac

SEQ ID NO: 5127234 - DNA, 19 bp, Homo sapiens
aattttgcaaatataaaca

SEQ ID NO: 5127235 - DNA, 12 bp, Homo sapiens
aattttgcaatg

SEQ ID NO: 5127236 - DNA, 13 bp, Homo sapiens
aattttgcagaag

SEQ ID NO: 5127237 - DNA, 12 bp, Homo sapiens
aattttgctaac

SEQ ID NO: 5127238 - DNA, 16 bp, Homo sapiens
aattttgctaactggg

SEQ ID NO: 5127239 - DNA, 21 bp, Homo sapiens
aattttgctaactgggttaaa

SEQ ID NO: 5127240 - DNA, 15 bp, Homo sapiens
aattttgctttatca

SEQ ID NO: 5127241 - DNA, 22 bp, Homo sapiens
aattttgctttatcagaagcaa

SEQ ID NO: 5127242 - DNA, 17 bp, Homo sapiens
aattttgcttttaatta

SEQ ID NO: 5127243 - DNA, 12 bp, Homo sapiens
aattttggaaaa

SEQ ID NO: 5127244 - DNA, 18 bp, Homo sapiens
aattttggaaaaatgtca

SEQ ID NO: 5127245 - DNA, 22 bp, Homo sapiens
aattttggaaaaatgtcactga

SEQ ID NO: 5127246 - DNA, 18 bp, Homo sapiens
aattttggaagaattcat

SEQ ID NO: 5127247 - DNA, 18 bp, Homo sapiens
aattttggaagattttca

SEQ ID NO: 5127248 - DNA, 22 bp, Homo sapiens
aattttggccaaagtgttaatc

SEQ ID NO: 5127249 - DNA, 18 bp, Homo sapiens
aattttggtgatgtaaaa

SEQ ID NO: 5127250 - DNA, 17 bp, Homo sapiens
aattttggttgtaatta

SEQ ID NO: 5127251 - DNA, 20 bp, Homo sapiens
aattttggttgtaattaaat

SEQ ID NO: 5127252 - DNA, 15 bp, Homo sapiens
aattttggttgtatt

SEQ ID NO: 5127253 - DNA, 16 bp, Homo sapiens
aattttggttgtattc

SEQ ID NO: 5127254 - DNA, 10 bp, Homo sapiens
aattttgtaa

SEQ ID NO: 5127255 - DNA, 12 bp, Homo sapiens
aattttgtaaaa

SEQ ID NO: 5127256 - DNA, 13 bp, Homo sapiens
aattttgtaaaaa

SEQ ID NO: 5127257 - DNA, 21 bp, Homo sapiens
aattttgtaaaacaatgccat

SEQ ID NO: 5127258 - DNA, 13 bp, Homo sapiens
aattttgtaagaa

SEQ ID NO: 5127259 - DNA, 16 bp, Homo sapiens
aattttgtaattttct

SEQ ID NO: 5127260 - DNA, 17 bp, Homo sapiens
aattttgtaattttctt

SEQ ID NO: 5127261 - DNA, 13 bp, Homo sapiens
aattttgtatatt

SEQ ID NO: 5127262 - DNA, 14 bp, Homo sapiens
aattttgtattttc

SEQ ID NO: 5127263 - DNA, 23 bp, Homo sapiens
aattttgtattttccaagtgtgc

SEQ ID NO: 5127264 - DNA, 17 bp, Homo sapiens
aattttgtcacagctct

SEQ ID NO: 5127265 - DNA, 21 bp, Homo sapiens
aattttgtctgccccaagttt

SEQ ID NO: 5127266 - DNA, 22 bp, Homo sapiens
aattttgtcttaagtgtttctc

SEQ ID NO: 5127267 - DNA, 23 bp, Homo sapiens
aattttgtgaaacagacttgtat

SEQ ID NO: 5127268 - DNA, 13 bp, Homo sapiens
aattttgtgaagc

SEQ ID NO: 5127269 - DNA, 17 bp, Homo sapiens
aattttgtgaagcaaaa

SEQ ID NO: 5127270 - DNA, 12 bp, Homo sapiens
aattttgtgatg

SEQ ID NO: 5127271 - DNA, 14 bp, Homo sapiens
aattttgtgcattc

SEQ ID NO: 5127272 - DNA, 12 bp, Homo sapiens
aattttgtgcta

SEQ ID NO: 5127273 - DNA, 15 bp, Homo sapiens
aattttgtgtaagaa

SEQ ID NO: 5127274 - DNA, 17 bp, Homo sapiens
aattttgtgtaagaaat

SEQ ID NO: 5127275 - DNA, 18 bp, Homo sapiens
aattttgtgttccttttt

SEQ ID NO: 5127276 - DNA, 13 bp, Homo sapiens
aattttgttaaca

SEQ ID NO: 5127277 - DNA, 18 bp, Homo sapiens
aattttgttaagaatttc

SEQ ID NO: 5127278 - DNA, 18 bp, Homo sapiens
aattttgttggtctgaat

SEQ ID NO: 5127279 - DNA, 19 bp, Homo sapiens
aattttgtttataagaaat

SEQ ID NO: 5127280 - DNA, 15 bp, Homo sapiens
aattttgtttcagaa

SEQ ID NO: 5127281 - DNA, 21 bp, Homo sapiens
aattttgtttcagaattttgt

SEQ ID NO: 5127282 - DNA, 22 bp, Homo sapiens
aattttgtttcagaattttgta

SEQ ID NO: 5127283 - DNA, 14 bp, Homo sapiens
aattttgtttctgt

SEQ ID NO: 5127284 - DNA, 16 bp, Homo sapiens
aattttgtttctgtac

SEQ ID NO: 5127285 - DNA, 13 bp, Homo sapiens
aattttgtttgta

SEQ ID NO: 5127286 - DNA, 17 bp, Homo sapiens
aattttgttttactttt

SEQ ID NO: 5127287 - DNA, 21 bp, Homo sapiens
aattttgtttttattttcaag

SEQ ID NO: 5127288 - DNA, 19 bp, Homo sapiens
aatttttaaaaatacactt

SEQ ID NO: 5127289 - DNA, 17 bp, Homo sapiens
aatttttaaaactgcat

SEQ ID NO: 5127290 - DNA, 15 bp, Homo sapiens
aatttttaaaagact

SEQ ID NO: 5127291 - DNA, 17 bp, Homo sapiens
aatttttaaaataaact

SEQ ID NO: 5127292 - DNA, 19 bp, Homo sapiens
aatttttaaaataaactgt

SEQ ID NO: 5127293 - DNA, 15 bp, Homo sapiens
aatttttaaacaagt

SEQ ID NO: 5127294 - DNA, 19 bp, Homo sapiens
aatttttaaacaagtattt

SEQ ID NO: 5127295 - DNA, 20 bp, Homo sapiens
aatttttaaatgtaaaacat

SEQ ID NO: 5127296 - DNA, 14 bp, Homo sapiens
aatttttaaatgtt

SEQ ID NO: 5127297 - DNA, 14 bp, Homo sapiens
aatttttaactgta

SEQ ID NO: 5127298 - DNA, 12 bp, Homo sapiens
aatttttaactt

SEQ ID NO: 5127299 - DNA, 22 bp, Homo sapiens
aatttttaacttttggaatcat

SEQ ID NO: 5127300 - DNA, 11 bp, Homo sapiens
aatttttaagc

SEQ ID NO: 5127301 - DNA, 15 bp, Homo sapiens
aatttttaagcaaat

SEQ ID NO: 5127302 - DNA, 17 bp, Homo sapiens
aatttttaagctgcaaa

SEQ ID NO: 5127303 - DNA, 19 bp, Homo sapiens
aatttttaagtgtcagact

SEQ ID NO: 5127304 - DNA, 21 bp, Homo sapiens
aatttttaatgactttttata

SEQ ID NO: 5127305 - DNA, 11 bp, Homo sapiens
aatttttaatt

SEQ ID NO: 5127306 - DNA, 16 bp, Homo sapiens
aatttttacagaattg

SEQ ID NO: 5127307 - DNA, 16 bp, Homo sapiens
aatttttacatgacca

SEQ ID NO: 5127308 - DNA, 14 bp, Homo sapiens
aatttttacattca

SEQ ID NO: 5127309 - DNA, 16 bp, Homo sapiens
aatttttacatttgtt

SEQ ID NO: 5127310 - DNA, 20 bp, Homo sapiens
aatttttaccctaatgtctt

SEQ ID NO: 5127311 - DNA, 22 bp, Homo sapiens
aatttttactcaggctttctat

SEQ ID NO: 5127312 - DNA, 16 bp, Homo sapiens
aatttttaggaagttt

SEQ ID NO: 5127313 - DNA, 13 bp, Homo sapiens
aatttttatgtaa

SEQ ID NO: 5127314 - DNA, 20 bp, Homo sapiens
aatttttatgtaattatata

SEQ ID NO: 5127315 - DNA, 13 bp, Homo sapiens
aatttttatgtgt

SEQ ID NO: 5127316 - DNA, 17 bp, Homo sapiens
aatttttattatgcata

SEQ ID NO: 5127317 - DNA, 16 bp, Homo sapiens
aatttttattatttgt

SEQ ID NO: 5127318 - DNA, 19 bp, Homo sapiens
aatttttatttatttttct

SEQ ID NO: 5127319 - DNA, 21 bp, Homo sapiens
aatttttatttctttttaatt

SEQ ID NO: 5127320 - DNA, 17 bp, Homo sapiens
aatttttatttttgaac

SEQ ID NO: 5127321 - DNA, 18 bp, Homo sapiens
aatttttcaaaatcgttt

SEQ ID NO: 5127322 - DNA, 15 bp, Homo sapiens
aatttttcagatgct

SEQ ID NO: 5127323 - DNA, 21 bp, Homo sapiens
aatttttcagctctctgtata

SEQ ID NO: 5127324 - DNA, 12 bp, Homo sapiens
aatttttcatag

SEQ ID NO: 5127325 - DNA, 13 bp, Homo sapiens
aatttttcataga

SEQ ID NO: 5127326 - DNA, 20 bp, Homo sapiens
aatttttccaactactaata

SEQ ID NO: 5127327 - DNA, 12 bp, Homo sapiens
aatttttccaca

SEQ ID NO: 5127328 - DNA, 13 bp, Homo sapiens
aatttttcctttt

SEQ ID NO: 5127329 - DNA, 16 bp, Homo sapiens
aatttttctctttaaa

SEQ ID NO: 5127330 - DNA, 14 bp, Homo sapiens
aatttttctgtata

SEQ ID NO: 5127331 - DNA, 18 bp, Homo sapiens
aatttttctgtatagaca

SEQ ID NO: 5127332 - DNA, 22 bp, Homo sapiens
aatttttctgttggtcttaact

SEQ ID NO: 5127333 - DNA, 21 bp, Homo sapiens
aatttttcttatttcatttct

SEQ ID NO: 5127334 - DNA, 21 bp, Homo sapiens
aatttttcttttcttgatttt

SEQ ID NO: 5127335 - DNA, 13 bp, Homo sapiens
aatttttgaaaaa

SEQ ID NO: 5127336 - DNA, 20 bp, Homo sapiens
aatttttgaaaaatattgct

SEQ ID NO: 5127337 - DNA, 12 bp, Homo sapiens
aatttttgacac

SEQ ID NO: 5127338 - DNA, 19 bp, Homo sapiens
aatttttgacactttttgt

SEQ ID NO: 5127339 - DNA, 22 bp, Homo sapiens
aatttttgatgcccagacagca

SEQ ID NO: 5127340 - DNA, 11 bp, Homo sapiens
aatttttgcaa

SEQ ID NO: 5127341 - DNA, 12 bp, Homo sapiens
aatttttgcaat

SEQ ID NO: 5127342 - DNA, 21 bp, Homo sapiens
aatttttgcaataatgcagta

SEQ ID NO: 5127343 - DNA, 13 bp, Homo sapiens
aatttttgcaatt

SEQ ID NO: 5127344 - DNA, 19 bp, Homo sapiens
aatttttgcaattattcta

SEQ ID NO: 5127345 - DNA, 17 bp, Homo sapiens
aatttttgcatgtttaa

SEQ ID NO: 5127346 - DNA, 22 bp, Homo sapiens
aatttttgcatgtttaataata

SEQ ID NO: 5127347 - DNA, 21 bp, Homo sapiens
aatttttgcctatctttaaac

SEQ ID NO: 5127348 - DNA, 18 bp, Homo sapiens
aatttttgcttttagaaa

SEQ ID NO: 5127349 - DNA, 19 bp, Homo sapiens
aatttttgcttttagaaaa

SEQ ID NO: 5127350 - DNA, 19 bp, Homo sapiens
aatttttggggaaaaaagc

SEQ ID NO: 5127351 - DNA, 22 bp, Homo sapiens
aatttttggggaaaaaagcaca

SEQ ID NO: 5127352 - DNA, 23 bp, Homo sapiens
aatttttggtttatgactttgtc

SEQ ID NO: 5127353 - DNA, 14 bp, Homo sapiens
aatttttgtaattt

SEQ ID NO: 5127354 - DNA, 13 bp, Homo sapiens
aatttttgtacat

SEQ ID NO: 5127355 - DNA, 13 bp, Homo sapiens
aatttttgtagta

SEQ ID NO: 5127356 - DNA, 14 bp, Homo sapiens
aatttttgtatttt

SEQ ID NO: 5127357 - DNA, 17 bp, Homo sapiens
aatttttgtatttttag

SEQ ID NO: 5127358 - DNA, 23 bp, Homo sapiens
aatttttgtcattttaaaatctg

SEQ ID NO: 5127359 - DNA, 20 bp, Homo sapiens
aatttttgtctttcatggaa

SEQ ID NO: 5127360 - DNA, 14 bp, Homo sapiens
aatttttgtttgga

SEQ ID NO: 5127361 - DNA, 23 bp, Homo sapiens
aattttttaaaaaaaatttgtgt

SEQ ID NO: 5127362 - DNA, 17 bp, Homo sapiens
aattttttaaaagagac

SEQ ID NO: 5127363 - DNA, 14 bp, Homo sapiens
aattttttaaagaa

SEQ ID NO: 5127364 - DNA, 19 bp, Homo sapiens
aattttttaaagaatccaa

SEQ ID NO: 5127365 - DNA, 21 bp, Homo sapiens
aattttttacattttcctgtg

SEQ ID NO: 5127366 - DNA, 17 bp, Homo sapiens
aattttttattcttgtg

SEQ ID NO: 5127367 - DNA, 23 bp, Homo sapiens
aattttttattcttgtgaatatg

SEQ ID NO: 5127368 - DNA, 17 bp, Homo sapiens
aattttttattttaata

SEQ ID NO: 5127369 - DNA, 20 bp, Homo sapiens
aattttttcatgcacactgt

SEQ ID NO: 5127370 - DNA, 12 bp, Homo sapiens
aattttttgaaa

SEQ ID NO: 5127371 - DNA, 23 bp, Homo sapiens
aattttttgaaatgggcatttat

SEQ ID NO: 5127372 - DNA, 14 bp, Homo sapiens
aattttttgaactt

SEQ ID NO: 5127373 - DNA, 15 bp, Homo sapiens
aattttttgaatatg

SEQ ID NO: 5127374 - DNA, 13 bp, Homo sapiens
aattttttgagta

SEQ ID NO: 5127375 - DNA, 12 bp, Homo sapiens
aattttttgcag

SEQ ID NO: 5127376 - DNA, 14 bp, Homo sapiens
aattttttgtatat

SEQ ID NO: 5127377 - DNA, 17 bp, Homo sapiens
aattttttgtgatgaaa

SEQ ID NO: 5127378 - DNA, 19 bp, Homo sapiens
aatttttttaaatttcagt

SEQ ID NO: 5127379 - DNA, 20 bp, Homo sapiens
aatttttttaaatttcagtc

SEQ ID NO: 5127380 - DNA, 20 bp, Homo sapiens
aatttttttaaccaaaggtg

SEQ ID NO: 5127381 - DNA, 17 bp, Homo sapiens
aatttttttaaggaaaa

SEQ ID NO: 5127382 - DNA, 16 bp, Homo sapiens
aatttttttaattttg

SEQ ID NO: 5127383 - DNA, 18 bp, Homo sapiens
aatttttttaattttgta

SEQ ID NO: 5127384 - DNA, 23 bp, Homo sapiens
aatttttttatgttttgtttctg

SEQ ID NO: 5127385 - DNA, 20 bp, Homo sapiens
aatttttttcacctagattt

SEQ ID NO: 5127386 - DNA, 15 bp, Homo sapiens
aatttttttcagtat

SEQ ID NO: 5127387 - DNA, 21 bp, Homo sapiens
aatttttttcatcttctctgg

SEQ ID NO: 5127388 - DNA, 20 bp, Homo sapiens
aatttttttccttacctttt

SEQ ID NO: 5127389 - DNA, 16 bp, Homo sapiens
aatttttttctgcaca

SEQ ID NO: 5127390 - DNA, 19 bp, Homo sapiens
aatttttttctgcacagct

SEQ ID NO: 5127391 - DNA, 17 bp, Homo sapiens
aatttttttgaaaaaag

SEQ ID NO: 5127392 - DNA, 15 bp, Homo sapiens
aatttttttgtaata

SEQ ID NO: 5127393 - DNA, 18 bp, Homo sapiens
aatttttttgtatgaaaa

SEQ ID NO: 5127394 - DNA, 20 bp, Homo sapiens
aattttttttaaaatagaaa

SEQ ID NO: 5127395 - DNA, 19 bp, Homo sapiens
aattttttttaatgcttaa

SEQ ID NO: 5127396 - DNA, 15 bp, Homo sapiens
aattttttttaatgt

SEQ ID NO: 5127397 - DNA, 19 bp, Homo sapiens
aattttttttaatgtacaa

SEQ ID NO: 5127398 - DNA, 20 bp, Homo sapiens
aattttttttaatgtacaag

SEQ ID NO: 5127399 - DNA, 15 bp, Homo sapiens
aattttttttagtat

SEQ ID NO: 5127400 - DNA, 23 bp, Homo sapiens
aattttttttagtatttatttat

SEQ ID NO: 5127401 - DNA, 20 bp, Homo sapiens
aattttttttcaaaaatgct

SEQ ID NO: 5127402 - DNA, 23 bp, Homo sapiens
aattttttttcaaatgtgcaatt

SEQ ID NO: 5127403 - DNA, 14 bp, Homo sapiens
aattttttttcatg

SEQ ID NO: 5127404 - DNA, 15 bp, Homo sapiens
aattttttttcatgt

SEQ ID NO: 5127405 - DNA, 20 bp, Homo sapiens
aattttttttgttgtttcag

SEQ ID NO: 5127406 - DNA, 22 bp, Homo sapiens
aattttttttgttgtttcagtg

SEQ ID NO: 5127407 - DNA, 18 bp, Homo sapiens
aattttttttgttttttg

SEQ ID NO: 5127408 - DNA, 14 bp, Homo sapiens
aattttttttttcc

SEQ ID NO: 5127409 - DNA, 14 bp, Homo sapiens
aattttttttttct

SEQ ID NO: 5127410 - DNA, 23 bp, Homo sapiens
acaaaaaaaaaaaaagaagaccg

SEQ ID NO: 5127411 - DNA, 16 bp, Homo sapiens
acaaaaaaaacaacaa

SEQ ID NO: 5127412 - DNA, 18 bp, Homo sapiens
acaaaaaaaacaacaaaa

SEQ ID NO: 5127413 - DNA, 19 bp, Homo sapiens
acaaaaaaaacaacaaaaa

SEQ ID NO: 5127414 - DNA, 22 bp, Homo sapiens
acaaaaaaaacaacaaaaaaag

SEQ ID NO: 5127415 - DNA, 13 bp, Homo sapiens
acaaaaaaaagaa

SEQ ID NO: 5127416 - DNA, 17 bp, Homo sapiens
acaaaaaaaagaaagaa

SEQ ID NO: 5127417 - DNA, 21 bp, Homo sapiens
acaaaaaaaagaaagaaaaaa

SEQ ID NO: 5127418 - DNA, 13 bp, Homo sapiens
acaaaaaaactat

SEQ ID NO: 5127419 - DNA, 22 bp, Homo sapiens
acaaaaaaagtttgttactttg

SEQ ID NO: 5127420 - DNA, 22 bp, Homo sapiens
acaaaaaaatatcagacaagca

SEQ ID NO: 5127421 - DNA, 19 bp, Homo sapiens
acaaaaaaatctgcagaag

SEQ ID NO: 5127422 - DNA, 18 bp, Homo sapiens
acaaaaaacaatatttat

SEQ ID NO: 5127423 - DNA, 14 bp, Homo sapiens
acaaaaaactgcct

SEQ ID NO: 5127424 - DNA, 24 bp, Homo sapiens
acaaaaaacttttaatgccttcca

SEQ ID NO: 5127425 - DNA, 12 bp, Homo sapiens
acaaaaaagaga

SEQ ID NO: 5127426 - DNA, 13 bp, Homo sapiens
acaaaaaagagaa

SEQ ID NO: 5127427 - DNA, 14 bp, Homo sapiens
acaaaaaagagaaa

SEQ ID NO: 5127428 - DNA, 12 bp, Homo sapiens
acaaaaaaggaa

SEQ ID NO: 5127429 - DNA, 12 bp, Homo sapiens
acaaaaaagtta

SEQ ID NO: 5127430 - DNA, 19 bp, Homo sapiens
acaaaaaataaaatgaaca

SEQ ID NO: 5127431 - DNA, 13 bp, Homo sapiens
acaaaaaatacat

SEQ ID NO: 5127432 - DNA, 12 bp, Homo sapiens
acaaaaaatact

SEQ ID NO: 5127433 - DNA, 14 bp, Homo sapiens
acaaaaaatgtttt

SEQ ID NO: 5127434 - DNA, 13 bp, Homo sapiens
acaaaaacaaaaa

SEQ ID NO: 5127435 - DNA, 18 bp, Homo sapiens
acaaaaacaaaaaaacta

SEQ ID NO: 5127436 - DNA, 14 bp, Homo sapiens
acaaaaacacaaat

SEQ ID NO: 5127437 - DNA, 16 bp, Homo sapiens
acaaaaacacaaatac

SEQ ID NO: 5127438 - DNA, 16 bp, Homo sapiens
acaaaaacacagcaag

SEQ ID NO: 5127439 - DNA, 19 bp, Homo sapiens
acaaaaacagaatttgaga

SEQ ID NO: 5127440 - DNA, 15 bp, Homo sapiens
acaaaaacagcctca

SEQ ID NO: 5127441 - DNA, 21 bp, Homo sapiens
acaaaaacagcctcacagaag

SEQ ID NO: 5127442 - DNA, 11 bp, Homo sapiens
acaaaaaccaa

SEQ ID NO: 5127443 - DNA, 20 bp, Homo sapiens
acaatcactattcttaagca

SEQ ID NO: 5127444 - DNA, 14 bp, Homo sapiens
acaatcactgccaa

SEQ ID NO: 5127445 - DNA, 19 bp, Homo sapiens
acaatcagaccaaggaaca

SEQ ID NO: 5127446 - DNA, 13 bp, Homo sapiens
acaatcagctgct

SEQ ID NO: 5127447 - DNA, 22 bp, Homo sapiens
acaatcaggtaagatcataaca

SEQ ID NO: 5127448 - DNA, 16 bp, Homo sapiens
acaatcagtcatcatg

SEQ ID NO: 5127449 - DNA, 17 bp, Homo sapiens
acaatcagtcccctccc

SEQ ID NO: 5127450 - DNA, 18 bp, Homo sapiens
acaatcagtcccctccca

SEQ ID NO: 5127451 - DNA, 22 bp, Homo sapiens
acaatcagtcccctcccatctg

SEQ ID NO: 5127452 - DNA, 13 bp, Homo sapiens
acaatcagtttat

SEQ ID NO: 5127453 - DNA, 14 bp, Homo sapiens
acaatcagtttatc

SEQ ID NO: 5127454 - DNA, 21 bp, Homo sapiens
acaatcatgaacagctctgag

SEQ ID NO: 5127455 - DNA, 20 bp, Homo sapiens
acaatcatgagtcagacatt

SEQ ID NO: 5127456 - DNA, 14 bp, Homo sapiens
acaatcatgttctg

SEQ ID NO: 5127457 - DNA, 13 bp, Homo sapiens
acaatcattgctg

SEQ ID NO: 5127458 - DNA, 14 bp, Homo sapiens
acaatcattgctga

SEQ ID NO: 5127459 - DNA, 22 bp, Homo sapiens
acaatccatgtgattaatgttt

SEQ ID NO: 5127460 - DNA, 18 bp, Homo sapiens
acaatcccacctagccca

SEQ ID NO: 5127461 - DNA, 20 bp, Homo sapiens
acaatcccacctagcccagg

SEQ ID NO: 5127462 - DNA, 13 bp, Homo sapiens
acaatccctgggg

SEQ ID NO: 5127463 - DNA, 16 bp, Homo sapiens
acaatcctagtgcttt

SEQ ID NO: 5127464 - DNA, 17 bp, Homo sapiens
acaatcctagtgctttc

SEQ ID NO: 5127465 - DNA, 23 bp, Homo sapiens
acaatcctagtgctttccttttt

SEQ ID NO: 5127466 - DNA, 20 bp, Homo sapiens
acaatcctgaagaaaccaca

SEQ ID NO: 5127467 - DNA, 14 bp, Homo sapiens
acaatcctgtccct

SEQ ID NO: 5127468 - DNA, 21 bp, Homo sapiens
acaatcctgtttataatctga

SEQ ID NO: 5127469 - DNA, 16 bp, Homo sapiens
acaatcgatggccttg

SEQ ID NO: 5127470 - DNA, 16 bp, Homo sapiens
acaatcgtcttaagtt

SEQ ID NO: 5127471 - DNA, 19 bp, Homo sapiens
acaatcgttctgtgtttga

SEQ ID NO: 5127472 - DNA, 18 bp, Homo sapiens
acaatctaattaaatggc

SEQ ID NO: 5127473 - DNA, 15 bp, Homo sapiens
acaatctagtaatgt

SEQ ID NO: 5127474 - DNA, 22 bp, Homo sapiens
acaatctatggcttatttctat

SEQ ID NO: 5127475 - DNA, 11 bp, Homo sapiens
acaatctattt

SEQ ID NO: 5127476 - DNA, 14 bp, Homo sapiens
acaatctatttaaa

SEQ ID NO: 5127477 - DNA, 19 bp, Homo sapiens
acaatctatttaaaaaact

SEQ ID NO: 5127478 - DNA, 20 bp, Homo sapiens
acaatctatttattggacat

SEQ ID NO: 5127479 - DNA, 22 bp, Homo sapiens
acaatctcatcccaacaaactt

SEQ ID NO: 5127480 - DNA, 17 bp, Homo sapiens
acaatctcccttcacaa

SEQ ID NO: 5127481 - DNA, 21 bp, Homo sapiens
acaatctcccttcacaagttt

SEQ ID NO: 5127482 - DNA, 20 bp, Homo sapiens
acaatctcgtaggtgtcctg

SEQ ID NO: 5127483 - DNA, 12 bp, Homo sapiens
acaatctcttaa

SEQ ID NO: 5127484 - DNA, 21 bp, Homo sapiens
acaatctggagatactaaatc

SEQ ID NO: 5127485 - DNA, 16 bp, Homo sapiens
acaatctgggactttc

SEQ ID NO: 5127486 - DNA, 14 bp, Homo sapiens
acaatctgttctac

SEQ ID NO: 5127487 - DNA, 16 bp, Homo sapiens
acaatcttagtgaatg

SEQ ID NO: 5127488 - DNA, 15 bp, Homo sapiens
acaatcttatgtttc

SEQ ID NO: 5127489 - DNA, 15 bp, Homo sapiens
acaatcttgggaaca

SEQ ID NO: 5127490 - DNA, 19 bp, Homo sapiens
acaatcttggggctgatga

SEQ ID NO: 5127491 - DNA, 19 bp, Homo sapiens
acaatctttattatgcatt

SEQ ID NO: 5127492 - DNA, 16 bp, Homo sapiens
acaatctttcatgtct

SEQ ID NO: 5127493 - DNA, 19 bp, Homo sapiens
acaatgaaaacaaataaaa

SEQ ID NO: 5127494 - DNA, 18 bp, Homo sapiens
acaatgaaaactctttgc

SEQ ID NO: 5127495 - DNA, 24 bp, Homo sapiens
acaatgaacatccctttttcaatg

SEQ ID NO: 5127496 - DNA, 21 bp, Homo sapiens
acaatgaaggaaaacctcact

SEQ ID NO: 5127497 - DNA, 13 bp, Homo sapiens
acaatgaagggaa

SEQ ID NO: 5127498 - DNA, 18 bp, Homo sapiens
acaatgaagggaaattgt

SEQ ID NO: 5127499 - DNA, 20 bp, Homo sapiens
acaatgaagtgttttacaat

SEQ ID NO: 5127500 - DNA, 21 bp, Homo sapiens
acaatgaagttgaaaatcata

SEQ ID NO: 5127501 - DNA, 13 bp, Homo sapiens
acaatgaatcaga

SEQ ID NO: 5127502 - DNA, 13 bp, Homo sapiens
acaatgaatgtat

SEQ ID NO: 5127503 - DNA, 14 bp, Homo sapiens
acaatgaatgtata

SEQ ID NO: 5127504 - DNA, 15 bp, Homo sapiens
acaatgaatgtcttt

SEQ ID NO: 5127505 - DNA, 22 bp, Homo sapiens
acaatgaattgaatgctctaag

SEQ ID NO: 5127506 - DNA, 20 bp, Homo sapiens
acaatgacaaaaagaagatg

SEQ ID NO: 5127507 - DNA, 17 bp, Homo sapiens
acaatgacaagatgttc

SEQ ID NO: 5127508 - DNA, 16 bp, Homo sapiens
acaatgacatttatat

SEQ ID NO: 5127509 - DNA, 15 bp, Homo sapiens
acaatgactaagcca

SEQ ID NO: 5127510 - DNA, 17 bp, Homo sapiens
acaatgactaagccaag

SEQ ID NO: 5127511 - DNA, 20 bp, Homo sapiens
acaatgactaattcttgcat

SEQ ID NO: 5127512 - DNA, 17 bp, Homo sapiens
acaatgacttactgtac

SEQ ID NO: 5127513 - DNA, 22 bp, Homo sapiens
acaatgacttactgtacatgaa

SEQ ID NO: 5127514 - DNA, 20 bp, Homo sapiens
acaatgagaaaaataaatgg

SEQ ID NO: 5127515 - DNA, 21 bp, Homo sapiens
acaatgatcaccgactgaaaa

SEQ ID NO: 5127516 - DNA, 17 bp, Homo sapiens
acaatgatgatgataat

SEQ ID NO: 5127517 - DNA, 20 bp, Homo sapiens
acaatgatggtaaagccatg

SEQ ID NO: 5127518 - DNA, 16 bp, Homo sapiens
acaatgattaatcagc

SEQ ID NO: 5127519 - DNA, 20 bp, Homo sapiens
acaatgatttggccaggcct

SEQ ID NO: 5127520 - DNA, 13 bp, Homo sapiens
acaatgatttgta

SEQ ID NO: 5127521 - DNA, 14 bp, Homo sapiens
acaatgatttgtaa

SEQ ID NO: 5127522 - DNA, 16 bp, Homo sapiens
acaatgcaacttttaa

SEQ ID NO: 5127523 - DNA, 18 bp, Homo sapiens
acaatgcacttttatgaa

SEQ ID NO: 5127524 - DNA, 16 bp, Homo sapiens
acaatgcatgctttgg

SEQ ID NO: 5127525 - DNA, 16 bp, Homo sapiens
acaatgcatgtgctgt

SEQ ID NO: 5127526 - DNA, 18 bp, Homo sapiens
acaatgccatgaacaaat

SEQ ID NO: 5127527 - DNA, 19 bp, Homo sapiens
acaatgccatgaacaaatt

SEQ ID NO: 5127528 - DNA, 20 bp, Homo sapiens
acaatgccatgaacaaattc

SEQ ID NO: 5127529 - DNA, 21 bp, Homo sapiens
acaatgccatgaacaaattct

SEQ ID NO: 5127530 - DNA, 18 bp, Homo sapiens
acaatgccctgctggcct

SEQ ID NO: 5127531 - DNA, 21 bp, Homo sapiens
acaatgccctgctggcctgtc

SEQ ID NO: 5127532 - DNA, 16 bp, Homo sapiens
acaatgcctattgtaa

SEQ ID NO: 5127533 - DNA, 16 bp, Homo sapiens
acaatgccttgttgta

SEQ ID NO: 5127534 - DNA, 22 bp, Homo sapiens
acaatgccttgttgtattcctg

SEQ ID NO: 5127535 - DNA, 16 bp, Homo sapiens
acaatgcgaatggtag

SEQ ID NO: 5127536 - DNA, 21 bp, Homo sapiens
acaatgcgtggcacatctaaa

SEQ ID NO: 5127537 - DNA, 16 bp, Homo sapiens
acaatgctgccatgcc

SEQ ID NO: 5127538 - DNA, 21 bp, Homo sapiens
acaatgctgccatgcccacca

SEQ ID NO: 5127539 - DNA, 14 bp, Homo sapiens
acaatgctgtattt

SEQ ID NO: 5127540 - DNA, 23 bp, Homo sapiens
acaatgctgtgccctaaagtgta

SEQ ID NO: 5127541 - DNA, 24 bp, Homo sapiens
acaatgctgtgccctaaagtgtat

SEQ ID NO: 5127542 - DNA, 18 bp, Homo sapiens
acaatgctttgataaaat

SEQ ID NO: 5127543 - DNA, 14 bp, Homo sapiens
acaatggaaactga

SEQ ID NO: 5127544 - DNA, 23 bp, Homo sapiens
acaatggagtgggagatcagcca

SEQ ID NO: 5127545 - DNA, 22 bp, Homo sapiens
acaatggatattgcctgtgttt

SEQ ID NO: 5127546 - DNA, 12 bp, Homo sapiens
acaatggcagct

SEQ ID NO: 5127547 - DNA, 16 bp, Homo sapiens
acaatggccagcccag

SEQ ID NO: 5127548 - DNA, 17 bp, Homo sapiens
acaatggccagcccaga

SEQ ID NO: 5127549 - DNA, 17 bp, Homo sapiens
acaatggctatattaat

SEQ ID NO: 5127550 - DNA, 23 bp, Homo sapiens
acaatggctgggagggggccctt

SEQ ID NO: 5127551 - DNA, 16 bp, Homo sapiens
acaatggctgggtttg

SEQ ID NO: 5127552 - DNA, 18 bp, Homo sapiens
acaatggctgggtttggg

SEQ ID NO: 5127553 - DNA, 19 bp, Homo sapiens
acaatgggaaaacttcact

SEQ ID NO: 5127554 - DNA, 13 bp, Homo sapiens
acaatgggaaaag

SEQ ID NO: 5127555 - DNA, 17 bp, Homo sapiens
acaatggggactttgtt

SEQ ID NO: 5127556 - DNA, 19 bp, Homo sapiens
acaatggggctggttttgc

SEQ ID NO: 5127557 - DNA, 14 bp, Homo sapiens
acaatggtaacatt

SEQ ID NO: 5127558 - DNA, 18 bp, Homo sapiens
acaatggtagctctgaag

SEQ ID NO: 5127559 - DNA, 22 bp, Homo sapiens
acaatggtagctctgaagggag

SEQ ID NO: 5127560 - DNA, 18 bp, Homo sapiens
acaatggtcttacattgg

SEQ ID NO: 5127561 - DNA, 19 bp, Homo sapiens
acaatggtcttacattgga

SEQ ID NO: 5127562 - DNA, 15 bp, Homo sapiens
acaatggtgtctctt

SEQ ID NO: 5127563 - DNA, 20 bp, Homo sapiens
acaatggtgtggtgaatgtg

SEQ ID NO: 5127564 - DNA, 21 bp, Homo sapiens
acaatggtttacatgaacaca

SEQ ID NO: 5127565 - DNA, 22 bp, Homo sapiens
acaatggtttacatgaacacag

SEQ ID NO: 5127566 - DNA, 20 bp, Homo sapiens
acaatggtttcaaagaaaga

SEQ ID NO: 5127567 - DNA, 21 bp, Homo sapiens
acaatggttttcttgtgtgtt

SEQ ID NO: 5127568 - DNA, 21 bp, Homo sapiens
acaatgtaattacattaaaat

SEQ ID NO: 5127569 - DNA, 13 bp, Homo sapiens
acaatgtaattat

SEQ ID NO: 5127570 - DNA, 12 bp, Homo sapiens
acaatgtacaat

SEQ ID NO: 5127571 - DNA, 13 bp, Homo sapiens
acaatgtacaatt

SEQ ID NO: 5127572 - DNA, 14 bp, Homo sapiens
acaatgtacaatta

SEQ ID NO: 5127573 - DNA, 18 bp, Homo sapiens
acaatgtacaattatgtc

SEQ ID NO: 5127574 - DNA, 14 bp, Homo sapiens
acaatgtacacact

SEQ ID NO: 5127575 - DNA, 14 bp, Homo sapiens
acaatgtactatat

SEQ ID NO: 5127576 - DNA, 16 bp, Homo sapiens
acaatgtagaaaatga

SEQ ID NO: 5127577 - DNA, 20 bp, Homo sapiens
acaatgtagataagtgttct

SEQ ID NO: 5127578 - DNA, 21 bp, Homo sapiens
acaatgtagataagtgttctg

SEQ ID NO: 5127579 - DNA, 23 bp, Homo sapiens
acaatgtagatggcctcttacta

SEQ ID NO: 5127580 - DNA, 16 bp, Homo sapiens
acaatgtataaagatt

SEQ ID NO: 5127581 - DNA, 18 bp, Homo sapiens
acaatgtataaagattgt

SEQ ID NO: 5127582 - DNA, 15 bp, Homo sapiens
acaatgtatctttat

SEQ ID NO: 5127583 - DNA, 17 bp, Homo sapiens
acaatgtatgtaatttg

SEQ ID NO: 5127584 - DNA, 20 bp, Homo sapiens
acaatgtatgtacaatacaa

SEQ ID NO: 5127585 - DNA, 14 bp, Homo sapiens
acaatgtatttatt

SEQ ID NO: 5127586 - DNA, 17 bp, Homo sapiens
acaatgtatttatttaa

SEQ ID NO: 5127587 - DNA, 19 bp, Homo sapiens
acaatgtatttatttaaaa

SEQ ID NO: 5127588 - DNA, 20 bp, Homo sapiens
acaatgtatttatttaaaag

SEQ ID NO: 5127589 - DNA, 21 bp, Homo sapiens
acaatgtatttatttaaaaga

SEQ ID NO: 5127590 - DNA, 15 bp, Homo sapiens
acaatgtattttgga

SEQ ID NO: 5127591 - DNA, 14 bp, Homo sapiens
acaatgtcacataa

SEQ ID NO: 5127592 - DNA, 22 bp, Homo sapiens
acaatgtcctaactgaaagatg

SEQ ID NO: 5127593 - DNA, 16 bp, Homo sapiens
acaatgtcctctttga

SEQ ID NO: 5127594 - DNA, 21 bp, Homo sapiens
acaatgtcgagtatattatta

SEQ ID NO: 5127595 - DNA, 18 bp, Homo sapiens
acaatgtctggctgaagc

SEQ ID NO: 5127596 - DNA, 19 bp, Homo sapiens
acaatgtgaactttattaa

SEQ ID NO: 5127597 - DNA, 12 bp, Homo sapiens
acaatgtgaata

SEQ ID NO: 5127598 - DNA, 17 bp, Homo sapiens
acaatgtgaataatggc

SEQ ID NO: 5127599 - DNA, 17 bp, Homo sapiens
acaatgtgactttgaaa

SEQ ID NO: 5127600 - DNA, 20 bp, Homo sapiens
acaatgtgactttgaaaata

SEQ ID NO: 5127601 - DNA, 20 bp, Homo sapiens
acaatgtgatatgtgtaata

SEQ ID NO: 5127602 - DNA, 23 bp, Homo sapiens
acaatgtggaattacataacagg

SEQ ID NO: 5127603 - DNA, 21 bp, Homo sapiens
acaatgtggacgtgcactgac

SEQ ID NO: 5127604 - DNA, 21 bp, Homo sapiens
acaatgtggccgaggactttg

SEQ ID NO: 5127605 - DNA, 22 bp, Homo sapiens
acaatgtgggcgtttgtaaatt

SEQ ID NO: 5127606 - DNA, 22 bp, Homo sapiens
acaatgtgtctatttctgaaag

SEQ ID NO: 5127607 - DNA, 22 bp, Homo sapiens
acaatgtgtgttgctgtcagaa

SEQ ID NO: 5127608 - DNA, 13 bp, Homo sapiens
acaatgttaaatg

SEQ ID NO: 5127609 - DNA, 16 bp, Homo sapiens
acaatgttaaatgcaa

SEQ ID NO: 5127610 - DNA, 22 bp, Homo sapiens
acaatgttaaggaaactcttat

SEQ ID NO: 5127611 - DNA, 21 bp, Homo sapiens
acaatgttcatcccatgatgt

SEQ ID NO: 5127612 - DNA, 23 bp, Homo sapiens
acaatgttccttttttgtatatt

SEQ ID NO: 5127613 - DNA, 16 bp, Homo sapiens
acaatgttctgttgta

SEQ ID NO: 5127614 - DNA, 19 bp, Homo sapiens
acaatgttggagcagcagg

SEQ ID NO: 5127615 - DNA, 20 bp, Homo sapiens
acaatgttggagcagcaggc

SEQ ID NO: 5127616 - DNA, 22 bp, Homo sapiens
acaatgttgtagtgtcccccac

SEQ ID NO: 5127617 - DNA, 21 bp, Homo sapiens
acaatgttgtccaacaataaa

SEQ ID NO: 5127618 - DNA, 22 bp, Homo sapiens
acaatgttgtccaacaataaac

SEQ ID NO: 5127619 - DNA, 14 bp, Homo sapiens
acaaaaaccaagtt

SEQ ID NO: 5127620 - DNA, 15 bp, Homo sapiens
acaaaaaccagcagg

SEQ ID NO: 5127621 - DNA, 21 bp, Homo sapiens
acaaaaactttccatgacagt

SEQ ID NO: 5127622 - DNA, 14 bp, Homo sapiens
acaaaaagaaagct

SEQ ID NO: 5127623 - DNA, 14 bp, Homo sapiens
acaaaaagaaatct

SEQ ID NO: 5127624 - DNA, 21 bp, Homo sapiens
acaaaaagaaatcttgtctta

SEQ ID NO: 5127625 - DNA, 16 bp, Homo sapiens
acaaaaagaaatgtca

SEQ ID NO: 5127626 - DNA, 16 bp, Homo sapiens
acaaaaagaacaaaaa

SEQ ID NO: 5127627 - DNA, 20 bp, Homo sapiens
acaaaaagaagagtttgtga

SEQ ID NO: 5127628 - DNA, 15 bp, Homo sapiens
acaaaaagcaaaaat

SEQ ID NO: 5127629 - DNA, 14 bp, Homo sapiens
acaaaaagcaatta

SEQ ID NO: 5127630 - DNA, 21 bp, Homo sapiens
acaaaaagctaacatctttac

SEQ ID NO: 5127631 - DNA, 14 bp, Homo sapiens
acaaaaagcttccc

SEQ ID NO: 5127632 - DNA, 18 bp, Homo sapiens
acaaaaaggaaatgaata

SEQ ID NO: 5127633 - DNA, 12 bp, Homo sapiens
acaaaaaggcaa

SEQ ID NO: 5127634 - DNA, 14 bp, Homo sapiens
acaaaaaggcaaat

SEQ ID NO: 5127635 - DNA, 14 bp, Homo sapiens
acaaaaaggtgcta

SEQ ID NO: 5127636 - DNA, 22 bp, Homo sapiens
acaaaaagtaatgtatatctgt

SEQ ID NO: 5127637 - DNA, 23 bp, Homo sapiens
acaaaaagtgcttcattctttgc

SEQ ID NO: 5127638 - DNA, 15 bp, Homo sapiens
acaaaaagttttttt

SEQ ID NO: 5127639 - DNA, 21 bp, Homo sapiens
acaaaaagttttttttttgtt

SEQ ID NO: 5127640 - DNA, 20 bp, Homo sapiens
acaaaaataaatttatatga

SEQ ID NO: 5127641 - DNA, 14 bp, Homo sapiens
acaaaaataacact

SEQ ID NO: 5127642 - DNA, 16 bp, Homo sapiens
acaaaaataacactgt

SEQ ID NO: 5127643 - DNA, 12 bp, Homo sapiens
acaaaaatactc

SEQ ID NO: 5127644 - DNA, 18 bp, Homo sapiens
acaaaaatactctaattc

SEQ ID NO: 5127645 - DNA, 20 bp, Homo sapiens
acaaaaatactctaattcta

SEQ ID NO: 5127646 - DNA, 14 bp, Homo sapiens
acaaaaatagagaa

SEQ ID NO: 5127647 - DNA, 13 bp, Homo sapiens
acaaaaatataaa

SEQ ID NO: 5127648 - DNA, 13 bp, Homo sapiens
acaaaaatatatt

SEQ ID NO: 5127649 - DNA, 21 bp, Homo sapiens
acaaaaatatattaaaaatat

SEQ ID NO: 5127650 - DNA, 17 bp, Homo sapiens
acaaaaatcaaagaaca

SEQ ID NO: 5127651 - DNA, 19 bp, Homo sapiens
acaaaaatgaactgaagtt

SEQ ID NO: 5127652 - DNA, 13 bp, Homo sapiens
acaaaaatgaata

SEQ ID NO: 5127653 - DNA, 14 bp, Homo sapiens
acaaaaatgactct

SEQ ID NO: 5127654 - DNA, 14 bp, Homo sapiens
acaaaaattaaaat

SEQ ID NO: 5127655 - DNA, 20 bp, Homo sapiens
acaaaaattatctatttgta

SEQ ID NO: 5127656 - DNA, 23 bp, Homo sapiens
acaaaaatttattttcttttttg

SEQ ID NO: 5127657 - DNA, 13 bp, Homo sapiens
acaaaacaaaaca

SEQ ID NO: 5127658 - DNA, 18 bp, Homo sapiens
acaaaacaaaacaaaact

SEQ ID NO: 5127659 - DNA, 14 bp, Homo sapiens
acaaaacaaaacta

SEQ ID NO: 5127660 - DNA, 16 bp, Homo sapiens
acaaaacaaacacaca

SEQ ID NO: 5127661 - DNA, 12 bp, Homo sapiens
acaaaacaaatg

SEQ ID NO: 5127662 - DNA, 12 bp, Homo sapiens
acaaaacaacaa

SEQ ID NO: 5127663 - DNA, 14 bp, Homo sapiens
acaaaacaacaaca

SEQ ID NO: 5127664 - DNA, 17 bp, Homo sapiens
acaaaacaaccctagag

SEQ ID NO: 5127665 - DNA, 15 bp, Homo sapiens
acaaaacaagaaaga

SEQ ID NO: 5127666 - DNA, 23 bp, Homo sapiens
acaaaacatttaaataaaacttt

SEQ ID NO: 5127667 - DNA, 20 bp, Homo sapiens
acaaaacattttgaaggaaa

SEQ ID NO: 5127668 - DNA, 19 bp, Homo sapiens
acaaaaccaaaagttatta

SEQ ID NO: 5127669 - DNA, 22 bp, Homo sapiens
acaaaaccacagtgtaccatta

SEQ ID NO: 5127670 - DNA, 15 bp, Homo sapiens
acaaaaccagctgct

SEQ ID NO: 5127671 - DNA, 21 bp, Homo sapiens
acaaaaccagctgctactcat

SEQ ID NO: 5127672 - DNA, 18 bp, Homo sapiens
acaaaaccgtttagtcat

SEQ ID NO: 5127673 - DNA, 16 bp, Homo sapiens
acaaaacctaacttgc

SEQ ID NO: 5127674 - DNA, 18 bp, Homo sapiens
acaaaacctatttttcct

SEQ ID NO: 5127675 - DNA, 18 bp, Homo sapiens
acaaaaccttgtgtaaga

SEQ ID NO: 5127676 - DNA, 16 bp, Homo sapiens
acaaaacgcgcagatg

SEQ ID NO: 5127677 - DNA, 15 bp, Homo sapiens
acaaaactacatgag

SEQ ID NO: 5127678 - DNA, 17 bp, Homo sapiens
acaaaactacatgagaa

SEQ ID NO: 5127679 - DNA, 14 bp, Homo sapiens
acaaaactatactt

SEQ ID NO: 5127680 - DNA, 16 bp, Homo sapiens
acaaaactatacttga

SEQ ID NO: 5127681 - DNA, 18 bp, Homo sapiens
acaaaactctgtcaggca

SEQ ID NO: 5127682 - DNA, 16 bp, Homo sapiens
acaaaactgcatttca

SEQ ID NO: 5127683 - DNA, 12 bp, Homo sapiens
acaaaactgtaa

SEQ ID NO: 5127684 - DNA, 22 bp, Homo sapiens
acaaaactgtaaataaaatgtg

SEQ ID NO: 5127685 - DNA, 14 bp, Homo sapiens
acaaaactgtaact

SEQ ID NO: 5127686 - DNA, 21 bp, Homo sapiens
acaaaacttaaaagtattcat

SEQ ID NO: 5127687 - DNA, 16 bp, Homo sapiens
acaaaacttataattt

SEQ ID NO: 5127688 - DNA, 11 bp, Homo sapiens
acaaaacttcc

SEQ ID NO: 5127689 - DNA, 11 bp, Homo sapiens
acaaaacttct

SEQ ID NO: 5127690 - DNA, 17 bp, Homo sapiens
acaaaacttcttgtcag

SEQ ID NO: 5127691 - DNA, 12 bp, Homo sapiens
acaaaagaaaaa

SEQ ID NO: 5127692 - DNA, 16 bp, Homo sapiens
acaaaagaaatacctt

SEQ ID NO: 5127693 - DNA, 21 bp, Homo sapiens
acaaaagaactaagaggccca

SEQ ID NO: 5127694 - DNA, 20 bp, Homo sapiens
acaaaagaagcccggctcct

SEQ ID NO: 5127695 - DNA, 20 bp, Homo sapiens
acaaaagaaggtcaaactgt

SEQ ID NO: 5127696 - DNA, 21 bp, Homo sapiens
acaaaagaataacattttcta

SEQ ID NO: 5127697 - DNA, 16 bp, Homo sapiens
acaaaagaataagaca

SEQ ID NO: 5127698 - DNA, 21 bp, Homo sapiens
acaaaagaataagacaagaga

SEQ ID NO: 5127699 - DNA, 16 bp, Homo sapiens
acaaaagaatttttgt

SEQ ID NO: 5127700 - DNA, 21 bp, Homo sapiens
acaaaagagcatggatgcatt

SEQ ID NO: 5127701 - DNA, 17 bp, Homo sapiens
acaaaagatatgaagaa

SEQ ID NO: 5127702 - DNA, 15 bp, Homo sapiens
acaaaagcaaaattt

SEQ ID NO: 5127703 - DNA, 18 bp, Homo sapiens
acaaaagcaaagtgaagt

SEQ ID NO: 5127704 - DNA, 11 bp, Homo sapiens
acaaaagcaat

SEQ ID NO: 5127705 - DNA, 18 bp, Homo sapiens
acaaaagcagccctctgc

SEQ ID NO: 5127706 - DNA, 15 bp, Homo sapiens
acaaaagcagctttt

SEQ ID NO: 5127707 - DNA, 16 bp, Homo sapiens
acaaaagcagctttta

SEQ ID NO: 5127708 - DNA, 21 bp, Homo sapiens
acaaaagcattcggagggagg

SEQ ID NO: 5127709 - DNA, 21 bp, Homo sapiens
acaaaagcccgcttgctcgct

SEQ ID NO: 5127710 - DNA, 18 bp, Homo sapiens
acaaaagcttgtgtatct

SEQ ID NO: 5127711 - DNA, 21 bp, Homo sapiens
acaaaaggaatgtgtaagtct

SEQ ID NO: 5127712 - DNA, 19 bp, Homo sapiens
acaaaaggctccatatata

SEQ ID NO: 5127713 - DNA, 14 bp, Homo sapiens
acaaaagggccagg

SEQ ID NO: 5127714 - DNA, 23 bp, Homo sapiens
acaaaagggctctataatgatta

SEQ ID NO: 5127715 - DNA, 14 bp, Homo sapiens
acaaaagggtcaga

SEQ ID NO: 5127716 - DNA, 22 bp, Homo sapiens
acaaaagtacattgcttaaaat

SEQ ID NO: 5127717 - DNA, 23 bp, Homo sapiens
acaaaagtctcaatgttccattc

SEQ ID NO: 5127718 - DNA, 22 bp, Homo sapiens
acaaaagtgaaccatctcagac

SEQ ID NO: 5127719 - DNA, 15 bp, Homo sapiens
acaaaagtgacagat

SEQ ID NO: 5127720 - DNA, 22 bp, Homo sapiens
acaaaagtgtacctgtaaatgt

SEQ ID NO: 5127721 - DNA, 20 bp, Homo sapiens
acaaaagttctgcgtaatga

SEQ ID NO: 5127722 - DNA, 15 bp, Homo sapiens
acaaaagtttcacaa

SEQ ID NO: 5127723 - DNA, 22 bp, Homo sapiens
acaaaagtttcatccttttcat

SEQ ID NO: 5127724 - DNA, 13 bp, Homo sapiens
acaaaataaattg

SEQ ID NO: 5127725 - DNA, 12 bp, Homo sapiens
acaaaataacat

SEQ ID NO: 5127726 - DNA, 15 bp, Homo sapiens
acaaaatacaaaaaa

SEQ ID NO: 5127727 - DNA, 13 bp, Homo sapiens
acaaaatacacat

SEQ ID NO: 5127728 - DNA, 16 bp, Homo sapiens
acaaaatacacattct

SEQ ID NO: 5127729 - DNA, 14 bp, Homo sapiens
acaaaatacattct

SEQ ID NO: 5127730 - DNA, 14 bp, Homo sapiens
acaaaatagaaagt

SEQ ID NO: 5127731 - DNA, 19 bp, Homo sapiens
acaaaatagcacatccacc

SEQ ID NO: 5127732 - DNA, 14 bp, Homo sapiens
acaaaatagttgta

SEQ ID NO: 5127733 - DNA, 11 bp, Homo sapiens
acaaaatataa

SEQ ID NO: 5127734 - DNA, 22 bp, Homo sapiens
acaaaatataaagcatctaaac

SEQ ID NO: 5127735 - DNA, 14 bp, Homo sapiens
acaaaatatttaag

SEQ ID NO: 5127736 - DNA, 15 bp, Homo sapiens
acaaaatatttaatt

SEQ ID NO: 5127737 - DNA, 13 bp, Homo sapiens
acaaaatatttct

SEQ ID NO: 5127738 - DNA, 23 bp, Homo sapiens
acaaaatcacaagcaataattag

SEQ ID NO: 5127739 - DNA, 14 bp, Homo sapiens
acaaaatccaactc

SEQ ID NO: 5127740 - DNA, 19 bp, Homo sapiens
acaaaatccatgtgaccat

SEQ ID NO: 5127741 - DNA, 22 bp, Homo sapiens
acaaaatccattccaggtagct

SEQ ID NO: 5127742 - DNA, 18 bp, Homo sapiens
acaaaatctaaaacaaaa

SEQ ID NO: 5127743 - DNA, 14 bp, Homo sapiens
acaaaatctcctct

SEQ ID NO: 5127744 - DNA, 14 bp, Homo sapiens
acaaaatctgaact

SEQ ID NO: 5127745 - DNA, 23 bp, Homo sapiens
acaaaatctgaactctcaaaagt

SEQ ID NO: 5127746 - DNA, 23 bp, Homo sapiens
acaaaatcttgtaggtcattgca

SEQ ID NO: 5127747 - DNA, 11 bp, Homo sapiens
acaaaatgaaa

SEQ ID NO: 5127748 - DNA, 22 bp, Homo sapiens
acaaaatgaaacgcaaccacca

SEQ ID NO: 5127749 - DNA, 14 bp, Homo sapiens
acaaaatgaaagaa

SEQ ID NO: 5127750 - DNA, 11 bp, Homo sapiens
acaaaatgaat

SEQ ID NO: 5127751 - DNA, 16 bp, Homo sapiens
acaaaatgaattgcct

SEQ ID NO: 5127752 - DNA, 17 bp, Homo sapiens
acaaaatgaattgcctt

SEQ ID NO: 5127753 - DNA, 19 bp, Homo sapiens
acaaaatgaattgcctttg

SEQ ID NO: 5127754 - DNA, 12 bp, Homo sapiens
acaaaatgactg

SEQ ID NO: 5127755 - DNA, 15 bp, Homo sapiens
acaaaatgattgtct

SEQ ID NO: 5127756 - DNA, 21 bp, Homo sapiens
acaaaatgcctttttgtttac

SEQ ID NO: 5127757 - DNA, 14 bp, Homo sapiens
acaaaatggaatac

SEQ ID NO: 5127758 - DNA, 19 bp, Homo sapiens
acaaaatggaatactctta

SEQ ID NO: 5127759 - DNA, 11 bp, Homo sapiens
acaaaatggac

SEQ ID NO: 5127760 - DNA, 22 bp, Homo sapiens
acaaaatggatacataaagact

SEQ ID NO: 5127761 - DNA, 16 bp, Homo sapiens
acaaaatggcttcagt

SEQ ID NO: 5127762 - DNA, 20 bp, Homo sapiens
acaaaatggggcagaagaga

SEQ ID NO: 5127763 - DNA, 14 bp, Homo sapiens
acaaaatgtaactg

SEQ ID NO: 5127764 - DNA, 16 bp, Homo sapiens
acaaaatgtaactgtt

SEQ ID NO: 5127765 - DNA, 20 bp, Homo sapiens
acaaaatgtcacacttgttt

SEQ ID NO: 5127766 - DNA, 23 bp, Homo sapiens
acaaaatgtcacacttgtttctt

SEQ ID NO: 5127767 - DNA, 21 bp, Homo sapiens
acaaaatgtgtgcttggaaaa

SEQ ID NO: 5127768 - DNA, 11 bp, Homo sapiens
acaaaatgtta

SEQ ID NO: 5127769 - DNA, 19 bp, Homo sapiens
acaaaattaaaaaaaattg

SEQ ID NO: 5127770 - DNA, 14 bp, Homo sapiens
acaaaattataaag

SEQ ID NO: 5127771 - DNA, 18 bp, Homo sapiens
acaaaattcaaagcatgg

SEQ ID NO: 5127772 - DNA, 12 bp, Homo sapiens
acaaaattccag

SEQ ID NO: 5127773 - DNA, 15 bp, Homo sapiens
acaaaatttcacagt

SEQ ID NO: 5127774 - DNA, 12 bp, Homo sapiens
acaaaatttgaa

SEQ ID NO: 5127775 - DNA, 21 bp, Homo sapiens
acaaaatttgaataataaatc

SEQ ID NO: 5127776 - DNA, 16 bp, Homo sapiens
acaaaattttctcatt

SEQ ID NO: 5127777 - DNA, 13 bp, Homo sapiens
acaaaattttgtt

SEQ ID NO: 5127778 - DNA, 23 bp, Homo sapiens
acaaaattttgtttaaaactcag

SEQ ID NO: 5127779 - DNA, 10 bp, Homo sapiens
acaaacaaaa

SEQ ID NO: 5127780 - DNA, 18 bp, Homo sapiens
acaaacaaaaaaaagaac

SEQ ID NO: 5127781 - DNA, 14 bp, Homo sapiens
acaaacaaaaaact

SEQ ID NO: 5127782 - DNA, 15 bp, Homo sapiens
acaaacaaaaaatta

SEQ ID NO: 5127783 - DNA, 14 bp, Homo sapiens
acaaacaaaaattg

SEQ ID NO: 5127784 - DNA, 12 bp, Homo sapiens
acaaacaaaact

SEQ ID NO: 5127785 - DNA, 15 bp, Homo sapiens
acaaacaaaactctt

SEQ ID NO: 5127786 - DNA, 14 bp, Homo sapiens
acaaacaaaactta

SEQ ID NO: 5127787 - DNA, 19 bp, Homo sapiens
acaaacaaaatttctatta

SEQ ID NO: 5127788 - DNA, 16 bp, Homo sapiens
acaaacaaacaaacaa

SEQ ID NO: 5127789 - DNA, 11 bp, Homo sapiens
acaaacaaatc

SEQ ID NO: 5127790 - DNA, 14 bp, Homo sapiens
acaaacaaatggct

SEQ ID NO: 5127791 - DNA, 15 bp, Homo sapiens
acaaacaagggagaa

SEQ ID NO: 5127792 - DNA, 18 bp, Homo sapiens
acaaacacacctctgcca

SEQ ID NO: 5127793 - DNA, 11 bp, Homo sapiens
acaaacacatt

SEQ ID NO: 5127794 - DNA, 18 bp, Homo sapiens
acaaacacattataaagt

SEQ ID NO: 5127795 - DNA, 21 bp, Homo sapiens
acaaacaccttcttattatat

SEQ ID NO: 5127796 - DNA, 11 bp, Homo sapiens
acaaacactgc

SEQ ID NO: 5127797 - DNA, 20 bp, Homo sapiens
acaaacactgccatattgtg

SEQ ID NO: 5127798 - DNA, 14 bp, Homo sapiens
acaaacagatgctc

SEQ ID NO: 5127799 - DNA, 13 bp, Homo sapiens
acaaacagctcag

SEQ ID NO: 5127800 - DNA, 20 bp, Homo sapiens
acaaacagggctgccttctg

SEQ ID NO: 5127801 - DNA, 16 bp, Homo sapiens
acaatgttgtgtttgg

SEQ ID NO: 5127802 - DNA, 23 bp, Homo sapiens
acaatgtttgcttttcactggca

SEQ ID NO: 5127803 - DNA, 15 bp, Homo sapiens
acaatgtttttcata

SEQ ID NO: 5127804 - DNA, 17 bp, Homo sapiens
acaatgttttttatact

SEQ ID NO: 5127805 - DNA, 21 bp, Homo sapiens
acaattaaaaacctgatggaa

SEQ ID NO: 5127806 - DNA, 19 bp, Homo sapiens
acaattaaagctgttattt

SEQ ID NO: 5127807 - DNA, 13 bp, Homo sapiens
acaattaactgcc

SEQ ID NO: 5127808 - DNA, 22 bp, Homo sapiens
acaattaagttacaattacatc

SEQ ID NO: 5127809 - DNA, 20 bp, Homo sapiens
acaattaattatcttttcaa

SEQ ID NO: 5127810 - DNA, 14 bp, Homo sapiens
acaattacatgtaa

SEQ ID NO: 5127811 - DNA, 14 bp, Homo sapiens
acaattactaaatt

SEQ ID NO: 5127812 - DNA, 15 bp, Homo sapiens
acaattactcaggtt

SEQ ID NO: 5127813 - DNA, 15 bp, Homo sapiens
acaattactgtacac

SEQ ID NO: 5127814 - DNA, 14 bp, Homo sapiens
acaattactgtgag

SEQ ID NO: 5127815 - DNA, 20 bp, Homo sapiens
acaattactgtgagaactgt

SEQ ID NO: 5127816 - DNA, 19 bp, Homo sapiens
acaattagaggaatttaaa

SEQ ID NO: 5127817 - DNA, 13 bp, Homo sapiens
acaattagatttc

SEQ ID NO: 5127818 - DNA, 15 bp, Homo sapiens
acaattagcagaatg

SEQ ID NO: 5127819 - DNA, 16 bp, Homo sapiens
acaattaggcttcatt

SEQ ID NO: 5127820 - DNA, 13 bp, Homo sapiens
acaattaggtctg

SEQ ID NO: 5127821 - DNA, 20 bp, Homo sapiens
acaattaggtctgcattttc

SEQ ID NO: 5127822 - DNA, 12 bp, Homo sapiens
acaattataaac

SEQ ID NO: 5127823 - DNA, 16 bp, Homo sapiens
acaattatgaaaaaat

SEQ ID NO: 5127824 - DNA, 17 bp, Homo sapiens
acaattatggaaatata

SEQ ID NO: 5127825 - DNA, 17 bp, Homo sapiens
acaattatgtctcttga

SEQ ID NO: 5127826 - DNA, 20 bp, Homo sapiens
acaattatgtctcttgagca

SEQ ID NO: 5127827 - DNA, 21 bp, Homo sapiens
acaattattccaaaccaaatt

SEQ ID NO: 5127828 - DNA, 19 bp, Homo sapiens
acaattattggcaaagttt

SEQ ID NO: 5127829 - DNA, 18 bp, Homo sapiens
acaattattgtacactaa

SEQ ID NO: 5127830 - DNA, 18 bp, Homo sapiens
acaattattttaatattg

SEQ ID NO: 5127831 - DNA, 19 bp, Homo sapiens
acaattatttttgctctgc

SEQ ID NO: 5127832 - DNA, 20 bp, Homo sapiens
acaattcaagctgagaaaag

SEQ ID NO: 5127833 - DNA, 13 bp, Homo sapiens
acaattcagtggt

SEQ ID NO: 5127834 - DNA, 15 bp, Homo sapiens
acaattcagttttag

SEQ ID NO: 5127835 - DNA, 15 bp, Homo sapiens
acaattcatgaactt

SEQ ID NO: 5127836 - DNA, 22 bp, Homo sapiens
acaattcattgttaaaaaacaa

SEQ ID NO: 5127837 - DNA, 14 bp, Homo sapiens
acaattccatttcc

SEQ ID NO: 5127838 - DNA, 19 bp, Homo sapiens
acaattcccgggcccttca

SEQ ID NO: 5127839 - DNA, 16 bp, Homo sapiens
acaattccctgctgtc

SEQ ID NO: 5127840 - DNA, 21 bp, Homo sapiens
acaattcccttctttttcatc

SEQ ID NO: 5127841 - DNA, 20 bp, Homo sapiens
acaattcctccagagacact

SEQ ID NO: 5127842 - DNA, 23 bp, Homo sapiens
acaattcctccagagacactgag

SEQ ID NO: 5127843 - DNA, 17 bp, Homo sapiens
acaattcctctgataat

SEQ ID NO: 5127844 - DNA, 13 bp, Homo sapiens
acaattcctgtaa

SEQ ID NO: 5127845 - DNA, 12 bp, Homo sapiens
acaattctaaaa

SEQ ID NO: 5127846 - DNA, 17 bp, Homo sapiens
acaattctaatggtaac

SEQ ID NO: 5127847 - DNA, 24 bp, Homo sapiens
acaattctaggatgaacaatgtat

SEQ ID NO: 5127848 - DNA, 21 bp, Homo sapiens
acaattctcccgggactctgc

SEQ ID NO: 5127849 - DNA, 14 bp, Homo sapiens
acaattctgcatgt

SEQ ID NO: 5127850 - DNA, 14 bp, Homo sapiens
acaattctgggtgc

SEQ ID NO: 5127851 - DNA, 13 bp, Homo sapiens
acaattctgtccc

SEQ ID NO: 5127852 - DNA, 22 bp, Homo sapiens
acaattctgttttaggttaaaa

SEQ ID NO: 5127853 - DNA, 15 bp, Homo sapiens
acaattcttgaattc

SEQ ID NO: 5127854 - DNA, 14 bp, Homo sapiens
acaattctttatac

SEQ ID NO: 5127855 - DNA, 15 bp, Homo sapiens
acaattctttataca

SEQ ID NO: 5127856 - DNA, 17 bp, Homo sapiens
acaattctttatacaac

SEQ ID NO: 5127857 - DNA, 12 bp, Homo sapiens
acaattctttgt

SEQ ID NO: 5127858 - DNA, 19 bp, Homo sapiens
acaattcttttgaaagatg

SEQ ID NO: 5127859 - DNA, 22 bp, Homo sapiens
acaattgaaatttttaaatcat

SEQ ID NO: 5127860 - DNA, 15 bp, Homo sapiens
acaattgaacttcca

SEQ ID NO: 5127861 - DNA, 21 bp, Homo sapiens
acaattgaacttccaggaaag

SEQ ID NO: 5127862 - DNA, 19 bp, Homo sapiens
acaattgaagtaaactttt

SEQ ID NO: 5127863 - DNA, 22 bp, Homo sapiens
acaattgaagtaaactttttgt

SEQ ID NO: 5127864 - DNA, 15 bp, Homo sapiens
acaattgatctcttt

SEQ ID NO: 5127865 - DNA, 24 bp, Homo sapiens
acaattgatctgtcatccatattt

SEQ ID NO: 5127866 - DNA, 16 bp, Homo sapiens
acaattgatctttttt

SEQ ID NO: 5127867 - DNA, 21 bp, Homo sapiens
acaattgattttccccctaat

SEQ ID NO: 5127868 - DNA, 13 bp, Homo sapiens
acaattgggagct

SEQ ID NO: 5127869 - DNA, 19 bp, Homo sapiens
acaattggtgtcattttct

SEQ ID NO: 5127870 - DNA, 22 bp, Homo sapiens
acaattggtgtcattttcttga

SEQ ID NO: 5127871 - DNA, 19 bp, Homo sapiens
acaattggttgtatataaa

SEQ ID NO: 5127872 - DNA, 13 bp, Homo sapiens
acaattgtaattg

SEQ ID NO: 5127873 - DNA, 21 bp, Homo sapiens
acaattgtcgaaaagagtctt

SEQ ID NO: 5127874 - DNA, 21 bp, Homo sapiens
acaattgtcttaaaaccagag

SEQ ID NO: 5127875 - DNA, 15 bp, Homo sapiens
acaattgtgaacatg

SEQ ID NO: 5127876 - DNA, 17 bp, Homo sapiens
acaattgtgaacatgat

SEQ ID NO: 5127877 - DNA, 14 bp, Homo sapiens
acaattgtgtagcc

SEQ ID NO: 5127878 - DNA, 16 bp, Homo sapiens
acaattgtgtagcctt

SEQ ID NO: 5127879 - DNA, 24 bp, Homo sapiens
acaattgtgtataactggattgca

SEQ ID NO: 5127880 - DNA, 12 bp, Homo sapiens
acaattgtgttt

SEQ ID NO: 5127881 - DNA, 22 bp, Homo sapiens
acaatttaaaacaatccttact

SEQ ID NO: 5127882 - DNA, 20 bp, Homo sapiens
acaatttaaagcaaaggagt

SEQ ID NO: 5127883 - DNA, 22 bp, Homo sapiens
acaatttacttttaataaagta

SEQ ID NO: 5127884 - DNA, 23 bp, Homo sapiens
acaatttagaaaacattcatcca

SEQ ID NO: 5127885 - DNA, 17 bp, Homo sapiens
acaatttagcaggtaga

SEQ ID NO: 5127886 - DNA, 16 bp, Homo sapiens
acaatttatactgcga

SEQ ID NO: 5127887 - DNA, 12 bp, Homo sapiens
acaatttatatt

SEQ ID NO: 5127888 - DNA, 18 bp, Homo sapiens
acaatttatgaattgaat

SEQ ID NO: 5127889 - DNA, 14 bp, Homo sapiens
acaatttattatgg

SEQ ID NO: 5127890 - DNA, 12 bp, Homo sapiens
acaatttatttt

SEQ ID NO: 5127891 - DNA, 20 bp, Homo sapiens
acaatttcaaaaaaataaaa

SEQ ID NO: 5127892 - DNA, 13 bp, Homo sapiens
acaatttcaaaag

SEQ ID NO: 5127893 - DNA, 18 bp, Homo sapiens
acaatttcaaaatgcatg

SEQ ID NO: 5127894 - DNA, 11 bp, Homo sapiens
acaatttcaac

SEQ ID NO: 5127895 - DNA, 17 bp, Homo sapiens
acaatttcaatgcttct

SEQ ID NO: 5127896 - DNA, 18 bp, Homo sapiens
acaatttcaatgcttctt

SEQ ID NO: 5127897 - DNA, 15 bp, Homo sapiens
acaatttcatcctcc

SEQ ID NO: 5127898 - DNA, 23 bp, Homo sapiens
acaatttccatatagtctattca

SEQ ID NO: 5127899 - DNA, 17 bp, Homo sapiens
acaatttcctttatatt

SEQ ID NO: 5127900 - DNA, 23 bp, Homo sapiens
acaatttcctttatatttagtga

SEQ ID NO: 5127901 - DNA, 21 bp, Homo sapiens
acaatttctattatttttcaa

SEQ ID NO: 5127902 - DNA, 22 bp, Homo sapiens
acaatttctattatttttcaag

SEQ ID NO: 5127903 - DNA, 14 bp, Homo sapiens
acaatttctctggg

SEQ ID NO: 5127904 - DNA, 14 bp, Homo sapiens
acaatttctttaaa

SEQ ID NO: 5127905 - DNA, 21 bp, Homo sapiens
acaatttctttaaaaaagaaa

SEQ ID NO: 5127906 - DNA, 19 bp, Homo sapiens
acaatttgagactgaaatt

SEQ ID NO: 5127907 - DNA, 19 bp, Homo sapiens
acaatttgagcaattcatt

SEQ ID NO: 5127908 - DNA, 14 bp, Homo sapiens
acaatttgatacat

SEQ ID NO: 5127909 - DNA, 15 bp, Homo sapiens
acaatttgcacaata

SEQ ID NO: 5127910 - DNA, 21 bp, Homo sapiens
acaatttgcacaatatttctt

SEQ ID NO: 5127911 - DNA, 17 bp, Homo sapiens
acaatttgcataatact

SEQ ID NO: 5127912 - DNA, 13 bp, Homo sapiens
acaatttgccata

SEQ ID NO: 5127913 - DNA, 23 bp, Homo sapiens
acaatttgggcttcctgtttgta

SEQ ID NO: 5127914 - DNA, 19 bp, Homo sapiens
acaatttgtacttttttct

SEQ ID NO: 5127915 - DNA, 22 bp, Homo sapiens
acaatttgtacttttttcttaa

SEQ ID NO: 5127916 - DNA, 16 bp, Homo sapiens
acaatttgttaattcc

SEQ ID NO: 5127917 - DNA, 18 bp, Homo sapiens
acaatttgtttttgcatt

SEQ ID NO: 5127918 - DNA, 23 bp, Homo sapiens
acaatttgtttttgcatttttgt

SEQ ID NO: 5127919 - DNA, 17 bp, Homo sapiens
acaattttaaagttctt

SEQ ID NO: 5127920 - DNA, 14 bp, Homo sapiens
acaattttaaataa

SEQ ID NO: 5127921 - DNA, 12 bp, Homo sapiens
acaattttaaga

SEQ ID NO: 5127922 - DNA, 23 bp, Homo sapiens
acaattttaatgatggtgttaaa

SEQ ID NO: 5127923 - DNA, 17 bp, Homo sapiens
acaattttacctattct

SEQ ID NO: 5127924 - DNA, 19 bp, Homo sapiens
acaattttacctattctga

SEQ ID NO: 5127925 - DNA, 14 bp, Homo sapiens
acaattttcagatt

SEQ ID NO: 5127926 - DNA, 15 bp, Homo sapiens
acaattttcagattt

SEQ ID NO: 5127927 - DNA, 22 bp, Homo sapiens
acaattttcagatttgcacaaa

SEQ ID NO: 5127928 - DNA, 15 bp, Homo sapiens
acaattttcatccca

SEQ ID NO: 5127929 - DNA, 16 bp, Homo sapiens
acaattttcatcccac

SEQ ID NO: 5127930 - DNA, 18 bp, Homo sapiens
acaattttctaccactgg

SEQ ID NO: 5127931 - DNA, 12 bp, Homo sapiens
acaattttctgt

SEQ ID NO: 5127932 - DNA, 15 bp, Homo sapiens
acaattttctgtaag

SEQ ID NO: 5127933 - DNA, 21 bp, Homo sapiens
acaattttctgtaatctttta

SEQ ID NO: 5127934 - DNA, 12 bp, Homo sapiens
acaattttgtcc

SEQ ID NO: 5127935 - DNA, 20 bp, Homo sapiens
acaattttgtcctaatatat

SEQ ID NO: 5127936 - DNA, 22 bp, Homo sapiens
acaattttgtcttaagtgtttc

SEQ ID NO: 5127937 - DNA, 14 bp, Homo sapiens
acaatttttaatgg

SEQ ID NO: 5127938 - DNA, 15 bp, Homo sapiens
acaatttttaatggc

SEQ ID NO: 5127939 - DNA, 14 bp, Homo sapiens
acaatttttgatca

SEQ ID NO: 5127940 - DNA, 21 bp, Homo sapiens
acaatttttgctgttttcagc

SEQ ID NO: 5127941 - DNA, 18 bp, Homo sapiens
acaattttttgtgatgaa

SEQ ID NO: 5127942 - DNA, 21 bp, Homo sapiens
acaattttttgtgatgaaaag

SEQ ID NO: 5127943 - DNA, 18 bp, Homo sapiens
acaatttttttaattttg

SEQ ID NO: 5127944 - DNA, 17 bp, Homo sapiens
acaattttttttttcct

SEQ ID NO: 5127945 - DNA, 13 bp, Homo sapiens
acacaaaaagaaa

SEQ ID NO: 5127946 - DNA, 16 bp, Homo sapiens
acacaaaaagaaagct

SEQ ID NO: 5127947 - DNA, 22 bp, Homo sapiens
acacaaaaaggagcgggcaggg

SEQ ID NO: 5127948 - DNA, 13 bp, Homo sapiens
acacaaaacaaca

SEQ ID NO: 5127949 - DNA, 17 bp, Homo sapiens
acacaaaacaacagcaa

SEQ ID NO: 5127950 - DNA, 13 bp, Homo sapiens
acacaaaacattt

SEQ ID NO: 5127951 - DNA, 16 bp, Homo sapiens
acacaaaactccgccc

SEQ ID NO: 5127952 - DNA, 21 bp, Homo sapiens
acacaaaactccgcccccagc

SEQ ID NO: 5127953 - DNA, 15 bp, Homo sapiens
acacaaaagaagaaa

SEQ ID NO: 5127954 - DNA, 19 bp, Homo sapiens
acacaaaagtttctctttt

SEQ ID NO: 5127955 - DNA, 18 bp, Homo sapiens
acacaaacctaaaaattt

SEQ ID NO: 5127956 - DNA, 16 bp, Homo sapiens
acacaaacctgcctgg

SEQ ID NO: 5127957 - DNA, 21 bp, Homo sapiens
acacaaactatggtgtgctta

SEQ ID NO: 5127958 - DNA, 19 bp, Homo sapiens
acacaaactgtaaataaaa

SEQ ID NO: 5127959 - DNA, 12 bp, Homo sapiens
acacaaagacca

SEQ ID NO: 5127960 - DNA, 12 bp, Homo sapiens
acacaaagagag

SEQ ID NO: 5127961 - DNA, 17 bp, Homo sapiens
acacaaagagatattta

SEQ ID NO: 5127962 - DNA, 16 bp, Homo sapiens
acacaaaggcatgctg

SEQ ID NO: 5127963 - DNA, 18 bp, Homo sapiens
acacaaaggcatgctgga

SEQ ID NO: 5127964 - DNA, 18 bp, Homo sapiens
acacaaataccagagcac

SEQ ID NO: 5127965 - DNA, 20 bp, Homo sapiens
acacaaatacggaagtaaac

SEQ ID NO: 5127966 - DNA, 19 bp, Homo sapiens
acacaaatattgcttggac

SEQ ID NO: 5127967 - DNA, 17 bp, Homo sapiens
acacaaatgcagacaca

SEQ ID NO: 5127968 - DNA, 21 bp, Homo sapiens
acacaaatggggtccaggtca

SEQ ID NO: 5127969 - DNA, 20 bp, Homo sapiens
acacaaatgtgatttttgta

SEQ ID NO: 5127970 - DNA, 18 bp, Homo sapiens
acacaaatgtgtattttt

SEQ ID NO: 5127971 - DNA, 12 bp, Homo sapiens
acacaaattttc

SEQ ID NO: 5127972 - DNA, 14 bp, Homo sapiens
acacaacaaaaatg

SEQ ID NO: 5127973 - DNA, 15 bp, Homo sapiens
acacaacaagaaact

SEQ ID NO: 5127974 - DNA, 14 bp, Homo sapiens
acacaacaccagga

SEQ ID NO: 5127975 - DNA, 15 bp, Homo sapiens
acacaacaccaggac

SEQ ID NO: 5127976 - DNA, 21 bp, Homo sapiens
acacaacagcagtctccttca

SEQ ID NO: 5127977 - DNA, 13 bp, Homo sapiens
acacaacatttgt

SEQ ID NO: 5127978 - DNA, 19 bp, Homo sapiens
acacaacgattatagtaac

SEQ ID NO: 5127979 - DNA, 13 bp, Homo sapiens
acacaactcactc

SEQ ID NO: 5127980 - DNA, 17 bp, Homo sapiens
acaaacagtgaatttaa

SEQ ID NO: 5127981 - DNA, 17 bp, Homo sapiens
acaaacatacccatctg

SEQ ID NO: 5127982 - DNA, 16 bp, Homo sapiens
acaaacatagacagat

SEQ ID NO: 5127983 - DNA, 19 bp, Homo sapiens
acaaacatatttgttaaat

SEQ ID NO: 5127984 - DNA, 11 bp, Homo sapiens
acaaacatgaa

SEQ ID NO: 5127985 - DNA, 15 bp, Homo sapiens
acaaacattgctgcc

SEQ ID NO: 5127986 - DNA, 13 bp, Homo sapiens
acaaacattgtgt

SEQ ID NO: 5127987 - DNA, 20 bp, Homo sapiens
acaaacattgtgttgacatt

SEQ ID NO: 5127988 - DNA, 11 bp, Homo sapiens
acaaacatttt

SEQ ID NO: 5127989 - DNA, 17 bp, Homo sapiens
acaaacatttttcaaca

SEQ ID NO: 5127990 - DNA, 23 bp, Homo sapiens
acaaaccaagagcttttacagat

SEQ ID NO: 5127991 - DNA, 15 bp, Homo sapiens
acaaaccacaactga

SEQ ID NO: 5127992 - DNA, 14 bp, Homo sapiens
acaaaccacagcag

SEQ ID NO: 5127993 - DNA, 22 bp, Homo sapiens
acaaaccaccctaaaatgacag

SEQ ID NO: 5127994 - DNA, 23 bp, Homo sapiens
acaaaccaccctaaaatgacagc

SEQ ID NO: 5127995 - DNA, 16 bp, Homo sapiens
acaaaccactgtacat

SEQ ID NO: 5127996 - DNA, 18 bp, Homo sapiens
acaaaccactgtacatat

SEQ ID NO: 5127997 - DNA, 20 bp, Homo sapiens
acaaaccagcaacttttctc

SEQ ID NO: 5127998 - DNA, 16 bp, Homo sapiens
acaaaccagcctgggg

SEQ ID NO: 5127999 - DNA, 20 bp, Homo sapiens
acaaaccatctggtgccttt

SEQ ID NO: 5128000 - DNA, 23 bp, Homo sapiens
acaaaccattttattttttgggc

SEQ ID NO: 5128001 - DNA, 21 bp, Homo sapiens
acaaaccgagtgcaatgaatg

SEQ ID NO: 5128002 - DNA, 18 bp, Homo sapiens
acaaacctaccaaaatgg

SEQ ID NO: 5128003 - DNA, 21 bp, Homo sapiens
acaaacctaccaaaatggaat

SEQ ID NO: 5128004 - DNA, 18 bp, Homo sapiens
acaaacctagaattttct

SEQ ID NO: 5128005 - DNA, 19 bp, Homo sapiens
acaaacctagcttttaaaa

SEQ ID NO: 5128006 - DNA, 18 bp, Homo sapiens
acaaacctctatatgttg

SEQ ID NO: 5128007 - DNA, 22 bp, Homo sapiens
acaaacctctatatgttgctga

SEQ ID NO: 5128008 - DNA, 23 bp, Homo sapiens
acaaacctgaaaagatgttgtgt

SEQ ID NO: 5128009 - DNA, 17 bp, Homo sapiens
acaaacctgcatggtgt

SEQ ID NO: 5128010 - DNA, 12 bp, Homo sapiens
acaaacctgcct

SEQ ID NO: 5128011 - DNA, 14 bp, Homo sapiens
acaaacctgcttgt

SEQ ID NO: 5128012 - DNA, 21 bp, Homo sapiens
acaaacctgtttctgcagcca

SEQ ID NO: 5128013 - DNA, 24 bp, Homo sapiens
acaaaccttcttttcaatgcaatg

SEQ ID NO: 5128014 - DNA, 21 bp, Homo sapiens
acaaacggagcccctgaaagc

SEQ ID NO: 5128015 - DNA, 15 bp, Homo sapiens
acaaacgtccccagc

SEQ ID NO: 5128016 - DNA, 13 bp, Homo sapiens
acaaacgtttgac

SEQ ID NO: 5128017 - DNA, 16 bp, Homo sapiens
acaaacgtttgacaaa

SEQ ID NO: 5128018 - DNA, 15 bp, Homo sapiens
acaaactaaaaatat

SEQ ID NO: 5128019 - DNA, 13 bp, Homo sapiens
acaaactaaactt

SEQ ID NO: 5128020 - DNA, 16 bp, Homo sapiens
acaaactacatgtaat

SEQ ID NO: 5128021 - DNA, 17 bp, Homo sapiens
acaaactacctctggac

SEQ ID NO: 5128022 - DNA, 23 bp, Homo sapiens
acaaactacttgattttattgta

SEQ ID NO: 5128023 - DNA, 23 bp, Homo sapiens
acaaactatttcagaatattttg

SEQ ID NO: 5128024 - DNA, 15 bp, Homo sapiens
acaaactcaaaatct

SEQ ID NO: 5128025 - DNA, 19 bp, Homo sapiens
acaaactcaaaatctggga

SEQ ID NO: 5128026 - DNA, 12 bp, Homo sapiens
acaaactccagg

SEQ ID NO: 5128027 - DNA, 16 bp, Homo sapiens
acaaactctcaccatg

SEQ ID NO: 5128028 - DNA, 15 bp, Homo sapiens
acaaactctctgaac

SEQ ID NO: 5128029 - DNA, 22 bp, Homo sapiens
acaaactctctgaacccctccc

SEQ ID NO: 5128030 - DNA, 13 bp, Homo sapiens
acaaactcttgaa

SEQ ID NO: 5128031 - DNA, 22 bp, Homo sapiens
acaaactcttttttaaaaatta

SEQ ID NO: 5128032 - DNA, 16 bp, Homo sapiens
acaaactgatttctca

SEQ ID NO: 5128033 - DNA, 19 bp, Homo sapiens
acaaactgcaatagagact

SEQ ID NO: 5128034 - DNA, 14 bp, Homo sapiens
acaaactgcacatg

SEQ ID NO: 5128035 - DNA, 20 bp, Homo sapiens
acaaactgcacatgatttca

SEQ ID NO: 5128036 - DNA, 22 bp, Homo sapiens
acaaactgcaccagttgctgct

SEQ ID NO: 5128037 - DNA, 21 bp, Homo sapiens
acaaactgcttcctttcttga

SEQ ID NO: 5128038 - DNA, 16 bp, Homo sapiens
acaaactgtaatacaa

SEQ ID NO: 5128039 - DNA, 14 bp, Homo sapiens
acaaactgtcgtct

SEQ ID NO: 5128040 - DNA, 19 bp, Homo sapiens
acaaactgtgaaaatagtg

SEQ ID NO: 5128041 - DNA, 20 bp, Homo sapiens
acaaactgtgaaaatagtgt

SEQ ID NO: 5128042 - DNA, 21 bp, Homo sapiens
acaaactgtgaaaatagtgta

SEQ ID NO: 5128043 - DNA, 12 bp, Homo sapiens
acaaacttccaa

SEQ ID NO: 5128044 - DNA, 13 bp, Homo sapiens
acaaactttgttt

SEQ ID NO: 5128045 - DNA, 14 bp, Homo sapiens
acaaacttttaaga

SEQ ID NO: 5128046 - DNA, 12 bp, Homo sapiens
acaaacttttat

SEQ ID NO: 5128047 - DNA, 13 bp, Homo sapiens
acaaacttttata

SEQ ID NO: 5128048 - DNA, 14 bp, Homo sapiens
acaaacttttataa

SEQ ID NO: 5128049 - DNA, 18 bp, Homo sapiens
acaaacttttcaaggctt

SEQ ID NO: 5128050 - DNA, 15 bp, Homo sapiens
acaaagaaaaaaaat

SEQ ID NO: 5128051 - DNA, 17 bp, Homo sapiens
acaaagaaaaaaatata

SEQ ID NO: 5128052 - DNA, 15 bp, Homo sapiens
acaaagaaaaattaa

SEQ ID NO: 5128053 - DNA, 14 bp, Homo sapiens
acaaagaaaatgtt

SEQ ID NO: 5128054 - DNA, 12 bp, Homo sapiens
acaaagaaacaa

SEQ ID NO: 5128055 - DNA, 20 bp, Homo sapiens
acaaagaaacaaagatgtta

SEQ ID NO: 5128056 - DNA, 19 bp, Homo sapiens
acaaagaaacattttacgc

SEQ ID NO: 5128057 - DNA, 23 bp, Homo sapiens
acaaagaaaggtgccatgtcttt

SEQ ID NO: 5128058 - DNA, 23 bp, Homo sapiens
acaaagaaccatgcaggaaggaa

SEQ ID NO: 5128059 - DNA, 14 bp, Homo sapiens
acaaagaagaaagc

SEQ ID NO: 5128060 - DNA, 13 bp, Homo sapiens
acaaagaagacat

SEQ ID NO: 5128061 - DNA, 21 bp, Homo sapiens
acaaagaagacatgttttaga

SEQ ID NO: 5128062 - DNA, 22 bp, Homo sapiens
acaaagaagacatgttttagac

SEQ ID NO: 5128063 - DNA, 18 bp, Homo sapiens
acaaagaaggaaaagagt

SEQ ID NO: 5128064 - DNA, 14 bp, Homo sapiens
acaaagaaggaaat

SEQ ID NO: 5128065 - DNA, 16 bp, Homo sapiens
acaaagaaggcacagg

SEQ ID NO: 5128066 - DNA, 14 bp, Homo sapiens
acaaagaattccaa

SEQ ID NO: 5128067 - DNA, 19 bp, Homo sapiens
acaaagacaaattctgttt

SEQ ID NO: 5128068 - DNA, 22 bp, Homo sapiens
acaaagacaaattctgtttctt

SEQ ID NO: 5128069 - DNA, 18 bp, Homo sapiens
acaaagacacaggaagaa

SEQ ID NO: 5128070 - DNA, 14 bp, Homo sapiens
acaaagacaggcaa

SEQ ID NO: 5128071 - DNA, 16 bp, Homo sapiens
acaaagacatggaaga

SEQ ID NO: 5128072 - DNA, 15 bp, Homo sapiens
acaaagacattgaca

SEQ ID NO: 5128073 - DNA, 17 bp, Homo sapiens
acaaagacattgacagc

SEQ ID NO: 5128074 - DNA, 19 bp, Homo sapiens
acaaagacattgacagcaa

SEQ ID NO: 5128075 - DNA, 20 bp, Homo sapiens
acaaagacattgacagcaat

SEQ ID NO: 5128076 - DNA, 21 bp, Homo sapiens
acaaagacattgacagcaatt

SEQ ID NO: 5128077 - DNA, 17 bp, Homo sapiens
acaaagaccaaaatgaa

SEQ ID NO: 5128078 - DNA, 20 bp, Homo sapiens
acaaagaccaaaatgaaagt

SEQ ID NO: 5128079 - DNA, 15 bp, Homo sapiens
acaaagaccctggct

SEQ ID NO: 5128080 - DNA, 17 bp, Homo sapiens
acaaagactcctctggg

SEQ ID NO: 5128081 - DNA, 21 bp, Homo sapiens
acaaagactcctctgggcctg

SEQ ID NO: 5128082 - DNA, 17 bp, Homo sapiens
acaaagactccttgtgg

SEQ ID NO: 5128083 - DNA, 14 bp, Homo sapiens
acaaagagaaaaag

SEQ ID NO: 5128084 - DNA, 18 bp, Homo sapiens
acaaagagaccaggggcg

SEQ ID NO: 5128085 - DNA, 15 bp, Homo sapiens
acaaagagatgtcct

SEQ ID NO: 5128086 - DNA, 20 bp, Homo sapiens
acaaagagcgttgaagttga

SEQ ID NO: 5128087 - DNA, 11 bp, Homo sapiens
acaaagagctg

SEQ ID NO: 5128088 - DNA, 19 bp, Homo sapiens
acaaagagtgaaatattgt

SEQ ID NO: 5128089 - DNA, 18 bp, Homo sapiens
acaaagagttcaagaaat

SEQ ID NO: 5128090 - DNA, 22 bp, Homo sapiens
acaaagagttcaagaaataagt

SEQ ID NO: 5128091 - DNA, 23 bp, Homo sapiens
acaaagataacgcaggagagaga

SEQ ID NO: 5128092 - DNA, 22 bp, Homo sapiens
acaaagataagacttgtttctt

SEQ ID NO: 5128093 - DNA, 21 bp, Homo sapiens
acaaagatacttgatgcactt

SEQ ID NO: 5128094 - DNA, 20 bp, Homo sapiens
acaaagatatcttttcttta

SEQ ID NO: 5128095 - DNA, 16 bp, Homo sapiens
acaaagatattattta

SEQ ID NO: 5128096 - DNA, 20 bp, Homo sapiens
acaaagatggctcagagggg

SEQ ID NO: 5128097 - DNA, 12 bp, Homo sapiens
acaaagatttct

SEQ ID NO: 5128098 - DNA, 16 bp, Homo sapiens
acaaagattttctaag

SEQ ID NO: 5128099 - DNA, 21 bp, Homo sapiens
acaaagattttctaaggaatg

SEQ ID NO: 5128100 - DNA, 13 bp, Homo sapiens
acaaagcaaaggc

SEQ ID NO: 5128101 - DNA, 15 bp, Homo sapiens
acaaagcaaaggcag

SEQ ID NO: 5128102 - DNA, 15 bp, Homo sapiens
acaaagcaattcttt

SEQ ID NO: 5128103 - DNA, 16 bp, Homo sapiens
acaaagcacaccatat

SEQ ID NO: 5128104 - DNA, 17 bp, Homo sapiens
acaaagcagctttaaaa

SEQ ID NO: 5128105 - DNA, 22 bp, Homo sapiens
acaaagcagctttaaaaaaata

SEQ ID NO: 5128106 - DNA, 23 bp, Homo sapiens
acaaagcagtatataataacttt

SEQ ID NO: 5128107 - DNA, 17 bp, Homo sapiens
acaaagcagtttttccc

SEQ ID NO: 5128108 - DNA, 19 bp, Homo sapiens
acaaagcagtttttccccc

SEQ ID NO: 5128109 - DNA, 20 bp, Homo sapiens
acaaagcatgggaaaaagag

SEQ ID NO: 5128110 - DNA, 19 bp, Homo sapiens
acaaagccaaactctgcca

SEQ ID NO: 5128111 - DNA, 16 bp, Homo sapiens
acaaagccagaagctg

SEQ ID NO: 5128112 - DNA, 20 bp, Homo sapiens
acaaagccagaagctgagca

SEQ ID NO: 5128113 - DNA, 15 bp, Homo sapiens
acaaagccagaggag

SEQ ID NO: 5128114 - DNA, 18 bp, Homo sapiens
acaaagccagctctgagc

SEQ ID NO: 5128115 - DNA, 15 bp, Homo sapiens
acaaagccattcttt

SEQ ID NO: 5128116 - DNA, 11 bp, Homo sapiens
acaaagcccaa

SEQ ID NO: 5128117 - DNA, 16 bp, Homo sapiens
acaaagccccccagct

SEQ ID NO: 5128118 - DNA, 19 bp, Homo sapiens
acaaagccccccagctccc

SEQ ID NO: 5128119 - DNA, 15 bp, Homo sapiens
acaaagcccttttat

SEQ ID NO: 5128120 - DNA, 17 bp, Homo sapiens
acaaagccttaagcaaa

SEQ ID NO: 5128121 - DNA, 18 bp, Homo sapiens
acaaagccttaagcaaat

SEQ ID NO: 5128122 - DNA, 19 bp, Homo sapiens
acaaagccttaagcaaatt

SEQ ID NO: 5128123 - DNA, 21 bp, Homo sapiens
acaaagcgtggtggacatgca

SEQ ID NO: 5128124 - DNA, 18 bp, Homo sapiens
acaaagcgtttctttact

SEQ ID NO: 5128125 - DNA, 17 bp, Homo sapiens
acaaagctatttaagtg

SEQ ID NO: 5128126 - DNA, 19 bp, Homo sapiens
acaaagctatttaagtgga

SEQ ID NO: 5128127 - DNA, 13 bp, Homo sapiens
acaaagctcaaga

SEQ ID NO: 5128128 - DNA, 19 bp, Homo sapiens
acaaagctgatttcccttt

SEQ ID NO: 5128129 - DNA, 14 bp, Homo sapiens
acaaagctgtcact

SEQ ID NO: 5128130 - DNA, 14 bp, Homo sapiens
acaaagctgttaaa

SEQ ID NO: 5128131 - DNA, 19 bp, Homo sapiens
acaaagcttagcaggagag

SEQ ID NO: 5128132 - DNA, 20 bp, Homo sapiens
acaaagcttctatcccagga

SEQ ID NO: 5128133 - DNA, 23 bp, Homo sapiens
acaaagcttggaagagcctgcag

SEQ ID NO: 5128134 - DNA, 15 bp, Homo sapiens
acaaagctttctttt

SEQ ID NO: 5128135 - DNA, 19 bp, Homo sapiens
acaaagctttcttttctaa

SEQ ID NO: 5128136 - DNA, 14 bp, Homo sapiens
acaaagctttgcta

SEQ ID NO: 5128137 - DNA, 15 bp, Homo sapiens
acaaagctttgctac

SEQ ID NO: 5128138 - DNA, 16 bp, Homo sapiens
acaaagctttgctaca

SEQ ID NO: 5128139 - DNA, 15 bp, Homo sapiens
acaaagcttttgcat

SEQ ID NO: 5128140 - DNA, 22 bp, Homo sapiens
acaaagcttttgcatattgcat

SEQ ID NO: 5128141 - DNA, 23 bp, Homo sapiens
acaaagcttttgcatattgcata

SEQ ID NO: 5128142 - DNA, 11 bp, Homo sapiens
acaaaggaaaa

SEQ ID NO: 5128143 - DNA, 16 bp, Homo sapiens
acaaaggagcctgtga

SEQ ID NO: 5128144 - DNA, 14 bp, Homo sapiens
acaaaggagccttg

SEQ ID NO: 5128145 - DNA, 12 bp, Homo sapiens
acaaaggcagct

SEQ ID NO: 5128146 - DNA, 16 bp, Homo sapiens
acaaaggcagctgtgt

SEQ ID NO: 5128147 - DNA, 23 bp, Homo sapiens
acaaaggcagctgtgtctgagcc

SEQ ID NO: 5128148 - DNA, 20 bp, Homo sapiens
acaaaggcatgttttaaaat

SEQ ID NO: 5128149 - DNA, 15 bp, Homo sapiens
acaaaggccaaactg

SEQ ID NO: 5128150 - DNA, 15 bp, Homo sapiens
acaaaggccttaaca

SEQ ID NO: 5128151 - DNA, 22 bp, Homo sapiens
acaaaggctgacattcactgag

SEQ ID NO: 5128152 - DNA, 16 bp, Homo sapiens
acaaaggctgtattca

SEQ ID NO: 5128153 - DNA, 12 bp, Homo sapiens
acaaagggaaaa

SEQ ID NO: 5128154 - DNA, 15 bp, Homo sapiens
acaaagggaaaaaag

SEQ ID NO: 5128155 - DNA, 16 bp, Homo sapiens
acaaagggaaaaaaga

SEQ ID NO: 5128156 - DNA, 18 bp, Homo sapiens
acaaagggaaagcctctg

SEQ ID NO: 5128157 - DNA, 21 bp, Homo sapiens
acaaaggggatcataaagtta

SEQ ID NO: 5128158 - DNA, 15 bp, Homo sapiens
acaaagggttttaat

SEQ ID NO: 5128159 - DNA, 20 bp, Homo sapiens
acacaactccactgtcttta

SEQ ID NO: 5128160 - DNA, 15 bp, Homo sapiens
acacaactttgcaaa

SEQ ID NO: 5128161 - DNA, 18 bp, Homo sapiens
acacaagaaaaagataag

SEQ ID NO: 5128162 - DNA, 22 bp, Homo sapiens
acacaagaagaagggcacccta

SEQ ID NO: 5128163 - DNA, 17 bp, Homo sapiens
acacaagaattacacta

SEQ ID NO: 5128164 - DNA, 19 bp, Homo sapiens
acacaagaccagtgcttag

SEQ ID NO: 5128165 - DNA, 20 bp, Homo sapiens
acacaagagggactgtattt

SEQ ID NO: 5128166 - DNA, 17 bp, Homo sapiens
acacaagattggtgttt

SEQ ID NO: 5128167 - DNA, 21 bp, Homo sapiens
acacaagattggtgttttttt

SEQ ID NO: 5128168 - DNA, 17 bp, Homo sapiens
acacaagcactttaatg

SEQ ID NO: 5128169 - DNA, 19 bp, Homo sapiens
acacaagccacagaagcca

SEQ ID NO: 5128170 - DNA, 15 bp, Homo sapiens
acacaagccacgcct

SEQ ID NO: 5128171 - DNA, 14 bp, Homo sapiens
acacaagctggaag

SEQ ID NO: 5128172 - DNA, 22 bp, Homo sapiens
acacaagcttttttacacaaat

SEQ ID NO: 5128173 - DNA, 19 bp, Homo sapiens
acacaaggccagaaaaaga

SEQ ID NO: 5128174 - DNA, 15 bp, Homo sapiens
acacaaggtgatttc

SEQ ID NO: 5128175 - DNA, 18 bp, Homo sapiens
acacaaggtgatttcaga

SEQ ID NO: 5128176 - DNA, 13 bp, Homo sapiens
acacaaggtgctc

SEQ ID NO: 5128177 - DNA, 14 bp, Homo sapiens
acacaagtaaacat

SEQ ID NO: 5128178 - DNA, 19 bp, Homo sapiens
acacaagtaagagactcag

SEQ ID NO: 5128179 - DNA, 16 bp, Homo sapiens
acacaagtagattgat

SEQ ID NO: 5128180 - DNA, 22 bp, Homo sapiens
acacaagtgcagtagtgcagtt

SEQ ID NO: 5128181 - DNA, 16 bp, Homo sapiens
acacaagttgtttggt

SEQ ID NO: 5128182 - DNA, 19 bp, Homo sapiens
acacaagtttaaaaatatt

SEQ ID NO: 5128183 - DNA, 20 bp, Homo sapiens
acacaagtttaaaaatatta

SEQ ID NO: 5128184 - DNA, 14 bp, Homo sapiens
acacaataaagcag

SEQ ID NO: 5128185 - DNA, 21 bp, Homo sapiens
acacaataagagtctccttct

SEQ ID NO: 5128186 - DNA, 22 bp, Homo sapiens
acacaataagagtctccttctc

SEQ ID NO: 5128187 - DNA, 18 bp, Homo sapiens
acacaataggtctttctc

SEQ ID NO: 5128188 - DNA, 14 bp, Homo sapiens
acacaatcagacca

SEQ ID NO: 5128189 - DNA, 16 bp, Homo sapiens
acacaatctttccttg

SEQ ID NO: 5128190 - DNA, 22 bp, Homo sapiens
acacaatgacacatttgttgca

SEQ ID NO: 5128191 - DNA, 23 bp, Homo sapiens
acacaatgacacatttgttgcac

SEQ ID NO: 5128192 - DNA, 22 bp, Homo sapiens
acacaatgctattgaaattact

SEQ ID NO: 5128193 - DNA, 21 bp, Homo sapiens
acacaatggcacctctgccct

SEQ ID NO: 5128194 - DNA, 22 bp, Homo sapiens
acacaatggcacctctgccctt

SEQ ID NO: 5128195 - DNA, 17 bp, Homo sapiens
acacaatgtgtctttct

SEQ ID NO: 5128196 - DNA, 21 bp, Homo sapiens
acacaatgttgcactgaaaac

SEQ ID NO: 5128197 - DNA, 20 bp, Homo sapiens
acacaattcattggctcctg

SEQ ID NO: 5128198 - DNA, 21 bp, Homo sapiens
acacaattggaattgtcttta

SEQ ID NO: 5128199 - DNA, 14 bp, Homo sapiens
acacaattgtttta

SEQ ID NO: 5128200 - DNA, 23 bp, Homo sapiens
acacaattttattttttttctgt

SEQ ID NO: 5128201 - DNA, 12 bp, Homo sapiens
acacacaaaaac

SEQ ID NO: 5128202 - DNA, 19 bp, Homo sapiens
acacacaaaaaggagcggg

SEQ ID NO: 5128203 - DNA, 21 bp, Homo sapiens
acacacaaaacaacagcaaca

SEQ ID NO: 5128204 - DNA, 15 bp, Homo sapiens
acacacaaatgcaga

SEQ ID NO: 5128205 - DNA, 21 bp, Homo sapiens
acacacaaatgcagacacaca

SEQ ID NO: 5128206 - DNA, 13 bp, Homo sapiens
acacacaacaaaa

SEQ ID NO: 5128207 - DNA, 14 bp, Homo sapiens
acacacaacagcca

SEQ ID NO: 5128208 - DNA, 15 bp, Homo sapiens
acacacaacagccaa

SEQ ID NO: 5128209 - DNA, 14 bp, Homo sapiens
acacacacaaagag

SEQ ID NO: 5128210 - DNA, 16 bp, Homo sapiens
acacacacaaagagag

SEQ ID NO: 5128211 - DNA, 10 bp, Homo sapiens
acacacacac

SEQ ID NO: 5128212 - DNA, 14 bp, Homo sapiens
acacacacacaaat

SEQ ID NO: 5128213 - DNA, 15 bp, Homo sapiens
acacacacacaaatg

SEQ ID NO: 5128214 - DNA, 14 bp, Homo sapiens
acacacacacacac

SEQ ID NO: 5128215 - DNA, 15 bp, Homo sapiens
acacacacacacaca

SEQ ID NO: 5128216 - DNA, 16 bp, Homo sapiens
acacacacacacacag

SEQ ID NO: 5128217 - DNA, 16 bp, Homo sapiens
acacacacacacatat

SEQ ID NO: 5128218 - DNA, 13 bp, Homo sapiens
acacacacacacg

SEQ ID NO: 5128219 - DNA, 13 bp, Homo sapiens
acacacacacagc

SEQ ID NO: 5128220 - DNA, 14 bp, Homo sapiens
acacacacacagcc

SEQ ID NO: 5128221 - DNA, 14 bp, Homo sapiens
acacacacacagga

SEQ ID NO: 5128222 - DNA, 14 bp, Homo sapiens
acacacacacatat

SEQ ID NO: 5128223 - DNA, 15 bp, Homo sapiens
acacacacacatata

SEQ ID NO: 5128224 - DNA, 13 bp, Homo sapiens
acacacacacatg

SEQ ID NO: 5128225 - DNA, 17 bp, Homo sapiens
acacacacacatgcata

SEQ ID NO: 5128226 - DNA, 14 bp, Homo sapiens
acacacacagatgt

SEQ ID NO: 5128227 - DNA, 11 bp, Homo sapiens
acacacacagc

SEQ ID NO: 5128228 - DNA, 14 bp, Homo sapiens
acacacacagccac

SEQ ID NO: 5128229 - DNA, 15 bp, Homo sapiens
acacacacagccaca

SEQ ID NO: 5128230 - DNA, 12 bp, Homo sapiens
acacacacagct

SEQ ID NO: 5128231 - DNA, 12 bp, Homo sapiens
acacacacaggt

SEQ ID NO: 5128232 - DNA, 12 bp, Homo sapiens
acacacacatac

SEQ ID NO: 5128233 - DNA, 14 bp, Homo sapiens
acacacacatacag

SEQ ID NO: 5128234 - DNA, 15 bp, Homo sapiens
acacacacatatata

SEQ ID NO: 5128235 - DNA, 11 bp, Homo sapiens
acacacacatc

SEQ ID NO: 5128236 - DNA, 16 bp, Homo sapiens
acacacacccaggccc

SEQ ID NO: 5128237 - DNA, 15 bp, Homo sapiens
acacacaccccccca

SEQ ID NO: 5128238 - DNA, 15 bp, Homo sapiens
acacacacccttccc

SEQ ID NO: 5128239 - DNA, 17 bp, Homo sapiens
acacacacctgtctgtg

SEQ ID NO: 5128240 - DNA, 16 bp, Homo sapiens
acacacacgatgcatt

SEQ ID NO: 5128241 - DNA, 22 bp, Homo sapiens
acacacacgatgcatttaataa

SEQ ID NO: 5128242 - DNA, 19 bp, Homo sapiens
acacacacgcacgcacaca

SEQ ID NO: 5128243 - DNA, 21 bp, Homo sapiens
acacacacgcacgcacacaca

SEQ ID NO: 5128244 - DNA, 15 bp, Homo sapiens
acacacacgcagaca

SEQ ID NO: 5128245 - DNA, 20 bp, Homo sapiens
acacacacgcagacacacac

SEQ ID NO: 5128246 - DNA, 16 bp, Homo sapiens
acacacacgctccctg

SEQ ID NO: 5128247 - DNA, 23 bp, Homo sapiens
acacacactcgggttaagaaata

SEQ ID NO: 5128248 - DNA, 15 bp, Homo sapiens
acacacagaaaatat

SEQ ID NO: 5128249 - DNA, 18 bp, Homo sapiens
acacacagaaaatatact

SEQ ID NO: 5128250 - DNA, 19 bp, Homo sapiens
acacacagaaaatatactg

SEQ ID NO: 5128251 - DNA, 13 bp, Homo sapiens
acacacagacaca

SEQ ID NO: 5128252 - DNA, 16 bp, Homo sapiens
acacacagacatatat

SEQ ID NO: 5128253 - DNA, 17 bp, Homo sapiens
acacacagactcatatt

SEQ ID NO: 5128254 - DNA, 16 bp, Homo sapiens
acacacagagatatgc

SEQ ID NO: 5128255 - DNA, 12 bp, Homo sapiens
acacacagcagc

SEQ ID NO: 5128256 - DNA, 10 bp, Homo sapiens
acacacagcc

SEQ ID NO: 5128257 - DNA, 11 bp, Homo sapiens
acacacagcca

SEQ ID NO: 5128258 - DNA, 15 bp, Homo sapiens
acacacagccacaca

SEQ ID NO: 5128259 - DNA, 12 bp, Homo sapiens
acacacagccat

SEQ ID NO: 5128260 - DNA, 19 bp, Homo sapiens
acacacagccattcatctg

SEQ ID NO: 5128261 - DNA, 14 bp, Homo sapiens
acacacagccccta

SEQ ID NO: 5128262 - DNA, 19 bp, Homo sapiens
acacacagcctttctgtat

SEQ ID NO: 5128263 - DNA, 20 bp, Homo sapiens
acacacaggaactctgtgtg

SEQ ID NO: 5128264 - DNA, 24 bp, Homo sapiens
acacacaggagtcctttcttttga

SEQ ID NO: 5128265 - DNA, 16 bp, Homo sapiens
acacacaggccttctg

SEQ ID NO: 5128266 - DNA, 19 bp, Homo sapiens
acacacaggccttctgtgg

SEQ ID NO: 5128267 - DNA, 24 bp, Homo sapiens
acacacaggtggggactgggcaca

SEQ ID NO: 5128268 - DNA, 20 bp, Homo sapiens
acacacagtgaccaagggaa

SEQ ID NO: 5128269 - DNA, 14 bp, Homo sapiens
acacacagttactg

SEQ ID NO: 5128270 - DNA, 12 bp, Homo sapiens
acacacataaag

SEQ ID NO: 5128271 - DNA, 12 bp, Homo sapiens
acacacatagat

SEQ ID NO: 5128272 - DNA, 16 bp, Homo sapiens
acacacatatacacga

SEQ ID NO: 5128273 - DNA, 14 bp, Homo sapiens
acacacatatacat

SEQ ID NO: 5128274 - DNA, 18 bp, Homo sapiens
acacacatatacatatat

SEQ ID NO: 5128275 - DNA, 18 bp, Homo sapiens
acacacatatatgtatac

SEQ ID NO: 5128276 - DNA, 15 bp, Homo sapiens
acacacatcccagga

SEQ ID NO: 5128277 - DNA, 16 bp, Homo sapiens
acacacatctggccct

SEQ ID NO: 5128278 - DNA, 14 bp, Homo sapiens
acacacatgcacac

SEQ ID NO: 5128279 - DNA, 13 bp, Homo sapiens
acacacatgccct

SEQ ID NO: 5128280 - DNA, 17 bp, Homo sapiens
acacacatgccctcctg

SEQ ID NO: 5128281 - DNA, 19 bp, Homo sapiens
acacacatgggcagcccaa

SEQ ID NO: 5128282 - DNA, 17 bp, Homo sapiens
acacacattgctattcc

SEQ ID NO: 5128283 - DNA, 15 bp, Homo sapiens
acacaccagagccca

SEQ ID NO: 5128284 - DNA, 17 bp, Homo sapiens
acacaccaggcgctaat

SEQ ID NO: 5128285 - DNA, 12 bp, Homo sapiens
acacaccaggct

SEQ ID NO: 5128286 - DNA, 17 bp, Homo sapiens
acacaccagtttacagg

SEQ ID NO: 5128287 - DNA, 17 bp, Homo sapiens
acacacccaaggggccc

SEQ ID NO: 5128288 - DNA, 16 bp, Homo sapiens
acacaccccaacatgc

SEQ ID NO: 5128289 - DNA, 20 bp, Homo sapiens
acacaccccacaccccagcc

SEQ ID NO: 5128290 - DNA, 21 bp, Homo sapiens
acacaccccacaccccagccc

SEQ ID NO: 5128291 - DNA, 14 bp, Homo sapiens
acacacccccagag

SEQ ID NO: 5128292 - DNA, 12 bp, Homo sapiens
acacacccccca

SEQ ID NO: 5128293 - DNA, 14 bp, Homo sapiens
acacacccccccac

SEQ ID NO: 5128294 - DNA, 13 bp, Homo sapiens
acacacccctcaa

SEQ ID NO: 5128295 - DNA, 11 bp, Homo sapiens
acacaccctcc

SEQ ID NO: 5128296 - DNA, 18 bp, Homo sapiens
acacaccctccagcacag

SEQ ID NO: 5128297 - DNA, 21 bp, Homo sapiens
acacaccctccagcacagact

SEQ ID NO: 5128298 - DNA, 14 bp, Homo sapiens
acacaccctgaggt

SEQ ID NO: 5128299 - DNA, 12 bp, Homo sapiens
acacaccctgcc

SEQ ID NO: 5128300 - DNA, 17 bp, Homo sapiens
acacaccctgcccctgc

SEQ ID NO: 5128301 - DNA, 13 bp, Homo sapiens
acacacccttccc

SEQ ID NO: 5128302 - DNA, 20 bp, Homo sapiens
acacacccttccccactccc

SEQ ID NO: 5128303 - DNA, 16 bp, Homo sapiens
acacaccgatgtacac

SEQ ID NO: 5128304 - DNA, 16 bp, Homo sapiens
acacaccggtcaccga

SEQ ID NO: 5128305 - DNA, 15 bp, Homo sapiens
acacacctcaccaga

SEQ ID NO: 5128306 - DNA, 13 bp, Homo sapiens
acacacctctgcc

SEQ ID NO: 5128307 - DNA, 13 bp, Homo sapiens
acacacctctgga

SEQ ID NO: 5128308 - DNA, 16 bp, Homo sapiens
acacacctgagaatgt

SEQ ID NO: 5128309 - DNA, 16 bp, Homo sapiens
acacacctgctccaat

SEQ ID NO: 5128310 - DNA, 20 bp, Homo sapiens
acacacctgtagcacttact

SEQ ID NO: 5128311 - DNA, 17 bp, Homo sapiens
acacacctgtctgtgca

SEQ ID NO: 5128312 - DNA, 14 bp, Homo sapiens
acacacgagcaaac

SEQ ID NO: 5128313 - DNA, 20 bp, Homo sapiens
acacacgatgcatttaataa

SEQ ID NO: 5128314 - DNA, 22 bp, Homo sapiens
acacacgatgcatttaataaag

SEQ ID NO: 5128315 - DNA, 18 bp, Homo sapiens
acacacgcacgcacacac

SEQ ID NO: 5128316 - DNA, 15 bp, Homo sapiens
acacacgcagacaca

SEQ ID NO: 5128317 - DNA, 16 bp, Homo sapiens
acacacgcagacacac

SEQ ID NO: 5128318 - DNA, 19 bp, Homo sapiens
acacacgcagacacacaca

SEQ ID NO: 5128319 - DNA, 16 bp, Homo sapiens
acacacgcaggaactc

SEQ ID NO: 5128320 - DNA, 20 bp, Homo sapiens
acacacgcaggaactcccag

SEQ ID NO: 5128321 - DNA, 16 bp, Homo sapiens
acacacgcgcgcacac

SEQ ID NO: 5128322 - DNA, 16 bp, Homo sapiens
acacacgcgtccacat

SEQ ID NO: 5128323 - DNA, 20 bp, Homo sapiens
acacacgcgtccacatacac

SEQ ID NO: 5128324 - DNA, 22 bp, Homo sapiens
acacacgcgtccacatacactg

SEQ ID NO: 5128325 - DNA, 15 bp, Homo sapiens
acacacggaggccag

SEQ ID NO: 5128326 - DNA, 19 bp, Homo sapiens
acacacggaggccagacac

SEQ ID NO: 5128327 - DNA, 17 bp, Homo sapiens
acacacggctgtccctc

SEQ ID NO: 5128328 - DNA, 18 bp, Homo sapiens
acacacggggcacccagc

SEQ ID NO: 5128329 - DNA, 20 bp, Homo sapiens
acacacggggcacccagccc

SEQ ID NO: 5128330 - DNA, 13 bp, Homo sapiens
acacacggggctc

SEQ ID NO: 5128331 - DNA, 17 bp, Homo sapiens
acacacgtatttatatt

SEQ ID NO: 5128332 - DNA, 23 bp, Homo sapiens
acacacgtatttatatttggaaa

SEQ ID NO: 5128333 - DNA, 22 bp, Homo sapiens
acacacgttgacgggccgcagg

SEQ ID NO: 5128334 - DNA, 14 bp, Homo sapiens
acacactaacatca

SEQ ID NO: 5128335 - DNA, 13 bp, Homo sapiens
acacactaatcga

SEQ ID NO: 5128336 - DNA, 17 bp, Homo sapiens
acacactacaccacaca

SEQ ID NO: 5128337 - DNA, 22 bp, Homo sapiens
acacactaccgaatgtgtcttt

SEQ ID NO: 5128338 - DNA, 15 bp, Homo sapiens
acacactcaaatcaa

SEQ ID NO: 5128339 - DNA, 22 bp, Homo sapiens
acacactcaccagtggcctttc

SEQ ID NO: 5128340 - DNA, 12 bp, Homo sapiens
acacactcagcc

SEQ ID NO: 5128341 - DNA, 18 bp, Homo sapiens
acaaagggttttaatgta

SEQ ID NO: 5128342 - DNA, 19 bp, Homo sapiens
acaaaggtgattttcctgt

SEQ ID NO: 5128343 - DNA, 21 bp, Homo sapiens
acaaaggtggaataaacatta

SEQ ID NO: 5128344 - DNA, 18 bp, Homo sapiens
acaaaggtggtaaattca

SEQ ID NO: 5128345 - DNA, 14 bp, Homo sapiens
acaaaggtttaaat

SEQ ID NO: 5128346 - DNA, 17 bp, Homo sapiens
acaaaggtttaaatgaa

SEQ ID NO: 5128347 - DNA, 19 bp, Homo sapiens
acaaaggtttaaatgaaca

SEQ ID NO: 5128348 - DNA, 22 bp, Homo sapiens
acaaaggtttaaatgaacaaga

SEQ ID NO: 5128349 - DNA, 15 bp, Homo sapiens
acaaaggttttgtct

SEQ ID NO: 5128350 - DNA, 14 bp, Homo sapiens
acaaagtaatttct

SEQ ID NO: 5128351 - DNA, 17 bp, Homo sapiens
acaaagtactagctaaa

SEQ ID NO: 5128352 - DNA, 21 bp, Homo sapiens
acaaagtactcctcacttttc

SEQ ID NO: 5128353 - DNA, 16 bp, Homo sapiens
acaaagtactctttaa

SEQ ID NO: 5128354 - DNA, 21 bp, Homo sapiens
acaaagtatatttaaggatta

SEQ ID NO: 5128355 - DNA, 16 bp, Homo sapiens
acaaagtcatgaagct

SEQ ID NO: 5128356 - DNA, 14 bp, Homo sapiens
acaaagtctctggg

SEQ ID NO: 5128357 - DNA, 14 bp, Homo sapiens
acaaagtgaaatta

SEQ ID NO: 5128358 - DNA, 22 bp, Homo sapiens
acaaagtgaactctattttgat

SEQ ID NO: 5128359 - DNA, 21 bp, Homo sapiens
acaaagtgcaaagctgcttga

SEQ ID NO: 5128360 - DNA, 16 bp, Homo sapiens
acaaagtgccaaagaa

SEQ ID NO: 5128361 - DNA, 18 bp, Homo sapiens
acaaagtgccaaagaaag

SEQ ID NO: 5128362 - DNA, 12 bp, Homo sapiens
acaaagtgcttt

SEQ ID NO: 5128363 - DNA, 14 bp, Homo sapiens
acaaagtggaagga

SEQ ID NO: 5128364 - DNA, 16 bp, Homo sapiens
acaaagtggaaggaaa

SEQ ID NO: 5128365 - DNA, 17 bp, Homo sapiens
acaaagtgggtactttc

SEQ ID NO: 5128366 - DNA, 21 bp, Homo sapiens
acaaagtgggtactttctgaa

SEQ ID NO: 5128367 - DNA, 19 bp, Homo sapiens
acaaagtgggtgtgtggcc

SEQ ID NO: 5128368 - DNA, 15 bp, Homo sapiens
acaaagtgtgtatta

SEQ ID NO: 5128369 - DNA, 16 bp, Homo sapiens
acaaagtgtgtattaa

SEQ ID NO: 5128370 - DNA, 20 bp, Homo sapiens
acaaagtgtgtctcaaaaat

SEQ ID NO: 5128371 - DNA, 19 bp, Homo sapiens
acaaagtgttgaaaatgta

SEQ ID NO: 5128372 - DNA, 18 bp, Homo sapiens
acaaagttaaaattgtta

SEQ ID NO: 5128373 - DNA, 23 bp, Homo sapiens
acaaagttactaggtaacttcat

SEQ ID NO: 5128374 - DNA, 18 bp, Homo sapiens
acaaagttactggctctt

SEQ ID NO: 5128375 - DNA, 22 bp, Homo sapiens
acaaagttcactgtttattgaa

SEQ ID NO: 5128376 - DNA, 18 bp, Homo sapiens
acaaagttccacttccag

SEQ ID NO: 5128377 - DNA, 13 bp, Homo sapiens
acaaagttctgta

SEQ ID NO: 5128378 - DNA, 19 bp, Homo sapiens
acaaagttgattaagaaag

SEQ ID NO: 5128379 - DNA, 19 bp, Homo sapiens
acaaagtttacattgtcct

SEQ ID NO: 5128380 - DNA, 22 bp, Homo sapiens
acaaagtttacattgtcctgta

SEQ ID NO: 5128381 - DNA, 18 bp, Homo sapiens
acaaagtttcagagtata

SEQ ID NO: 5128382 - DNA, 20 bp, Homo sapiens
acaaagtttcagagtatatt

SEQ ID NO: 5128383 - DNA, 18 bp, Homo sapiens
acaaagtttggaagtaca

SEQ ID NO: 5128384 - DNA, 14 bp, Homo sapiens
acaaagttttcctt

SEQ ID NO: 5128385 - DNA, 15 bp, Homo sapiens
acaaagttttccttt

SEQ ID NO: 5128386 - DNA, 18 bp, Homo sapiens
acaaataaaattggcacc

SEQ ID NO: 5128387 - DNA, 14 bp, Homo sapiens
acaaataaacctga

SEQ ID NO: 5128388 - DNA, 17 bp, Homo sapiens
acaaataaagatggcta

SEQ ID NO: 5128389 - DNA, 13 bp, Homo sapiens
acaaataaataaa

SEQ ID NO: 5128390 - DNA, 18 bp, Homo sapiens
acaaataaatgattatat

SEQ ID NO: 5128391 - DNA, 19 bp, Homo sapiens
acaaataaatgattatatt

SEQ ID NO: 5128392 - DNA, 22 bp, Homo sapiens
acaaataaatgattatattcac

SEQ ID NO: 5128393 - DNA, 15 bp, Homo sapiens
acaaataacaacttt

SEQ ID NO: 5128394 - DNA, 16 bp, Homo sapiens
acaaataacaagaata

SEQ ID NO: 5128395 - DNA, 19 bp, Homo sapiens
acaaataactactgcaaaa

SEQ ID NO: 5128396 - DNA, 15 bp, Homo sapiens
acaaataatattgcc

SEQ ID NO: 5128397 - DNA, 22 bp, Homo sapiens
acaaataatattgccttgatgt

SEQ ID NO: 5128398 - DNA, 12 bp, Homo sapiens
acaaataatcac

SEQ ID NO: 5128399 - DNA, 13 bp, Homo sapiens
acaaataatcaca

SEQ ID NO: 5128400 - DNA, 20 bp, Homo sapiens
acaaataatgaacagcagaa

SEQ ID NO: 5128401 - DNA, 11 bp, Homo sapiens
acaaataatta

SEQ ID NO: 5128402 - DNA, 19 bp, Homo sapiens
acaaataatttaagttggc

SEQ ID NO: 5128403 - DNA, 14 bp, Homo sapiens
acaaataatttaga

SEQ ID NO: 5128404 - DNA, 15 bp, Homo sapiens
acaaataattttagt

SEQ ID NO: 5128405 - DNA, 14 bp, Homo sapiens
acaaatacacatac

SEQ ID NO: 5128406 - DNA, 14 bp, Homo sapiens
acaaatacagatga

SEQ ID NO: 5128407 - DNA, 17 bp, Homo sapiens
acaaatactcatgtgta

SEQ ID NO: 5128408 - DNA, 18 bp, Homo sapiens
acaaatacttattcattg

SEQ ID NO: 5128409 - DNA, 16 bp, Homo sapiens
acaaatagaaaatggt

SEQ ID NO: 5128410 - DNA, 23 bp, Homo sapiens
acaaatagatttctttgcacaat

SEQ ID NO: 5128411 - DNA, 15 bp, Homo sapiens
acaaataggagtgag

SEQ ID NO: 5128412 - DNA, 17 bp, Homo sapiens
acaaatagttatctttt

SEQ ID NO: 5128413 - DNA, 20 bp, Homo sapiens
acaaatagttatcttttaat

SEQ ID NO: 5128414 - DNA, 14 bp, Homo sapiens
acaaatagttgtaa

SEQ ID NO: 5128415 - DNA, 15 bp, Homo sapiens
acaaatataaatctt

SEQ ID NO: 5128416 - DNA, 19 bp, Homo sapiens
acaaatataagaataaaat

SEQ ID NO: 5128417 - DNA, 14 bp, Homo sapiens
acaaatatatgtat

SEQ ID NO: 5128418 - DNA, 14 bp, Homo sapiens
acaaatatattata

SEQ ID NO: 5128419 - DNA, 18 bp, Homo sapiens
acaaatatatttaattgt

SEQ ID NO: 5128420 - DNA, 20 bp, Homo sapiens
acaaatatgattctcctctc

SEQ ID NO: 5128421 - DNA, 21 bp, Homo sapiens
acaaatatgattctcctctcc

SEQ ID NO: 5128422 - DNA, 12 bp, Homo sapiens
acaaatatgcaa

SEQ ID NO: 5128423 - DNA, 17 bp, Homo sapiens
acaaatatgctaaatgt

SEQ ID NO: 5128424 - DNA, 18 bp, Homo sapiens
acaaatatgctaaatgtt

SEQ ID NO: 5128425 - DNA, 16 bp, Homo sapiens
acaaatatgctaattt

SEQ ID NO: 5128426 - DNA, 20 bp, Homo sapiens
acaaatatggctagttttca

SEQ ID NO: 5128427 - DNA, 21 bp, Homo sapiens
acaaatatggctagttttcaa

SEQ ID NO: 5128428 - DNA, 21 bp, Homo sapiens
acaaatatgtagaatgtaata

SEQ ID NO: 5128429 - DNA, 17 bp, Homo sapiens
acaaatatgttctctga

SEQ ID NO: 5128430 - DNA, 12 bp, Homo sapiens
acaaatattaaa

SEQ ID NO: 5128431 - DNA, 18 bp, Homo sapiens
acaaatattaaaaagtct

SEQ ID NO: 5128432 - DNA, 20 bp, Homo sapiens
acaaatattaaaaagtcttt

SEQ ID NO: 5128433 - DNA, 16 bp, Homo sapiens
acaaatattaagaaaa

SEQ ID NO: 5128434 - DNA, 14 bp, Homo sapiens
acaaatattcagaa

SEQ ID NO: 5128435 - DNA, 15 bp, Homo sapiens
acaaatattctgaat

SEQ ID NO: 5128436 - DNA, 16 bp, Homo sapiens
acaaatattgtcatct

SEQ ID NO: 5128437 - DNA, 13 bp, Homo sapiens
acaaatatttaga

SEQ ID NO: 5128438 - DNA, 15 bp, Homo sapiens
acaaatattttcatg

SEQ ID NO: 5128439 - DNA, 16 bp, Homo sapiens
acaaatattttcatgt

SEQ ID NO: 5128440 - DNA, 15 bp, Homo sapiens
acaaatattttcttt

SEQ ID NO: 5128441 - DNA, 14 bp, Homo sapiens
acaaatcaaacaca

SEQ ID NO: 5128442 - DNA, 16 bp, Homo sapiens
acaaatcaaattgctt

SEQ ID NO: 5128443 - DNA, 19 bp, Homo sapiens
acaaatcaaattgcttaaa

SEQ ID NO: 5128444 - DNA, 17 bp, Homo sapiens
acaaatcaacagaagca

SEQ ID NO: 5128445 - DNA, 19 bp, Homo sapiens
acaaatcaacagaagcatt

SEQ ID NO: 5128446 - DNA, 23 bp, Homo sapiens
acaaatcaacagaagcatttgta

SEQ ID NO: 5128447 - DNA, 12 bp, Homo sapiens
acaaatcaagtt

SEQ ID NO: 5128448 - DNA, 22 bp, Homo sapiens
acaaatcactgtggggaaacaa

SEQ ID NO: 5128449 - DNA, 20 bp, Homo sapiens
acaaatcagaagtcatcttg

SEQ ID NO: 5128450 - DNA, 18 bp, Homo sapiens
acaaatccctatgttgct

SEQ ID NO: 5128451 - DNA, 20 bp, Homo sapiens
acaaatcctctgttttctct

SEQ ID NO: 5128452 - DNA, 20 bp, Homo sapiens
acaaatctataaagaaggat

SEQ ID NO: 5128453 - DNA, 20 bp, Homo sapiens
acaaatctatattaaagtgt

SEQ ID NO: 5128454 - DNA, 15 bp, Homo sapiens
acaaatctatgccac

SEQ ID NO: 5128455 - DNA, 21 bp, Homo sapiens
acaaatctcaagcaaacagct

SEQ ID NO: 5128456 - DNA, 15 bp, Homo sapiens
acaaatctcactgta

SEQ ID NO: 5128457 - DNA, 19 bp, Homo sapiens
acaaatctgcaaagcatgt

SEQ ID NO: 5128458 - DNA, 22 bp, Homo sapiens
acaaatctgcaaagcatgtttt

SEQ ID NO: 5128459 - DNA, 21 bp, Homo sapiens
acaaatctgggcattgagcaa

SEQ ID NO: 5128460 - DNA, 23 bp, Homo sapiens
acaaatctgtataaatgtctatt

SEQ ID NO: 5128461 - DNA, 14 bp, Homo sapiens
acaaatctgtctgc

SEQ ID NO: 5128462 - DNA, 19 bp, Homo sapiens
acaaatctgtgtatattat

SEQ ID NO: 5128463 - DNA, 18 bp, Homo sapiens
acaaatcttcaaggtgta

SEQ ID NO: 5128464 - DNA, 13 bp, Homo sapiens
acaaatcttcagt

SEQ ID NO: 5128465 - DNA, 14 bp, Homo sapiens
acaaatgaaaatga

SEQ ID NO: 5128466 - DNA, 14 bp, Homo sapiens
acaaatgaaagaga

SEQ ID NO: 5128467 - DNA, 18 bp, Homo sapiens
acaaatgaaagagaaaat

SEQ ID NO: 5128468 - DNA, 20 bp, Homo sapiens
acaaatgaaagagaaaatat

SEQ ID NO: 5128469 - DNA, 19 bp, Homo sapiens
acaaatgaagtatttcatg

SEQ ID NO: 5128470 - DNA, 22 bp, Homo sapiens
acaaatgaagtatttcatgtaa

SEQ ID NO: 5128471 - DNA, 17 bp, Homo sapiens
acaaatgacagatcttt

SEQ ID NO: 5128472 - DNA, 16 bp, Homo sapiens
acaaatgactgtatct

SEQ ID NO: 5128473 - DNA, 18 bp, Homo sapiens
acaaatgactttattatt

SEQ ID NO: 5128474 - DNA, 14 bp, Homo sapiens
acaaatgatctagt

SEQ ID NO: 5128475 - DNA, 15 bp, Homo sapiens
acaaatgattgcttt

SEQ ID NO: 5128476 - DNA, 19 bp, Homo sapiens
acaaatgattgcttttaaa

SEQ ID NO: 5128477 - DNA, 18 bp, Homo sapiens
acaaatgcaaatttctat

SEQ ID NO: 5128478 - DNA, 13 bp, Homo sapiens
acaaatgcagaca

SEQ ID NO: 5128479 - DNA, 14 bp, Homo sapiens
acaaatgcagacac

SEQ ID NO: 5128480 - DNA, 20 bp, Homo sapiens
acaaatgcagacacacaaca

SEQ ID NO: 5128481 - DNA, 20 bp, Homo sapiens
acaaatgcagtgtatttaat

SEQ ID NO: 5128482 - DNA, 15 bp, Homo sapiens
acaaatgcatctttg

SEQ ID NO: 5128483 - DNA, 17 bp, Homo sapiens
acaaatgcatgaacaag

SEQ ID NO: 5128484 - DNA, 18 bp, Homo sapiens
acaaatgccaaattaaaa

SEQ ID NO: 5128485 - DNA, 15 bp, Homo sapiens
acaaatgccacacat

SEQ ID NO: 5128486 - DNA, 20 bp, Homo sapiens
acaaatgccttaaaatggaa

SEQ ID NO: 5128487 - DNA, 17 bp, Homo sapiens
acaaatgctcaaagaaa

SEQ ID NO: 5128488 - DNA, 23 bp, Homo sapiens
acaaatgctcccacctgaatttg

SEQ ID NO: 5128489 - DNA, 15 bp, Homo sapiens
acaaatgctctgtct

SEQ ID NO: 5128490 - DNA, 16 bp, Homo sapiens
acaaatggaagagaag

SEQ ID NO: 5128491 - DNA, 20 bp, Homo sapiens
acaaatggagctttctgtat

SEQ ID NO: 5128492 - DNA, 18 bp, Homo sapiens
acaaatggatgacacatt

SEQ ID NO: 5128493 - DNA, 18 bp, Homo sapiens
acaaatggcttacttaca

SEQ ID NO: 5128494 - DNA, 20 bp, Homo sapiens
acaaatggcttacttacaaa

SEQ ID NO: 5128495 - DNA, 21 bp, Homo sapiens
acaaatggcttacttacaaaa

SEQ ID NO: 5128496 - DNA, 19 bp, Homo sapiens
acaaatgggactgatgtca

SEQ ID NO: 5128497 - DNA, 20 bp, Homo sapiens
acaaatgggactgatgtcat

SEQ ID NO: 5128498 - DNA, 20 bp, Homo sapiens
acaaatggtgaatggatttc

SEQ ID NO: 5128499 - DNA, 15 bp, Homo sapiens
acaaatggtggagga

SEQ ID NO: 5128500 - DNA, 17 bp, Homo sapiens
acaaatgtaaacatttt

SEQ ID NO: 5128501 - DNA, 17 bp, Homo sapiens
acaaatgtaagcaaagg

SEQ ID NO: 5128502 - DNA, 19 bp, Homo sapiens
acaaatgtatagaataaac

SEQ ID NO: 5128503 - DNA, 15 bp, Homo sapiens
acaaatgtattttga

SEQ ID NO: 5128504 - DNA, 15 bp, Homo sapiens
acaaatgtcctcaga

SEQ ID NO: 5128505 - DNA, 18 bp, Homo sapiens
acaaatgtctagtttcta

SEQ ID NO: 5128506 - DNA, 14 bp, Homo sapiens
acaaatgtctatca

SEQ ID NO: 5128507 - DNA, 9 bp, Homo sapiens
acaaatgtg

SEQ ID NO: 5128508 - DNA, 15 bp, Homo sapiens
acaaatgtgaaacgg

SEQ ID NO: 5128509 - DNA, 14 bp, Homo sapiens
acaaatgtgaagat

SEQ ID NO: 5128510 - DNA, 16 bp, Homo sapiens
acaaatgtgaagatgc

SEQ ID NO: 5128511 - DNA, 17 bp, Homo sapiens
acaaatgtgaagatgca

SEQ ID NO: 5128512 - DNA, 18 bp, Homo sapiens
acaaatgtgaagatgcat

SEQ ID NO: 5128513 - DNA, 21 bp, Homo sapiens
acaaatgtgaagatgcattgt

SEQ ID NO: 5128514 - DNA, 16 bp, Homo sapiens
acaaatgtggccaagc

SEQ ID NO: 5128515 - DNA, 22 bp, Homo sapiens
acaaatgtgtatcggatgcttt

SEQ ID NO: 5128516 - DNA, 19 bp, Homo sapiens
acaaatgtgtatttttgtt

SEQ ID NO: 5128517 - DNA, 19 bp, Homo sapiens
acaaatgttaaaatgtgtt

SEQ ID NO: 5128518 - DNA, 14 bp, Homo sapiens
acaaatgttaaagt

SEQ ID NO: 5128519 - DNA, 23 bp, Homo sapiens
acaaatgttttcatttacaggaa

SEQ ID NO: 5128520 - DNA, 14 bp, Homo sapiens
acacactcaggcct

SEQ ID NO: 5128521 - DNA, 19 bp, Homo sapiens
acacactcaggcctgtgcc

SEQ ID NO: 5128522 - DNA, 24 bp, Homo sapiens
acacactcaggcctgtgcccactc

SEQ ID NO: 5128523 - DNA, 14 bp, Homo sapiens
acacactcagtgca

SEQ ID NO: 5128524 - DNA, 19 bp, Homo sapiens
acacactccccacttcact

SEQ ID NO: 5128525 - DNA, 16 bp, Homo sapiens
acacactccctgcttg

SEQ ID NO: 5128526 - DNA, 12 bp, Homo sapiens
acacactccttc

SEQ ID NO: 5128527 - DNA, 22 bp, Homo sapiens
acacactctcatgtccccttcc

SEQ ID NO: 5128528 - DNA, 11 bp, Homo sapiens
acacactgacc

SEQ ID NO: 5128529 - DNA, 15 bp, Homo sapiens
acacactgaggcagg

SEQ ID NO: 5128530 - DNA, 15 bp, Homo sapiens
acacactgatgctta

SEQ ID NO: 5128531 - DNA, 15 bp, Homo sapiens
acacactgcacatct

SEQ ID NO: 5128532 - DNA, 15 bp, Homo sapiens
acacactgcctccca

SEQ ID NO: 5128533 - DNA, 14 bp, Homo sapiens
acacactgccttat

SEQ ID NO: 5128534 - DNA, 19 bp, Homo sapiens
acacactgcggtgtctgca

SEQ ID NO: 5128535 - DNA, 11 bp, Homo sapiens
acacactggac

SEQ ID NO: 5128536 - DNA, 12 bp, Homo sapiens
acacactggacc

SEQ ID NO: 5128537 - DNA, 16 bp, Homo sapiens
acacactggctcctgg

SEQ ID NO: 5128538 - DNA, 16 bp, Homo sapiens
acacactggtacttag

SEQ ID NO: 5128539 - DNA, 10 bp, Homo sapiens
acacactgta

SEQ ID NO: 5128540 - DNA, 12 bp, Homo sapiens
acacactgtaaa

SEQ ID NO: 5128541 - DNA, 21 bp, Homo sapiens
acacactgtaaacccctgggt

SEQ ID NO: 5128542 - DNA, 21 bp, Homo sapiens
acacactgtgctttctattgt

SEQ ID NO: 5128543 - DNA, 22 bp, Homo sapiens
acacactgtgctttctattgta

SEQ ID NO: 5128544 - DNA, 15 bp, Homo sapiens
acacacttacagagc

SEQ ID NO: 5128545 - DNA, 14 bp, Homo sapiens
acacacttcttcca

SEQ ID NO: 5128546 - DNA, 13 bp, Homo sapiens
acacactttattt

SEQ ID NO: 5128547 - DNA, 17 bp, Homo sapiens
acacactttccatctct

SEQ ID NO: 5128548 - DNA, 22 bp, Homo sapiens
acacactttccatctctgcctg

SEQ ID NO: 5128549 - DNA, 16 bp, Homo sapiens
acacacttttgcacat

SEQ ID NO: 5128550 - DNA, 20 bp, Homo sapiens
acacacttttgcacatatat

SEQ ID NO: 5128551 - DNA, 23 bp, Homo sapiens
acacacttttggttaagtctgtt

SEQ ID NO: 5128552 - DNA, 14 bp, Homo sapiens
acacactttttaag

SEQ ID NO: 5128553 - DNA, 17 bp, Homo sapiens
acacagaaaaaggatgt

SEQ ID NO: 5128554 - DNA, 12 bp, Homo sapiens
acacagaaaata

SEQ ID NO: 5128555 - DNA, 13 bp, Homo sapiens
acacagaaaatat

SEQ ID NO: 5128556 - DNA, 17 bp, Homo sapiens
acacagaaaatatactg

SEQ ID NO: 5128557 - DNA, 19 bp, Homo sapiens
acacagaaaatatactgta

SEQ ID NO: 5128558 - DNA, 20 bp, Homo sapiens
acacagaaaatatactgtaa

SEQ ID NO: 5128559 - DNA, 18 bp, Homo sapiens
acacagaaacctttttaa

SEQ ID NO: 5128560 - DNA, 21 bp, Homo sapiens
acacagaaatatatatacata

SEQ ID NO: 5128561 - DNA, 16 bp, Homo sapiens
acacagaaatgctgct

SEQ ID NO: 5128562 - DNA, 14 bp, Homo sapiens
acacagaaatgtgt

SEQ ID NO: 5128563 - DNA, 16 bp, Homo sapiens
acacagaactcagcct

SEQ ID NO: 5128564 - DNA, 16 bp, Homo sapiens
acacagaatgcaacca

SEQ ID NO: 5128565 - DNA, 17 bp, Homo sapiens
acacagaatgctcaggg

SEQ ID NO: 5128566 - DNA, 23 bp, Homo sapiens
acacagaattatagatgtctgag

SEQ ID NO: 5128567 - DNA, 17 bp, Homo sapiens
acacagacacacaagca
